(12) United States Patent
Brover et al.

(10) Patent No.: US 8,299,318 B2
(45) Date of Patent: Oct. 30, 2012

(54) NUCLEOTIDE SEQUENCES AND CORRESPONDING POLYPEPTIDES CONFERRING MODULATED PLANT CHARACTERISTICS

(75) Inventors: Vyacheslav Brover, Simi Valley, CA (US); Timothy J. Swaller, Thousand Oaks, CA (US); Kenneth A Feldmann, Newbury Park, CA (US); Maxim Troukhan, Agoura Hills, CA (US)

(73) Assignee: Ceres, Inc., Thousand Oaks, CA (US)

( * ) Notice: Subject to any disclaimer, the term of this patent is extended or adjusted under 35 U.S.C. 154(b) by 1004 days.

(21) Appl. No.: 12/168,788

(22) Filed: Jul. 7, 2008

(65) Prior Publication Data

US 2011/0167514 A1  Jul. 7, 2011

Related U.S. Application Data

(60) Provisional application No. 60/958,715, filed on Jul. 5, 2007.

(51) Int. Cl.
*C12N 15/29* (2006.01)
*C12N 15/82* (2006.01)
*C12N 5/04* (2006.01)
*A01H 5/00* (2006.01)
*A01H 5/10* (2006.01)

(52) U.S. Cl. ........ 800/278; 800/287; 800/298; 435/419; 435/320.1; 536/23.1; 536/23.6; 426/54

(58) Field of Classification Search .................. None
See application file for complete search history.

(56) References Cited

OTHER PUBLICATIONS

Kano-Murakami et al (1993, FEBS 334:365-368).*
Bowie et al, Science 247:1306-1310, 1990.*
McConnell et al, Nature 411 (6838):709-713, 2001.*

* cited by examiner

*Primary Examiner* — Stuart F. Baum
(74) *Attorney, Agent, or Firm* — Birch, Stewart, Kolasch & Birch, LLP

(57) ABSTRACT

The present invention relates to isolated nucleic acid molecules and their corresponding encoded polypeptides. The present invention further relates to the uses of these nucleic acid molecules and polypeptides. For example, the nucleic acid molecules and polypeptides could be used in making enzymes or used to make plants, plant cells, plant materials or seeds of a plant having such modulated growth or phenotype characteristics that are altered with respect to wild type plants grown under similar conditions.

18 Claims, No Drawings

US 8,299,318 B2

NUCLEOTIDE SEQUENCES AND CORRESPONDING POLYPEPTIDES CONFERRING MODULATED PLANT CHARACTERISTICS

CROSS REFERENCE PARAGRAPH

This Nonprovisional application claims priority under 35 U.S.C. §119(e) on U.S. Provisional Application No. 60/958,715 filed on Jul. 5, 2007, the entire contents of which are hereby incorporated by reference.

FIELD OF THE INVENTION

The present invention relates to isolated nucleic acid molecules and their corresponding encoded polypeptides. The present invention further relates to using the nucleic acid molecules and polypeptides to make transgenic plants, plant cells, plant materials or seeds of a plant having modulated phenotypic and growth characteristics as compared to wild-type plants grown under similar conditions.

BACKGROUND OF THE INVENTION

Switchgrass is a hardy, warm season perennial bunch grass of the millet family. It was a component of the native prairie in the Great Plains states and Canada and can grow up to 1.8-2.2 m in height. Switchgrass propagates by rhizomes and seeds produced on spikelets. Switchgrass grown from seed has low vigor and is slow to establish, thus production is decreased until the third year growing year. Switchgrass uses the C4 carbon fixation pathway which allows for improved water use efficiency during its growth period, providing an advantage under drought and high temperature conditions. Once established, switchgrass is also tolerant of flooding and grows rapidly, capturing a significant amount of solar energy and turning it into stored energy in the form of cellulose.

As pasture forage, switchgrass is palatable in the vegetative stage and is grazed by certain animals, used as ground cover to control erosion and farmed as forage for livestock.

Switchgrass is also a good energy crop and can be cut and baled with conventional mowers and balers. Once established in a field, it can be harvested as a cash crop, either annually or semiannually, for 10 years or more before replanting is needed. Switchgrass offers important advantages as an energy crop, in part because it can be liquified, gasified, or burned directly. Ethanol production from switchgrass can provide as much as twenty times more net energy output than corn and removes considerably more $CO_2$ from the air. Switchgrass has the potential to produce the biomass required for production of up to 100 gallons (380 liters) of ethanol per metric ton, which gives switchgrass the potential to produce 1000 gallons of ethanol per acre, compared to 665 gallons for the sucrose from sugarcane and 400 gallons for the starch from corn.

Combustion of switchgrass pellets can result in nearly complete combustion with only 3% to 4% of original mass remaining as ash due in part to switchgrass' lower silica and chloride content as compared to cool season grasses. Ash contents can be further reduced by allowing switchgrass to overwinter in the field, thereby reducing the silica and chloride contents further through the process of leaching. There are also advantages from an ash content perspective to producing switchgrass in sandy soils as opposed to clay soils, again based on silica and chloride contents.

Despite the many advantages that switchgrass has as an energy crop, in order for this grass to fulfill its promise, new varieties of switchgrass are needed that will have increased hardiness and yield, reduce the need for nitrogen and other chemical fertilizers, and allow propagation under widely variant growing conditions.

Plants specifically improved for energy usage can be obtained using molecular technologies. Manipulation of crop performance has been accomplished conventionally for centuries through plant breeding. The breeding process is, however, both time-consuming and labor-intensive. Furthermore, appropriate breeding programs must be specially designed for each relevant plant species.

On the other hand, molecular genetics approaches that introduce and express recombinant nucleic acid molecules allow production of plant species tailored to grow more efficiently and produce more product in unique geographic and/or climatic environments. To this end, there is an ongoing need for genetic sequences and materials to advantageously manipulate plant characteristics such as architecture, biomass, development, composition, conversion efficiency, energy output, confinement, nitrogen use, nutrient uptake, phosphate use, photosynthetic capacity, shade avoidance, cold tolerance, drought tolerance, water use efficiency, stress tolerance, vigor, flowering time and yield to maximize the benefits of energy crops and other economically important crops depending on the benefit sought and the particular environment in which the crop must grow. These molecules may be from the plant itself, and simply expressed at a higher or lower level, or the molecules may be from different plant species.

SUMMARY OF THE INVENTION

The present invention, therefore, relates to isolated nucleic acid molecules and polypeptides and their use in making transgenic plants, plant cells, plant materials or seeds of plants having modulated plant characteristics, with respect to wild-type plants grown under similar or identical conditions, in traits such size (in whole or in part), vegetative growth, increased organ number and/or increased biomass (sometimes hereinafter collectively referred to as increased biomass), lethality, sterility, stress tolerance, or compositional characteristics as compared to a wild-type plant cultivated under identical conditions. (sometimes hereinafter collectively referred to as "modulated growth and phenotype characteristics").

Unless otherwise defined, all technical and scientific terms used herein have the same meaning as commonly understood by one of ordinary skill in the art to which this invention belongs.

DETAILED DESCRIPTION OF THE INVENTION

1. The Invention

The invention of the present application may be described by, but not necessarily limited to, the following exemplary embodiments.

The present invention discloses novel isolated nucleic acid molecules, nucleic acid molecules that interfere with these nucleic acid molecules, nucleic acid molecules that hybridize to these nucleic acid molecules, and isolated nucleic acid molecules that encode the same protein due to the degeneracy of the DNA code. Additional embodiments of the present application further include the polypeptides encoded by the isolated nucleic acid molecules of the present invention.

More particularly, the nucleic acid molecules of the present invention comprise: (a) a nucleotide sequence encoding an amino acid sequence that is at least 85% identical to any one of the polypeptides in the sequence listing (SEQ ID Nos. 1-9762), (b) a nucleotide sequence encoding an amino acid sequence that is at least 85% identical to any one of the polypeptides from *Panicum virgatum* in the sequence listing (SEQ ID Nos. 1-9176), (c) a nucleotide sequence that is complementary to any one of the nucleotide sequences according to (a) and (b), (d) a nucleotide sequence according to any one of the nucleotides in the sequence listing SEQ ID Nos. 1-9176, (e) a nucleotide sequence able to interfere with any one of the nucleotide sequences according to (a) and (b), (f) a nucleotide sequence able to form a hybridized nucleic acid duplex with the nucleic acid according to any one of paragraphs (a)-(d) at a temperature from about 40° C. to about 48° C. below a melting temperature of the hybridized nucleic acid duplex, (g) a nucleotide sequence encoding any one of the polypeptide sequences from *Panicum virgatum* in the sequence listing, (h) a nucleotide sequence encoding any one of the polypeptide sequences given in the sequence listing.

The present invention further embodies a vector comprising a first nucleic acid having a nucleotide sequence encoding a plant transcription and/or translation signal, and a second nucleic acid having a nucleotide sequence according to the isolated nucleic acid molecules of the present invention. More particularly, the first and second nucleic acids may be operably linked Even more particularly, the second nucleic acid may be endogenous to a first organism, and any other nucleic acid in the vector may be endogenous to a second organism. Most particularly, the first and second organisms may be different species.

In a further embodiment of the present invention, a host cell may comprise an isolated nucleic acid molecule according to the present invention. More particularly, the isolated nucleic acid molecule of the present invention found in the host cell of the present invention may be endogenous to a first organism and may be flanked by nucleotide sequences endogenous to a second organism. Further, the first and second organisms may be different species. Even more particularly, the host cell of the present invention may comprise a vector according to the present invention, which itself comprises nucleic acid molecules according to those of the present invention.

In another embodiment of the present invention, the isolated polypeptides of the present invention may additionally comprise amino acid sequences that are at least 85% identical to any one of the polypeptides in the sequence listing.

Other embodiments of the present invention include methods of introducing an isolated nucleic acid of the present invention into a host cell. More particularly, an isolated nucleic acid molecule of the present invention may be contacted to a host cell under conditions allowing transport of the isolated nucleic acid into the host cell. Even more particularly, a vector as described in a previous embodiment of the present invention, may be introduced into a host cell by the same method.

Methods of detection are also available as embodiments of the present invention. Particularly, methods for detecting a nucleic acid molecule according to the present invention in a sample. More particularly, the isolated nucleic acid molecule according to the present invention may be contacted with a sample under conditions that permit a comparison of the nucleotide sequence of the isolated nucleic acid molecule with a nucleotide sequence of nucleic acid in the sample. The results of such an analysis may then be considered to determine whether the isolated nucleic acid molecule of the present invention is detectable and therefore present within the sample.

A further embodiment of the present invention comprises a plant, plant cell, plant material or seeds of plants comprising an isolated nucleic acid molecule and/or vector of the present invention. More particularly, the isolated nucleic acid molecule of the present invention may be exogenous to the plant, plant cell, plant material or seed of a plant.

A further embodiment of the present invention includes a plant regenerated from a plant cell or seed according to the present invention. More particularly, the plant, or plants derived from the plant, plant cell, plant material or seeds of a plant of the present invention preferably has increased size (in whole or in part), increased vegetative growth, increased organ number and/or increased biomass (sometimes hereinafter collectively referred to as increased biomass), lethality, sterility, improved stress tolerance, or compositional characteristics as compared to a wild-type plant cultivated under identical conditions. Furthermore, the transgenic plant may comprise a first isolated nucleic acid molecule of the present invention, which encodes a protein involved in modulating growth and phenotype characteristics, and a second isolated nucleic acid molecule which encodes a promoter capable of driving expression in plants, wherein the growth and phenotype modulating component and the promoter are operably linked More preferably, the first isolated nucleic acid may be mis-expressed in the transgenic plant of the present invention, and the transgenic plant exhibits modulated characteristics as compared to a progenitor plant devoid of the nucleic acid, when the transgenic plant and the progenitor plant are cultivated under identical environmental conditions. In another embodiment of the present invention the modulated growth and phenotype characteristics may be due to the inactivation of a particular sequence, using for example an interfering RNA.

A further embodiment consists of a plant, plant cell, plant material or seed of a plant according to the present invention which comprises an isolated nucleic acid molecule of the present invention, wherein the plant, or plants derived from the plant, plant cell, plant material or seed of a plant, has the modulated growth and phenotype characteristics as compared to a wild-type plant cultivated under identical conditions.

Another embodiment of the present invention includes methods of modulating growth and phenotype characteristics in plants. More particularly, these methods comprise transforming a plant with an isolated nucleic acid molecule according to the present invention.

In yet another embodiment, lethality genes of the invention can be used to control transmission and expression of transgenic traits, thereby facilitating the cultivation of transgenic plants without the undesired transmission of transgenic traits to other plants. Such lethality genes can also be utilized for selective lethality, by combining the lethal gene with appropriate promoter elements for selective expression, to thereby cause lethality of only certain cells or only under certain conditions.

In another aspect, methods of identifying a trait associated polymorphism are provided. The methods include providing a population of switchgrass plants, and determining whether one or more polymorphisms in the population are present within a nucleic acid corresponding to a switchgrass polynucleotide provided in the Sequence Listing. The correlation between variation in the trait in a tissue in plants of the population and the presence of the one or more polymorphisms in plants of the population is measured, thereby permitting identification of the trait associated polymorphism. The trait may be selected from a feature noted in the Sequence Listing for a polypeptide encoded by the corresponding switchgrass polynucleotide.

2. Definitions

The following terms are utilized throughout this application:

Biomass: As used herein, "biomass" refers to useful biological material including a product of interest, which material is to be collected and is intended for further processing to isolate or concentrate the product of interest. "Biomass" may comprise the fruit, or parts of it, or seeds, leaves, or stems or roots where these are the parts of the plant that are of particular interest for the industrial purpose. "Biomass", as it refers to plant material, includes any structure or structures of a plant that contain or represent the product of interest.

Transformation: Examples of means by which this can be accomplished are described below and include *Agrobacterium*-mediated transformation (of dicots (9-10), of monocots (11-13), and biolistic methods (14)), electroporation, in planta techniques, and the like. Such a plant containing the exogenous nucleic acid is referred to here as a $T_0$ for the primary transgenic plant and $T_1$ for the first generation.

Functionally Comparable Proteins or Functional Homologs: This phrase describes a set of proteins that perform similar functions within an organism. By definition, perturbation of an individual protein within that set (through misexpression or mutation, for example) is expected to confer a similar phenotype as compared to perturbation of any other individual protein. Such proteins typically share sequence similarity resulting in similar biochemical activity. Within this definition, homologs, orthologs and paralogs are considered to be functionally comparable.

Functionally comparable proteins will give rise to the same characteristic to a similar, but not necessarily the same, degree. Typically, comparable proteins give the same characteristics where the quantitative measurement due to one of the comparables is at least 20% of the other; more typically, between 30 to 40%; even more typically, between 50-60%; even more typically between 70 to 80%; even more typically between 90 to 100% of the other.

Heterologous sequences: "Heterologous sequences" are those that are not operatively linked or are not contiguous to each other in nature. For example, a promoter from corn is considered heterologous to an *Arabidopsis* coding region sequence. Also, a promoter from a gene encoding a growth factor from corn is considered heterologous to a sequence encoding the corn receptor for the growth factor. Regulatory element sequences, such as UTRs or 3' end termination sequences that do not originate in nature from the same gene as the coding sequence, are considered heterologous to said coding sequence. Elements operatively linked in nature and contiguous to each other are not heterologous to each other. On the other hand, these same elements remain operatively linked but become heterologous if another filler sequence is placed between them. Thus, the promoter and coding sequences of a corn gene expressing an amino acid transporter are not heterologous to each other, but the promoter and coding sequence of a corn gene operatively linked in a novel manner are heterologous.

Misexpression: The term "misexpression" refers to an increase or a decrease in the transcription of a coding region into a complementary RNA sequence as compared to the wild-type. This term also encompasses expression and/or translation of a gene or coding region or inhibition of such transcription and/or translation for a different time period as compared to the wild-type and/or from a non-natural location within the plant genome, including a gene coding region from a different plant species or from a non-plant organism.

Percentage of sequence identity: As used herein, the term "percent sequence identity" refers to the degree of identity between any given query sequence and a subject sequence. A query nucleic acid or amino acid sequence is aligned to one or more subject nucleic acid or amino acid sequences using the computer program ClustalW (version 1.83, default parameters), which allows alignments of nucleic acid or protein sequences to be carried out across their entire length (global alignment). Chenna et al. (2003) *Nucleic Acids Res.* 31(13): 3497-500.

ClustalW calculates the best match between a query and one or more subject sequences, and aligns them so that identities, similarities and differences can be determined Gaps of one or more residues can be inserted into a query sequence, a subject sequence, or both, to maximize sequence alignments. For fast pairwise alignment of nucleic acid sequences, the following default parameters are used: word size: 2; window size: 4; scoring method: percentage; number of top diagonals: 4; and gap penalty: 5. For an alignment of multiple nucleic acid sequences, the following parameters are used: gap opening penalty: 10.0; gap extension penalty: 5.0; and weight transitions: yes. For fast pairwise alignment of protein sequences, the following parameters are used: word size: 1; window size: 5; scoring method: percentage; number of top diagonals: 5; gap penalty: 3. For multiple alignment of protein sequences, the following parameters are used: weight matrix: blosum; gap opening penalty: 10.0; gap extension penalty: 0.05; hydrophilic gaps: on; hydrophilic residues: Gly, Pro, Ser, Asn, Asp, Gln, Glu, Arg, and Lys; residue-specific gap penalties: on. The output is a sequence alignment that reflects the relationship between sequences. ClustalW can be run, for example, at the Baylor College of Medicine Search Launcher website and at the European Bioinformatics Institute website on the World Wide Web.

To determine a percent identity for polypeptide or nucleic acid sequences between a query and a subject sequence, the sequences are aligned using Clustal W and the number of identical matches in the alignment is divided by the query length, and the result is multiplied by 100. The output is the percent identity of the subject sequence with respect to the query sequence. It is noted that the percent identity value can be rounded to the nearest tenth. For example, 78.11, 78.12, 78.13, and 78.14 are rounded down to 78.1, while 78.15, 78.16, 78.17, 78.18, and 78.19 are rounded up to 78.2.

In some embodiments, the amino acid sequence of a suitable subject polypeptide has greater than 40% sequence identity (e.g., >40%, >50%, >60%, >70% or >80%, >90%, 91%, >92%, >93%, >94%, >95%, >96%, >97%, >98%, or >99%) to the amino acid sequence of the query polypeptide. In other embodiments, the nucleotide sequence of a suitable subject nucleic acid has greater than 40% sequence identity (e.g., >45%, >50%, >55%, >60%, >65%, >70%, >75%, >80%, >90%, >91%, >92%, >93%, >94%, >95%, >96%, >97%, >98%, or >99%) to the nucleotide sequence of the query nucleic acid.

Regulatory Regions: The term "regulatory region" refers to nucleotide sequences that, when operably linked to a sequence, influence transcription initiation or translation initiation or transcription termination of said sequence and the rate of said processes, and/or stability and/or mobility of a transcription or translation product. As used herein, the term "operably linked" refers to positioning of a regulatory region and said sequence to enable said influence. Regulatory regions include, without limitation, promoter sequences, enhancer sequences, response elements, protein recognition sites, inducible elements, protein binding sequences, 5' and 3' untranslated regions (UTRs), transcriptional start sites, termination sequences, polyadenylation sequences, and introns. Regulatory regions can be classified in two categories, promoters and other regulatory regions.

Stringency: "Stringency," as used herein is a function of nucleic acid molecule probe length, nucleic acid molecule probe composition (G+C content), salt concentration, organic solvent concentration and temperature of hybridization and/or wash conditions. Stringency is typically measured by the parameter $T_m$, which is the temperature at which 50% of the complementary nucleic acid molecules in the hybridization assay are hybridized, in terms of a temperature differential from $T_m$. High stringency conditions are those providing a condition of $T_m-5°$ C. to $T_m-10°$ C. Medium or moderate stringency conditions are those providing $T_m-20°$ C. to $T_m-29°$ C. Low stringency conditions are those providing a condition of $T_m-40°$ C. to $T_m-48°$ C. The relationship between hybridization conditions and $T_m$ (in ° C.) is expressed in the mathematical equation:

$$T_m=81.5-16.6(\log_{10}[Na^+])+0.41(\% \ G+C)-(600/N) \quad (I)$$

where N is the number of nucleotides of the nucleic acid molecule probe. This equation works well for probes 14 to 70 nucleotides in length that are identical to the target sequence. The equation below, for $T_m$ of DNA-DNA hybrids, is useful for probes having lengths in the range of 50 to greater than 500 nucleotides, and for conditions that include an organic solvent (formamide):

$$T_m=81.5+16.6 \log \{[Na^+]/(1+0.7[Na^+])\}+ 0.41(\% \ G+C)-500/L \ 0.63(\% \text{ formamide}) \quad (II)$$

where L represents the number of nucleotides in the probe in the hybrid (Bonner et al. (1973) *J. Mol. Biol.* 81:123). The $T_m$ of Equation II is affected by the nature of the hybrid: for DNA-RNA hybrids, $T_m$ is 10-15° C. higher than calculated; for RNA-RNA hybrids, $T_m$ is 20-25° C. higher. Because the $T_m$ decreases about 1° C. for each 1% decrease in homology when a long probe is used (Frischauf et al. (1983) *J. Mol Biol,* 170: 827-842), stringency conditions can be adjusted to favor detection of identical genes or related family members.

Equation II is derived assuming the reaction is at equilibrium. Therefore, hybridizations according to the present invention are most preferably performed under conditions of probe excess and allowing sufficient time to achieve equilibrium. The time required to reach equilibrium can be shortened by using a hybridization buffer that includes a hybridization accelerator such as dextran sulfate or another high volume polymer.

Stringency can be controlled during the hybridization reaction, or after hybridization has occurred, by altering the salt and temperature conditions of the wash solutions. The formulas shown above are equally valid when used to compute the stringency of a wash solution. Preferred wash solution stringencies lie within the ranges stated above; high stringency is 5-8° C. below $T_m$, medium or moderate stringency is 26-29° C. below $T_m$ and low stringency is 45-48° C. below $T_m$.

$T_0$: The term "$T_0$" refers to the whole plant, explant or callus tissue, inoculated with the transformation medium.

$T_1$: The term $T_1$ refers to either the progeny of the $T_0$ plant, in the case of whole-plant transformation, or the regenerated seedling in the case of explant or callous tissue transformation.

$T_2$: The term $T_2$ refers to the progeny of the $T_1$ plant. $T_2$ progeny are the result of self-fertilization or cross-pollination of a $T_1$ plant.

$T_3$: The term $T_3$ refers to second generation progeny of the plant that is the direct result of a transformation experiment. $T_3$ progeny are the result of self-fertilization or cross-pollination of a $T_2$ plant.

3. Important Characteristics of the Polynucelotides and Polypeptides of the Invention The nucleic acid molecules and polypeptides of the present invention are of interest because when the nucleic acid molecules are mis-expressed (i.e., when expressed at a non-natural location or in an increased or decreased amount relative to wild-type) they produce plants that exhibit modulated growth and phenotype characteristics as compared to wild-type plants. This trait can be used to exploit or maximize plant products. For example, the nucleic acid molecules and polypeptides of the present invention are used to increase the expression of genes that cause the plant to have modulated growth and phenotype characteristics.

Because some of the disclosed sequences and methods increase vegetative growth, the disclosed methods can be used to enhance biomass production. For example, plants that grow vegetatively have an increase biomass production, compared to a plant of the same species that is not genetically modified for substantial vegetative growth. Examples of increases in biomass production include increases of at least 5%, at least 10%, at least 20%, or even at least 50%, when compared to an amount of biomass production by a plant of the same species not genetically modified.

The life cycle of flowering plants in general can be divided into three growth phases: vegetative, inflorescence, and floral (late inflorescence phase). In the vegetative phase, the shoot apical meristem (SAM) generates leaves that later will ensure the resources necessary to produce fertile offspring. Upon receiving the appropriate environmental and developmental signals the plant switches to floral, or reproductive, growth and the SAM enters the inflorescence phase (I) and gives rise to an inflorescence with flower primordia. During this phase the fate of the SAM and the secondary shoots that arise in the axils of the leaves is determined by a set of meristem identity genes, some of which prevent and some of which promote the development of floral meristems. Once established, the plant enters the late inflorescence phase (12) where the floral organs are produced. If the appropriate environmental and developmental signals for floral, or reproductive, growth are disrupted, the plant will not be able to enter reproductive growth, therefore maintaining vegetative growth and increasing overall biomass.

As more and more transgenic plants are developed and introduced into the environment, it can be important to control the undesired spread of the transgenic triat(s) from transgenic plants to other traditional and transgenic cultivars, plant species and breeding lines, thereby preventing cross-contamination. Such genetic confinement systems (also called biocontainment applications) can be designed using a number of different technical strategies. The use of a conditionally lethal gene, i.e. one which results in plant cell death under certain conditions, has been suggested as a means to selectively kill plant cells containing a recombinant DNA (see e.g., WO 94/03619 and US patent publication 20050044596A1). The use of genes to control transmission and expression of transgenic traits is also described in (see US patent publication 20050257293A1), which is hereby incorporated by reference. Some of the nucleotides of the invention are lethal genes, and can therefore be used as conditionally lethal genes, namely genes to be expressed in response to specific conditions, or in specific plant cells. For example, a gene that encodes a lethal trait can be placed under that control of a tissue specific promoter, or under the control of a promoter that is induced in response to specific conditions, for example, a specific chemical trigger, or specific environmental conditions.

Male or female sterile genes can also be used to control the spread of certain germplasm, such as by selective destruction of tissue, such as of the tapetum by fusing such a gene to a tapetum-specific promoter such as, TA29. Further examples of such promoters are described below.

The sequences of the invention can be used to advantageously manipulate plant characteristics in traits such as size (in whole or in part), vegetative growth, increased organ number and/or increased biomass (sometimes hereinafter collectively referred to as increased biomass), lethality, sterility, stress tolerance, or compositional characteristics as compared to a wild-type plant cultivated under identical conditions. Furthermore, the sequences of the invention can be used to advantageously manipulate plant characteristics such as architecture, biomass, development, composition, conversion efficiency, energy output, confinement, nitrogen use, nutrient uptake, phosphate use, photosynthetic capacity, shade avoidance, cold tolerance, drought tolerance, water use efficiency, stress tolerance, vigor, flowering time and yield to maximize the benefits of energy crops and other economically important crops depending on the benefit sought and the particular environment in which the crop must grow. These molecules may be from the plant itself, and simply expressed at a higher or lower level, or the molecules may be from different plant species The sequences of the invention can be applied to substrates for use in array applications such as, but not limited to, assays of global gene expression, under varying conditions of development, and growth conditions. The arrays are also used in diagnostic or forensic methods.

The polynucleotides of the invention are also used to create various types of genetic and physical maps of the genome of switchgrass plants. Some are absolutely associated with particular phenotypic traits, allowing construction of gross genetic maps. Creation of such maps is based on differences or variants, generally referred to as polymorphisms, between different parents used in crosses. Common methods of detecting polymorphisms that can be used are restriction fragment length polymorphisms (RFLPs, single nucleotide polymorphisms (SNPs) or simple sequence repeats [(SSRs), also called microsatellites].

The sequence information disclosed herein can be useful in breeding of switchgrass plants. Based on the information in the Sequence Listing, one can search for and identify polymorphisms linked to genetic loci for such polypeptides. As those of skill in the art appreciate, polymorphisms can be identified based on characterization of libraries, such as genomic or expression libraries, and/or characterization of nucleic acids extracted from individual plants, and possibly amplified and/or otherwise processed. For example, the nucleotide sequences provided in the sequence listing can serve for design of primers for amplification of nucleic acids and polymorphism characterization. As such, polymorphisms may be found in coding regions or untranslated regions of polynucleotides presented in the Sequence Listing, or they may be found within the locus for a disclosed sequence. Polymorphisms that can be identified include simple sequence repeats (SSRs), rapid amplification of polymorphic DNA (RAPDs), amplified fragment length polymorphisms (AFLPs) and restriction fragment length polymorphisms (RFLPs), as described below. If a polymorphism is identified, its presence and frequency in populations is analyzed to determine if it is statistically significantly correlated to a trait, such as the trait noted in the Sequence Listing. Those polymorphisms that are correlated with a trait can be incorporated into a marker assisted breeding program to facilitate the development of lines that have a desired alteration in the respective trait. Typically, a polymorphism identified in such a manner is used with polymorphisms at other loci that are correlated with the same trait.

The use of RFLPs and of recombinant inbred lines for such genetic mapping is described for *Arabidopsis* by Alonso-Blanco et al. (*Methods in Molecular Biology*, vol. 82, "*Arabidopsis Protocols*", pp. 137-146, J. M. Martinez-Zapater and J. Salinas, eds., c. 1998 by Humana Press, Totowa, N.J.) and for corn by Burr ("Mapping Genes with Recombinant Inbreds", pp. 249-254. In Freeling, M. and V. Walbot (Ed.), *The Maize Handbook*, c. 1994 by Springer-Verlag New York, Inc.: New York, N.Y., USA; Berlin Germany; Burr et al. *Genetics* (1998) 118: 519; Gardiner, J. et al., (1993) *Genetics* 134: 917). This procedure, however, is not limited to plants and is used for other organisms (such as yeast) or for individual cells.

The polynucleotides of the present invention are also used for simple sequence repeat (SSR) mapping. Rice SSR mapping is described by Morgante et al. (*The Plant Journal* (1993) 3: 165), Panaud et al. (*Genome* (1995) 38: 1170); Senior et al. (*Crop Science* (1996) 36: 1676), Taramino et al. (*Genome* (1996) 39: 277) and Ahn et al. (*Molecular and General Genetics* (1993) 241: 483-90). SSR mapping is achieved using various methods. In one instance, polymorphisms are identified when sequence specific probes contained within a polynucleotide flanking an SSR are made and used in polymerase chain reaction (PCR) assays with template DNA from two or more individuals of interest. Here, a change in the number of tandem repeats between the SSR-flanking sequences produces differently sized fragments (U.S. Pat. No. 5,766,847). Alternatively, polymorphisms are identified by using the PCR fragment produced from the SSR-flanking sequence specific primer reaction as a probe against Southern blots representing different individuals (U. H. Refseth et al., (1997) *Electrophoresis* 18: 1519).

The polynucleotides of the invention can further be used to identify certain genes or genetic traits using, for example, known AFLP technologies, such as in EP0534858 and U.S. Pat. No. 5,878,215.

The polynucleotides of the present invention are also used for single nucleotide polymorphism (SNP) mapping.

The polynucleotides of the invention can be used with the various types of maps discussed above to identify Quantitative Trait Loci (QTLs). Many important crop traits, such as the solids content of tomatoes, are quantitative traits and result from the combined interactions of several genes. These genes reside at different loci in the genome, often times on different chromosomes, and generally exhibit multiple alleles at each locus. The polynucleotides of the invention are used to identify QTLs and isolate specific alleles as described by de Vicente and Tanksley (*Genetics* (1993) 134:585). Once a desired allele combination is identified, crop improvement is accomplished either through biotechnological means or by directed conventional breeding programs (for review see Tanksley and McCouch (1997) *Science* 277:1063). In addition to isolating QTL alleles in present crop species, the polynucleotides of the invention are also used to isolate alleles from the corresponding QTL of wild relatives.

In addition, the polynucleotides of the present invention can be used for marker assisted breeding. Marker assisted breeding uses genetic fingerprinting techniques to assist plant breeders in matching a molecular profile to the physical properties of a variety. This allows plant breeders to significantly accelerate the speed of natural plant breeding programs. Marker assisted breeding also allows better retention of sequences that participate in QTLs.

Following the procedures described above and using a plurality of the polynucleotides of the present invention, any individual can be genotyped. These individual genotypes are used for the identification of particular cultivars, varieties, lines, ecotypes and genetically modified plants or can serve as tools for subsequent genetic studies directed towards the improvement of multiple phenotypic traits.

4. The Sequences of the Invention

Polynucleotides of the present invention and proteins expressed via translation of these polynucleotides are set forth in the Sequence Listing, specifically the polynucleotides from *Panicum virgatum*. The Sequence Listing also provides annotations which are indicative of use(s) for which the sequences can be utilized; for example, to make transgenic plants with modulated growth and phenotype characteristics, including ornamental, biomass and seed yield, confinement, stress tolerance, ornamental and/or compositional characteristics.

5. Use of the Sequences to Make Transgenic Plants

To use the sequences of the present invention or a combination of them or parts and/or mutants and/or fusions and/or variants of them, recombinant DNA constructs are prepared that comprise the polynucleotide sequences of the invention inserted into a vector and that are suitable for transformation of plant cells. The construct can be made using standard recombinant DNA techniques (see, Sambrook et al., Molecular Cloning: A Laboratory Manual, Second Edition, Cold Spring Harbor Laboratory Press (1989) New York) and can be introduced into the plant species of interest by, for example, *Agrobacterium*-mediated transformation, or by other means of transformation, for example, as disclosed below.

The vector backbone may be any of those typically used in the field such as plasmids, viruses, artificial chromosomes, BACs, YACs, PACs and vectors such as, for instance, bacteria-yeast shuttle vectors, lamda phage vectors, T-DNA fusion vectors and plasmid vectors (see, 17-24).

Typically, the construct comprises a vector containing a nucleic acid molecule of the present invention with any desired transcriptional and/or translational regulatory sequences such as, for example, promoters, UTRs, and 3' end termination sequences. Vectors may also include, for example, origins of replication, scaffold attachment regions (SARs), markers, homologous sequences, and introns. The vector may also comprise a marker gene that confers a selectable phenotype on plant cells. The marker may preferably encode a biocide resistance trait, particularly antibiotic resistance, such as resistance to, for example, kanamycin, bleomycin, or hygromycin, or herbicide resistance, such as resistance to, for example, glyphosate, chlorsulfuron or phosphinothricin.

It will be understood that more than one regulatory region may be present in a recombinant polynucleotide, e.g., introns, enhancers, upstream activation regions, transcription terminators, and inducible elements. Thus, more than one regulatory region can be operably linked to said sequence.

To "operably link" a promoter sequence to a sequence, the translation initiation site of the translational reading frame of said sequence is typically positioned between one and about fifty nucleotides downstream of the promoter. A promoter can, however, be positioned as much as about 5,000 nucleotides upstream of the translation initiation site, or about 2,000 nucleotides upstream of the transcription start site. A promoter typically comprises at least a core (basal) promoter. A promoter also may include at least one control element, such as an enhancer sequence, an upstream element or an upstream activation region (UAR). For example, a suitable enhancer is a cis-regulatory element (−212 to −154) from the upstream region of the octopine synthase (ocs) gene. Fromm et al. (1989) *Plant Cell* 1:977-984.

A basal promoter is the minimal sequence necessary for assembly of a transcription complex required for transcription initiation. Basal promoters frequently include a "TATA box" element that may be located between about 15 and about 35 nucleotides upstream from the site of transcription initiation. Basal promoters also may include a "CCAAT box" element (typically the sequence CCAAT) and/or a GGGCG sequence, which can be located between about 40 and about 200 nucleotides, typically about 60 to about 120 nucleotides, upstream from the transcription start site.

The choice of promoters to be included depends upon several factors, including, but not limited to, efficiency, selectability, inducibility, desired expression level, and cell- or tissue-preferential expression. It is a routine matter for one of skill in the art to modulate the expression of a sequence by appropriately selecting and positioning promoters and other regulatory regions relative to said sequence.

Some suitable promoters initiate transcription only, or predominantly, in certain cell types. For example, a promoter that is active predominantly in a reproductive tissue (e.g., fruit, ovule, pollen, pistils, female gametophyte, egg cell, central cell, nucellus, suspensor, synergid cell, flowers, embryonic tissue, embryo sac, embryo, zygote, endosperm, integument, or seed coat) can be used. Thus, as used herein a cell type- or tissue-preferential promoter is one that drives expression preferentially in the target tissue, but may also lead to some expression in other cell types or tissues as well. Methods for identifying and characterizing promoter regions in plant genomic DNA include, for example, those described in the following references: Jordano, et al. (1989) *Plant Cell* 1:855-866; Bustos et al. (1989) *Plant Cell* 1:839-854; Green et al. (1988) *EMBO J.* 7: 4035-4044; Meier et al. (1991) *Plant Cell* 3: 309-316; and Zhang et al. (1996) *Plant Physiology* 110: 1069-1079.

Examples of various classes of regulatory regions are described below. Some properties of the regulatory regions indicated below, as well as additional regulatory regions, are described in more detail in U.S. Patent Application Ser. Nos. 60/505,689; 60/518,075; 60/544,771; 60/558,869; 60/583, 691; 60/619,181; 60/637,140; 60/757,544; 60/776,307; Ser. No. 10/957,569; 11/058,689; 11/172,703; 11/208,308; 11/274,890; 60/583,609; 60/612,891; Ser. No. 11/097,589; 11/233,726; 11/408,791; 11/414,142; 10/950,321; 11/360, 017; PCT/US05/011105; PCT/US05/034308; and PCT/US05/23639. Specifically, the sequences of regulatory regions p326, YP0144, YP0190, p13879, YP0050, p32449, 21876, YP0158, YP0214, YP0380, PT0848, PT0633 YP0128, YP0275, PT0660, PT0683, PT0758, PT0613, PT0672, PT0837, YP0092, PT0676, PT0708, YP0396, YP0007, YP0111, YP0103, YP0028, YP0121, YP0008, YP0039, YP0115, YP0119, YP0120, YP0374, YP0039, YP0101, YP0102, YP0110, YP0117, YP0119, YP0137, YP0285, YP0212, YP0097, YP0107, YP0088, YP0143, YP0156, PT0650, PT0695, PT0723, PT0838, PT0879, PT0740, PT0535, PT0668, PT0886, PT0585, YP0381, YP0337, YP0374, PT0710, YP0356, YP0385, YP0396, YP0384, PT0688, YP0286, YP0377, PD1367, PT0863, PT0829, PT0665, PT0678, YP0086, YP0188, YP0263, PT0758, PT0743, PT0829, YP0119, and YP0096 are set forth in the sequence listing of PCT/US06/040572; the sequence of regulatory region PT0625 is set forth in the sequence listing of PCT/US05/034343; the sequences of regulatory regions PT0623, YP0388, YP0087, YP0093, YP0108, YP0022, and YP0080 are set forth in the sequence listing of U.S. patent application Ser. No. 11/172,703; the sequence of regulatory region PR0924 is set forth in the sequence listing of PCT/US07/62762; and the sequences of regulatory regions p530c10, pOsFIE2-2, pOsMEA, pOsYp102, and pOsYp285 are set forth in the sequence listing of PCT/US06/038236. It will be appreciated that a regulatory region may meet criteria for one classification based on its activity in one plant species, and yet meet criteria for a different classification based on its activity in another plant species.

Broadly Expressing Promoters: A promoter can be said to be "broadly expressing" when it promotes transcription in many, but not necessarily all, plant tissues. For example, a broadly expressing promoter can promote transcription of an operably linked sequence in one or more of the shoot, shoot tip (apex), and leaves, but weakly or not at all in tissues such as roots or stems. As another example, a broadly expressing promoter can promote transcription of an operably linked sequence in one or more of the stem, shoot, shoot tip (apex), and leaves, but can promote transcription weakly or not at all in tissues such as reproductive tissues of flowers and developing seeds. Non-limiting examples of broadly expressing promoters that can be included in the nucleic acid constructs provided herein include the p326, YP0144, YP0190, p13879, YP0050, p32449, 21876, YP0158, YP0214, YP0380, PT0848, and PT0633 promoters. Additional examples include the cauliflower mosaic virus (CaMV) 35S promoter, the mannopine synthase (MAS) promoter, the 1' or 2' promoters derived from T-DNA of *Agrobacterium tumefaciens*, the figwort mosaic virus 34S promoter, actin promoters such as the rice actin promoter, and ubiquitin promoters such as the maize ubiquitin-1 promoter. In some cases, the CaMV 35S promoter is excluded from the category of broadly expressing promoters.

Root Promoters: Root-active promoters confer transcription in root tissue, e.g., root endodermis, root epidermis, or root vascular tissues. In some embodiments, root-active promoters are root-preferential promoters, i.e., confer transcription only or predominantly in root tissue. Root-preferential promoters include the YP0128, YP0275, PT0625, PT0660, PT0683, and PT0758 promoters. Other root-preferential promoters include the PT0613, PT0672, PT0688, and PT0837 promoters, which drive transcription primarily in root tissue and to a lesser extent in ovules and/or seeds. Other examples of root-preferential promoters include the root-specific subdomains of the CaMV 35S promoter (Lam et al., *Proc. Natl. Acad. Sci. USA*, 86:7890-7894 (1989)), root cell specific promoters reported by Conkling et al., *Plant Physiol.*, 93:1203-1211 (1990), and the tobacco RD2 promoter.

Maturing Endosperm Promoters: In some embodiments, promoters that drive transcription in maturing endosperm can be useful. Transcription from a maturing endosperm promoter typically begins after fertilization and occurs primarily in endosperm tissue during seed development and is typically highest during the cellularization phase. Most suitable are promoters that are active predominantly in maturing endosperm, although promoters that are also active in other tissues can sometimes be used. Non-limiting examples of maturing endosperm promoters that can be included in the nucleic acid constructs provided herein include the napin promoter, the Arcelin-5 promoter, the phaseolin promoter (Bustos et al., *Plant Cell*, 1(9):839-853 (1989)), the soybean trypsin inhibitor promoter (Riggs et al., *Plant Cell*, 1(6):609-621 (1989)), the ACP promoter (Baerson et al., *Plant Mol. Biol.*, 22(2):255-267 (1993)), the stearoyl-ACP desaturase promoter (Slocombe et al., *Plant Physiol.*, 104(4):167-176 (1994)), the soybean α' subunit of β-conglycinin promoter (Chen et al., *Proc. Natl. Acad. Sci. USA*, 83:8560-8564 (1986)), the oleosin promoter (Hong et al., *Plant Mol. Biol.*, 34(3):549-555 (1997)), and zein promoters, such as the 15 kD zein promoter, the 16 kD zein promoter, 19 kD zein promoter, 22 kD zein promoter and 27 kD zein promoter. Also suitable are the Osgt-1 promoter from the rice glutelin-1 gene (Zheng et al., *Mol. Cell Biol.*, 13:5829-5842 (1993)), the beta-amylase promoter, and the barley hordein promoter. Other maturing endosperm promoters include the YP0092, PT0676, and PT0708 promoters.

Ovary Tissue Promoters: Promoters that are active in ovary tissues such as the ovule wall and mesocarp can also be useful, e.g., a polygalacturonidase promoter, the banana TRX promoter, the melon actin promoter, YP0396, and PT0623. Examples of promoters that are active primarily in ovules include YP0007, YP0111, YP0092, YP0103, YP0028, YP0121, YP0008, YP0039, YP0115, YP0119, YP0120, and YP0374.

Embryo Sac/Early Endosperm Promoters: To achieve expression in embryo sac/early endosperm, regulatory regions can be used that are active in polar nuclei and/or the central cell, or in precursors to polar nuclei, but not in egg cells or precursors to egg cells. Most suitable are promoters that drive expression only or predominantly in polar nuclei or precursors thereto and/or the central cell. A pattern of transcription that extends from polar nuclei into early endosperm development can also be found with embryo sac/early endosperm-preferential promoters, although transcription typically decreases significantly in later endosperm development during and after the cellularization phase. Expression in the zygote or developing embryo typically is not present with embryo sac/early endosperm promoters. Promoters that may be suitable include those derived from the following genes: *Arabidopsis* viviparous-1 (see, GenBank No. U93215); *Arabidopsis* atmycl (see, Urao (1996) *Plant Mol. Biol.*, 32:571-57; Conceicao (1994) *Plant*, 5:493-505); *Arabidopsis* FIE (GenBank No. AF129516); *Arabidopsis* MEA; *Arabidopsis* FIS2 (GenBank No. AF096096); and FIE 1.1 (U.S. Pat. No. 6,906,244). Other promoters that may be suitable include those derived from the following genes: maize MAC1 (see, Sheridan (1996) *Genetics*, 142:1009-1020); maize Cat3 (see, GenBank No. L05934; Abler (1993) *Plant Mol. Biol.*, 22:10131-1038). Other promoters include the following *Arabidopsis* promoters: YP0039, YP0101, YP0102, YP0110, YP0117, YP0119, YP0137, DME, YP0285, and YP0212. Other promoters that may be useful include the following rice promoters: p530c10, pOsFIE2-2, pOsMEA, pOsYp102, and pOsYp285.

Embryo Promoters: Regulatory regions that preferentially drive transcription in zygotic cells following fertilization can provide embryo-preferential expression. Most suitable are promoters that preferentially drive transcription in early stage embryos prior to the heart stage, but expression in late stage and maturing embryos is also suitable. Embryo-preferential promoters include the barley lipid transfer protein (Ltp 1) promoter (*Plant Cell Rep* (2001) 20:647-654), YP0097, YP0107, YP0088, YP0143, YP0156, PT0650, PT0695, PT0723, PT0838, PT0879, and PT0740.

Photosynthetic Tissue Promoters: Promoters active in photosynthetic tissue confer transcription in green tissues such as leaves and stems. Most suitable are promoters that drive expression only or predominantly in such tissues. Examples of such promoters include the ribulose-1,5-bisphosphate carboxylase (RbcS) promoters such as the RbcS promoter from eastern larch (*Larix laricina*), the pine cab6 promoter (Yamamoto et al., *Plant Cell Physiol.,* 35:773-778 (1994)), the Cab-1 promoter from wheat (Fejes et al., *Plant Mol. Biol.,* 15:921-932 (1990)), the CAB-1 promoter from spinach (Lubberstedt et al., *Plant Physiol.,* 104:997-1006 (1994)), the cab1R promoter from rice (Luan et al., *Plant Cell,* 4:971-981 (1992)), the pyruvate orthophosphate dikinase (PPDK) promoter from corn (Matsuoka et al., *Proc. Natl. Acad. Sci. USA,* 90:9586-9590 (1993)), the tobacco Lhcb1*2 promoter (Cerdan et al., *Plant Mol. Biol.,* 33:245-255 (1997)), the *Arabidopsis thaliana* SUC2 sucrose-H+ symporter promoter (Truernit et al., *Planta,* 196:564-570 (1995)), and thylakoid membrane protein promoters from spinach (psaD, psaF, psaE, PC, FNR, atpC, atpD, cab, rbcS). Other photosynthetic tissue promoters include PT0535, PT0668, PT0886, YP0144, YP0380 and PT0585.

Vascular Tissue Promoters: Examples of promoters that have high or preferential activity in vascular bundles include YP0087, YP0093, YP0108, YP0022, and YP0080. Other vascular tissue-preferential promoters include the glycine-rich cell wall protein GRP 1.8 promoter (Keller and Baumgartner, *Plant Cell,* 3(10):1051-1061 (1991)), the Commelina yellow mottle virus (CoYMV) promoter (Medberry et al., *Plant Cell,* 4(2):185-192 (1992)), and the rice tungro bacilliform virus (RTBV) promoter (Dai et al., *Proc. Natl. Acad. Sci. USA,* 101(2):687-692 (2004)).

Inducible Promoters: Inducible promoters confer transcription in response to external stimuli such as chemical agents or environmental stimuli. For example, inducible promoters can confer transcription in response to hormones such as giberellic acid or ethylene, or in response to light or drought. Examples of drought-inducible promoters include YP0380, PT0848, YP0381, YP0337, PT0633, YP0374, PT0710, YP0356, YP0385, YP0396, YP0388, YP0384, PT0688, YP0286, YP0377, and PD1367. Examples of nitrogen-inducible promoters include PT0863, PT0829, PT0665, and PT0886. Examples of shade-inducible promoters include PR0924 and PT0678. An example of a promoter induced by salt is rd29A (Kasuga et al. (1999) *Nature Biotech* 17: 287-291).

Basal Promoters: A basal promoter is the minimal sequence necessary for assembly of a transcription complex required for transcription initiation. Basal promoters frequently include a "TATA box" element that may be located between about 15 and about 35 nucleotides upstream from the site of transcription initiation. Basal promoters also may include a "CCAAT box" element (typically the sequence CCAAT) and/or a GGGCG sequence, which can be located between about 40 and about 200 nucleotides, typically about 60 to about 120 nucleotides, upstream from the transcription start site.

Other Promoters: Other classes of promoters include, but are not limited to, shoot-preferential, callus-preferential, trichome cell-preferential, guard cell-preferential such as PT0678, tuber-preferential, parenchyma cell-preferential, and senescence-preferential promoters. Promoters designated YP0086, YP0188, YP0263, PT0758, PT0743, PT0829, YP0119, and YP0096, as described in the above-referenced patent applications, may also be useful.

Other Regulatory Regions: A 5' untranslated region (UTR) can be included in nucleic acid constructs described herein. A 5' UTR is transcribed, but is not translated, and lies between the start site of the transcript and the translation initiation codon and may include the +1 nucleotide. A 3' UTR can be positioned between the translation termination codon and the end of the transcript. UTRs can have particular functions such as increasing mRNA stability or attenuating translation. Examples of 3' UTRs include, but are not limited to, polyadenylation signals and transcription termination sequences, e.g., a nopaline synthase termination sequence. It will be understood that more than one regulatory region may be present in a recombinant polynucleotide, e.g., introns, enhancers, upstream activation regions, transcription terminators, and inducible elements.

Alternatively, misexpression can be accomplished using a two component system, whereby the first component consists of a transgenic plant comprising a transcriptional activator operatively linked to a promoter and the second component consists of a transgenic plant that comprise a nucleic acid molecule of the invention operatively linked to the target-binding sequence/region of the transcriptional activator. The two transgenic plants are crossed and the nucleic acid molecule of the invention is expressed in the progeny of the plant (US patent publication 20050257293A1). In another alternative embodiment of the present invention, the misexpression can be accomplished by having the sequences of the two component system transformed in one transgenic plant line.

Another alternative consists in inhibiting expression of a growth or phenotype-modulating polypeptide in a plant species of interest. The term "expression" refers to the process of converting genetic information encoded in a polynucleotide into RNA through transcription of the polynucleotide (i.e., via the enzymatic action of an RNA polymerase), and into protein, through translation of mRNA. "Up-regulation" or "activation" refers to regulation that increases the production of expression products relative to basal or native states, while "down-regulation" or "repression" refers to regulation that decreases production relative to basal or native states.

A number of nucleic-acid based methods, including antisense RNA, ribozyme directed RNA cleavage, and interfering RNA (RNAi) can be used to inhibit protein expression in plants. Antisense technology is one well-known method. In this method, a nucleic acid segment from the endogenous gene is cloned and operably linked to a promoter so that the antisense strand of RNA is transcribed. The recombinant vector is then transformed into plants, as described above, and the antisense strand of RNA is produced. The nucleic acid segment need not complement the entire sequence of the endogenous gene to be repressed, but typically will be substantially identical to at least a portion of the endogenous gene to be repressed. Generally, higher homology can be used to compensate for the use of a shorter sequence. Typically, a sequence of at least 30 nucleotides is used (e.g., at least 40, 50, 80, 100, 200, 500 nucleotides or more).

Thus, for example, an isolated nucleic acid provided herein can be an antisense nucleic acid to one of the aforementioned nucleic acids encoding a growth or phenotype-modulating polypeptide. A nucleic acid that decreases the level of a transcription or translation product of a gene encoding a growth or phenotype-modulating polypeptide is transcribed into an antisense nucleic acid, or complementary to the coding sequence of the growth or phenotype-modulating polypeptide in the Sequence Listing. Alternatively, the transcription product of an isolated nucleic acid can be similar or complementary to the coding sequence of a growth or phenotype-modulating polypeptide in the Sequence Listing, but is an RNA that is unpolyadenylated, lacks a 5' cap structure, or contains an unsplicable intron.

In another method, a nucleic acid can be transcribed into a ribozyme, or catalytic RNA, that affects expression of an mRNA. (See, U.S. Pat. No. 6,423,885). Ribozymes can be designed to specifically pair with virtually any target RNA and cleave the phosphodiester backbone at a specific location, thereby functionally inactivating the target RNA. Heterologous nucleic acids can encode ribozymes designed to cleave particular mRNA transcripts, thus preventing expression of a polypeptide. Hammerhead ribozymes are useful for destroying particular mRNAs, although various ribozymes that cleave mRNA at site-specific recognition sequences can be used. Hammerhead ribozymes cleave mRNAs at locations dictated by flanking regions that form complementary base pairs with the target mRNA. The sole requirement is that the target RNA contain a 5'-UG-3' nucleotide sequence. The construction and production of hammerhead ribozymes is known in the art. See, for example, U.S. Pat. No. 5,254,678 and WO 02/46449 and references cited therein. Hammerhead ribozyme sequences can be embedded in a stable RNA such as a transfer RNA (tRNA) to increase cleavage efficiency in vivo. Perriman, et al. (1995) *Proc. Natl. Acad. Sci. USA*, 92(13):6175-6179; de Feyter and Gaudron, Methods in Molecular Biology, Vol. 74, Chapter 43, "Expressing Ribozymes in Plants", Edited by Turner, P. C, Humana Press Inc., Totowa, N.J. RNA endoribonucleases such as the one that occurs naturally in *Tetrahymena thermophila*, and which have been described extensively by Cech and collaborators can be useful. See, for example, U.S. Pat. No. 4,987,071.

Methods based on RNA interference (RNAi) can be used. RNA interference is a cellular mechanism to regulate the expression of genes and the replication of viruses. This mechanism is thought to be mediated by double-stranded small interfering RNA molecules. A cell responds to such a double-stranded RNA by destroying endogenous mRNA having the same sequence as the double-stranded RNA. Methods for designing and preparing interfering RNAs are known to those of skill in the art; see, e.g., WO 99/32619 and WO 01/75164. For example, a construct can be prepared that includes a sequence that is transcribed into an interfering RNA. Such an RNA can be one that can anneal to itself, e.g., a double stranded RNA having a stem-loop structure. One strand of the stem portion of a double stranded RNA comprises a sequence that is similar or identical to the sense coding sequence of the polypeptide of interest, and that is from about 10 nucleotides to about 2,500 nucleotides in length. The length of the sequence that is similar or identical to the sense coding sequence can be from 10 nucleotides to 500 nucleotides, from 15 nucleotides to 300 nucleotides, from 20 nucleotides to 100 nucleotides, or from 25 nucleotides to 100 nucleotides. The other strand of the stem portion of a double stranded RNA comprises an antisense sequence of the growth or phenotype-modulating polypeptide of interest, and can have a length that is shorter, the same as, or longer than the corresponding length of the sense sequence. The loop portion of a double stranded RNA can be from 10 nucleotides to 5,000 nucleotides, e.g., from 15 nucleotides to 1,000 nucleotides, from 20 nucleotides to 500 nucleotides, or from 25 nucleotides to 200 nucleotides. The loop portion of the RNA can include an intron. See, e.g., WO 99/53050.

In some nucleic-acid based methods for inhibition of gene expression in plants, a suitable nucleic acid can be a nucleic acid analog. Nucleic acid analogs can be modified at the base moiety, sugar moiety, or phosphate backbone to improve, for example, stability, hybridization, or solubility of the nucleic acid. Modifications at the base moiety include deoxyuridine for deoxythymidine, and 5-methyl-2'-deoxycytidine and 5-bromo-2'-deoxycytidine for deoxycytidine. Modifications of the sugar moiety include modification of the 2' hydroxyl of the ribose sugar to form 2'-O-methyl or 2'-O-allyl sugars. The deoxyribose phosphate backbone can be modified to produce morpholino nucleic acids, in which each base moiety is linked to a six-membered morpholino ring, or peptide nucleic acids, in which the deoxyphosphate backbone is replaced by a pseudopeptide backbone and the four bases are retained. See, for example, Summerton and Weller (1997) *Antisense Nucleic Acid Drug Dev.*, 7:187-195; Hyrup et al. (1996) *Bioorgan. Med. Chem.*, 4: 5-23. In addition, the deoxyphosphate backbone can be replaced with, for example, a phosphorothioate or phosphorodithioate backbone, a phosphoroamidite, or an alkyl phosphotriester backbone.

In some cases, expression of a polypeptide of the invention inhibits one or more functions of an endogenous polypeptide. For example, a nucleic acid that encodes a dominant negative polypeptide can be used to inhibit gene function. A dominant negative polypeptide typically is mutated or truncated relative to an endogenous wild type polypeptide, and its presence in a cell inhibits one or more functions of the wild type polypeptide in that cell, i.e., the dominant negative polypeptide is genetically dominant and confers a loss of function. The mechanism by which a dominant negative polypeptide confers such a phenotype can vary but often involves a protein-protein interaction or a protein-DNA interaction. For example, a dominant negative polypeptide can be an enzyme that is truncated relative to a native wild type enzyme, such that the truncated polypeptide retains domains involved in binding a first protein but lacks domains involved in binding a second protein. The truncated polypeptide is thus unable to properly modulate the activity of the second protein. See, e.g., US 2007/0056058. As another example, a point mutation that results in a non-conservative amino acid substitution in a catalytic domain can result in a dominant negative polypeptide. See, e.g., US 2005/032221. As another example, a dominant negative polypeptide can be a transcription factor that is truncated relative to a native wild type transcription factor, such that the truncated polypeptide retains the DNA binding domain(s) but lacks the activation domain(s). Such a truncated polypeptide can inhibit the wild type transcription factor from binding DNA, thereby inhibiting transcription activation Transformation Nucleic acid molecules of the present invention may be introduced into the genome or the cell of the appropriate host plant by a variety of techniques. These techniques, able to transform a wide variety of higher plant species, are well known and described in the technical and scientific literature (see, e.g., 28-29).

A variety of techniques known in the art are available for the introduction of DNA into a plant host cell. These techniques include transformation of plant cells by injection (30), microinjection (31), electroporation of DNA (32), PEG (33), use of biolistics (34), fusion of cells or protoplasts (35), and via T-DNA using *Agrobacterium tumefaciens* (36-37) or *Agrobacterium rhizogenes* (38) or other bacterial hosts (39), for example.

In addition, a number of non-stable transformation methods that are well known to those skilled in the art may be desirable for the present invention. Such methods include, but are not limited to, transient expression (40) and viral transfection (41).

Seeds are obtained from the transformed plants and used for testing stability and inheritance. Generally, two or more generations are cultivated to ensure that the phenotypic feature is stably maintained and transmitted.

A person of ordinary skill in the art recognizes that after the expression cassette is stably incorporated in transgenic plants and confirmed to be operable, it can be introduced into other plants by sexual crossing. Any of a number of standard breeding techniques can be used, depending upon the species to be crossed.

The methods according to the present invention can be applied to any plant, preferably higher plants, pertaining to the classes of Angiospermae and Gymnospermae. Plants of the subclasses of the Dicotylodenae and the Monocotyledonae are particularly suitable. Suitable species may come from the family Acanthaceae, Alliaceae, Alstroemeriaceae, Amaryllidaceae, Apocynaceae, Arecaceae, Asteraceae, Berberidaceae, Bixaceae, Brassicaceae, Bromeliaceae, Cannabaceae, Caryophyllaceae, Cephalotaxaceae, Chenopodiaceae, Colchicaceae, Cucurbitaceae, Dioscoreaceae, Ephedraceae, Erythroxylaceae, Euphorbiaceae, Fabaceae, Lamiaceae, Linaceae, Lycopodiaceae, Malvaceae, Melanthiaceae, Musaceae, Myrtaceae, Nyssaceae, Papaveraceae, Pinaceae, Plantaginaceae, Poaceae, Rosaceae, Rubiaceae, Salicaceae, Sapindaceae, Solanaceae, Taxaceae, Theaceae, and Vitaceae.

Suitable species may include members of the genus *Abelmoschus, Abies, Acer, Agrostis, Allium, Alstroemeria, Ananas, Andrographis, Andropogon, Artemisia, Arundo, Atropa, Berberis, Beta, Bixa, Brassica, Calendula, Camellia, Camptotheca, Cannabis, Capsicum, Carthamus, Catharanthus, Cephalotaxus, Chrysanthemum, Cinchona, Citrullus, Coffea, Colchicum, Coleus, Cucumis, Cucurbita, Cynodon, Datura, Dianthus, Digitalis, Dioscorea, Elaeis, Ephedra, Erianthus, Erythroxylum, Eucalyptus, Festuca, Fragaria, Galanthus, Glycine, Gossypium, Helianthus, Hevea, Hordeum, Hyoscyamus, Jatropha, Lactuca, Linum, Lolium, Lupinus, Lycopersicon, Lycopodium, Manihot, Medicago, Mentha, Miscanthus, Musa, Nicotiana, Oryza, Panicum, Papaver, Parthenium, Pennisetum, Petunia, Phalaris, Phleum, Pinus, Poa, Poinsettia, Populus, Rauwolfia, Ricinus, Rosa, Saccharum, Salix, Sanguinaria, Scopolia, Secale, Solanum, Sorghum, Spartina, Spinacea, Tanacetum, Taxus, Theobroma, Triticosecale, Triticum, Uniola, Veratrum, Vinca, Vitis*, and *Zea*.

The methods of the present invention are preferably used in plants that are important or interesting for agriculture, horticulture, biomass for the production of liquid fuel molecules and other chemicals, and/or forestry. Non-limiting examples include, for instance, *Panicum virgatum* (switchgrass), *Sorghum bicolor* (sorghum, sudangrass), *Miscanthus giganteus* (miscanthus), *Saccharum* sp. (energycane), *Populus balsamifera* (poplar), *Zea mays* (corn), *Glycine max* (soybean), *Brassica napus* (canola), *Triticum aestivum* (wheat), *Gossypium hirsutum* (cotton), *Oryza sativa* (rice), *Helianthus annuus* (sunflower), *Medicago sativa* (alfalfa), *Beta vulgaris* (sugarbeet), *Pennisetum glaucum* (pearl millet), *Panicum* spp., *Sorghum* spp., *Miscanthus* spp., *Saccharum* spp., *Erianthus* spp., *Populus* spp., *Andropogon gerardii* (big bluestem), *Pennisetum purpureum* (elephant grass), *Phalaris arundinacea* (reed canarygrass), *Cynodon dactylon* (bermudagrass), *Festuca arundinacea* (tall fescue), *Spartina pectinata* (prairie cord-grass), *Arundo donax* (giant reed), *Secale cereale* (rye), *Salix* spp. (willow), *Eucalyptus* spp. (eucalyptus), *Triticosecale* spp. (triticum—wheat X rye), Bamboo, *Carthamus tinctorius* (safflower), *Jatropha curcas* (jatropha), *Ricinus communis* (castor), *Elaeis guineensis* (palm), *Linum usitatissimum* (flax), *Brassica juncea, Manihot esculenta* (cassava), *Lycopersicon esculentum* (tomato), *Lactuca sativa* (lettuce), *Musa paradisiaca* (banana), *Solanum tuberosum* (potato), *Brassica oleracea* (broccoli, cauliflower, brusselsprouts), *Camellia sinensis* (tea), *Fragaria ananassa* (strawberry), *Theobroma cacao* (cocoa), *Coffea arabica* (coffee), *Vitis vinifera* (grape), *Ananas comosus* (pineapple), *Capsicum annum* (hot & sweet pepper), *Allium cepa* (onion), *Cucumis melo* (melon), *Cucumis sativus* (cucumber), *Cucurbita maxima* (squash), *Cucurbita moschata* (squash), *Spinacea oleracea* (spinach), *Citrullus lanatus* (watermelon), *Abelmoschus esculentus* (okra), *Solanum melongena* (eggplant), *Papaver somniferum* (opium poppy), *Papaver orientale, Taxus baccata, Taxus brevifolia, Artemisia annua, Cannabis sativa, Camptotheca acuminate, Catharanthus roseus, Vinca rosea, Cinchona officinalis, Colchicum autumnale, Veratrum californica., Digitalis lanata, Digitalis purpurea, Dioscorea* spp., *Andrographis paniculata, Atropa belladonna, Datura stomonium, Berberis* spp., *Cephalotaxus* spp., *Ephedra sinica, Ephedra* spp., *Erythroxylum coca, Galanthus wornorii, Scopolia* spp., *Lycopodium serratum* (=*Huperzia serrata*), *Lycopodium* spp., *Rauwolfia serpentina, Rauwolfia* spp., *Sanguinaria canadensis, Hyoscyamus* spp., *Calendula officinalis, Chrysanthemum parthenium, Coleus forskohlii, Tanacetum parthenium, Parthenium argentatum* (guayule), *Hevea* spp. (rubber), *Mentha spicata* (mint), *Mentha piperita* (mint), *Bixa orellana, Alstroemeria* spp., *Rosa* spp. (rose), *Dianthus caryophyllus* (carnation), *Petunia* spp. (petunia), *Poinsettia pulcherrima* (poinsettia), *Nicotiana tabacum* (tobacco), *Lupinus albus* (lupin), *Uniola paniculata* (oats), bentgrass (*Agrostis* spp.), *Populus tremuloides* (aspen), *Pinus* spp. (pine), *Abies* spp. (fir), *Acer* spp. (maple), *Hordeum vulgare* (barley), *Poa pratensis* (bluegrass), *Lolium* spp. (ryegrass), *Phleum pratense* (timothy), and conifers. Of interest are plants grown for energy production, so called energy crops, such as cellulose-based energy crops like *Panicum virgatum* (switchgrass), *Sorghum bicolor* (sorghum, sudangrass), *Miscanthus giganteus* (miscanthus), *Saccharum* sp. (energycane), *Populus balsamifera* (poplar), *Andropogon gerardii* (big bluestem), *Pennisetum purpureum* (elephant grass), *Phalaris arundinacea* (reed canarygrass), *Cynodon dactylon* (bermudagrass), *Festuca arundinacea* (tall fescue), *Spartina pectinata* (prairie cord-grass), *Medicago sativa* (alfalfa), *Arundo donax* (giant reed), *Secale cereale* (rye), *Salix* spp. (willow), *Eucalyptus* spp. (eucalyptus), *Triticosecale* spp. (triticum—wheat X rye), and Bamboo; and starch-based energy crops like *Zea mays* (corn) and *Manihot esculenta* (cassava); and sucrose-based energy crops like *Saccharum* sp. (sugarcane) and *Beta vulgaris* (sugarbeet); and biodiesel-producing energy crops like *Glycine max* (soybean), *Brassica napus* (canola), *Helianthus annuus* (sunflower), *Carthamus tinctorius* (safflower), *Jatropha curcas* (jatropha), *Ricinus communis* (castor), *Elaeis guineensis* (palm), *Linum usitatissimum* (flax), and *Brassica juncea*. Thus, the described materials and methods are useful for modifying biomass characteristics, such as characteristics of biomass renewable energy source plants. A biomass renewable energy source plant is a plant having or producing material (either raw or processed) that comprises stored solar energy that can be converted to electrical energy, liquid fuels, and other useful chemicals. In general terms, such plants comprise dedicated energy crops as well as agricultural and woody plants. Examples of biomass renewable energy source plants include: *Panicum virgatum* (switchgrass), *Sorghum bicolor* (sorghum, sudangrass), *Miscanthus giganteus* (miscanthus), *Saccharum* sp. (energycane), *Populus balsamifera* (poplar), *Andropogon gerardii* (big bluestem), *Pennisetum purpureum* (elephant grass), *Phalaris arundinacea* (reed canarygrass), *Cynodon dactylon* (bermudagrass), *Festuca arundinacea* (tall fescue), *Spartina pectinata* (prairie cord-grass), *Medicago sativa* (alfalfa), *Arundo donax* (giant reed), *Secale cereale* (rye), *Salix* spp. (willow), *Eucalyptus* spp. (eucalyptus), *Triticosecale* spp. (triticum—wheat X rye), Bamboo, *Zea mays* (corn), *Manihot esculenta* (cassava), *Saccharum* sp. (sugarcane), *Beta vul-*

*garis* (sugarbeet), *Glycine max* (soybean), *Brassica napus* (canola), *Helianthus annuus* (sunflower), *Carthamus tinctorius* (safflower), *Jatropha curcas* (j atropha), *Ricinus communis* (castor), *Elaeis guineensis* (palm), *Linum usitatissimum* (flax), and *Brassica juncea*.

Homologues Encompassed by the Invention

It is known in the art that one or more amino acids in a sequence can be substituted with other amino acid(s), the charge and polarity of which are similar to that of the substituted amino acid, i.e. a conservative amino acid substitution, resulting in a biologically/functionally silent change. Conservative substitutes for an amino acid within the polypeptide sequence can be selected from other members of the class to which the amino acid belongs. Amino acids can be divided into the following four groups: (1) acidic (negatively charged) amino acids, such as aspartic acid and glutamic acid; (2) basic (positively charged) amino acids, such as arginine, histidine, and lysine; (3) neutral polar amino acids, such as serine, threonine, tyrosine, asparagine, and glutamine; and (4) neutral nonpolar (hydrophobic) amino acids such as glycine, alanine, leucine, isoleucine, valine, proline, phenylalanine, tryptophan, cysteine, and methionine.

Nucleic acid molecules of the present invention can comprise sequences that differ from those encoding a protein or fragment thereof selected from the group consisting of the nucleotide sequences in the sequence listing due to the fact that the different nucleic acid sequence encodes a protein having one or more conservative amino acid changes.

Biologically functional equivalents of the polypeptides, or fragments thereof, of the present invention can have about 10 or fewer conservative amino acid changes, more preferably about 7 or fewer conservative amino acid changes, and most preferably about 5 or fewer conservative amino acid changes. In a preferred embodiment of the present invention, the polypeptide has between about 5 and about 500 conservative changes, more preferably between about 10 and about 300 conservative changes, even more preferably between about 25 and about 150 conservative changes, and most preferably between about 5 and about 25 conservative changes or between 1 and about 5 conservative changes.

Identification of Useful Nucleic Acid Molecules and Their Corresponding Nucleotide Sequences The nucleic acid molecules and nucleotide sequences thereof of the present invention were identified as functional homologs of other sequences of established function and utility. The other sequences and their established function come from public and proprietary sources. For example, in some cases the properties of these sequences were established by use of a variety of screens that are predictive of nucleotide sequences that provide plants with altered size, vegetative growth, organ number, plant architecture, biomass, and/or enhanced resistance to various abiotic or biotic stresses. In other cases, characteristics of similar sequences are known from scientific and technical literature readily accessible to those of skill in the art.

Functional homologs/orthologs from *Panicum virgatum* for each gene of interest, which in many cases may be capable of modulating growth and phenotype characteristic when transformed in plants. The "Determination of Functional Homolog/Ortholog Sequences" process described below can be used to identify functional homologs/orthologs. Functional homologs/orthologs of a sequence of interest are understood to affect similar phenotype(s) as observed for the respective sequence of interest when their expression is modulated in plants.

Determination of Functional Homolog/Ortholog Sequences

A subject sequence is considered a functional homolog or ortholog of a query sequence if the subject and query sequences encode proteins having a similar function and/or activity. A process known as Reciprocal BLAST (Rivera et al., *Proc. Natl. Acad. Sci. USA*, 95:6239-6244 (1998)) was used, for many of the sequences provided, to identify potential functional homolog and/or ortholog sequences from a database consisting of Ceres-Inc. proprietary peptide sequences from *Panicum virgatum*.

Before starting a Reciprocal BLAST process, a specific query polypeptide is searched against all peptides from its source species using BLAST in order to identify polypeptides having BLAST sequence identity of 80% or greater to the query polypeptide and an alignment length of 85% or greater along the shorter sequence in the alignment. The query polypeptide and any of the aforementioned identified polypeptides are designated as a cluster.

The BLASTP version 2.0 program from Washington University at Saint Louis, Mo., USA is used to determine BLAST sequence identity and E-value. The BLASTP version 2.0 program includes the following parameters: 1) an E-value cutoff of 1.0e-5; 2) a word size of 5; and 3) the -postsw option. The BLAST sequence identity is calculated based on the alignment of the first BLAST HSP (High-scoring Segment Pairs) of the identified potential functional homolog and/or ortholog sequence with a specific query polypeptide. The number of identically matched residues in the BLAST HSP alignment is divided by the HSP length, and then multiplied by 100 to get the BLAST sequence identity. The HSP length typically includes gaps in the alignment, but in some cases gaps can be excluded.

The main Reciprocal BLAST process consists of two rounds of BLAST searches; forward search and reverse search. In the forward search step, a query polypeptide sequence, "polypeptide A," from source species SA (such as Arabidopsis) is BLASTed against all Ceres-Inc. proprietary peptide sequences from *Panicum virgatum*. Top hits are determined using an E-value cutoff of $10^{-5}$ and a sequence identity cutoff of 35%. Among the top hits, the sequence having the lowest E-value is designated as the best hit, and considered a potential functional homolog or ortholog. Any other top hit that has a high BLAST sequence identity to the best hit or to the original query polypeptide is considered a potential functional homolog or ortholog as well.

In the reverse search round, the top hits identified in the forward search from *Panicum virgatum* are BLASTed against all protein sequences from the source species SA. A top hit from the forward search that returns a polypeptide from the aforementioned cluster as its best hit is also considered as a potential functional homolog or ortholog.

Functional homologs and/or orthologs are identified by manual inspection of potential functional homolog and/or ortholog sequences. In some cases identification is based on known correlations between sequence domains and functions for specific classes of biomolecules.

Information in the Sequence Listing

The switchgrass sequences provided in the Sequence Listing are annotated to indicate one or several potential applications of the respective sequences. Some sequences are enzymes, i.e. catalysts of specific chemical or biochemical reactions, and their activity is indicated by enzyme classification (EC) numbers. The EC numbers used in the sequence listing correspond to the swissprot enzyme classification system, as found on the World Wide Web. Some sequences contain "pfam" domains which are indicative of particular applications. The specific pfam domains are described in more detail by various sources on the World Wide Web.

Some switchgrass sequences in the Sequence Listing are annotated in the "miscellaneous features" section as functional homologs of known sequences, and associated traits that could be modulated by the respective sequences in transgenic plants. In this context "great-hit" denotes a BLAST hit from a forward search that returns a polypeptide from the query cluster as its best hit in the reverse BLAST search, as explained above. Known sequence-function associations are sometimes based at least in part on literature documentation. In some cases, the known query sequences are not reproduced in the sequence listing, but it is identified by literature reference, such as by reference to specific sequences in patent publications or *Arabidopsis* locus numbers. If desired, sequence information for these designations may be obtained from various sources, such as the EMBL sequence database or *Arabidopsis* database available on the World Wide Web. In some cases, query sequences such as SEQ ID NOs: 9177-9762 are provided in the sequence listing, along with information pertinent to observed transgenic plant traits. When a listed query sequence is a truncation of a known coding region, those of skill in the art could design if necessary an equivalent truncation of the corresponding switchgrass functional homologs to obtain the indicated phenotype.

Modulated growth and phenotype characteristics for some of the sequences of the invention are noted by entries in the "miscellaneous feature" section for the respective nucleic acid and/or polypeptide sequence in the Sequence Listing. Valuable applications of the respective sequences are also sometimes noted in the Sequence Listing. In many cases, traits were originally associated with known sequences by misexpression or other transgenic or genetic interference with specific gene functions. For some sequences, plants were transformed with the genes of interest and screened for modulated morphological characteristics, as described, for example in PCT/US2005023326 or PCT/US2005/047099. When applicable, phenotypic observations for transformants are noted in the Sequence Listing. For some sequences, transgenic trait associations were suggested by results of screening transgenic plants for tolerance to specific stress conditions. Screening procedures and some results are exemplified in PCT/US2005/018950, PCT/US2005/018912, PCT/US2005/014197, or PCT/US2006/040572. Other methods are exemplified by references cited in the Sequence Listing or below.

From the disclosure of the Sequence Listing, it can be seen that the nucleotides and polypeptides of the inventions are useful, depending upon the respective individual sequence, to make plants with one or more altered characteristics in traits. For example, the sequences can be used, as noted in the sequence listing for the respective sequences, for biocontainment applications, for making ornamental plants with delayed petal abscission, alkaloid content, amino acid content, carbohydrate content, carbon content, carotene content, cell wall content and/or composition, glycerol content, lignin content, lutein content, lycopene content, nitrogen content, oil content, protein content, sterol content, terpenoid content, tocopherol content, enhanced nutritional value, high aluminum sensitivity, abiotic stress sensitivity, abscission, asexual embryo production, biomass, biotic stress sensitivity, carbohydrate content, carbon-nitrogen partitioning, cold sensitivity, drought sensitivity, endosperm cell number, endosperm cell size, endosperm size, flowering time, growth rate, heat sensitivity, herbicide sensitivity, high pH sensitivity, light quality response, light quality sensitivity, light response, light sensitivity, low iron sensitivity, low light sensitivity, nitrogen use efficiency, oxidative stress sensitivity, phosphate use efficiency, plant growth and development, root development, salt sensitivity, seed content, seed number, seed quality, seed size, seedling growth, silicon content, time to senescence, UV sensitivity, water use efficiency, yield.

Additionally, clone ids 1986288 (SEQ ID NO: 8028) and 1792286 (SEQ ID NO: 3570), are "useful for making plants with modulated flowering time." Furthermore, clone ids 1769278 (SEQ ID NO: 1674), 1797688 (SEQ ID NO: 4222), and 1891486 (SEQ ID NO: 6912) are "useful for making plants with modulated drought sensitivity."

Nucleotides and polypeptides that are useful for modulating plant characteristics in traits such as sterility, lethality and/or viability have been noted as "useful for biocontainment applications" or "useful for making plants with modulated asexual embryo production" in the Sequence Listing. Nucleotides and polypeptides that with this designation include those that are able to confer one or more of the following phenotypes, relative to wild-type control, when mis-expressed in plants: increased or decreased number of floral organs; alter floral organ type; reduced fertility; sterility, including female-sterility and/or male-sterility; alter how leaves emerge from the meristem; low/no seed germination; and reduced plant viability (e.g. albino plants and plants with vitrified leaves). The ability to modulate sterility, lethality, and/or viability is important in developing a genetic confinement system designed to reduce or prevent gene flow from transgenic pants to commercial crops and wild-type counterparts, making ornamental plants; and for other agricultural and/or horticultural purposes. Nucleotides and polynucleotides useful for developing a genetic confinement system can be utilized by procedures known to those skilled in the art, such as in US2005/0257293 A1, hereby incorporated by reference.

Some nucleotides and polypeptides are noted as being "useful for making plants with modulated biomass", "useful for making plants with modulated yield", "useful for making plants with modulated flowering time," "useful for making plants with modulated seed size", "useful for making plants with modulated time to senescence", "useful for making plants with modulated endosperm cell number", "useful for making plants with modulated endosperm cell size", "useful for making plants with modulated endosperm size", "useful for making plants with modulated growth rate", "useful for making plants with modulated seed content", "useful for making plants with modulated seed number", "useful for making plants with modulated seed quality", "useful for making plants with modulated plant growth and development." or "useful for making plants with modulated seedling growth" in the Sequence Listing. Nucleotides and polypeptides that have been given these designation include those that are able to confer one or more of the following phenotypes, relative to wild-type control, when mis-expressed in plants: increased or decreased plant size; increased or decreased plant height; increased or decreased leaf size; altered leaf shape; altered leaf structure; increased or decreased number of leaves; increased or decreased organ size; altered organ shape; increased or decreased organ number; increased or decreased branching length; increased or decreased branch number; increase or decrease petal abscission, increase or decrease in leaf abscission, increased or decreased apical dominance; and increased or decreased hypocotyls length. Altering plant biomass is valuable for increasing plant biomass produced per acre of arable land, increasing crop yield per acre of arable land, utilizing plants as chemical factories to produce valuable pharmaceutical compounds, developing a genetic confinement system designed to reduce or prevent gene flow from transgenic plants to commercial crops and wild-type counterparts, making ornamental plants; and for other agricultural and/or horticultural purposes.

Some nucleotides and polypeptides that are useful for modulating plant characteristics in traits such as the composition of a plant, plant material, plant tissue, plant cell and seed from a plant include those that have been given the designations "useful for making plants with altered alkaloid content", "useful for making plants with altered carbon content", "useful for making plants with modulated carbon-nitrogen partitioning", "useful for making plants with altered carotene content", "useful for making plants with modulated carbohydrate content", "useful for making plants with altered carbohydrate content", "useful for making plants with altered cell wall content and/or composition", "useful for making plants with altered glycerol content", "useful for making plants with altered lignin content", "useful for making plants with altered lutein content", "useful for making plants with altered lycopene content", "useful for making plants with altered nitrogen content", "useful for making plants with altered oil content", "useful for making plants with altered protein content", "useful for making plants with altered amino acid content", "useful for making plants with altered sterol content", "useful for making plants with altered terpenoid content", "useful for making plants with altered tocopherol content", "useful for making plants with modulated silicon content", or "useful for making plants with enhanced nutritional value" in the Sequence Listing. Nucleotides and polypeptides that have been given these designations include those that are able to confer one or more of the following phenotypes, relative to wild-type control, when mis-expressed in plants: increased or decreased carbon content; increased or decreased plant nitrogen content; altered color (indicative of change(s) to the chemical composition); altered metabolic profile, increased or decreased starch content, increased or decreased fiber content; increased or decreased amount of a valuable compound (e.g. increased alkaloids and/or terpenoids); increased or decreased number of trichomes; increased or decreased cotyledon size; increased or decreased cotyledon number; altered cotyledon shape; increased or decreased fruit size; increased or decreased fruit length; altered fruit shape; increased or decreased seed size; and altered seed shape; altered seed color (indicative of altered chemical composition); and having activated expression of a gene operably linked to an alkaloid or terpenoid related regulatory region or promoter. Altering characteristics such as the composition of a plant, plant organ, plant tissue and plant cell is valuable for improving the nutritional value of crops, improving the composition of plants to be used as bio-fuels, utilizing plants as chemical factories by increasing the content of valuable pharmaceutical compounds, producing plants with increased tolerance to abiotic or biotic stress, developing a genetic confinement system designed to reduce or prevent gene flow from transgenic plants to commercial crops and wild-type counterparts, making ornamental plants, and for other agricultural and/or horticultural purposes. Nucleotides and polynucleotides useful for developing plants with modified compositions can be utilized by procedures known to those skilled in the art, such as in PCT/US2006/014161, PCT/US2005/032680, PCT/US2006/0022851, PCT/US2005/44112, PCT/US2005/043562, PCT/US2006/41516, U.S. Ser. No. 60/838,646, U.S. Ser. No. 60/855,108, U.S. Ser. No. 60/854,825 PCT/US2006/360,459, PCT/US2007/061052, and PCT/US2007/002214, hereby incorporated by reference.

Some nucleotides and polypeptides that are useful for modulating plant characteristics in traits such as phosphate use include those that have been given the designation "Useful for making plants with modulated phosphate use efficiency", "useful for making plants with modulated high pH sensitivity", or "useful for making plants with high aluminum sensitivity", in the Sequence Listing. Nucleotides and polypeptides that have been given these designations include those that are able to confer one or more of the following phenotypes, relative to wild-type control, when mis-expressed in plants: increased or decreased tolerance to low phosphate conditions; increased or decreased tolerance to no phosphate conditions, and increased or decreased tolerance to high pH conditions. Altering characteristics such as phosphate use through genetic technologies is valuable for producing crop plants with increased tolerance to phosphate limiting conditions, using traditionally un-arable land to grow crop plants with increased tolerance to phosphate limiting conditions, developing a genetic confinement system designed to reduce or prevent gene flow from transgenic plants to commercial crops and wild-type counterparts, and for other agricultural and/or horticultural purposes. Nucleotides and polynucleotides useful for developing plants with modulated phosphate use efficiency can be utilized by procedures known to those skilled in the art, such as in PCT/US2005/018912, hereby incorporated by reference.

Nucleotides and polypeptides that are useful for modulating plant characteristics in traits such as light responses include those that have been given the designations "useful for making plants with modulated light quality response", "useful for making plants with modulated light quality sensitivity", "useful for making plants with modulated light response", "useful for making plants with modulated light sensitivity", "useful for making plants with modulated UV sensitivity", "useful for making plants with modulated low light sensitivity" in the Sequence Listing. Nucleotides and polypeptides that have been given these designations include those that are able to confer one or more of the following phenotypes, relative to wild-type control, when mis-expressed in plants: increased or decreased vigor in the dark; increased or decreased seedling vigor under low light conditions; increased or decreased plant vigor under low light conditions; increased or decreased leaf length; altered leaf shape; altered leaf structure, and increased or decreased cotyledon length. Altering characteristics such as shade avoidance and shade tolerance through genetic technologies is valuable for producing plants with tolerance to light limiting conditions, increasing plant biomass produced per acre of arable land, increasing crop production per acre of arable land, developing a genetic confinement system designed to reduce or prevent gene flow from transgenic plants to commercial crops and wild-type counterparts, making ornamental plants, and for other agricultural and/or horticultural purposes. Nucleotides and polynucleotides useful for developing plants with light responses can be utilized by procedures known to those skilled in the art, such as in U.S. Ser. No. 60/799,404, U.S. Ser. No. 60/813,533, and U.S. Ser. No. 60/818,569, hereby incorporated by reference.

Nucleotides and polypeptides that are useful for modulating plant characteristics in traits such as nitrogen use include those that have been given the designation "Useful for making plants with modulated nitrogen use efficiency" in the Sequence Listing. Nucleotides and polypeptides that have been given the "Nitrogen use" designation include those that are able to confer one or more of the following phenotypes, relative to wild-type control, when mis-expressed in plants: increased or decreased tolerance to low nitrogen conditions and surrogate low nitrogen conditions (e.g. exposure to an effective amount of MSX); increased or decreased tolerance to no nitrogen conditions; increased tolerance to high nitrogen conditions. Altering nitrogen use through genetic technologies is valuable for producing plants with increased tolerance to high or low nitrogen conditions, decreasing the amount of fertilizers used in crop production, using traditionally un-arable land to grow crop plants with increased tolerance to high or low nitrogen conditions, developing a genetic confinement system designed to reduce or prevent gene flow from transgenic plants to commercial crops and wild-type counterparts, and for other agricultural and/or horticultural purposes. Nucleotides and polynucleotides useful for developing plants with improved nitrogen use efficiency can be utilized by procedures known to those skilled in the art, such as in PCT/US2005/014197, hereby incorporated by reference.

Nucleotides and polypeptides that are useful for modulating plant characteristics in traits such as stress tolerance include those that have been given the designations "useful for making plants with modulated cold sensitivity", "useful for making plants with modulated drought sensitivity", "useful for making plants with modulated heat sensitivity", "useful for making plants with modulated low iron sensitivity", "useful for making plants with modulated oxidative stress sensitivity", "useful for making plants with modulated root development", "useful for making plants with modulated water use efficiency", "useful for making plants with modulated salt sensitivity", "useful for making plants with modulated abiotic stress sensitivity", or "useful for making plants with modulated biotic stress sensitivity" in the Sequence Listing. Nucleotides and polypeptides that have been given these designation include those that are able to confer one or more of the following phenotypes, relative to wild-type control, when mis-expressed in plants: increased or decreased tolerance to drought and/or surrogate drought conditions (e.g. exposure to effective amounts of ABA, PEG, mannitol or sucrose); increased or decreased tolerance to low temperature conditions; increased or decreased tolerance to high temperature conditions; increased or decreased salt tolerance; increased or decreased tolerance to oxidative stressors and/or surrogate oxidative stressors (e.g. exposure to an effective amount of arginine, ozone, or salicylic acid); having leaves with shiny or dull appearance (indicative of altered wax composition and/or content); and increase or decrease pest resistance. Altering abiotic stress tolerance through genetic technologies is valuable for farmers seeking to minimize economic losses due to drought, cold, heat, flooding and oxidative stressors; producing crop plants with increased tolerance to abiotic stressors; using traditionally un-arable land to grow crop plants with increased tolerance to abiotic stressors; developing a genetic confinement system designed to reduce or prevent gene flow from transgenic plants to commercial crops and wild-type counterparts; making ornamental plants; and for other agricultural and/or horticultural purposes. Nucleotides and polynucleotides useful for developing plants with improved abiotic stress tolerance can be utilized by procedures known to those skilled in the art, such as in PCT/US2005/018950, U.S. Ser. No. 11/248,547, U.S. Ser. No. 60/837,434, U.S. Ser. No. 60/860,296, or U.S. Ser. No. 60/851,585, hereby incorporated by reference.

The phenotypes mentioned in the sequence listing can be modulated by controlling the expression of nucleic acid sequences and polypeptide sequences that confer phenotype(s) when mis-expressed in plants. Modulation of a phenotype can also be achieved by inhibiting the expression of nucleic acid sequences and polypeptide sequences that confer phenotype(s) when mis-expressed in plants. A phenotype resulting from the expression of a nucleic acid sequence and/or polypeptide sequence can be modulated (e.g. increase or decrease of an observable/measurable phenotypic change in relation to wild-type control) using recombinant-DNA methods, as discussed in previous paragraphs.

According to another aspect, the nucleotide sequences of the invention encode polypeptides that can be utilized as herbicide targets, those useful in the screening of new herbicide compounds. Thus, the proteins encoded by the nucleotide sequences provide the bases for assays designed to easily and rapidly identify novel herbicides.

According to yet another aspect, the present invention provides a method of identifying a herbicidal compound, comprising: (a) combining a polypeptide comprising an amino acid sequence at least 85% identical to an amino acid sequence selected from the group consisting of the polypeptides described in the sequence listing with a compound to be tested for the ability to inhibit the activity of said polypeptide, under conditions conducive to inhibition; (b) selecting a compound identified in (a) that inhibits the activity of said polypeptide; (c) applying a compound selected in (b) to a plant to test for herbicidal activity; (d) selecting a compound identified in (c) that has herbicidal activity. The polypeptide can alternatively comprise an amino acid sequence at least 90%, or at least 95%, or at least 99% identical to an amino acid sequence selected from the group consisting of the polypeptides in the sequence listing. The present invention also provides a method for killing or inhibiting the growth or viability of a plant, comprising applying to the plant a herbicidal compound identified according to this method.

The Sequence Listing sets forth the polypeptide and polynucleotide sequences of the invention, including, in many cases, functional homologs of specific query sequences. The Sequence Listing indicates which of the functional homologs are associated with each query sequence. Sequencing reads from the same clone are given the same clone id number. The 3' read of a clone will additionally have the "R" designation. Overlapped clones and 5' reads of a clone do not have the "R" designation."

The present invention further encompasses nucleotides that encode the above described polypeptides, such as those included in the sequence listing, as well as the complements and/or fragments thereof, and including alternatives thereof based upon the degeneracy of the genetic code.

The invention being thus described, it will be apparent to one of ordinary skill in the art that various modifications of the materials and methods for practicing the invention can be made. Such modifications are to be considered within the scope of the invention as defined by the following claims.

Each of the references from the patent and periodical literature cited herein is hereby expressly incorporated in its entirety by such citation.

REFERENCES (8) Zhang et al. (2004) *Plant Physiol.* 135:615.
(9) Salomon et al. (1984) *EMBO J.* 3:141.
(10) Herrera-Estrella et al. (1983) *EMBO J.* 2:987.
(11) Escudero et al. (1996) *Plant J.* 10:355.
(12) Ishida et al. (1996) *Nature Biotechnology* 14:745.
(13) May et al. (1995) *Bio/Technology* 13:486)
(14) Armaleo et al. (1990) *Current Genetics* 17:97.
(15) Smith. T. F. and Waterman, M. S. (1981) *Adv. App. Math.* 2:482.
(16) Needleman and Wunsch (1970) *J. Mol. Biol.* 48:443.
(17) Pearson and Lipman (1988) *Proc. Natl. Acad. Sci. (USA)* 85: 2444.
(18) Yamauchi et al. (1996) *Plant Mol Biol.* 30:321-9.

(19) Xu et al. (1995) *Plant Mol. Biol.* 27:237.
(20) Yamamoto et al. (1991) *Plant Cell* 3:371.
(21) P. Tijessen, "Hybridization with Nucleic Acid Probes" In Laboratory Techniques in Biochemistry and Molecular Biology, P. C. vand der Vliet, ed., c. 1993 by Elsevier, Amsterdam.
(22) Bonner et al., (1973) *J. Mol. Biol.* 81:123.
(23) Sambrook et al., Molecular Cloning: A Laboratory Manual, Second Edition, Cold Spring Harbor Laboratory Press, 1989, New York.
(24) Shizuya et al. (1992) *Proc. Natl. Acad. Sci. USA*, 89: 8794-8797.
(25) Hamilton et al. (1996) *Proc. Natl. Acad. Sci. USA*, 93: 9975-9979.
(26) Burke et al. (1987) *Science*, 236:806-812.
(27) Sternberg N. et al. (1990) *Proc Natl Acad Sci USA.*, 87:103-7.
(28) Bradshaw et al. (1995) *Nucl Acids Res*, 23: 4850-4856.
(29) Frischauf et al. (1983) *J. Mol Biol*, 170: 827-842.
(30) Huynh et al., Glover N M (ed) DNA Cloning: A practical Approach, Vol. 1 Oxford: IRL Press (1985).
(31) Walden et al. (1990) *Mol Cell Biol* 1: 175-194.
(32) Vissenberg et al. (2005) *Plant Cell Physiol* 46:192.
(33) Husebye et al. (2002) *Plant Physiol* 128:1180.
(34) Plesch et al. (2001) *Plant J* 28:455.
(35) Weising et al. (1988) *Ann. Rev. Genet.*, 22:421.
(36) Christou (1995) *Euphytica*, v. 85, n. 1-3:13-27.
(37) Newell (2000)
(38) Griesbach (1987) *Plant Sci.* 50:69-77.
(39) Fromm et al. (1985) *Proc. Natl. Acad. Sci. USA* 82:5824.
(40) Paszkowski et al. (1984) *EMBO J.* 3:2717.
(41) Klein et al. (1987) *Nature* 327:773.
(42) Willmitzer, L. (1993) Transgenic Plants. In: iotechnology, A Multi-Volume Comprehensive treatise (H. J. Rehm, G. Reed, A. Püler, P. Stadler, eds., Vol. 2, 627-659, VCH Weinheim-New York-Basel-Cambridge).
(43) *Crit. Rev. Plant. Sci.* 4:1-46.
(44) Fromm et al. (1990) *Biotechnology* 8:833-844.
(45) Cho et al. (2000) *Planta* 210:195-204.
(46) Brootghaerts et al. (2005) *Nature* 433:629-633.
(47) Lincoln et al. (1998) *Plant Mol. Biol. Rep.* 16:1-4.
(48) Lacomme et al. (2001), "Genetically Engineered Viruses" (C. J. A. Ring and E. D. Blair, Eds). Pp. 59-99, BIOS Scientific Publishers, Ltd. Oxford, UK.

SEQUENCE LISTING (51846 sequences)

SEQ ID NO: 1 - DNA, 637 bp, Panicum virgatum
  misc_feature: Ceres CLONE 1717296
  misc_feature: Encodes the peptide sequence at SEQ ID NO. 2
atcgctagagtcggagtctcggagagatgcggggaatcggaggtccgctcctcaccatcggggatctcctcagcgacctcgccgtcgacggcggcgatgatcccctcgccgctggcggagatgcgtccgttccctcctctccctcggcggcacaacaggcgggggaagccgacccgtccgacctcagccggctcttcgaggaacactacaacaatttgatgaaggcgctccaagataacgatccttcatggccatcgctgatgctgaagctatgcgcggcgttgaaggctgcagataagctggtgagctccgcgaacacagatgctgagcagttgatggagaaggtgaaagtgctggagggcgtcctcgagagaggagatcgcgcggtggaacagattgtagaaagtctccagaggtcaggcctcgccaaggatcatcggagttcccaatcgaaatcggctagcaagtagtggcatagtggtgcgctcgtgtgggcctgtgtttgtcttgcaaatgtgggctcttgtcactgatcttgggtattgaaaagagttgtatatcgatctttgatcatgaactcctacagtctgcttgtgctttagcgctgctggaatctcagaaaaaaaaaaaaaaaaaa

SEQ ID NO: 2 - protein, 147 aa, Panicum virgatum
  misc_feature: Ceres CLONE 1717296
  misc_feature: Great-hit functional homolog of the protein sequence given in SEQ ID NO 9314
  misc_feature: Useful for biocontainment applications
MRGIGGPLLTIGDLLSDLAVDGGDDPLAAGGDASVPSSPSAAQQAGEADPSDLSRLFEEHYNNLMKALQDNDPSWPSLMLKLCAALKAADKLVSSANTDAEQLMEKVKVLEGVLERGDRAVEQIVESLQRSGLAKDHRSSQSKSASK

SEQ ID NO: 3 - DNA, 543 bp, Panicum virgatum
  misc_feature: Ceres CLONE 1717491
  misc_feature: Encodes the peptide sequence at SEQ ID NO. 4
attaaggcttggtgatatcaataaagatgaggcatcctgccgttctgcactcattccttcctagccaggccactgtagaataaaagcaacatgaagaagcagcggatcctgctccatgttctcttcttcgtcttcctcttcatcctcatggctgcccttgctgttgatgctgatgatccacaggagctgcaggagcagcatcgatccctgctccaggctcccccaaagatagactgcccgtcaagctgcatggtgcgctgcggcagaaactggaagaacaagatgtgcaacaagatgtgcaacgtctgctgcaaccgctgcagctgcgtcccgccaggcaccggccaggagacacgccacctctgcccctgctatgacaccatggtcaacccaaaaaccggcaagcccaagtgcccgtagcctggtgcctcaggccaatctggcaatttctgccgttcgtgttatctatgtatgctatcatcttcatgttaactatatcaactgatgataaataaacaccagactttctcctcattcatgatc

SEQ ID NO: 4 - protein, 109 aa, Panicum virgatum
  misc_feature: Ceres CLONE 1717491
  misc_feature (3)..(108): Pfam Name: GASA Pfam Description: Gibberellin regulated protein
MKKQRILLHVLFFVFLFILMAALAVDADDPQELQEQHRSLLQAPPKIDCPSSCMVRCGRNWKNKMCNKMCNVCCNRCSCVPPGTGQETRHLCPCYDTMVNPKTGKPKCP

SEQ ID NO: 5 - DNA, 640 bp, Panicum virgatum
  misc_feature: Ceres CLONE 1719358
  misc_feature: Encodes the peptide sequence at SEQ ID NO. 6
aacacacagcaacaagctactgctcgctagaacacaagacgcaaagagtttctacaggaaacagggagctgaagcgccaagcgaagcgaccatgaagagcagcacgctcctggtgctcctgtgcctgcaggccgccctggtcatggggatcttcgcagccgtggcaaaagaaaatgccgtggtcgagagcaaggccatcgacatcaacccgggtcagctcaagtgctgcaccaactgcaacttctccttctcggggctctacacctgcgacgacgtcaagaaggactgcgaccccgtctgcaagaagtgcgtcgccgtcaagacctactccggcaacaagttcaggtgcaccgacaccttcctcggcatctgcggacccaagtgctagactagatgcatgagccaccatcccagcatgggcagctgctggatcgaatttggtgcatgaccgaggccatgcggtcctccgatcctactacacgagcatacataagattattgtgtgttgtgagtttgtgtcattgtgtaatggtacgtgcttgttctcgacgatgcacgcgaacaataagccgttgtttgcgataaataaaagtgatgcagcatgcaaaagttacgttttgaaaaaaaaaaaaaaaaaaaa

SEQ ID NO: 6 - protein, 98 aa, Panicum virgatum
  misc_feature: Ceres CLONE 1719358
  misc_feature (1)..(23): Pfam Name: Bowman-Birk_leg Pfam Description: Bowman-Birk serine protease inhibitor family
MKSSTLLVLLCLQAALVMGIFAAVAKENAVVESKAIDINPGQLKCCTNCNFSFSGLYTCDDVKKDCDPVCKKCVAVKTYSGNKFRCTDTFLGICGPKC

SEQ ID NO: 7 - DNA, 857 bp, Panicum virgatum
  misc_feature: Ceres CLONE 1719435
  misc_feature: Encodes the peptide sequence at SEQ ID NO. 8
cccacgagccacgactccctccccttccccttcccccatccgctcatcgcctccgggtttgcgctcccagcctcccacagcctcgtgccttctcctcgatcgaccgatccgcgtcgccgccgttgccgcgaggatggagcagaccttcatcatgatcaagcccgacggcgtccagcggggcctgatcggggacatcatcagtcggttcgagaagaaagggttctacctcaaggggatgaagtttatgaatgtggagaggtcctttgcacagcagcactacgctgacctttctgacaagcccttctttcctgggttggtggagtacattatttctggacctgttgtcgcaatggtgtgggaggggaaggacgttgtgttgactggccgcaggataattggggccaccaggccttgggaggctgctcctggcaccatccgtggtgactatgccgttgaagttggcaggaatgtcatccatggaagtgactcggtggacaatgcaaagaaggagattgctctttggttcccttcaggtgtggcagagtggagaagcaaccttcatccctggatctatgaggcttaagcttcgaggtactactggaagtgtggtttcctttaaaattgagtttttccttgaagttatcggttggctctagctgtggagtcatgtccagtgttttgtggtatatagaacagttaaatgtgcctgaaggctgaagccctgaacttggtggcattcgtgtttttttctttgttcctgctttaatattttaatctactgtaattgcaaaccagttaatgagatctgaaataaaatgtcgacctggtatttgctagaaaaaaaaaaaaaaaaaaaa

SEQ ID NO: 8 - protein, 149 aa, Panicum virgatum
  misc_feature: Ceres CLONE 1719435
  misc_feature (1)..(134): Pfam Name: NDK Pfam Description: Nucleoside diphosphate kinase
  misc_feature (1)..(149): SWISSPROT Homolog: EC 2.7.4.6 Nucleoside diphosphate kinase 1
MEQTFIMIKPDGVQRGLIGDIISRFEKKGFYLKGMKFMNVERSFAQQHYADLSDKPFFPGLVEYIISGPVVAMVWEGKDVVLTGRRIIGATRPWEAAPGTIRGDYAVEVGRNVIHGSDSVDNAKKEIALWFPSGVAEWRSNLHPWIYEA

SEQ ID NO: 9 - DNA, 599 bp, Panicum virgatum
  misc_feature: Ceres CLONE 1719488
  misc_feature: Encodes the peptide sequence at SEQ ID NO. 10
cttcccccaaacaaacaaatttgccactgcaagtcccaaccctaatcaatcctctcctcggattcagatccctccattggatatcctcttctcctctccgtcggagcaaggccacggatctctctatcagtggccatggacgatgaggaacttgttgatcaaaagaagtatcttgaggaacgatgcaagccacagtgtgtaaaatcactttatgagtatgataaatgtgtcaagagagtcgagaatgatgatactgggcacaaacactgcaccgggcaatattttgattactggtcatgcatcgacaaatgtagcaccaaagctgtttaagaagctaaaatgatgtctgtggtgcttttggcaagtgattctgatgatatcatgatgctactttcagcgagcgacttatccatttgtgtgaaccttggtgcctttggaaccgggctgagctcacgaactgttatgcttgtgccttgattctgtgaacttgtaataaatcaacaattttccttcgcaagcatgtgtgttcctctggacttgacatggataagttgatgtttggtgaatctaatgtcatttgccccagtgccattccttcg

SEQ ID NO: 10 - protein, 64 aa, Panicum virgatum
  misc_feature: Ceres CLONE 1719488
  misc_feature (1)..(59): SWISSPROT Homolog: EC 1.10.2.2 Ubiquinol-cytochrome c reductase complex 7.8 kDa protein
MDDEELVDQKKYLEERCKPQCVKSLYEYDKCVKRVENDDTGHKHCTGQYFDYWSCIDKCSTKAV

SEQ ID NO: 11 - DNA, 683 bp, Panicum virgatum
  misc_feature: Ceres CLONE 1719493
  misc_feature: Encodes the peptide sequence at SEQ ID NO. 12
gataaactgataaacgcatctggagattaataccgccccactacctccggtcgcaattcacagcagaaacgccgccgcccacagaaaagccgtcgagtccaggagacagtcggaggagaagagaaggatgggtttcgagaaggagatcctgagagccggcaccggccccaagccgacaaagggccagaaggtcaccgtccactgcaccggctacgggaaggatcgtgatctatccaagaaattttggagcaccaaggaccctggtcagcaaccattcagtttcaacattggtctgggttcagtgatcaaaggatgggatgagggagttatgaccatgcaagtgggtgaagttgctcgtatccagtgcaccccggactatgcttatggagccagcggatttccagcctggggaattcaaccaaactcggtgctggtattcgagattgaggtcctcagtgcccagtaattcgcgttgcaattctggatggagccatctttcaaaaaaaaatctggatggagcctttgcctcttgagtactgaaataaatccattgtcacctcatgctacatgcagcagactgttgttcttagtaaatcctgttaaactttaacactgtgtggccgtgatacatcgggtttatgaaatttcttgtggtacgactcttaaaaaaaaaaaaaaaaaaa

SEQ ID NO: 12 - protein, 112 aa, Panicum virgatum
  misc_feature: Ceres CLONE 1719493
  misc_feature (1)..(99): Pfam Name: FKBP_C Pfam Description: FKBP-type peptidyl-prolyl cis-trans isomerase
  misc_feature (1)..(112): SWISSPROT Homolog: EC 5.2.1.8 Peptidyl-prolyl isomerase FKBP12
MGFEKEILRAGTGPKPTKGQKVTVHCTGYGKDRDLSKKFWSTKDPGQQPFSFNIGLGSVIKGWDEGVMTMQVGEVARIQCTPDYAYGASGFPAWGIQPNSVLVFEIEVLSAQ

SEQ ID NO: 13 - DNA, 843 bp, Panicum virgatum
  misc_feature: Ceres CLONE 1719496
  misc_feature: Encodes the peptide sequence at SEQ ID NO. 14
aacaacgctgcccttttccccatccccctctctccctccctgattcaatccgtctcgttcttagacctaggatttggggatctggaggggtacgatcgcgcctcgccgcgaatttgcttctggggacgaacggatctcggatcgtgttctccgggagcttcttaaagaccaataaatcaaagcgtgatcagctcggtgccaatcaaacctcaacaaccaagtttcatgtctgatctcgacgtccagcttccatctgccttcgacccgtttgctgaggcaaatgctgaggactctggtgctggcccgggaacaaaggattatgtgcatgtgcgcatccagcaacgcaacggcagaaagagtctgacgactgttcagggactaaagaaagagttcagctacaacaagatcctcaaggatctcaagaaggaattctgctgcaatggtactgtagttcaggatccagagctaggacaggttattcagctccaaggtgatcagcgtaagaatgttgccactttcctagttcaggctgggattgcaaagaaggagaacatcaagattcacgggttctaagggacctgtaaatgcttgtgtgcgctattgcgcgcgttaccgcatatttggaagcttgaagcagtgatattatagttactgctttctataacaacataagtattgtgctattatcagtgtgttttgcttgatgcaagttgtgttttctcctcattatgcgccaccagcatatgggtatggcttgtatggaatattgttgccaccttgataaaagtactccctatttggttataatgcttgatgtttgtctcaaaaaaaaaaaaaaaaaaa

SEQ ID NO: 14 - protein, 115 aa, Panicum virgatum
  misc_feature: Ceres CLONE 1719496
  misc_feature: Great-hit functional homolog of the protein sequence given in SEQ ID NO 9555
  misc_feature: Useful for making plants with modulated biomass
  misc_feature: Useful for making plants with modulated flowering time
  misc_feature: The plant flowers significantly earllier than wild-type.
  misc_feature: The plant is abnormally small.
MSDLDVQLPSAFDPFAEANAEDSGAGPGTKDYVHVRIQQRNGRKSLTTVQGLKKEFSYNKILKDLKKEFCCNGTVVQDPELGQVIQLQGDQRKNVATFLVQAGIAKKENIKIHGF

SEQ ID NO: 15 - DNA, 1105 bp, Panicum virgatum
  misc_feature: Ceres CLONE 1719533
  misc_feature: Encodes the peptide sequence at SEQ ID NO. 16
attcgacccataagcttttgcgatccctcccactcccaccgccgcatcgcattctccgatccggagctctctgctcgcagccatggcgaagtgctacccgaccgtgagcgccgagtaccaggaggccgtcgagaaggccaggcgcaagctccgcgccctcatcgccgagaagagctgcgcccctctcatgctccgtctcgcgtggcactcggcggggacgttcgacgtgtcctctaagaccggcggccccttcggtacgatgaagaacccggcggagcaggcgcacggcgccaacgcgggtctggacatcgccgtgcggatgttcgagcccgtcaaggaggagttccccatcctctcctacgccgatctgtaccagcttgcgggagttgtggccgtggaggtgaccggtggacctgaggtccccttccaccccggtagggaggacaagcctcagcccccacctgagggccgccttcctgatgctactaagggttctgaccatctgaggcaagtctttggcaagcagatgggcttgagcgatcaggacattgttgccctctctggtggccactccttgggaaggtgccacaaggagcgatctggttttgaggggccctggactagaaaccctttggtctttgacaactcttacttcaaggaacttctgagtggtgacaaagagggcctccttcagcttccaagtgacaaagccctgctgagcgaccctgtcttccgccctcttgtggagaaatatgctgcggatgagaaggctttctttgatgactacaaggaggcccacctcaagctctctgaactggggtttgctgatgcgtaaatggcgtatcctagactactacgtgctgctgcttgtatgggatcatgtaattttgttttgcatctggagtcagtgtgaaccagcagattaagtatcttgtttttaataaatttgttaccctgcccatggccattattgatactttgtcgatgtttgaatggggggtgtttggctagactctgatgctgtatgtcactgaaactacaagatctatgatctaccttatgaatgcagtacgttctgttgcctcaaaaaaaaaaaaaaaaaaaa

SEQ ID NO: 16 - protein, 250 aa, Panicum virgatum
  misc_feature: Ceres CLONE 1719533
  misc_feature (1)..(209): Pfam Name: peroxidase Pfam Description: Peroxidase
  misc_feature (1)..(250): SWISSPROT Homolog: EC 1.11.1.11 L-ascorbate peroxidase 1, cytosolic
  misc_feature (2)..(249): SWISSPROT Homolog: EC 1.11.1.11 L-ascorbate peroxidase 2, cytosolic
MAKCYPTVSAEYQEAVEKARRKLRALIAEKSCAPLMLRLAWHSAGTFDVSSKTGGPFGTMKNPAEQAHGANAGLDIAVRMFEPVKEEFPILSYADLYQLAGVVAVEVTGGPEVPFHPGREDKPQPPPEGRLPDATKGSDHLRQVFGKQMGLSDQDIVALSGGHSLGRCHKERSGFEGPWTRNPLVFDNSYFKELLSGDKEGLLQLPSDKALLSDPVFRPLVEKYAADEKAFFDDYKEAHLKLSELGFADA

SEQ ID NO: 17 - DNA, 1074 bp, Panicum virgatum
  misc_feature: Ceres CLONE 1719600
  misc_feature: Encodes the peptide sequence at SEQ ID NO. 18
agccaccccgcagatccccaattcgtttcctccgagccgagctgcgacggccgcggccgcggcgtctccctccgtcccgccactgcaggtctacccctaagtgaattttttatgcaagtcaaatcagggtctttaaggtagctttctgaaatgtggggttttgcatcaaatgcttggacatctgggctgggaaagaggagtcctccaaattgcgcctctcccagtgctgcttgttctgatgacgaggcatcctcatgcacaagcagggaagaaggcctggaatgcccaatatgttgggaatctttcaacatagtggagaacgtgccttatgtgctttggtgcggccacagcatgtgcaagaactgcatcctaggccttcaatgggctgtcatcaaagttccaacggtaccaatccagcttccattcttcatctgctgtccctggtgcaacctcctgtcactccgtatattttacaaagggaacctcatattcccacgcaagaattacttcctcctttggatggttgaggggatgaatggtgagcgtgcacgatcacgctctgttattcataatgagcaacatactccatggctcccaagcagcagcagatcaaatggaaatgcaggttgtgcaaaccccattcgacggcccctcccgccacaggctgacacatccagtgcaaatcacgctaaccatgggatccctctcctgaactctgagagggtgcaagcttcgctgcgcaagtcgctgtcattcctggttcacctgactgccaagtttcccctggtgttcatcttcctcctcatagttctgtatgcgatcccagccagcgcagcggtcttgttattgtacacccttatcactgtattgtttgcacttccctcgttcttgatactgtattttgcctatccaagcctagactggcttgttagagaaatatttgcttgagatttccttgttaggcgaaatctcaatgctgttgtttgatctgtgtaaccgaactccctagtatttgttgtaagtgcaaatatattgcaatgttttggcttcgaccaaaaaaaaaaaaaaaaaaaa

SEQ ID NO: 18 - protein, 265 aa, Panicum virgatum
  misc_feature: Ceres CLONE 1719600
  misc_feature: Great-hit functional homolog of the protein sequence given in SEQ ID NO 9182
  misc_feature: Great-hit functional homolog of the protein sequence given in SEQ ID NO 9290
  misc_feature: Useful for biocontainment applications
  misc_feature: Useful for making plants with altered alkaloid content
  misc_feature: Useful for making plants with altered protein content
  misc_feature: The plant produces a reduced number of seeds.
MWGFASNAWTSGLGKRSPPNCASPSAACSDDEASSCTSREEGLECPICWESFNIVENVPYVLWCGHSMCKNCILGLQWAVIKVPTVPIQLPFFICCPWCNLLSLRIFYKGNLIFPRKNYFLLWMVEGMNGERARSRSVIHNEQHTPWLPSSSRSNGNAGCANPIRRPLPPQADTSSANHANHGIPLLNSERVQASLRKSLSFLVHLTAKFPLVFIFLLIVLYAIPASAAVLLLYTLITVLFALPSFLILYFAYPSLDWLVREIFA

SEQ ID NO: 19 - DNA, 716 bp, Panicum virgatum
  misc_feature: Ceres CLONE 1719719
  misc_feature: Encodes the peptide sequence at SEQ ID NO. 20
accggacccagggcctttttttcgctctcctcccctacgccagccgcccggcggaaaccctagcgagcgaaccaccggagcagcggagcttgggcggcggaagccatggcagacgacgattacaacgaaatggacatggggtatgaggatgagcccccagaacctgagatggaggaaggagctgaggaagagcttgagaataacaatgaggatgcccctgatgacatggtggatgcagagggtgaagtgaaggaacaggaaaaggccaagcgtgagcgcaaaacgtcaaagtatatgacgaagtatgagcgtgcacgcatcctgggtacacgggctttgcagataagcatgaatgctcccgtcatggttgagcttgagggagaaactgatcctcttgagattgcgatgaaggagctgagagcgcgcaagatccctttcacaatcaggcggtatttacctgatggaagctatgaggattggggagttgatgagctcatcgtggaggactcctggaaacgccaggttggtggggactgaagctactgagctattcggcatgaaaggcctttgtggtgcagctggactttcctgtagttataatggtctatgctactcctacataagtggatgatgtagttgatgaactgggacgtgatgatgctatgtaaccttaatgtctgtggtcgccttgcactcaaaaaaaaaaaaaaaaaaaa

SEQ ID NO: 20 - protein, 143 aa, Panicum virgatum
  misc_feature: Ceres CLONE 1719719
  misc_feature (1)..(54): Pfam Name: RNA_pol_Rpb6 Pfam Description: RNA polymerase Rpb6
  misc_feature (1)..(134): SWISSPROT Homolog: EC 2.7.7.6 DNA-directed RNA polymerases I, II, and III 14.4 kDa polypeptide
MADDDYNEMDMGYEDEPPEPEMEEGAEEELENNNEDAPDDMVDAEGEVKEQEKAKRERKTSKYMTKYERARILGTRALQISMNAPVMVELEGETDPLEIAMKELRARKIPFTIRRYLPDGSYEDWGVDELIVEDSWKRQVGGD

SEQ ID NO: 21 - DNA, 663 bp, Panicum virgatum
  misc_feature: Ceres CLONE 1719739
  misc_feature: Encodes the peptide sequence at SEQ ID NO. 22
aatatcgagcacaggcaaccatagatagagaggaagggaagaggagtgtctccagcccaccctgcctaaacccttgctaattccttgacagagttgaagcagcatgaagaagcagcggatcctcttcttcttgatcatcctcatggtggcccttgctgttgatgctgatggtccacaggagctgcaggtgcagcagcagagcatcagatccctgctccagtctcccccgaagatagactgcccgtcgagttgcgtggtgcgttgcggcaacaactggaagaaccagatgtgcaacaagatgtgcaatgtctgctgcaaccgctgcagctgcgtgccgccggacaccggccaggagacacgccacctctgcccctgctacgacaccatggtcaacccgcacaccggcaagctcaagtgcccgtagcctagcagcgcgtgctatcatcttcatgttctatcagcaactccgatccctctgctatcttccacagatccactaagctcccagagtcctttttaattctcatgtctgctcaagatgaacctttaatagtaagagcactagattcattggggaaaatagtctctgtaaaggttcaacgtgttcagctggttttctgccaaataaaagacaggatcttggtcaaaaaaaaaaaaaaaaaa

SEQ ID NO: 22 - protein, 106 aa, Panicum virgatum
  misc_feature: Ceres CLONE 1719739
  misc_feature (7)..(108): Pfam Name: GASA Pfam Description: Gibberellin regulated protein
MKKQRILFFLIILMVALAVDADGPQELQVQQQSIRSLLQSPPKIDCPSSCVVRCGNNWKNQMCNKMCNVCCNRCSCVPPDTGQETRHLCPCYDTMVNPHTGKLKCP

SEQ ID NO: 23 - DNA, 762 bp, Panicum virgatum
  misc_feature: Ceres CLONE 1719834
  misc_feature: Encodes the peptide sequence at SEQ ID NO. 24
ctaccgcgagttcgtcccctctcctcctccctgctgctttcgccgatcgacttgcccgctcgattccgcgaacccctcggaccgatcggctcctccgatcgcagcccccggcgcgcgcttcgatcggttgctggcgtttgtcgatggccaaaacttgcttcaagatggagcatgaactagagaagaggcagtctgaatctgccaggatcagggataagtacccagacagaattcccgtgattgttgagaaagcaggcaagactgatgttccagagatcgataaaaagaagtaccttgtccctgctgatctcaccgttggccaatttatctatgtggtgagaaagaggatcaagttgagcccagagaaggctatctttgtctttgtgaagaacactttgccacccactgcctctttgatgtctgcgatctacgaggagaacaaagacgaggacggcttcctctacatgacttacagtggcgagaacaccttcggctctgcctaagcaaccacccctgccactgtaaataaacaagcgtgatcaggctgctgctgccgtcctaaacatggtgtacatagacgtcgtctctagtatgctgccggattgcttcatggcttaatgcatccttaggttttaagtgtttttggatcataaaattggaatggcccgtggtagtcaaatactatttgctctggattgaaacatttgctattccactatttctgcacctgcctttgggctcttccaaaaaaaaaaaaaaaaa

SEQ ID NO: 24 - protein, 119 aa, Panicum virgatum
  misc_feature: Ceres CLONE 1719834
  misc_feature: Great-hit functional homolog of the protein sequence given in SEQ ID NO 9436
  misc_feature: Useful for making plants with modulated nitrogen use efficiency
MAKTCFKMEHELEKRQSESARIRDKYPDRIPVIVEKAGKTDVPEIDKKKYLVPADLTVGQFIYVVRKRIKLSPEKAIFVFVKNTLPPTASLMSAIYEENKDEDGFLYMTYSGENTFGSA

SEQ ID NO: 25 - DNA, 1226 bp, Panicum virgatum
  misc_feature: Ceres CLONE 1719868
  misc_feature: Encodes the peptide sequence at SEQ ID NO. 26
gtggacgctggcgcctttgttcgttccctcgcgtcgtcgtctttggccgccgccgcctccttctacctcagcccagcccaggaggaccgcgggagagattcctcgttgattcgctccgaggtggtccgccgtccgcctcgtctcagattctcaggcgtctcagattctcaggggctccccggcctctcagtctcagcatccatcccttgttcctggcttccaccttctggtatgctcactaccttgtgggttcgtcagattgcgcatctgcccaagtgcgcaaattcaagggtagcctgtgccccttccttccttgctgtcacgcagccacctctccaatttagtttggttcacagggcatccttcagctcccaacacagccagtttacaagaagcgctgcaggtcctcttatggctgaaagggagttgattggcaaggataagcttgtgcttagaggtttgcagtttcacggattccatggagtgaaacaagaagaaaagacactgggccaaaagttcgctgtagacgtcgatgcttggatggatctgagcattgctggtgaaactgacagcatatatgatacagtcagttacacagatatttacagaattgtcaaggatgtggttgaaggaccatctcagaatcttttggagtcagtggctcaccggattgcaagtgccacattgctcaagttctctcaaatatctgctgtacgggttgaagttaagaaacctcatgttgctgtacaaggaattatcgactatttaggtgttgagatagttaggtatagaaaggacatggcaggaatttcaccatgagctccactgcactagcattccgaggatggcatgtccatgttcaatctgtcaatggcgctgactgctcaacattgcgttccttcagatgtatatactgcaacaattcgtactgaatgttgctctcagaagctgttcggctcaaaattgatctagttttattggaattgaagtaggcaattaagtttttcctcaaagcttggatggagatgaaattccggcattggatacttattattagctcggttgatattttccatattgcaccttccttcccagatgtctggtctgcagttctgtaaattttgtaccattctatcaaaactatgagcaaatttgagctgtcatgttggacccatgtaataagctcaaatttatttactgacatcagaaaaaaaaaaaaaaaaaaa

SEQ ID NO: 26 - protein, 195 aa, Panicum virgatum
  misc_feature: Ceres CLONE 1719868
  misc_feature (1)..(114): Pfam Name: FolB Pfam Description: Dihydroneopterin aldolase
  misc_feature (49)..(187): SWISSPROT Homolog: EC 4.1.2.25 Dihydroneopterin aldolase
MLTTLWVRQIAHLPKCANSRVACAPSFLAVTQPPLQFSLVHRASFSSQHSQFTRSAAGPLMAERELIGKDKLVLRGLQFHGFHGVKQEEKTLGQKFAVDVDAWMDLSIAGETDSIYDTVSYTDIYRIVKDVVEGPSQNLLESVAHRIASATLLKFSQISAVRVEVKKPHVAVQGIIDYLGVEIVRYRKDMAGISP

SEQ ID NO: 27 - DNA, 764 bp, Panicum virgatum
  misc_feature: Ceres CLONE 1719896
  misc_feature: Encodes the peptide sequence at SEQ ID NO. 28
gaagtttcggcggcggcggcgtgctcgtgatctcaacaccaagcgctcgcttccggtcacccgtcgctccacgcagccatgtcgaggaggaagaccagggagcccaaggaggagaatgtcacccttggccccactgtccgtgagggagagtatgtctttggtgttgctcacgtctttgcatccttcaacgacaccttcattcatgttactgatttgtctgggagggaaactctggttcggatcactggtggcatgaaggtcaaggctgatcgtgatgaatcgtcaccttatgctgctatgcttgcagctcaagacgttgcagctcgttgcaaggagcttggtatcactgcgctgcacattaagcttcgtgccactggaggcaacaaaaccaagactcctgggcccttccggctggctggtgctcagtctgctcttagggctcttgctcgttctggcatgaaaattgggcgcattgaggatgttaccccagttcccactgacagcactcgcagaaagggtggtaggaggggaaggaggctgtaggcgtcttctcctggctatttgccatatcatggcgcaggccatgaagaaactagtcctctctgggtagtgttgctgttcctatgcttgtcaagagagctttaattttgctctatgttgaggatcatttaccgttagtcgaacctgtgatgttgcatggatgatgttttggttgaggaattgacttgtcatatttatgctaaaaaaacatgtgttttcactct

SEQ ID NO: 28 - protein, 154 aa, Panicum virgatum
  misc_feature: Ceres CLONE 1719896
  misc_feature: Great-hit functional homolog of the protein sequence given in SEQ ID NO 9712
  misc_feature: Useful for making plants with modulated biomass
  misc_feature: The plant is abnormally large.
MSRRKTREPKEENVTLGPTVREGEYVFGVAHVFASFNDTFIHVTDLSGRETLVRITGGMKVKADRDESSPYAAMLAAQDVAARCKELGITALHIKLRATGGNKTKTPGPFRLAGAQSALRALARSGMKIGRIEDVTPVPTDSTRRKGGRRGRRL

SEQ ID NO: 29 - DNA, 1048 bp, Panicum virgatum
  misc_feature: Ceres CLONE 1719929
  misc_feature: Encodes the peptide sequence at SEQ ID NO. 30
aggagaaggagaaggaaggtcggaaggggtcgcgcgttaactgtgtccaacaaacaaacaccgtcccaccgccgtccgcccgtcccccgcacgccacttcttcgcctctctccgtctcggcgacgaccgccacttcttcgtcgggcgatcagcagcattcgattccgacagggtgcaggatgagtgatgaggacaagactgctgctgctgctgctgagcagccgaagcgagcccctaagctcaatgaaaggatcctctcttctttgtccaggagatccgtagctgctcatccatggcatgatcttgagatcggtcctggggctcccgctgtcttcaatgttgtcgttgagatcacaaagggaagcaaagttaaatatgagcttgacaagaaaactggattgattaaggttgatcgagtcctgtactcatcagttgtataccctcacaattacggattcattcctaggactctttgtgaggacaacgacccaatggatgttttggtcctgatgcaggagcctgttattccgggttcattcctccgggcaagagcaattggccttatgcctatgattgaccagggtgaaaaggatgacaagataattgctgtctgtgctgatgatccggaataccgtcactacaatgacatcagtgagctgtctcctcaccgcctgcaagagatcaagcgcttctttgaagattacaagaaaaatgagaacaaagaggttgctgttgatgcattcttgcctgcgaccactgctcgagatgccattcagtactccatggatctctatgcacagtatattttgcaaagcttgaggcagtaaaatgccagcaactatttattgtggtgtcttcgattgtgtgtgattttaagtggacgcttgaattgtgtgcgaccattacaattgaatgatgttactagctgtgatttccttctgcttttcccgggacttgtataactttgtcattaaattatgaataagcggagttcgtacgtttaccttgctcacccaagctaggtagccaaaaaaaaaaaaaaaaaaaa

SEQ ID NO: 30 - protein, 215 aa, Panicum virgatum
  misc_feature: Ceres CLONE 1719929
  misc_feature: Great-hit functional homolog of the protein sequence given in SEQ ID NO 9627
  misc_feature (1)..(155): Pfam Name: Pyrophosphatase Pfam Description: Inorganic pyrophosphatase
  misc_feature (1)..(215): SWISSPROT Homolog: EC 3.6.1.1 Soluble inorganic pyrophosphatase
  misc_feature: Useful for making plants with modulated nitrogen use efficiency
MSDEDKTAAAAAEQPKRAPKLNERILSSLSRRSVAAHPWHDLEIGPGAPAVFNVVVEITKGSKVKYELDKKTGLIKVDRVLYSSVVYPHNYGFIPRTLCEDNDPMDVLVLMQEPVIPGSFLRARAIGLMPMIDQGEKDDKIIAVCADDPEYRHYNDISELSPHRLQEIKRFFEDYKKNENKEVAVDAFLPATTARDAIQYSMDLYAQYILQSLRQ

SEQ ID NO: 31 - DNA, 540 bp, Panicum virgatum
  misc_feature: Ceres CLONE 1719964
  misc_feature: Encodes the peptide sequence at SEQ ID NO. 32
aagatccaagaactcgcgccccggcacggacagggcaggagatagagagtgagagtgaccgacagtctctggcgccatgaacgtggaggaggaggtcgggaagctcaaggaggagatccagaggctcggccagcagcagcccgatggctcctacaaggtcaagttcggtgtactattcaatgatgatcgctgtgcaaacatttttgaagcactagtcggcaccttgagggcctccaagaagaggaaaattttgacatatgatggcgagctgcttctgcagggtgttcatgacaatgtggagataaccctattgccgcctcctgcagttgctgccgcttgaggcgcacagatccaccagtccccctattctgtaccgttgatatgctagcactttgttgtgcctatatgtttcatgaactattttgtattcccagaagactgctattgtatgatgtactacgaagttgtgatgctaaaaaaattggcttgcttgaatatggttgtgttgtaacattctagataaaaaaaaaaaaaaaaaaa

SEQ ID NO: 32 - protein, 87 aa, Panicum virgatum
  misc_feature: Ceres CLONE 1719964
  misc_feature: Great-hit functional homolog of the protein sequence given in SEQ ID NO 9394
  misc_feature: Useful for making plants with modulated nitrogen use efficiency
MNVEEEVGKLKEEIQRLGQQQPDGSYKVKFGVLFNDDRCANIFEALVGTLRASKKRKILTYDGELLLQGVHDNVEITLLPPPAVAAA

SEQ ID NO: 33 - DNA, 792 bp, Panicum virgatum
  misc_feature: Ceres CLONE 1720186
  misc_feature: Encodes the peptide sequence at SEQ ID NO. 34
atcctcttcccccgactgcccccgccggccctgcgtgttccctcgccttgcaaggaactctttgtcgattcctctcaaccagttctcgagtcggcggcgatggcgtccaagcggatcctgaaggagctcaaggacctgcagaaggatccccccacatcctgcagcgcaggtcccgtaggagaggatatgttccattggcaggcaacaatcatgggcccttctgatagtccctatgcaggtggcgtgtttctggtttcaatccacttccctccggattatccattcaagccaccaaaggttgctttcaagacaaaggttttccatccaaatatcaacagcaatggaagcatctgccttgatatcctgaaagagcagtggagcccggcattaactgtttccaaggtgctactttcaatctgttcgctattgacagacccaaacccagatgatccgctggttcccgagatagctcacatgtacaaggtggaccgaagcaagtacgaggcctctgcgaggaactggacccagaagtatgcaatgggttagccagttagacctgcagcagcaggcagggaatccgtccgctataacatactaatggatcttatcccttttatggtacgattccggtattgtaatagcaactgaagtcgtaggtcgatggtaactgttgaacatatatgcattagcgtgccttaaacagatgaataggcattgataaactccgtgctggtgctgcgtgctcgcatgtttgaggtggatggcttgtttcaaaaaaaaaaaaaaaaaaaa

SEQ ID NO: 34 - protein, 148 aa, Panicum virgatum
  misc_feature: Ceres CLONE 1720186
  misc_feature: Great-hit functional homolog of the protein sequence given in SEQ ID NO 9309
  misc_feature (1)..(148): SWISSPROT Homolog: EC 6.3.2.19 Ubiquitin-conjugating enzyme E2-17 kDa
  misc_feature (1)..(148): SWISSPROT Homolog: EC 6.3.2.19 Ubiquitin-conjugating enzyme E2-17 kDa 8
  misc_feature: Useful for biocontainment applications
  misc_feature: The plant produces a reduced number of seeds.
MASKRILKELKDLQKDPPTSCSAGPVGEDMFHWQATIMGPSDSPYAGGVFLVSIHFPPDYPFKPPKVAFKTKVFHPNINSNGSICLDILKEQWSPALTVSKVLLSICSLLTDPNPDDPLVPEIAHMYKVDRSKYEASARNWTQKYAMG

SEQ ID NO: 35 - DNA, 813 bp, Panicum virgatum
  misc_feature: Ceres CLONE 1720217
  misc_feature: Encodes the peptide sequence at SEQ ID NO. 36
tcgagtgagcttagcggacggctcagggcctcagaactcctctcctttcccttctctcgaaccctgtcctccttgctcttccttccctggcggcgacgactgggtgagcggcggcgccatcccagccctttgccggcgacgagcgcatcctccaggtatgattgttacctcagcattgatcatatggaaggggttgatagttgtgactggaagcgagtctccagttgtagtggttctctctggtagcatggagcctggatttaaaaggggtgatatcctgtttttgcacatgagcaaagatcctatccgcacaggagaaatagttgttttcaatgttgatggccgtgagattccaattgttcaccgtgtgattaaggtccatgaacgtcaggatacttcagaagtggaaatcctcaccaaaggtgacaataactttggggatgaccgattattatatgcacatggacagctttggctccagcagcaccacattatggggcgagctgtgggctatcttccatatgttggctgggttacaattatcatgactgagaaaccatttattaagtacctgctgattggcgcgctgggcctgctggtcataacatcaaaagagtaaagaagttaagcttccgcgccttatagattttgctcttgtggcgcaacagcatagagcaatggcttgctgaatagtgttaagagaagctgttgtgttccaccatgtatcaaacgagaagatatctttgtccgttctgcaggtgccgaccctctaattggattatcagatctcatgcaaaaaaaaaaaaaaaaaaa

SEQ ID NO: 36 - protein, 153 aa, Panicum virgatum
  misc_feature: Ceres CLONE 1720217
  misc_feature (1)..(79): Pfam Name: Peptidase_S24 Pfam Description: Peptidase S24-like
MIVTSALIIWKGLIVVTGSESPVVVVLSGSMEPGFKRGDILFLHMSKDPIRTGEIVVFNVDGREIPIVHRVIKVHERQDTSEVEILTKGDNNFGDDRLLYAHGQLWLQQHHIMGRAVGYLPYVGWVTIIMTEKPFIKYLLIGALGLLVITSKE

SEQ ID NO: 37 - DNA, 782 bp, Panicum virgatum
  misc_feature: Ceres CLONE 1720344
  misc_feature: Encodes the peptide sequence at SEQ ID NO. 38
gtaaaagccccgcaagagaagccccaaataaatagaagcgacacgccacccctaccaaaccctacagcgagttcgtcccctcctcctccctgctgcttccgccgatcgacttgcccgctcgattccgcgaacccctcggcccgatcggctcctccggtcgcctccctcggcgcgcgcttcgatcggttgctggcgtttgcggatggccaagacttgcttcaagatggagcatgacctagtgaagaggcagtctgaatctgccaggatcagggataagtacccagacagaattcctgtgattgttgagaaagctggcaagactgatgtcccagagatcgataaaaagaagtaccttgtacctgctgatctcaccgttggccaatttatctatgtggtgaggaagaggatcaagctgagcccggagaaggtcatcttcgtctttgttaaggacactttgccacccactgcctctttgatgtctgcgatctacgaggagaacaaagatgaggacggcttcctctacatgacttacagtggcgagaacaccttcggctctgcctaagcaatcgcacccgtcactgtaaataaacaagcgtgatcaggctgctgctgccgtcgcaaacatggtgtacatacacgttgactatgctgccggatcgcttcatggcttaatgcgtccttaggtagtcaaatactatttgcttctggattgaaacatttgctattccactatttctgcacttgcctttgggctcgtctgtgaaaaaaaaaaaaaaaaaaaa

SEQ ID NO: 38 - protein, 119 aa, Panicum virgatum
  misc_feature: Ceres CLONE 1720344
  misc_feature: Great-hit functional homolog of the protein sequence given in SEQ ID NO 9436
  misc_feature: Useful for making plants with modulated nitrogen use efficiency
MAKTCFKMEHDLVKRQSESARIRDKYPDRIPVIVEKAGKTDVPEIDKKKYLVPADLTVGQFIYVVRKRIKLSPEKVIFVFVKDTLPPTASLMSAIYEENKDEDGFLYMTYSGENTFGSA

SEQ ID NO: 39 - DNA, 1189 bp, Panicum virgatum
  misc_feature: Ceres CLONE 1720532
  misc_feature: Encodes the peptide sequence at SEQ ID NO. 40
gccccttcgcaagagcctcctccccacccctttcgaacgccggagcgcgaggaagacgcacgcagagaattggcgcactgcaagaattagaaactgaactgtaagatggcatcagcggagctttcccgtgaggagaatgtgtacatggccaagctcgctgagcaggctgagaggtacgaggagatggttgagttcatggagaaggtagccaagactgttgactcagaggagctcactgtcgaggagcgcaacctcctttctgttgcgtacaagaatgtcattggagcccgccgtgcttcgtggcgcatcatctcctcgattgagcagaaggaggagggccgaggcaatgaggaccgtgtaacactcatcaaggactaccgtggcaagattgagactgagctcaccaagatctgtgatggcatcctcaagctgctcgagtcccaccttgtgccctcatccactgcccccgagtccaaggtcttctacctcaagatgaagggtgactactacagataccttgctgagttcaagactggggctgagagaaaggatgctgctgagaataccatggtggcatacaaggctgcccaggacattgctttggctgagctacctccaactcaccctattaggcttggcttggcacttaacttctcagtgttctactatgagattctcaactcacctgatcgtgcctgcagtcttgcaaagcaggcttttgatgaggccatctcggagctggacaccctgagcgaggagtcctacaaggacagcactttgatcatgcagctccttcgtgataacttgaccctatggacatccgacatctcggaggaccctgctgaggagatcagggagccgctgaagcatgactcgagcgaggggcagtgaagcaggctttacgtgccctagaaactagtagctagtgtttgctgctgtctaatgacactatgcaatatgatctggaccctggtttcttcggcgcgatgcttgtagccgtgctatgactattgtcgggaaaattctgggggctccccatatgagatgttgccgggcaaggcctcgatgtgtcccacttgtagtaggtgggggacactggagccgggtttggttgggtagggaagccaaactgttggtgtcacttgtatttttaccttttcgtcctgttcaaaaaaaaaaaaaaaaaaaa

SEQ ID NO: 40 - protein, 261 aa, Panicum virgatum
  misc_feature: Ceres CLONE 1720532
  misc_feature: Great-hit functional homolog of the protein sequence given in SEQ ID NO 9428
  misc_feature: The sequence is a functional homolog of  SEQ ID NO 2350 in the  10/374,780 US patent application
  misc_feature: The sequence is a functional homolog of  SEQ ID NO 344 in the  10/412,699 US patent application
  misc_feature: The sequence is a functional homolog of  SEQ ID NO 790 in the  10/225,066 US patent application
  misc_feature: The sequence is a functional homolog of  SEQ ID NO 805 in the  11/479,226 US patent application
  misc_feature: Useful for making plants with modulated drought sensitivity
  misc_feature: Useful for making plants with modulated growth and phenotype characteristics
MASAELSREENVYMAKLAEQAERYEEMVEFMEKVAKTVDSEELTVEERNLLSVAYKNVIGARRASWRIISSIEQKEEGRGNEDRVTLIKDYRGKIETELTKICDGILKLLESHLVPSSTAPESKVFYLKMKGDYYRYLAEFKTGAERKDAAENTMVAYKAAQDIALAELPPTHPIRLGLALNFSVFYYEILNSPDRACSLAKQAFDEAISELDTLSEESYKDSTLIMQLLRDNLTLWTSDISEDPAEEIREPLKHDSSEGQ

SEQ ID NO: 41 - DNA, 773 bp, Panicum virgatum
  misc_feature: Ceres CLONE 1720546
  misc_feature: Encodes the peptide sequence at SEQ ID NO. 42
acacaagaatcgaattgtttctgaccatttcatctcaaagacaagagtccatttgcttgaaagccaaaggcaggtagctacaatgatcagctccaagaagctagctcagctgtccaagaagtggcagggaatgggcgcaattggtcgaagaaggatcacaactgtagacaaagagatcaccccatcttgcagcagcatggttgcagggaagggcaactgcattgtctactcttccgatgggaagcggtttgagatccccctcacatacctccgcacgacagtctttgtggagctcctgaaattgtcacaggaagaatttgggttcacaagtgatgggagaatcacactgccttgcgatacagcagtgatggagtatgtgatgtgtttactgaggagagaggcctctgaagatgttgagaaggcactcagttccatagtgatgccttgccaccaccaaagcagaatggtgcaacaatccagtggattgaaccagcaatttgctgtctgcagctcctgaagatgaagatatcagggatttgagcttgttttctctctttttcccccttccatcttttttcccagctgtacattggagcacagtttttgtgcaacgtttttacaatggtacactgtggtcgtacagatggatgaatgtaaaaataatcacattgtgattagaaaagaagaaatcaagctttccattgaaataataaagtgtaagaccgactccggttaaacaaaaaaaaaaaaaataaaaaaaaaaaaaaaaaaaa

SEQ ID NO: 42 - protein, 144 aa, Panicum virgatum
  misc_feature: Ceres CLONE 1720546
  misc_feature (1)..(105): Pfam Name: Auxin_inducible Pfam Description: Auxin responsive protein
MISSKKLAQLSKKWQGMGAIGRRRITTVDKEITPSCSSMVAGKGNCIVYSSDGKRFEIPLTYLRTTVFVELLKLSQEEFGFTSDGRITLPCDTAVMEYVMCLLRREASEDVEKALSSIVMPCHHQSRMVQQSSGLNQQFAVCSS

SEQ ID NO: 43 - DNA, 945 bp, Panicum virgatum
  misc_feature: Ceres CLONE 1720681
  misc_feature: Encodes the peptide sequence at SEQ ID NO. 44
aaaaaaaaaaaaaaaaaaaaaaacgagttcgcgctagggtttcctcgctccccgccgccgccgcctcctagccgcacgcagccgccgcagcagcgcgtccctccctcgttctcggccatggcggaggtggagcagcagcagcaggatgtgaagctcttcaaccgctggacctttgaagatgtccaggtgaacgatatctcgctgaacgactacctggcggtgtcgtcgacgaagcacgcgacgtacctgccgcacaccgcggggcgctactcgaagaagcgtttccgcaaggcgcagtgccccatcgtcgagcgcctcaccaactcgctcatgatgcacggccgcaacaacggcaagaaggtcatggccgtccgcatcatcaagcacaccctggagatcattcacctgctcaccgacgccaaccccatccaggtcgtcgtcgacgctattatcaacagtgggccacgtgaggatgccacccgaattggttctgctggtgttgtgaggaggcaggctgttgatatctcgcccctgaggagggtgaaccaggccatctacctcctaaccactggagcccgggagagtgctttcaggaacatcaagaccattgctgaatgccttgcagatgagttgatcaatgctgctaagggctcatccaacagctatgccataaagaagaaggatgagattgagcgtgttgccaaggccaaccgttgagtgaagcttgtgtatcgtggtgcaatggagtccttgttatatcgttggcagttgttttggttgttttacctgatgtttagacattttgagacctagctaaggttttgctttgaatgaacaatggaaaatactgagagatgtagttgtttgggggcagaaatgccatgtgcctgatttattgaataccagctcttgttcttataagctcgaaaaaaaaaaaaaaaaaaa

SEQ ID NO: 44 - protein, 199 aa, Panicum virgatum
  misc_feature: Ceres CLONE 1720681
  misc_feature: Great-hit functional homolog of the protein sequence given in SEQ ID NO 9304
  misc_feature: Useful for making plants with modulated biomass
  misc_feature: Useful for making plants with modulated flowering time
  misc_feature: The plant flowers significantly late compared to wild-type.
  misc_feature: The plant is abnormally small.
MAEVEQQQQDVKLFNRWTFEDVQVNDISLNDYLAVSSTKHATYLPHTAGRYSKKRFRKAQCPIVERLTNSLMMHGRNNGKKVMAVRIIKHTLEIIHLLTDANPIQVVVDAIINSGPREDATRIGSAGVVRRQAVDISPLRRVNQAIYLLTTGARESAFRNIKTIAECLADELINAAKGSSNSYAIKKKDEIERVAKANR

SEQ ID NO: 45 - DNA, 870 bp, Panicum virgatum
  misc_feature: Ceres CLONE 1720955
  misc_feature: Encodes the peptide sequence at SEQ ID NO. 46
atctcgccgctgagactgagacagagtgagagacgacgtcaggagagtcgcagagaagggggggaaaaaaaaggaatctatggcgtcggcgctggcggcgaggagggcgaggggctcggccgcggtgctgtggggcgcggcgagggggttcgcgtcggtggggtccgacatcgtctcggcggcgcccggcgtgtcgctgcagaaggcgcggtcctgggacgagggcgtcgcctccaagttctccaccacgcctctcaaggacatcttctgcgggaagaaggtggtcatcttcggcttgcctggggcatatacaggagtttgttcacaatcacatgttcctagttacaagaacaacattgataagttgaaagcaaaagggattgactctgttatctgtgtagctgtgaatgacccgtatgtcctgaatggatgggcagaaaagctacaggctaaagatgcaattgagttctacggtgactttgatgggagtttccacaaaagtttggatttggagatagacctatctgctgctttgctcggccgtcgatctcacaggtggtcggctttcgttgatgatggcaagatcaagtcattcaatgttgaggaagcaccctccaatttcaaggtttctagcgcggaggtgattcttgaccagatctgagcttaccaacgaacctgggatgccttcagtttgctcgtgcagcatgcttgctcagctgcagtaaataaatgaaaactccttttatctttgtaaagaactaaagatgctaggtgctcccatatactgtctcggatacactgcagtgtcttgagtcttcgactggaccgtgaaggacttgagtatttctgtaaaaaaaaaaaaaaaaaaaa

SEQ ID NO: 46 - protein, 193 aa, Panicum virgatum
  misc_feature: Ceres CLONE 1720955
  misc_feature (5)..(170): Pfam Name: Redoxin Pfam Description: Redoxin
  misc_feature (1)..(193): SWISSPROT Homolog: EC 1.11.1.15 Peroxiredoxin-2F, mitochondrial precursor
MASALAARRARGSAAVLWGAARGFASVGSDIVSAAPGVSLQKARSWDEGVASKFSTTPLKDIFCGKKVVIFGLPGAYTGVCSQSHVPSYKNNIDKLKAKGIDSVICVAVNDPYVLNGWAEKLQAKDAIEFYGDFDGSFHKSLDLEIDLSAALLGRRSHRWSAFVDDGKIKSFNVEEAPSNFKVSSAEVILDQI

SEQ ID NO: 47 - DNA, 785 bp, Panicum virgatum
  misc_feature: Ceres CLONE 1720961
  misc_feature: Encodes the peptide sequence at SEQ ID NO. 48
attcccacacagcacacacagcacactactgcagcatttgctttgcttagcacgaccgccgatcgataattaataataatacaacgataatggcggctctgatgatgaagaacaagaagcagatgcaggcggtggtggccttggccgttgtggtggcggcggcggcgctggtggcgtcggcgtcggcggccatcacgtgcgggcaggtgggttcggcgctggcgccgtgcatcccgtacgcgacggggaaggcgagcgcgctgccgtcgtcgtgctgcggcggcgtgcgcagcctcaacagcgcggcgcggacgagctcggaccggcaggcggcgtgccggtgcctcaagagcctggccagcaccgtcaagtcggtgaacatgggcaccgtcgccaccatccccggcaagtgcggcgtctccgtggcattccccatcagcatgtccacagactgcaacaaggtcaactaataaattgtgcatcaatataataatcctaccagctgatgaggaagctcagctcgatccgctcagaagctagcgagctatattcaggagaataaaataaagttgaggcatcatcagcagcacatcatctatatatattattgttgtactcgatctgtgtgtacgtgcgcgtatacatacatgcatgcttatacgatcgatgtatatatatgtgctgcttctctcacaagtacgcgtgctcatatatatacatacatgtgtgctagctttgtgtcctgctgtgatcaataacaactactcctgctactgttcagtgcc

SEQ ID NO: 48 - protein, 126 aa, Panicum virgatum
  misc_feature: Ceres CLONE 1720961
  misc_feature (1)..(86): Pfam Name: Tryp_alpha_amyl Pfam Description: Protease inhibitor/seed storage/LTP family
MAALMMKNKKQMQAVVALAVVVAAAALVASASAAITCGQVGSALAPCIPYATGKASALPSSCCGGVRSLNSAARTSSDRQAACRCLKSLASTVKSVNMGTVATIPGKCGVSVAFPISMSTDCNKVN

SEQ ID NO: 49 - DNA, 977 bp, Panicum virgatum
  misc_feature: Ceres CLONE 1721122
  misc_feature: Encodes the peptide sequence at SEQ ID NO. 50
gcaactactccctctactctctagtctctactacacgcttccaagaaacagagcaacccagagaccagagcaggaaccaaatttctccaagcgatccggccacggatcgaggctgtcctctgctgccgccggcgccgatgggttcggccgatcgcagtgagatcgacggcatcgcggtggcggagagaggcgcgaggggctgcgtcgaatgccgcgccaccactacgcccatgtggcgcagcggcccgaccgggcccaggtcgctttgcaatgcttgcgggatccggtaccggaagaagaggaggcaagagcttggcctagaccacaagcagcaacagcagctgcgacagcaacataatggtgaggtcaaaactgaagtaaaagacagtagcagcagcagcagcgggagcagcaacttgcaggcggtgcagaaacggaggctcctaatgggagtggaggaggctgcgttgttgctcatgaccctgtcttcctcacccacatccacattgctacatggctaagaaccctgcatacaactccaaaccaacgatgtacatacacacacacacctcacacctgcacaccaagtacccaacattacaatccaaccatacaagtttctccagtttatcttcacctggataagatagggaggggaggggcctatctcaagattctgtgatcttgcgatggggtgtggattagtgcctccatcctctttgttctcctccgttgcgccgcagcatcgtagatcttggtcatgtcaggttgtgaaacttatcttttctgtgatttgtggtaggctccatgatcggaggtcagttratctcactcccccacccatcctttttttgttctttgtatgtastttgttgttgctcctttgtgagggattgacggtcgaaaggtgacgtcgtccctcttcattccaaaataataaagggaacaataataataaaaggctttttttattgttc

SEQ ID NO: 50 - protein, 127 aa, Panicum virgatum
  misc_feature: Ceres CLONE 1721122
  misc_feature (1)..(36): Pfam Name: GATA Pfam Description: GATA zinc finger
MGSADRSEIDGIAVAERGARGCVECRATTTPMWRSGPTGPRSLCNACGIRYRKKRRQELGLDHKQQQQLRQQHNGEVKTEVKDSSSSSSGSSNLQAVQKRRLLMGVEEAALLLMTLSSSPTSTLLHG

SEQ ID NO: 51 - DNA, 763 bp, Panicum virgatum
  misc_feature: Ceres CLONE 1721194
  misc_feature: Encodes the peptide sequence at SEQ ID NO. 52
aagcagcagctcgagtccaaccaaacaacaaccggaagagaagagaaggcaagaagagactcacccgtcgctacgaacaccaattcttgcagagaggaggcatgagaacccaagtgttcttcctcacattcgccttgctcgctgtgctcgggcaatcgagcaacaggcaccaccaccaccaccactcccatgttcagagcaaagggcatggagggggaggaggaggaggggagctagcgagccgggggaaggcggcggcgcgggcgtggccgtgctgcgacaactgcggcgggtgcaccaagtcgaacccggcgcagtgccggtgccttgacgcggcgccccgcgggtgccacccggcctgccgggactgcgtcaagtccagcctcagcgccgacccgccggtgtaccagtgcatggaccgcgtccccaacttctgctcccgccgctgctccgccgccgccgcccacagaccggccggctgagcggacgacaacgagtcgacgactcgttctgattgctgctgttgacccaccaactgtccaacccaacccacccacccgcccgcaattcctaccttctgaaggcaagctgtggattatagatttttgtgtgtagagactagagagatgaggaatctgttcatcagatgagcaaaccaaaccaagcttggatttttttttcctttttttttttgtcttttgacttgacactgctctgtaattgctggctactactgttcccacaaaaaaaaaaaaaaaaaaaa

SEQ ID NO: 52 - protein, 126 aa, Panicum virgatum
  misc_feature: Ceres CLONE 1721194
  misc_feature (1)..(27): Pfam Name: Bowman-Birk_leg Pfam Description: Bowman-Birk serine protease inhibitor family
MRTQVFFLTFALLAVLGQSSNRHHHHHHSHVQSKGHGGGGGGGELASRGKAAARAWPCCDNCGGCTKSNPAQCRCLDAAPRGCHPACRDCVKSSLSADPPVYQCMDRVPNFCSRRCSAAAAHRPAG

SEQ ID NO: 53 - DNA, 871 bp, Panicum virgatum
  misc_feature: Ceres CLONE 1721195
  misc_feature: Encodes the peptide sequence at SEQ ID NO. 54
acgcacctccttcccaacgccgaaaaacatctccaaaaccaaaccaaaccaaaccaaagcctcactccccaccgctctcctccctaatccgccatgctccagcaccgccgcctcgtcctcctcctcgccgtcgccgccgcggccgcggcaggcggcgccgcctcggcgaagcccaccgcctacgaggccctcgcggactacgacttcccgccggggatcctccccaaaggcgtggtcgcctacactctcgacaactccacgggcgccttcacggccacgctcgacgcctccgcgtccggcgcgggcaaatccgtctgcgagttctccatccaggggtcctactcgctccgctaccagaccaagatcaccggcaagatcaagcccgaccacctctacaacctccagggcgtctccgtcaaggttctcttcttgtggatcaacatcgtcgaggtcacccgccgcggcgacaacctcgagttctccgtcggcatcgcctccgccgacttcgggatcgaaaacttcctcgagtgccccaactgcggctgcgggttcgactgcaacgacctcctcatgctgaagccgggggctgccactgccaagctgcgcctgcgaggtgcgttctaggatcccacttctgcagattgaatgtactgctgctgtaagctactaccgctagcgatgtatgtcttagactcttagtagatgcgttaataaagagaggaaagatgaaaggtcccagcttttagatgtgggatggaatagcaagttcagtactccagttcatgtttcgccaatgtgtcaagacagtttagagacaaagcaattaagacctttcaaatctttttatctataaaaaaaaaaaaaaaaaaaa

SEQ ID NO: 54 - protein, 176 aa, Panicum virgatum
  misc_feature: Ceres CLONE 1721195
  misc_feature: Great-hit functional homolog of the protein sequence given in SEQ ID NO 9431
  misc_feature: Useful for making plants with altered terpenoid content
MLQHRRLVLLLAVAAAAAAGGAASAKPTAYEALADYDFPPGILPKGVVAYTLDNSTGAFTATLDASASGAGKSVCEFSIQGSYSLRYQTKITGKIKPDHLYNLQGVSVKVLFLWINIVEVTRRGDNLEFSVGIASADFGIENFLECPNCGCGFDCNDLLMLKPGAATAKLRLRGAF

SEQ ID NO: 55 - DNA, 995 bp, Panicum virgatum
  misc_feature: Ceres CLONE 1721214
  misc_feature: Encodes the peptide sequence at SEQ ID NO. 56
acacgcagagcgcacaaggcgatccaattgaagaccgagcactgtcgatggcatcggccaagctcctcgtcaccgccctcgcggccctgctggcggccgccggtggcgccggcgcgagggagttgagtcggctcgagatgacgtccgccgagatgatcgccgacggcggcggcatgccgctgatccacatgctccgcccgctgcggggctccggcggccgcctgggccggcgcgccggcgtgccgtgcgacagctggcggttcgccgtggagaccaactccgtgcgcggctggagcaccatccccgcccgctgcgagagctacgtcggcaactacatgatgggcggccactaccggcgcgactcccgcgccgtcgtcgacgaggccgtcgcctacgccgagggcctgcagctcgccggcgacggcagggaggtctgggtgttcgacgtcgacgagaccacgctctccaacctcccctactacgccaagcacggcttcggggccgagccgtacaactcgacgctgttcggcgcgtacgtgcaggaggcgagcgcgccggcgctgccggagacgaagcggttgtacgacaggctgctggcgctgggcatcaagccggtgatcctgacggggcggcgcgaggacaagcgggaggccacggcgaggaacctcgccgccgcggggtacaccggctacgagaagctcctgctcaagccgcaggacgcgagggtgcacgcggtggagttcaagtccggcgagaggcagaagctggaggacgccgggtacgtcatcgtcggcaacatcggggaccagtggagcgacctgctcggcgcgccggagggcgctcgcaccttcaagctgccggaccccatgtactacatcggctagctagctaccgaacagcagcagatttaaataaactcctgaataacgtccaaatttcagtgtgtcgaataaagaagacgacctgtttaccattaaaaaaaaaaaaaaaaaaaa

SEQ ID NO: 56 - protein, 278 aa, Panicum virgatum
  misc_feature: Ceres CLONE 1721214
  misc_feature (2)..(226): Pfam Name: Acid_phosphat_B Pfam Description: HAD superfamily, subfamily IIIB (Acid phosphatase)
MASAKLLVTALAALLAAAGGAGARELSRLEMTSAEMIADGGGMPLIHMLRPLRGSGGRLGRRAGVPCDSWRFAVETNSVRGWSTIPARCESYVGNYMMGGHYRRDSRAVVDEAVAYAEGLQLAGDGREVWVFDVDETTLSNLPYYAKHGFGAEPYNSTLFGAYVQEASAPALPETKRLYDRLLALGIKPVILTGRREDKREATARNLAAAGYTGYEKLLLKPQDARVHAVEFKSGERQKLEDAGYVIVGNIGDQWSDLLGAPEGARTFKLPDPMYYIG

SEQ ID NO: 57 - DNA, 755 bp, Panicum virgatum
  misc_feature: Ceres CLONE 1721221
  misc_feature: Encodes the peptide sequence at SEQ ID NO. 58
caaacacattcatccagcacgggacggagtggggtcgtcaagctaagttcacattcacgcacaatccaagcaatggctcgcgctcatcaggtggtggctatcgccgtggttgccgccgtcgtggtgctcgccgccgcggcgaccaccaccgaggccgccgtgacctgcgggcaggtgagctcggccatcggcccctgcatcgcctacgcccgcggcaccggctccggcccctcggcagcctgctgcagcggcgtgaggagcctcaactcggcggccaggagcaccgccgacaggcgcgccgcatgcaactgcctcaagtccgccgccggcagggtgagtggcctcaaacttggaaacgccgcaagcatcccgtccaagtgcggagtcagcatcccctacaccatcagcccaaacgtcgactgctccagggtgagctaaacgacgaccagtaccgtcgctacctatctacttaattatcgtctatgatcgagttcgatgatgatgaataaaaatctctccgccgtcgcgtgcactgtcgtcatgcgctagctcagctcgcgtggtacgtcgtcgctcagcatgtgatgagcgatcgagagacggagtcctctccgatccttgtgtccttttgcatgcttcgtacgttttgtgtctgcatckacatagtagtgtgccctccatttccgtytggaggagacccactctgtaccttgtccactataccttttaatacatcatacaccacttttttttgc

SEQ ID NO: 58 - protein, 121 aa, Panicum virgatum
  misc_feature: Ceres CLONE 1721221
  misc_feature (1)..(86): Pfam Name: Tryp_alpha_amyl Pfam Description: Protease inhibitor/seed storage/LTP family
MARAHQVVAIAVVAAVVVLAAAATTTEAAVTCGQVSSAIGPCIAYARGTGSGPSAACCSGVRSLNSAARSTADRRAACNCLKSAAGRVSGLKLGNAASIPSKCGVSIPYTISPNVDCSRVS

SEQ ID NO: 59 - DNA, 911 bp, Panicum virgatum
  misc_feature: Ceres CLONE 1721226
  misc_feature: Encodes the peptide sequence at SEQ ID NO. 60
attttctcctccatcctctagccaagtagccatcggcgacaggaccccggccccctcctccccgatccacagctcgatcagccagatcgggaggaaactagactgagctaaaccggcagccagcatggcggcggggcggtggtggctggcggcggcgtggtgcgcggtggccgcggtggctgctgcggcgcagtcgtcgtcgccgccggcggcggacccgctgcaggccaagtgctcggcggacttcgggaagctgacggactgcatggactacgcgacggggcacgaggggcagccctcgtcgacgtgctgctccgatgccgccgacacgcaaaaggcgcggccgcagtgcctctgctacatcatccagcaggtgcacagcggccggaacgaggtgcagtcgctgggcctccgcttcgaccgcctcatggcgctccccgccgcctgcaagctcgccaacgccaacgtcacgctctgcatcaccctgctgaacctgaagccgggctcgccggactacgccctcttcgccaacgcctccaagatcatgccgtcgaccggcggcactccggcgagcgacgccaccgccggcagcggcttcaagcttcagacggggttccgcggcagcgtcgcgctcgccgtgctctccgcggtgctctcgtccgtgttctgattgctcgagcaagcagcagttttttaccgtgtggattcgttcttgatgcttcgctagtccatgtccattttgtacccacataaaaatagatttcatctcagacttcttgttcctgtatcctgttgcatgatgagagtggatggtctttgcatcaccaattcacaaccctttgttcggaggaacagactgtcagtgcaacaaccaagtgaaataatttagttgttattatgcttttacagcc

SEQ ID NO: 60 - protein, 181 aa, Panicum virgatum
  misc_feature: Ceres CLONE 1721226
  misc_feature (1)..(82): Pfam Name: Tryp_alpha_amyl Pfam Description: Protease inhibitor/seed storage/LTP family
MAAGRWWLAAAWCAVAAVAAAAQSSSPPAADPLQAKCSADFGKLTDCMDYATGHEGQPSSTCCSDAADTQKARPQCLCYIIQQVHSGRNEVQSLGLRFDRLMALPAACKLANANVTLCITLLNLKPGSPDYALFANASKIMPSTGGTPASDATAGSGFKLQTGFRGSVALAVLSAVLSSVF

SEQ ID NO: 61 - DNA, 905 bp, Panicum virgatum
  misc_feature: Ceres CLONE 1721240
  misc_feature: Encodes the peptide sequence at SEQ ID NO. 62
atccatcatcctcgacaacctttagcagcaaagcaaacaagacaaagcgagcgagaagctagcaggctgctgctgctgcaggaagccaccgagcggcgaggacgcgggcagcgtagcgagaccggtcggattcggcgagatccatcatccatggcgccgaggaggtcgacttcgccggccgggagcggtggcagcggcgcggagcagccgccgaggcggctgcgcggcgtgcggaagcggccgtggggccggtacgcggcggagatccgagaccccgcgcgcaaggcgcgcgtgtggctgggcaccttcgacacgcccgaggaggcggcgcgcgcctacgacgccgccgcgcgcaggctccgcgggccgcgcgccgccaccaactaccccgccgccgcacacgcccaggacccgaacgcggcgctgtccgaggacgcgcggtcgtcgtcgtcgtccttgtcctcttgccgggactcgccgctggcggtggccgtcgcggcggcgcccccgtcgctggacctgagcctggcggtcccggccacgccgccgccgtcgtaccacatgtgcctggaaacggccgtggcgccagcgctgctgcagtttcttccgcccaagcacgaggaagagcggagcttctcaggggcgtcgtcggtggcgttcgacgcggcgccggccgtgggcctggggctggacctcaacctggcgctgccggcggccgggatggtgatgtagagtcggttaattagcacagtagagtaggtacgagctcatgcatggatcaagatgtcatcagatgtaaataggctgcagatttgtgcgtgcgctgcgatggtgatgcagcgattttaggaaatttgccaaggcttaaaatgcttcatcttaaccaaaaaaaaaaaaaaaaaaaa

SEQ ID NO: 62 - protein, 193 aa, Panicum virgatum
  misc_feature: Ceres CLONE 1721240
  misc_feature (3)..(65): Pfam Name: AP2 Pfam Description: AP2 domain
MAPRRSTSPAGSGGSGAEQPPRRLRGVRKRPWGRYAAEIRDPARKARVWLGTFDTPEEAARAYDAAARRLRGPRAATNYPAAAHAQDPNAALSEDARSSSSSLSSCRDSPLAVAVAAAPPSLDLSLAVPATPPPSYHMCLETAVAPALLQFLPPKHEEERSFSGASSVAFDAAPAVGLGLDLNLALPAAGMVM

SEQ ID NO: 63 - DNA, 504 bp, Panicum virgatum
  misc_feature: Ceres CLONE 1721241
  misc_feature: Encodes the peptide sequence at SEQ ID NO. 64
cacacatcggtgagcagcccccacattctcgttctccgtccaccaacctacccacctgcggcggcgcaaggaagcgaagcgacgcgatgtcggcgccgacggcggcggtgcccttctggcgcgcggcggggatgacctacatcggctactccaacatctgcgccgcgctggtgcgcaactgcctcaaggagcccttcaagtccgaggccgcgtcccgcgagaaggtccacttctccgtctccaagtggacggacggcaagcaggagaagcccactgtccgcacggagtcagatgaataaagatctggtgccatgatgatagtccttctacagatgttttgaagtgttgttgcaagctctggaacttgctgtttatctggcttgattttatggtcaacactgaagaataaatactttttgtaacaattgatctttttgaacaatgccatgtcattactgtttctaattgcacttgctcaactctcaaaaaaaaaaaaaaaaaaaa

SEQ ID NO: 64 - protein, 70 aa, Panicum virgatum
  misc_feature: Ceres CLONE 1721241
  misc_feature (1)..(49): Pfam Name: ATP-synt_Eps Pfam Description: Mitochondrial ATP synthase epsilon chain
  misc_feature (1)..(70): SWISSPROT Homolog: EC 3.6.3.14 ATP synthase epsilon chain, mitochondrial
MSAPTAAVPFWRAAGMTYIGYSNICAALVRNCLKEPFKSEAASREKVHFSVSKWTDGKQEKPTVRTESDE

SEQ ID NO: 65 - DNA, 726 bp, Panicum virgatum
  misc_feature: Ceres CLONE 1721298
  misc_feature: Encodes the peptide sequence at SEQ ID NO. 66
gcctcaagccacactgctgctgcgcgctgcatcctagctcactagtactactactactagctagctagtaaattaagccatggctcccaccgtgatggccgcctcggccacctccgtggctccgttccagggcctcaagtccactgccaggctccccatcagccgccgctccagcagcaagggcttccgcaacgtcagcaacggcggaaggatcaggtgcatgcaggtgtggccgactgagaacaacaagaagttcgagaccctgtcgtacctgccgccgctctccacggaggacctcttgaagcagatcgactacctgatccggaacaactgggtcccttgcctcgagttcagcaagctcggcttcgtcttccgtgagaacgccacttcccccgggtactacgatggccgctactggaccatgtggaagctgcccatgttcggctgcaccgacgccactcaggtgtacgccgagctcgaggagtgtaagaaggcctaccccgacaactacatccgcatcctcggattcgacaacgccaggcaggtgcagtgcgtcatgttcatcgcctacaagcccgagtagaccggcggcgcctaagcttaccgatcgcgcgcgcggacagcaggcccggcagctcgctcgtgagcggccgtgaagtgtctactcggttttggcgaacttgaagctctatgtctcgtcttcctcaaaaaaaaaaaaaaaaaaaa

SEQ ID NO: 66 - protein, 167 aa, Panicum virgatum
  misc_feature: Ceres CLONE 1721298
  misc_feature (1)..(109): Pfam Name: RuBisCO_small Pfam Description: Ribulose bisphosphate carboxylase, small chain
  misc_feature (1)..(166): SWISSPROT Homolog: EC 4.1.1.39 Ribulose bisphosphate carboxylase small chain A, chloroplast precursor
  misc_feature (1)..(166): SWISSPROT Homolog: EC 4.1.1.39 Ribulose bisphosphate carboxylase small chain, chloroplast precursor
MAPTVMAASATSVAPFQGLKSTARLPISRRSSSKGFRNVSNGGRIRCMQVWPTENNKKFETLSYLPPLSTEDLLKQIDYLIRNNWVPCLEFSKLGFVFRENATSPGYYDGRYWTMWKLPMFGCTDATQVYAELEECKKAYPDNYIRILGFDNARQVQCVMFIAYKPE

SEQ ID NO: 67 - DNA, 768 bp, Panicum virgatum
  misc_feature: Ceres CLONE 1721304
  misc_feature: Encodes the peptide sequence at SEQ ID NO. 68
agcgcctcagcctttcccttctctctctgactctctcctgccctgttcttccttgttccttccctggcggcggcgacgatcgggggagtggcggcgccattcgtcacgtcttcacccagcccttcgccggcgacgagcatccaccagcaagccagcaatggagaagtataacagcaacactcgatttgcacccttgagagacgtgccacttgctctccgtggtgctcttggtagctcaagctcaaatctggagcaagccaggggctacacatcttcgcctctagcagccctgcgaccaaatatgtctccaactggaagccgaaccctgcacacaagccgccccctgtcatctcctgttgcgaaccgcccattgtcgccccacctcccgctgaagaagccacagtttagcgctacattctcaatctcgcaccgtattttcggtgtcgcattgggagttgccatcatatccgtccctcttgccaccaagttcagcctgatgtttggtgtttgagagtgaactgctgcattggcgagaaacattgtttcccattcctgtgactgtttcatcgtctgggttatcttcaaactcgactgtgggtttggttggaataacacctttgtcatgcttgcaaacttcgctaataaataagactatcaaatgatcagtgtagagatcacattctgaatgtacatggttatgaggttctgcaaatttggtcagaacattgatttctatgcacgtgaattcttggttttgaatggaggtgg

SEQ ID NO: 68 - protein, 117 aa, Panicum virgatum
  misc_feature: Ceres CLONE 1721304
  misc_feature (1)..(50): Pfam Name: Sdh_cyt Pfam Description: Succinate dehydrogenase cytochrome b subunit
MEKYNSNTRFAPLRDVPLALRGALGSSSSNLEQARGYTSSPLAALRPNMSPTGSRTLHTSRPLSSPVANRPLSPHLPLKKPQFSATFSISHRIFGVALGVAIISVPLATKFSLMFGV

SEQ ID NO: 69 - DNA, 839 bp, Panicum virgatum
  misc_feature: Ceres CLONE 1721334
  misc_feature: Encodes the peptide sequence at SEQ ID NO. 70
gtcgcaacgatggagtctgcgtcgctcatgtcactcggcaatccattcccgtgcacctcccaatccccaagatcccggtgtccatcagagcccaagaagatccgtttggcatgccgcaggagggctccccctctgaaggcaacctgtgagatctctaggcggagggcggtttcagggatggtggttcttggcgcagcggcctcatgcatcgatcctcttgccctccccgtgccggcgcaggcagcaatgccggagcctgacgttatcaggtaccggaagctggacagtggagtgatactcgaagatgtcgtcgaaggggagggacctgaagcacgggaaggcgatctagtgaagttcaactatgtatgccgccgtgcaaatggttatttcgtgcatagcacagtagaccagttcagcggcgagagcaagccggtcacactcccacttggtggagaagagattattcaaggccttaaagatgtactaatcgggatgaaggctggaggcaagaggagggctttaattccacctgaagttggctacatcagtgagaccttgaagcccataccagaagagttcggaccacggcggagtctgctgtctcatgccaaggagcctctggtgtttgaggttcagttgctgaaggtcctgtgattctgcatttctgtcatcgtatcatgatatcatcatcatccttggtcaatacagacgctgttccaagggagtcgtactgaacttgaattttcttccatggaaaacgaaatcatcgtctaggttgaattaatgaaagagtcaaacagcagccatccagcttttgtcaaaaaaaaaaaaaaaaaaaa

SEQ ID NO: 70 - protein, 214 aa, Panicum virgatum
  misc_feature: Ceres CLONE 1721334
  misc_feature (1)..(109): Pfam Name: FKBP_C Pfam Description: FKBP-type peptidyl-prolyl cis-trans isomerase
MESASLMSLGNPFPCTSQSPRSRCPSEPKKIRLACRRRAPPLKATCEISRRRAVSGMVVLGAAASCIDPLALPVPAQAAMPEPDVIRYRKLDSGVILEDVVEGEGPEAREGDLVKFNYVCRRANGYFVHSTVDQFSGESKPVTLPLGGEEIIQGLKDVLIGMKAGGKRRALIPPEVGYISETLKPIPEEFGPRRSLLSHAKEPLVFEVQLLKVL

SEQ ID NO: 71 - DNA, 1000 bp, Panicum virgatum
  misc_feature: Ceres CLONE 1721369
  misc_feature: Encodes the peptide sequence at SEQ ID NO. 72
acgcccacctccgctcccactgctcccgatcgccttctccttcgctctccttgctcccatggctctgtccgtcggctcgttcgcggcatgcagcctccagccaagcagagctagtagcatccgggcgggccgtgcgccgccgccgccgggcgctgccgcggtggtctcgcttacgaggacggggcgccgggcgaacgcgaccaagggcgtgtccgccgcgtgcgagccgctggggcccgaccggccgctctggttcccaggcgcctccccgcccccgtggctcgacggcagcctccctggagacttcggatttgacccgcttggactaggttcggagccggagcagctgcgttggttcgcgcaggcggagctgatacacgggcggtgggcgatgctggcggcggtggggatcctggtcccggacgtgctggcgcggtggggcttcatcgacggcggcttctcgtggttcgacgccgggtctcgggagtacttcgcggatccctggacgctcttcgtgtcgcagatggcgctaatggggtgggcggagggccggcggtgggcggacctcctccaccccggctgcgtcgacatcgagccggacctccccaaccgcaagaagcccgtccccgacgtcggctaccccggcgggctgtggttcgactgggccaactggggccgcgggtcccccgagcccgtcatggtgctgcgcaccaaggagatcaagaacggccgcctcgccatgctcgccttcctcggcttctggttccaggccgtctacaccggccaggggcccatcgacaacctcctagcgcacctcgccgacccgggccactgcaacatattctcggcgttcacgtcccactgaatgctagttaccttatcagatacaagagaatggagtcgtgaacgctttgtacctggcagcaatttgtttgatgaaatcacatgagatgctaggggggaatcccattgcaacaggtaaaaaaaaaaaaaaaaaaaa

SEQ ID NO: 72 - protein, 268 aa, Panicum virgatum
  misc_feature: Ceres CLONE 1721369
  misc_feature: Great-hit functional homolog of the protein sequence given in SEQ ID NO 9411
  misc_feature: Useful for making plants with modulated oxidative stress sensitivity
MALSVGSFAACSLQPSRASSIRAGRAPPPPGAAAVVSLTRTGRRANATKGVSAACEPLGPDRPLWFPGASPPPWLDGSLPGDFGFDPLGLGSEPEQLRWFAQAELIHGRWAMLAAVGILVPDVLARWGFIDGGFSWFDAGSREYFADPWTLFVSQMALMGWAEGRRWADLLHPGCVDIEPDLPNRKKPVPDVGYPGGLWFDWANWGRGSPEPVMVLRTKEIKNGRLAMLAFLGFWFQAVYTGQGPIDNLLAHLADPGHCNIFSAFTSH

SEQ ID NO: 73 - DNA, 781 bp, Panicum virgatum
  misc_feature: Ceres CLONE 1721386
  misc_feature: Encodes the peptide sequence at SEQ ID NO. 74
ccccgtgctctctcagaggtgggttggcttctccccctcttaccaagtcctcggttctagggttttagttggaaggggagatggcggcggcggatgtggagtaccgctgcttcgtcggcggcctcgcctgggccaccgacaacgcgtccctccagcaggccttcgcctcctacggcgacgtcctcgactccaaggtcatcaccgaccgtgagacggggaggtcccgcgggttcggcttcgtcaccttctcaaccgagcagtcgatgctcgacgccatcgaagccatgaacggcaaggagctcgacggccgcaacatcaccgtcaaccaggcccaatcccgcggcggtggcggcggcggcggcggcggcggttacggcggcggtcgccagggaggctacggcggcggcggcggcggctacggcggcggtcgccgtgagggcggctacggtggcggcggctacgacggtggcggtggcggatacggcggcggtcgccgcgagggcggctacggcggtggtggctacggcagccgcggtgactccggtggcaactggaggaactaatggggtggccctcccgtgctggcagccaagttatcctatatatctattagtgttcgtgttaccatttgatccgagttaccccagagtttagtgtccgtgttacctgttggttcccatgttaccgttcccgagttgtttccgcaatgaaatgagaagaaaagagtgagcaaggtttttgttcgcatctcttgctgtgccaaaaaaaaaaaaaaaaaaaa

SEQ ID NO: 74 - protein, 160 aa, Panicum virgatum
  misc_feature: Ceres CLONE 1721386
  misc_feature: Great-hit functional homolog of the protein sequence given in SEQ ID NO 9183
  misc_feature: Great-hit functional homolog of the protein sequence given in SEQ ID NO 9185
  misc_feature: Great-hit functional homolog of the protein sequence given in SEQ ID NO 9703
  misc_feature: Useful for making plants with altered Lignin content
  misc_feature: Useful for making plants with altered alkaloid content
  misc_feature: Useful for making plants with modulated biomass
  misc_feature: Useful for making plants with modulated nitrogen use efficiency
  misc_feature: The plant is abnormally small.
MAAADVEYRCFVGGLAWATDNASLQQAFASYGDVLDSKVITDRETGRSRGFGFVTFSTEQSMLDAIEAMNGKELDGRNITVNQAQSRGGGGGGGGGGYGGGRQGGYGGGGGGYGGGRREGGYGGGGYDGGGGGYGGGRREGGYGGGGYGSRGDSGGNWRN

SEQ ID NO: 75 - DNA, 830 bp, Panicum virgatum
  misc_feature: Ceres CLONE 1721520
  misc_feature: Encodes the peptide sequence at SEQ ID NO. 76
aaaaaaaaaaaaaaacttttatttccgttccccttttccaaagccccatcaagtcctccgccgtcggccatggggcaagcctggggctctctccaagataaactgcaagggcggcggtggaaggagcggcaggtgcggaagatcaccgacaaggtgttcgaccgcctgacggaggacgcccagaagcgcgataaggaggccctcaccttggaggaggtctacatcgcggtcctctgcgtctacaatgatatcaacaagtacttgccggggccgcaccacgatcccccgtccaaggagaagctcaaggcaatgatggatgagtacgacgtcaacctggacggcctcctggaccgcgaggagttcgcggagttcatccggaagctgacggcggactcgctgtgctccatcagcctgaagctcgtgatcccgctggtggccgcgccggcgctggcgatggcgaccaagcgggcgaccgagggcgtccccggcgtgggcaaggtggtgcgcaagatgcccaacgcgctctacgcgtcggccatcaccctgggcgtcgtgctggtgcagaaatcctccgagggcgtcgagtgactcgccaatcggagcagcagcgcgccgttatgtgcctgccataggctggagctgcagcagggtatctaggatagatgctgctttcgacttgttcgagcgatgctgtgatcaaacaaacatctgatgtgatttattatggtctgggtgccgatcctgtgaattgtcttgtcatgaacaatttaggaagtgaacaataaagctgtactccttgttatgctttttaaaaaaaaaaaaaaaaaaaa

SEQ ID NO: 76 - protein, 172 aa, Panicum virgatum
  misc_feature: Ceres CLONE 1721520
  misc_feature: Great-hit functional homolog of the protein sequence given in SEQ ID NO 9462
  misc_feature: Useful for making plants with modulated cold sensitivity
MGQAWGSLQDKLQGRRWKERQVRKITDKVFDRLTEDAQKRDKEALTLEEVYIAVLCVYNDINKYLPGPHHDPPSKEKLKAMMDEYDVNLDGLLDREEFAEFIRKLTADSLCSISLKLVIPLVAAPALAMATKRATEGVPGVGKVVRKMPNALYASAITLGVVLVQKSSEGVE

SEQ ID NO: 77 - DNA, 841 bp, Panicum virgatum
  misc_feature: Ceres CLONE 1721527
  misc_feature: Encodes the peptide sequence at SEQ ID NO. 78
aatttttttttcccccgactcctcgcttcctcccgtttgtggccgagccccccgcgacacgccgtcgccgccgcgcgcgcttagaagagagggaggcggccgcagcatcgaccccgcgccacccctcctgatcccccggcatcgatcgggtttgatccatggcgtcgaagaggatcctgaaggagttgaaggacctgcaaaaggacccgcccacgtcctgcagcgcaggtcctgttggtgaggacatgttccattggcaaaccactatcatggggccttcggacagcccgtttgctggtggggtattcttggtgaacattcatttcccacctgattatcctttcaaaccaccaaaggtgtcatttcgcactaaggtgttccacccgaacattaacagcaatggcagcatttgccttgacattctcaaggaacagtggagccctgctttgaccatatcaaaggtgctcctctcaatctgttcgctgctcacagacccgaaccctgatgatccgcttgtgcctgagattgctcacatgtacaagactgatagggccaagtatgagtcaactgctcgctcctggacgcagaagtacgccatgggctagaagaaaggccaattggtgaatgtgcgcaaccctgaaacgttatcacctaaataaccagccaagtcactctccccgcaaccaagtatgaatggacttttgagggctattgtgtcctgttgaactcatatgtattaccttgtgaagtccgtttgagtctggtagtctgttctacctgactgatccgttatctgatgttgcatcgttaatcatatttgcaaaaaaaaaaaaaaaaaaaa

SEQ ID NO: 78 - protein, 148 aa, Panicum virgatum
  misc_feature: Ceres CLONE 1721527
  misc_feature: Great-hit functional homolog of the protein sequence given in SEQ ID NO 9309
  misc_feature (1)..(148): SWISSPROT Homolog: EC 6.3.2.19 Ubiquitin-conjugating enzyme E2-17 kDa
  misc_feature (1)..(148): SWISSPROT Homolog: EC 6.3.2.19 Ubiquitin-conjugating enzyme E2-17 kDa 10/12
  misc_feature: Useful for biocontainment applications
  misc_feature: The plant produces a reduced number of seeds.
MASKRILKELKDLQKDPPTSCSAGPVGEDMFHWQTTIMGPSDSPFAGGVFLVNIHFPPDYPFKPPKVSFRTKVFHPNINSNGSICLDILKEQWSPALTISKVLLSICSLLTDPNPDDPLVPEIAHMYKTDRAKYESTARSWTQKYAMG

SEQ ID NO: 79 - DNA, 813 bp, Panicum virgatum
  misc_feature: Ceres CLONE 1721569
  misc_feature: Encodes the peptide sequence at SEQ ID NO. 80
gacccacgattgacggctcctttgaccccccatcgtctcgtctcgtctcgtctcgtcttcctctgtcgccgcacgaaggttgaggcaatccaccccgctccccccgcccgcgcccccaagccctgcgctccgcagcccggatccatggccaacagcaacctcccgcgccgaatcatcaaggagacgcagcggctcctcagcgaaccagcgccagggattagcgcgtcgccgtcggaggagaacatgcggtacttcaatgttatgatccttggccccgcgcagtcaccctatgaagggggagtttttaagctcgaactattcttgcctgaggaatatcctatggctgctccaaaagttagatttctcaccaaaatttatcaccccaacattgacaagcttggtaggatatgccttgacattcttaaggacaaatggagtccggctcttcagatacgtactgttctgttgagcatacaggcactgctgagcgcaccaaatccggacgatcctctctctgacaacattgcaaagcactggaaagcaaatgaagctgaagctgtcgagacagcgaaggagtggactcgcctttatgcaagtggggcatgacaaccaagggttgttatctttgtaataacaatatcacctgcttgagagcaaattgcaatgttttgcaacaggggaaaaatgatcgaaccacgacagttcgaattgctttgtacttgtgtctccgttcagtgcagtaagcatcaaagcctgtgttgcttggtctgattcaatttgctgttatgtggctaaaaaaaaaaaaaaaaaaaa

SEQ ID NO: 80 - protein, 153 aa, Panicum virgatum
  misc_feature: Ceres CLONE 1721569
  misc_feature (4)..(150): SWISSPROT Homolog: EC 6.3.2.19 Ubiquitin-conjugating enzyme E2 N
MANSNLPRRIIKETQRLLSEPAPGISASPSEENMRYFNVMILGPAQSPYEGGVFKLELFLPEEYPMAAPKVRFLTKIYHPNIDKLGRICLDILKDKWSPALQIRTVLLSIQALLSAPNPDDPLSDNIAKHWKANEAEAVETAKEWTRLYASGA

SEQ ID NO: 81 - DNA, 724 bp, Panicum virgatum
  misc_feature: Ceres CLONE 1721580
  misc_feature: Encodes the peptide sequence at SEQ ID NO. 82
aaaccaaacaaacaccctccacctccagctcctttgcccccaatcgaatcgaaggctcccgagacctagcgcgatgtccgccatggagaccgacatcaacgcgccgccgccgcccgcacccgccggcgagggctcctccgcggccggcccgtcctcatcctcctcccgcaagcccaacaagcgcttcgagatcaagaagtggaacgccgtcgcgctctgggcatgggatatcgtcgtcgataactgcgccatctgccgcaaccacatcatggatctatgcatcgagtgccaggcgaaccaggccagcgccaccagcgaggagtgcactgtcgcttggggtgtctgtaatcatgcttttcacttccactgcatcagcaggtggcttaagactcgccaagtgtgcccattagacaacagtgagtgggagttccagaaatatggccactagagcctgggtcacccgcatgtgccgttggagcttgtttctggctactgctgctgcaatctaagtgttttgtctgccaaacagctcgttcttttgctgctttcaatgcctgcatctatcgcccgtcaattatcactggtagtgcgtccatcctgggcttgtatttggatgattcattgaggaccatattatagtagttccttatcaatgttatgtggatctgcataagtgagcttgaattgtgctgtggtacatttccaaaaaaaaaaaaaaaaaaaa

SEQ ID NO: 82 - protein, 124 aa, Panicum virgatum
  misc_feature: Ceres CLONE 1721580
  misc_feature (1)..(56): Pfam Name: zf-C3HC4 Pfam Description: Zinc finger, C3HC4 type (RING finger)
MSAMETDINAPPPPAPAGEGSSAAGPSSSSSRKPNKRFEIKKWNAVALWAWDIVVDNCAICRNHIMDLCIECQANQASATSEECTVAWGVCNHAFHFHCISRWLKTRQVCPLDNSEWEFQKYGH

SEQ ID NO: 83 - DNA, 721 bp, Panicum virgatum
  misc_feature: Ceres CLONE 1721598
  misc_feature: Encodes the peptide sequence at SEQ ID NO. 84
atcgccatcctcctctccctccgatcagaagcagcacagccagcaccggccgaccagcgcagcggccacaccgagcgaccggtccaccatccacagcttcaatcacacgaccatggcgtcgcagcagcggaggcagcaggagcagcaggcggcggcgccggtggggttcgaggactacctgccggtgatggcggagcggctgggcgaggagggcctgatgcgggagctggcgagcgggttccggctgctcatggacccggcgcgcgggctcatcaccttcgacagcctccgccgcagcacgccgctgctgggcctgggcgccatgtccgacgacgacctccgcgggatgctcgccgagggcgacttcgacggcgacggcgcgctcagcgagatggagttctgcgcgctcatgctccgcctcagccccgagctcatggacgggccccgcaggtggctcgacgacgccgtctcgcaggcctcgcacttcctcttcttcgccagctaggcgcgctgcctgcccgggacgtgcgcataggaattcctgagctcttcttcttcgttctcgttgttcatagctggattaggaagggactggcggctgattggtcgatcgatggattccatatcatgtgtactcgcctgttcctcccctactggagtctgaattgatcaaacatgcttcttcctcttttgaccatcacaaaaaaaaaaaaaaaaaaaa

SEQ ID NO: 84 - protein, 130 aa, Panicum virgatum
  misc_feature: Ceres CLONE 1721598
  misc_feature: Great-hit functional homolog of the protein sequence given in SEQ ID NO 9669
  misc_feature: Useful for making plants with altered glycerol content
MASQQRRQQEQQAAAPVGFEDYLPVMAERLGEEGLMRELASGFRLLMDPARGLITFDSLRRSTPLLGLGAMSDDDLRGMLAEGDFDGDGALSEMEFCALMLRLSPELMDGPRRWLDDAVSQASHFLFFAS

SEQ ID NO: 85 - DNA, 715 bp, Panicum virgatum
  misc_feature: Ceres CLONE 1721630
  misc_feature: Encodes the peptide sequence at SEQ ID NO. 86
ctagtggggcttcaggactcgacctctcgcgccgccgccatgaccttcaagcgccgcaacggcggccgcaacaagcacggccgcggccatgtcaagtacatccgctgctccaactgcgccaagtgctgccccaaggacaaggcgatcaagaggtttcaggtgaggaacatcgtggagcaggcggccatcagggacgttcaggaggcgtgcgtccatgacggatacgtccttcccaagctctacgccaaggtgcaccactgcgtctcgtgcgcgatccacgctcacatcgtccgcgtccgttcccgtgagaagcgcagggaccgcaagccaccggaacgcttcaggcgcagggaggataggcctgctggtgggcaaggagggccccgccctggtggacctggccctgctggtgctgctgcagctccggcaccaaatgctcctcgcccataggtttagcttatcgaccgcataagtctggcctgttggtagccatggctgtcttacttcagtaccagtgtgtcatcaatcagaggagtgtggagttgctatattagtagaacttttgtctgaagtctggaatgtttgctaagaggttatcttgtcatttgaatattatgctcagctataatttcacttgaacatcagtgatatgggtattgagagctatcttttagtttcaacctaagttcttatttaaaaaaaaaaaaaaaaaaaa

SEQ ID NO: 86 - protein, 136 aa, Panicum virgatum
  misc_feature: Ceres CLONE 1721630
  misc_feature: Great-hit functional homolog of the protein sequence given in SEQ ID NO 9225
  misc_feature: Useful for making plants with modulated nitrogen use efficiency
MTFKRRNGGRNKHGRGHVKYIRCSNCAKCCPKDKAIKRFQVRNIVEQAAIRDVQEACVHDGYVLPKLYAKVHHCVSCAIHAHIVRVRSREKRRDRKPPERFRRREDRPAGGQGGPRPGGPGPAGAAAAPAPNAPRP

SEQ ID NO: 87 - DNA, 991 bp, Panicum virgatum
  misc_feature: Ceres CLONE 1721640
  misc_feature: Encodes the peptide sequence at SEQ ID NO. 88
gcacaggcacagcgagctccccaccccacgcactcaacagcaacagctaggctacacccacaagacagcaacatggctgaggaggccaagaaggtggaggtggaggtcgccaaggagcccgaggcggcgccggcgccggcgccggcgccggccgcggaaccggccaaggaggacgtccccgaggagaaggccgtcatccccgccaccgagccgccggccgccgactccaaggccctggctatcgtcgagaaggttgcagatgaacctgctacagagaagcctgccgctgagaagcaagggagctccaatgacagagatctcgctcttgcaagggtggaaactgagaagaggaactctttgatcaaagcatgggaagagaatgagaagacaaaagctgagaacaaagctgttaaaaaaatatctgctattctttcatgggagaactcaaagaaagcgaacatagaagctgaactgaagaagattgaggagcaactggaaaagaagaaggctgaatacgccgagaagatgaagaacaagatcgcaatcatccacaaggaagccgaagagaagcgggcaatggtcgaagcaaaacgcggcgaggaggtcctgaaggctgatgagatggctgccaagtaccgcgccaccggccacgctcccaagaagctcattggatgctttggagcctaagaaacgtcccgagtaacaccaagcagaaagtgaataacgtcaatccgtgattgcttggttctctcgctctatcaagtgtgtagtttgtcttcaaaagtgtgtaaagcctaccgttgctgtatatacgcatattccttcaaagacaggcgtttggtggtggtgtacatgttgaatgcttgacgagcaacattcttatgtgtagttaagaagtcacattgttgttgttgacatttaagcagacatttttttcttttcctagtgttattgctatttttttgtctgtcaaaaaaaaaaaaaaaaaaaa

SEQ ID NO: 88 - protein, 204 aa, Panicum virgatum
  misc_feature: Ceres CLONE 1721640
  misc_feature: The sequence is a functional homolog of  SEQ ID NO 1492 in the  11/479,226 US patent application
  misc_feature: The sequence is a functional homolog of  SEQ ID NO 438 in the  10/666,642 US patent application
  misc_feature: The sequence is a functional homolog of  SEQ ID NO 496 in the  11/435,388 US patent application
  misc_feature: The sequence is a functional homolog of  SEQ ID NO 644 in the  11/435,388 US patent application
  misc_feature: The sequence is a functional homolog of  SEQ ID NO 716 in the  10/412,699 US patent application
  misc_feature: Useful for making plants with modulated growth and phenotype characteristics
MAEEAKKVEVEVAKEPEAAPAPAPAPAAEPAKEDVPEEKAVIPATEPPAADSKALAIVEKVADEPATEKPAAEKQGSSNDRDLALARVETEKRNSLIKAWEENEKTKAENKAVKKISAILSWENSKKANIEAELKKIEEQLEKKKAEYAEKMKNKIAIIHKEAEEKRAMVEAKRGEEVLKADEMAAKYRATGHAPKKLIGCFGA

SEQ ID NO: 89 - DNA, 677 bp, Panicum virgatum
  misc_feature: Ceres CLONE 1721664
  misc_feature: Encodes the peptide sequence at SEQ ID NO. 90
atcgttcacagtcacagctccacaaacgaagcactgcaaactcaaatcacagctctccagcttccattcaggaagaaaaagagaagggtcagaggaccaaccgtgatcagcgccaagaggatcgctcagatggccaagaagtggcagaggatggcggcgctcgggaggaagcgcctcgcctggcttaaggaggaagccgaccactgctgcacatccgtggcgagcaatggccactgcgcggtgtacacggccgacggggcgcggttcgaggtgccgctggcgtgcctcggcaccgcggtcttcgcggagctcctgcggatgtcgcaggaggagttcggcttcgcgggcggcgacgacggcaggatcacgcttccctgcgacgcggcggtgatggagtacgccatgtgctttctcaggagaggcgcctctgccgagctagagcaggcgttcctgagcaccatggcgatgccgtgccactatgcgagccgtgtggcgccgcacgtagaagccagccggcaggttgctgtctagagttgcagttcagtgtatgtatagtagggcaaagataggtgttcttcagcgccttctgatcctgcagcgaccaaggtgttaaaagtaccaagaagttccttttcaaaagaaaatgcaagaagttagaaaaaaaaaaaaaaaaaaaa

SEQ ID NO: 90 - protein, 133 aa, Panicum virgatum
  misc_feature: Ceres CLONE 1721664
  misc_feature (4)..(101): Pfam Name: Auxin_inducible Pfam Description: Auxin responsive protein
MAKKWQRMAALGRKRLAWLKEEADHCCTSVASNGHCAVYTADGARFEVPLACLGTAVFAELLRMSQEEFGFAGGDDGRITLPCDAAVMEYAMCFLRRGASAELEQAFLSTMAMPCHYASRVAPHVEASRQVAV

SEQ ID NO: 91 - DNA, 942 bp, Panicum virgatum
  misc_feature: Ceres CLONE 1721676
  misc_feature: Encodes the peptide sequence at SEQ ID NO. 92
atcgaaccaaaagctccgatccgtccttacgtgcttaaccacctacacagctcacactagtcaggtcactcgtacacagccagtgcaagctagcatggcgcacaagctcccagccaccctcgtcgccgccttcgccgtcctcctggccctcgccgcgccgctggtggtcatcgccggcgaccccgacatgctccaggacatctgcgtcgccgactaccattccctcaagggcccgctgaggctgaacgggttcccgtgcaagagggtggagaacgtgacggcgcacgacttctcctccggcctgctggcgaagcccggcaacaccagcaacgcggtggggtcggcggtgacggcggcgaacgtggagatggtggcggggctcaacaccctgggcgtgtccatggcgcgcatcgacttcgcgccgtggggtgtgaacccgccgcacacccacccgcgcgccaccgagatcatcttcgtcctcaagggatccctccacgtcggcttcatcaccaccgcgaacgtcctcttcgcacgcaccctccgaaggggcgagatcttcgtcttcccccgcggcctcgtccacttccagaggaacaacggccgcgcccccgccgccgtcgtctccgccttcaacagccagctgccgggcacgcaggccgtcgccgccacgctcttcggcgcctcgccgccggtgcccgacgacgtgctcgccagggcgttccagatcgacgccggcctcgtcgaggccatcagggccaagttcccggcgcccatgtagtaggcgcgcgcatgctggccctgccaatgccatgcaagcagatcgatggtgatttcagtccgagcgatacgattgtgtgctagcgcgctgtaataaagcatgatccgtcaaataattggttgggtttgtttcgtgtgtgtggtcaaaaaaaaaaaaaaaaaaaa

SEQ ID NO: 92 - protein, 227 aa, Panicum virgatum
  misc_feature: Ceres CLONE 1721676
  misc_feature (4)..(227): SWISSPROT Homolog: EC 1.15.1.1 Nectarin-1 precursor
MAHKLPATLVAAFAVLLALAAPLVVIAGDPDMLQDICVADYHSLKGPLRLNGFPCKRVENVTAHDFSSGLLAKPGNTSNAVGSAVTAANVEMVAGLNTLGVSMARIDFAPWGVNPPHTHPRATEIIFVLKGSLHVGFITTANVLFARTLRRGEIFVFPRGLVHFQRNNGRAPAAVVSAFNSQLPGTQAVAATLFGASPPVPDDVLARAFQIDAGLVEAIRAKFPAPM

SEQ ID NO: 93 - DNA, 766 bp, Panicum virgatum
  misc_feature: Ceres CLONE 1721703
  misc_feature: Encodes the peptide sequence at SEQ ID NO. 94
acagctcaccagcagcacaacctctcaccggccgtctcgcttctgtaatctgactgaggtcgatctctcagctccatccatccatccgattccgatcatggcagccagcagcaacaagcaggcgtcgtctctcgcgctcttccttgtggcgctcgcggtatcgagcgccgtgctggtgagcctggcgccgggcgcgggtgcggcgacgacgacgtgcaccccgacgcagctgacgccgtgcgcgccggccatcatcgggaacgcggcgcccacggcggcgtgctgcgcgaggctcaaggcgcacccggcgagctgcttctgccagtacaagaagaaccccaacatgcagcgctacgtcaactcccccaacggcaagaaggtcttcgccgcctgcaaggtgcccctgcccagttgctgagcgcccgatccgcccgatcgagctctcgcgttccgatcgacgaagcgggcgcgcccccgtgcgagcacaccggccgatcgatgacatggctcgctggtgctatctgctgtactaataaaagaccagtgatctgcttagagttcgtacgtaatacttgctgagaataaattgaggcgtagtagtgcttggggccttggcacgttgtgcagaccccagacttgctgtatcgtttaattatgtatgaacacttttcatatatgcagtatttgtatgagcttctatgaagtaaatgctgcaagaataaaagaatgtcactcggagttgccttaaaaaaaaaaaaaaaaaaaa

SEQ ID NO: 94 - protein, 106 aa, Panicum virgatum
  misc_feature: Ceres CLONE 1721703
  misc_feature (1)..(67): Pfam Name: Tryp_alpha_amyl Pfam Description: Protease inhibitor/seed storage/LTP family
MAASSNKQASSLALFLVALAVSSAVLVSLAPGAGAATTTCTPTQLTPCAPAIIGNAAPTAACCARLKAHPASCFCQYKKNPNMQRYVNSPNGKKVFAACKVPLPSC

SEQ ID NO: 95 - DNA, 883 bp, Panicum virgatum
  misc_feature: Ceres CLONE 1721704
  misc_feature: Encodes the peptide sequence at SEQ ID NO. 96
atcccatctcactagctagcactagcagtcgcttgctgctactcagttcttgtagctagcatagtgctcagctgagcttacaacctaaatatataaggcgtaaaccatggcatccaaggccgtcctcttcttggcactcaacctcctcttattcacggtggccaacgcctgcggcagctgcccgaccccaccaacgcccccggctgtgccgccgccgccgccaccttctaccccacccccatcatccagcggcaagtgcccggtgaacgcgctcaaattcggcgtgtgcgtcaacgtgctcggcctcgtcaagggcgaggccggcaaggtgcccgctgagccgtgctgcagcctcctcaacggcctcgccgacttggaggccgccgtctgcctctgcacggccatcaaggccaacgtgctcggcgtcgccatcgacatccctatcaagctcagcgccctcgtcaactactgtggcaagtgcgtgcccaaaggctacacctgtgcgtaaacacgccgcggctacacgctcgtatagccgctcacgcaatctgcatggcatatatacgtgcgttgggtttgctgctgaactcttctgtctcatttgtgcatgcaacttcggttctgcaacctagaaccatgcatttcgtccaaatgctttgtcagtttgtgtgtattgcattgtgtctcttgtcgaatttcctttcatttttgaatttgttcataagaggcatgcatctctccttgaagtgaacaagaggagtagtgttgcttctagttattgcaaatcatgtaatctgttgggaaacttttattgtgtatgtaaaatcaagcgcttgaactatctgtaataatacttattcgttaaaaaaaaaaaaaaaaaaaa

SEQ ID NO: 96 - protein, 133 aa, Panicum virgatum
  misc_feature: Ceres CLONE 1721704
  misc_feature (1)..(82): Pfam Name: Tryp_alpha_amyl Pfam Description: Protease inhibitor/seed storage/LTP family
MASKAVLFLALNLLLFTVANACGSCPTPPTPPAVPPPPPPSTPPPSSSGKCPVNALKFGVCVNVLGLVKGEAGKVPAEPCCSLLNGLADLEAAVCLCTAIKANVLGVAIDIPIKLSALVNYCGKCVPKGYTCA

SEQ ID NO: 97 - DNA, 831 bp, Panicum virgatum
  misc_feature: Ceres CLONE 1721712
  misc_feature: Encodes the peptide sequence at SEQ ID NO. 98
aatagcgagctgctggtcctgcacaatatagcagtagttcaatatgcctcagacttgtaatcagctacctgcaaacgccaaacaggcaattcctcacttggtgagcgttataacagcgcgagcattacctcgctccggccgctgccaggtcgcctttcctggccagacggcacatcttggtggacggagggccctgcgtgctgcccccaaactctgtcgtccgcttcatgccatcctagatacagagagaaaattaaggttggacaaatatttcgaagtggagatgactgtacgtgattgtgatcttgacaaatatggagttgtcaataatgccatctatgctagttacatcgataaagcccgagaaatgctgcttgcgggcctcggtttcagcacagattcgctagcatccaggggctgtgctttggcaacgtcagagttaaacctcaagtattttgcacctctgaaggataaagacaagtttgtggtaatgatgaggccagtcgaaatcaagggtgtacggatatttgcagagtattttatagaaacgctgccaaatcgtaatgtagttttaaaagcggtgggcagcttcgtttgcctcaacaaagactaccgtccaactcgtgtgttcccggagttgtcaaccaagctgctgcagttcttcgcatcggacgatgacaagctcaattagctttatggttgtctactcgtgggacctcgtgtaataatataataaagatctattcctacataagccgtcacgggcacttggctgaacctaaagaaattgtctgtagttttaattcggatcaaaaaaaaaaaaaaaaaaaa

SEQ ID NO: 98 - protein, 215 aa, Panicum virgatum
  misc_feature: Ceres CLONE 1721712
  misc_feature (1)..(86): Pfam Name: 4HBT Pfam Description: Thioesterase superfamily
MPQTCNQLPANAKQAIPHLVSVITARALPRSGRCQVAFPGQTAHLGGRRALRAAPKLCRPLHAILDTERKLRLDKYFEVEMTVRDCDLDKYGVVNNAIYASYIDKAREMLLAGLGFSTDSLASRGCALATSELNLKYFAPLKDKDKFVVMMRPVEIKGVRIFAEYFIETLPNRNVVLKAVGSFVCLNKDYRPTRVFPELSTKLLQFFASDDDKLN

SEQ ID NO: 99 - DNA, 815 bp, Panicum virgatum
  misc_feature: Ceres CLONE 1721726
  misc_feature: Encodes the peptide sequence at SEQ ID NO. 100
accagcacttgcttgtcattcccaagcaaacgcattcatccagcaccggccgcactcagctcgtcaagctaagttcacattcacgcacaatccaagcaatggctcgcgctcatcaggtcgtggctatcgccgccgttgccgccgtcgtgctgctcgccgccgcggcgaccaccaccaaggccgccgtgacctgcgggcaggtgagctcggccatcggcccctgcatcgcctacgcccgcggcaccggctccggcccctccgcagcctgctgcagcggcgtgaggagcctcaactcggcggccaggagcaccgccgacaggcgcgccgcatgcaactgcctcaagtccgccgccggcagggtgagtggcctcaaacttggaaacgccgcaagcatcccctccaagtgcggagtcagcatcccctacaccataagcccaaacgtcgactgctccagggtgagctaaacgacgaccagtaccgtcgctacctatctacttaattatcgtctatgatcgagttcgatgatgatgaataaaaatctctccggcgtcgcgtgcactgtcgtcatgcgctagctcagctcgcgtggtacgtcgtcgctcagcatgtgatgagcgatcgagagacggagtcctctccgatccttgtgtccttttgcatgcttcgtacgttttgtgtctgcatctgcatagtagtgtgtcctccatttccgtttggaggagacccactctgtaccttgtccactataccttttaatacatcatacaccacttttttgtacgctccatgactttatttcgatgcttctctgcttc

SEQ ID NO: 100 - protein, 121 aa, Panicum virgatum
  misc_feature: Ceres CLONE 1721726
  misc_feature (1)..(86): Pfam Name: Tryp_alpha_amyl Pfam Description: Protease inhibitor/seed storage/LTP family
MARAHQVVAIAAVAAVVLLAAAATTTKAAVTCGQVSSAIGPCIAYARGTGSGPSAACCSGVRSLNSAARSTADRRAACNCLKSAAGRVSGLKLGNAASIPSKCGVSIPYTISPNVDCSRVS

SEQ ID NO: 101 - DNA, 827 bp, Panicum virgatum
  misc_feature: Ceres CLONE 1721793
  misc_feature: Encodes the peptide sequence at SEQ ID NO. 102
aagaaacactccaagcaaacgatcagaagctaaccaaatcactcgatcctcacccaagaatcctcgattactcagaaacaccacttcagaaaacccaccgaccatgtcgctgatccgccgcagcaacgtgttcgaccccttctccctcgacctctgggaccccttcgagggcttccccttcggctccggcagcagcagcctcttcccctcgttcccgcgcaccagctcggagaccgcggccttcgccggcgcgcggatcgactggaaggagacccccgaggcgcacgtgttcaaggcggacgtcccggggctgaagaaggaggaggtgaaggtggaggtcgaggacggcaacgtcctccagatcagtggcgagcgcaacaaggagcaggaggagaagacggacacctggcaccgcgtcgagcgcagcagcggcaggttcatgcgcaggttccggctgccggagaacgccaagacagagcagatcagggcgtccatggagaacggcgtgctcaccgtcaccgtgcccaaggacgaagtcaagaagcccgaggtgaagtccatccagatctcgggctagacatcatcgtgcctgcgtgatgaaccatgctgctgccctctggagtccgcctgggtcgtgctgctggtgaaataaaaatcgggttcgacgttgtggtctcgtgtagtgtcaagagtccgcgtgatgggcatgtcgtccctgcgtccgtcatggcatggtttgaatccagtttgcggtcattagtgtgtctgtatttagtctccactggtaacgaactccaatgttgctgcaaaaaaaaaaaaaaaaaaaa

SEQ ID NO: 102 - protein, 157 aa, Panicum virgatum
  misc_feature: Ceres CLONE 1721793
  misc_feature (1)..(104): Pfam Name: HSP20 Pfam Description: Hsp20/alpha crystallin family
MSLIRRSNVFDPFSLDLWDPFEGFPFGSGSSSLFPSFPRTSSETAAFAGARIDWKETPEAHVFKADVPGLKKEEVKVEVEDGNVLQISGERNKEQEEKTDTWHRVERSSGRFMRRFRLPENAKTEQIRASMENGVLTVTVPKDEVKKPEVKSIQISG

SEQ ID NO: 103 - DNA, 912 bp, Panicum virgatum
  misc_feature: Ceres CLONE 1721799
  misc_feature: Encodes the peptide sequence at SEQ ID NO. 104
aaaagccagctccatttctcgccaccaccaccagctcgctctcgccgcgcctcacccaaagctcgccattgattgattgatttccacccacgtaggagcgagcagcagcaacaacaaccgcacagctagccgagctcggcccggctggcgtcgatggcgaaatgcagcagcaagatccgctacatcgtgtggctccggcagacgctgcggcggtggcggtcccgcgccgcggcgcgcgcggcggcggcggcggtcgggagcgaggcggtggtcccggcggggcacgtggcggtgtgcgtgggcggcgcggcgcggcggttcgtggtgcgggcggcgcacctgaaccatccggtgttccgggagctgctccggcaggcggaggaggagtacggcttcccgtccggcgcctgcgcgggacccatcgcgctcccctgcgacgagggcctcttcgagcacgtcctccgccacctctcctccccgtccaaggcctcccggttcgtcaccctagagaacatcaagagcggcgcgctatcctgctgctgcgtcgccgccgcaggcgactcgctcccgctcctccacggcatcgccgccgacaaggccgtgtggtgaacgcgctcacggagggtagccgccgctcgcgccattgcgcgtacgtgtgcgaccatttcgtcttccttttttttcttcttttctttttttgccctcgctccctccatttccatccgagaggagctgaggcgcgacgggaacaagcaagcaagattgagcgcggccggccagaggcggtgaagtgagatggctgagaaagtcctaggatttttagacgactgccaagtctagtcatccattcattcccttgtccaatccgggaaatttttagtggtgaaggtttaaaaaaaaaaaaaaaaaaaa

SEQ ID NO: 104 - protein, 151 aa, Panicum virgatum
  misc_feature: Ceres CLONE 1721799
  misc_feature: Great-hit functional homolog of the protein sequence given in SEQ ID NO 9502
  misc_feature (1)..(98): Pfam Name: Auxin_inducible Pfam Description: Auxin responsive protein
  misc_feature: Useful for making plants with modulated cold sensitivity
  misc_feature: Useful for making plants with modulated nitrogen use efficiency
MAKCSSKIRYIVWLRQTLRRWRSRAAARAAAAAVGSEAVVPAGHVAVCVGGAARRFVVRAAHLNHPVFRELLRQAEEEYGFPSGACAGPIALPCDEGLFEHVLRHLSSPSKASRFVTLENIKSGALSCCCVAAAGDSLPLLHGIAADKAVW

SEQ ID NO: 105 - DNA, 917 bp, Panicum virgatum
  misc_feature: Ceres CLONE 1721831
  misc_feature: Encodes the peptide sequence at SEQ ID NO. 106
ctcttcttcccgattccaaagccgctctcgcccccagaaataaagcagctcctcccgggggcggcgaacaactccccatcgccaaaaccctagccccgatccgatcgaggagcactgcttccttcccatggcgggcaccgctagccaggcgagcctcctgctccagaagcagctcaaagatctcgcgaagaaccccgtggatgggttctctgccgggctggtggatgatagcaacgtcttcgagtggcaggtcaccatcatcggcccgcctgacaccctatatgacggaggctacttcaatgcaataatgaccttccctcagaattatcccaacagcccaccatctgtgagatttacttctgagatgtggcatccaaatgtttatcctgatgggcgtgtgtgcatttctattcttcatccacctggtgaagatcccaatggctatgaacttgcaagtgaacggtggacaccagtgcacacggttgaaagtatagttctgagcatcatttcgatgctctctagtccaaatgatgagtctccagcgaacattgaagcggctaaggattggagagaaaagagggatgagttcaagaaaaaggttaggcacattgttcgcaaatctcaggaaatgctctgaaagaggatcatctggggagtaacgagtgctgcaaccggtgctgtgtgtctcaccatcaatcacccagcgcccgcatttcggcttctcccctgtatattttccattcagtgtcattagtatggtggtgttggtctctttgtcagagaaactcgggaatgttgcttatccttaaaatttgattgtattatgtggcacggggtgttggtgtggacaatgtttgaacatgctgccacctaatcataattttcatgatgaacatcaaaaaaaaaaaaaaaaaaaa

SEQ ID NO: 106 - protein, 169 aa, Panicum virgatum
  misc_feature: Ceres CLONE 1721831
  misc_feature (5)..(168): SWISSPROT Homolog: EC 6.3.2.19 Ubiquitin-conjugating enzyme E2 7
  misc_feature (6)..(168): SWISSPROT Homolog: EC 6.3.2.19 Ubiquitin-conjugating enzyme E2 13
MAGTASQASLLLQKQLKDLAKNPVDGFSAGLVDDSNVFEWQVTIIGPPDTLYDGGYFNAIMTFPQNYPNSPPSVRFTSEMWHPNVYPDGRVCISILHPPGEDPNGYELASERWTPVHTVESIVLSIISMLSSPNDESPANIEAAKDWREKRDEFKKKVRHIVRKSQEML

SEQ ID NO: 107 - DNA, 1071 bp, Panicum virgatum
  misc_feature: Ceres CLONE 1721862
  misc_feature: Encodes the peptide sequence at SEQ ID NO. 108
gtgagcttagggagctgaagcttttgcgatccctccctctcccaccgccgcatcgcattctccggtccgaagctctctgctcgcagccatggggaagagctacccgaccgtgagcgccgagtaccaggaggccgtcgagaaggccaggcgcaagctccgcgccctcatcgccgagaagagctgcgcccccctcatgctccgtctcgcgtggcactcggcggggacgttcgacgtgtcctcgaggaccggcggccccttcggtacgatgaagaacccggcggagcaggcgcacggcgccaacgcgggtctggacatcgccgtgcggttgctcgagcccgtcaaggaggagttccccatcctctcctacgccgacctgtaccagcttgcgggagttgtggccgtggaggtgaccggtggacctgaggtccccttccaccccggtagggaggacaagcctcagcccccacctgagggccgccttcctgatgctactaagggttctgaccatctgaggcaagtctttggcaagcagatgggcttgagcgatcaggacattgttgccctctctggtggccacaccttgggaaggtgccacaaggagcggtctggttttgaggggccctggactagaaaccctttggtctttgacaactcttacttcaaggaacttctgagtggtgacaaagagggcctccttcagctcccaagtgacaaagccctgctgagcgaccctgtcttccgccctctcgtggagaaatatgctgcggatgagaaggctttctttgatgactacaaggaggcccacctcaagctctctgaactggggttcgctgatgcataaaatggcgtatcctagactactacgtgctgctgcttgtatgggatcgtgtaatcttgttttgcatctggagtcagtgtgaaccagcagattaagtatcttctctgtaataaatttgttaccaagtcagtgtttggctagactctgatgctgtatcactgaaactacaagatctatgatctaccttatgaatgcagtacgttctgttacctcaaaaaaaaaaaaaaaaaaaa

SEQ ID NO: 108 - protein, 250 aa, Panicum virgatum
  misc_feature: Ceres CLONE 1721862
  misc_feature (1)..(209): Pfam Name: peroxidase Pfam Description: Peroxidase
  misc_feature (1)..(249): SWISSPROT Homolog: EC 1.11.1.11 L-ascorbate peroxidase 2, cytosolic
  misc_feature (1)..(250): SWISSPROT Homolog: EC 1.11.1.11 L-ascorbate peroxidase 1, cytosolic
MGKSYPTVSAEYQEAVEKARRKLRALIAEKSCAPLMLRLAWHSAGTFDVSSRTGGPFGTMKNPAEQAHGANAGLDIAVRLLEPVKEEFPILSYADLYQLAGVVAVEVTGGPEVPFHPGREDKPQPPPEGRLPDATKGSDHLRQVFGKQMGLSDQDIVALSGGHTLGRCHKERSGFEGPWTRNPLVFDNSYFKELLSGDKEGLLQLPSDKALLSDPVFRPLVEKYAADEKAFFDDYKEAHLKLSELGFADA

SEQ ID NO: 109 - DNA, 1016 bp, Panicum virgatum
  misc_feature: Ceres CLONE 1721895
  misc_feature: Encodes the peptide sequence at SEQ ID NO. 110
actcgcaagctgcacagacaagtggctctgagcctctggctctcagatccccttcctcctctcgcgagagcgcaccagcagctatggcgtcggtgggggcgccgccgccttggagcaggctggatggccaggtggtgctggtgacgggcgcctcctccggcatcggcagcgacttctgcctggacctagcgcgcgccggctgccgcgtcgtcgccgccgcccgccgcgccgaccgcctccgctcgctctgcgacgagatcaacgcctccgcggccgccgacgcgccccgcgcggcggccgtggagctcgacgtcgcggccgggggctcggccctggaggcggcggtgcagagggcctgggacgccttcggccgcatcgacgtcttgatcaacaacgccggcgtccgaggtgcagtgcattctccccttgattggcctgaggatgagtgggacaagatcatcaagacgaaccttaccggattatggcttgtggccaaacatgtctgtcgacgcatgcgtgatgctaagctaaagggttcggttattaacatttcgtctattgctggtcttaaccgtggccatctgcctggttccattggatacgcgtcgtccaagtccgctgtgcattctgccacaaagataatggctttggaattgggagcatatggcattagagtgaacgcgattgcgccgggactgttcaaatcagagataactgctcctctgctgcaaaagagatggttgaacactgtggcttcaaagatagtgccacttaaggaacatggcactactgatccagcattgacatcgctggttcgtttcctgattcatgaagcatcgtcatatatgactggcaacatcttcattgtagattcaggcgtcaccatacctggtgttccattattctcctctctgtaaattttcatttagattactgtagctgtgttacatatgattgcataaagcaaccagttaagaccccatgaaggaagccggcaaaaaaaaaaaaaaaaaaaa

SEQ ID NO: 110 - protein, 277 aa, Panicum virgatum
  misc_feature: Ceres CLONE 1721895
  misc_feature (1)..(177): Pfam Name: adh_short Pfam Description: short chain dehydrogenase
MASVGAPPPWSRLDGQVVLVTGASSGIGSDFCLDLARAGCRVVAAARRADRLRSLCDEINASAAADAPRAAAVELDVAAGGSALEAAVQRAWDAFGRIDVLINNAGVRGAVHSPLDWPEDEWDKIIKTNLTGLWLVAKHVCRRMRDAKLKGSVINISSIAGLNRGHLPGSIGYASSKSAVHSATKIMALELGAYGIRVNAIAPGLFKSEITAPLLQKRWLNTVASKIVPLKEHGTTDPALTSLVRFLIHEASSYMTGNIFIVDSGVTIPGVPLFSSL

SEQ ID NO: 111 - DNA, 777 bp, Panicum virgatum
  misc_feature: Ceres CLONE 1721950
  misc_feature: Encodes the peptide sequence at SEQ ID NO. 112
cccgtgctctctcagaggtgggttggcttctccccctcttaccaagtcctcggttctagggttttagttggaaggggagatggcggcggcggatgtggagtaccgctgcttcgtcggcggcctcgcctgggccaccgacaacgcgtccctccagcaggccttcgcctcctacggcgacgtcctcgactccaaggtcatcaccgaccgtgagacggggaggtcccgcgggttcggcttcgtcaccttctcaaccgagcagtcgatgctcgacgccatcgaggccatgaacggcaaggagctcgacggccgcaacatcaccgtcaaccaggcccagtcccgcggcggtggcggcggcggcggcggttacggcggcggtcgccagggaggctacggcggcggcggcggcgggtacggtggcggcggcggtcgccgtgagggcgggtacggtggcggcggctacgacggtggcggtggcggatacggcggcggtcgccgcgagggcggctacggcggtggtggctacggcagccacggtgactccggtggcaactggaggaactgatggggtagccctcccgtgctggcagccaagttatcctagatatctattagtgttcgtgttaccatttgatcccgagttaccccagagtttagtgtccgtgttaccgtttgattaggtgttggttcccatgttaccgttcccgagttgtttccgcaatgaaatgagaagaaaagagtgagcaaggtttttgttcgcaaaaaaaaaaaaaaaaaaaa

SEQ ID NO: 112 - protein, 160 aa, Panicum virgatum
  misc_feature: Ceres CLONE 1721950
  misc_feature: Great-hit functional homolog of the protein sequence given in SEQ ID NO 9185
  misc_feature: Great-hit functional homolog of the protein sequence given in SEQ ID NO 9423
  misc_feature: Great-hit functional homolog of the protein sequence given in SEQ ID NO 9703
  misc_feature: Great-hit functional homolog of the protein sequence given in SEQ ID NO 9716
  misc_feature: Useful for making plants with altered Lignin content
  misc_feature: Useful for making plants with altered alkaloid content
  misc_feature: Useful for making plants with modulated flowering time
  misc_feature: Useful for making plants with modulated nitrogen use efficiency
  misc_feature: The plant flowers significantly late compared to wild-type.
MAAADVEYRCFVGGLAWATDNASLQQAFASYGDVLDSKVITDRETGRSRGFGFVTFSTEQSMLDAIEAMNGKELDGRNITVNQAQSRGGGGGGGGYGGGRQGGYGGGGGGYGGGGGRREGGYGGGGYDGGGGGYGGGRREGGYGGGGYGSHGDSGGNWRN

SEQ ID NO: 113 - DNA, 1142 bp, Panicum virgatum
  misc_feature: Ceres CLONE 1721953
  misc_feature: Encodes the peptide sequence at SEQ ID NO. 114
gtagcatgctccggattgatcgagcttggccgtggtaatggattcggtgccttcttcctcctctccctgggccgccgccgctccctgctgccccttcgacgcgctgcggagggcgtgcgccaggcacgccgccgccgccgccagggccgccggctgggtgctcggcgcgctgctcacctgcgtcttcgccgtcgtgggctcactcgttgggatcttcattggtgccttcatggggatgtccacggaaagcggtatgctccgcggggctggcgttggggcagtctccggcgcagtattctccatcgaggctgttgaatcctgcatcgagatttggaggtccagccattcaggaaaatacagcattctctttgtgctggacatcatctctagcctcttcagcggaagaattgtgtgggagaaagtcagtccagcactgcagcgtgccgtgcaaagccagatgagtctactgagcacaccattcatcgacaacaatgacctttttgaaactggcagcacaggaggcatgtcaagggatttgattgacaggatcccaaagatgaggttcagtgctgcaagcaattgtgatcaggaaactgatagcagctgctgctcagtctgccttcaggattttggagcacaacaatttgtgagggccctgcctcaatgccaacacctattccatgtgcggtgcattgacaattggctccttaggcacgcgtcttgcccactatgtcgggctggtgttcatatagaccatatacatatgtaaataaacttgcagggtggcacctggtgtattttcatagtgaatacccgtgcacctgtttgatatcataaatatagctgtatacatagattttcactttttgttacttctccggtcttatgtgaggctatgctttcagctgcacgtttttgtcaaagtaataacatgatatgtacatcccgaaaatggaccgactaacaagctccctaaatatccttgtgcctcaagaactccgagtgtttgtgctcttgttaacttctgatgacgacctgctaatgtaattgtttgctacttggcaactaatgtcaggaccattggagtctaaccttgcaactgaaggttggtactcatagttgaaaaaaaaaaaaaaaaaaaa

SEQ ID NO: 114 - protein, 243 aa, Panicum virgatum
  misc_feature: Ceres CLONE 1721953
  misc_feature (1)..(42): Pfam Name: zf-C3HC4 Pfam Description: Zinc finger, C3HC4 type (RING finger)
  misc_feature: The sequence is a functional homolog of  SEQ ID NO 216 in the  10/225,068 US patent application
  misc_feature: The sequence is a functional homolog of  SEQ ID NO 2322 in the  10/374,780 US patent application
  misc_feature: The sequence is a functional homolog of  SEQ ID NO 242 in the  10/412,699 US patent application
  misc_feature: The sequence is a functional homolog of  SEQ ID NO 515 in the  11/479,226 US patent application
  misc_feature: Useful for making plants with modulated growth and phenotype characteristics
MDSVPSSSSPWAAAAPCCPFDALRRACARHAAAAARAAGWVLGALLTCVFAVVGSLVGIFIGAFMGMSTESGMLRGAGVGAVSGAVFSIEAVESCIEIWRSSHSGKYSILFVLDIISSLFSGRIVWEKVSPALQRAVQSQMSLLSTPFIDNNDLFETGSTGGMSRDLIDRIPKMRFSAASNCDQETDSSCCSVCLQDFGAQQFVRALPQCQHLFHVRCIDNWLLRHASCPLCRAGVHIDHIHM

SEQ ID NO: 115 - DNA, 707 bp, Panicum virgatum
  misc_feature: Ceres CLONE 1721961
  misc_feature: Encodes the peptide sequence at SEQ ID NO. 116
accaccaccccatctcaatacgatccgatctccgattgtgctgagctccatcggatccgctgcagaacctgggagcaggatccgcggtcgcgagccatggcggggagggccaacatccccaccaacaactccgccctcatcgccatcatcgccgacgaggacaccgtcaccggcttcttgatggccggggttggcaatgttgatctgcgcaagaaaaccaactacctcctcgtcgataacaagacgacagtgaaacaaattgaagatgcattcaaagagtttactgccagggaggatattgctattgtgctcatcagtcaatatattgccaacatgatacgatttctggtggatagctacaacaagccagtccctgctattctggagatcccatccaaggaccatccatatgatccagcgcatgactcggtgctctctcgcgtgaagtatctgttttcctcagaatcagtggcatctgataggcgatgaagacacccttttgtagtagtaccctttgttgtatctattttgtttcttgtgttgaagaaaagtttgcttgtaccatctggtgtgagggacagcaagaagcatgaataatgagcttggaaacaataattgggttgaaccgaaccgaaatgtattttacaagattggggtgctgtttggtgcttgtactgatttggttttaaaaaaaaaaaaaaaaaaaa

SEQ ID NO: 116 - protein, 130 aa, Panicum virgatum
  misc_feature: Ceres CLONE 1721961
  misc_feature (1)..(101): Pfam Name: ATP-synt_F Pfam Description: ATP synthase (F/14-kDa) subunit
  misc_feature (14)..(125): SWISSPROT Homolog: EC 3.6.3.14 Vacuolar ATP synthase subunit F
MAGRANIPTNNSALIAIIADEDTVTGFLMAGVGNVDLRKKTNYLLVDNKTTVKQIEDAFKEFTAREDIAIVLISQYIANMIRFLVDSYNKPVPAILEIPSKDHPYDPAHDSVLSRVKYLFSSESVASDRR

SEQ ID NO: 117 - DNA, 915 bp, Panicum virgatum
  misc_feature: Ceres CLONE 1721998
  misc_feature: Encodes the peptide sequence at SEQ ID NO. 118
ccagctccgtctctactaccaccctgctccactcctctcgtcgacaccgacgcaccaatccaaaccctccgcgacctcgccgcagctccggccatgtcgatcttcgagtacaacgggtccgccgtgatggcgatggtggggaagaactgcttcgcgatcgccagcgaccggcgtctgggcgtgcagctgcagaccatcgctaccgacttccagcgggtgttcaagatccacgacaagctatacgtcggcctctcggggcttgccaccgacgcccagacgctgtaccagaagctggtgtttaggcacaagctgtatcagctgcgggaggagagggacatgaagcccgagaccttcgccagcctagtttctgcgctcctttacgagaagagattcgggccatatttctgccaaccagtcattgctggacttggagatgacaacgagccgtttatttgtaccatggactgccttggtgccaaggaactagccaaggattttgttgtttctgggacagcatcagaatctttgtatggtgcttgcgaatccatgtacaagccaaacatggaacctgacgaactcttcgagactgtatcccaagctctgatgtcatcagttgatcgtgactgccttagcgggtggggaggctacgtgctgatcataacgccgactgaagtgagagaacatgtggtgaagggcaggatggactaaatcagcaccctagaattcttaggccactttccgatgctttgatgccggcatgttacctccggtctgacagaagtatatccgtgttgtgtttggattgtgaagtaacattgtatcatcacagttgatgttacattctctgagagggaacattggtttctttatcccaataccactatctttgtttggcaaaaaaaaaaaaaaaaaaaa

SEQ ID NO: 118 - protein, 204 aa, Panicum virgatum
  misc_feature: Ceres CLONE 1721998
  misc_feature (1)..(204): SWISSPROT Homolog: EC 3.4.25.1 Proteasome subunit beta type 3
  misc_feature (1)..(204): SWISSPROT Homolog: EC 3.4.25.1 Proteasome subunit beta type 3-A
MSIFEYNGSAVMAMVGKNCFAIASDRRLGVQLQTIATDFQRVFKIHDKLYVGLSGLATDAQTLYQKLVFRHKLYQLREERDMKPETFASLVSALLYEKRFGPYFCQPVIAGLGDDNEPFICTMDCLGAKELAKDFVVSGTASESLYGACESMYKPNMEPDELFETVSQALMSSVDRDCLSGWGGYVLIITPTEVREHVVKGRMD

SEQ ID NO: 119 - DNA, 785 bp, Panicum virgatum
  misc_feature: Ceres CLONE 1722002
  misc_feature: Encodes the peptide sequence at SEQ ID NO. 120
ccgcttccagagtcgccggcggcctgtgttctcccacgggcggcgaggcggcgggacgtgaggatgatgggcagcaacagcggcggagggggcggaggccctggcgggggcatgggtccgggcatgggcgggcccgtgggtggaggcggggacgggcggcacgacgacgaggccgcgctcaccgagttcctctcctcgctcatggactacacccccacgattcccgatgagcttgtggagcactacctcggacgcagcggattccactgccctgacctccgcttaacgagattggttgctgtagctgcccagaagttcctttcggacattgcaagcgattctcttcagcactgcaaggccagggtagtagcaccaatcaaagacaataagagcaaacagcctaaggatagacgtcttgtactaactatggatgatctttcgaaagccttgcgtgagcatggtgtgaacttgaaacacgcggagtacttcgcagacagcccttctgcaggaatggctcctgcaacaagggaggaatagattggattgagccaacctgtaccaagtgtctaattggaactgggtatactgggatcatgtcaatgagtagcctgtccacattcttgcccaattcgatgtaatggtgtactagcatagcctccaaagtgtggactccattgctattcgtgctgtattagtattgaccattagggtgtgatttctacttactaagattgtgttatcaatgctgattagtctctctcggttaaaaaaaaaaaaaaaaaaaa

SEQ ID NO: 120 - protein, 157 aa, Panicum virgatum
  misc_feature: Ceres CLONE 1722002
  misc_feature: Great-hit functional homolog of the protein sequence given in SEQ ID NO 9359
  misc_feature: Great-hit functional homolog of the protein sequence given in SEQ ID NO 9415
  misc_feature: Useful for making plants with altered Lignin content
  misc_feature: Useful for making plants with altered terpenoid content
MMGSNSGGGGGGPGGGMGPGMGGPVGGGGDGRHDDEAALTEFLSSLMDYTPTIPDELVEHYLGRSGFHCPDLRLTRLVAVAAQKFLSDIASDSLQHCKARVVAPIKDNKSKQPKDRRLVLTMDDLSKALREHGVNLKHAEYFADSPSAGMAPATREE

SEQ ID NO: 121 - DNA, 801 bp, Panicum virgatum
  misc_feature: Ceres CLONE 1722056
  misc_feature: Encodes the peptide sequence at SEQ ID NO. 122
gacgacgaatcacgaagcacttgaagaagaaagcaacagcaacacaagcaatggcctcgttcgcatcgacggcggcatccgcttcgacagccgttccgagctgcggcgccggggcccggcgcggcgggcggtgcgtggcccgcgcgtccgcggtggcgatggcgccggcgaggacgcactacgaggtgctcggggtcggggccggggcgagcaggggcgagatcaaggcggcgtaccggcgcctggccagggaggtgcacccggacgccggcggctgcggcggcggcgacgagggcttcatccagctgcacgccgcgtacgccacgctcgcggaccccgacgagcgcgcgcgctacgaccgctcggtggtggcgcggcccgcggcccgcggggcggcgccgccggggttccggccgcggaggtgggagaccgaccagtgctggtagtggtagggacacagccgcgccgcctgcccgtcgcgccgcgtcttgcgctgccacggtgccacctccgccgctcaatcgtggccggcggtgaagtcgccggccgactggccggagcgcgcggcccatcccatcatgttggggagggaaggggaaggcccgcgtggcccacttcgcgacccattggggcccaccagaaaacggaaccttgtccacggttgcacgaagagagacatttttcccatctcttgtgtacttacttgatcaccttgtaaatatggataattcctcgtcttggacggtaaacaatccaaagtaggcaagaaacggtaatttccaaaaaaaaaaaaaaaaaaaa

SEQ ID NO: 122 - protein, 131 aa, Panicum virgatum
  misc_feature: Ceres CLONE 1722056
  misc_feature (1)..(61): Pfam Name: DnaJ Pfam Description: DnaJ domain
MASFASTAASASTAVPSCGAGARRGGRCVARASAVAMAPARTHYEVLGVGAGASRGEIKAAYRRLAREVHPDAGGCGGGDEGFIQLHAAYATLADPDERARYDRSVVARPAARGAAPPGFRPRRWETDQCW

SEQ ID NO: 123 - DNA, 764 bp, Panicum virgatum
  misc_feature: Ceres CLONE 1722071
  misc_feature: Encodes the peptide sequence at SEQ ID NO. 124
ttaatggccgctggaatatcttgatcaggccagaataatagttctataaaaaaaatatcagcttgcatacgagtccataccttccattgtcagatcagaggaaaaaaaaagggtaaagaggggaaaagcccgaacagggcgggggagagagatgccggagcttccggaagtggaggcggcgcggtgggcgctgcaggagcactgcgtcgggaagcggatcgtgaagtgcgccgccgcggacgacaccaaggtcatcgacggcgtcgccccggaccggctggaggcggcgctggttgggaagaccatcaccgctgcgctgcgcaagggcaagaacttatggctcgcgctcgactccccgccgcatcccaccttccagtttgggatggctggtgctatttacatcataggtgtggagctgagcaaatataaaagagataagcatcaacacgattcaagaagtagcaacttcaaggtgtgggttgtctcctttggaggttaccccagagcttctccttgccacacatgaagatcatgcagcacaagtgaatggagggagcagcagtccggtgccagaagtgaacaatgaatagttcctttttattatctttgttcagcagggtatgccctgttagtcagttgtatcagttaaatcttgctaccttgtgttctggacaagtttgtcagtttgattatttccctatgttatcccttcattacctcagcaatgaactctgcagttttatcaaaaaaaaaaaaaaaaaaaa

SEQ ID NO: 124 - protein, 124 aa, Panicum virgatum
  misc_feature: Ceres CLONE 1722071
  misc_feature (1)..(93): Pfam Name: Fapy_DNA_glyco Pfam Description: Formamidopyrimidine- DNA glycosylase N-terminal domain
MPELPEVEAARWALQEHCVGKRIVKCAAADDTKVIDGVAPDRLEAALVGKTITAALRKGKNLWLALDSPPHPTFQFGMAGAIYIIGVELSKYKRDKHQHDSRSSNFKVWVVSFGGYPRASPCHT

SEQ ID NO: 125 - DNA, 810 bp, Panicum virgatum
  misc_feature: Ceres CLONE 1722078
  misc_feature: Encodes the peptide sequence at SEQ ID NO. 126
aaaaaaaacaaccgacctccgatccacttctgctcaccagacactgctaagctagctagctgctttacacttcactcactagtcactagcagcttgatcattcgacgatcagtgagtgttatcatatacagtcgtagctgcaatattaatatatatatagctcgcctctccgccgttgtcgccgtcgtcctggtggctgcgctggtggcggctgagaccgcttcggctgcggtgagctgcagccaggtgacgtcggccgtggcgccgtgcctggggtacgccatgggcagctcggcgtcgccctcgccggcgtgctgcaacggggtgaggtcgctcaacagccgggcgtcgtcgacggcggacaggcaggcggcgtgcgcctgcctcaagagcatggcggggaggctgggtggcaacatgggcaacgccgccgccagcatccccagcaagtgcggcgtcaacgtcggcgtgccaatcagcccaaacgtcgactgcgccaagattaactgagacgaaggatgatggatgctcagctctctatcgtctttgggtatgatgtccgccaacaagagcagagagcagtcgtttaatttacaacctcttccttttacatttgtacaacaccacgcaccacctgtgtacgtcgtcgtgtatgtacaacaataatcttctctctgcttatgtgtttgctgggtctctgttttcatgtactactaccatgatgctgctgctactgcttgttataggcaggtcaggcagctctccgctcaatcaataaacttttttctgcaaaaaaaaaaaaaaaaaaaa

SEQ ID NO: 126 - protein, 75 aa, Panicum virgatum
  misc_feature: Ceres CLONE 1722078
  misc_feature (16)..(86): Pfam Name: Tryp_alpha_amyl Pfam Description: Protease inhibitor/seed storage/LTP family
MGSSASPSPACCNGVRSLNSRASSTADRQAACACLKSMAGRLGGNMGNAAASIPSKCGVNVGVPISPNVDCAKIN

SEQ ID NO: 127 - DNA, 656 bp, Panicum virgatum
  misc_feature: Ceres CLONE 1722081
  misc_feature: Encodes the peptide sequence at SEQ ID NO. 128
ataaacctatctgcaagctaagcattacagctagtagctgatcacccacccgatacaagcaggagaagcaaccatggtcagtgccaagagacttgttcaaatggccaagaagtggcagagaatggcagccctcgcgaggaaaaggatcacgtcgccggcgaaagaaaccgaagggtcgtcgtgcagcacggcgttggtggccggcaagggccactgcgtggtgtactcggccgacggcaggcggttcgaggttccgctggtgtacctcggcacagcgatcttcggcgagctcctgagcctgtcgcaggaggagttcggattcgccggcgatgacggcaggatcacacttccctgcgacgctgccatgatggagtacgtgatgtgtctgctcggaagagacgcatcagaagaggtactgagggcgttcttgagctttatggcgaggccttgccactgcggacatggcttggcgcaatccacgggtgttagccagcaagttgctgtctctagcttctgaagattagcactcagattgttttctttttcttgcatgatacgtgtaaatagttacatgtgggagattggaaacgaaactagatatgcttgttcaaaaagaaatagaacagagatatacacaaaaaaaaaaaaaaaaaaaa

SEQ ID NO: 128 - protein, 147 aa, Panicum virgatum
  misc_feature: Ceres CLONE 1722081
  misc_feature (1)..(108): Pfam Name: Auxin_inducible Pfam Description: Auxin responsive protein
MVSAKRLVQMAKKWQRMAALARKRITSPAKETEGSSCSTALVAGKGHCVVYSADGRRFEVPLVYLGTAIFGELLSLSQEEFGFAGDDGRITLPCDAAMMEYVMCLLGRDASEEVLRAFLSFMARPCHCGHGLAQSTGVSQQVAVSSF

SEQ ID NO: 129 - DNA, 806 bp, Panicum virgatum
  misc_feature: Ceres CLONE 1722089
  misc_feature: Encodes the peptide sequence at SEQ ID NO. 130
aaaaacggaaaaggtgggggaagtcgtcaagagctccgatcccacaggccacagctacccatcgacgatcgactccggtctccggttactcccaaatctgccgagacgagcccgggaatctcaacgcgcgagcggatgaagggaaccctgcggcgcgaagcgagctcgaggtgatgatgagttgttacggtttatggacggagcaagcaaggagcctctccacaaggactactacaaagttctggaggttgactatgatgcatctgatgacacgatcaaattgagttatagaagattagctttgatgtggcatccagataagcataagggagatagcgatgtcacagctaaatttcaggagattaatgaagcatacaaggttttaagtgatccaactaagcgattagaatatgacctttccggctgttatgagatcaatcaatatactttgcgtgagtatcttacaagatttaagggcatgatacttacctgcaatggccttggcatagatcacaactcaaaatgggctcgacacttgagggaattgaagccccattgatcaacaggtacagatgtaccatcactgatgctcatcagatttattgtactttgttaaatacgctgtctagtgtcacatacagtggtactttagtactttacccctttctgccgaaagagatccatgtatactatttccaggtctcttattggtgactgactggtcgtggatacagaattaaattttttcccccaatataagcggaacccaaaagaaactaaataccgaaaaaaaaaaaaaaaaaaaa

SEQ ID NO: 130 - protein, 121 aa, Panicum virgatum
  misc_feature: Ceres CLONE 1722089
  misc_feature: Great-hit functional homolog of the protein sequence given in SEQ ID NO 9312
  misc_feature (1)..(63): Pfam Name: DnaJ Pfam Description: DnaJ domain
  misc_feature: Useful for making plants with modulated heat sensitivity
MDGASKEPLHKDYYKVLEVDYDASDDTIKLSYRRLALMWHPDKHKGDSDVTAKFQEINEAYKVLSDPTKRLEYDLSGCYEINQYTLREYLTRFKGMILTCNGLGIDHNSKWARHLRELKPH

SEQ ID NO: 131 - DNA, 760 bp, Panicum virgatum
  misc_feature: Ceres CLONE 1722115
  misc_feature: Encodes the peptide sequence at SEQ ID NO. 132
actcctccctccgccttcacagccgccgcctctcctcccctggcgccgccgtgacaagcctagctagcgaagcgcgagagccatggcgacccccggacggatcgaactggacaagctcagcgtggagcagctcaaggggctcaaggagcagacggatctggaggtcaacctcctccacgacagcctcaacaagatccgcacagccatcacccgcctcgacagcgcctccgccgcgctgcaggacctatccctccgcccccacgggaagaagatgcttgtgccgctcacggcgtccctctacgtgcccggctcgctcgacgacgccgagaaggtcctcgtcgacgtcggcactggttacttcatcgagaaaaccatggctcgagggaaagaatactgtgaaaggaaaattaatttgttgaagtcaaatttagatgaactggctgaggtggctacgaaaaagaaagccatagcagatcagatgactctgctgctacataccaagctgaggcaaggatcgcctggcccaagttcatgaaggctctggatgtgttttgcccccggatgaacggatggtttagtttgtagcattagggaagcacagggaaatgatagttgcctgtcatgtgtgcaagactacgggtcacagataatttgctgaaccaacctgccccatgaaacatcatcgagttattttgatgttggttctgaacaagcgttgagtaattttgaagctactgttgaaaaaaaaaaaaaaaaaaaa

SEQ ID NO: 132 - protein, 150 aa, Panicum virgatum
  misc_feature: Ceres CLONE 1722115
  misc_feature: Great-hit functional homolog of the protein sequence given in SEQ ID NO 9448
  misc_feature: Useful for making plants with modulated heat sensitivity
MATPGRIELDKLSVEQLKGLKEQTDLEVNLLHDSLNKIRTAITRLDSASAALQDLSLRPHGKKMLVPLTASLYVPGSLDDAEKVLVDVGTGYFIEKTMARGKEYCERKINLLKSNLDELAEVATKKKAIADQMTLLLHTKLRQGSPGPSS

SEQ ID NO: 133 - DNA, 721 bp, Panicum virgatum
  misc_feature: Ceres CLONE 1722129
  misc_feature: Encodes the peptide sequence at SEQ ID NO. 134
gtaaccctagacaacccatcagatcgggggctcggctcctcttggctcacgagaccagggatttgtctcgcgatcctacgagttccatggcggacgctgaacctgttgatccgaagaattaccttgaggaacgttgcaagccacagtgtgtaaaatcattgtatcattatgagagatgcatgaaaagagttgagaacgacgatagtgggcagaagcactgcaccggccaatatttcgactactggtcatgcgtcgacaagtgtgttgctccaaagctctttgataagctcaaatgatgagactgcagctttcaacgtgacttctctgttgtaattctcgagctaaataagttgaacatgtaacaaatggtttcattttgctattcaactggtagaagtctttgaataaggcagcaaacacgtactgtgctggttttcagtttcactgtcatgactagagaaggtagatggagcaaggtacccagagtgttagtataactaaccaaacgttttcctggtggtggtggtggatatgagcttcgaaattcaacctttcatcctttattttgacaattgtttacattcaagattgccatccatttgtcgtgcctccagtcctttgataattttcatgtagatttcaaatgaattggttattggtccgtgcaatgacatccatgagctgcaaacgtggattgatccaaaaaaaaaaaaaaaaaaaa

SEQ ID NO: 134 - protein, 69 aa, Panicum virgatum
  misc_feature: Ceres CLONE 1722129
  misc_feature (1)..(69): SWISSPROT Homolog: EC 1.10.2.2 Ubiquinol-cytochrome c reductase complex 7.8 kDa protein
MADAEPVDPKNYLEERCKPQCVKSLYHYERCMKRVENDDSGQKHCTGQYFDYWSCVDKCVAPKLFDKLK

SEQ ID NO: 135 - DNA, 1031 bp, Panicum virgatum
  misc_feature: Ceres CLONE 1722134
  misc_feature: Encodes the peptide sequence at SEQ ID NO. 136
agctgcactgcaccgcacgccaccggaggtcgtcgcaagtagggagcgtaagccaagcaaagctagctaaggtgctaagccggagccgatcaagctagtagcagccatggcggaggaggcgtcgtcggcgccggcgccggcgccggcgccggccggggcgaagatgacgatcgtggcgggggtggacgacagcgaccacagcttctacgcgctgcagagggcgctcggccacttcttcccgccggcgcagccgcagcagtaccgcctcgtcgtcgtcaccgccaagccctccgccgcgtccgccatcgggctcgccgggccgggcgcggcggacgtgctgccgttcgtggaggcggacctcaagcgcgtcgcgctgcgcgtcctcgacagggccagggagctctgcgccgccgcgcaggtggccgacgccgagttcgaggcgatcgagggcgacgccaggagcgtcctctgcgacgccgtcgagaggcacctcgccgagatgctcgtcgtcggcagccacggctacggcgccatcaaaagggctgttcttggaagcgtgagcgattactgtgcccaccacgcgcactgcagcgtgatgatcgtgaagaagcccaagaccaagcactaagcaccgatcggtgtggcgatctgacgactcgtcagtaatcgtcagtattgtcaagttgcacatgtgtctgctttgtgaataatcagaagatacataaccggttgcttggtcgagtaaccggatatgcaatcctactgcctacggattgacaagtacaaaataattgctgtccagcacctcaaaaacattgttagtatttgttcatggaatgcaatacgtgtgaagtgtatgtgtttgattgcaaattctggtctcccctgttgtcagtctgagatacagagtaacaaggactccaaattggggaaatggtatctccattttgttcgcttcgacgagctcttcgacaaggtgctcgaatttagtaaagaaaatatggtttcgtcaaaaaaaaaaaaaaaaaaaa

SEQ ID NO: 136 - protein, 173 aa, Panicum virgatum
  misc_feature: Ceres CLONE 1722134
  misc_feature (2)..(150): Pfam Name: Usp Pfam Description: Universal stress protein family
MAEEASSAPAPAPAPAGAKMTIVAGVDDSDHSFYALQRALGHFFPPAQPQQYRLVVVTAKPSAASAIGLAGPGAADVLPFVEADLKRVALRVLDRARELCAAAQVADAEFEAIEGDARSVLCDAVERHLAEMLVVGSHGYGAIKRAVLGSVSDYCAHHAHCSVMIVKKPKTKH

SEQ ID NO: 137 - DNA, 998 bp, Panicum virgatum
  misc_feature: Ceres CLONE 1722229
  misc_feature: Encodes the peptide sequence at SEQ ID NO. 138
aaatcgcatcgagcccatctctatttccgccgccgccgccgccgtcgagagagaggatcccgaccccgccccacccaccaccatgtggcgccgcgtccaaaccctagctcccgccctgcgccgggtcgccgccgccgccgcctccacccccacggcgccggcctcctctgcagcccgcgccgccccgctctcctcggcggccgccgccttccgccccaccagcccgctcctctcaggggacaagccggcgagggtggaggacgtcatgcccatcgccaccgggctcgagcgcgaggagctggaggccgagctccagggaaagaagcggtttgacatggattcccccgtcggccccttcggtaccaaggaggcaccagcagtcattgagtcctactacaacaagcggatagtcggttgccctggtggtgaaggagaggatgaacatgatgttgtatggttttggttgaaaaaagacgagccgcatgagtgtccagtctgctcgcaatactttgtgcttaaggtcattggtgatggtggagatccagatggtcacgatgacgaagatgaaggacaccactaaggatgcctcgtgttctggaaataatgaatttgatgaggcagatgatttcattatacttattttctagcaccagactgctctacggggtccttgtttatgaatatagacatttggccatcaagcaggtggtagttttcacctagggattttatcaaaacaaaagctttttgtgatttgacttgcatttctttcagagcatcatcgaataaaagatgactgcatcagattgctttcttttgttacctaatcgcccatcgggtgtgatggacatgttatagtcagtcatgcaacagtcctatttctctgcttagtgtggcaggcagtttacaaaaggcctcctaaatctttgactagtttcaagacagtttggtgatcaatgattttatgattatgagagcaaaaaaaaaaaaaaaaaaaa

SEQ ID NO: 138 - protein, 165 aa, Panicum virgatum
  misc_feature: Ceres CLONE 1722229
  misc_feature (1)..(87): Pfam Name: COX5B Pfam Description: Cytochrome c oxidase subunit Vb
MWRRVQTLAPALRRVAAAAASTPTAPASSAARAAPLSSAAAAFRPTSPLLSGDKPARVEDVMPIATGLEREELEAELQGKKRFDMDSPVGPFGTKEAPAVIESYYNKRIVGCPGGEGEDEHDVVWFWLKKDEPHECPVCSQYFVLKVIGDGGDPDGHDDEDEGHH

SEQ ID NO: 139 - DNA, 796 bp, Panicum virgatum
  misc_feature: Ceres CLONE 1722230
  misc_feature: Encodes the peptide sequence at SEQ ID NO. 140
atcagctcatcacaactcttgatctctagctagctaaagagataagcttcctctcttcctctcggtcgaaggagtgatcctctctcactctcaccaggagctcagctcgggtagctcaaggaggccagaagaagaaatggcgtcgctgtcgatgaccagcagctcggtgcgggcgcagtggacgaagaagcagaacaagctcttcgagcaggcgttggccgtgtacgacaaggacacccccgaccggtggcacaacatcgcccgcgccgtcggcggcaagtccgccgaggaggtcaggcgctactacgagctgctggaggaggatgtcaagcacatcgagtccggcaaggtgcccttccccgcctaccgctgccccggcggcgccggcgccggcgccctcggctacgaggccgacaggatgaagcatctgaagatctaggcgaacttcagagtatggtcgagaagaggctgcgcaggcacgtgtattagtgtatatatgattgggacagcatgcatgtccatgctactcctacgcaagtggtctggaagaagcaagaagaatcagatgagatgcatgcatgtcataattaattaattaattaattaattaataattagtatgggatgatcgagtagtatcctagcctgtcacgcgagatcgaccgacccatcgatctcccagcatgtgtccttcgtacccacgcgcgtatgtgtattatatcctagctgcatctgtgtaccataccaatcaagaaacatgaacttgatattgatgcaaaaaaaaaaaaaaaaaaaa

SEQ ID NO: 140 - protein, 100 aa, Panicum virgatum
  misc_feature: Ceres CLONE 1722230
  misc_feature (1)..(51): Pfam Name: Myb_DNA-binding Pfam Description: Myb-like DNA-binding domain
  misc_feature: The sequence is a functional homolog of  SEQ ID NO 1973 in the  11/479,226 US patent application
  misc_feature: The sequence is a functional homolog of  SEQ ID NO 510 in the  10/666,642 US patent application
  misc_feature: The sequence is a functional homolog of  SEQ ID NO 880 in the  11/435,388 US patent application
  misc_feature: The sequence is a functional homolog of  SEQ ID NO 976 in the  11/435,388 US patent application
  misc_feature: Useful for making plants with modulated growth and phenotype characteristics
MASLSMTSSSVRAQWTKKQNKLFEQALAVYDKDTPDRWHNIARAVGGKSAEEVRRYYELLEEDVKHIESGKVPFPAYRCPGGAGAGALGYEADRMKHLKI

SEQ ID NO: 141 - DNA, 1150 bp, Panicum virgatum
  misc_feature: Ceres CLONE 1722246
  misc_feature: Encodes the peptide sequence at SEQ ID NO. 142
attcgagtgagcttagcactcgtccactcccctgcttcaccgaagcgtgccggcaccggcagcaagcagtcgggagctatggctccgccgctactgctcgtcctcctcctcctcccggccctagccgccggccaccagcacccgtcctccttcggctcctccgccctctccgagtggcgctccgccaaggcctcctactacgccgccgaccccgaggacgccatcggtggagcgtgcgggttcggggatctgggcaagcacgggtacgggatggcgacggtggggctgagcacggcgctgttcgagcgcggcgcggcgtgcggcggctgctacgaggtcaagtgcgtcgaggatctcaaatattgtctccccggcacctccatcgtcgtcacggccaccaacttctgcgcccccaactacggcctccccgccgacgccggcggccactgcaacccgcccaaccaccacttcctcctccccatccaggcgttcgagaagattgccctctggaaggccggcgtcatgcccatccaataccgccgtgttaagtgcctccgtgaaggtggtgtcaggttctctgtcaatggtcgacacttcttcttcacagtgctaatcagcaacgttggtggtgcgggtgatgtgagatcggtgaagatcaaaggaacagagtcaggatggctctcgatgggccgcaactggggtcaggtgtggcacatcaactgtgacatgaggggccagcccctgtccttcgagctcagctcaagcgatggcaagacgctgaccagtttcaatgtcgtgcccaaggattgggaatatggaaaaacatacaccgggaaacagtttctgctgtagatggagtaccacacgatcagcttacagtttctaatttttgttctgatcctacgagttggactgtggtgtatattcctctgtggaacaagtaatatcattaggagaaagttactagtgcagggcctcaaatagtagttcttgctcataaatgcattttcgtgtcccctgatagaaggcttgatgtatcgatcaaaatagaaggccgtattttgggcgtctccattgtattacaacattttacctggcaagcaatgataatagtatctctgcatttctgcaaaaaaaaaaaaaaaaaaaa

SEQ ID NO: 142 - protein, 257 aa, Panicum virgatum
  misc_feature: Ceres CLONE 1722246
  misc_feature: Great-hit functional homolog of the protein sequence encoded by LOCUS At3g03220
  misc_feature: Useful for making plants with altered cell wall content and/or composition
MAPPLLLVLLLLPALAAGHQHPSSFGSSALSEWRSAKASYYAADPEDAIGGACGFGDLGKHGYGMATVGLSTALFERGAACGGCYEVKCVEDLKYCLPGTSIVVTATNFCAPNYGLPADAGGHCNPPNHHFLLPIQAFEKIALWKAGVMPIQYRRVKCLREGGVRFSVNGRHFFFTVLISNVGGAGDVRSVKIKGTESGWLSMGRNWGQVWHINCDMRGQPLSFELSSSDGKTLTSFNVVPKDWEYGKTYTGKQFLL

SEQ ID NO: 143 - DNA, 808 bp, Panicum virgatum
  misc_feature: Ceres CLONE 1722253
  misc_feature: Encodes the peptide sequence at SEQ ID NO. 144
aaggctgctgccctcacgataggcggctgtccaaagctctcaaaaaccacaccgagctagtgagcttgctcggctcggcagtctcggcaacacagccggaaaaaatatccccttttcttatccatggaggcagccgcgctcacgatacgctccacctcccagctgcgtcccgccgccgccgccgctcctgcgcacggccaccggcggggcgccgccgcggcggccgtgcctcgccgcagatgggcgccgtgcggcaggcttcgggctttgccgccggagctcagcgagatcctcagccccaagctggtgcccggctcgccgtccgacaccggcgacgtctcgtcgctcatcccagtcagtgctctgatgctgctcttctacttcgtgtccaactgggtggtgcctgagttgctcatgaagcggctccagcccaaggccgaggaccaagaggcatcagcagcggcatccatgtcgttctccggggacgctaccgacggccaaacggacggcgacgcctcccgccctaagatccagctgaaggtgatgaagaagaagaagaagaacagaaaagcgcccgtggaggtctagcacgcatacacattgtacatgcatggaggcttccctaatgaatacaaactattgacagacatcagaatatgttagcaatcaaaaagcctctgaagaagaaatgctacagtagtagtgtttaatttagcgttgtctgatatatatgcatataagcatattgtactttgtctcttctgaataaaagcaacactattattgttaaaaaaaaaaaaaaaaaaaa

SEQ ID NO: 144 - protein, 154 aa, Panicum virgatum
  misc_feature: Ceres CLONE 1722253
  misc_feature: Great-hit functional homolog of the protein sequence given in SEQ ID NO 9520
  misc_feature: Useful for making plants with modulated nitrogen use efficiency
MEAAALTIRSTSQLRPAAAAAPAHGHRRGAAAAAVPRRRWAPCGRLRALPPELSEILSPKLVPGSPSDTGDVSSLIPVSALMLLFYFVSNWVVPELLMKRLQPKAEDQEASAAASMSFSGDATDGQTDGDASRPKIQLKVMKKKKKNRKAPVEV

SEQ ID NO: 145 - DNA, 1018 bp, Panicum virgatum
  misc_feature: Ceres CLONE 1722257
  misc_feature: Encodes the peptide sequence at SEQ ID NO. 146
ctgcccgcagttaacagtagctgtgagcatcgccaccgccccccacctcaccctcatcaatggcggcgagaagcctcctggcggcggcgttcctggcgctggcggtgccggcggtgctgtgccaggcgcccggcccggcggcgcccaagggcccgccgaacgtgacggcgatcctggagaagggtgggcagtacgcgaccttcatccggctgatgaaggcgacgcagcaggacacgcagctcaacagccagctcaacaactccttcggcagcggctacacggtgttcgcgcccaccgacaacgccttcaacagcctcaagcccggcacgctcaacaagctgtcgcagcaggagcaggtgtcgctggtgcagtaccacatcctcccgcagttctactcgctcgactccttcgagaccgccagcaaccccgtccgcacgcaggcgtccggctccgacgggccctacacgctcaacatcaccgccgacagcaacaaccaggtgaacgtctccacggggctcgtcgccaccagggtcggcaccgcgctgcgcgacacgcagccgctcgcggtctactccgtcgacaaggtgctcctgcccaacgacctgttcggcgtgaagcccccgacgtccacgccgcccgcgcccaccaagaagcccgccaaggggggctccgtggccgaggcgcccgctggctcagccgactcggcgccctccggcgctgcgccaggcggcgccagggtcgccgggtggagcttggccgcgctggttctcggcgcggcgggcggcctgttataaggatccgtggaggaagcgatcgtcgtcccgacacggcgagatcctacgtgcatgtgcatgagtagcgttcttgttgcgatttcattttcttcttctcttgatcttggatttgttcgttgcttcacctggtttggagaaaccgggccatgtgatcccgatccctgaatgttaatgatgctcagttactgagctgtttctctctccaaaaaaaaaaaaaaaaaaaa

SEQ ID NO: 146 - protein, 244 aa, Panicum virgatum
  misc_feature: Ceres CLONE 1722257
  misc_feature: Great-hit functional homolog of the protein sequence encoded by LOCUS At1g03870
  misc_feature: Useful for making plants with altered cell wall content and/or composition
MAARSLLAAAFLALAVPAVLCQAPGPAAPKGPPNVTAILEKGGQYATFIRLMKATQQDTQLNSQLNNSFGSGYTVFAPTDNAFNSLKPGTLNKLSQQEQVSLVQYHILPQFYSLDSFETASNPVRTQASGSDGPYTLNITADSNNQVNVSTGLVATRVGTALRDTQPLAVYSVDKVLLPNDLFGVKPPTSTPPAPTKKPAKGGSVAEAPAGSADSAPSGAAPGGARVAGWSLAALVLGAAGGLL

SEQ ID NO: 147 - DNA, 722 bp, Panicum virgatum
  misc_feature: Ceres CLONE 1722266
  misc_feature: Encodes the peptide sequence at SEQ ID NO. 148
accacaccacccaggcacccagcgtcatctcatccccgtttgcccgctgcgagaattcctttcacctcacctcactctgagtctgagcgcgcggccgcactcaagcgagcgagcacgggcgaaatggcgcgccactccgggaagcccctcctcgcgctcctcgtgctgtccggcctcctcctcctcccgctcgtcgcctccgtccccttgccaagaagcctgcgcctggggaacccgcagcagcacccgccggctctgaagcttgcttcttctcaggaggcggcgatggcggcgtggaacctcggtagcaggcaggcagcgaggatggccgtggaggtgaacgactaccaaccgtccggccccaacaaccgccatgacccgcccaagggtcccgggagagcgtgaacagtggggggggggtggacccaaataatcctccatcttcttcgccactagtatgaagtgcttgcttgcttgctagtagtttgctcctgtattctaaaatggtagcagaaacgaaatcacctagtagttacagaagggatccgggggccgatcggtgtctgtctatatgccgcccgtgtgtgtcaggcggcgcaccgatcgcctggctgttcttgggtttgtttgttcgtcagaactgctgcgcacatcggtttctcgtgctgtgctggtgtcgaatacactgccccgaaattattcaaaaaaaaaaaaaaaaaaaa

SEQ ID NO: 148 - protein, 93 aa, Panicum virgatum
  misc_feature: Ceres CLONE 1722266
  misc_feature: Great-hit functional homolog of the protein sequence given in SEQ ID NO 9364
  misc_feature: Useful for making plants with modulated flowering time
  misc_feature: The plant flowers significantly late compared to wild-type.
MARHSGKPLLALLVLSGLLLLPLVASVPLPRSLRLGNPQQHPPALKLASSQEAAMAAWNLGSRQAARMAVEVNDYQPSGPNNRHDPPKGPGRA

SEQ ID NO: 149 - DNA, 749 bp, Panicum virgatum
  misc_feature: Ceres CLONE 1722275
  misc_feature: Encodes the peptide sequence at SEQ ID NO. 150
ccccgtgctctctcagaggtgggttggcttctccccctcttaccaagtcctcggttctagggttttagttggaaggggagatggcggcggcggatgtggagtaccgctgcttcgtcggcggcctcgcctgggccaccgacaacgcgtccctccagcaggccttcgcctcctacggcgacgtcctcgactccaaggtcatcaccgaccgtgagacggggaggtcccgcgggttcggcttcgtcaccttctcaaccgagcagtcgatgctcgacgccatcgaagccatgaacggcaaggagctcgacggccgcaacatcaccgtcaaccaggcccaatcccgcggcggtggcggcggcggcggcggttacggcggcggtcgccagggaggctacggcggcggcggcggtcgccgtgagggcggctacggtggcggcggctacgacggtggcggtggcggatacggcggcggtcgccgcgagggcggctacggcggtggtggctacggcagccgcggtgactccggtggcaactggaggaactaatggggtggccctcccgtgctggcagccaagttatcctagatatctattagtgttcgtgttaccatttgatccgagttaccccagagtttagtgtccgtccgtgttacctgttggttcccatgttaccgttcccgagtcgtttccgcaatgaaatgagaagaaaagagtgagcaaggtttttgttcgcaaaaaaaaaaaaaaaaaaaa

SEQ ID NO: 150 - protein, 153 aa, Panicum virgatum
  misc_feature: Ceres CLONE 1722275
  misc_feature: Great-hit functional homolog of the protein sequence given in SEQ ID NO 9185
  misc_feature: Great-hit functional homolog of the protein sequence given in SEQ ID NO 9423
  misc_feature: Great-hit functional homolog of the protein sequence given in SEQ ID NO 9703
  misc_feature: Great-hit functional homolog of the protein sequence given in SEQ ID NO 9716
  misc_feature: Useful for making plants with altered Lignin content
  misc_feature: Useful for making plants with altered alkaloid content
  misc_feature: Useful for making plants with modulated flowering time
  misc_feature: Useful for making plants with modulated nitrogen use efficiency
  misc_feature: The plant flowers significantly late compared to wild-type.
MAAADVEYRCFVGGLAWATDNASLQQAFASYGDVLDSKVITDRETGRSRGFGFVTFSTEQSMLDAIEAMNGKELDGRNITVNQAQSRGGGGGGGGYGGGRQGGYGGGGGRREGGYGGGGYDGGGGGYGGGRREGGYGGGGYGSRGDSGGNWRN

SEQ ID NO: 151 - DNA, 980 bp, Panicum virgatum
  misc_feature: Ceres CLONE 1722305
  misc_feature: Encodes the peptide sequence at SEQ ID NO. 152
aggcgtgccccactcgacaactcctttcctttcctttcccctccccctcttcctccgccgccccgtgctcgtctcgtctgcccccaattccgtctccccttttcctcctcctcggtcgtcgcctccccccagagagcagaagcaccgcgcctcccgccccgcccgccgccatgaaccccgagtatgactacctcttcaagctgctgctcatcggggactcgggcgtcgggaagtcttgcctgctgctgaggtttgcggatgattcttatctggaaagctatatcagtaccattggtgttgattttaaaatccgcactgttgagcaagatgggaagacaataaagctgcagatttgggacactgctggccaagagcgctttaggaccatcacaagcagctactaccgtggagctcatggcatcattgtcgtgtatgatgtgactgaccaggagagcttcaacaatgtcaagcagtggctgaatgaaattgacaggtacgccagcgaaaatgtgaacaagcttttggtggggaacaagtgcgacctagctgagagcagagcagtttcttatgaggctggcaaggcccttgctgatgagatagggataccattcctggagactagtgccaaggatgcaacaaatgtggagaaggcattcatgaccatggcaggagagataaagaacaggatggcaagtcaaccagctgcaagtggtgctagcaggcctgcaacggtgcaaatgcggggtcagcctattgctcagcaaagcagctgctgctcttgatcgtctatctagattgcggtagtgtgattgtgcagcaagcaaaacatgaattggttgctctatccctgtaaattaagtcttatcactatcggaaaacttgtgttctctgttggatattggaagtatgtctcctgactgcagcacattttaagcagatgatgtgttcttatgcctgttcaaaaaaaaaaaaaaaaaaaa

SEQ ID NO: 152 - protein, 203 aa, Panicum virgatum
  misc_feature: Ceres CLONE 1722305
  misc_feature: Great-hit functional homolog of the protein sequence given in SEQ ID NO 9286
  misc_feature: Useful for making plants with altered Lignin content
MNPEYDYLFKLLLIGDSGVGKSCLLLRFADDSYLESYISTIGVDFKIRTVEQDGKTIKLQIWDTAGQERFRTITSSYYRGAHGIIVVYDVTDQESFNNVKQWLNEIDRYASENVNKLLVGNKCDLAESRAVSYEAGKALADEIGIPFLETSAKDATNVEKAFMTMAGEIKNRMASQPAASGASRPATVQMRGQPIAQQSSCCS

SEQ ID NO: 153 - DNA, 874 bp, Panicum virgatum
  misc_feature: Ceres CLONE 1722326
  misc_feature: Encodes the peptide sequence at SEQ ID NO. 154
aagaaacactcgaagcgaaagatcagaagctcaccaaatcactcaatcctcactcaagaatcctcgattccgctaaaccgccagtcagaaatcccaccgaccatgtcgctgatccgccgcagcaacgtgttcgaccccttctccctcgacctctgggaccccttcgagggcttccccttcggctccggcagcagcagcagcctcttcccctcgttcccgcgcaccagctcggagaccgcggccttcgccggcgcgctgatcgactggaaggagacccctgaggcgcacgtgttcaaggcggatgtcccggggctgaagaaggaggaggtgaaggtggaggtcgaggacggcaacatcctccagatcagcggcgagcgcaacaaggagcaggaggagaagacggacacctggcaccgcgtggagcgcagcagcggcaggttcctgcgcaggttccggctccccgggaacgccaagacggagcagatcagggcgtccatggagaacggcgtgctcaccgtcaccatgcccaaggaggaggtcaagaagcctgaggtgaagtcaatccagttctccggctagagatcatcgtgctcgtgcctgcgctgcgtaacgaagaatgctgctgccctctagagtccgcctgggtcgttctggcgaaataaaaatcgggttcggcgctgtggtctcgtgtagtgtcaagagtccgcgtgatgggcgtgtggtccgaatcgaaatgtgagtcctgtgtctgccatggcatggttgaatccagtttatgtacattaacatttgtgtgtctgtgtgtactttgtatcgccatctggtaatgaactccaattctctctcgttttattaaaaaaaaaaaaaaaaaaaa

SEQ ID NO: 154 - protein, 158 aa, Panicum virgatum
  misc_feature: Ceres CLONE 1722326
  misc_feature (1)..(104): Pfam Name: HSP20 Pfam Description: Hsp20/alpha crystallin family
MSLIRRSNVFDPFSLDLWDPFEGFPFGSGSSSSLFPSFPRTSSETAAFAGALIDWKETPEAHVFKADVPGLKKEEVKVEVEDGNILQISGERNKEQEEKTDTWHRVERSSGRFLRRFRLPGNAKTEQIRASMENGVLTVTMPKEEVKKPEVKSIQFSG

SEQ ID NO: 155 - DNA, 637 bp, Panicum virgatum
  misc_feature: Ceres CLONE 1722333
  misc_feature: Encodes the peptide sequence at SEQ ID NO. 156
atcgacccattcagcttcgtctcccctccgatcgagacgaccccacccaagcggagcgagcgagcgagcggcggcggcgggcggagaagatggtgcggaaggcgaaggttgagttcgacgagcagccgccggacaacttcgacccgaagaacccgtatggggacccggtggcgatgcttgagtaccgggagcacctggtgcgggagaagtggatccagatcgagaccgccaagatcatccgggagcgcctccgctggtgctaccggatcgagggcgtcaaccaccaccagaagtgccgccacctcgtcgaccagtacctcgaggccacccgcggcgttggctggggcaaggacgcccgcccgcccgagctccatgagcccaagaaggtcgtcgaggcggagtagcggctctgctgctgcggcttcgcgtgctgctgttcctggattggagaggtgatctgatccttccgtcgaattgaaacgagtaacatggaactgctgcagttcttttacgtctgaagctgctgatagacttcaaataatgttgtcaaagaaaacattcttgtgcctgtaccttttcctggcctgttatggaattaagcaaatcgttgcttgaacaaaaaaaaaaaaaaaaaaaa

SEQ ID NO: 156 - protein, 104 aa, Panicum virgatum
  misc_feature: Ceres CLONE 1722333
  misc_feature (3)..(104): SWISSPROT Homolog: EC 1.6.5.3 NADH dehydrogenase [ubiquinone] iron-sulfur protein 6
MVRKAKVEFDEQPPDNFDPKNPYGDPVAMLEYREHLVREKWIQIETAKIIRERLRWCYRIEGVNHHQKCRHLVDQYLEATRGVGWGKDARPPELHEPKKVVEAE

SEQ ID NO: 157 - DNA, 821 bp, Panicum virgatum
  misc_feature: Ceres CLONE 1722335
  misc_feature: Encodes the peptide sequence at SEQ ID NO. 158
agccgcttgggagctagggtttgacgccgccgttaccaccttgccgccgtcgtcctccctagcgaaccctaatcgttcctcttcctcgcacgccgccgccgccatgtccgggaggaagaagactcgggagcccaaggaggagaacgtgacgctcggccccgccgtccgcgagggggagtacgtcttcggcgtcgcccacatcttcgcctccttcaacgacaccttcatccatgtgacggatctgtctgggagggaaacgctcgtccgcatcactggtggcatgaaggttaaagctgatcgtgatgagtcatcaccgtatgctgctatgcttgcctcacaggatgttgctcaaagatgcaaggagcttgggattactgctctgcacattaagctccgtgctactggtggaaacaagaccaaaagtccaggtcctggtgctcagtctgcccttagagctctcgctcgatctggcatgaagattggtcgtattgaggatgtcaccccagtcccaactgacagcacacgcagaaagggtggcagaaggggaaggaggctgtaatttcaagtatattgactggtgtttccagatgtagcagttctagactgttttcatctcatatactgcgcaagttttgcaacatttattgaagttttgaggtgtctactcgtggacatgttttgtttaatacttgttgacgaagtatgtgccattcaacgtagcaagacaattacaggagctcccacttctgataatttatttgcttgttcccttgataaatagatgcaaaagtgatttcagttaaaaaaaaaaaaaaaaaaaa

SEQ ID NO: 158 - protein, 151 aa, Panicum virgatum
  misc_feature: Ceres CLONE 1722335
  misc_feature: Great-hit functional homolog of the protein sequence given in SEQ ID NO 9712
  misc_feature: Useful for making plants with modulated biomass
  misc_feature: The plant is abnormally large.
MSGRKKTREPKEENVTLGPAVREGEYVFGVAHIFASFNDTFIHVTDLSGRETLVRITGGMKVKADRDESSPYAAMLASQDVAQRCKELGITALHIKLRATGGNKTKSPGPGAQSALRALARSGMKIGRIEDVTPVPTDSTRRKGGRRGRRL

SEQ ID NO: 159 - DNA, 835 bp, Panicum virgatum
  misc_feature: Ceres CLONE 1722341
  misc_feature: Encodes the peptide sequence at SEQ ID NO. 160
attcattgacctctcctcgcaggtcgcaagaaagcatggcgccggttaaggtattcgggtccgcggtgttcgcgaacgccgcgcgtgtgatggcgtgcctcgaggaggtgggcgtcgagtacgacgtcgtcgaggtcgactacatggccaaggagcacaagggcctcgagcatctggcgagaaacccgttcggccaaatcccagcgtttcaggatggggacatcatgctcttcgagtcccgagcaatctcaaagtatgtgctccgaaaatatgccaagtcagcccaagatgacctgctgcgagagggcaacccggaggaagctgcgatggtggatgtgtggacagaagtggaggcacaccactacctaccggccatggcacccatcttctacgaatgcgtcgtgtaccccgcgaggctcggcaccacgcccaaccagaaggttgtggacgagagtgtcgagaagttcaagaaggtgctcgacgtctacgaggtctgcctgtccaagagcaagtacctcgccggcgacttctttagctttgcggacctcaaccatttcccctttaccttccatatcatggcgacgccgcacgcgtcggtcttcgactcgtacccgcacgtcaaggcgtggtgggagagagttatggagaggccgtcgctgaagaagatcagcgcccatatggagatcaagccctgatcgctcaagcaaatatagttatagctgcgttgcatgatctactttgagttttattgcaaaccatttggtcctgtacctgcaatataacgttgctatttccgccgctgtagcaacttgtgcaaaaaaaaaaaaaaaaaaaa

SEQ ID NO: 160 - protein, 219 aa, Panicum virgatum
  misc_feature: Ceres CLONE 1722341
  misc_feature (1)..(76): Pfam Name: GST_N Pfam Description: Glutathione S-transferase, N-terminal domain
  misc_feature (1)..(97): Pfam Name: GST_C Pfam Description: Glutathione S-transferase, C-terminal domain
  misc_feature (1)..(215): SWISSPROT Homolog: EC 2.5.1.18 Glutathione S-transferase 1
  misc_feature (1)..(215): SWISSPROT Homolog: EC 2.5.1.18 Glutathione S-transferase 2
MAPVKVFGSAVFANAARVMACLEEVGVEYDVVEVDYMAKEHKGLEHLARNPFGQIPAFQDGDIMLFESRAISKYVLRKYAKSAQDDLLREGNPEEAAMVDVWTEVEAHHYLPAMAPIFYECVVYPARLGTTPNQKVVDESVEKFKKVLDVYEVCLSKSKYLAGDFFSFADLNHFPFTFHIMATPHASVFDSYPHVKAWWERVMERPSLKKISAHMEIKP

SEQ ID NO: 161 - DNA, 817 bp, Panicum virgatum
  misc_feature: Ceres CLONE 1722345
  misc_feature: Encodes the peptide sequence at SEQ ID NO. 162
agaacaggaacggctccgccgtttcgctcgcggtctcgcaccatatctcctttgctccaagaaaaggcgctgccatggccatggcggcgctgcgcggggcctcccgctgcctggcgtcaagggggagcgccgtggccgcgcggcccgtgctcctggcgcactcgcgcggaatcacctacaagctcttcattggaggcttatcacagtttgcaacggaagacagcctagcagaagcgttctctcgttacggccaagtaatagaagctacgattgtcacggataaggtgaccaacagaccaaaggggtttggcttcgtgaagtttgcttccgaggaagaagccaataacgcgagggaagagatgaacggcaaggtattgaatggccgtgtgatctacgtcgacattgcaaaggccaaaccggaccggcgggatgcagatgccaggccaatagcgagaggccctcctaagccaattggcaacgactgaaaaaaaaatggcctggtgcgtagactccatacttctgctctgccctctctgctagtctgctatactagttcacccctcagattcggaagctctagatataaactgtgttcggctcgctagtgctggtgggtggtgctgattttttgtgagataaaaatactgcttcttgctagtgctggctttggctttgtgtgagagagaaatactgttggctggatgcagtgaagatgaaacaaacagagtcatagggtgatgtgtaataatgtgtgatgtgtcgaggttttgcgagaatataaatcaagtccatttaataaaaaaaaaaaaaaaaaaaa

SEQ ID NO: 162 - protein, 136 aa, Panicum virgatum
  misc_feature: Ceres CLONE 1722345
  misc_feature: Great-hit functional homolog of the protein sequence given in SEQ ID NO 9524
  misc_feature: Useful for making plants with modulated cold sensitivity
MAMAALRGASRCLASRGSAVAARPVLLAHSRGITYKLFIGGLSQFATEDSLAEAFSRYGQVIEATIVTDKVTNRPKGFGFVKFASEEEANNAREEMNGKVLNGRVIYVDIAKAKPDRRDADARPIARGPPKPIGND

SEQ ID NO: 163 - DNA, 647 bp, Panicum virgatum
  misc_feature: Ceres CLONE 1722367
  misc_feature: Encodes the peptide sequence at SEQ ID NO. 164
atcgctcgcgtccattctgtccgggcatcgccgtgcacctcgccgctacgccgccgggcctatttatacccctgcccggcctcgccattcctcatcacaagcgaagcagagcacaagcatcaagaagcaccacaccttcttcagcaccagttcctgctcgtgatcaacaggatcagcatgtcttgctgcggcggcaactgcgggtgcggcgccggctgcaagtgcacctcatgcaccggctgcaagatgttccctgacgtggaggccacctccgccaccaccaccatggtcatcgccgccgccaccagcaaggcgagctccggcgggttcgaggcggcgatggagagcggcggctgcgactgcaacacctgcaagtgcggcaccagctgcggctgctcctgctgcagctgcaactgaggcagcgccgcgatggagcacgagggggaaagagaacccccacagcgtactatactatatagtagcaggccagcgtttaaataagatcttgattggaaactggaaatcgtggttaattgaacactactgtatcaaggaaattgatgtgcctgcctgttggggaagaagttacatgccctcttgaaatgaagacattactacagtttggccaaaaaaaaaaaaaaaaaaaa

SEQ ID NO: 164 - protein, 79 aa, Panicum virgatum
  misc_feature: Ceres CLONE 1722367
  misc_feature (1)..(83): Pfam Name: Metallothio_2 Pfam Description: Metallothionein
  misc_feature (15)..(39): Pfam Name: Metallothio Pfam Description: Metallothionein
  misc_feature (18)..(42): Pfam Name: Metallothio Pfam Description: Metallothionein
MSCCGGNCGCGAGCKCTSCTGCKMFPDVEATSATTTMVIAAATSKASSGGFEAAMESGGCDCNTCKCGTSCGCSCCSCN

SEQ ID NO: 165 - DNA, 442 bp, Panicum virgatum
  misc_feature: Ceres CLONE 1722405
  misc_feature: Encodes the peptide sequence at SEQ ID NO. 166
acaactcgttgcatttccttacaagctcacaacgcaaagctagcacgcgcaaacctctgttagcttcacgccttcacagcgtcatggcctccaagatcttgtacgtcgccgtcgtcgcggccgtcgccgtgtcctccttcgccggcgtcgtcttcgcggccgacgccccggcgccgagccccacctccggcgcggcggccgtctcctcgtcgctcgtggccgccgtcctctgcccggccgtggcgctcctcctcggcagcctgcgccactgagccctcggcggatcgtcgtagacggaagctgctgccaagtgccaccacatgcgtcgcatgatatcttttacctgcttgcttgtttcctgaccagtgtttttgtactaccgatcgaaccgcatggaattttattcattcagagattcagaccaaaaaaaaaaaaaaaaaaa

SEQ ID NO: 166 - protein, 62 aa, Panicum virgatum
  misc_feature: Ceres CLONE 1722405
  misc_feature: Great-hit functional homolog of the protein sequence encoded by LOCUS At5g11740
  misc_feature: Useful for making plants with altered cell wall content and/or composition
MASKILYVAVVAAVAVSSFAGVVFAADAPAPSPTSGAAAVSSSLVAAVLCPAVALLLGSLRH

SEQ ID NO: 167 - DNA, 1184 bp, Panicum virgatum
  misc_feature: Ceres CLONE 1723950
  misc_feature: Encodes the peptide sequence at SEQ ID NO. 168
accttctacccagcaaacaaacaaagcagcaacaaaaagatcaaacgagctcaacgactcgctcacctccggccggtcccgcgatcacacgctagcgcgccggatcaagcaatggcggccaaggtggcggcgccgctcgcgttccgccgcgaagtgcgcggcccgctccgccggccctgcctgggctcccggagcgggctacagggcgcgctgtggtgcagcagtgctggcgccgggggaagcaggccagcgccgccggtgtggctggtgcgcgcgcgggggaggaacaggtccgccggcgggcggagctcgaccaaggacgatgcggaggaggacgaggaggcggcggaggtggtgttcgtggacggcggggatgaggagttcgccgccgacgagctgtccgggttcaggggcctggttcttgatatctcctacaggcctgtcaatgttgtttgctggaagcgtgcgatctgcctggaattcatggagaaggccgatgtactggagtactacgatcagacagtctcttcacctagcggatccttctacatccctgcagttctgagggttccacagctcctgcaggtagtgaagagaagaagagtcaagcagagccttagccgtaaaaacattcttttcagggatgagttcacctgtcaatattgctcttctcgggaaaacttgactattgaccatgttattcctatttcacgaggcggtaaatgggaatgggaaaatttggtgactgcctgttcaagatgcaattccagaaagggtcagaagacactggagcaggcaaacatgaagctgcgcaagatacccagggcgccccaggagtacgacattatggctgtgcccttgacgagatccgcattcaggacgctcaagaggagccaggggttgcctgaagtgtggctgcaatacctcgccaggccatctccataatcaggagctccagacctgatcaaccagccatctcgttgtatattacttggcatgcgcagcaaagactcaattatctgctctatcataacttctgtacatgtcaataattcacagtagtaaaacatgatattgacttattatcatgctcccattccatggcaagttctgtatatgacgacggccagcaataaaggctcacagaactgtttgaaagaatgtaaaaaaaaaaaaaaaaaaaa

SEQ ID NO: 168 - protein, 277 aa, Panicum virgatum
  misc_feature: Ceres CLONE 1723950
  misc_feature (1)..(46): Pfam Name: HNH Pfam Description: HNH endonuclease
MAAKVAAPLAFRREVRGPLRRPCLGSRSGLQGALWCSSAGAGGSRPAPPVWLVRARGRNRSAGGRSSTKDDAEEDEEAAEVVFVDGGDEEFAADELSGFRGLVLDISYRPVNVVCWKRAICLEFMEKADVLEYYDQTVSSPSGSFYIPAVLRVPQLLQVVKRRRVKQSLSRKNILFRDEFTCQYCSSRENLTIDHVIPISRGGKWEWENLVTACSRCNSRKGQKTLEQANMKLRKIPRAPQEYDIMAVPLTRSAFRTLKRSQGLPEVWLQYLARPSP

SEQ ID NO: 169 - DNA, 1240 bp, Panicum virgatum
  misc_feature: Ceres CLONE 1723964
  misc_feature: Encodes the peptide sequence at SEQ ID NO. 170
acacaggccaccgccattcccattgccgcgttcttggactctgcttctctcgctgttgaacctcctgctgtttggaggctgatcgaggaggaagaagatgacaatcaccattgaacagccccagctcgatgcggtggcagcggagaggaaggtccccgccggcggcgaccccgcggagctggtgctggacggcggcttcgtcgtgccggacgccaacgccttcggcaacaccttcagggactacgacgcggagtcggagcggaagaagacggtggaggagttctacgaggtgaaccacatccggcagacgcacgagttcgtgtcccggatgcgggccgagtacgggcggctcgacaggacggagatgggcatctgggagtgcatcgagctgctcaacgagttcatcgacgacagcgacccggacctggacatgccccaaatcgagcacctcctccagaccgccgaggccatccgcaaggactacccccaccaggactggctccacctcaccggcctcatccacgacctgggcaaggtgctgctgcacccaagcttcggggagctccctcagtgggcagttgtcggtgacaccttccctgtcggctgcgcgtacgacgagtgcaacgtgcacttcaagtacttcaacgagaaccctgactaccacaaccccaagttcaacaccaagctcggcgtctactccgagggctgcggcctcgaaaaagtgctcatgtcatggggccatgacgactacatgtacctggtggccaaggagaacaagaccacccttccttctgctgggctgttcatcatcagataccactctttctaccccctgcacaagcatggagcctacacgcacctgatgaacgatgaggacaaggagaacctcaagtggctgcatgtgttcaacaagtatgacttgtacagcaagagcaatgtcaggatagatgtggagaaggtgaagccctactacatgtccctcatcgacaagtacttcccggcgaagctgagatggtgaaaaggggcaacccaccctggaggggaaccaaagagttgttccaagtctccatgtaccatagaaaaatatatagcacaaggtgtccgtgtatgaacattttcatacccgagtcgagagtgtgtacccattttgtaccgttcagatcagagttccatgagatcccataaaattcgaataaaagtcgctgcatctgttctttgcgaaaaaaaaaaaaaaaaaaaa

SEQ ID NO: 170 - protein, 306 aa, Panicum virgatum
  misc_feature: Ceres CLONE 1723964
  misc_feature (1)..(306): SWISSPROT Homolog: EC 1.13.99.1 Inositol oxygenase 1
  misc_feature (1)..(306): SWISSPROT Homolog: EC 1.13.99.1 Inositol oxygenase 4
MTITIEQPQLDAVAAERKVPAGGDPAELVLDGGFVVPDANAFGNTFRDYDAESERKKTVEEFYEVNHIRQTHEFVSRMRAEYGRLDRTEMGIWECIELLNEFIDDSDPDLDMPQIEHLLQTAEAIRKDYPHQDWLHLTGLIHDLGKVLLHPSFGELPQWAVVGDTFPVGCAYDECNVHFKYFNENPDYHNPKFNTKLGVYSEGCGLEKVLMSWGHDDYMYLVAKENKTTLPSAGLFIIRYHSFYPLHKHGAYTHLMNDEDKENLKWLHVFNKYDLYSKSNVRIDVEKVKPYYMSLIDKYFPAKLRW

SEQ ID NO: 171 - DNA, 1051 bp, Panicum virgatum
  misc_feature: Ceres CLONE 1723971
  misc_feature: Encodes the peptide sequence at SEQ ID NO. 172
aggagaccagaccaccaccaccaccactccacccccatcacagaaacagagagagccctgcctacaatggcggcggccctcgagtctggctggcaggtcctgaccgccaacttcaccgagttccagctcgccaccgtcttcaccttcctgatccacgaggccgccttcttcctctccggcctcccctccctcctcttcgagcgcttcgggctcttcgccaagtacaagattcagaagaagagcaacacctctgcttatcaaaacagatgtgtcctgcgtctcattctctaccatgtctgtgtgaacttgcctgtcgtgattttctcctaccctgccttcaaattcatgggccttaggagctctcttcctctgccacactggacggttgtcgtatctcaaattctattctactttgtactggaggattttgtattctattgggggcaccgggcactgcacaccaaatggctatacaagcatgtccacagcgtccaccacgaatatgctacaccctttgggttaacttctgaatacgcccaccccgctgaaattttgttcctgggattcgccacagttgttggccctgctcttactggccctcatttgttgaccctgtggctttgggtggtgttgagggtattggagacagttgaagctcacagcggctaccacttcccatggagcccctcaaatttcctgccactgtatggcggctcggacttccatgactaccatcaccgtgtgctctacaccaagtcagggaactattcctcgacttttgtgtacatggactggttgtttgggacggacaaggattaccgcaaggtgaaggccatggaggagaaggaagggaacaaggatatgtagatgatgcatgcatgggatctgcgaataatgaagacaggaggctattagcagcacgtactgagtactacaatcgtacgtaatcctggggatttgtgttagttcctgctttaatttgtttgggcgggatcggatgtatatacatgggatgggtttggatcggagctaaaaaaaaaaaaaaaaaaaa

SEQ ID NO: 172 - protein, 266 aa, Panicum virgatum
  misc_feature: Ceres CLONE 1723971
  misc_feature: Great-hit functional homolog of the protein sequence given in SEQ ID NO 9408
  misc_feature: Great-hit functional homolog of the protein sequence given in SEQ ID NO 9661
  misc_feature (1)..(213): Pfam Name: Sterol_desat Pfam Description: Sterol desaturase
  misc_feature: Useful for making plants with altered sterol content
  misc_feature: Useful for making plants with modulated cold sensitivity
MAAALESGWQVLTANFTEFQLATVFTFLIHEAAFFLSGLPSLLFERFGLFAKYKIQKKSNTSAYQNRCVLRLILYHVCVNLPVVIFSYPAFKFMGLRSSLPLPHWTVVVSQILFYFVLEDFVFYWGHRALHTKWLYKHVHSVHHEYATPFGLTSEYAHPAEILFLGFATVVGPALTGPHLLTLWLWVVLRVLETVEAHSGYHFPWSPSNFLPLYGGSDFHDYHHRVLYTKSGNYSSTFVYMDWLFGTDKDYRKVKAMEEKEGNKDM

SEQ ID NO: 173 - DNA, 1072 bp, Panicum virgatum
  misc_feature: Ceres CLONE 1723977
  misc_feature: Encodes the peptide sequence at SEQ ID NO. 174
gacctcctataactgcgcactgaaacctctggcggtctcctcatcactagcaaaatcctcgcctcgattcgattaaacagagagaaattcgaagcagctcgccgtcgccagtcgccatgaccgtggaggtgtgcgtgaaggccgccgtcggggcccccgacaccctcggcgactgtcccttctcccagagggtgctgctcacgctggaggagaagaaggtcccctacgagatgaagctcatcgacctcagcaacaagcccgaatggttcctgaagatcagtccagagggtaaggtgcctgtgtttgacagtggtgatggcaactggattgctgactctgatgtgatcactcaagtcattgaggagaagttcccaactccatttctggtcacccctccagaatatgcatcaatgggatcaaagattttcccatcctttgtcaagttcctgaagagcaaagatgctagtgatggttcagagaaggcacttcttgatgagctgcaggcactagacgaccatctgaaagctcatggtccgtacatcaacggagagaatgtatcagctgctgatcttagcctggggccgaagcttttccacctccaggttgcactggagcatttcaagggctggaagatcccagaaaacctgaccagcgtccatgcatacaccaaggcactgttcagccgcgaatcttttgtgaagactaagccagccaaggagcacctgattgcgggatgggcacccaaggtgaacgcgtaagcgcccatcccccttgtgctttggtgctaccttgtggacaccatgcgtttatctgatcagtcgctgtcagtggtgtgggtaggcgtcgcgtctgtagcatgaacgcatgattggactagaataatgcagcaccatgttccgagtacttgtggttgttgcaagtgtgcgcgccttttatatggaccttccttgccggtttggttcgagaccatgagcatctcttggtcttatgtatgagagtgtgcatactgtaatgttaaccatggtatcaaataatggagccgcttctatgccaaaaaaaaaaaaaaaaaaaa

SEQ ID NO: 174 - protein, 213 aa, Panicum virgatum
  misc_feature: Ceres CLONE 1723977
  misc_feature (1)..(74): Pfam Name: GST_N Pfam Description: Glutathione S-transferase, N-terminal domain
  misc_feature (1)..(72): Pfam Name: GST_C Pfam Description: Glutathione S-transferase, C-terminal domain
MTVEVCVKAAVGAPDTLGDCPFSQRVLLTLEEKKVPYEMKLIDLSNKPEWFLKISPEGKVPVFDSGDGNWIADSDVITQVIEEKFPTPFLVTPPEYASMGSKIFPSFVKFLKSKDASDGSEKALLDELQALDDHLKAHGPYINGENVSAADLSLGPKLFHLQVALEHFKGWKIPENLTSVHAYTKALFSRESFVKTKPAKEHLIAGWAPKVNA

SEQ ID NO: 175 - DNA, 1095 bp, Panicum virgatum
  misc_feature: Ceres CLONE 1723984
  misc_feature: Encodes the peptide sequence at SEQ ID NO. 176
accaaccaatctctgttcgccgcgctgccacggcccccgcctcatccgcacggcccatgacgagcgcctccgagctcttcaccgcgcgccgcgccgcccgcggggcgcgcctcgccgccgaccccgacccggagccggatccgcacgccgacgcgctccgggacccgcacggcctcgccgcccggaggaggcgccgcgggtgccgcccgcgacgacagctcgacgccgccggggacgtgcggcagcacctgcacaccggggccccgccgccgcgccgccgcgggtcgtacaccgaccagatcttatcatacctagacaataataacattggggattctgctgctcggaggaacagacttgataggctgatgttcaggacaaatgaacgtcttccaggtgctgtactgcaagcgcaagcacgtgtcctggagagactaagaggcatttctctcggttcatccgcctccaggccatctatctcgttagatgaattttcagctagcgatgtgtttagaatcattgacttcagaaacagggaaacacggcatcagccaaatggacccaactcatcatcgttccacccaagcagtgaatcagatgaggaaaggccaaccatcagttcctctaacttacacaggttatccggacttagcaaggcagctttcctgcggctgcagattgagatttttgagactagtaaagatgacaacagggagccctcgccggagtgttccatttgccttgatggattctatgatggagatgagctgataaagctgcgctgtggtcacaggttccactcgacatgtttggagccatgggtgcgtaaatgtgcagattgcccatactgccgcacgaatattcgatcacaatcctgatgacaagcccttggttctgaataggattttaaccagcacgaagatgcattgttatatttcgctgttgtcatggtgcctgttatctggtgtgcgatgacagcctgttaaatttcatgtgtagtacgctgaatatcttttgttgtgccggccctaaagaggcttaaatattgcgtgtgaatggaagctgatagaagtataaaaaaaaaaaaaaaaaaaa

SEQ ID NO: 176 - protein, 273 aa, Panicum virgatum
  misc_feature: Ceres CLONE 1723984
  misc_feature (1)..(41): Pfam Name: zf-C3HC4 Pfam Description: Zinc finger, C3HC4 type (RING finger)
MTSASELFTARRAARGARLAADPDPEPDPHADALRDPHGLAARRRRRGCRPRRQLDAAGDVRQHLHTGAPPPRRRGSYTDQILSYLDNNNIGDSAARRNRLDRLMFRTNERLPGAVLQAQARVLERLRGISLGSSASRPSISLDEFSASDVFRIIDFRNRETRHQPNGPNSSSFHPSSESDEERPTISSSNLHRLSGLSKAAFLRLQIEIFETSKDDNREPSPECSICLDGFYDGDELIKLRCGHRFHSTCLEPWVRKCADCPYCRTNIRSQS

SEQ ID NO: 177 - DNA, 1122 bp, Panicum virgatum
  misc_feature: Ceres CLONE 1723990
  misc_feature: Encodes the peptide sequence at SEQ ID NO. 178
aaaacgacaagcaccaagcgtccaagccgagaccgtatcatggcggcggctccgtcagcggcggcgacggcggcgggggcgtcaacggcggcgctcgcccccaggccagcgcctaccagcgcgctcctccggcacacccaggtcacccctctccgccaccccgcgctgaaatgccgccgggctgggcccctcgcccccaaggcggctgcggccgcggccgcggcgggcggcagctccccctcgtccgcggtcttccacggcgaggtattcgtggtgggcgacaacatcgacaccgaccagatcatccccgccgagcacctcaccctggtgccgtccaagcccgacgagtaccgcaagctcggctccttcgccttcgcggggctcccctccgcggcctacccgacgcccttcgtcgccccgggagaggagtccacccactacgccgtcatcgtcggcggggccaacttcgggtgcggctcctcccgcgagcacgcgcccgtcgcgctcggggccgccggcgcgcgcgccgtcgtggcggagagctacgcgcgcatcttcttccgcaactccgtggccacgggagaggtctaccctctggagctcaccgacgccggagcctggaaggagtgcaagactggggatgtcgtcaccgtggaccttggcaattccgtctttattaaccacacatccggcaaggagtacaagctgaaacctattggcgatgccgggccggtcattgaggctggagggatctttgcgtatgcccggaagactggaatgattgcgtcgaaagccgcagcatgagggacaggtgaatttcatctggtgtcaaattagttgaggccttcgcatacagtatgtaaaactggatctaggaccaacctctacttgcttttgtccagcttgtgtaccgctacttttgcttacatttatactggagtcggtgttctaaaataagttacagcgtattgggctatgtatgctgaatcgatccattcgatctcttatgtattgcacttctctgtacaattgtacctgctactgagctaatctgtttgaataacagctttgttgtcagcttatgtttgtttggctttctgataaaaaaaaaaaaaaaaaaaa

SEQ ID NO: 178 - protein, 254 aa, Panicum virgatum
  misc_feature: Ceres CLONE 1723990
  misc_feature (1)..(123): Pfam Name: Aconitase_C Pfam Description: Aconitase C-terminal domain
MAAAPSAAATAAGASTAALAPRPAPTSALLRHTQVTPLRHPALKCRRAGPLAPKAAAAAAAAGGSSPSSAVFHGEVFVVGDNIDTDQIIPAEHLTLVPSKPDEYRKLGSFAFAGLPSAAYPTPFVAPGEESTHYAVIVGGANFGCGSSREHAPVALGAAGARAVVAESYARIFFRNSVATGEVYPLELTDAGAWKECKTGDVVTVDLGNSVFINHTSGKEYKLKPIGDAGPVIEAGGIFAYARKTGMIASKAAA

SEQ ID NO: 179 - DNA, 1245 bp, Panicum virgatum
  misc_feature: Ceres CLONE 1723998
  misc_feature: Encodes the peptide sequence at SEQ ID NO. 180
cggttattctattcccaccccgcctcctcatcgtcgcgctcacgcacgcgagctccaacatccccgcccccccgctgccgcgccacaccagcaccagcaccgcactccccccccccgtcccccgtttcccccacgcgcgtcgctgtcgctcccccccggcgccttcgcttcccccgcacggaacctctcgagcaggcagccgccgtcccccccccccccccccccccccgcgcgctataagtcgaaggcacaccccccgcggccatggcgcccgcaccggcatccctttccgcgccccgctccctctcgctgctcgcgcccgccgctagagtctcccccgggaggtggagcggtctgtcggtctcagtcgcggcccgcgccgtgaccggggtggcggcgtccgcgcagaggcggctggtcgcggcggcggcggcgacgaaawggcgcccgcggcgagcggggaggagggcgggaagccgttcgtggaggagatgcgggcggtcgccatgaagctgcacaccaaggaccaggcgcgggagggggagaaggagccggacgcgccgcccgtcgccaagtgggagccctccgtcgagggctacctccgcttcctcgtcgacagcaggctcgtcttccagacgctcgaggacatcgtcgaccgcgccgccgtcccgtggtatgctgagtttcggaataccgggttggagagatcagaggcactcaagaaggatctggagtggttcaaggaacagggccacacaattccagaaccatcagatcctggcactacatatgcttcccttctggaagagctgtctgagaaggacccccaggcatttatctgccatttctataatgtgtactttgcacatactgcaggaggccgaatgattggaaaaaaggtttccgagaagattctgaacaagaaggagctggagttctacaagtgggagggcaatctctcccagctgctgcaggacgtccgcaacaagcttaaccaagttgcatcgagctggtctcgggaggagaaggaccactgcctggaggagacggagaagtccttcgcctactctggggcgctcctccgccacatattcacctgacttagcattgccctctgatccaaatcacaattcacaaaacgctgtaaatacattatccatgactgtttcgactttgttactggggcggtggtgggatctcctccaccaggtacgatttacctttcagacaaaatgccaaagtgtt

SEQ ID NO: 180 - protein, 202 aa, Panicum virgatum
  misc_feature: Ceres CLONE 1723998
  misc_feature (1)..(199): Pfam Name: Heme_oxygenase Pfam Description: Heme oxygenase
MRAVAMKLHTKDQAREGEKEPDAPPVAKWEPSVEGYLRFLVDSRLVFQTLEDIVDRAAVPWYAEFRNTGLERSEALKKDLEWFKEQGHTIPEPSDPGTTYASLLEELSEKDPQAFICHFYNVYFAHTAGGRMIGKKVSEKILNKKELEFYKWEGNLSQLLQDVRNKLNQVASSWSREEKDHCLEETEKSFAYSGALLRHIFT

SEQ ID NO: 181 - DNA, 910 bp, Panicum virgatum
  misc_feature: Ceres CLONE 1724001
  misc_feature: Encodes the peptide sequence at SEQ ID NO. 182
atccattcgcaaagctccaacagcaatcaagctagcgagaagctacgacaagaagccagcaagcggcgagatcactcggatcaaagtgatccatggcgccgaggaggtcgacttcgccggccgggagcagcggcagcagcggcgcggagcagcagccgaggctgcgcggcgtgcggaagcggccgtggggccggtacgcggcggagatccgggaccccgtgcgcaaggcgcgcgtgtggctcggcaccttcgacacgcccgaggaggcggcgcgcgcctacgacgccgccgcgcgcaggctccgcgggcccggcgccgccaccaactaccccgcccagggcgcaaaggcaccggcggcgagcgcgagcgggagcatcgggttgtcggaggacgcgtcgtcatcctgctcctcccgggactcgccgcgggcggtgacggcgtccgtcgcggcgcccccgtcgctggacctgagcctggcgctcccggccatggcgaccacaccgtcgtcgcaccacatgttcatggacccggcctcgacgatggtggccgtggcgccggcgctgctgcagttcctgccgcccaagagcgaggaaaagcagagcttgtcagggtcgtcctcgtggtcgtcgtcggtggtgttcgacgcggcgccggccgtgggcctgggcctggacctcaacctggcgctgccggccgggatggtgatgtagagacggacaaatcgtttggtcaatttagctcctaggctcctagctcactcaacgatccagatgttggtcaggtgtttgtttgtgcatcttcgcagccttcgtttctttactttctttgtactggcagattttgagtctcgcaatgatgcgccaccgcaagaacgaagaaactttttcctcaaaaaaaaaaaaaaaaaaaa

SEQ ID NO: 182 - protein, 205 aa, Panicum virgatum
  misc_feature: Ceres CLONE 1724001
  misc_feature (1)..(60): Pfam Name: AP2 Pfam Description: AP2 domain
MAPRRSTSPAGSSGSSGAEQQPRLRGVRKRPWGRYAAEIRDPVRKARVWLGTFDTPEEAARAYDAAARRLRGPGAATNYPAQGAKAPAASASGSIGLSEDASSSCSSRDSPRAVTASVAAPPSLDLSLALPAMATTPSSHHMFMDPASTMVAVAPALLQFLPPKSEEKQSLSGSSSWSSSVVFDAAPAVGLGLDLNLALPAGMVM

SEQ ID NO: 183 - DNA, 847 bp, Panicum virgatum
  misc_feature: Ceres CLONE 1724006
  misc_feature: Encodes the peptide sequence at SEQ ID NO. 184
aagcaagcgaccattctcttctccaccagcgccgcctcctttatccccaatctttctccgcctccgccgcgatcccaaggaccaccaaaccctagcacgaaggcgcctcctctgtccaatcatggccaacagcaacctcccccgccgcatcatcaaggagacgcagcggctgctcagcgatccagctccaggaatcagtgcctccccatctgaagagaacatgcgctacttcaatgtcatgatccttggcccgtctcagtcgccatatgagggaggagttttcaagctcgaattattcttgcctgaagaatatccaatggctccaccaaaggttcgctttctcacaaaaatttatcaccccaacattgacaagcttggtaggatatgccttgatattttaaaggacaagtggagtcctgcccttcagatccgaacagttcttttgagcatccaggcgctgctcagtgccccaaatcctgatgacccgcttgctgataatgttgcaaagcactggaaagctaatgaggctgaagctgtagaaacagccaaagagtggacccgtgtatatgcaagcggagcatgagctttggacgatgcaatgctcgcttctttggtaataatcttcgtagtggagctcgacttgaatgactattggctggttacatttgaaactgaaggggtaataatytagtcatatgtggaaatttttcctctttwttwtggggggtacttgagtytgatgtacatwggtttaacggggcaggtaaagtgttttttttgtaggttgggtggttgggggaacatatttcataataattttcctgaaatgaggggggggcctgttttt

SEQ ID NO: 184 - protein, 153 aa, Panicum virgatum
  misc_feature: Ceres CLONE 1724006
  misc_feature (4)..(150): SWISSPROT Homolog: EC 6.3.2.19 Ubiquitin-conjugating enzyme E2 N
MANSNLPRRIIKETQRLLSDPAPGISASPSEENMRYFNVMILGPSQSPYEGGVFKLELFLPEEYPMAPPKVRFLTKIYHPNIDKLGRICLDILKDKWSPALQIRTVLLSIQALLSAPNPDDPLADNVAKHWKANEAEAVETAKEWTRVYASGA

SEQ ID NO: 185 - DNA, 1103 bp, Panicum virgatum
  misc_feature: Ceres CLONE 1724011
  misc_feature: Encodes the peptide sequence at SEQ ID NO. 186
acatccctgtacaaatcgaagcaaatttccactcctccgcggggcagctaccgtgcaagcagcggcggaggggatcagcgagcgacctcgaagctcggccggcgcggcgatggaggtcaagtgccggcgcctggaggggaaggtggccgtcgtgacggcgtccacgcaggggatcggcctcgccatcgccgagcgtctcggcctagagggcgccgccgtcgtcatctcctcccggaagcagaagaacgtggacgacgcggtgaagaggctcaaggcacaggggatcacggcggtcggggccgtctgccacgtctccgacgcccagcagcgcaagagcctcatcgacacggcagtcaagaacttcggacacattgatattcttgtctcgaatgctgctgcaaatcctactgtagatggcatacttgaaatgaaagaagctgttctcgataaactgtgggatattaatgtcaaggcttctattcttcttcttcaggatgctgctccccacctacgtaagggatcatctgtgattattatttcctcaattgctggttacaatccagaacaaggattgacaatgtatggtgttacaaagactgctctcttaggtctcacgaaggcccttgctcgtgagatgggacccaatactcgtgttaactgtatagcccctggtttcgttcctacacggttcgctagtttcctcacaaacgatgagaccattaggaaagagcttactgagaggaccattattaagagattgggttctgtggaagacatggctgcagttgccgcattcctggcttctgacgatgcgtccttcatcacagctgaaaccatagttgttgctggagggatacagtctagattgtagacctggccgaagcttacactggcatgctcgaataatccgtactagcaccgcatgtgaccataccggtgcatttagagggtatagcaactatactgtaataattcgctgttaagttccgttgtgctaagttgggtaaactgcttgtttttaaattggattgcaatgtggtagcgaatacagagcgagagtttatatagcaggaccaaaagcacaaaaaaaaaaaaaaaaaaaa

SEQ ID NO: 186 - protein, 253 aa, Panicum virgatum
  misc_feature: Ceres CLONE 1724011
  misc_feature (1)..(167): Pfam Name: adh_short Pfam Description: short chain dehydrogenase
  misc_feature (8)..(253): SWISSPROT Homolog: EC 1.1.1.184 Dehydrogenase/reductase SDR family member 4
MEVKCRRLEGKVAVVTASTQGIGLAIAERLGLEGAAVVISSRKQKNVDDAVKRLKAQGITAVGAVCHVSDAQQRKSLIDTAVKNFGHIDILVSNAAANPTVDGILEMKEAVLDKLWDINVKASILLLQDAAPHLRKGSSVIIISSIAGYNPEQGLTMYGVTKTALLGLTKALAREMGPNTRVNCIAPGFVPTRFASFLTNDETIRKELTERTIIKRLGSVEDMAAVAAFLASDDASFITAETIVVAGGIQSRL

SEQ ID NO: 187 - DNA, 1186 bp, Panicum virgatum
  misc_feature: Ceres CLONE 1724012
  misc_feature: Encodes the peptide sequence at SEQ ID NO. 188
gcctctcgttcggaaccggctcgagccccacctgtcaccgacgagccgcctggccggcgggggcaatcgcaatcccactgctagggttcaagctcccggcgatggcgccaccgccgccgtccgagcagccggacgccgccgctcccggggccggcgctatctccagggtcctcatcgtcatggcgatggagaaggaggcgatggcgcttgtcaacaagttcaagctcgtcgaggcgcccgccagcgaatccatatttcctaaaggtgccccatggactaggttctatggcatctacaaagatctccaccttgaccttgtcatgcctggaaaggatcctgtttttggagttgacagtgttggtaccgtatcagcagctcttgtgacttatgcttccattcaagcattgaagccagacattatcattaatgctggcactgctggtggcttcaaggccaaaggagcaagcattaaagatgtcttcctagcatcagatgttgcattccatgacaggaggataccaatacctgtttttgacatgtatggaattggagcacggaaaacttttgcagcccctaatatcctgaaggaactcaatttcaagcttggcaagttgtcgactggggattctctggatatgtctccccaggatgaggaggctatactgagcaatgatgctacaatcaaggatatggagggagcggcggtggcatacgtcgcggacatgttctcaactccagcaatcttagtgaaagccgtgactgatattgtggatgggaacaagccaactgcagaagagtttctgaaaaacctgatctccgtgacagcagcactggatgtggcagtcaccaaattggtggatttcatctgcgggaagcgcatctctgatctttaggaactcccaaactgcctctccatgctgtttcccggtcggcagaaactgaatatgctcatgaatccaagatccccccctttgctttgatgcacaatacaagtaggatacaatacaattaggctgtatgattacttttggaggggttgtgtatgtgaggttttacattcttaacccccgtgtacaaaattctggtcgagacatggtgtggaattttgtagaataatttgcgaggcatacttttcttgcggaaataaaatgctgggggagaactagaaaaaaaaaaaaaaaaaaaa

SEQ ID NO: 188 - protein, 263 aa, Panicum virgatum
  misc_feature: Ceres CLONE 1724012
  misc_feature (1)..(224): Pfam Name: PNP_UDP_1 Pfam Description: Phosphorylase family
MAPPPPSEQPDAAAPGAGAISRVLIVMAMEKEAMALVNKFKLVEAPASESIFPKGAPWTRFYGIYKDLHLDLVMPGKDPVFGVDSVGTVSAALVTYASIQALKPDIIINAGTAGGFKAKGASIKDVFLASDVAFHDRRIPIPVFDMYGIGARKTFAAPNILKELNFKLGKLSTGDSLDMSPQDEEAILSNDATIKDMEGAAVAYVADMFSTPAILVKAVTDIVDGNKPTAEEFLKNLISVTAALDVAVTKLVDFICGKRISDL

SEQ ID NO: 189 - DNA, 822 bp, Panicum virgatum
  misc_feature: Ceres CLONE 1724023
  misc_feature: Encodes the peptide sequence at SEQ ID NO. 190
aagcgcaacacaagtcgctcgctgctcgcgtttcgcaaccgaaccaagaaaaaaagaagaagagcaagtcgtgcaagaagccgcgcgccgaggagaatgtaccaggccatcccgtacggcgccagccgggcgtggccgccgcgcccgcgccccgcgccgatggcggccgaggcggcggccgtcgtggacgccgccgtcgcagcggcgacggcggcgggggagaggctgcctgcacagcagccggccgcggcgagggaggaggtgaggcgggccgtgacggagagccccgtggtggtcgtggggaggcgcgggtgctgcctcagccacgtcgtgaagcggctgctgcaggggctcggggtcaacccggccgtgcacgaggtcgccggcgaggcggagctcgccgggatcgtcgacggcgacgtcgcgctcccggcggtgttcgtcgggggcaggctcctcgggggcctcgaccggctcatggccgtgcacatctccggcgagctcgtgcccatactgaaggaggccggtgcgctctggctctgaggacacggagctctccgaacggctcatggccgtgcacatcgacttctccctgctggcgctccgatcctccaattcttcatcttttattttcctccttgtggagttaatgaaggcgttgttaacttatcattagataggacttcgattcttttaagagaagcgtatagtattgcataagtagttattaggaaattggagtgcttatcttaagcgatttccattttattttccatcatgtgaatatgaagagtgatgcaagtttacctgatgagcttccgg

SEQ ID NO: 190 - protein, 148 aa, Panicum virgatum
  misc_feature: Ceres CLONE 1724023
  misc_feature (1)..(60): Pfam Name: Glutaredoxin Pfam Description: Glutaredoxin
MYQAIPYGASRAWPPRPRPAPMAAEAAAVVDAAVAAATAAGERLPAQQPAAAREEVRRAVTESPVVVVGRRGCCLSHVVKRLLQGLGVNPAVHEVAGEAELAGIVDGDVALPAVFVGGRLLGGLDRLMAVHISGELVPILKEAGALWL

SEQ ID NO: 191 - DNA, 1190 bp, Panicum virgatum
  misc_feature: Ceres CLONE 1724040
  misc_feature: Encodes the peptide sequence at SEQ ID NO. 192
ggccaacagctcgagcttctccgcgaaccccacccctagcgccgccccttcccttccccgggcgccctccccggcatcctccccgctctccgatccaagatgtataagctggggagaggaaaccgcgacaaggtgcagcagttcatggccataaccggcgccagtgagaaggttgcccttcaggcactgaaagctagtgattggcacttggaaggagcttttgacttcttctatagccaacctcagatttctgctgtcaatactcggcatcttgaagacattttcaatagatacaaagaacctgatgctgatatgatcatggtggagggagtatctcagctttgcaatgatctgcaggtggagcctcaggatattgtcatgcttgtcatatcatggcacatgaaagccgccacaatgtgtgaatttactcgccaggaattcattggtggactgcagtctattggggtagattcaatcgagaaatttcgtgcaaagttaccatcattacgagctgagctaaaagatgataataagttccgtgagatatacaacttcgcgttcacttgggcaagagaaaagggtcaaaagtctctctcactggagactgctattgggatgtggcagttgctatttgctgaaaggaactggcctcttctggatcattggtgccaatttttacaggtcaggcacaataaagccatatctagagacacctgggcgcagctgctggaatttgtaaagtcgattgatccacagctatccaactatgacgacgaaggtgcttggccctacctcatagatgaatttgtggaatacctgactgacaatgggttggttcagcgcacgaaatgaactgcaatggggaggattcgcccctcaccgaacaaacggttgggctgtacaaacacgattcatcttggtgtatacggtgcccaggacccgatgttggcactcctgctcaatccactcgccaaactgttggcctatcattgcatgacagaatttgctgataaacgcggagaaaacgcaacctaagcctgggaagtggtggtcccgagcctgccatcgtgaactactccaaaatgcactggggagtttgggactctggttaacgtacaagttgtttcggatgtatcactgtcacttgctactatatttctattatccctcaaaaaaaaaaaaaaaaaaaa

SEQ ID NO: 192 - protein, 250 aa, Panicum virgatum
  misc_feature: Ceres CLONE 1724040
  misc_feature: Great-hit functional homolog of the protein sequence given in SEQ ID NO 9585
  misc_feature: Useful for making plants with altered Lignin content
MYKLGRGNRDKVQQFMAITGASEKVALQALKASDWHLEGAFDFFYSQPQISAVNTRHLEDIFNRYKEPDADMIMVEGVSQLCNDLQVEPQDIVMLVISWHMKAATMCEFTRQEFIGGLQSIGVDSIEKFRAKLPSLRAELKDDNKFREIYNFAFTWAREKGQKSLSLETAIGMWQLLFAERNWPLLDHWCQFLQVRHNKAISRDTWAQLLEFVKSIDPQLSNYDDEGAWPYLIDEFVEYLTDNGLVQRTK

SEQ ID NO: 193 - DNA, 1138 bp, Panicum virgatum
  misc_feature: Ceres CLONE 1724047
  misc_feature: Encodes the peptide sequence at SEQ ID NO. 194
acacaaggcgccccgctttattgtcctgccccccattttgtcttcctccccaagaagcgaaatccggaaagccaatctagaagctccccccttccctctcgcagcctcctcccacccgatcccaatctaagctcgccgagatgggccgcaagttcttcgtcggtggcaactggaaatgcaacggaaccactgatcaggtcgagaagattgtcaaaactctgaatgaaggacaggttccctctccagatgttgttgagatcgttgtcagccctccttatgtgttccttcctgtggtcaagagccagctgcgcccagagttccaagttgctgctcagaactgctgggtgaaaaagggaggtgctttcactggtgaagtcagtgctgagatgctcgtcaaccttggcgttccctgggtcattcttggacactctgaaaggagggctctgttgggagaatcaaatgagtttgttggagacaaagttgcctatgcactctctcagggactaaaggtcattgcatgtgttggtgagacccttgagcagagggaagctggatcgactatggatgttgtcgcggcacaaacaaaagccattgctgagaagatcaatgactggagcaacgtggttattgcctacgaaccagtctgggccattggaactggcaaagttgccacccctgatcaggcccaggaagtgcacgcgtccctgagagattggctaaggatcaatgtcagccctgaggtcgccgaatctaccaggatcatctatggaggctctgtgactggtgcaaactgcaaagagctggcggcaaagcacgatgttgacggtttcctggtcggtggtgcttctttgaagcctgagttcattgacatcatcaactcggccaccgtgaagaccgcctaagatgtcccatgttcccgccccgcctaagaacagacttgttacctgtttatgtacgctagtaattttgtgctggagcgtatactgcttcctctctccctcagctctgaggctgcagcttgagcttgctaataatgtttaccgctgaacataccaataatgttttttggttagccccttttttttctggtgaggcacattgcaccaggtgtttgacttaaaaaaaaaaaaaaaaaaaa

SEQ ID NO: 194 - protein, 253 aa, Panicum virgatum
  misc_feature: Ceres CLONE 1724047
  misc_feature (1)..(241): Pfam Name: TIM Pfam Description: Triosephosphate isomerase
  misc_feature (1)..(253): SWISSPROT Homolog: EC 5.3.1.1 Triosephosphate isomerase, cytosolic
MGRKFFVGGNWKCNGTTDQVEKIVKTLNEGQVPSPDVVEIVVSPPYVFLPVVKSQLRPEFQVAAQNCWVKKGGAFTGEVSAEMLVNLGVPWVILGHSERRALLGESNEFVGDKVAYALSQGLKVIACVGETLEQREAGSTMDVVAAQTKAIAEKINDWSNVVIAYEPVWAIGTGKVATPDQAQEVHASLRDWLRINVSPEVAESTRIIYGGSVTGANCKELAAKHDVDGFLVGGASLKPEFIDIINSATVKTA

SEQ ID NO: 195 - DNA, 983 bp, Panicum virgatum
  misc_feature: Ceres CLONE 1724050
  misc_feature: Encodes the peptide sequence at SEQ ID NO. 196
aaccaagcaatgcaagctctcgatcgcgtcgggactagccggtcggcctgcagctagcgacctccccatccatcgtccgagtcggccgtcgccgatgacggccgggacggcggcggcggtgagggtgctgagcggggaggtgagcccgttcacggcgcgggcgcggctgacgctggagctgcggggcgtggcgcacgagctcctggacgagccgctcgggcccgccaagagcgccaggctcctcgccgacaaccccgtctacggcaagatccccgtcctgctcctccccgacggccgcgccatctgcgagtccgccgtcatcgtccagtacgtcgaagacgtcgcgcgggccaccagctgcggtggcggcgccgacggcgaggactgccccctcctgccggaggacccctacgagcgcgccatgcaccgcttctggaccgcctacatcgacgacaagttttggccggcgctggacgccgtctccctgggcccgaccccggccgcccgcgcgcgggcggccgccgacacccgcgcggcgctgcggctcctggaggaggcgttcagggaccgcagcggcggcgcggctttcttctccgggcgcgacgccgcgccggggctcctggacctggcgctcggctgcttcctgccggcgctcagggcctgcgagcgcctccacgggctctccctcgtcgacgcgtccgccacgccgctgctggacgggtggagccgccgcttcgccgcacaccccgccgccaggcgcgtcctgccggacacggacaaggtgctgcgcttcacgaggttcctccaggcaaagttcggggtcgatattgatgtctccaaatgatattgtctgtctgtgtttgtgtaacacctctctgcttgtttgattttctctctgtcgtatctgtgcgcgcactttgttctgctaccttcgctgcaaataataaacttgtcgatgcatataaaaaaaaaaaaaaaaaaaa

SEQ ID NO: 196 - protein, 249 aa, Panicum virgatum
  misc_feature: Ceres CLONE 1724050
  misc_feature (1)..(74): Pfam Name: GST_N Pfam Description: Glutathione S-transferase, N-terminal domain
  misc_feature (3)..(76): Pfam Name: GST_N Pfam Description: Glutathione S-transferase, N-terminal domain
  misc_feature (1)..(65): Pfam Name: GST_C Pfam Description: Glutathione S-transferase, C-terminal domain
MTAGTAAAVRVLSGEVSPFTARARLTLELRGVAHELLDEPLGPAKSARLLADNPVYGKIPVLLLPDGRAICESAVIVQYVEDVARATSCGGGADGEDCPLLPEDPYERAMHRFWTAYIDDKFWPALDAVSLGPTPAARARAAADTRAALRLLEEAFRDRSGGAAFFSGRDAAPGLLDLALGCFLPALRACERLHGLSLVDASATPLLDGWSRRFAAHPAARRVLPDTDKVLRFTRFLQAKFGVDIDVSK

SEQ ID NO: 197 - DNA, 1551 bp, Panicum virgatum
  misc_feature: Ceres CLONE 1724055
  misc_feature: Encodes the peptide sequence at SEQ ID NO. 198
actcgatcccagctagcctccgactcatctctctccctcgctctagtccccaatacctctccaacatactcgtattggttcgtgggcaacaatggcgaggagccgcccggccgtcctcttgtccctcgccgttgtggcgttggcggccacggcgctggctccggcgccggcggcggcgaccaagtacaacatcaccaagctgctggcgccgtacaagcagtactcgaggttcaacgagatgctgtccaggacgcggctggcgtacgacatcaaccggcggcagaccatcacggtgctcgccgtcgacaacgcggccatgtcggcgctggaccactactcgctgcagaccatccggcacatcctctcgctgcacgtcctcgtcgactactacggcgacaagaagctcaagaagctcgcccacggctccaccgcctcttcctccatgtatcaggccaccggcgccgcgtcaggcatgtccgggtacgtgaacatcacccgcaaggacggcaaggtcagcttcacgacggacgacgccgacgccaccgcgaagcccacccggtacatcaggtccatcaaggagtacccctacgacatcgcggtgctcgaggtgagctccatcatctcctccgccgacgccgaggcgcccgtgccgccgccggcgcccgtcgacctcgtcgagctcctctccaagaagtactgcaagtccttcgcgtccctcctctcggccaacgccgacgtgctccgcaccttgaacgagaccaaggacaacgggctgacgctcttctgccccgtcgactccgccgtcgcggcgttcgcggccacctacaagaacctcacggccaaggccaagacggccatcctgctctaccacggcgtgccggactacttctcgctgcagctgctcaagtccaacaacggcatggtcaccacgctcgccaccgccaacgagaacaagaaggactacagctacgacgtgcagaacaagggcgagacggtcaccctccagaccagggtcgtcacctccagcatcacggccaccgtcggcgacatggagccgctcgccgtctacgccgtgaacaagttcctcaagccgaaggagatattcaaggtcgtcgaggcacccgcgcccgcaccagagccgtccaagaagaagagcaaggcagctgacggcggagatgactcgtccgacaattccggcgacgtgacggccgacaagggcgacgctgcgccagccgccatgctcgctcggtgggtggccgcagccacaacagcggtagcggcatttgcgttgatgggctaaatagttgtttcaaatcttattattctttttattttcatggtagattgttttcctatttaatggcgctcggcaaagggggaaaattgaaacacattgttctgcatgcgccctgtagcaagaaacgtggaggaaggaactcgggattgtggcttgtagtgctttgagttttcgtcaattagcttgatatcgatgtaattattttgtaattaatacagttgttgtcagagtttgaaaaaaaaaaaaaaaaaaaa

SEQ ID NO: 198 - protein, 402 aa, Panicum virgatum
  misc_feature: Ceres CLONE 1724055
  misc_feature: Great-hit functional homolog of the protein sequence encoded by LOCUS At4g12730
  misc_feature: Useful for making plants with altered cell wall content and/or composition
MARSRPAVLLSLAVVALAATALAPAPAAATKYNITKLLAPYKQYSRFNEMLSRTRLAYDINRRQTITVLAVDNAAMSALDHYSLQTIRHILSLHVLVDYYGDKKLKKLAHGSTASSSMYQATGAASGMSGYVNITRKDGKVSFTTDDADATAKPTRYIRSIKEYPYDIAVLEVSSIISSADAEAPVPPPAPVDLVELLSKKYCKSFASLLSANADVLRTLNETKDNGLTLFCPVDSAVAAFAATYKNLTAKAKTAILLYHGVPDYFSLQLLKSNNGMVTTLATANENKKDYSYDVQNKGETVTLQTRVVTSSITATVGDMEPLAVYAVNKFLKPKEIFKVVEAPAPAPEPSKKKSKAADGGDDSSDNSGDVTADKGDAAPAAMLARWVAAATTAVAAFALMG

SEQ ID NO: 199 - DNA, 1180 bp, Panicum virgatum
  misc_feature: Ceres CLONE 1724071
  misc_feature: Encodes the peptide sequence at SEQ ID NO. 200
aagctctcggattctttcccttcttcttataacgcaagaaagaaaacggagaaatcgaaagggaaacctgaaaaagcctcactcgattcatcgcctccgcctctctcccagcagcgcacatcgccggcgacgccatggccatgaagctggacatgtccgcgctcgagaccaacttcgccgtcccctgcggcgacgacggcgacggcacgtacttctccgccgaggcccccgacgtgccgtccatggtgctccccacctgcgccgacttcgacgggttccaggcggcgaccaaggagatggtgaagaataagaaggggacgaccacgctcgccttcatcttcgataagggcgtcatcgtcgctgccgactccaaggccagcatgggcggctacatatcctcacaaactgtgaggaaaattattgaaataaatccctacatgctgggaacgatggctggaggagctgctgattgccaattttggcataggaaccttggaaccaagtgccggctccatgagctttcaaacaagcgaaggatctctattgctggtgcttccaaactgttggctaatatcctttattcatatcgtgggatgggactgtcaattggtacaatgattgcgggatgggatgagaagggtcctggcttgtactatgttgacagtgagggtgcaaggcttgtgggacacaggttctctgttggctctggttccctctatgcttatggtatcttggatgaaggttaccgcttcaacatgtcagtcgaggaagctggtgagttagctcgaagggctatttatggggcaaccttccgtgatgcagcaagtggtggttgtgttagtgtttatcacgttggccctgacggttggaagaagctttctggagatgatgtcggggagctgcactaccattactacccagttcagaaaacaccggttgaacaggagatgaccgatgcagctactgcttctgcttaaacccgtcgtttagaggtgcatgtatccagggaaccgtgaattgtcaaagcgccttgtttatgaacttggacatgtttgtctcacaatgttagatcacttttgtgtcctgttgatgtttctgagtgactttgcgcaattattaaattcttgacccaccgatatagatgttttctttgaggtttcaaaaaaaaaaaaaaaaaaaa

SEQ ID NO: 200 - protein, 280 aa, Panicum virgatum
  misc_feature: Ceres CLONE 1724071
  misc_feature (3)..(275): SWISSPROT Homolog: EC 3.4.25.1 Proteasome subunit beta type 5-A precursor
  misc_feature (3)..(276): SWISSPROT Homolog: EC 3.4.25.1 Proteasome subunit beta type 5-B precursor
MAMKLDMSALETNFAVPCGDDGDGTYFSAEAPDVPSMVLPTCADFDGFQAATKEMVKNKKGTTTLAFIFDKGVIVAADSKASMGGYISSQTVRKIIEINPYMLGTMAGGAADCQFWHRNLGTKCRLHELSNKRRISIAGASKLLANILYSYRGMGLSIGTMIAGWDEKGPGLYYVDSEGARLVGHRFSVGSGSLYAYGILDEGYRFNMSVEEAGELARRAIYGATFRDAASGGCVSVYHVGPDGWKKLSGDDVGELHYHYYPVQKTPVEQEMTDAATASA

SEQ ID NO: 201 - DNA, 958 bp, Panicum virgatum
  misc_feature: Ceres CLONE 1724082
  misc_feature: Encodes the peptide sequence at SEQ ID NO. 202
acaggacagcgcgatcgtcatccgccacccaggctcaactgctcgcggcgaggcagcacccgtcccctctctcccgtcctcctgcgcgctctccctcctcgctgacgcgcgcacacgtccaagcctccaaggggaccaaccaatcgcgcgcggctctggttgggaaatgggtctcctggaccagctctgggacgagacggtggccggcccgcgcccggagtccggcctcggcaggctccgcaagtacgcctccttctccccctcgtcgtcgtcctcgctgacccccgccgcggcgcccgcggtgacgcgcagcttcaccgtcgggggccgcccggcgtcgctgtccgtcgaccagtcgccgcacggggagtcgtacagctcctccgtcccgtcctccccggccagcgggccggactccccgttcgccgcagctacgcccaaggctgatggctatgggaggcttggccggaaacccaaggcctccgacgggccggagccggccatcgggccgaggagccccaccgtgtacgactgggtggtgatcaacttggaatgataagcaatcgagcggaggacgtacagagagcgaggaagctagctagcgtgtgtgtgtttgcctgcaagtttgaggctgcgtcgtgtttccgttccgtatatgttccgtgttctaccgaaaccgtgcctgactgtctggggtggcatgtgtagtagtatgtctagctagagacctggtaggatgatgatgatgatgatcagttcgtgggggttggaagcaggcggcgatccgatccagtctagttctgccttccggcaagatgagttttgttcagttcttcgatctgggggaagaactctgaaatgactaatgaggatgtggtgtacgcccgcctgctttgtttttctacgctcccctgtaattacctaatactgtgttcaatgcaaagcatggcactgcttt

SEQ ID NO: 202 - protein, 129 aa, Panicum virgatum
  misc_feature: Ceres CLONE 1724082
  misc_feature (1)..(23): Pfam Name: Auxin_repressed Pfam Description: Dormancy/auxin associated protein
MGLLDQLWDETVAGPRPESGLGRLRKYASFSPSSSSSLTPAAAPAVTRSFTVGGRPASLSVDQSPHGESYSSSVPSSPASGPDSPFAAATPKADGYGRLGRKPKASDGPEPAIGPRSPTVYDWVVINLE

SEQ ID NO: 203 - DNA, 1216 bp, Panicum virgatum
  misc_feature: Ceres CLONE 1724099
  misc_feature: Encodes the peptide sequence at SEQ ID NO. 204
ccaacaatccactcgatcagtgacaacctcctcaaccgagctcccagcacttcgcgaactctcgctagctagagctgctgctgcctccaacgatcagctgagaagaagatgaggtcgttggcggtcgccgtcgcggcgatggcctgcctggcggcggtggcgcaggccggcaacttctaccaggacacggagatgacctggggcggcgggcgcggcaaggtcgtggacggcgggcgcgggctcgacctcacgctggaccgcacctccggctccgggttccagtccaagagcgagtacctcttcggcaagatcgacatgcagatcaagctggtccccggcaactccgccggcaccgtcaccaccttctacctctcgtcgcaggggagcacccacgacgagatcgacttcgagttcctgggcaacgtcaccggcgagccctacacgctgcacaccaacgtgttcacgcaggggcagggccagcgcgagcagcagttccgcctctggttcgaccccaccacggcctaccacacctactccatcgtctggaacccgcagcacatcatcttcgcggtggacggcaccccgatccgtgacttcaagaaccacgaggcgcgcggcgtggcgttccccaagagccagccgatgcggctgtacgcgagcctgtggaacgccgacgactgggcgacgcagggcgggcgcgtgaaggcggactggtcccacgcgccgttcgtggcctccttccggggcttccgcgccgacgcctgcgtctggtccggcggccggcagcagtgccccgtgggcaccatggaggccgccgccgcgggcggcgggcgcggctggtggagccagcagctgagcgacacgagctaccgccgcatgcgctgggtgcagaggaagttcatgatctacaactactgcaccgacgccaagcgcttcccgcagggcgtccccaccgagtgccacctccggtgagctgctagaggctgccgcagtgccgtgcacgcacgatggctcctcgccgtcccaacccatcgcatcatggagaagaataagggtcgtttttgcatgatggggccgggcgatgtacaatgtaaatggagcagcacgcgtatcgcattctttgatttgtttctgtaacaccagatgtgcacctgtcatcaagtttctttcagcataatcttccgtcagcgtcctcgaaaaaaaaaaaaaaaaaaaa

SEQ ID NO: 204 - protein, 287 aa, Panicum virgatum
  misc_feature: Ceres CLONE 1724099
  misc_feature: Great-hit functional homolog of the protein sequence encoded by LOCUS At4g25810
  misc_feature: Great-hit functional homolog of the protein sequence encoded by LOCUS At5g57560
  misc_feature (1)..(181): Pfam Name: Glyco_hydro_16 Pfam Description: Glycosyl hydrolases family 16
  misc_feature (20)..(218): SWISSPROT Homolog: EC 2.4.1.207 Xyloglucan endotransglucosylase/hydrolase protein 24 precursor
  misc_feature (20)..(284): SWISSPROT Homolog: EC 2.4.1.207 Xyloglucan endotransglucosylase/hydrolase protein 22 precursor
  misc_feature: Useful for making plants with altered cell wall content and/or composition
MRSLAVAVAAMACLAAVAQAGNFYQDTEMTWGGGRGKVVDGGRGLDLTLDRTSGSGFQSKSEYLFGKIDMQIKLVPGNSAGTVTTFYLSSQGSTHDEIDFEFLGNVTGEPYTLHTNVFTQGQGQREQQFRLWFDPTTAYHTYSIVWNPQHIIFAVDGTPIRDFKNHEARGVAFPKSQPMRLYASLWNADDWATQGGRVKADWSHAPFVASFRGFRADACVWSGGRQQCPVGTMEAAAAGGGRGWWSQQLSDTSYRRMRWVQRKFMIYNYCTDAKRFPQGVPTECHLR

SEQ ID NO: 205 - DNA, 972 bp, Panicum virgatum
  misc_feature: Ceres CLONE 1724107
  misc_feature: Encodes the peptide sequence at SEQ ID NO. 206
gtgcaaacctagtctgctgcctttctagctgaaaactttacccgttcgtcttcctccgatcctcttcttcctcctcgttgctgcttgctgggagagtatactgttcttcacaaggcgaagcgaggcggcggcggtgacagccgatcagaatcgaaggaatgtcgtcccagatcgcggcagcggtggatcatgtgtgctacgttcactgcaacttctgcaacacagttctcgcggtgagtgtccctgggaatagcatgctcaacatcgtgacagtccggtgtggacactgcacaaatctattgtcagtgaacctgagagcactgatgcactcactcccagagcaacaggatcagctacaggcccatggcatcaatggcagtcatttggagtttggttcttcgtcctcgaagttccgactgcctatgatgtactcgccacaaaaccaacaccacctgctgcaggaacagacgctaaatgctcatcctccagagaagaggcaacgggttccatcggcgtacaacagattcatcaaggaagagatccgcaggataaaagcaaacaaccctgacattagccacagggaagcctttagcacagcagccaagaactgggcacattatccaaatatccatttcgggctaagccccagacgggagggtggcaagaagctcgtcgatgaggctgtctcagcctctctgccgcctaagaagatccaaagtctctactgatagatatgtgtgtctattcatcatctggatgcaagaatcaataccacaaattaaaatatactgttagtaaaaaattaagaggaagaggggaaaataagttactactacttattaacgagtgataagtgatgggaggtgaaacatacaatcacatggattgctattaggcacttggttgaactgagacgacttaataaatcatttgaccgcattattattgtgtgaaaaaaaaaaaaaaaaaaaa

SEQ ID NO: 206 - protein, 189 aa, Panicum virgatum
  misc_feature: Ceres CLONE 1724107
  misc_feature: The sequence is a functional homolog of  SEQ ID NO 1151 in the  10/666,642 US patent application
  misc_feature: The sequence is a functional homolog of  SEQ ID NO 1506 in the  10/666,642 US patent application
  misc_feature: The sequence is a functional homolog of  SEQ ID NO 420 in the  10/666,642 US patent application
  misc_feature: Useful for making plants with modulated growth and phenotype characteristics
MSSQIAAAVDHVCYVHCNFCNTVLAVSVPGNSMLNIVTVRCGHCTNLLSVNLRALMHSLPEQQDQLQAHGINGSHLEFGSSSSKFRLPMMYSPQNQHHLLQEQTLNAHPPEKRQRVPSAYNRFIKEEIRRIKANNPDISHREAFSTAAKNWAHYPNIHFGLSPRREGGKKLVDEAVSASLPPKKIQSLY

SEQ ID NO: 207 - DNA, 935 bp, Panicum virgatum
  misc_feature: Ceres CLONE 1724109
  misc_feature: Encodes the peptide sequence at SEQ ID NO. 208
gaactctttcggattcctccccctgcggccctacctatatacacgacgccgtcgccctttcctcgtcgccacggtacccgtttctctcacacctcgcgcagcatcggagcactagagaggaatccagcccagcagcccaagcaatggagtgcgtcctgggcgtggtcggccgcgacttcgcggtggtggcggcggacacctccgccgtgcagagcatcctcgtccacaagacggacgaggacaaggtgatggtcctcgactcgcacaagctgatgggcgcctcgggggagcccggcgaccgggtgcaattcacggagtacatacagaagaacctccacctgtaccagttccgcaacaccaccccgctctccaccgccgccaccgccaacttcacccgcggtgagctcgccacagccctccggaagaatccatacatggtcaacgttatacttggtggttatgataaggatgttggtgcttccttgtactacatcgactacattgcaaccttgcacaagattgacaagggtgcttttgggtatggctcctacttctgtttgtcgctaatggacaagctgtaccacccggacatgactgttgaggaagcagtagatcttgttgacaagtgcatcaaggagatccgtctgaggttggtcgttgcgcctcagaactttgtaatcaagatcgtggataaggatggggcgagggagtatgcgaggcgtgagctcgtcggcgacaacgcatcagcatcagcgggagctgcagcaactacagttgccgcttgaggcgtgaactcgttggagctcgcatattgttaattgtttctcagcgctgctactatgtaatcacaagatactttggggtcccagaactgtttttatcaattttagcccagacgtgtaactctgttgtttcaaaaaaaaaaaaaaaaaaaa

SEQ ID NO: 208 - protein, 213 aa, Panicum virgatum
  misc_feature: Ceres CLONE 1724109
  misc_feature (1)..(202): SWISSPROT Homolog: EC 3.4.25.1 Proteasome subunit beta type 2-A
  misc_feature (1)..(213): SWISSPROT Homolog: EC 3.4.25.1 Proteasome subunit beta type 2
MECVLGVVGRDFAVVAADTSAVQSILVHKTDEDKVMVLDSHKLMGASGEPGDRVQFTEYIQKNLHLYQFRNTTPLSTAATANFTRGELATALRKNPYMVNVILGGYDKDVGASLYYIDYIATLHKIDKGAFGYGSYFCLSLMDKLYHPDMTVEEAVDLVDKCIKEIRLRLVVAPQNFVIKIVDKDGAREYARRELVGDNASASAGAAATTVAA

SEQ ID NO: 209 - DNA, 1378 bp, Panicum virgatum
  misc_feature: Ceres CLONE 1724110
  misc_feature: Encodes the peptide sequence at SEQ ID NO. 210
acggctaggcacactaagtgttttctattctacttatacaccaagcaagctacctttaattaaggagatcgagagttggctagcttcctagagagagagagagagagagagagatgcatgatatggagtctctccctgtgcccagcgttcaggcgatggtggcggccaccggtggagcccatgtgccgccaaggtatctccggccagaggtggccgccgatgctgtggctagcgaaggcgaggccgcgatacccatcattgactttgagaggctgctgctggaggaggaggcggcggcggcggcggcggcttcttgtcgcgttgaatctgcacgcctccatgcggcctgccaggagtggggcttcttccagctcataaaccacggagttccggatgacgtcatccaggggatgaaggccaacattgaagcattctttgggttgcctgcagagacgaagcagcagtttgctcaggaacgaggccagctggagggctacggtcagctgttcgtggtgtcggaggatcagaagctggactgggctgacatcctctatctgaatacgcagccgcctgagcaccggaacacgagattctggcctgacaagcccgataccttgaggtcgacactggacgcatattctgctgccgtaaagactgtagcggatcgccttctggctattatgtccagcaacctcgggttgccaccggaggtggttgctagcagatgcagcggtggcggaatgcagtcggtgaggatcaactactatcctccctgcgccgaggcagacaaggttgtgggcttctccccacactcggacgctgatctcctcaccctggtcctgcaagtgaaccaggtccaaggtctgcaggtaaagcgccaagatggtacctgggttcctgtgcggcctctggatggcgcttttgttgtcaacgttggagacattcttcagatcttcacaaatggaaggtaccggagcatagagcaccgtgccgtgatcaacgcggagagcgcgcgcctgtccgttgcagcattccactcaccgaacatccatgccacgattggccctcttctaacagtgacagacggtggaccaccagagcttcatgaggctcttcttctctgccaagctggagggcaagagcttcttgcaacggatgaagctcgatcttgacacagctagcaacagcagcagcacctgagtactgccgcaatttcttcttctctatcgcattgctttgcttgctataaacacatgtcgtcattgcattgggtctgtctctgtagtcaacattacattttatgcacgagatgaacaattaatcaatctgcttaccagataagtgattatttggtgaataaaaaaaaaaaaaaaaaaaa

SEQ ID NO: 210 - protein, 352 aa, Panicum virgatum
  misc_feature: Ceres CLONE 1724110
  misc_feature (1)..(101): Pfam Name: 2OG-FeII_Oxy Pfam Description: 2OG-Fe(II) oxygenase superfamily
MHDMESLPVPSVQAMVAATGGAHVPPRYLRPEVAADAVASEGEAAIPIIDFERLLLEEEAAAAAAASCRVESARLHAACQEWGFFQLINHGVPDDVIQGMKANIEAFFGLPAETKQQFAQERGQLEGYGQLFVVSEDQKLDWADILYLNTQPPEHRNTRFWPDKPDTLRSTLDAYSAAVKTVADRLLAIMSSNLGLPPEVVASRCSGGGMQSVRINYYPPCAEADKVVGFSPHSDADLLTLVLQVNQVQGLQVKRQDGTWVPVRPLDGAFVVNVGDILQIFTNGRYRSIEHRAVINAESARLSVAAFHSPNIHATIGPLLTVTDGGPPELHEALLLCQAGGQELLATDEARS

SEQ ID NO: 211 - DNA, 1067 bp, Panicum virgatum
  misc_feature: Ceres CLONE 1724115
  misc_feature: Encodes the peptide sequence at SEQ ID NO. 212
gtagctaccataccaagcaccagccaccagcagctagcaccggctagacctcgggcaggaagcaagcagccggcggcgacaccagagaggaagagaggcatggcggccggcggcgacaccattgcccgggtccacgccggcatcgacagcagcaacaagacgctgctcaagagcgaggccctctacaagtacgtgctggacacgtcggtgctgccgcacgagccggagtgcatgcgcgagctgcggctggtgacggacaagcacgagtgggggctgatgcagtcgtccccggacgaggcgcagctgctgcggatgctcatcaagctgatgggcgcgcgcaacaccatcgaggtgggcgtgttcacgggctactcgctcctcgccaccgcgctcgccctccccgccgacggccgggtcatcgccatcgacgtcgaccgcgagtactacgagatcggccgccccttcatcgagaaggccggcgtcgcgggcaaggtggacttccgcgagggccccgcgctggaccacctcgacgcgctcctcgccgacgagcgcaacctgggcgccttcgacttcgccttcgtcgacgccgacaagcccaactacgtgcgctaccacgagcagctgctccgcctcgtgcgcgtgggcggcaccatcgtgtacgacaacacgctgtgggcgggcaccgtggcgctgccccccgacacgccgctctccgacctcgaccgccggttctccgccgccatcagggacctcaacgcccgcctctccgccgacgaccgcgtcgaggtctgccagctcgccatcgccgacggcgtcaccatctgccgccgcctcgtctgagttgatgatctgttgctgctccccctcgctctcgccgctgctgctgccgtcccggtgctttcaataagattcttttccccctttctattcctttctctttttgcaagttgatgcgtcgtcacatcgtgtgctatactgtacctactactactactgtactgtacttgtgttatcgaactggagcaaatacagcgcattattttcgccaaaaaaaaaaaaaaaaaaaa

SEQ ID NO: 212 - protein, 246 aa, Panicum virgatum
  misc_feature: Ceres CLONE 1724115
  misc_feature (1)..(216): Pfam Name: Methyltransf_3 Pfam Description: O-methyltransferase
  misc_feature (19)..(245): SWISSPROT Homolog: EC 2.1.1.104 Caffeoyl-CoA O-methyltransferase 1
  misc_feature (19)..(245): SWISSPROT Homolog: EC 2.1.1.104 Caffeoyl-CoA O-methyltransferase 2
MAAGGDTIARVHAGIDSSNKTLLKSEALYKYVLDTSVLPHEPECMRELRLVTDKHEWGLMQSSPDEAQLLRMLIKLMGARNTIEVGVFTGYSLLATALALPADGRVIAIDVDREYYEIGRPFIEKAGVAGKVDFREGPALDHLDALLADERNLGAFDFAFVDADKPNYVRYHEQLLRLVRVGGTIVYDNTLWAGTVALPPDTPLSDLDRRFSAAIRDLNARLSADDRVEVCQLAIADGVTICRRLV

SEQ ID NO: 213 - DNA, 1424 bp, Panicum virgatum
  misc_feature: Ceres CLONE 1724132
  misc_feature: Encodes the peptide sequence at SEQ ID NO. 214
aagcccgaagcaaccaatccaaacaagcaaggaatccccaatggctcatcgcgtcctcctcctcctctccctcgccgcggcggccgcggtcgtcaccgccgccgtcgacgccgaggaccccctgatccgtcaggtggtgcccggcggcgacgacaacgacctggagctgaacgcggagtcccacttcttgagcttcgtgcagcgcttcggcaagtcctacaaggacaccgacgagcacgcgtaccggctgtccgtgttcaagtccaacctgcgccgcgcgcgccgccaccagctgctggacccgtcggcggagcacggcatcaccaagttctccgacctgaccccggccgagttccgccggacctacctcggcctccgcaagtcccggcgcgcgctcctcagggagctcgggggctcggcgcacgaggcgcccgtgctccccaccgacggcctccccgaggacttcgactggagggaccacggcgccgtcggccccgtcaagaaccagggttcatgcgggtcgtgctggtcgttcagcgcgtcgggagcgctggagggtgcgcactacctcgccaccggcaagctggaggtgctctccgagcagcagtttgtcgactgcgaccatgagtgtgattcatcagaacctgattcatgtgatgcgggatgcaatggtgggctgatgaccacagccttcagttatctccagaaagctggtggccttgagagtgagaaggattacccgtacactgggagagatggcaaatgcaattttgacaagtggaagattgttgcttcggttcaaaacttcagtgttgtctctgtggatgaaggccaaattgctgccaaccttatcaaacatggtccactggcaattggtatcaatgctgcgtacatgcagacatacatcggtggtgtgtcatgcccatacatctgcggcaggcaccttgaccacggtgttctccttgtcggctacggtgcagctggtttcgcccccatccgcctgaaggagaagccctactggatcatcaagaactcgtggggtgagaactggggcgagaatgggtactacaagatctgcaggggctccaacgcccgcaacaagtgtggcgtggactccatggtctccacggtgtccgctatccatgcctctaaggagtagactgacggtagccctccctgacaatttcatatatgctagaactgcgataccctgctagtatttatgctccatctgtgtgctgttatatataaggcagcaaagatgtgaagctgcaatgggatgcttgcggaaggtttatgtttgctatgcatgctacacgctatttcgatgtagcaaagttatcaccagatctgtatacgctttttaatctgcagaacttttgaataattgtgtacataaatatatggtgtgctctcatactcct

SEQ ID NO: 214 - protein, 372 aa, Panicum virgatum
  misc_feature: Ceres CLONE 1724132
  misc_feature (1)..(228): Pfam Name: Peptidase_C1 Pfam Description: Papain family cysteine protease
MAHRVLLLLSLAAAAAVVTAAVDAEDPLIRQVVPGGDDNDLELNAESHFLSFVQRFGKSYKDTDEHAYRLSVFKSNLRRARRHQLLDPSAEHGITKFSDLTPAEFRRTYLGLRKSRRALLRELGGSAHEAPVLPTDGLPEDFDWRDHGAVGPVKNQGSCGSCWSFSASGALEGAHYLATGKLEVLSEQQFVDCDHECDSSEPDSCDAGCNGGLMTTAFSYLQKAGGLESEKDYPYTGRDGKCNFDKWKIVASVQNFSVVSVDEGQIAANLIKHGPLAIGINAAYMQTYIGGVSCPYICGRHLDHGVLLVGYGAAGFAPIRLKEKPYWIIKNSWGENWGENGYYKICRGSNARNKCGVDSMVSTVSAIHASKE

SEQ ID NO: 215 - DNA, 1234 bp, Panicum virgatum
  misc_feature: Ceres CLONE 1724138
  misc_feature: Encodes the peptide sequence at SEQ ID NO. 216
atccccaattccccaccccagctagcaaccctaatcacatttcgccgcctccacccccgtcaacctctcccccttctctcgccaacccccgcgagatctgcccagcgcgagcagccatggcggatacgctcgacatgaccctcgacgacatcatcaagaacaacaagaagagcaacccctcctccggcgggggccgccgcagccgcggcggatccgcctctggcggcagcggcggcggggtcgggccgaccaggcgccccttcaagagggccggaaacaggcaggctccctaccagccgccgaaggcccccgacgcggcgtggcagcacgacatgtaccccgcggtcgccgccaccggtggaggcagcggcgggagggtctcggctatcgagacgggcaccaaactctacatctccaacctggactttggcgtctcgaacgacgacatcaaggagcttttctctgagttaggtgatctgaagcgatcttccataaattatgatcgaagtgggaggtctaagggaacagctgaagttgtgtttgcaaggcgtgctgatgctgtagctgcagtaaagaaatataacaacgtgcaacttgatggtaagcccatgaagatagagatagttgggaccaatactccaacaacagctgctgctcctccagtcattaacggaggccaggctaggaatgctgtgaagagcacaccgaggggtggccctacaggtatgccacagcgtagaccccatcagaggggcggcggtggaagacgtggtggtggatctggtggtcgtcgtggcaaagagcgtagtaagccaaagtctgctgaagaacttgatgctgactcggagaagtatcatgccaatgcaatgcagactaactaaaggccttcaccaagttgaaatttccgtcaattatgaagagcattagtcctttcattcctgctgtttgtgctgctatgttcaggggacaacagaacattatgtttgtgggggtcttgctttactgaattttatgggttatatgtgtttacatagaactagacagtgggtgatgctgaacactgctatggaaattacttggttgcctttagtttctgtacctaatgctgaagagtgaagaatcatccaagttgctccacatgtgaacattggagatgtacgaagatcctctcatttgctttgaccctcaccatgcaatacaacatcttcgaggcgaaaaaaaaaaaaaaaaaaaa

SEQ ID NO: 216 - protein, 254 aa, Panicum virgatum
  misc_feature: Ceres CLONE 1724138
  misc_feature: Great-hit functional homolog of the protein sequence given in SEQ ID NO 9424
  misc_feature: Useful for making plants with modulated biomass
  misc_feature: The plant is abnormally small.
MADTLDMTLDDIIKNNKKSNPSSGGGRRSRGGSASGGSGGGVGPTRRPFKRAGNRQAPYQPPKAPDAAWQHDMYPAVAATGGGSGGRVSAIETGTKLYISNLDFGVSNDDIKELFSELGDLKRSSINYDRSGRSKGTAEVVFARRADAVAAVKKYNNVQLDGKPMKIEIVGTNTPTTAAAPPVINGGQARNAVKSTPRGGPTGMPQRRPHQRGGGGRRGGGSGGRRGKERSKPKSAEELDADSEKYHANAMQTN

SEQ ID NO: 217 - DNA, 1038 bp, Panicum virgatum
  misc_feature: Ceres CLONE 1724142
  misc_feature: Encodes the peptide sequence at SEQ ID NO. 218
gcccgttcgccgctctctcgtccgctgctcttgttttctctgtgccatccgctagggtttatctactcgagcaatgacgacgatgcagctctccagcgcaagggtcggggcggcggcgttcgctgcgaaggggaaggcctccctcgaaccgctccggcttccggcgacggtgaccgtcggcgaggcccgccccgcgcggcgggcgtttcgcggtctcgtcgtcagggccgccaccgtcgtcgcccccaagtatacagcacttaagcccttggctgatagagtgcttgtaaagatcaagtcttctgaggagaagacaaccggtggaattttgctccccacgactgctcagtccagacctcagtgtggtgaggtagttgctgttggagaaggaagggccattggggataagaaagttgatatcggcattcaggttggagctcaaattatatattcaaagtatgctggaactgaagttgagctgaatgattacaaccatctagttctaaaagaggatgacattataggtatcgtagaaactgatgatgtgaaagacatgaagcctctgaatgaccgtgtactaatcaaggttgctgaagctgaagataaaactccaggtggtctactgcttaccgaaactaccaaggagaagccatctattggaacggtcgtatctgttggcccaggtcccctggatgaggaaggcagcaggatcccgttgtccgtctctgcaggcagcaccgtcctctactccaagtacgccggcagcgagttcaagggcgccaatggcaccaactacatcgtgctgagggtgtcggatctgatggccgtcctctcctgagcagtgggttttcaacagttacctccaaagcttcgaccattctgttgtagcatcgccattttgtgggaacaaccacggttccctggcaatcctctagactttctcccggcttcccgttctctctttggtcaatactagtattcttactgtgtctgaggaataaacataaaaaattcggtcgcatgaaaggattttcttgt

SEQ ID NO: 218 - protein, 254 aa, Panicum virgatum
  misc_feature: Ceres CLONE 1724142
  misc_feature (1)..(94): Pfam Name: Cpn10 Pfam Description: Chaperonin 10 Kd subunit
MTTMQLSSARVGAAAFAAKGKASLEPLRLPATVTVGEARPARRAFRGLVVRAATVVAPKYTALKPLADRVLVKIKSSEEKTTGGILLPTTAQSRPQCGEVVAVGEGRAIGDKKVDIGIQVGAQIIYSKYAGTEVELNDYNHLVLKEDDIIGIVETDDVKDMKPLNDRVLIKVAEAEDKTPGGLLLTETTKEKPSIGTVVSVGPGPLDEEGSRIPLSVSAGSTVLYSKYAGSEFKGANGTNYIVLRVSDLMAVLS

SEQ ID NO: 219 - DNA, 1051 bp, Panicum virgatum
  misc_feature: Ceres CLONE 1724146
  misc_feature: Encodes the peptide sequence at SEQ ID NO. 220
actaggccccaacccccgacgaccaaaacacaccctctccctctacttagagggacaggagatatttttctcacgccctccccgccgcgaataaaaacttttctagcctccctttgaatccatccatccattgctcgtctccctcccaaattcgatgcctttgtagcgctgccgcttcgcccgtgcgtcgcgccgcgccgcgccgcgccgtgcagtccgctcgccgctgcgcttcccatggacaccggggccggggccggatccggcaatgcctccggcggcggcggcggcggcgcgtccgtgtgctgctactacgccctgctcggcatccgcaagaacgcctccgccaccgacatccgcaccgcctaccggaggctcgcgatgaagtggcacccggaccggtgggcgagcgaccccggcgccgccggcgagaccaagcggcggttccagcggatccaggaggcctattccgtcttgtcggacaaggggaagaaggccatgtacgacgccgggcttttcgatcccctggatgacgacgaccaggatttctccgacttcatgcaggagatgctggggatgatggataacgtgaaaaacgagaagccggacacgctggaggacctgcagaagatgctggaggacatcgtcaacggcgacgatgggagccgcggcgtgggcggccgcgtgccgccggacggtgcccggcgggcgcgcgtcgcgccgtacccgcagcaccaggggcgcaggtgaccggcgcgccggtgtacgagatgtacacgcgacgagcctgcgctttcgcggcgagaggaggcggagaaggaagatcagccagcaaagccaacgggaggctctggaaagaacaaggggggagaataaaaatgaagttgccaagtcggtggtgattgccatccgataatttgaccgtagttgccgggcgcccgctcggtcccggccgcgccgccgcacgaaaccggcggacgcgtggccggggactctgatttgttattacatctcatcggcatttcgtgcccaaaaaaaaaaaaaaaaaaaa

SEQ ID NO: 220 - protein, 170 aa, Panicum virgatum
  misc_feature: Ceres CLONE 1724146
  misc_feature (2)..(67): Pfam Name: DnaJ Pfam Description: DnaJ domain
  misc_feature (1)..(68): Pfam Name: DnaJ Pfam Description: DnaJ domain
MDTGAGAGSGNASGGGGGGASVCCYYALLGIRKNASATDIRTAYRRLAMKWHPDRWASDPGAAGETKRRFQRIQEAYSVLSDKGKKAMYDAGLFDPLDDDDQDFSDFMQEMLGMMDNVKNEKPDTLEDLQKMLEDIVNGDDGSRGVGGRVPPDGARRARVAPYPQHQGRR

SEQ ID NO: 221 - DNA, 1134 bp, Panicum virgatum
  misc_feature: Ceres CLONE 1724165
  misc_feature: Encodes the peptide sequence at SEQ ID NO. 222
caacccatttccttcctgcccgcaaggccgcaacccagcccaggcccggcggtccctcgatcctctcggctccggatcggcaagagcccagccgccgccgcccgtagccgcctcgctgccggattcacacgacaccttgtcggcgtctctttctctctctcgaggcccatggcgcagcgcgacaagaaggttgaggagccgacggagctgcacgcgccggagctcacgctctgcgccaacagctgcggcttcccgggcaacccggccaccaagaacctctgccagaactgcttcctggccgcctccgcctccgtctcgccgccgtcgccctcctcctcgccggcggtgttcgacaagccgcggacggcggcggcggcggccgcccctcccgcgctctggccgccgttctccccggccgccaaccggcccccagcgggccccgcggagtccccctccaaggcgccccggacgtcgtcgtcggtcaaccggtgccacagctgccggaagcgggtcgggctgacggggttccggtgccgctgcggcgagctcttctgcggcgcgcaccggtactcggaccgccacgactgcggctacgactacaagggcgtcgcccgggacgccatcgcccgggagaaccccgtcgtgcgcgccgccaagatcgtcaggttctgagagagctggggagcaccggaggaccacgcacagctcagctccacgccgatcgtcgatccatcatctcccgcgctccggaatcccctctcttttttctctttttctttcctcttttgttacaaaatttaaaggtgattggtcgagggtgctgtcatcacgctgttctcgagaatcccacaaacaagaagaagatgatttgattgatgaaggaaaaagaagaaggagcagatcatgggagccatgaaggcagggaagctgcgagaaaaaggggatcgagagcacagtgcgatgataatgttgttgttgtagcggtggttggggtggaggggaagagatagggtcggtttggtgtgttgtcctactacaaatcacaatcttctattaaatttttcttccatctctctgtataaactaaattataattggaatctccctattgcccaaaaaaaaaaaaaaaaaaaa

SEQ ID NO: 222 - protein, 167 aa, Panicum virgatum
  misc_feature: Ceres CLONE 1724165
  misc_feature (1)..(41): Pfam Name: zf-AN1 Pfam Description: AN1-like Zinc finger
MAQRDKKVEEPTELHAPELTLCANSCGFPGNPATKNLCQNCFLAASASVSPPSPSSSPAVFDKPRTAAAAAAPPALWPPFSPAANRPPAGPAESPSKAPRTSSSVNRCHSCRKRVGLTGFRCRCGELFCGAHRYSDRHDCGYDYKGVARDAIARENPVVRAAKIVRF

SEQ ID NO: 223 - DNA, 1319 bp, Panicum virgatum
  misc_feature: Ceres CLONE 1724167
  misc_feature: Encodes the peptide sequence at SEQ ID NO. 224
gaagcagaggagaccagaaaaatcgtagagcaagaagcaggaagccatggcgttcctccttcccaagctcgccacgccgtcatgcaagttgcccccgagccccctcctcaagccccagctcgccctgccaggccacggcggcggcaagatccacggctccgggtccggcgcggcgcaggccgcagccccgggccacctcagtctcctgctcctgctcagcgcctcgcagcaggccgccatcccgtcggccaagtccacggcgaccaagaaccggggcaagggcggcggggacccgcaaaggtcggatttttacctcaatcttgggacggcggtgcgaacactgcgagacgacctgcctgatgtcttcgtccgggaacccaactacgatatctatcgtgaagacatcacatttatcgacccactgaacacattccatgggattgacaactacaagactatattctgggcacttaggttccatggccgcctactattcagagaaattgggcttgatgtatcacgcatttggcaactgacagagaactcaatagtcgtccggtgggagctgtggggcaacccccgtgtcccatgggaatcatatggctgcttcagtggcacgtcgaggtacaaggttgaccggaatgggaaaatctacgaacacaaagttgacaacttggcattggacttcccgcgatcagtcgcaaatgttggcagcattgctgacatggtagtcgccacatgcccacccagccccaatttgacattttgggatgtggttgagacaggtgatagttgctcatggacaaagctttacgaagctgtggtcgaagctgtagaacaggaagaccacaaatccagtggcattgtcattgggggtctaatcacttgttcataggatggaatgagctccagcactagttgcttggtagttcctaggggaatgtatagaatgtgggtacatgattcatgatactactaatatccctttgtatactgtagctctagaacagcaaaattagataaaaacacatactagatggctatatttcatcaccgttgtcacattctggggtagtgctttcacatcttatttcttgtgagatccatggattttgagcgatatatcgcttcttaaaacatgctgactgactatgtttgcaatattttgtaccagttgctcaattgtcagcgaatctgacagactgggctaggaacaaatgtgaggattcatattatctgtacggtagggtttctgggatcataaatttaggcttatggtcgcaacaccggtatgttgcgaaaaaaaaaaaaaaaaaaaa

SEQ ID NO: 224 - protein, 282 aa, Panicum virgatum
  misc_feature: Ceres CLONE 1724167
  misc_feature: Great-hit functional homolog of the protein sequence given in SEQ ID NO 9348
  misc_feature: Useful for making plants with modulated nitrogen use efficiency
  misc_feature: Useful for making plants with modulated nitrogen use efficiency
MAFLLPKLATPSCKLPPSPLLKPQLALPGHGGGKIHGSGSGAAQAAAPGHLSLLLLLSASQQAAIPSAKSTATKNRGKGGGDPQRSDFYLNLGTAVRTLRDDLPDVFVREPNYDIYREDITFIDPLNTFHGIDNYKTIFWALRFHGRLLFREIGLDVSRIWQLTENSIVVRWELWGNPRVPWESYGCFSGTSRYKVDRNGKIYEHKVDNLALDFPRSVANVGSIADMVVATCPPSPNLTFWDVVETGDSCSWTKLYEAVVEAVEQEDHKSSGIVIGGLITCS

SEQ ID NO: 225 - DNA, 982 bp, Panicum virgatum
  misc_feature: Ceres CLONE 1724172
  misc_feature: Encodes the peptide sequence at SEQ ID NO. 226
ggacagctagcgcgatcgtcatccgcccccacccccaggctcaactgctcgcggcgaggcaacacccgccccctcttcccctcctccgccaccacctcctcgctgacgcgcgcatacgtccacggcacgatcgggccgaccaatcgcgcgcggcggctctggtgggaatgggtctcctcgaccagctctgggacgagacggtggccggcccgcgcccggactccggcctcggcaggctccgcaagtacgcctccttctcccactcgtcgtcgtcgtcctcgccggcgcccgcaatgacgcgcagcttcaccatcggcggcccgccatcgctgtccgtcgaccaccagtcgccgcgcggcgagtcgccctacagctcctccgtcccgtcctccccggccagcgcgccggactccccgttcgccgcagctacgcccaaggctgatggctggagcaggcttggccggaaacccaaggcctccgtcgggccggagccggccgtcgggccgaggagccccaccgtgtacgactgggtggtgatcaacttggaataagcaatcgagcggaggacgtacagagagaaagctagctagcgtgtgtgtgtgtgtgtgtgtgtgtgtgtgtgtgtgtgtgtgtgtgtgtgtgtgtgtgtgcctgcaagttcgaggctgcgttgtgtttccgtacatgtcccgtgttcttccgaaaccgtgcctgtctgggctggcatgtggagtagtagtatatctagctagggacctggtaagatgatgatgatgatgatgatcagttcgtgggggttggaagttggcggcgatccgatccagtctagttctgccttcggcaagatgtgttttgttcggttcttcgatctggggaagaactctgaaatgaggatgtcgtgtacgcccgcctgctttgtttttctaccctcccctgtaattacctagtactgtgttcaatgcaaaaaaaaaaaaaaaaaaaa

SEQ ID NO: 226 - protein, 127 aa, Panicum virgatum
  misc_feature: Ceres CLONE 1724172
  misc_feature (1)..(20): Pfam Name: Auxin_repressed Pfam Description: Dormancy/auxin associated protein
MGLLDQLWDETVAGPRPDSGLGRLRKYASFSHSSSSSSPAPAMTRSFTIGGPPSLSVDHQSPRGESPYSSSVPSSPASAPDSPFAAATPKADGWSRLGRKPKASVGPEPAVGPRSPTVYDWVVINLE

SEQ ID NO: 227 - DNA, 1169 bp, Panicum virgatum
  misc_feature: Ceres CLONE 1724191
  misc_feature: Encodes the peptide sequence at SEQ ID NO. 228
gtgacgcaagcaacacgctgtcgtctcgctcgtcgtcttccccacctcggcttgtcccctctaccaacgccatggggtcgtcggaggccgacgaggatcagctcctcaagagcttcctggcggaggtcagcgaagccgagcgcgaaaatgaagtgctcaggatacttggttgcttcaagttaaacccctttgagcatcttaagttgtcttttgattcatctccagatgaggtgaagaagcaatataggaagttgtcattgttggtccatcctgataaatgcaagcatccgcaggcacaagaagcttttgcagctctggcaaaagcacagcaactcctgcttgatccacaggaaagaggatacattctcgaccaagttactgctgcaaaagaagagttgagggcaaagagaaaaaaggaactgaagaaggacagtgcatccaagataaaatcccttgtagacgagggaaaatatgaagagcagtttgaacgatcggatgaatttcagcagcagctaataattaaagtgcgtgaaattttgacggagaaagagtggcgtaggagaaaaatgcaaatgaggatatcagaggaagaaggaagacttaagaaggatgaggaggaaacaaaagagatgtggaagagaaagagagagcatgaagagaagtgggaggagacgagagatcagcgggtctctagctggagggatttcatgaagacaggaaagaagggacggaaaggtgaaatcaaacccccaaaacttaagactgaagatccaaacaagtcttatgtgcagaggccagtgaagcgcaattaagaggaatgctattggtgtctgcaatcaaaaaaatatcctgtagcgatccttgatgccactgccacctgatccgagctggcaagtggcaaccctgccatgttctgcaggctgtaagtttcaaatatgcctcggaggctcaactgtagtcagtgaacagatcaacagaacggataattactagcgaaatgcccatattactacctagagtgatattggattgatgtacccatgaggtcgaaaattttactggaaagtagaagattctgttggaaaagaaccctactgaagtgaatgttgaaaggcccatctcattactggattctggttcttgcttcagaaaaaaaaaaaaaaaaaaaa

SEQ ID NO: 228 - protein, 246 aa, Panicum virgatum
  misc_feature: Ceres CLONE 1724191
  misc_feature (1)..(61): Pfam Name: DnaJ Pfam Description: DnaJ domain
MGSSEADEDQLLKSFLAEVSEAERENEVLRILGCFKLNPFEHLKLSFDSSPDEVKKQYRKLSLLVHPDKCKHPQAQEAFAALAKAQQLLLDPQERGYILDQVTAAKEELRAKRKKELKKDSASKIKSLVDEGKYEEQFERSDEFQQQLIIKVREILTEKEWRRRKMQMRISEEEGRLKKDEEETKEMWKRKREHEEKWEETRDQRVSSWRDFMKTGKKGRKGEIKPPKLKTEDPNKSYVQRPVKRN

SEQ ID NO: 229 - DNA, 1353 bp, Panicum virgatum
  misc_feature: Ceres CLONE 1724192
  misc_feature: Encodes the peptide sequence at SEQ ID NO. 230
accaccggtcggtcgccagccgagttccaagtccgagtgctcagttcaggcctcaggcctcaggctcagctcgctctccgtccgtgtcctagctcgctgatcatcgatcaatccagagacctgccgggcaatggcgatcaagaagggcggcgcggcggcgtcggggctgaagcagatcctgcggcggtgctcgagccttggtcgccggcagcagcagcagcagcagcagcagcacagcgagtacgaggaggagtacaacgacgaggaggaggaggcgtccgggctgccgtcggacgtgccgcggggccacttcgcggtgtacgtgggcgagcggcggcggcggttcgtggtgcccatcgcgctgctggaccagcccgagttccggaccctgctgcggcgcgccgaggaggagttcgggttcgccggcgccggggccggcggcatcctcgtgctcccctgcgaggaggtcgccttccgctccctgacctccgccctcgcctgcgccggcgcccggtgagcgcgcgcgccactcccgccgccggcgcacggcatcctcctgtggctagctattcgttcgattcccattgatttggccggcccggctagctatacctcgccggcgaagtataagtatgtagcaatcacacgtgtaccgtgaaggttaatgcatggtgtgtgtaaatatggagaggattagagaagaccaagttagtggtgcatgcgcggaggattatattagcgcgcccccgcccgaccgccattggaatttggagagcatccatcgaagaagatggagaggacgcgcgcggagaagatgatcaggtttgagatcgagatcgaggtggcattagctttgatgatggattattggctagtaaaaagaagcatctggccgcgagctgctgctagctagcttgtgcgttgttgtttgtgatgggttgtacttcctggcctcctgctcctgctagacacgcatgggtaggagggccaagtgaacgaaccgtcattaacccttttttttttctgtatacacgcaaagataagatgttgcccgggtagctgcccagatcatcagaggagcttgcaacctaccgagatcgatcaaccagatgtatacaagctaagtgtacgttttcctctcctgagattcaactctgttgcccccaaaaaaattggtagtagaacgcagacactcataacgcacacacccgggaacatcgcctaccattacactgtcaaattttagaatattcgttcccatggaaaatcgaacctagaacctcaggtgctactgaaactcttgtaagcatgagactacgtgcccttttgcgaaaaaaaaaattattggtgatg

SEQ ID NO: 230 - protein, 128 aa, Panicum virgatum
  misc_feature: Ceres CLONE 1724192
  misc_feature (1)..(113): Pfam Name: Auxin_inducible Pfam Description: Auxin responsive protein
MAIKKGGAAASGLKQILRRCSSLGRRQQQQQQQQHSEYEEEYNDEEEEASGLPSDVPRGHFAVYVGERRRRFVVPIALLDQPEFRTLLRRAEEEFGFAGAGAGGILVLPCEEVAFRSLTSALACAGAR

SEQ ID NO: 231 - DNA, 1098 bp, Panicum virgatum
  misc_feature: Ceres CLONE 1724201
  misc_feature: Encodes the peptide sequence at SEQ ID NO. 232
gatcattccacccgaggcttggaaggctcgaactaagccaagaacccaagacaggggaatcagagctctgagagcgcgctcccagcctcccaccaggtcactaccaccaacccctcacggcggcggtggcgtcggcggccggatcgtcgcctgcggcggcggagatggcgtccgtggccgcggcggagggcgcggcggcggcgctccgctcggtgctgtcgcgcgcgcagcaggcggcggcgcgggcgggtcgcgcgctcgggtccgtgcgcgtggtggcggttagcaagaccaagccggtgcccgtcatccgcggcgtctacgacgcgggccaccgctgcttcggcgagaactacgtccaggagctcatcgacaaggcgccccagcttcctgaggatatcgagtggcacttcattgggaacttgcaaagcaacaaagccagagccctacttgctggcgtgccaaatcttgatatggttgagagtgtagatgatgagaagattgctaaccgtcttgatcgcgtggtagctgacttggggagaaaacctcttaaggttttagtccaagtcaacactagtggagaggaatcaaaattcggagtagatccgtcaggatgcgtggaattagcaaagcatgtcaaattgaactgcccgaaccttgtgttttctggcttgatgacaattgggatgcttaattactcctcaactccagagaatttcaagacactggctcattgccagaaagaggtttgcaaggagcttggaatacccgaagagcagtgcgagttgtctatgggcatgtctgctgattttgagcaagcgattgaaatgggcagcacaaatgtaagagtcggatcaaccatattcggtgctagagagtacccaaagaagaactaggatgagcgtacactcaagaagttttgttgtgactgccacatgcacagcacagaccattgaggagtctccttcagcagttgcaatattgataataaatgtgtggttatgtacccattttggtcagctgaaaacattttgacacatcatataccatgtgtgacaaataaagagattcatttgccaaaaaaaaaaaaaaaaaaaa

SEQ ID NO: 232 - protein, 243 aa, Panicum virgatum
  misc_feature: Ceres CLONE 1724201
  misc_feature (2)..(237): Pfam Name: Ala_racemase_N Pfam Description: Alanine racemase, N-terminal domain
MASVAAAEGAAAALRSVLSRAQQAAARAGRALGSVRVVAVSKTKPVPVIRGVYDAGHRCFGENYVQELIDKAPQLPEDIEWHFIGNLQSNKARALLAGVPNLDMVESVDDEKIANRLDRVVADLGRKPLKVLVQVNTSGEESKFGVDPSGCVELAKHVKLNCPNLVFSGLMTIGMLNYSSTPENFKTLAHCQKEVCKELGIPEEQCELSMGMSADFEQAIEMGSTNVRVGSTIFGAREYPKKN

SEQ ID NO: 233 - DNA, 1255 bp, Panicum virgatum
  misc_feature: Ceres CLONE 1724214
  misc_feature: Encodes the peptide sequence at SEQ ID NO. 234
aaaagaaagcaacggcgagcgcgccggcaccggagtctggcgacatggcgcggaggaggggcggccccgcggcggcggctgcgacggcggtcgcctcgccggccgttgtcgggacggtcgccctcatggcgctcgtgtactactccacgctcttcgtctttctggaccactggctcggcctcggcacgccggccggcgccgcccacgcggccgccgtttcgctcgccgtcgtcgcctgcttcttcgcctttgcgtgcgccgcggctgccgacccgggctccgttcccgcctccttcgcacccgacgccgaagccgcgcagggacagcgggggttggaatcaaggtattgcgataaatgttgcatgttcaagcctcctcgatcccaccattgcagggtctgcaaaaggtgtgttctcaaaatggatcatcactgtgtctggatcaataactgcgtgggatatgctaactacaaagccttcatcatctgtgtcctaaatgcaactatcgggtctctttattcatttgtgatatttctgtgtgatctctttctgaaagagcatgagtttgatgttctttatgtcaagatagtatatatcttggctggtgtcctgttattcttcttaagcttgacaataggttctctattatgctggcacatctatcttttgtgtcataacatgacaaccatagagtaccgggaggcagtaagagcgaagtggcttgcaaagaagagcgggcagaaatatcgccaccaattcgatcttggcatgaggaagaacattcaaatgatcctgggtccaaacattctttgctggctttgccctactgcgacagggcatttgaaggatggcaccgagttccaaatcacaaacaactgacgggatgcatcatcagcattgccagtcgcctcatactgccatgtagatttacaagttagtttattttgttaccaaatggctcatagtcctttgtctttgttgctagccagggcatctgtagaaatcttcagatttcccccatattgtaacagcatgtaaagtttcctccccgccgtcccatctccttgtatcttcgactgtttgttcaattttattgtgtatgtgtagacatgttttgagtttgatcagttgtactgaaacactggatgtgtagttactttgagggtgctacaaattctccccaaattgtgtgggatatgttcatatgaacatagtgtatgagtagattgtgaagtcaaaaaaaaaaaaaaaaaaaa

SEQ ID NO: 234 - protein, 277 aa, Panicum virgatum
  misc_feature: Ceres CLONE 1724214
  misc_feature (5)..(66): Pfam Name: zf-DHHC Pfam Description: DHHC zinc finger domain
MARRRGGPAAAAATAVASPAVVGTVALMALVYYSTLFVFLDHWLGLGTPAGAAHAAAVSLAVVACFFAFACAAAADPGSVPASFAPDAEAAQGQRGLESRYCDKCCMFKPPRSHHCRVCKRCVLKMDHHCVWINNCVGYANYKAFIICVLNATIGSLYSFVIFLCDLFLKEHEFDVLYVKIVYILAGVLLFFLSLTIGSLLCWHIYLLCHNMTTIEYREAVRAKWLAKKSGQKYRHQFDLGMRKNIQMILGPNILCWLCPTATGHLKDGTEFQITNN

SEQ ID NO: 235 - DNA, 1001 bp, Panicum virgatum
  misc_feature: Ceres CLONE 1724216
  misc_feature: Encodes the peptide sequence at SEQ ID NO. 236
agagacacagagaagagagcttcacattcctttccacaaaccatccctcttggtcacggcggccggccggccggccggatcctcagatggagggcaaggacctgtgcgccgtcgagaggcgcggccgcgtgcacctcatcacaatcaccggcgccggcgaccaccgcctcaacccggccctcctcgccgccatccgctccgccgtggccgcctccgcgggcgccggcgcgctcgtcctcgccgccgaaggcaagtacttctccaacggcttcgaccaggcgtgggtgcgcacggcaccgccccacctccacgccaccatggacggcggcttccgcgcgctggtcgccgacctcctggcgctgcccatgcccacggtcgccgccgtgacgggccacgccgcggccgccgggtgcgcgctggccctcgcgcacgacgccgtcgtcatgcgcggctcccgcgggttcctctacatgagcgaggtcgacgccggcatcaagatcgtggatttcttcgccgagctgatccgcgagaaggtccccgacgcggcggcgaggagggacctggtgctgcgcggggacaagatgacggcggccgaggccgcgcggcggggcatcgtggacgcggccgtggacggcggcgtggaggacgtggtggccgcggccgtcgccgaggccgagcggctcgcggcgaggggctgggacggggaggtcctggctgagatcaggaaggccgcgtggcccaaggtgtggggccaggtcaaggaccacggcgccgggccggcggccgcgcggccgcggctctaggcgcgcgcggcggctgcgctggctggctggtactagcacagcgacgcgcttctcatgactcgccgttgactagaacatgtagctgcccagctagctgggtgaataaatctagacgaatgtatcctgcttgctgcctgtacttaggaagcaaatgatctgattgaactgctctagtgacaaaaaaaaaaaaaaaaaaaa

SEQ ID NO: 236 - protein, 238 aa, Panicum virgatum
  misc_feature: Ceres CLONE 1724216
  misc_feature (1)..(173): Pfam Name: ECH Pfam Description: Enoyl-CoA hydratase/isomerase family
MEGKDLCAVERRGRVHLITITGAGDHRLNPALLAAIRSAVAASAGAGALVLAAEGKYFSNGFDQAWVRTAPPHLHATMDGGFRALVADLLALPMPTVAAVTGHAAAAGCALALAHDAVVMRGSRGFLYMSEVDAGIKIVDFFAELIREKVPDAAARRDLVLRGDKMTAAEAARRGIVDAAVDGGVEDVVAAAVAEAERLAARGWDGEVLAEIRKAAWPKVWGQVKDHGAGPAAARPRL

SEQ ID NO: 237 - DNA, 1198 bp, Panicum virgatum
  misc_feature: Ceres CLONE 1724225
  misc_feature: Encodes the peptide sequence at SEQ ID NO. 238
gaacagagcaagcttgagagagagagagagaagcaagtgtgcgagcgccctgcttgttaccactagcatggacggggcggcggcggcggcgattaggcaccggacggtggaggcgaacggcatcgcgatgcacgtggcggagtccggcgacgaggggagcccgcgggcggtggtggtgttcctgcacggcttcccggagctctggtactcgtggcgccaccagatgcagcacctggccgcgcggggctaccgctgcgtggcgcccgacctccgcggctacggcggcaccgacgcgccgcccgacgtcgcctcctactccgccttccacgtcgtcggcgacgtcgtcgcactcctcgacgcgctcggcctcgccaaggtgttcgttgtgggtcacgactggggcgccatcatcgcgtggtacctctgcctgttccggccggaccgcgtgacggcgctggtcaacaccagcgtggccttcatgcgccacgtcttcatccgcgccggcgccggcgccggcgccgtcaaaaccaccgacttcttcagccgcacctacgggcccacctactacatatgccgcttccaggagcctggggttgcagagaaggagttctctccggccaacgcccggtacatcatgaggcagatcctgtgcaaccgcttcacctccgaggcggccggcggcgccaagccggcggcggcggcggccgacgaggagccgctcccgccgtggctgacggaggcggacgtggaccggttcgcgtcggagttcgagcggacagggttcacgggcggcatcaactactaccgcaacatggaccggaactgggagctggcggtgccgtgggcggacgccaaggtggcggtgcccaccaggttcgtggtcggcgacggcgacctcacgtaccactacccgggcatccagaactacatccacaagggcggcttcaaggccgacgtgccgctgctggaggacgtcgtcgtcatccccggcgccggccacttcatccagcaggagaaggccgacgaggtcagccaccacatctacgacttcatctcaaagttctgatggatgcctagacatccagtatgtaattgggtgttgtgtttcgaattacgggcagctggatgcatgtatgttgttaacttcaatcattagtgtgttcgagtattcgagttcgaaaaaaaaaaaaaaaaaaaa

SEQ ID NO: 238 - protein, 332 aa, Panicum virgatum
  misc_feature: Ceres CLONE 1724225
  misc_feature (1)..(266): Pfam Name: Abhydrolase_1 Pfam Description: alpha/beta hydrolase fold
MDGAAAAAIRHRTVEANGIAMHVAESGDEGSPRAVVVFLHGFPELWYSWRHQMQHLAARGYRCVAPDLRGYGGTDAPPDVASYSAFHVVGDVVALLDALGLAKVFVVGHDWGAIIAWYLCLFRPDRVTALVNTSVAFMRHVFIRAGAGAGAVKTTDFFSRTYGPTYYICRFQEPGVAEKEFSPANARYIMRQILCNRFTSEAAGGAKPAAAAADEEPLPPWLTEADVDRFASEFERTGFTGGINYYRNMDRNWELAVPWADAKVAVPTRFVVGDGDLTYHYPGIQNYIHKGGFKADVPLLEDVVVIPGAGHFIQQEKADEVSHHIYDFISKF

SEQ ID NO: 239 - DNA, 1148 bp, Panicum virgatum
  misc_feature: Ceres CLONE 1724230
  misc_feature: Encodes the peptide sequence at SEQ ID NO. 240
acggatccatccatctctcctctgctctctcccttgaattcagttcgtctcagagaactcttctttccgagacaatccgagctaagcagtaagcaacggcgatggcttttagcccgagggctcgcgtgctggcggcggcgctgctcctgggcctctgctgtggcaccggcttgccggcggcggcgggaagcaggatcgacgagggcctggaggtgacgtggggcgacgggcgcgggagcgtgtcgccggacggccaggtcctgacgctgtcgctggaccgcacctccggctccgggttccgctccagggacacctacctcttcgcgcgcgccgacgtgcagctcaagctcgtccccaacaactccgccggcaccgtcaccaccttctacttcatctcggagggcccgtgggacgtccacgacgaggtggacctcgagttcctgggcaacgtgagcgggcagccctacacgctgcacaccaacgtgttcgccggcggcaacggcggcaaggagcagcagttccacctctggttcgaccccaccgccgacttccacacctactccatcgagtggacgcagcagcacatcctcgtgctggtggacgggacgccgatccgggagttcaagaaccacgcggaccgcggcgtggcgtacccgtcgacgcagcggatgcggctctacggctcgctgtgggacgccgaggactgggccacgcagggcggccgcgtcaaggcggactggtcgcaggcccccttcgcggcgcagtaccgcaacttcacggccgcggacgcctcggcgtcggcggcggcgggcgggtacgggcaggagatggacgcggcggcgcagcaggccatgaagtgggcgcgggacaactacatggtgtacgactactgcgccgacggcaagcggttcccgcagggcgccccgcccgagtgctccatgccgtagcgtagcgtccagatgggccaagacgcgcgcgctttgattgcgaagtcgatcagagggggagcattagggcaggttacacgcatatgctaggtcatagaatccattggtctcattcattgtttatatattcatcgattctttggtgtgaagaatatatataatactcaagattcttttcatcaaaaaaaaaaaaaaaaaaaa

SEQ ID NO: 240 - protein, 281 aa, Panicum virgatum
  misc_feature: Ceres CLONE 1724230
  misc_feature (1)..(184): Pfam Name: Glyco_hydro_16 Pfam Description: Glycosyl hydrolases family 16
  misc_feature (10)..(278): SWISSPROT Homolog: EC 2.4.1.207 Xyloglucan endotransglucosylase/hydrolase protein 22 precursor
  misc_feature (36)..(279): SWISSPROT Homolog: EC 2.4.1.207 Xyloglucan endotransglucosylase/hydrolase protein 24 precursor
MAFSPRARVLAAALLLGLCCGTGLPAAAGSRIDEGLEVTWGDGRGSVSPDGQVLTLSLDRTSGSGFRSRDTYLFARADVQLKLVPNNSAGTVTTFYFISEGPWDVHDEVDLEFLGNVSGQPYTLHTNVFAGGNGGKEQQFHLWFDPTADFHTYSIEWTQQHILVLVDGTPIREFKNHADRGVAYPSTQRMRLYGSLWDAEDWATQGGRVKADWSQAPFAAQYRNFTAADASASAAAGGYGQEMDAAAQQAMKWARDNYMVYDYCADGKRFPQGAPPECSMP

SEQ ID NO: 241 - DNA, 1029 bp, Panicum virgatum
  misc_feature: Ceres CLONE 1724231
  misc_feature: Encodes the peptide sequence at SEQ ID NO. 242
aaaacaacccccgctccctccactccgtgtctccctctctcgccgtcgcactcgcactcacgccgccaccgccgcgttgtgatcgagcctgtggagcggcgagcgaggccggaaatgcagatggactcctacttgtacgccggcttcttccacgacgaggccgcgttctacccgcagggcgccgtgccgccctccccggagctgcccttcggcctcattgcctcgccgggggagcccgcgccgcccttccagccgccggaggcgccgaggcccgccgcgttccaggactactccgtggcggagccggagctgctggcgcaggccgtgggcgccggagagccacactacgggagctcgggcccgagcgtgaacatgcgggtggtcgacgcgctgggcgggatgggcggggaccctgtgcatgatcagacaatgggggaggagtgggaggaggagccgcggcggcagcgccagcagcagcagccggcgggcgccgccgtggagagcagccgcgggttccggcacatgatgcgggagcggcagcggcgcgagaagctgagccagagctacgccgacctctacgccatggtcgccgcccggtccaagggcgacaagaactccatcgtgcagtccgcagcgatctacatccacgagctcaagggcgcgcgggagcagctgctgcggcggaacgaggagctcaaggcgcggatcctgggccacgacgcgcggcagcagtgcgtcaaggtgcagttcgaggtggacgagccggcgtcggcgatcgactccatgatcggggcgctccggcgcctcaagggcatggacgtcagggctaggggcatccggtccaccatgtccggacgcaggctgtggacggagatgaatgtcgagaccacggtgagcgctctgacagcttgtttcaatcgccggatttctcgagtactaatttagtagtttagattatatgttgaaaacttctggacttgttcgctagctctgctgacagcagatgctccagtcctttgtttaggtcgg

SEQ ID NO: 242 - protein, 276 aa, Panicum virgatum
  misc_feature: Ceres CLONE 1724231
  misc_feature (1)..(47): Pfam Name: HLH Pfam Description: Helix-loop-helix DNA-binding domain
MQMDSYLYAGFFHDEAAFYPQGAVPPSPELPFGLIASPGEPAPPFQPPEAPRPAAFQDYSVAEPELLAQAVGAGEPHYGSSGPSVNMRVVDALGGMGGDPVHDQTMGEEWEEEPRRQRQQQQPAGAAVESSRGFRHMMRERQRREKLSQSYADLYAMVAARSKGDKNSIVQSAAIYIHELKGAREQLLRRNEELKARILGHDARQQCVKVQFEVDEPASAIDSMIGALRRLKGMDVRARGIRSTMSGRRLWTEMNVETTVSALTACFNRRISRVLI

SEQ ID NO: 243 - DNA, 1119 bp, Panicum virgatum
  misc_feature: Ceres CLONE 1724245
  misc_feature: Encodes the peptide sequence at SEQ ID NO. 244
agtcatccagtactccagtatccacgaccacgcagcacctgcgactgcgagcacacagctgcttcggccccttctcagcgcgcgagcgttgcctgtgtgtgtgttgttcgtgagcaggcgcggcggcacggatggcgcagtccatgctcatgtcgacgagcgtcggcggcggccgcgcgctgccgtcgctgcaggccggccggccggcgccgtacccgcggctcgcgctgccgtcggcatacaggcactccaggtccgtctccgtgaagaccctggccctcttcggcaagtccaaggccgcgccggcgaagaaggctcctgcgcccaaaccgaaggttgaggacgggatcttcggcacgtccggcgggatcggtttcaccaaggagaacgagctgttcgtcggccgtgttgccatgcttggttttgccgcatccctactcggagaggccatcaccgggaagggcatccttgcccagctgaacctggagacgggcatccccatctacgaggcggagcccctcctcctcttcttcatcctcttcaccctcctcggcgccatcggcgctctcggagaccgcggcaccttcgtcgacgacgccactggcctcgacaaggccgtcatcccacccggcaagggcttccgtggcgccctcggcctcagcgagggagggccgctgttcgggttcaccaagtcgaacgagctgttcgtggggcggctggcgcagctgggcgtggccttctctatcatcggcgagatcatcacggggaagggcgcgctggcgcagctcaacatcgagacgggcgtgcccatcaacgagatcgagccgctcgtgctcttcaacgtcctcttcttcttcatcgccgccatcaaccctggcaccggcaagttcatcatcggcgaggacgagaagtagagagagaccgagggaaatgatgcgcctggttgtttgtggttgatcgatcagtgcgtctctgcgcgtgtgcgtgcaactcgctgtgtattgcacgtgaggctttggaggttagggtgttgcgttgggttgtcttgtaaaacaagagcttatctaatatccaatggctgccggtgttctcttagagtaaaaaaaaaaaaaaaaaaaa

SEQ ID NO: 244 - protein, 260 aa, Panicum virgatum
  misc_feature: Ceres CLONE 1724245
  misc_feature: Great-hit functional homolog of the protein sequence given in SEQ ID NO 9477
  misc_feature: Useful for making plants with modulated light quality response
MAQSMLMSTSVGGGRALPSLQAGRPAPYPRLALPSAYRHSRSVSVKTLALFGKSKAAPAKKAPAPKPKVEDGIFGTSGGIGFTKENELFVGRVAMLGFAASLLGEAITGKGILAQLNLETGIPIYEAEPLLLFFILFTLLGAIGALGDRGTFVDDATGLDKAVIPPGKGFRGALGLSEGGPLFGFTKSNELFVGRLAQLGVAFSIIGEIITGKGALAQLNIETGVPINEIEPLVLFNVLFFFIAAINPGTGKFIIGEDEK

SEQ ID NO: 245 - DNA, 1025 bp, Panicum virgatum
  misc_feature: Ceres CLONE 1724250
  misc_feature: Encodes the peptide sequence at SEQ ID NO. 246
aacccagcagcatcccgccggccggcgaccaccgtccgtccgtgagcgagcgagcggcggcacacgaccgtagtaccgtacaatggcccggccttcctctccccggtttcttggagcggcggtcgcggtggcgcttgtagtccttgccgccgcgcctccggcgctcgccggcgacccggactacctccaggacctctgcgtcgccgacctcaactccgaagtgaaggtgaacgggttcccgtgcaaggcgaacgccaccgccgacgacttcttctccggcgtgctggccaagccgggcgccaccaacgccagcgccgtgggctccgtggtcacgggcgccaacgtccagaaggtgccggggctcaacaccctgggcgtctcgctcgcccgcatcgactacgcccccggcgggctcaacccgccgcacacgcacccgcgcgccaccgagctcgtcttcgtcctctacggcaccctcgacgtgggcttcctcaccaccgccaacaagctcgtcgccaagaccgtcgcccagggcgacgtcttcgccttcccgcgggggctcgtgcacttccagaggaacgccggcgacgagcccgccgccgtcatctcggccttcaacagccagctccccggcacgcagtccatcgccatgacgctcttcggggcctcgcccgaggtgcccgacgaggtgctcgccaaggcgttccagatcggcgccgaggaggtggacaagatcaaggccaagttcgcgcccaagaagagctgaggatcggacccggccaggagaaataagttttggtctgtccatcagtcgttgatgatgatgatattggtatgcattggttggttggattattctgctgtttcttcgtttgcttgtgatacgatcgtcggttaagtgtgacctgcagaatgagttggtagggattctctcttgtaataagctgcaggcctgatggagaacattgtgttcatcttatattataagcccaatcatttgtaaaccagaaaaaaaaaaaaaaaaaaaa

SEQ ID NO: 246 - protein, 226 aa, Panicum virgatum
  misc_feature: Ceres CLONE 1724250
  misc_feature (5)..(225): SWISSPROT Homolog: EC 1.15.1.1 Nectarin-1 precursor
MARPSSPRFLGAAVAVALVVLAAAPPALAGDPDYLQDLCVADLNSEVKVNGFPCKANATADDFFSGVLAKPGATNASAVGSVVTGANVQKVPGLNTLGVSLARIDYAPGGLNPPHTHPRATELVFVLYGTLDVGFLTTANKLVAKTVAQGDVFAFPRGLVHFQRNAGDEPAAVISAFNSQLPGTQSIAMTLFGASPEVPDEVLAKAFQIGAEEVDKIKAKFAPKKS

SEQ ID NO: 247 - DNA, 1052 bp, Panicum virgatum
  misc_feature: Ceres CLONE 1724259
  misc_feature: Encodes the peptide sequence at SEQ ID NO. 248
aagtagccctacactagcaacctcgctcatgcacgccattgtttgttaggcaaagatacttgattaaaactttaaaagtaggaggcccatggcatccacggcagtcgccggcggccaggtcctggacggctcgaacccgacggtggcccgcgtgcggcagctcatcgggggcccggaatattgtcaagatgggtggagccggtgctgggaggaaggcgtgacgccgtgggaccttggccagcccacgccggccgtcgtcgagctcgccaagtccgggacgctgcccggcgacgccgccaccgtcctcgtcccgggatgcggtgcggggtacgacgtggtggcgctctccggccccggccgcttcgtcgtcggccttgacatctgcgagagcgccgttgccaaggccaaacagtggtcggcagcggcggcggccgacgccagcttgttcaccttcgtcgcggcggacttcttcacctgggagccgccggagctgttcgacctcatcttcgactacacattcttctgcgctttccacccgtcgatgaggccagcatgggcaaagcgaatggccgacctgctcaagcccaatggcgagctcattaccctcatgtacctggctgaaggtcaggaggctggcccgccattcaacacaacagtgctcgattacgaggaggtgctgaagcccctgggtttcgtgatcacttgcatccaagacaacgatgtggctgttaaaccacgacagggaatggagaaaatcgcaaggtggaagaggatggcaagcccaaccaatctggattctgaagagtaacactatcaaggagactccaacccccacaatatgcaatgaattctgcactagtgaaatcaaaacgtatactcattatatacggaagactccagctcggtcttgtgtgtagtaattggtaatattgttcgctatatgtttatcgacatatcatatatgtattgtgcagaacattaaggtgtggttcctcttgaatacatacatcaacatatcgatatgtattgtgcaaaaaaaaaaaaaaaaaaaa

SEQ ID NO: 248 - protein, 239 aa, Panicum virgatum
  misc_feature: Ceres CLONE 1724259
  misc_feature (4)..(207): Pfam Name: TPMT Pfam Description: Thiopurine S-methyltransferase (TPMT)
MASTAVAGGQVLDGSNPTVARVRQLIGGPEYCQDGWSRCWEEGVTPWDLGQPTPAVVELAKSGTLPGDAATVLVPGCGAGYDVVALSGPGRFVVGLDICESAVAKAKQWSAAAAADASLFTFVAADFFTWEPPELFDLIFDYTFFCAFHPSMRPAWAKRMADLLKPNGELITLMYLAEGQEAGPPFNTTVLDYEEVLKPLGFVITCIQDNDVAVKPRQGMEKIARWKRMASPTNLDSEE

SEQ ID NO: 249 - DNA, 1067 bp, Panicum virgatum
  misc_feature: Ceres CLONE 1724265
  misc_feature: Encodes the peptide sequence at SEQ ID NO. 250
attgaattaacccaacccactctctctctctctcatcatcatccaggcgagcgaagcagccaaggagtaaacgggcgagggacaagcccgccgatcggaggaggaggcgtgggtgaggaaaggaggccaagaagatggtcggcctggtcggcggcggcgccgcggcgcggggggccgggaggctggggctgggagcgggcgacccggccgcggtggccagcgccggaggggaggccgaccacgtccggcgcctgcaccgccacgcgcccgccgaccaccagtgcagctccaccctcgtcaagcacatcaaggcgcccgtccacctcgtgtgggagctggtgcggagcttcgaccagccgcagaggtacaagccgttcgtcagccgctgcatcgtgcgcggggaccagctcgagatcggcagcctccgcgaggtcaacgtcaagaccggcctcccggcgaccactagcaccgagaggctcgagcagctcgacgacgacgagcacatactcggcgtcaagttcgtcggcggcgatcaccggctccagaactactcatccatcataaccgtccacccggagagcattgacgggaggccagggacgcttgtgatcgagtcctttgtggtcgatgtgccagaaggcaacacaaaggatgagacatgctactttgtcgaggccgtgatcaagtgcaacctcacatctctcgcggaggtgtccgagcggttagcagtccagtcacctacatcgccactcgaacattaacgccaacggtacagagacgcgattcgtcaagaaataagaagcttcgaaggatggctggagagttcaatctttttgagactggtagtttcccattgtcttccgcgtgtatgtctcttggaacttggaagcaccagtgatatgtaggaccaaatatctgtagtagcttgtatgttagtgatggtttagcctttaggtactgtgcctaggtgcctcatggatatgtatgcatactgctagtatgtgtagaaattagggaagcatggagcggtttttgcctctttggtgcaaaaaaaaaaaaaaaaaaaa

SEQ ID NO: 250 - protein, 208 aa, Panicum virgatum
  misc_feature: Ceres CLONE 1724265
  misc_feature (3)..(151): Pfam Name: Bet_v_I Pfam Description: Pathogenesis-related protein Bet v I family
  misc_feature (1)..(133): Pfam Name: Polyketide_cyc Pfam Description: Polyketide cyclase / dehydrase and lipid transport
MVGLVGGGAAARGAGRLGLGAGDPAAVASAGGEADHVRRLHRHAPADHQCSSTLVKHIKAPVHLVWELVRSFDQPQRYKPFVSRCIVRGDQLEIGSLREVNVKTGLPATTSTERLEQLDDDEHILGVKFVGGDHRLQNYSSIITVHPESIDGRPGTLVIESFVVDVPEGNTKDETCYFVEAVIKCNLTSLAEVSERLAVQSPTSPLEH

SEQ ID NO: 251 - DNA, 1014 bp, Panicum virgatum
  misc_feature: Ceres CLONE 1724281
  misc_feature: Encodes the peptide sequence at SEQ ID NO. 252
ggtcctcgctgcgctgcggttccccccatatccttccgctgctgctgctgcgcgccgtcgtccgtccgcgtccagatccggccgccaaccgatccggtctcccgcatggctgcggcggcgagggcggcgggagccctggcgctggcgctcgtgctcgcgctggcgggggccaactccgagggggacgcgctctcggcgctgcgccgcagcctcagggaccccggcggcgtgctccagagctgggaccccacgctcgtcaacccctacacctggttccacgtcacctgcaaccgcgacaactgcgtcacgcgcctagatcttggtaatttgaacttatctggtcatctggtgcctgaactcgggaaattagagcatctgcagtatctggaactttacaagaataacattcaaggaacaatcccacctgagcttggtagcttgaagagtctgataagcttggacttgtacaagaacaacatttcggggacaatacctcctgcccttggaaagttgaagtcccttgtattcttgcggctcaatggcaatcgtttgactgggccaatcccaagggaactggctggaatatctagtctcaaagttgttgatgtttcaagtaatgatttgtgcggaacaattcccacctctggaccatttgagcacattcctctgagcaactttgagaagaacccacgtttggaagggccagaactacaaggcctggcggtatatgataccaactgctagagggcaacgcgaacagaaaattggctagaaagagaaatgggcgtacaaggttactgaagatcgggtgatatagattatgttaggtctggttctgctgccactctgtaatccttcctgcatagctcttatttgcaacttgctgtcagcaagttgctgtatgttttagcagaatgctttctgtccgtgaaagtaaacttggaactgcttattacgactgaaatgatatcgtcatttatcctgccacgagtttaaaaaaaaaaaaaaaaaaaa

SEQ ID NO: 252 - protein, 212 aa, Panicum virgatum
  misc_feature: Ceres CLONE 1724281
  misc_feature (11)..(189): SWISSPROT Homolog: EC 2.7.11.1 BRASSINOSTEROID INSENSITIVE 1- associated receptor kinase 1 precursor
MAAAARAAGALALALVLALAGANSEGDALSALRRSLRDPGGVLQSWDPTLVNPYTWFHVTCNRDNCVTRLDLGNLNLSGHLVPELGKLEHLQYLELYKNNIQGTIPPELGSLKSLISLDLYKNNISGTIPPALGKLKSLVFLRLNGNRLTGPIPRELAGISSLKVVDVSSNDLCGTIPTSGPFEHIPLSNFEKNPRLEGPELQGLAVYDTNC

SEQ ID NO: 253 - DNA, 1289 bp, Panicum virgatum
  misc_feature: Ceres CLONE 1724290
  misc_feature: Encodes the peptide sequence at SEQ ID NO. 254
acctcaaatccaacagctgcaaacctacaactcaagcatcaaagacctactagtgctacagaaactgcacacaacacttcacttcagttgcagttgcacacttgcacataatctcctctcctcttcgcctgactgacacacaaccaacaatggtggttccggtgatcgacttctcgaagctcgatggcgccgagagggccgagaccatggcgcagatcgccaatggctgcgaggagtggggattctttcagctggtgaaccatggcatcccgctggagcttcttgagcgcgtcaagaaggtgtgctccgagtgctaccgcctccgcgaggctgggttcaaggcgtcggagccggtgcgcacgctggaggcgctcgtggaggcggagcggtgcggcgaggcggtgacgccggtagacgacatggactgggaggacatcttctacatccacgacggcaaccagtggccgtccgacccaccggcgttcaaggagacgatgcgcgagtaccgcgccgagctcaggaagctcgcggagcgcgtgatggaggccatggacgagaacctcgggctggagaagggcgccatccagcgcgccttctccggcgaggggcggcacgagcccttcttcggcaccaaggtcagccactacccgccgtgcccgcgcccggacctcatcaccggcctgcgcgcgcacacggacgccggcggcatcatcctgctgttccaggacgaccaggtcggcggcctcgaggtgctcaaggacggccggtggaccgacgtgcagccgctcgccggcgccatcgtcgtcaacaccggcgaccagatcgaggtgctcagcaatggccggtaccgcagcgcgtggcaccgcgtcctgcccatgcccgacggcaaccgccgctccatcgcctccttctacaacccggcgaacgaggccaccatctcgccggcggttgccagcggcgaggcgtaccccaagtacatcttcggcgactacatggacgtgtacgcccagcagaagttccaggccaaggagccacggttcgaggccgtcaaggcgcccaagtcatctccagcggcttaaaagtaaaaaaaaaatagtatagtgagattaaaaacaattatgtttattggtttgttgggtatataataagagcaactccagcaatagcccctattacagggcccctacttcatgagtaggggctcttcctatttttggggctatgtttttttcacgtaactccagcaagaacccctacttcttagcccctaaaaaaaaaaaaaaaaaaaa

SEQ ID NO: 254 - protein, 309 aa, Panicum virgatum
  misc_feature: Ceres CLONE 1724290
  misc_feature (1)..(101): Pfam Name: 2OG-FeII_Oxy Pfam Description: 2OG-Fe(II) oxygenase superfamily
  misc_feature (1)..(302): SWISSPROT Homolog: EC 1.14.17.4 1-aminocyclopropane-1-carboxylate oxidase
  misc_feature (4)..(309): SWISSPROT Homolog: EC 1.14.17.4 1-aminocyclopropane-1-carboxylate oxidase 2
MVVPVIDFSKLDGAERAETMAQIANGCEEWGFFQLVNHGIPLELLERVKKVCSECYRLREAGFKASEPVRTLEALVEAERCGEAVTPVDDMDWEDIFYIHDGNQWPSDPPAFKETMREYRAELRKLAERVMEAMDENLGLEKGAIQRAFSGEGRHEPFFGTKVSHYPPCPRPDLITGLRAHTDAGGIILLFQDDQVGGLEVLKDGRWTDVQPLAGAIVVNTGDQIEVLSNGRYRSAWHRVLPMPDGNRRSIASFYNPANEATISPAVASGEAYPKYIFGDYMDVYAQQKFQAKEPRFEAVKAPKSSPAA

SEQ ID NO: 255 - DNA, 1151 bp, Panicum virgatum
  misc_feature: Ceres CLONE 1724299
  misc_feature: Encodes the peptide sequence at SEQ ID NO. 256
gcacaggcccgccgatcggaggaggcgtcgaggaaggagggaggaagtccggaaggaggcggagaagatggtcggcctggtcggcggcggcgccgcggcgccgggtgccgggaggctgggagcgggcgacccggccgcggtggccagcgccggaggggaggccgaccacgtccgccgcctgcaccgccacgcgcccgccgaccaccagtgcagctccaccctcgtcaagcacatcaaagcgcccgtccacctcgtgtgggagctggtgcggagcttcgaccagccgcagcggtacaagccgttcgtcagccgctgcgtcgtggtcggggaccagctcgagatcggcagcctccgcgaggtcaacgtcaggaccggcctaccggcgaccaccagcaccgagaggctcgagcagctcgacgacgacgagcacatactcggcgtcaagttcgtcggcggcgaccaccgcctccagaactactcatccatcgtaacagtccacccggagagcattgacgggaggccagggacgcttgtgatcgagtcctttgtggtcgatgtgccagaaggcaacacaaaggatgagacatgctactttgtcgaggccgtgatcaagtgcaacctcacgtctctcgcggaggtgtccgagcggttagcagttcagtcacctacatcgccactcgaacattaacgccaacggtaagaagcttcgaaggatggctgcagagttcaatctttttgagactggtagtttcccattgtcttccgcgtgtatgtctcctggaacttggaagcactagtgatatgtaggaccaaatatctgtagtagcttgtatgttagtgatggtttagcctttaggaactgcgcctaggtgtctcatggatatgtatgcatactgctagtatgtgtagaaattagggaagcatggagcggtttttgcctctttggtgcacggagatctaccctttcttttctgcattttgagatggctattatattggtgtttgatagacacactttccactgacacatagggcttggctggagtcttggaccttcgattcggtttgattttcgaaatgcggctgtaatatatactgtacaccatatatatatatatttgtttatcctcgaaaaaaaaaaaaaaaaaaaa

SEQ ID NO: 256 - protein, 206 aa, Panicum virgatum
  misc_feature: Ceres CLONE 1724299
  misc_feature (3)..(151): Pfam Name: Bet_v_I Pfam Description: Pathogenesis-related protein Bet v I family
  misc_feature (1)..(133): Pfam Name: Polyketide_cyc Pfam Description: Polyketide cyclase / dehydrase and lipid transport
MVGLVGGGAAAPGAGRLGAGDPAAVASAGGEADHVRRLHRHAPADHQCSSTLVKHIKAPVHLVWELVRSFDQPQRYKPFVSRCVVVGDQLEIGSLREVNVRTGLPATTSTERLEQLDDDEHILGVKFVGGDHRLQNYSSIVTVHPESIDGRPGTLVIESFVVDVPEGNTKDETCYFVEAVIKCNLTSLAEVSERLAVQSPTSPLEH

SEQ ID NO: 257 - DNA, 1181 bp, Panicum virgatum
  misc_feature: Ceres CLONE 1724306
  misc_feature: Encodes the peptide sequence at SEQ ID NO. 258
aaaccactcgtagccgtcgaattccctcgcccgccctgcacactcgctccggccatggcgcgcgccggcgtctccaccgcgccgctctcccgcctgcactcgctgccgcctccgcgccccgcgctcctacaccactaccagcagccccacgtcgtcctccgcccccagcgccgggctcccagcagcgccgccgcggcgctgcccacggccgcggacctcacgccgctctccctgcccgctgccgccgccgccgccgcggcgctggcggcggcggtgtcgctctctgaccccgagcgcaggcggcgcgcgcaggccgaggccgcgggcggcggcgacaaggaggccgtccgcgcctacttcaactcgacggggttcgagcggtggcgcaagatctacgggtcggcgacggagggcgtgaaccgcgtgcagctggacatccgggagggccacgcgcagacggtggccaaggcgctggcgatgctccgcgactcgccgctggagctggcgagcgcgacggtgtgcgacgccgggtgcgggacggggtcgctgtccatcccgctggcggcggagggcgccgacgtgctggcctccgacatctccgcggccatggtgtcggaggcgcagcggcaggcgcaggcggcgctggcggcgcggccggcggggtccccgttccggatgccgcggttcgaggtgcgcgacctggagagcctcgagggccgctacgacgtggtggtgtgcctggacgtgctcatccactacccgcgggaggaggcgcgcgccatgatccggcacctcgcctcgctcgccggggagcggctgctcatcagcttcgcgcccaggacgctctacttcgacctgctcaagcgcgtcggcgagctgttcccgggcccgtccaaggccacgcgcgcctacctgcacgccgagcgcgacatcgaggacgcgctccgcgacgccggctggcgcgtcgccaaccgcggcttcatctccacgcagttctacttcgccaagctcttcgacgccgtgcccgcccgctagtactcgtagccgcaggcgtgcctgacgcaaaactgttgatagaaaatcgagacgccgcggcatcggtggcagcttctacttgcaaattttgctctcgagcttgtagattattattgcaggttgaacaaaaaaaaaaaaaaaaaaaa

SEQ ID NO: 258 - protein, 326 aa, Panicum virgatum
  misc_feature: Ceres CLONE 1724306
  misc_feature (1)..(97): Pfam Name: Mg-por_mtran_C Pfam Description: Magnesium- protoporphyrin IX methyltransferase C-terminus
  misc_feature (94)..(323): SWISSPROT Homolog: EC 2.1.1.11 Magnesium-protoporphyrin O-methyltransferase
MARAGVSTAPLSRLHSLPPPRPALLHHYQQPHVVLRPQRRAPSSAAAALPTAADLTPLSLPAAAAAAAALAAAVSLSDPERRRRAQAEAAGGGDKEAVRAYFNSTGFERWRKIYGSATEGVNRVQLDIREGHAQTVAKALAMLRDSPLELASATVCDAGCGTGSLSIPLAAEGADVLASDISAAMVSEAQRQAQAALAARPAGSPFRMPRFEVRDLESLEGRYDVVVCLDVLIHYPREEARAMIRHLASLAGERLLISFAPRTLYFDLLKRVGELFPGPSKATRAYLHAERDIEDALRDAGWRVANRGFISTQFYFAKLFDAVPAR

SEQ ID NO: 259 - DNA, 1500 bp, Panicum virgatum
  misc_feature: Ceres CLONE 1724312
  misc_feature: Encodes the peptide sequence at SEQ ID NO. 260
tcaggaaggatcctaccaaacctaccaactcctcctccatcgatcgcccgcgcaaaggggaaacctaaaaactaactctcgccattcgccaactagctagctttctctctccgcttcggcgccgctgcggctccaccgcgttcgagcgagaggtttcgtgaagaaaccagagagtagcgtcgaggaactgatcgtcgatcgtgaagacgatgaccgtggtcgacgccgtgtccgcgggcgccggcgacgccgccgccgcggtgccgcagccggcggggaacgggcagaccgtgtgcgtcaccggcgcggccgggtacatcgcgtcgtggctcgtcaagctgctgctcgagaaggggtacactgtcaagggcaccgtcaggaacccagatgacccgaagaacgcgcacctcaaggcgctggacggcgccgccgagcggctcatcctctgcaaggccgacctcctggactacgacgccatctgccgcgccgtggagggctgccacggcgtcttccacaccgcctcccccgtcaccgacgaccccgagcaaatggtggagccggcggtgcgcggcacggagtacgtgatcagcgcggcggcggaggccggcacggtacggcgggtggtgttcacgtcctccatcggcgccgtgaccatggaccccaaccgcgggcccgacgtggtggtcgacgagtcctgctggagcgacctcgacttctgcaagaaaaccaggaactggtactgctacggcaaggcggtggcggagcaggcggcgtgggaggcggcgcggcagcgcggcgtggacctggtggtggtgaacccggtgctggtggtgggcccgctgctgcagccgacggtgaacgccagcatcgcgcacatcctcaagtacctggacggctccgcccgcaccttcgccaacgccgtgcaggcctacgtcgacgtccgcgacgtcgccgccgcgcacctccgcgtcttcgagagccccgccgcctccggccgccacctctgcgccgagcgcgtcctccaccgcgaggacgtcgtccgcatcctcgccaagctcttccccgagtaccccgtccccaccaggtgctccgacgaggtgaacccgcggaagcaggcgtacaagtttacgaaccagaagctccgggacctggggctggagttccggccggtgagccagtcgctgtacgacacggtgaagagcctccaggagaagggccacctgccggtgctcgccgacgagcaggcgccggaggccgcccccggcgccgaggcgcagcagggcgggatcgccatccgtgcgtgaggtccaggccgatggcgccacgaatgaacagaatgcaagcgatgttcatatactgcccctgatgtgtaacccaagtagtgtttgttgcctgtctgatgtccctagcaagacttgaaacgtcgtgctcgtccttgtgaactacatggtgggtgaataaatatggttaatgttcgttcaaaaaaaaaaaaaaaaaaaa

SEQ ID NO: 260 - protein, 364 aa, Panicum virgatum
  misc_feature: Ceres CLONE 1724312
  misc_feature: Great-hit functional homolog of the protein sequence encoded by LOCUS At1g15950
  misc_feature: Great-hit functional homolog of the protein sequence encoded by LOCUS At1g80820
  misc_feature (1)..(240): Pfam Name: Epimerase Pfam Description: NAD dependent epimerase/dehydratase family
  misc_feature: Useful for making plants with altered cell wall content and/or composition
MTVVDAVSAGAGDAAAAVPQPAGNGQTVCVTGAAGYIASWLVKLLLEKGYTVKGTVRNPDDPKNAHLKALDGAAERLILCKADLLDYDAICRAVEGCHGVFHTASPVTDDPEQMVEPAVRGTEYVISAAAEAGTVRRVVFTSSIGAVTMDPNRGPDVVVDESCWSDLDFCKKTRNWYCYGKAVAEQAAWEAARQRGVDLVVVNPVLVVGPLLQPTVNASIAHILKYLDGSARTFANAVQAYVDVRDVAAAHLRVFESPAASGRHLCAERVLHREDVVRILAKLFPEYPVPTRCSDEVNPRKQAYKFTNQKLRDLGLEFRPVSQSLYDTVKSLQEKGHLPVLADEQAPEAAPGAEAQQGGIAIRA

SEQ ID NO: 261 - DNA, 1387 bp, Panicum virgatum
  misc_feature: Ceres CLONE 1724316
  misc_feature: Encodes the peptide sequence at SEQ ID NO. 262
actccatcgagctagcttcacgagtgaattagttgagtgatagctcaattagttagccgattacgtggcacgcgctgcttgttgcaggagctgttgagctagctagcaatggcaacctcgatggctcgccgattcgtggcggcggcgtgcgtcgcggccacggcgttcgcgctcttggcagcgcccagcagcgggcagctggacccgcacttctacgacaaggcgtgcccggcggcgctccccaccatcaggagggtggtggaggaggccgtggcggcggagccgcgcatgggcgcctcgctcctgcgcctccacttccacgactgcttcgtcaacgggtgcgacgggtcgatcctgctggacgacacgcccttcttcaccggcgagaagaaggcctcgccgaacgccaactccgtccgcggcttcgacgtgatcgaccgcatcaaggccgccgtcaacgccgcctgcaggggcaacgtcgtctcctgcgccgacatcgtcgccgtcgcggcacgtgactccgtcgtcgcgctgggagggccgtcgtacaacgtgccgctgggccgccgggacgcgcgcacggcgagccaggcggcggcgaacagcagcatcccggcgccgaccttcgacctcggccgcctcgcctccagcttcgcctcgcacggcctctccctccaggacctcgtcgtgctctcgggcggccacacgctgggcttctcccgctgcaccaacttccgggaccgcctctacaacgagaccgccgccgcgctggacggcgccctcgcggcgtcgctccgggccgtgtgcccgcgcgccgccggcagcggcgacgacaacctggccccgctcgacccgacgcccgcgcggttcgacggcgccgcctacttcgcctcgctgctgcggcgcaggggcgtgctgcactcggaccagcagctgttcgccggcggcctcggcgccaccgacgcgctcgtgcggttctacgccgcgaaccccgacgcgttccggagggacttcgcggaggccatggtgaggatggccagcctcggcccgctcaccggtgccagcggcgagatccgctacgactgcaggaaggtgaactactcctgagcgagtggtgttcgttcgcgcgcgcgcgcgcgaggagcttttgccgtacagtgtactgttcagtccagaagtgtcgtcgcgtcaaacagagtgcttaaagttcagttacattttctacattcacgtcctgagattagtaacttttttttcgtaatttttgtttcatcatgtgttgtactcctacgctttttcagttgcattggttgaggaaccaataagtgtttctaagacagatggaggatgatctgcatctttttggtaaaaaaaaaaaaaaaaaaaa

SEQ ID NO: 262 - protein, 332 aa, Panicum virgatum
  misc_feature: Ceres CLONE 1724316
  misc_feature (1)..(247): Pfam Name: peroxidase Pfam Description: Peroxidase
  misc_feature (30)..(330): SWISSPROT Homolog: EC 1.11.1.7 Peroxidase 52 precursor
  misc_feature (30)..(330): SWISSPROT Homolog: EC 1.11.1.7 Peroxidase P7
MATSMARRFVAAACVAATAFALLAAPSSGQLDPHFYDKACPAALPTIRRVVEEAVAAEPRMGASLLRLHFHDCFVNGCDGSILLDDTPFFTGEKKASPNANSVRGFDVIDRIKAAVNAACRGNVVSCADIVAVAARDSVVALGGPSYNVPLGRRDARTASQAAANSSIPAPTFDLGRLASSFASHGLSLQDLVVLSGGHTLGFSRCTNFRDRLYNETAAALDGALAASLRAVCPRAAGSGDDNLAPLDPTPARFDGAAYFASLLRRRGVLHSDQQLFAGGLGATDALVRFYAANPDAFRRDFAEAMVRMASLGPLTGASGEIRYDCRKVNYS

SEQ ID NO: 263 - DNA, 1411 bp, Panicum virgatum
  misc_feature: Ceres CLONE 1724317
  misc_feature: Encodes the peptide sequence at SEQ ID NO. 264
accaaaccacacgcaggagagacccgggagctcaatccctgatggcccagcagcaaacgagccccgaggaggtggtcctcgggcaggagaccggcagcgcgagggtgatcacgctgaaccgcccgcggcagctcaacggcatctctgaccgagtggtctacctcctcgcacagttcctggagaaatgggagaaagacgatagcgccaaattggtcatctttaagggagctggacgtgcattttctgctggtggggacctgaagatgttttatgaagggaaatcagatgattcctgccttgaggtcgtatataggatgtattggctctgctatcacatccatacatacaagaaaaccacggtggctcttgttaacgggctcgtcatgggtggtggtgctgctatggttgctccactgaagtttgcagttgttacagagaaaacaatttttgctactcctgaggctagtgttggattgcacacagattgtagcttttcctacatccattcacggctccctggatatttaggcgagtacctggctttaacaggtgctagactgaatgcgaaggaaatgatatctgctggtctcgctactcatttcgtcagttccgaaaaactggaagaactcgaaaaatgtttactgaatttggactcaggtgacaagtctgcagtccgagctgttattgaagaattttctacagatgttcaacctgatgaagatagtgttttgaacaagctttcaactatcaacaaatgtttctctgcggagactgttgaggacatcataaaagcatttgaatcagaagcgagcatagacggaaaccaatgggtggctccagtcctaaaaggtctgagaaaatcatctccaactgcactgaagatcaccttgagatcgatcagagagggtcggaaacagagtttgcctgaatgtttgatgaaggaattcagacttacaatgaacattctccgatctgttgttaatggggatgtttatgagggaattagagctcttagcatcgacaaggacaatgcccccaagtggaatcctgcaacccttgaggaggtgaagaacgaggacattgaccgtgtgtttcaaccgttcagtccagagcatgagctccaagtcccaaatgacgattccaacaggtggagcggtaaatatgagaacacggtgtatgctaaaattcctcggtaactgtatacaagataccagccgatgcttgttggcagcaaccagcagggaacaatattcacatcacgtgcataacggatagttcagtatgtaactcgtatgcatctcgtgtgggtgttctattggtgtcacaatgtgtgaacagttgaaaaagattacgaggcaataaagcatatgggatagtttttgacccaacacaaaaaaaaaaaaaaaaaaaa

SEQ ID NO: 264 - protein, 384 aa, Panicum virgatum
  misc_feature: Ceres CLONE 1724317
  misc_feature (1)..(167): Pfam Name: ECH Pfam Description: Enoyl-CoA hydratase/isomerase family
MAQQQTSPEEVVLGQETGSARVITLNRPRQLNGISDRVVYLLAQFLEKWEKDDSAKLVIFKGAGRAFSAGGDLKMFYEGKSDDSCLEVVYRMYWLCYHIHTYKKTTVALVNGLVMGGGAAMVAPLKFAVVTEKTIFATPEASVGLHTDCSFSYIHSRLPGYLGEYLALTGARLNAKEMISAGLATHFVSSEKLEELEKCLLNLDSGDKSAVRAVIEEFSTDVQPDEDSVLNKLSTINKCFSAETVEDIIKAFESEASIDGNQWVAPVLKGLRKSSPTALKITLRSIREGRKQSLPECLMKEFRLTMNILRSVVNGDVYEGIRALSIDKDNAPKWNPATLEEVKNEDIDRVFQPFSPEHELQVPNDDSNRWSGKYENTVYAKIPR

SEQ ID NO: 265 - DNA, 1292 bp, Panicum virgatum
  misc_feature: Ceres CLONE 1724332
  misc_feature: Encodes the peptide sequence at SEQ ID NO. 266
aatccccaacccacgcccaccgtccccggccaccgcccccagatcccacgcgccgccagccaggtcccttgcccgcgggccatgacgccctcctccgcgctcgccctggcccacctcgccgcggcctccccgctcccggccgcctcctcgccgcggccctcgcccaggcccgcctcgctcagcctgggccccgccgggctcgggccgcgccggctcgtcgcggcgccgcccccgcgggcctttttctcctcctcgccctaccagccgccccagccggaggggttctccccgcaccgcgagtacggcctcgtccccatggtcatcgagaccacctcccgcggggagcgcgcctacgacatcttctcgcgcctcctcaaggagcgcatcgtctgcatccacggccctatcgccgacgacaccgcctcgctcgtcgtcgcgcagctgctcttcctcgagtccgagaacccgctcaagcccgtccacctctacatcaactccccggggggcgtcgtcaccgccggcctcgccatctacgacaccatgcagtacatccgctgccccgtcaccacgctctgcatcggccaggccgcctccatgggctcgctcctcctcgcggccggggcgcccggcgagaggcgcgccctgcccaacgccagggtcatgatccaccagccctctggtggcgcgcaggggcaggccaccgacatcgccatccaggccaaggagatcctcaagatgcgcgaccgcctcaacaagatctaccagaagcacacgcgccagcccatcgataagatcgagcagtgcatggagagggacctcttcatggaccccgaggaggcgcgcgactgggggctcatcgacgaggtcatcaagagccgacccgcctcgctcatgcccgaaggactcggtggaggcggcctcgatgtgcccagccttggcggcggcggcggcaacggacggggaagggatgtcgaggagccctctgcggtgtgagcaacggccacaaaggtgaaatcttatcgcgtccggtggctgtgttgttgttagatctaaagctttaatttcttactagacaaggttaaccttgttgttctggttgccgaggcgtccggctccccattccccttcttgcttcaattgcctgaattgagctattagtgataattgttgcaactaaggaaatttccttcctttgatacggataaatcgacactattgtgtatgttgtactaaatttgtatcaattccatgctggagcattgaaaatctcggaaaaaaaaaaaaaaaaaaaa

SEQ ID NO: 266 - protein, 303 aa, Panicum virgatum
  misc_feature: Ceres CLONE 1724332
  misc_feature (1)..(182): Pfam Name: CLP_protease Pfam Description: Clp protease
  misc_feature (68)..(270): SWISSPROT Homolog: EC 3.4.21.92 ATP-dependent Clp protease proteolytic subunit
MTPSSALALAHLAAASPLPAASSPRPSPRPASLSLGPAGLGPRRLVAAPPPRAFFSSSPYQPPQPEGFSPHREYGLVPMVIETTSRGERAYDIFSRLLKERIVCIHGPIADDTASLVVAQLLFLESENPLKPVHLYINSPGGVVTAGLAIYDTMQYIRCPVTTLCIGQAASMGSLLLAAGAPGERRALPNARVMIHQPSGGAQGQATDIAIQAKEILKMRDRLNKIYQKHTRQPIDKIEQCMERDLFMDPEEARDWGLIDEVIKSRPASLMPEGLGGGGLDVPSLGGGGGNGRGRDVEEPSAV

SEQ ID NO: 267 - DNA, 1141 bp, Panicum virgatum
  misc_feature: Ceres CLONE 1724336
  misc_feature: Encodes the peptide sequence at SEQ ID NO. 268
accacagtggtggaaggaaaggaaacgagagggagagagagagaaaaaaaggaggcaccccccgatctcctcctccgcccaccccgatcgcccgaccgatcgccgctcgatgaagcttccgggtaccctccccgccgcccgctacgccatggagccgccgcacgccgaggaggccgccgccgcgggaggaggaggtggagagggcggccgcgcgagcccgggcaccggcctcgaagggccgatgctgaggctggggctggacggcggcggggacggggagggcggggagcgggaggcggaggcggacgcgcggctgccggagcgccccggcgaggcggactgcggctactacctccgcacgggcgcctgcggcttcggggaccgctgccgctacaaccaccctcgcgatcgcggcggcactgagtttggtggaggtgccaagaatggagcagcatcagactttccagagagacagggtcaacctatatgcgagtattatttcaagactggtacttgtaaatttggttccaattgcaaataccaccatcctaagcaagatggatcagtgcaatcggttatattaaacaacggtggattccctctacgcccgggtgagaaagaatgctcctactatatgaagactgggcaatgcaagtttggtactacatgtaaatttcatcatccagaatttggtggtattccagtgacccctggaatatatccaccattacaatctgcatctgtgccctccccccatacatatgctcctcttgcgaattggcaaatgggaaggtcacctgtagttcctggatcatatataccaggttcatatactccgatgatgctctcatctggaatggttccattgcaaggatggagcccttatccggtatataatttggacaaaatgctttattttttactgaagaaagggttcatggcaacaaacttctaccaagatatatataaaaaaaacgagcaagcccttttgtaagctagtataagattgtcatatgatttggctaggcaagatctgaaagacattcattgatgtgttacgtgaaattacttggcaatgcgaagaaaagaaataatgtagggcactacagttgactttttggaaaaaaaaaaaaaaaaaaaa

SEQ ID NO: 268 - protein, 294 aa, Panicum virgatum
  misc_feature: Ceres CLONE 1724336
  misc_feature (2)..(27): Pfam Name: zf-CCCH Pfam Description: Zinc finger C-x8-C-x5-C-x3-H type (and similar)
MKLPGTLPAARYAMEPPHAEEAAAAGGGGGEGGRASPGTGLEGPMLRLGLDGGGDGEGGEREAEADARLPERPGEADCGYYLRTGACGFGDRCRYNHPRDRGGTEFGGGAKNGAASDFPERQGQPICEYYFKTGTCKFGSNCKYHHPKQDGSVQSVILNNGGFPLRPGEKECSYYMKTGQCKFGTTCKFHHPEFGGIPVTPGIYPPLQSASVPSPHTYAPLANWQMGRSPVVPGSYIPGSYTPMMLSSGMVPLQGWSPYPVYNLDKMLYFLLKKGFMATNFYQDIYKKNEQALL

SEQ ID NO: 269 - DNA, 986 bp, Panicum virgatum
  misc_feature: Ceres CLONE 1724339
  misc_feature: Encodes the peptide sequence at SEQ ID NO. 270
agagtcgggagtcctccattctccagcgaccatctcaatggcggcggctgctacctccttcgctaccctcgccatcgcgcggccggcgacggcagcggcggcggcatccgggcagcgggccctccacgcctccaaggcctcctcgccgctcctatcctcccgcggtgcccgcctccactcacaggccgtttccttctccgggggcctggcgccttcgccctcccacagccgcgcgcgcttcgtcacatccgccagcgccgaacccaaggaagcagaaatccagtccaaaatcacaaacaaggtgtactttgacataagcatcgggaaccctgtggggaagaatgttgggaggattgtcatcggcttgtatggggatgatgttccccaaacagcagagaacttccgtgctctttgcactggagagaaagggttcggatacaagggatccagtttccaccgtgtcatcagggatttcatgattcaggggggagattttgacaagggcaatggtactggcgggaaaagcatatatggacgaaccttcaaagatgagaacttcaaattggttcacactggacctggagcggtcagtatggctaacgctggaccaaacaccaatggcagccagtttttcatctgcactgtcaagacaccttggttggacgggaggcacgtcgtgtttggccaggttctggaaggcatggatgtcgtgaagctgatcgagtcgcaggagactgacagaggtgaccgtccgaagaagaaagtagtcatcagcgattgtggggagcttccggtggtctaagttttacatgtcttacctcggacgagaagttgatattcccccacttgagttgacatgaaatatcatgatactttacttatcgtgctatctcccactagttatagagattattttgagttaaagccaaggtcacaaatctgaggcatactgttgcttctcggcggaaaaaaaaaaaaaaaaaaaa

SEQ ID NO: 270 - protein, 254 aa, Panicum virgatum
  misc_feature: Ceres CLONE 1724339
  misc_feature (1)..(164): Pfam Name: Pro_isomerase Pfam Description: Cyclophilin type peptidyl- prolyl cis-trans isomerase/CLD
  misc_feature (1)..(253): SWISSPROT Homolog: EC 5.2.1.8 Peptidyl-prolyl cis-trans isomerase CYP20-3, chloroplast precursor
  misc_feature (68)..(253): SWISSPROT Homolog: EC 5.2.1.8 Peptidyl-prolyl cis-trans isomerase CYP20-2, chloroplast precursor
MAAAATSFATLAIARPATAAAAASGQRALHASKASSPLLSSRGARLHSQAVSFSGGLAPSPSHSRARFVTSASAEPKEAEIQSKITNKVYFDISIGNPVGKNVGRIVIGLYGDDVPQTAENFRALCTGEKGFGYKGSSFHRVIRDFMIQGGDFDKGNGTGGKSIYGRTFKDENFKLVHTGPGAVSMANAGPNTNGSQFFICTVKTPWLDGRHVVFGQVLEGMDVVKLIESQETDRGDRPKKKVVISDCGELPVV

SEQ ID NO: 271 - DNA, 1028 bp, Panicum virgatum
  misc_feature: Ceres CLONE 1724354
  misc_feature: Encodes the peptide sequence at SEQ ID NO. 272
atctctagggtttgagattttagccgccgccgccgctcctcacgtccttgaaaagtcgcagccgacgtagtcctcaccggatccgatggccgtgactttctcggacctccacaccgctgacggcctcaaggccctcgaggcgcacctcgccggcaagacctacgtctccggggatgcgatcagcaaggacgacattaaggtgtttgcggcggtgccgtcgaagcctggtggtgagttccccaatgctgccagatggtacgagaccgtcgccgcggctcttgctgccagattccctggcaagggtgtcggtgtgaatctgcctggagcgggatcggctcctgcagcagctgctcctgcggctgaggttgctaaggatgacgatgatgacgacttggatcttttcggtgatgaaaccgaggaggataagaaggctgctgatgagcgtgcggctgccaaggcctctgccaagaagaaagaaagtggcaagtcctctgtcctgatggacgtgaagccgtgggatgatgaaactgacatgaagaagcttgaggaggctgttcgcagtgtccagatggagggtctcacttggggagcttcaaagcttgtgcccgttggttatggtatcaagaagatgacaatcatgttgaccattgtggatgacctcgtgtccattgatagtctgattgaggaccacctcatggaggcacccatcaatgagtatgtccagagctgtgacattgttgccttcaacaagatctagaatcccaattatcgggcactaaatctgctgctggggtcttggtctcttggaactggattggttatgatggcaagcgctcaagtttctcgtgggatgcgagctcttaccccttttagttactctgctatagaaattgtcgggtctgagtctattgttcagtgctgccaggtttttgaatatctgtttatcttgaatagttgaactgctgggcggtgaaacatgtgctgtgtctaatgtacaccagttttctgtgcaacgctagttttgaacg

SEQ ID NO: 272 - protein, 223 aa, Panicum virgatum
  misc_feature: Ceres CLONE 1724354
  misc_feature (1)..(52): Pfam Name: GST_C Pfam Description: Glutathione S-transferase, C-terminal domain
MAVTFSDLHTADGLKALEAHLAGKTYVSGDAISKDDIKVFAAVPSKPGGEFPNAARWYETVAAALAARFPGKGVGVNLPGAGSAPAAAAPAAEVAKDDDDDDLDLFGDETEEDKKAADERAAAKASAKKKESGKSSVLMDVKPWDDETDMKKLEEAVRSVQMEGLTWGASKLVPVGYGIKKMTIMLTIVDDLVSIDSLIEDHLMEAPINEYVQSCDIVAFNKI

SEQ ID NO: 273 - DNA, 1069 bp, Panicum virgatum
  misc_feature: Ceres CLONE 1724364
  misc_feature: Encodes the peptide sequence at SEQ ID NO. 274
aaaagcggaaggcactctctcttgtagcggcggcgaccggtgaggacaccaaagacgtaggtcactgtcgcggatcgaagaagaggaggaccgacatggcgtggcagcaggcgatgggatctcacgccgcgggcgggagccaggcgccaccggcggcggcggcgggaggaggcgagacgcagcggacgcagtatccgtatgtgactggtacttccgtcattgccttgaagtacaaggatggggtaatcatggcatgtgatactggagcctcctatgggtcaactttgagatacaagagtgtggaacgcattaaggcagttggcaagcatagcctcattggagcaagcggagagttcagtgatttccaggagattttgcgctatctcgatgaactaactttgtctgatcatatgtgggatgatgggaactctttgggcccgaaagagatccacagttatttgacaagggtaatgtacaacagacgcaacaagtttgatcctctctggaacacccttgtccttggtggagttaaaaagggcccaaagggtgatgagaagtatcttgggatggttaacatgattggtacccactttgaggaaaaccatgttgctactgggtttggaaatcatctggcgatccccatacttcgggctgaatggcgcgaggacatgacttttgaagaagctgttaagctggttgagaagtgtttgctggtcttgctgtaccgtgataggtcatccatcaacaaattccagattgccaagatcacaactgaaggatcaaccatttacccgccatactccttgaagacctactggggcttctctcattttgaaaacccagcccagggtgcagtagggtcatggtagatttatgctgctcaaatcttgcatatcaatcgtgccatgaacttagggggaagcaatatatgtgccttcagcaatgctttcagcccttgtgaatgtttgttctgaacatcactgaaactttgcatttgctttgtacgacgtgacagttatgattcagagagtttaattcttgtgaacgttaaaaaaaaaaaaaaaaaaaa

SEQ ID NO: 274 - protein, 257 aa, Panicum virgatum
  misc_feature: Ceres CLONE 1724364
  misc_feature (27)..(257): SWISSPROT Homolog: EC 3.4.25.1 Proteasome subunit beta type 4 precursor
MAWQQAMGSHAAGGSQAPPAAAAGGGETQRTQYPYVTGTSVIALKYKDGVIMACDTGASYGSTLRYKSVERIKAVGKHSLIGASGEFSDFQEILRYLDELTLSDHMWDDGNSLGPKEIHSYLTRVMYNRRNKFDPLWNTLVLGGVKKGPKGDEKYLGMVNMIGTHFEENHVATGFGNHLAIPILRAEWREDMTFEEAVKLVEKCLLVLLYRDRSSINKFQIAKITTEGSTIYPPYSLKTYWGFSHFENPAQGAVGSW

SEQ ID NO: 275 - DNA, 1341 bp, Panicum virgatum
  misc_feature: Ceres CLONE 1724384
  misc_feature: Encodes the peptide sequence at SEQ ID NO. 276
agcatccactgcaaggccgggcgatctctggatactcgcagcggttgcagaggccggccggcggcgtcgaagaagatggctaggcggcgaggcgttgctcccgtgctcgcagcagcattggtcgttgcggcactcgccgccaccgctacaagtgtgcgagccatcggcgtgtgctacggcgtgatcggcagcggcctcccgtccaagagcgacgtcgtgcagctctacaagtcccacggcatcggcaacatgcgcttctacttcgccgaccaggatgtcctcaaagccctgcgcggctcgggcatcggcctcgctctcgacgtcggcaacgagaacctccgcgacctcgccgccaaccccgcctccgcggcgtcctgggtcaaggacaacgtgcaggcctactacccggacgtcaacatcaggtacatcgtcgtcgggaacgaggtcgacggcgccgcctcggtcctccaggccatgcagaacgtccacgacgccctcacgtcagccaacctcgccagcagcatcaaggtgtcgacggcggtgaagatggacgtgctcgacgacaactcctcgccgccctccaacggcgtgttcagggacccctccgtgatgtcgcccatcgtgcagttcctcgccggcaacggcgcgccgctgctcgccaacgtgtacccctacttcgcctacaaggacagccagggcatcgacctcaactacgcgctgttcgagccgagctccacgacggtggtcgacaccaacgggctcacctacacgaacctcttcgacgcgatggtggacgccatccacgccgcgctggacaaggtcggcggcggcggcgtcgacgtcgtggtgtcggagagcgggtggccgtcggccgacgggaggggcgccagcgtggagaacgcgcggacatacaaccagaacctgatcaaccacgccggcaagggcacgccgaggaagccgggcccgatggaggtgtacgtgttcgccatgttcaacgaggacaagaaggacggcgaccccacggagaagaagttcgggctgttcaatggtcccgacaagacaccagtctaccctattaatttcgcatgagattaagtaacgcaggagtacatacaagccggattatttctacgcatgcttcgaatactgcatatacatatactactgcatacgagtatatatgaacaactttttttgcaaccatataaataataaactaggcgtatggccccgcgcatttgcgcagttagtattgaaaattcaaaaatttgcatgttgttgtatccttatatttttattaaagagtatactatttattaccaaaaaaaaaaaaaaaaaaaa

SEQ ID NO: 276 - protein, 337 aa, Panicum virgatum
  misc_feature: Ceres CLONE 1724384
  misc_feature: Great-hit functional homolog of the protein sequence encoded by LOCUS At3g57260
  misc_feature (1)..(284): Pfam Name: Glyco_hydro_17 Pfam Description: Glycosyl hydrolases family 17
  misc_feature (31)..(336): SWISSPROT Homolog: EC 3.2.1.39 Glucan endo-1,3-beta-glucosidase GV
  misc_feature (4)..(336): SWISSPROT Homolog: EC 3.2.1.39 Glucan endo-1,3-beta-glucosidase GII precursor
  misc_feature: Useful for making plants with altered cell wall content and/or composition
MARRRGVAPVLAAALVVAALAATATSVRAIGVCYGVIGSGLPSKSDVVQLYKSHGIGNMRFYFADQDVLKALRGSGIGLALDVGNENLRDLAANPASAASWVKDNVQAYYPDVNIRYIVVGNEVDGAASVLQAMQNVHDALTSANLASSIKVSTAVKMDVLDDNSSPPSNGVFRDPSVMSPIVQFLAGNGAPLLANVYPYFAYKDSQGIDLNYALFEPSSTTVVDTNGLTYTNLFDAMVDAIHAALDKVGGGGVDVVVSESGWPSADGRGASVENARTYNQNLINHAGKGTPRKPGPMEVYVFAMFNEDKKDGDPTEKKFGLFNGPDKTPVYPINFA

SEQ ID NO: 277 - DNA, 1630 bp, Panicum virgatum
  misc_feature: Ceres CLONE 1724392
  misc_feature: Encodes the peptide sequence at SEQ ID NO. 278
aactccaaccgtccagcgcgcgggcaagcgagcggctcaagctcaactcgaccaaatgccgctgctcctcacctcctccctgccggcgctgcaggcgccgttggccgcgtcgtccagggcccgcgtcagggtcgcagcttccgccgccgcctccgccccggacggggccggcgccactgccagagggttcccgtcattccttccccgagcagtggagcgcatccgcgacggcgccgccatccgcctcgccaagcgaatcgagcgggtgcccgtacagacctctttctcggggagtccgatactgagcagctgcgtgaggccgctcaagcagcagcaggacgctgacccgatcgtcctgctccatggcttcgacagttcttgtctagagtggagatacacctacccgttgcttgaggaggctggactggaggcgtgggctgtggacatccttggttggggcttctctgatttagcaacacggccgccatgtgatgttgcgtccaagcgggaacatctttaccagttctggaaatcctacatcaaaaggcctatggttttagtcgggcccagccttggtgctgctgttgccattgatttctcaatcaactatcccgaagcggtttcaaaactgatcttcattggtgcaagtgtatactctgagggcccaaaagatatgactaggatgcctaaatttgtttcatatactggggtgtttatactgaagagtcttccactgcgttttttagcaacacgcttggcattcaataaaactccaaatgaattctttgattgggtgcaaatcgggcatctgcattgcctacttccttggtgggaggatgctacagtagattttatgattagagggggatataatgtcattagacaaataaaacaggtgaagcataaatgcctgatcatgtggggagaggatgacgggataataagcagcaaactagcatatagattgcatcaggaactcccagatgcaattctgaggcaggtacggcagtgtggccatattcctcatgtcgaaaagccaagggaagctgtgaaacttgttcttgaattcctcgaaagggataaagccgaaaaggcagatggggcttcttctgtaacaccagtactcacgaatggctgaacagatccgccttcaggttatatatgctcgatgcggtttcagaaatggttgctgaacttgttgaagttatggtcatgggccggcttgggtgttgtgcgctagtgaacagtccagtggatgagttggtgccagggcttcctctgtggagctggaacaagtgacgctagaagatgcagcggacgaagagccaggcgtccttgctggtcagctgctccgattttagattgttggtcagttagcactagcagtactagagcactgcaagatgttttttgacacggggatgagctaacaaaagtgtaactgtcaatctgtctaggttcgtgttcgtgcaggctgtgtcctttcttttttagagaaaaacaggctatgttctttcgtttactgtacgtgttacatggcccgtgctcggttcaggaatcggcgtttgtgatttgctctttgccattcacatacaccggacgcttcacttaaaaaaaaaaaaaaaaaaaa

SEQ ID NO: 278 - protein, 360 aa, Panicum virgatum
  misc_feature: Ceres CLONE 1724392
  misc_feature (1)..(215): Pfam Name: Abhydrolase_1 Pfam Description: alpha/beta hydrolase fold
MPLLLTSSLPALQAPLAASSRARVRVAASAAASAPDGAGATARGFPSFLPRAVERIRDGAAIRLAKRIERVPVQTSFSGSPILSSCVRPLKQQQDADPIVLLHGFDSSCLEWRYTYPLLEEAGLEAWAVDILGWGFSDLATRPPCDVASKREHLYQFWKSYIKRPMVLVGPSLGAAVAIDFSINYPEAVSKLIFIGASVYSEGPKDMTRMPKFVSYTGVFILKSLPLRFLATRLAFNKTPNEFFDWVQIGHLHCLLPWWEDATVDFMIRGGYNVIRQIKQVKHKCLIMWGEDDGIISSKLAYRLHQELPDAILRQVRQCGHIPHVEKPREAVKLVLEFLERDKAEKADGASSVTPVLTNG

SEQ ID NO: 279 - DNA, 1147 bp, Panicum virgatum
  misc_feature: Ceres CLONE 1724393
  misc_feature: Encodes the peptide sequence at SEQ ID NO. 280
gggcgacctgttcgatcagctatctagctaccataccaagcaccaccaccagcaaggcggcgagagaaagagagagagagagagagagagagagagagagagagagagagagagagagagagagagagagagctagaggcatggcggccggcggcgacaccattgcccgggtccacaccggcatcgacagcagcaacaagacgctgctcaagagcgaggccctctacaagtacgtgctggacacgtcggtgctgccgcacgagccggagtgcatgcgtgagctgcggctggtgacggacaagcacgagtgggggttcatgcagtcgtccccggacgaggcgcagctgctgcggatgctcatcaagctgacgggcgcgcgaaacacgctggaggtgggcgtgttcacgggctactctctcctcgccaccgcgctcgcgctccccgaggacggccgggtgatcgccgtcgacgtggaccgcgactactacgagatcggccggcccttcatcgagaaggccggcgtggcgcacaaggtggacttccgcgagggccccgcgctggaccacctggacgcgctcctcgccgacgagcgcaacctgggcgccttcgacttcgccttcgtcgacgccgacaagcccaactacgtgcgctaccacgagcagctgctccgcctagtgcgcgtggggggcaccatcgtgtacgacaacacgctgtgggcgggcaccgtggcgctgcccccggacacgccgctctccgacctcgaccgccgcttctccgccgccatcagggacctcaacgcccgcctctccgccgacgagcgcgtcgaggtctgccagctcgccatcgccgacggcgtcaccatctgccgccgcctcgtctgagcgatatgatcccgcatgtggccggcggctgtgttgatctgttactactcgccctcgctctcgctgctgctgctgctgccgtcccggtactttcaataagttttttttcttccctttctgtttctttctctttttgcaagttggtcgcgtcagatcgtgtggtatacagtatactgtacctactactactgtactgtacttgtgtaaccggaattgttggagcaaatacagcgcattactttcgccaaaaaaaaaaaaaaaaaaaa

SEQ ID NO: 280 - protein, 246 aa, Panicum virgatum
  misc_feature: Ceres CLONE 1724393
  misc_feature (1)..(216): Pfam Name: Methyltransf_3 Pfam Description: O-methyltransferase
  misc_feature (19)..(245): SWISSPROT Homolog: EC 2.1.1.104 Caffeoyl-CoA O-methyltransferase 1
  misc_feature (19)..(245): SWISSPROT Homolog: EC 2.1.1.104 Caffeoyl-CoA O-methyltransferase 2
MAAGGDTIARVHTGIDSSNKTLLKSEALYKYVLDTSVLPHEPECMRELRLVTDKHEWGFMQSSPDEAQLLRMLIKLTGARNTLEVGVFTGYSLLATALALPEDGRVIAVDVDRDYYEIGRPFIEKAGVAHKVDFREGPALDHLDALLADERNLGAFDFAFVDADKPNYVRYHEQLLRLVRVGGTIVYDNTLWAGTVALPPDTPLSDLDRRFSAAIRDLNARLSADERVEVCQLAIADGVTICRRLV

SEQ ID NO: 281 - DNA, 854 bp, Panicum virgatum
  misc_feature: Ceres CLONE 1724419
  misc_feature: Encodes the peptide sequence at SEQ ID NO. 282
gctcaaaattttcccccaaaactcctcttcttcttgccgaggaaggcagcccaagcgagcaggcgtgcgtgcgtgcgctgcaatggcggattcttcggcgccgacgcgggtgatgatggcggtgaacgaatcgtcgctcaagagttacccgcacccctccatcagctgccgcactgccttcgactggacgctctccaagcttgtccgctccaaccctagcggcttccacttcctcttcctccatgtccaggtccccgacgaggacggatttgatgacatggatagcatctatgcgtcaccggccgacttccaccaaatgaaacagagagacaagataagggggcttcacttgcttgagtactttgtaaaccaatgccatcagctagggataaaatgcgaggcatggatcagacatggggatccaaaggaggttatctgcagcgaagtgaagagagtccagcctgaccttctagttgtgggaagtaggggccttgggccgtttcagagggttttcgtgggcacagtgagcgagttctgcgttaaacatgccgaatgccctgtcatcaccatcaaaaggaaggctactgaagcgccgcaggaccccatcgacgattgatgctgctttcaagtcataccacttgagaatgagatattcttcactgcttaatgggtttaatgtacaaaatgcgatatggaagtgcctggaactaagtagcacaagctttgcacactgcgccccaaaactagagtgaagatgaagacgctatcgttggcccatggatgattcgagattgtacgtatcatatgtgatgccatcaatcgagttgtgaacctaaaaaaaaaaaaaaaaaaaa

SEQ ID NO: 282 - protein, 177 aa, Panicum virgatum
  misc_feature: Ceres CLONE 1724419
  misc_feature (1)..(158): Pfam Name: Usp Pfam Description: Universal stress protein family
MADSSAPTRVMMAVNESSLKSYPHPSISCRTAFDWTLSKLVRSNPSGFHFLFLHVQVPDEDGFDDMDSIYASPADFHQMKQRDKIRGLHLLEYFVNQCHQLGIKCEAWIRHGDPKEVICSEVKRVQPDLLVVGSRGLGPFQRVFVGTVSEFCVKHAECPVITIKRKATEAPQDPIDD

SEQ ID NO: 283 - DNA, 1300 bp, Panicum virgatum
  misc_feature: Ceres CLONE 1724422
  misc_feature: Encodes the peptide sequence at SEQ ID NO. 284
gctgcttgccgccgccgccgccgccaatgaccgaccgcctcgccgcgtgaatcgcccggaatcgccggcgtgagatggcggtctcctccgcgttcgagccctccgcggagatggagcggttcctctgcaagcggctgctggacgcggagcagcccatcgccgagcgcttccgggcgctcttctccctccgcaacctccgcggggacgccccgcgccgcgccctcctccaagctgcaagggatccttctaacttgctggcccatgaagctgcatttgcactagggcagatgcaggatgctgaggctattcccgcattagtggcagttctcaaagatctttctctacatccaattgtacgccatgaggctgccgaagctcttggggctattggcgtggaaaagagcgttcccctgttggaggaaagtttaacagctgatcctgctgtggaggtacaagaaacttgtgagctggcactaagacggatagaagagcagaagaaagttaatggggctgagagtacgaccacttcaccctatctttcggttgatccagcactgcctgcaaaacatggactttcagtagaccaattaagggatcttctccttaatgagcaagaaagcatgtacgaacgttatgcagcgctttttgcacttaggaatgacggtggagatgctgctgtttctgctattgttgcagctctgggcgtcaaaagtgctcttctacggcatgaggttgcttatgtgttaggtcagctgcaaaataaagccgcttcagatgcactttctgcagtcctgaaggatgtctgtgagcacccaatggtcaggcatgaagctgctgaagcccttggttcaatcgcagatcaagaaagcattgcacttttggaggagtttgcgaaggatcctgaacccatagtctcacagagctgtgaagtagctctcagtatgctcgagtatgagagatcgggaaagtcctttgagtttctcttccttcagactcctcatgtgcagtaggagtcctctccgttgtcggtgttactcgttcgagctgcgagcgcccaggctcctgtccatcgatgatcactcgttgaagcgactgaaaccttggttaacgtgactgcaccagttatatttccatgggctttgatgactgtatcctgatagtttctttttttgtcaatggcgatatggaggctgaaatattgagcggctgaagagagaaggaaacaaagaccatgtaatctatacttctatagaaacttatgaaaatgggcagtttgcatcaaaaaaaaaaaaaaaaaaaa

SEQ ID NO: 284 - protein, 311 aa, Panicum virgatum
  misc_feature: Ceres CLONE 1724422
  misc_feature (1)..(27): Pfam Name: HEAT_PBS Pfam Description: PBS lyase HEAT-like repeat
  misc_feature (1)..(311): SWISSPROT Homolog: EC 1.14.99.29 Deoxyhypusine hydroxylase-A
  misc_feature (13)..(311): SWISSPROT Homolog: EC 1.14.99.29 Deoxyhypusine hydroxylase-B
MAVSSAFEPSAEMERFLCKRLLDAEQPIAERFRALFSLRNLRGDAPRRALLQAARDPSNLLAHEAAFALGQMQDAEAIPALVAVLKDLSLHPIVRHEAAEALGAIGVEKSVPLLEESLTADPAVEVQETCELALRRIEEQKKVNGAESTTTSPYLSVDPALPAKHGLSVDQLRDLLLNEQESMYERYAALFALRNDGGDAAVSAIVAALGVKSALLRHEVAYVLGQLQNKAASDALSAVLKDVCEHPMVRHEAAEALGSIADQESIALLEEFAKDPEPIVSQSCEVALSMLEYERSGKSFEFLFLQTPHVQ

SEQ ID NO: 285 - DNA, 1252 bp, Panicum virgatum
  misc_feature: Ceres CLONE 1724425
  misc_feature: Encodes the peptide sequence at SEQ ID NO. 286
ttttcccttctcccggactctctcctcccttgctcttccttccctggcggcgacgactgggcgagcggcggcgccatttgtcgcgtcttcgcccagccctttgccggcgacgagcacccaccaggaaccccaataagtttactgcttccatcaaaggaggacctgcctgtctccgagaacttaattactcctgatcttctgtggcacaagcatcatctgagaaaatgccatcagtttatctttacatccctaatattatcgggtatttcaggatcatcataaattttatagcttttgctgtttgctattccaacaagacactctttgctatcctttacttcatcagttttgtcctagatggcgtggatggttggtttgctcggaagtttaatcaagcatcaacatttggagctgtgttggacatggttacagatagggttagcactgcttgcttgttggcccttctctcccaattttacaggcctggcttagtcttcttgatactgcttgggttggatatcacaagccactggtttcaaatgtacagttctttcttgtcaggtaagactagccacaaggatgtaaagcacacaggcaattggcttctgaaattatattacgggtacaggccgttcatggccttctgttgtgtttcttgtgaggttttgtatattatcctctttctctttgctgatgtgaagtcgacaagcttgcttagtgtatgcagaggtatcctgaatcaaagccccctcattgtcttggtgtttgtttccactttaattggctgggcagtgaaacaacttaccaatatcattcagatgaaaactgctgcagacgcatgtgtcgtgtatgatctgaagcgcagcaagtaaagcatgaaggcaccggttttgttcagtttgtgttgatattatccaaggaaaattcccgtgaggcttgtacaccatttcatacatacagtggctacttcttgtgtgccttgacatctttctgactatgcctatctgttgggaagagacggcaacttgctgtgggaagaacatgaagaaaacagaggagacaaacgttttacggagaaagtataggctgttaagttgtttgtcagtgtttgttcactatatagttggatgcagagcatgacctttgttagctggagtggcctatgagtatctgaaccatgtttacaagctgcatttttcagagtccaggaatatatgaagttttagaattgcaaaaaaaaaaaaaaaaaaaa

SEQ ID NO: 286 - protein, 215 aa, Panicum virgatum
  misc_feature: Ceres CLONE 1724425
  misc_feature: Great-hit functional homolog of the protein sequence given in SEQ ID NO 9501
  misc_feature (3)..(215): SWISSPROT Homolog: EC 2.7.8.11 CDP-diacylglycerol--inositol 3-phosphatidyltransferase 1
  misc_feature: Useful for biocontainment applications
  misc_feature: The plant produces a reduced number of seeds.
MPSVYLYIPNIIGYFRIIINFIAFAVCYSNKTLFAILYFISFVLDGVDGWFARKFNQASTFGAVLDMVTDRVSTACLLALLSQFYRPGLVFLILLGLDITSHWFQMYSSFLSGKTSHKDVKHTGNWLLKLYYGYRPFMAFCCVSCEVLYIILFLFADVKSTSLLSVCRGILNQSPLIVLVFVSTLIGWAVKQLTNIIQMKTAADACVVYDLKRSK

SEQ ID NO: 287 - DNA, 1356 bp, Panicum virgatum
  misc_feature: Ceres CLONE 1724432
  misc_feature: Encodes the peptide sequence at SEQ ID NO. 288
aaaatagcaccttgaaggtaccgtttcgttagagtcatcacatctactccgatttgcaatcaagttggagcaaccagtctagatgacgatgtccttgaagagcctattctactgtctgccgcttctcgtcgtccatttctcgctctccgccagcaccgccgccgccggaaaggtgtcagcgatcttcgtgttcggggactcgacggtcgacgcaggcaacaacaacttcatccccaccgtcgccaaggccaactttccaccatatgggcgcgacttcgacgggggcgtcgccaccggcaggttctccaatggccgcctcgtcacggacttcctttcggaggcgttcgggttgccgccgtctgtaccggcctacctggaccccagctgcacgatcgagcagctctccacgggtgtgagctttgcctccgcgggcactgggcttgatgatttaacagcaaaaatcccatcagttatacccttgagccaacagctggagtacttcgtggagtacaaggagagactgaaactcgcaaaaggggagtccgtggccaacaagatcatcgcggaggctctgtacatcttcagcatcggcaccaacgacttcatcgtgaactaccttgcccttcccctccggcccgcccagtacaccccgccggagtatgtcgcctacctaattgccctagcggacgcggctgttcgtgacgtctacgacctcggcgcgcggaagatggagttcacgggactcgcgccgttcgggtgcctaccttcggcgaggacgctgaaccacgacgagcccggcgagtgcaatgaggagtacaacaagctggcgaggaggttcaacgccgagctgcaggaggccctgaggaagctcaacggtgagctcgccggcgcgcaggtggtctacgcagagacgtacagcttggcgtctgccatcattgccagcccgtccgattacggattcgagaacgccgtgcaaggttgttgtggtacaggactcatcgaaacatcagtcctttgcggcgtggatgaaccgttgacgtgtcaagacgcggacaagtatatgttcttcgattcagttcatccgtccgagcggacgtaccggatagttgctgacaatcttctgaacaatgcattgcaagtgttcctgtgacatctctagtttgtacccgcgcagtttttaataacaaaaatattaaacggaccgaattaattaatgttaattagaaccccttgctagcaggacgtgctggctgtactagagatgagaagcacaggtttacccggccctatagtggcccaattaagggtgttacatgtgcatgccctatttatgtggaaaaaaaaaaaaaaaaaaaa

SEQ ID NO: 288 - protein, 355 aa, Panicum virgatum
  misc_feature: Ceres CLONE 1724432
  misc_feature (1)..(313): Pfam Name: Lipase_GDSL Pfam Description: GDSL-like Lipase/Acylhydrolase
MTMSLKSLFYCLPLLVVHFSLSASTAAAGKVSAIFVFGDSTVDAGNNNFIPTVAKANFPPYGRDFDGGVATGRFSNGRLVTDFLSEAFGLPPSVPAYLDPSCTIEQLSTGVSFASAGTGLDDLTAKIPSVIPLSQQLEYFVEYKERLKLAKGESVANKIIAEALYIFSIGTNDFIVNYLALPLRPAQYTPPEYVAYLIALADAAVRDVYDLGARKMEFTGLAPFGCLPSARTLNHDEPGECNEEYNKLARRFNAELQEALRKLNGELAGAQVVYAETYSLASAIIASPSDYGFENAVQGCCGTGLIETSVLCGVDEPLTCQDADKYMFFDSVHPSERTYRIVADNLLNNALQVFL

SEQ ID NO: 289 - DNA, 1135 bp, Panicum virgatum
  misc_feature: Ceres CLONE 1724434
  misc_feature: Encodes the peptide sequence at SEQ ID NO. 290
attttggttcatcgaacgcttcactcgctctctgtcgttgccgctggctgcctggctgccggtggcgatggcgacggggtggctctcccgggcgctgtggctctcggcgctcgccgccgtcgcggccctcgcgcaggggcaggggcaggggctgtcgccggggttctacaacgcgacgtgcccggcgctgcaggccgtcgtacggcgcggcgtggcgcgggcggtccggagcgagccgcgcatgggggcctccatcctccgcctcttcttccacgactgcttcgtcaatgggtgcgacgcctccgtcttgctggacgacgtgccgggcagcttcacgggggagaagaacgcggggcccaacgccaactcgctgcgcggctacgaggtcatcgacgccatcaaggcgcaggtcgaggcctcctgcaacgccaccgtctcctgcgccgacatcctcgccctcgccgcgcgcgacgccgtcaacctgctcggcgggccgagctggacggtgccgctgggtcgccgcgacgcgcgcaacacgagcgcgagcgccgcaaacaccaacctgccgccgcccgacgcgggcctccccacgctcctgtccatgttccgcgccaagggcctggacacgcgcgacctgacggcgctctccggcgcgcacaccgtggggcgggcccgctgcgccgtcttccgctcgcacatctacaacgacaccgccgcggacgccgccttcgccgcgggcctccgcgccggcgtctgccccgccgcgggcggcgacggcaacctcgcgccgctggagccgcgggcgcccgacgccttcgacaacggctacttccgggacctgctcgcccgccgcgtgctgctgcgctccgaccaggcgctctacggcggcggcaacagcaccacggacgcgctcgtgcgcgcctacgccgccaacgggacggccttcgcggccgacttcgccgccgcgatggtgaggttgggcggcctggccccagccgccgggagcgccggcgaggtccgtctcaactgccggcaattgaactgatttttgatttagctgcacgcggcaccatttcacattgctcatcaatggataattaattagttcttggcgcaaaaaaaaaaaaaaaaaaaa

SEQ ID NO: 290 - protein, 325 aa, Panicum virgatum
  misc_feature: Ceres CLONE 1724434
  misc_feature (1)..(246): Pfam Name: peroxidase Pfam Description: Peroxidase
  misc_feature (29)..(325): SWISSPROT Homolog: EC 1.11.1.7 Peroxidase 52 precursor
  misc_feature (29)..(325): SWISSPROT Homolog: EC 1.11.1.7 Peroxidase P7
MATGWLSRALWLSALAAVAALAQGQGQGLSPGFYNATCPALQAVVRRGVARAVRSEPRMGASILRLFFHDCFVNGCDASVLLDDVPGSFTGEKNAGPNANSLRGYEVIDAIKAQVEASCNATVSCADILALAARDAVNLLGGPSWTVPLGRRDARNTSASAANTNLPPPDAGLPTLLSMFRAKGLDTRDLTALSGAHTVGRARCAVFRSHIYNDTAADAAFAAGLRAGVCPAAGGDGNLAPLEPRAPDAFDNGYFRDLLARRVLLRSDQALYGGGNSTTDALVRAYAANGTAFAADFAAAMVRLGGLAPAAGSAGEVRLNCRQLN

SEQ ID NO: 291 - DNA, 937 bp, Panicum virgatum
  misc_feature: Ceres CLONE 1724435
  misc_feature: Encodes the peptide sequence at SEQ ID NO. 292
caccatcaagccaagcggcccaaaattccactccatcactcactagctctcgcgcttgcttccgatcccctgcgcgcagagagcatcagctccggcgagctctggccgccatgggtccgagggcgatggcgctcgtggcggcggcgatgatggcgtcggcggcggtggtgggcggggacttcgcggcggaccgggcggagtgctcggacaagctggtggggctggcgacgtgcctggcgtacgtgcaggacgaggcggcggcgccgacgccggactgctgcgcggggctcaagacggtgctgcagaccagccgcaagtgcctctgcgtgctcgtcaaggacaaggacgacccaaacctggggctcaagctcaacgtcaccaaggcgctggggctccccgccatctgcaaggccgccgccaacatctccgactgccccaggctgctgaacctggcgcccaactccaaggaggcgcaggtgttcgagcagtacgcgaagcaggcggcggcgcagggcaccgtccccggcggcaccggtggcggaagcagcagcagcgcgccggccgcgggcgcgcagaagagcggcggcgccgggcccacggggcggtggttgggagtggggagggtcggtggcggcggcgcacgcgcggtggtggcgctgctcgccgcggccgctccactcgccgtgcctctcctcatcctgctgggatagacggcggccggtggttgcgtgattgcgtcttgcgtgcgtgctttgctgtgctgtgctgtggacttgtggaaaggaagtgatcaaacaaaggtccagtgaggaatagttgcagcgttggcagttaattatcgtttgtttaaccgttggcggttacgatcgcactttatcatcatcagattatcagctcatggacaaaagccccttcagaaaaaaaaaaaaaaaaaaaa

SEQ ID NO: 292 - protein, 199 aa, Panicum virgatum
  misc_feature: Ceres CLONE 1724435
  misc_feature (1)..(82): Pfam Name: Tryp_alpha_amyl Pfam Description: Protease inhibitor/seed storage/LTP family
MGPRAMALVAAAMMASAAVVGGDFAADRAECSDKLVGLATCLAYVQDEAAAPTPDCCAGLKTVLQTSRKCLCVLVKDKDDPNLGLKLNVTKALGLPAICKAAANISDCPRLLNLAPNSKEAQVFEQYAKQAAAQGTVPGGTGGGSSSSAPAAGAQKSGGAGPTGRWLGVGRVGGGGARAVVALLAAAAPLAVPLLILLG

SEQ ID NO: 293 - DNA, 1566 bp, Panicum virgatum
  misc_feature: Ceres CLONE 1724439
  misc_feature: Encodes the peptide sequence at SEQ ID NO. 294
agctgcaaaattcagccaaaaaaagttcccaaataaaaaataaagttagaaaaaaaaaacactaggagcggcatccaccaccggagctcctatcggctaatcggcccatccctccgtgtcaaccccctccacaaaattttatttgcaatccagtccctggccggccgacccgggcaccggacggagccgctcgccggaggaagccgcccgtgtccttgctctgcggcggggtcatggggttctcgctgcaccccatgaagacgtccacgcgcgtgctctggagcaccagcttcttccgccataagctcgcctcctcctcctgcttcatctgagctgagctgagagccggcccaacaccgccctcgatcgcctcggcgcggcggcggccgctgctgcacggatttcaaagcggccgtttaagagcgtgtgtgtgcgcgcgcgcgcacgtgcgggtttcaagattgggtttttgtttcgttctttgggaggaaggggacaaggagaagggagagggcaagaagaagagcaagaatcagcatggatccgggccgcgtcggcgtcgactcgggcggcgcacggcggggcggcggcggcggcgcgcagatgctgctcttcggcggcgggggcagcgccaacagcaacggcttcatccgaggtattccgatggcggttctcggcatggacgacgcggcgcgcgtgggcaagcggccgttcttcacaacgcacgaggagctcctggaggaggagtactacgacgagcaggcgccggagaagaagcgccggctgacggcggagcaggtgcagctcctggagcggagcttcgaggaggagaacaagctggagccggagcgcaagaccgagctggcgcgccggctggggatggcgcccctccaggtggccgtctggttccagaaccgccgcgcgcgctggaagaccaagcagctcgagaccgactacgaccgtctcaaggctgcctacgacgcgcttgccgccgatcaccagggcctactcgccgacaacgacagcctcagggcacaggtaatctccctgacggagaagctgcaaggcaaggatacatccccatcggcgaccatcactgcccaagaggttgaccagctggacgagcacactgcggcgtcaggcaccgagaagctgctggtgcagctgaagcacgaccacctcagcagtggcgactgtaccggccacggtgccctctcgtccgaggaagaggacggtggcgtgatcagcgacgaggtatgcagcttcgaccttccagatgccttgttcgccgctgctggggtcacccaccacggcgcagaggaagcgcagctgtgcagctggaactcctggctgtggaacaactgatcggtggatggctggatggatccattccatgccccgtgtgcgaagttctcccctggtttcgacccttttctgcaccgtataattactgtgttaattatgttccgccaaaatgtttttgagtgttgaaacagaacctgatgttgtaagtttacgtttttgaagattttatgtgttcatatataaaaaaaaaaaaaaaaaaaa

SEQ ID NO: 294 - protein, 275 aa, Panicum virgatum
  misc_feature: Ceres CLONE 1724439
  misc_feature (1)..(55): Pfam Name: Homeobox Pfam Description: Homeobox domain
MDPGRVGVDSGGARRGGGGGAQMLLFGGGGSANSNGFIRGIPMAVLGMDDAARVGKRPFFTTHEELLEEEYYDEQAPEKKRRLTAEQVQLLERSFEEENKLEPERKTELARRLGMAPLQVAVWFQNRRARWKTKQLETDYDRLKAAYDALAADHQGLLADNDSLRAQVISLTEKLQGKDTSPSATITAQEVDQLDEHTAASGTEKLLVQLKHDHLSSGDCTGHGALSSEEEDGGVISDEVCSFDLPDALFAAAGVTHHGAEEAQLCSWNSWLWNN

SEQ ID NO: 295 - DNA, 1029 bp, Panicum virgatum
  misc_feature: Ceres CLONE 1724456
  misc_feature: Encodes the peptide sequence at SEQ ID NO. 296
acaagcataggttttatctgttacgtcgcagcatctgcacgcggcctgcgttcgagcgatcagctcccctgtgctgcgcgaccatggccgccgtgtcggaggtggcggtcgacggcgtcgtcttcccgccggtggcacgcccgccgggctccgggcgctcgcacttcctcgccggcgcaggtgtgcgagggatggagattggcggcaacttcatcaagttcacggccattggcgtgtacctggaggagggcgccgccgtgtccgcgctggcgaagaagtgggccggcaagtccgccgacgagctcgccgccgacgtcgccttcttccgcgacgtcgtcacgggcgacttcgagaagttcacgcgggtgacgatgattctgccgctcacgggcgagcagtactcgggcaaggtgacggagaactgcgtggcgtactggaaggccgtcggcgtgtacacggacgccgagggcgccgccgtggacaagttcaaggaggccttcaagcctgagacgttcccgccgggcgcgtccatcctcttcacgcactcgcccgccggagtcctcaccgttgcgttctccaaggactcgtcggtgccggagtccggcggcgtggcgatcgacaacaagcccctctgcgaggccgtgctggagtccatcatcggggagcacggcgtctcgccggccgcgaagctgagcgtcgcggcgagggtgtcggagctcctcaaggaggccagcccggccggcggcgcgccacaggcggcggcggagcccgcggtcccggtctccgcgtgaggggaggaagagccaggcgatggcatccgccggctgccggtgtctaagatgtgtgccagtagcagggagagagatgccgcggcggcgcgccctatcgatcgtcttgtttgtttgtgccctttgtggccgtgttcgtgttcggatccctacatgccgttcgctgccggtgacctgaattactattactaataaagaaacgcggcggatacttatgttgcaaaaaaaaaaaaaaaaaaaa

SEQ ID NO: 296 - protein, 235 aa, Panicum virgatum
  misc_feature: Ceres CLONE 1724456
  misc_feature (1)..(215): Pfam Name: Chalcone Pfam Description: Chalcone-flavanone isomerase
  misc_feature (12)..(235): SWISSPROT Homolog: EC 5.5.1.6 Chalcone--flavonone isomerase
MAAVSEVAVDGVVFPPVARPPGSGRSHFLAGAGVRGMEIGGNFIKFTAIGVYLEEGAAVSALAKKWAGKSADELAADVAFFRDVVTGDFEKFTRVTMILPLTGEQYSGKVTENCVAYWKAVGVYTDAEGAAVDKFKEAFKPETFPPGASILFTHSPAGVLTVAFSKDSSVPESGGVAIDNKPLCEAVLESIIGEHGVSPAAKLSVAARVSELLKEASPAGGAPQAAAEPAVPVSA

SEQ ID NO: 297 - DNA, 1175 bp, Panicum virgatum
  misc_feature: Ceres CLONE 1724465
  misc_feature: Encodes the peptide sequence at SEQ ID NO. 298
aaccgcgccgccgcctcccgttcccaatccaacccccacgccaccgaacaccctcctacgtctaccaccgttgccatgggcagcgccgccacctcgccgccgccgtccatgaagctggcgcaggaggacttgaagcgcgtggcggcgcacatgggcgacgccgccgcctcgccgccgccgcccgtgaagctgacgcaggaagacctgaagcgcgtggcggcgcaccgcgcggtggagttcgtggagcccggcatggcgctgggactcggcacgggttccacggcggcgcacgcgctggaccgcctgggcgacctcatccgcgcgggcgcgctcccgggcgtggcgggcgtgcccacctccctcaagacggagctccacgcgacccgcgtcgggatcccgctcctcccgctcgggggcgaccgcgggcccgccaggatccacctctccatcgacggcgccgacgaggtggacccggacctcaacctagtcaagggccgcggcggctctttgctccgggagaagatgatcgagggggctggggagaaattcgttgtcatcgtcgacgagtccaagctggtgccccgcctcgggtgtacgggcgcggtgcccgtcgaggtcatccccttcggcgcttcccacacgctgggcctcatccgcaaggtgttcgatggattgcctggcttccacgccaggctcaggatggtcaagaaagatgccgatgaagacacgccgttcacgactgacaacggcaactacatcgtggagatgttcttcgaggacggcatccgcggcgacctccacaacatcagcgaccaactccttcggatcacgggcgttgttgagcatggcatgttcctcagcatggccacctctgtcatcgtcgccaacaaggatggcaccatcactgtgatggacaaaaagaattaacctgctgatgcggcatgctgctaataagctaccgagatcatcattctccttctaacgaaggaaaataacaagaaaagaagagcatagcagctctcagcgtgctctaaagttttgttgctctcctcctgttgtcgtactagtactgttgttaccttgtttgcgccagtttcacgggtaataacacaacagaattacctggatgaatgtgatgaaaccaataagtttcagaaaaaaaaaaaaaaaaaaaa

SEQ ID NO: 298 - protein, 283 aa, Panicum virgatum
  misc_feature: Ceres CLONE 1724465
  misc_feature (1)..(187): Pfam Name: Rib_5-P_isom_A Pfam Description: Ribose 5- phosphate isomerase A (phosphoriboisomerase A)
MGSAATSPPPSMKLAQEDLKRVAAHMGDAAASPPPPVKLTQEDLKRVAAHRAVEFVEPGMALGLGTGSTAAHALDRLGDLIRAGALPGVAGVPTSLKTELHATRVGIPLLPLGGDRGPARIHLSIDGADEVDPDLNLVKGRGGSLLREKMIEGAGEKFVVIVDESKLVPRLGCTGAVPVEVIPFGASHTLGLIRKVFDGLPGFHARLRMVKKDADEDTPFTTDNGNYIVEMFFEDGIRGDLHNISDQLLRITGVVEHGMFLSMATSVIVANKDGTITVMDKKN

SEQ ID NO: 299 - DNA, 1417 bp, Panicum virgatum
  misc_feature: Ceres CLONE 1724466
  misc_feature: Encodes the peptide sequence at SEQ ID NO. 300
agccaagcgccacgctccaccagtccaccggaccaaccagccgcgcgcggtgatcagctagtgcggtggtgttgctttccgctccgtgggcgcggaccggcatccagcggggaggatgaagaaggtgtcggtggccgcggcggcggcagcggcgctgctgctgctgctgctggcggcggcggcgacggaggggagcgagctcaagctgggctactacgccaagacctgccgcgggtgggagaacgtggtcaagtaccacgtcgccaaggccatccgggccaaccgcgccagcggcgccgccctcgtccgcctcatcttccacgactgcttcgtcaggggttgcgacgcgtcggtgctgctcgacccgacgccggcgaacccgcacacggagaagacggcgccgatcaacatcgggctggcggcgttcgaggtgatcgacgacatcaaggcggcgctggaggagcggtgccccggcacggtgtcgtgctcggacatcgtggtgttcgcggcccgggacgcgtccagcatcctgagcaacgggcacgtgcacttcgacccgccggcggggcgcctcgacggcaaggtctcccgcgccgccgacgcgcagcgcgacctcccggactcgaccttcacgatcgccgagctgatccgcaacttccggcgcaagaacttcacggtggaggagctggtgatcctgtccggggcgcacgccgtcggcgtggggcactgctcctccttccgcgcgcggctgtcctcgccgccgagccagatcgtgccggcgtaccggaacctgctgtccgggcggtgcgcggcgaggccggaccccgtggtgcccaacaacgtgcgggacgaggacccccgcgcggtggcggcggcgttcccgtcgttcctgaagaagctgcggcggagcggggacttcctggacaacagctactaccacaacaacctggcccggatcgtgaccttcaactcggactggcagctgctgacggagaaggaggcgctggggcacgtcaaggagtacgccgagaacgggacgctgtgggacgaggacttctccgaggcgctggtgaagctcagcaagctgcccatgccgccgcgcagcaagggggagatcaggagccactgccgcgtcgtcaacggccaccaccaccactaccactagcttcgatcgattcctatatatctcgcgctctgctgctgctgcaggacgacaacgcagtgattactatatctcgttcattctatctctcgcgttcatcatttgattgttcattttgctgttgatgctgtacgttttttttttcctatgtgatttttttgttgtctttctggtgttgttgggggatgtaatgtgattgatttgttatatgatctttgggtgcacaaagttacggaaaaaaaaaaaaaaaaaaaa

SEQ ID NO: 300 - protein, 349 aa, Panicum virgatum
  misc_feature: Ceres CLONE 1724466
  misc_feature (1)..(261): Pfam Name: peroxidase Pfam Description: Peroxidase
MKKVSVAAAAAAALLLLLLAAAATEGSELKLGYYAKTCRGWENVVKYHVAKAIRANRASGAALVRLIFHDCFVRGCDASVLLDPTPANPHTEKTAPINIGLAAFEVIDDIKAALEERCPGTVSCSDIVVFAARDASSILSNGHVHFDPPAGRLDGKVSRAADAQRDLPDSTFTIAELIRNFRRKNFTVEELVILSGAHAVGVGHCSSFRARLSSPPSQIVPAYRNLLSGRCAARPDPVVPNNVRDEDPRAVAAAFPSFLKKLRRSGDFLDNSYYHNNLARIVTFNSDWQLLTEKEALGHVKEYAENGTLWDEDFSEALVKLSKLPMPPRSKGEIRSHCRVVNGHHHHYH

SEQ ID NO: 301 - DNA, 1053 bp, Panicum virgatum
  misc_feature: Ceres CLONE 1724467
  misc_feature: Encodes the peptide sequence at SEQ ID NO. 302
ctcctccgatcgagccgggaccgccaggcaaacctggtgctccccttctccgtcaccgcgacgcctcggcctccccgctccaccgcctccgctcctcgtgaggcgacgccacgcctatagatcgcgtgcccaagcacggacgccaccccgctcggtgctgggaggtagagcgcgatggcagcgccgccggcgagggctcgagccgactacgactacctcatcaagctgcttctcatcggagacagcggtgttggaaaaagttgtcttctcttacggttttcagatggctccttcaccactagcttcatcactactattggtattgacttcaagataaggactgtcgagttggatggcaaacggattaagttgcagatctgggatactgcaggccaagaacgtttccgcacgattacaactgcctattacaggggagctatgggcattttacttgtgtatgacgtcacagacgagtcgtcttttaataatataagaaattggatcagaaacattgaacaacatgcctcggataatgtgaacaaagttctggtaggcaataaagctgatatggatgaaagcaaacgggctgttcccacttccaaggggcaagctcttgccgatgaatatgggataaaattctttgaaacgagtgcaaagacaaacctgaacgtcgagcaggttttcttttctattgcaagggatatcaaacaaagactctcggagactgattcgaagcctgaggatcgaactatcaagatcaaggccgaaggggaagctgatgcagcagatgcacagaaatcagcttgctgcggctcctaaacagttgttacagcaagatttggtgttactgctcatgtaatttttatcgttttattctttgccagcaactctccttgtgtgtttctcaagtcatcgcaattgttgggatttggacaaacgggtgttaagtcagaacatttacttgctatattggtgggaaactgtggtcttgataacgatgagcgcgtatagaattgggtggcttggtttgatctaaaaaaaaaaaaaaaaaaa

SEQ ID NO: 302 - protein, 214 aa, Panicum virgatum
  misc_feature: Ceres CLONE 1724467
  misc_feature: Great-hit functional homolog of the protein sequence given in SEQ ID NO 9467
  misc_feature: Great-hit functional homolog of the protein sequence given in SEQ ID NO 9640
  misc_feature: Useful for making plants with altered Lignin content
  misc_feature: Useful for making plants with modulated oxidative stress sensitivity
MAAPPARARADYDYLIKLLLIGDSGVGKSCLLLRFSDGSFTTSFITTIGIDFKIRTVELDGKRIKLQIWDTAGQERFRTITTAYYRGAMGILLVYDVTDESSFNNIRNWIRNIEQHASDNVNKVLVGNKADMDESKRAVPTSKGQALADEYGIKFFETSAKTNLNVEQVFFSIARDIKQRLSETDSKPEDRTIKIKAEGEADAADAQKSACCGS

SEQ ID NO: 303 - DNA, 1031 bp, Panicum virgatum
  misc_feature: Ceres CLONE 1724479
  misc_feature: Encodes the peptide sequence at SEQ ID NO. 304
agccgcacagcgcccattcccgcatacccctcccgccgccgccgccgccgcgccgccgccggagaagatgggtcgcgtcatccgcgcgcagcgtaagggtgcggggtccgtgttcaagtcccacacccaccaccgcaagggccccgcccggttccgctccctcgacttcggcgagcgcaacgggtacctcaaggacgtcgtcaccgacgtcatccacgacccgggccgcggcgcgccgctcgccaaggtcaccttccgccacccgttcaggtacaagcaccagaaggagctcttcgtcgccgccgagggcatgtacacgggccagttcgtctactgcggccgccgcgccacgctctccatcggcaacgtgctgccgctgcgcgggatccccgagggagccgtcgtctgcaacgtggagcaccacgtcggcgaccgcggcgtcttcgccagggcctccggggactacgccatcgtcatcagccacaacccggacaatggaacctccaggatcaagctcccctctggtgccaagaagattgtccccagcagctgccgtgccatgatcggtcaggttgctggtggaggcaggactgagaagcccatgctgaaggctggtaacgcctaccacaagtaccgcgtgaagaggaactgctggcctaaggtgcgtggtgtggccatgaaccctgtggagcatccccacggaggaggtaaccaccagcacattggtcacgcctccacagtccgccgtgatgctccccccggccagaaggtcggtctcatcgctgccaggaggactggacgtctcaggggccaggctgctgccaccgccgccaagtccgacaaggccacgtagagttatcatcgtttatctatatctgctgcctctagatgattaaaggacgtgttccagtatggatgtgttattgcctggtactctggtgaaccattgtgtcagttttcatcgttgctgtctgaattttgtgttatgcctaaagaagtttttgctcggataaaaaaaaaaaaaaaaaaaa

SEQ ID NO: 304 - protein, 261 aa, Panicum virgatum
  misc_feature: Ceres CLONE 1724479
  misc_feature: Great-hit functional homolog of the protein sequence given in SEQ ID NO 9282
  misc_feature: Useful for making plants with modulated nitrogen use efficiency
MGRVIRAQRKGAGSVFKSHTHHRKGPARFRSLDFGERNGYLKDVVTDVIHDPGRGAPLAKVTFRHPFRYKHQKELFVAAEGMYTGQFVYCGRRATLSIGNVLPLRGIPEGAVVCNVEHHVGDRGVFARASGDYAIVISHNPDNGTSRIKLPSGAKKIVPSSCRAMIGQVAGGGRTEKPMLKAGNAYHKYRVKRNCWPKVRGVAMNPVEHPHGGGNHQHIGHASTVRRDAPPGQKVGLIAARRTGRLRGQAAATAAKSDKAT

SEQ ID NO: 305 - DNA, 1028 bp, Panicum virgatum
  misc_feature: Ceres CLONE 1724480
  misc_feature: Encodes the peptide sequence at SEQ ID NO. 306
acccaggtccacccagcacatcacctgcccctccccccaagccaaacgcgagtacctcgcccgtgatctccccgatctccggcgatggccgcgcggcggcccggatcccccgcctccaggtggctgcgcccatccgcgctgcttctccttgtcgccttcgctctcctctcggccccaaggccggcgcgcgccctcctgttcgacctcgagtccggccacaccaagtgcatctccgacgagatcaagatcaactccatggccgtcgacaagtaccacgtcgtcgggcccgaccccaacttccccgacgcccagctccccgaatcgcatcgcatctccctcagggtgacgtcgccgtacgggaacagcatgcactacgcggagaacgtgcagtcagggcacttcgccttcacggcgacggaggccggcgactacctagcctgcttctgggcgcccgaccacaagccgccggtcaccatcggcttcgagtttgactggaggagcggcgtctcggccaaggactggcccagcgttgccaagaagggcaaggtcgatatgatggaattggagctgaagaagctggaggaaaccataaaaaatatacatgaagaaatgttctatctccgtgaaagggaggaggaaatgcaggacctgaacaggcgaacaaactcgaggatggcttggcttgggttcctctcactcggcatctgcttatcagtggcaggcttgcagctgtggcacctgaagactttcttcgagagaaagaagctgctgtagttcccccaattattcacgatagcacacagcactagagcggacaggtgtaactttttgtgtgtgaacggttaatccatgttacagaaacgtgaaccccatgcaggaaacggtgtttgtcatacttgagaattgtgcttcaatgtgatttagtctgtccagttgaaattaaaaaaaatgttgtaagaaaaatctcaaatgccttcaagtctataattcatgctgtaatttcggggcaaaaaaaaaaaaaaaaaaaa

SEQ ID NO: 306 - protein, 229 aa, Panicum virgatum
  misc_feature: Ceres CLONE 1724480
  misc_feature: Great-hit functional homolog of the protein sequence encoded by LOCUS At1g26690
  misc_feature: Useful for making plants with altered cell wall content and/or composition
MAARRPGSPASRWLRPSALLLLVAFALLSAPRPARALLFDLESGHTKCISDEIKINSMAVDKYHVVGPDPNFPDAQLPESHRISLRVTSPYGNSMHYAENVQSGHFAFTATEAGDYLACFWAPDHKPPVTIGFEFDWRSGVSAKDWPSVAKKGKVDMMELELKKLEETIKNIHEEMFYLREREEEMQDLNRRTNSRMAWLGFLSLGICLSVAGLQLWHLKTFFERKKLL

SEQ ID NO: 307 - DNA, 1272 bp, Panicum virgatum
  misc_feature: Ceres CLONE 1724500
  misc_feature: Encodes the peptide sequence at SEQ ID NO. 308
actcaacaagtaagcaagcttcagaagcaagtgccggcggcatagcattctgagagctgagctagcagctggttggccggcatggcgaaggacatcgaggcgtcggggcccgaggcgggcgagttctcggccaaggactacacggaccccccgccggcgccgctgatcgacgcggaggagctgaccaagtggtcgctgtaccgcgcggtcatcgccgagttcattgccacgctgctcttcctctacatcactgtggccaccgtgatcgggtacaagcaccagacggacgcggcggcgtcgggccccgacgcggcgtgcggcggcgtgggcgtcctcggcatcgcgtgggccttcggcggcatgatcttcatcctcgtctactgcaccgccggcatctcgggcgggcacatcaacccggccgtcaccttcggactgttcctggcgaggaaggtgtcgctggtgcgcgcgctgctctacatcgtggcgcagtgcctcggcgccatctgcggcgtggggctcgtcaagggcttccagagcgcctacttcgtgcgctacggcggcggcgccaacgagctcagcgacggatactccaagggcacggggctcgccgccgagatcatcggcaccttcgtgctcgtctacaccgtcttctccgccaccgaccccaagcgcaacgcccgcgactcccacgtcccggtgttggctcctctcccaattgggttcgccgtgttcatggtgcacctggccaccatcccgatcaccggcactggcatcaacccagccaggagcctgggagccgcggtcatctacaacaaggacaaggcctgggatgaccaatggatcttctgggtgggcccgctgatcggcgccgccatcgccgccgcgtaccaccagtacgtgctcagggccagcgccgccaagctcgggtcctaccggagcaacgcctaggtccggccggccgccggcgaggaggggggccccaccgaagtgtagatatgcgcgcacaaccgacgcccgcttcccgatcgatccgttcatctgctgtcgcagttcgtagtagtcgtgtaatcgtgtcatgctcgcggggtctccgcgccgtgtttcgatgtgttccggagtccgccgccacgttcgcttgctgtgttttgcttcgaaaaaaagtgtgatataatctttgctatttttttctgtatgtatgtatttggtatggagaatttggaaactgagttatgtgagcttttatctatcgtctaaaaaaaaaaaaaaaaaaaa

SEQ ID NO: 308 - protein, 288 aa, Panicum virgatum
  misc_feature: Ceres CLONE 1724500
  misc_feature: Great-hit functional homolog of the protein sequence given in SEQ ID NO 9410
  misc_feature: Great-hit functional homolog of the protein sequence given in SEQ ID NO 9486
  misc_feature: Useful for making plants with modulated cold sensitivity
  misc_feature: Useful for making plants with modulated drought sensitivity
MAKDIEASGPEAGEFSAKDYTDPPPAPLIDAEELTKWSLYRAVIAEFIATLLFLYITVATVIGYKHQTDAAASGPDAACGGVGVLGIAWAFGGMIFILVYCTAGISGGHINPAVTFGLFLARKVSLVRALLYIVAQCLGAICGVGLVKGFQSAYFVRYGGGANELSDGYSKGTGLAAEIIGTFVLVYTVFSATDPKRNARDSHVPVLAPLPIGFAVFMVHLATIPITGTGINPARSLGAAVIYNKDKAWDDQWIFWVGPLIGAAIAAAYHQYVLRASAAKLGSYRSNA

SEQ ID NO: 309 - DNA, 1031 bp, Panicum virgatum
  misc_feature: Ceres CLONE 1724501
  misc_feature: Encodes the peptide sequence at SEQ ID NO. 310
actccaacacaaactaacacaactcatctcatcctcatcacatcgatcagtagctaaaaccaagagcatccatcacacaaagcacaagctcatctctcttcacaattcagacaacccatcatctaatagctagctagctagcaatggcgcctatggtagtaaccatgagcaacaaggccgtggtgctcctcctgctggtggctcttctccctctcggcgccctcggctcccgctccggcccgtccgcgcaccacggccacgccggccacggccccaagcactcgtcgcctccgtctgctacaccggcgacgcccgcccccgccgcggcacccgccgccgccgcgctggtgcgctccacctgcaactcgacgacctactacgacctgtgcgtgtccgcactgggcgccgacccgtccagcgccacggccgacgtgcgcggcctctcctccatcgccgtctcggccgccgccaccaacgcctccggtggcgccgccacggccgcggcgctcgccaacggcaccgccgcggcgtcgaacgcgcaggcggccccggccaccgccgaccccgccgtgcaggcgctgctccgcacctgcgccgccaaatacggccaggcccgcgacgcgctgaacgccgccagagagtcgatcgcggcgcaggactacgacttcgccaacgtgcacgtcagcgccgccgccgagtacccgcaggtgtgcaaggcgctgttccggcggcagaggcccgggcagtacccggcggagttggcggcgagggaggaggcgctcaggcagctctgctccgtcgccaacgacatcatcgcgctcctcgccaacagcagcagctagctgtagccagcgtggcgtacgtgtagtagtctactagcagtgagtctacgtgtaatgacacgagtctacttcacttgttagttaactgtatgtacctgtctacatactccagctgtgttgagttgatcaataaatacttaatgccactttgaattttgttaatcataacaaaaaaaaaaaaaaaaaaaa

SEQ ID NO: 310 - protein, 232 aa, Panicum virgatum
  misc_feature: Ceres CLONE 1724501
  misc_feature (1)..(157): Pfam Name: PMEI Pfam Description: Plant invertase/pectin methylesterase inhibitor
MAPMVVTMSNKAVVLLLLVALLPLGALGSRSGPSAHHGHAGHGPKHSSPPSATPATPAPAAAPAAAALVRSTCNSTTYYDLCVSALGADPSSATADVRGLSSIAVSAAATNASGGAATAAALANGTAAASNAQAAPATADPAVQALLRTCAAKYGQARDALNAARESIAAQDYDFANVHVSAAAEYPQVCKALFRRQRPGQYPAELAAREEALRQLCSVANDIIALLANSSS

SEQ ID NO: 311 - DNA, 1136 bp, Panicum virgatum
  misc_feature: Ceres CLONE 1724515
  misc_feature: Encodes the peptide sequence at SEQ ID NO. 312
aaacacaacgtcatccgcctgcaccgatccacacgccggctgcccgcctaggccggctagctagctagctctgctcgtcggcagcacctgcgtcggtcgctccgatcgcgtgcgcgctccggcgtcccacgccgccgccgcgcgcgcgcatgcaggagcccgggcgccggcccgcgccgccgttcgcgggcgtcgacctccgcaggcccaagggctacccgccggcgccgacggccgcggaggcggaggaccccgcgccggcgcccgccggcgacccgtgcccgcggtgcgagtcgcgggacaccaagttctgctactacaacaactacaacacgtcgcagccgcgccacttctgcaggtcgtgccgccgctactggaccaaaggcggctccctgcgcaacgtccccgtcggcggcggcacccgcaagagctcgtcgtcgtcgtcgccggtccctccctcgcccgccgccgcgcccaggagcacgaagcggtcgaaggagtccaagcgccgccgcgtcgccccggccccggaccccgctcccggcacggacgccttcgccgccgccatcaccggcgtcgcgaacaccgccccgacgcccgcgccggagacggtggccgccggggagaagcctgccgcgccggtgcccgcagcgacggttgccgccaaggagaagccggcagcgacggttgccgccacggagatgccgaccgcgcccccggcggccgtcagcggtttcacggacacgtccacggcgcccggggtcaggctcgcagacgttggcagcgatgccgatgacggcaaggagccgcagccggacccgaaccacttcgagtggccgtcgggctgcgacctggggccccactggggcaccggcgtgttcgccgacaccgacccggcgctcttcctcaacctgccgtgaggccgcgagcagagcgcgcaccatggctaagttaaccgatcaaccatcaggacgcacgagacgacgacgcatcatgatcagctcctgaagctgaagctggctgccgcagtttcctgagtccactgtagtgatcactctacccctctagttctcttattactattgttctgctagttttaatcgccgcttttactccaaaaaaaaaaaaaaaaaaaa

SEQ ID NO: 312 - protein, 256 aa, Panicum virgatum
  misc_feature: Ceres CLONE 1724515
  misc_feature (1)..(63): Pfam Name: zf-Dof Pfam Description: Dof domain, zinc finger
MQEPGRRPAPPFAGVDLRRPKGYPPAPTAAEAEDPAPAPAGDPCPRCESRDTKFCYYNNYNTSQPRHFCRSCRRYWTKGGSLRNVPVGGGTRKSSSSSSPVPPSPAAAPRSTKRSKESKRRRVAPAPDPAPGTDAFAAAITGVANTAPTPAPETVAAGEKPAAPVPAATVAAKEKPAATVAATEMPTAPPAAVSGFTDTSTAPGVRLADVGSDADDGKEPQPDPNHFEWPSGCDLGPHWGTGVFADTDPALFLNLP

SEQ ID NO: 313 - DNA, 1037 bp, Panicum virgatum
  misc_feature: Ceres CLONE 1724523
  misc_feature: Encodes the peptide sequence at SEQ ID NO. 314
acacaagcataagctttgatctgttacgttgcatctacacgcagcccgcgcaaccatggccgtgtcggaggtggcggtcgacggcgtcgtcttcccgccggtggcacgcccgccgggctccggccgctcgcacttcctcgccggcgcaggtgtgcgagggatggagattggcggcaacttcatcaagttcacggccatcggcgtgtacctggaggagggcgccgccgtgtccgcgctggcgaagaagtgggcagggaagtccgccgacgagctcgccgccgacgtcgccttcttccgcgacgtcgtcacgggcgacttcgagaagttcacgcgggtgacgatgatcctgccgctcacgggcgagcagtactcggacaaggtgacggagaactgcgtggcgtactggaaggccgtcggcgcgtacacggacgccgagggcgccgccgtggacaagttcaaggaggccttcaagcccgagacgttcccgccgggcgcgtccatcctcttcacgcactcgcccgccggagtcctcaccgtcgcgttctccaaggactcgtcggtgccggactccggcggcgtggcgatcgacaacaagcccctctgcgaggccgtactggagtccatcatcggggagcacggcgtctcgccggccgcgaagctgagcgtcgcggcgagggtgtcggagctgctcaaagaggccagcccggccggcggcgcgccacgggcggcggagcccgcggtcccggtctccgcgtgagcagggccgcgaggggaggaagagtcaggcagtcaggcgatggcatctgccggccggcgtctaagatgtgtactagcagagcgagagagatgccgcggcggcgcggctgtcgatcgtcttgttcgtttgtgcctttgtggccgtgtccgtgtccgtgtgtctgaggcgtcgtgttcggatcccccgtacatgccgtacgctgttggcgtgtgagccggcggtgacctgaacgaataaagaaacgctgatactcatgttgcaaaaaaaaaaaaaaaaaaaa

SEQ ID NO: 314 - protein, 233 aa, Panicum virgatum
  misc_feature: Ceres CLONE 1724523
  misc_feature (2)..(215): Pfam Name: Chalcone Pfam Description: Chalcone-flavanone isomerase
  misc_feature (11)..(233): SWISSPROT Homolog: EC 5.5.1.6 Chalcone--flavonone isomerase
MAVSEVAVDGVVFPPVARPPGSGRSHFLAGAGVRGMEIGGNFIKFTAIGVYLEEGAAVSALAKKWAGKSADELAADVAFFRDVVTGDFEKFTRVTMILPLTGEQYSDKVTENCVAYWKAVGAYTDAEGAAVDKFKEAFKPETFPPGASILFTHSPAGVLTVAFSKDSSVPDSGGVAIDNKPLCEAVLESIIGEHGVSPAAKLSVAARVSELLKEASPAGGAPRAAEPAVPVSA

SEQ ID NO: 315 - DNA, 1160 bp, Panicum virgatum
  misc_feature: Ceres CLONE 1724526
  misc_feature: Encodes the peptide sequence at SEQ ID NO. 316
acgggtgctccttctccgacgacgagcgtacaggtacaggcgggaatgcagaccaccgcgcgctcctccgcttccgctccgtcctcgccgctcccccgctccgcgccaccgccaccccgcgtcgccttccccgccctccgccggcgcgacctcctcctgctccccgcggcgctgtccctcccgctcgcccctcccgccgcggcgcccgcgccggccgcggcccgcgggctgttccgcatgcccccgcagcggctggcgaaccgctacttcctggtgcgcgcgggggagtccgtctacgaggggcagggcctcctccgcaccaacccggtcgccaagacctccgttgacagcggcctctcccccgtggggctccgccagacggcgcgcgccgcgctcgagctccagcgcctcggcgcgtgcgaggacgactgctggatatggccgtccatcacgcagcgcgcgtaccaggcggccgagatcatcgccgccgccaacggcgtcaaccgcagccgcattgtgcctgagtacagcttcttggatgcccggggattgggtgcgtttgaggggaagagcctggacgcactgcctgaggtgtatgcgtcggataacatttcaccagatatgaagcctcctcctatcagcgatggtactcctaatgagagcgtagcagatgtatttgtccgggtgacacagctcatgtcaatactagagacccagtattcaggggaaactgttgtcatcgtttcaccagattctgacaacctgtcgattcttcaagctggattgattgggctagacctacgaaggcatagcagcttattttttaagcccggtgaagtcaggccagttgatcccagtagcattcctgaatacaagcaacctgcttctactgtttttaagtgtacgaatccgccaagttgtaaataggtcacttcctgtcactgcagttcatatttctgttcatgtatgaatatatacccatgagaaatctctcattgattatactctgtagcatatagctcaaagtacgttttgtgtgttgcatctgagtaagcaagttagcttgaattcgcataatacttttgttcagtgggaccaaagctgtatagctcagttgtaaaaaaggaatttctatagctcaaaaaaaaaaaaaaaaaaaa

SEQ ID NO: 316 - protein, 293 aa, Panicum virgatum
  misc_feature: Ceres CLONE 1724526
  misc_feature (1)..(170): Pfam Name: PGAM Pfam Description: Phosphoglycerate mutase family
MQTTARSSASAPSSPLPRSAPPPPRVAFPALRRRDLLLLPAALSLPLAPPAAAPAPAAARGLFRMPPQRLANRYFLVRAGESVYEGQGLLRTNPVAKTSVDSGLSPVGLRQTARAALELQRLGACEDDCWIWPSITQRAYQAAEIIAAANGVNRSRIVPEYSFLDARGLGAFEGKSLDALPEVYASDNISPDMKPPPISDGTPNESVADVFVRVTQLMSILETQYSGETVVIVSPDSDNLSILQAGLIGLDLRRHSSLFFKPGEVRPVDPSSIPEYKQPASTVFKCTNPPSCK

SEQ ID NO: 317 - DNA, 1285 bp, Panicum virgatum
  misc_feature: Ceres CLONE 1724527
  misc_feature: Encodes the peptide sequence at SEQ ID NO. 318
gaacctcagcagaacccaagagaatcggcggccaagaaaatgctcctcctcatcctcttcgcccttctcgccggcgccgccgccttcctcctcttcatgttcgccaccgtcgtcgatggggacttgacgctcgtgtcgcgcggcccgccgcggcgggagagggtggacggcaaggtcgtgtggattactggagcgagccgcgggattggggaggtccttgcaatgcaatttgcaaacttaggagcaaagctgatactatctgctcgtaacaaggacgagcttgagagagtaaaacaaaacattctcagcaagaatccagatagcagagttgaagtgttacccatggatttatcagctggtgaaaaatctctgaaacaagttgtacatgcggcagaatcactcttttctaatgcaggcgttgactatatgatccataatgctgcctttgaacgtcctaaacggggggcactggaagaaagtgaggaaggtctcaaggctactattaatgtcaatgtcatcggaactattactctaacacgccttcttgcaccttatatgctggatagagggatgggtcattttgttgtgatgagcagtgcggctggaaaggttcctgctcctggtcaggccatttattctgcatccaaacatgctctcaatggatacttcgcctctctgcgttctgagttgtgtacaaaaggcattaagatcactgttgtatgccctggaccaattgaaacaccacaatcttctgcagcagcatcttcggtacaaagtcattcttctgagagacgtgtttcggtggaaagatgtgttgaactgacgatcattgcagcaactcatgggcttaaagaagcatggatatcatatcagcctgtgctgactgttatgtacttggtgcaatacatgccaacgattggttactggcttatggacaaggttggtgcaaaacggctggacgcagctgcaaagaaaggcaacacctatagttggaatctcatttttggcggcaagaagtcagcatgaccaagttgcccgtcacttctgctaccagggatatttcaacactccaagctccacgagtcacttgtatgcttatatacaaaaaaggttaaactgaaaaggaacagagcatctatagacgggtttagttgaaaaatggactcatgtgttaagtgttatgacacagtgaggtatggttaaagttgaaacatgttgaaccggcattttctttgaaatcaagcacagggtaaatcagcgccggtaaaaaaaaaaaaaaaaaaaa

SEQ ID NO: 318 - protein, 328 aa, Panicum virgatum
  misc_feature: Ceres CLONE 1724527
  misc_feature (1)..(174): Pfam Name: adh_short Pfam Description: short chain dehydrogenase
MLLLILFALLAGAAAFLLFMFATVVDGDLTLVSRGPPRRERVDGKVVWITGASRGIGEVLAMQFANLGAKLILSARNKDELERVKQNILSKNPDSRVEVLPMDLSAGEKSLKQVVHAAESLFSNAGVDYMIHNAAFERPKRGALEESEEGLKATINVNVIGTITLTRLLAPYMLDRGMGHFVVMSSAAGKVPAPGQAIYSASKHALNGYFASLRSELCTKGIKITVVCPGPIETPQSSAAASSVQSHSSERRVSVERCVELTIIAATHGLKEAWISYQPVLTVMYLVQYMPTIGYWLMDKVGAKRLDAAAKKGNTYSWNLIFGGKKSA

SEQ ID NO: 319 - DNA, 1280 bp, Panicum virgatum
  misc_feature: Ceres CLONE 1724544
  misc_feature: Encodes the peptide sequence at SEQ ID NO. 320
agctatctatcgtcccatctctcgggcctccttccactcatcagtacaccgccatggccgccgtgaccgccgcggccgtctctctgtcgtccttcccggctgctgccaaggcggccgcctcgacgtcgtccccgtcgtcatgcggcatcacgtacccgcggcgcagcgccgcccgggcagtgcgcgtgcaggtgtcgacgacggagaccgctgaggccggggcggcgccggtgaagacggagaagatctccaagaagcaggacgagggtgtggtgaccaacaagtacaggcccaaggagccctacgtggggaggtgcctgctcaacaccaggatcaccggcgacaaggcgccgggggagacgtggcacatggtcttcagcaccgaaggcgagatcccttacagagaagggcagtccattggcgtcatagccgacggcgtcgacaagaacggcaagccgcacaagctcaggctctactccatcgccagcagcgccctcggggatttcggcgactccaagaccgtgtcgctgtgcgtgaagaggctcgtgtacaccaacgaccaaggagagatcgtcaaaggagtctgctccaactacctatgtgacctgaagcccggcgctgaggtgaagatcacagggccagtcggcaaggagatgctcatgcccaaagaccccaacgcaacagtcattatgctggcgacgggtaccggtatcgcccccttccgctccttcttgtggaagatgttcttcgagaagcacgacgactacaagtacaacggcctggcctggctgttcttgggagtcccgacgagcgacaccctgctgtacaaggaggagctggagaagatgaaggagatggcgccggacaacttccggctggacttcgcggtgagccgggagcagacgaacgcggcgggggagaagatgtatatccagacgcggatggccgagtacaaggaggagctgtgggagctgctcaagaaggacaacacctacgtctacatgtgcgggctcaaggggatggagaagggcatcgacgacatcatggtcgacctcgcagccaaggacgggatcgactggattgagtacaagaagcagctcaagaagggcgagcaatggaacgtcgaagtctactaaaccatcatgcatgcatattctcactagctagctagcaccatcttatatatgctgcatatatagtacgtacatacaggcgcacgtcagtacatacaccacattatatccatcattttgttgtgccaaaaaaaaaaaaaaaaaaaa

SEQ ID NO: 320 - protein, 360 aa, Panicum virgatum
  misc_feature: Ceres CLONE 1724544
  misc_feature (1)..(118): Pfam Name: NAD_binding_1 Pfam Description: Oxidoreductase NAD-binding domain
  misc_feature (1)..(360): SWISSPROT Homolog: EC 1.18.1.2 Ferredoxin--NADP reductase, leaf isozyme, chloroplast precursor
MAAVTAAAVSLSSFPAAAKAAASTSSPSSCGITYPRRSAARAVRVQVSTTETAEAGAAPVKTEKISKKQDEGVVTNKYRPKEPYVGRCLLNTRITGDKAPGETWHMVFSTEGEIPYREGQSIGVIADGVDKNGKPHKLRLYSIASSALGDFGDSKTVSLCVKRLVYTNDQGEIVKGVCSNYLCDLKPGAEVKITGPVGKEMLMPKDPNATVIMLATGTGIAPFRSFLWKMFFEKHDDYKYNGLAWLFLGVPTSDTLLYKEELEKMKEMAPDNFRLDFAVSREQTNAAGEKMYIQTRMAEYKEELWELLKKDNTYVYMCGLKGMEKGIDDIMVDLAAKDGIDWIEYKKQLKKGEQWNVEVY

SEQ ID NO: 321 - DNA, 978 bp, Panicum virgatum
  misc_feature: Ceres CLONE 1724556
  misc_feature: Encodes the peptide sequence at SEQ ID NO. 322
ctcggtcaagctcgctcccctgcgtgggtttttctctggatcggttgccttgcttcttcctccgccgggggcggggaagcgccatccagatcgacggaggcgtccggcgacctccccaactccgaccaggagaggaggcttctgcggtcagcgcaacatggaggggctgagctggggaagggtgtgcttatcggtgctctgcgtcgtgctgctctcgcgcccggccgcggccatccgcttcgtcattgacagggaggagtgcttctcgcataacgtggaatacgagggggacacggtccacgtatcctttgttgtgatcaaggccgaaacaccgtggcattacagcgaggaaggcgtcgatcttgtggttaaagatcctaatggcgctcaagtccgcgactctcgagataagactagtgataagtttgagttcatagttcagaagagaggtgtccatcggttctgcttcaccaataaatctccatatcacgaaaccatagactttgatgtgcacgttggccatttttcatattttgagcagcatgccaaagacgaacattttgctccactgttggagcaaattgccaagttagatgaggctctttacaatattcagttcgaacagcactggctagaggcccaaactgaccgacaggcaatattgaacgaaaacatgagcaggagggcagtccacaaggcgctgttcgagtcagcagcgctcatcgcagccagcgtcatccaggtctatcttctgcgccggctcttcgagcgcaagctggggtcatctagggtgtaacactctagtagccgctcccccaatgtagccaagatcatcccaacgtgactgttataccggattgagtggttgctagatctgctaatactacttgcttgtggactccagttacatgtaatgtaatcacttttatgattccgtggatggtaactctgaaagttcaaactgtcaatttagccttc

SEQ ID NO: 322 - protein, 212 aa, Panicum virgatum
  misc_feature: Ceres CLONE 1724556
  misc_feature: Great-hit functional homolog of the protein sequence encoded by LOCUS At3g07680
  misc_feature: Useful for making plants with altered cell wall content and/or composition
MEGLSWGRVCLSVLCVVLLSRPAAAIRFVIDREECFSHNVEYEGDTVHVSFVVIKAETPWHYSEEGVDLVVKDPNGAQVRDSRDKTSDKFEFIVQKRGVHRFCFTNKSPYHETIDFDVHVGHFSYFEQHAKDEHFAPLLEQIAKLDEALYNIQFEQHWLEAQTDRQAILNENMSRRAVHKALFESAALIAASVIQVYLLRRLFERKLGSSRV

SEQ ID NO: 323 - DNA, 1369 bp, Panicum virgatum
  misc_feature: Ceres CLONE 1724569
  misc_feature: Encodes the peptide sequence at SEQ ID NO. 324
gagaatctgaagttctgaacctgcacctgcagcagcagagtgcccggtccggcggctccccattcgaccatctccggccgccgcccctccgtcggcccgtctccccagcggcatgagcaccgtcacggccgccgatccgcacacctccttcctcgccgacaaggacgccaaggtcttcgtcgccgggcaccggggcctcgtcggttccgcggtcgtgcgccgcctcctctcgctcggcttcacctccgtcgtcgtccggacccacgccgagctcgacctcacccgccaggccgacgtcgaggccttcttcgccgccgagcgcccgcgctacgtcgtcctcgccgccgccaaggtcggcggcatccacgccaactccaccttccccgccgacttcatcgccgccaacctccagatccagaccaacgtcgtcgacgccgcgctgcgctccggctccgtccgcaagctcctcttcctgggctcctcctgcatctaccccaagttcgcgccgcagcccatcaccgagggcgcgctcctctccggcccgctcgagcccaccaacgagtggtacgccgtcgccaagatcgccggcatcaagatgtgccaggcataccgcatccagcacggcctcgacgccgtctccgccatgcccaccaacctctacggcccgcacgacaacttccacccggagaactcgcacgtcctgcccgcgctcatccgcaggttccacgaggccaaggcgtgcgacgcccccgaggtcgtcgtatggggctcgggctcgccgctgcgggagttcctgcacgtcgatgacctcgccgacgcggtcatcttcttgatggaccagtactccgggctggagcacgtcaacgtggggagtgggagcgaggtcgccatcaaggagctcgctgagctggtgaaggaggtggtggggttccaggggaagctggtgtgggactccagcaagccggacggcacacccaggaagctcatggatagctccaagatacaaggcatggggtggaagcctaagatcgccctcaaggagggcctcgtcgaaacctacaaatggtatgttgagaatgtcgtctctggcaagaagtagagccttgcttgccagtggtggtggtgtctttctctccatagctactcttgcaagttggtgtcatgatttctagtgttcctatggttgttgattatcagatcatacgattctgttttactacccacatagaagaggtttgttataatgttatgtgttggctgaataatctgtgggtcaaatttgtatactgctaggatcataattgatcttgaacactttttggtgattagaaagtttaacgaccatctgatggatggatgttcttggccg

SEQ ID NO: 324 - protein, 328 aa, Panicum virgatum
  misc_feature: Ceres CLONE 1724569
  misc_feature: Great-hit functional homolog of the protein sequence encoded by LOCUS At1g17890
  misc_feature: Great-hit functional homolog of the protein sequence encoded by LOCUS At1g73250
  misc_feature (1)..(233): Pfam Name: Epimerase Pfam Description: NAD dependent epimerase/dehydratase family
  misc_feature (14)..(323): SWISSPROT Homolog: EC 1.1.1.271 GDP-L-fucose synthase 1
  misc_feature (20)..(322): SWISSPROT Homolog: EC 1.1.1.271 GDP-L-fucose synthetase
  misc_feature: Useful for making plants with altered cell wall content and/or composition
MSTVTAADPHTSFLADKDAKVFVAGHRGLVGSAVVRRLLSLGFTSVVVRTHAELDLTRQADVEAFFAAERPRYVVLAAAKVGGIHANSTFPADFIAANLQIQTNVVDAALRSGSVRKLLFLGSSCIYPKFAPQPITEGALLSGPLEPTNEWYAVAKIAGIKMCQAYRIQHGLDAVSAMPTNLYGPHDNFHPENSHVLPALIRRFHEAKACDAPEVVVWGSGSPLREFLHVDDLADAVIFLMDQYSGLEHVNVGSGSEVAIKELAELVKEVVGFQGKLVWDSSKPDGTPRKLMDSSKIQGMGWKPKIALKEGLVETYKWYVENVVSGKK

SEQ ID NO: 325 - DNA, 1096 bp, Panicum virgatum
  misc_feature: Ceres CLONE 1724575
  misc_feature: Encodes the peptide sequence at SEQ ID NO. 326
accaacaaccaaaggagagcacccgcgcatgtttagcttcgccgggcgcgcctccaccgcatcgagcatcgtcgccagcctcgccacccccgcgccgccgtccaagcccatcagccccgccttcgcctccgcccgccgccccaggctcatcatgagcgcgcccgtcttcgccgcccccagcgccgtcgcgagcatggacgccgtggagcgcttgaagagcgggttcgagcagttcaagacccaggtctacgacaagaagccggagctgttcgagccgctcaaggccggccaatgccccaggtacatggtgttcgcctgcgccgactcccgctgctgcccgtcggtgaccctgggcctgcagcccggcgaggccttcaccatccgcaacatcgccgccatggtcccgccctacgacaagaacaagtacgccggcatcggggccgccatcgagtacgccgtctgcgccctcaaggtggaggtcctcaccgtcattggccacagccgctgcggtggcatcagggcgctcctctccctccaggacggcgcagccgacaccttccacttcgtcgaggactgggtcaggatcggctaccaggccaagaagaaggtgcagaaagagcaccccactgttccgttcgacgatcagtgctccatcttggagaaggaggctgtgaacgtgtccctctacaacctcttgacctacccctgggtcaaggaaggtgtggccaacgggaccctcaagttggtcggtgcccgctacgacttcgtgaacggtgtgttcgacacatgggagaaatgagccataaacttctactacgtcatatacatacatacatacatacatacctatatgcacctgatcgatgtgaatccgtggagtacttactgcctatttcgaccgccactacaagccggatcgtcatcctatatgcgaatgtaataagcaatagcattttctactgctttactttcaaatgtggagcttatatgtaatatatggtgcgcaatttgaccgcttttgtggtcaaaagacatcagctgtataagcctttttcataatattatctcaatttactaaaaaaaaaaaaaaaaaaaa

SEQ ID NO: 326 - protein, 256 aa, Panicum virgatum
  misc_feature: Ceres CLONE 1724575
  misc_feature (1)..(171): Pfam Name: Pro_CA Pfam Description: Carbonic anhydrase
  misc_feature (5)..(256): SWISSPROT Homolog: EC 4.2.1.1 Carbonic anhydrase, chloroplast precursor
MFSFAGRASTASSIVASLATPAPPSKPISPAFASARRPRLIMSAPVFAAPSAVASMDAVERLKSGFEQFKTQVYDKKPELFEPLKAGQCPRYMVFACADSRCCPSVTLGLQPGEAFTIRNIAAMVPPYDKNKYAGIGAAIEYAVCALKVEVLTVIGHSRCGGIRALLSLQDGAADTFHFVEDWVRIGYQAKKKVQKEHPTVPFDDQCSILEKEAVNVSLYNLLTYPWVKEGVANGTLKLVGARYDFVNGVFDTWEK

SEQ ID NO: 327 - DNA, 1149 bp, Panicum virgatum
  misc_feature: Ceres CLONE 1724584
  misc_feature: Encodes the peptide sequence at SEQ ID NO. 328
gagcggatctcccctcctcctcctcctccttcctccaccaccaccgcccgggctggttgcagcaagcgagccttatcttcttcttcgtccgtccagaccgtcctggcactggctagtagatgtcgcgagacagggagggtagcagcgagctgagactgagaggtttacggagggcggcgcggcggccatgaagatccagtgcggcgcgtgcgaggccgcggcggccacggtggtgtgctgcgccgacgaggcggcgctgtgcgcgcgctgcgacgtcgagatccacgccgccaacaagctcgccaacaagcaccagcgcctcccgctcgaggcgctctccgccaggctcccccgctgcgacgtctgccaggagaaggcggccttcatcttctgcgtggaggaccgggcgctcttctgccgggactgcgacgagcccatccacgtccccggcacgctctccggcaaccaccagcgctacctcgccaccggcatccgcgtcggcctcgcctccgcctccgcgtgcggcgacgccagcgacgcccacgactcggaccaccaccacgccccgcccaaggccaccgtcgagcccgccgtctccgccgcggcgcagcaggtgccctcgccgccgccgttcctgcctcagggctgggccgtcgacgacctcctccagttctccgactacgagtccggcgacaagctgcagaaggagtcgccgctcgggttcaaggagctcgagtggttcgccgacatcgacctcttccacgaccaggcgccgcccaaggccggcagggcgctggcggaggtcccggagcttttcggatcccaggcggcaagcgacgcggcgtactacaggccgagcaaagccggcgccggccttcgccagagcaagaaggcccggatcgaggtcaccgacgacgaggacgactacctcatcgtccctgaccttggctgaaaagaagagcgcgagagttttggttcttcgcctgttgtggtgttgtataccagaagaattctactgtgtacaagctaatgtcatgtgttgtgcatcttgactgtagtatggctcaactgtgaacattataattctggccactttgttgctatgctagcaacagagcctgtgtgatagaaaaaaaaaaaaaaaaaaaa

SEQ ID NO: 328 - protein, 254 aa, Panicum virgatum
  misc_feature: Ceres CLONE 1724584
  misc_feature (1)..(48): Pfam Name: zf-B_box Pfam Description: B-box zinc finger
  misc_feature: The sequence is a functional homolog of  SEQ ID NO 1961 in the  11/479,226 US patent application
  misc_feature: The sequence is a functional homolog of  SEQ ID NO 465 in the  11/479,226 US patent application
  misc_feature: Useful for making plants with modulated growth and phenotype characteristics
MKIQCGACEAAAATVVCCADEAALCARCDVEIHAANKLANKHQRLPLEALSARLPRCDVCQEKAAFIFCVEDRALFCRDCDEPIHVPGTLSGNHQRYLATGIRVGLASASACGDASDAHDSDHHHAPPKATVEPAVSAAAQQVPSPPPFLPQGWAVDDLLQFSDYESGDKLQKESPLGFKELEWFADIDLFHDQAPPKAGRALAEVPELFGSQAASDAAYYRPSKAGAGLRQSKKARIEVTDDEDDYLIVPDLG

SEQ ID NO: 329 - DNA, 1124 bp, Panicum virgatum
  misc_feature: Ceres CLONE 1724594
  misc_feature: Encodes the peptide sequence at SEQ ID NO. 330
gcagcagaaactccagcgatcccagcccgcacaagcgagcgcgattcctctcctccgccctcccccgagctcccgcggcagccatggagaccctcctctccccctccacattgttcaccccactccgcggctcccggagaccggccctcgctgctgccgccaccgtctcgaccaggcccgccgccgtctcctgcgcgctcaagaagccgcaagcgggtctcgccgccgcttcctcctcccatggagttggagaccccggcgccgtcggcggcaggagctgggtgtcgttcctgcaccacggcctggcggcggccgcgctgtcgctggccatcagcctggcgcccgcgcccgcgccggcggcggcgtcggagttcgacgtgctgaacgacgggccccccgtggactcgtacgtggtggacgacgccggcgtgctcagccgcgtgaccaagtccgacgtcaagcggctggcgcgcgacctcgaggcccgcaagaacatccgcctcaacttcatcaccgtccgcaagctcacgagcaaagccgacgcgttcgagtacgcggaccaggtgctggagaagtggtacccgacgattgaggagggcagcaacaagggcatcatcgtgctcgtcaccagccagaaagagggcgccgtcaccggcggcccggccttcatccaggccgtcggcgagcagatcctcgacgccaccgtgtccgagaacctcccagtgctcgcgacggacgagaagtacaacgaggcgatcttcagcacggcgaggcggctggcggcggcgatcgacgggctgccggacacgggcggcccgtcgttcaaggagaacaagcgggagtccaacttcaagaccaaggaggagacggaggagaagcgcgggcagttcacgctcgtcgtcggcggcctgctcgtcatcgccttcgtcgtgcccatggcgcagtactacgcctacgtgtccaagaagtgagtcgagccatggcgctctgtacagtaattttacaccgatcgaggaggaagagttcgtctccccgagggtgatcgagcttcttctgttgggagggattcttagaggtgaatacaagtgcaagacagtgccggttaaaaaaaaaaaaaaaaaaaa

SEQ ID NO: 330 - protein, 295 aa, Panicum virgatum
  misc_feature: Ceres CLONE 1724594
  misc_feature: Great-hit functional homolog of the protein sequence given in SEQ ID NO 9543
  misc_feature: Useful for biocontainment applications
  misc_feature: The plant produces a reduced number of seeds.
METLLSPSTLFTPLRGSRRPALAAAATVSTRPAAVSCALKKPQAGLAAASSSHGVGDPGAVGGRSWVSFLHHGLAAAALSLAISLAPAPAPAAASEFDVLNDGPPVDSYVVDDAGVLSRVTKSDVKRLARDLEARKNIRLNFITVRKLTSKADAFEYADQVLEKWYPTIEEGSNKGIIVLVTSQKEGAVTGGPAFIQAVGEQILDATVSENLPVLATDEKYNEAIFSTARRLAAAIDGLPDTGGPSFKENKRESNFKTKEETEEKRGQFTLVVGGLLVIAFVVPMAQYYAYVSKK

SEQ ID NO: 331 - DNA, 1242 bp, Panicum virgatum
  misc_feature: Ceres CLONE 1724608
  misc_feature: Encodes the peptide sequence at SEQ ID NO. 332
attcctctctctctctctctgtctctctctacctccgcgcgcgtccaggcgaccgggcggggcgaaccctagccgagattagattggaggcgagcgccaccaccggcggaggaggacgacgacgacaagatgctgagggttgcggggaggaggctctcgtcttccctctcctggcgccccgccgcggcggctgccaggaacccgctcgccggcgctggcgcccccggcggggacgacgactccgcccgcggccggagccagccgcggttctccatggagcaccccttcttcgccgccgccaggggtttctcttcaactgaaacacttgtaccaaggaaccaagatgctggtcttgctgacctcccagcaactgtggctgctgtgaagaaccctaacccaaaggtggtttatgatgagtacaaccatgaaagatatcctcctggagatcccagcaagcgtgcctttgcttactttgtcctgagtggtgggaggttcatttatgcatcactgctgcgtctcctcatattgaagtttgtcctgagcatgtcagcaagtaaggatgtgcttgccctcgcttcgctcgaggtggacctctccagcatcgaaccaggcaccacggtgaccgtgaagtggcgtaggaagccggtcttcatcaggcgccggactgagaacgacattaagctggccaacagtgtggacatcgcgtccctgcgccacccagagcaggacgcagagcgcgtgaagaatcctgagtggctggtggtcattggcgtctgcacccacctcggctgcatcccgctcccgaacgccggagactttggtggctggttctgcccatgccacggctcccactacgacatctccgggaggatccgcaagggacctgcaccgttcaacctcgaggtgcccacctacagtttcttggaggagaacaagctgctcgtaggctaagagctcggaaagcaccgcttattttatctaccgtaatccgcagaggtgaatccctgctgtgctgttatattgtttcttttttttgttgggttggcaaaaatttttgtttcgtgggagtcagggccatgccatgatggttcactgccatctaccaaagtgaatttttgtcaagtaaaaataatttgccactatcgtgctactgaaatgtaagttggaaatgaattgggaacttcattttttccgaggtaatgtagggagggcattggatgccaaaaaaaaaaaaaaaaaaaa

SEQ ID NO: 332 - protein, 273 aa, Panicum virgatum
  misc_feature: Ceres CLONE 1724608
  misc_feature (1)..(273): SWISSPROT Homolog: EC 1.10.2.2 Ubiquinol-cytochrome c reductase iron-sulfur subunit 3, mitochondrial precursor
  misc_feature (1)..(273): SWISSPROT Homolog: EC 1.10.2.2 Ubiquinol-cytochrome c reductase iron-sulfur subunit, mitochondrial precursor
MLRVAGRRLSSSLSWRPAAAAARNPLAGAGAPGGDDDSARGRSQPRFSMEHPFFAAARGFSSTETLVPRNQDAGLADLPATVAAVKNPNPKVVYDEYNHERYPPGDPSKRAFAYFVLSGGRFIYASLLRLLILKFVLSMSASKDVLALASLEVDLSSIEPGTTVTVKWRRKPVFIRRRTENDIKLANSVDIASLRHPEQDAERVKNPEWLVVIGVCTHLGCIPLPNAGDFGGWFCPCHGSHYDISGRIRKGPAPFNLEVPTYSFLEENKLLVG

SEQ ID NO: 333 - DNA, 1362 bp, Panicum virgatum
  misc_feature: Ceres CLONE 1724616
  misc_feature: Encodes the peptide sequence at SEQ ID NO. 334
gcatgagctccgcctcctccccgtcccccgccgatccaccgcaaaccctagccccgacctgacctccggcgggcttgccggtcagagagggagtcgcccacccccacccccaggcctgcctctgccgccacgggcgtggggcgcgggcggcgggcgagatgccatcgcacggggatctggaccggcagatcgcgcagctgcgcgactgcaagttcctgcccgaggcggaggtcaaggcgctctgcgagcaggccaaggccatcctcatggaggagtggaacgtgcagccggtccgctgccccgtcaccgtctgcggcgacatccacggccagttctacgacctcatcgagctcttccgcatcggcggcgacgcgcccgacaccaactacctcttcatgggcgactacgtcgatcgtggctactattcagtggaaacggtttctctgctagtggctttgaaagtccggtacagagatagaattacaatacttagaggaaatcatgagagcagacaaatcactcaagtgtatggcttctatgatgaatgcttaagaaaatatggaaatgcaaatgtgtggaagtactttacagacctgtttgattgtttgcctctcacagctcttatagaaaatcaggtcttctgtcttcatggtggcctctctccatcattggatacattggataacattcgttctcttgatcgcatacaagaggttcctcatgaaggaccaatgtgtgatcttttgtggtctgacccggatgaccgatgtggttggggaatttcaccaagaggagcaggttacacatttgggcaagacattgcacaacaattcaaccatacaaatggtctctctctcatttcaagggcccatcaacttgtaatggaaggattcaattggtgccaggataagaatgttgtaaccgtcttcagtgcgccgaactattgctaccgctgtggtaacatggctgcaattcttgaaatcggtgagaatatggaccagaacttcctccaattcgatcctgcgcctcggcaaattgagccggacacaactcgcaagaccccagactactttttgtaattgtggtgacctttttaacttacgggtgttgatgctcctctcttctgcagcgtcagggtctgtagatcttatgtccttagatatgggtttcgtgagcccgagctgtatgtctcccaattcttttgtttggagattttgttgtactttgactttatattatttgtagacagtgaagggaagttgcagtaggatcgccctgcgattgtttttttattttcgtctaaaacatgtggtaagaatcaccatatcgcctacctggctgaataaatttctgttcggacgg

SEQ ID NO: 334 - protein, 306 aa, Panicum virgatum
  misc_feature: Ceres CLONE 1724616
  misc_feature (1)..(196): Pfam Name: Metallophos Pfam Description: Calcineurin-like phosphoesterase
  misc_feature (1)..(306): SWISSPROT Homolog: EC 3.1.3.16 Serine/threonine-protein phosphatase PP2A-1 catalytic subunit
  misc_feature (1)..(306): SWISSPROT Homolog: EC 3.1.3.16 Serine/threonine-protein phosphatase PP2A-3 catalytic subunit
MPSHGDLDRQIAQLRDCKFLPEAEVKALCEQAKAILMEEWNVQPVRCPVTVCGDIHGQFYDLIELFRIGGDAPDTNYLFMGDYVDRGYYSVETVSLLVALKVRYRDRITILRGNHESRQITQVYGFYDECLRKYGNANVWKYFTDLFDCLPLTALIENQVFCLHGGLSPSLDTLDNIRSLDRIQEVPHEGPMCDLLWSDPDDRCGWGISPRGAGYTFGQDIAQQFNHTNGLSLISRAHQLVMEGFNWCQDKNVVTVFSAPNYCYRCGNMAAILEIGENMDQNFLQFDPAPRQIEPDTTRKTPDYFL

SEQ ID NO: 335 - DNA, 1062 bp, Panicum virgatum
  misc_feature: Ceres CLONE 1724625
  misc_feature: Encodes the peptide sequence at SEQ ID NO. 336
aatcctcccccagcccaaactcgaacgcgatcctgagcaaaaatacatccgcggcaagcgcgcgcttccgcttccaatcctccgtacagccaggcagccagctcgaccgatctcgatccatggcgccgaggaggcccccttcgccggccggaagcagcagcagggatgagcgcgcggcggcggagcagcggcagcagccgaggctccgcggcgtgcggcggcggccgtggggccggtacgcggcggagatccgcgaccccgtccgcaaggcgcgcgtgtggctgggcaccttcgacacccccgaggaggccgcgcgggcctacgacgccgccgcgcggcggctccgcgggccacgcgccgccaccaactacccggccgcggcgggcgaggcgccgtcctcgtccgcggccgacgactcgcggccagcgacgccgccactgccggctcgtcggtcgccgtacctgttcctggacccggagccgccgacgacgacgacggtggtgcccgccgcgccggcgatgcggcatcagctcctgccgccgaagggcgaggaggagcggagccgctgctaccccggggagtcggtgcgcctggggctggacctcaacctgcccccgccggccgagatggtgatgtagccacggaaatggagccgcccaagatgattaacgctaatgggttaccactgctgcgcattagctagctgatgctcgttaaggcgtcatcagctggcagctagccccgcgcaaacaatgtaaatagtactcctactaggcagctagctagctcctagttcgtgtggtcgtgttgttactagaaatggtcgcggcggccagtgtggtgcgtagtatgttgcttggcagttttttgaagtctgtcttcgtgtttggacatctacgtgcccccttggctggcaccacttttgtctggcatgtcgcgcgctgtgtggatccacaggcgctaactggcacggcagatgcaggaagctgagtcgaatccatcactttgtttgtttcacattcatgtttatagttcgtggaccaaaaaaaaaaaaaaaaaaaa

SEQ ID NO: 336 - protein, 172 aa, Panicum virgatum
  misc_feature: Ceres CLONE 1724625
  misc_feature (1)..(62): Pfam Name: AP2 Pfam Description: AP2 domain
MAPRRPPSPAGSSSRDERAAAEQRQQPRLRGVRRRPWGRYAAEIRDPVRKARVWLGTFDTPEEAARAYDAAARRLRGPRAATNYPAAAGEAPSSSAADDSRPATPPLPARRSPYLFLDPEPPTTTTVVPAAPAMRHQLLPPKGEEERSRCYPGESVRLGLDLNLPPPAEMVM

SEQ ID NO: 337 - DNA, 1179 bp, Panicum virgatum
  misc_feature: Ceres CLONE 1724632
  misc_feature: Encodes the peptide sequence at SEQ ID NO. 338
gcgcggtcgctgccacatctccccaaactcctgtgtggctagcttctgctgcactgccgccgctccctcctccacatctccccccgccgccagggccgccgcccgccgcggccgcagcgctgggaggggatcgccgggcagaggcgcgaggcgggggaggaggagccgcggcttcgtcgcccggatggcggcggggcgatgacgctggcggcgggagcggagggtgttgggatgcggacgatctgcgatgtgtgcgagggcgcgccggcggtgctcttctgcgcggccgacgaggccgcgctctgccgggcctgcgacgagaaggtacacatgtgtaacaagcttgctagtcggcatgtgagagttggacttgcaaactctaataaacttgcccgctgtgatatatgtgaaatttttcctgctttcttccactgtgagatagatggcacctcactttgcctgagctgtgacatgactgttcatgttggtggcaaacgaacccatggaagatacctgctcctaaggcaaagtgttgaatttccaggagataaactaggccatatggatgatgatgtggctatgcaaagcaaagatcctgaaaaccagatagatcagaagaagcctcctcattcagcaataaaggagcaaatggcaaaccaccatagtagctctgatgatccagcatctaatggaaactgcgatgaccagttgaaccttaattcgaaaatgatcgaccttaatatgcgaccggttcgtaccaatggacaaggatcaaattcccagactcagggtgtggatgttagcatgaacaaccatgactctcctggggtggtgccaacaagtaattacgaaggagatgccaacaagtaaacactggaagttcggaatgtacatttcttcatatacatatatactgctctagcagctcaggagggcagaatacggtggggttagcattggcatctctgttactattgctatagtagtacatttctggcagagttggagctaacattactgcatctcgatcaattcggcttgtcgtgcccaagatctatttattgtgaggtcaattctcgtcgcgattgtcagaactcatgtaacttgccacaatgctgctgttatagatgcgcagtggctgtcacctgtgctttggagtaaaaaaaaaaaaaaaaaaaa

SEQ ID NO: 338 - protein, 223 aa, Panicum virgatum
  misc_feature: Ceres CLONE 1724632
  misc_feature (1)..(47): Pfam Name: zf-B_box Pfam Description: B-box zinc finger
  misc_feature: The sequence is a functional homolog of  SEQ ID NO 1300 in the  11/479,226 US patent application
  misc_feature: The sequence is a functional homolog of  SEQ ID NO 602 in the  10/412,699 US patent application
  misc_feature: Useful for making plants with modulated growth and phenotype characteristics
MTLAAGAEGVGMRTICDVCEGAPAVLFCAADEAALCRACDEKVHMCNKLASRHVRVGLANSNKLARCDICEIFPAFFHCEIDGTSLCLSCDMTVHVGGKRTHGRYLLLRQSVEFPGDKLGHMDDDVAMQSKDPENQIDQKKPPHSAIKEQMANHHSSSDDPASNGNCDDQLNLNSKMIDLNMRPVRTNGQGSNSQTQGVDVSMNNHDSPGVVPTSNYEGDANK

SEQ ID NO: 339 - DNA, 1182 bp, Panicum virgatum
  misc_feature: Ceres CLONE 1724642
  misc_feature: Encodes the peptide sequence at SEQ ID NO. 340
atcttccaggtcgcagcgcagcaaggaggagagagcgaggcgaagcgcagcgctgaagccactagcagagcagcagcagcagccgagtcatggcggccaagggcgccgcgccggcggtggcgctgagcagcggccaccggatgcccgcggtggggctgggcgtctggcggatggagaagcccgccatccgcaccctcatcctctccgcgctccgcatcggataccgccacctcgactgcgccgctgactatcagaatgaagccgaagttggtgatgcacttgcagaggcattccaaactggacttgtcaaaagggaggatctgttcatcacaaccaagctgtggaattcagatcatggtcatgtaattgaagcctgtaaggatagcttgaagaagctgcagctagattatcttgatctctatcttgttcacttcccagtagctactagacatactggagttggtacaacttctagcgctctcggtgatgatggtgtgcttgacattgataccactatctcattggaaacaacatggcatgcaatggaagaacttgtttctatgggactggtccgcagcattgggatcagcaactacgacatcttcctcaccagggactgcttggcctacgctaagataaagcctgcagtgaaccaaattgagacgcacccctacttccagcgtgattcccttgtcaagttctgccagaagcatgggatctgtgtcacagcgcatacccccttgggtggttccactgccaacaccgagtggttcgggtcagtctcatgccttgacgaccctgtcatcaagagcttggctgagaagtacggcaagacacctgcgcagcttgtcctccgctggggcctccagaggaacacggtggtgatccccaagacctccaaggttgagaggctgcaggagaactttgaggtctttgatttcgagatctcgagcgaggacatggagaagatcaaggccattgacaggaactaccgaaccaaccagcctgccaagttctggggcatcgacctgtatgcttagttcacttgcattgcgcctgagctttcatgtgtgtgcacatttctgaataattgttgcataccctgccccacccccacccccaatacatacggcatcaataatgaggatctcctcttttccagaaaaaaaaaaaaaaaaaaaa

SEQ ID NO: 340 - protein, 316 aa, Panicum virgatum
  misc_feature: Ceres CLONE 1724642
  misc_feature (1)..(288): Pfam Name: Aldo_ket_red Pfam Description: Aldo/keto reductase family
  misc_feature (10)..(316): SWISSPROT Homolog: EC 1.1.1.200 NADP-dependent D-sorbitol-6-phosphate dehydrogenase
MAAKGAAPAVALSSGHRMPAVGLGVWRMEKPAIRTLILSALRIGYRHLDCAADYQNEAEVGDALAEAFQTGLVKREDLFITTKLWNSDHGHVIEACKDSLKKLQLDYLDLYLVHFPVATRHTGVGTTSSALGDDGVLDIDTTISLETTWHAMEELVSMGLVRSIGISNYDIFLTRDCLAYAKIKPAVNQIETHPYFQRDSLVKFCQKHGICVTAHTPLGGSTANTEWFGSVSCLDDPVIKSLAEKYGKTPAQLVLRWGLQRNTVVIPKTSKVERLQENFEVFDFEISSEDMEKIKAIDRNYRTNQPAKFWGIDLYA

SEQ ID NO: 341 - DNA, 1182 bp, Panicum virgatum
  misc_feature: Ceres CLONE 1724652
  misc_feature: Encodes the peptide sequence at SEQ ID NO. 342
atcttctccccttcttctctcccaaccaagaagaaagacaagagaagaaagagagagagagcgagcgagcaagtaggaataatggcgtccgacggcaacggcagcggcgtggtcaccgtctacggcaacaacggcaccaccctgctggagccctccaagcagtccaagtcggccactttctccgtcaaggtgggcctggcgcagatgctgcgcggcggcgtcatcatggacgtcgtcacgccggagcaggcgcgcatcgccgaggaggccggggcctgcgccgtcatggcgctggagcgcgtccccgccgacatccgcgcgcagggcggcgtggcgcgcatgtccgacccgggcctcatccgcgacatcaagcgcgccgtcaccatcccggtcatggccaaggcgcgcatcggccacttcgtcgaggcccagatcctggaggccatcggcgtcgactacgtggacgagagcgaggtgctcacgctcgccgacgacgcgcaccacatcaacaagcacaacttccgcgtccccttcgtgtgcggctgccgcgacctcggggaggcgctgcgccgcatccgcgagggcgccgccatgatccgcaccaagggggaggccggcacgggcaacgtcatcgaggccgtgcgccacgtccgctccgtcatgggcgacatccgcgcgctgcgcaacatggacgacgacgaggtcttcgcctacgccaagcgcatcgccgcgccatacgacctcgtcatgcagaccaagcagctgggccgcctccccgtcgtccagttcgccgccgggggagtcgtcacgcccgccgacgccgcgctcatgatgcagctcggctgcgacggcgtcttcgtcggctcgggaatcttcaagagcggcgaccccgcgcgccgcgcccgcgccatcgtccaggccgtcacgcactacagcgacccggaggtcctcgccgacgtcagctcagggctcggggaggcaatggtcgggatcaacctctccgacccaaaagtggagcgctacgccgcgcgctccgagtagctagcgcgcgccttccaccgccatcgccatcaccatcaccatcacccgggttgacgttttacattacaacaagaaaagaaacaaaactcaaataataatctctaccattcccttcctttttaaaaaaaaaaaaaaaaaaaa

SEQ ID NO: 342 - protein, 319 aa, Panicum virgatum
  misc_feature: Ceres CLONE 1724652
  misc_feature (1)..(38): Pfam Name: IGPS Pfam Description: Indole-3-glycerol phosphate synthase
  misc_feature (1)..(47): Pfam Name: Trp_syntA Pfam Description: Tryptophan synthase alpha chain
MASDGNGSGVVTVYGNNGTTLLEPSKQSKSATFSVKVGLAQMLRGGVIMDVVTPEQARIAEEAGACAVMALERVPADIRAQGGVARMSDPGLIRDIKRAVTIPVMAKARIGHFVEAQILEAIGVDYVDESEVLTLADDAHHINKHNFRVPFVCGCRDLGEALRRIREGAAMIRTKGEAGTGNVIEAVRHVRSVMGDIRALRNMDDDEVFAYAKRIAAPYDLVMQTKQLGRLPVVQFAAGGVVTPADAALMMQLGCDGVFVGSGIFKSGDPARRARAIVQAVTHYSDPEVLADVSSGLGEAMVGINLSDPKVERYAARSE

SEQ ID NO: 343 - DNA, 1018 bp, Panicum virgatum
  misc_feature: Ceres CLONE 1724663
  misc_feature: Encodes the peptide sequence at SEQ ID NO. 344
aacagaagccaccggcaaagagagcctctgccgattcagtagcaattctctggttggtgttcgtcacttgatctcagctgctgtgtgtgtgtgtctgggaagaaacaaggagaggggagagatggcttgccctgcgcagtacatgctctcgtccagcggctgcatcttcctggggagcagcaagcctcaggcgagcctcgtccgaggcgccgtcaccggcggcgtcagcggcagcaggccgttcctgctcacctgcagcgcctcgtcgtctccgtccccttcctcgccagcgccggcgcaggaggactccgactgcaacgaggaggagtgcgccccggagaaggaggtcgggagcctgagcgccgagtggctggcggaggagcggacccgggtcgtcggaaccttcccgcccaggaagagagggtggaccggcctcgtcgagaaggacaccgccggccagaccaacatctactccgtcgagccgacggtgtacgtggcggagagtgccatcagctccggcacggcgggcacgtcggcggagggggccgagaacacggccgccatcgcggcggggctcgtcctcatcaccgtcgccgcggcgtcgagcatcctcatccaggtgagcaagaagcagccgcaggtgcccgaggccgcctacagcggcccgccgctcagctactacgtcgccaagttccagcctgcggtggaagcgccggcgccggcggagcccctcgaggcccccgcccccgcggaggcggcggtcgtcgcccaggacacccccgccatcgaggcttctgcgccggcaccggaggctgatctgctgtcctcgtgagctcgtgttgtagtcaagattcagttttcgtggcagcttacacacatgagcttgtagtgaatgatatggtggaagagaatacagatggtcctcgtgagcatttccgaattgtaaaactttcgtgcatgtatatacagtgcattcagcatgcctatatgcttgtatgaaaaaaaaaaaaaaaaaaaa

SEQ ID NO: 344 - protein, 236 aa, Panicum virgatum
  misc_feature: Ceres CLONE 1724663
  misc_feature: Great-hit functional homolog of the protein sequence given in SEQ ID NO 9318
  misc_feature: Useful for making plants with modulated flowering time
  misc_feature: The plant flowers significantly late compared to wild-type.
MACPAQYMLSSSGCIFLGSSKPQASLVRGAVTGGVSGSRPFLLTCSASSSPSPSSPAPAQEDSDCNEEECAPEKEVGSLSAEWLAEERTRVVGTFPPRKRGWTGLVEKDTAGQTNIYSVEPTVYVAESAISSGTAGTSAEGAENTAAIAAGLVLITVAAASSILIQVSKKQPQVPEAAYSGPPLSYYVAKFQPAVEAPAPAEPLEAPAPAEAAVVAQDTPAIEASAPAPEADLLSS

SEQ ID NO: 345 - DNA, 1466 bp, Panicum virgatum
  misc_feature: Ceres CLONE 1724682
  misc_feature: Encodes the peptide sequence at SEQ ID NO. 346
aagctcgggggagctcggctcattgacagcccttcccccctcgggctcatctctgaactctctcctcgcccttggctctttgctcttccttccctggcggcggcggctgcgcgagcggcagcgccattccgtcacgtcttggcccagccccctctgccggcggcgagcatccaccagaagacttcagggggtttcgcaacgatgtcctggtgcacgattgagtctgaccctggtgttttcaccgagttgattcagcaaatgcaagtgaaaggtgtgcaggtggaagagctttactctcttgatgtggactctcttagcgaactgcggccagtatacgggctaatttttctcttcaagtggatacctggggaaaaggatgaacggcctgttgtcagagatcctaatccaaaccttttctttgctcagcaagtcatcaataatgcatgtgctactcaagctattctctcagttctcatgaatcgcccagaaattaacataggtccagaactatctcaactgaaggaatttacaggagctttcacacctgatctgaggggcttagctatcagcaacagcgaatctattcggacagctcataacagttttgctaggccagagccgttcatttcagatgagcagagagcagcgactaaggatgatgatgtgtaccatttcataagttatttaccttttgaaggtgtcctctatgagctggatgggctgaaggaaggacctgtgaaccttgggcagtgcgatggttctgatgaccttgattggctacggatggtgcagccagttattcaagaaaggatcgaacgctattcacagagtgagattaggttcaatctcatggcaattataaagaataggaaagaggtgtacagtgccgagctggaggaactggagaagagaagggagcaaattttgcaggagataaacaatacttctgccacagaatccttgaacaactcgcttacagaggtgatatcagcaattgagacagttagcgagaagatcatcatggaagaagagaagtttaagaagtggaagacggagaacatccggaggaagcacaactacatcccgttcctgttcaacctgttgaaggtgctcgcagagaagcagcagctaaaacctctggtcaagaaggccaaacagcaaaagtcttcaagctctggcactaaatgatggtgaaatgtcataggctggtagattgatgtatcaggtgcctagggttcattgtaccttcgtctctacaagcgcattacctgatagttggcagcttagagaaatcattgctaaggttatggaccatcttgctcgctgcggtgtgttgtcaactgcgccagttttggtgagcacgcacgttgtggaaacggtcaaattggttgtttattttgtcaagttattttttctggattatagaatgtgttgaaggttgtggatcaaaaaaaaaaaaaaaaaaa

SEQ ID NO: 346 - protein, 328 aa, Panicum virgatum
  misc_feature: Ceres CLONE 1724682
  misc_feature (1)..(207): Pfam Name: Peptidase_C12 Pfam Description: Ubiquitin carboxyl-terminal hydrolase, family 1
  misc_feature (3)..(323): SWISSPROT Homolog: EC 3.4.19.12 Ubiquitin carboxyl-terminal hydrolase isozyme L5
MSWCTIESDPGVFTELIQQMQVKGVQVEELYSLDVDSLSELRPVYGLIFLFKWIPGEKDERPVVRDPNPNLFFAQQVINNACATQAILSVLMNRPEINIGPELSQLKEFTGAFTPDLRGLAISNSESIRTAHNSFARPEPFISDEQRAATKDDDVYHFISYLPFEGVLYELDGLKEGPVNLGQCDGSDDLDWLRMVQPVIQERIERYSQSEIRFNLMAIIKNRKEVYSAELEELEKRREQILQEINNTSATESLNNSLTEVISAIETVSEKIIMEEEKFKKWKTENIRRKHNYIPFLFNLLKVLAEKQQLKPLVKKAKQQKSSSSGTK

SEQ ID NO: 347 - DNA, 1180 bp, Panicum virgatum
  misc_feature: Ceres CLONE 1724685
  misc_feature: Encodes the peptide sequence at SEQ ID NO. 348
atcggcagcagcaacagcatcagcatcaggttcaggttcagcttcagcttcagcacaggagaggtgaagcgcggccgcatttccagcgcggctgctccggcggacatggcgaccgacagcgccctgaggaagctggcgccgctggaagccatcctgttcgacatcgacggcaccctctgcgactccgaccccatccacttctccgccttccgcgagctcctgcagcagattggtttcaacgacggtgtccccatcaccgaggagttctacagcgccaacatcagcggcgggcacaacgacgacctcgcccggtctctgttcccggacatggatcaccagaaggctatccagttcatggatgacaaggaggcgttcttcagaaagctggcaccaggacagttgaaggccgtggatgggctgcacgacctctgcagacggatcgaaggccgcaacctgaagcgtgcggcggtgacgaacgctccaagggcgaacgccgagctgatgctgtcactgctggggctcacagacttcttcccggtgctcgtcatcggaagcaagtgcgaccgggccaagccgttccctgacccttacctcaaggccctcgagctcatcggcgcatcgcctgaccacaccttcatatttgaagactctgcatcagggatccgagctggtgtggctgcaggcatgcctgtggttggcctgacgactaggaaccctgggaaggctctcagcgatgcaggagcgagcttactgatcaacgattttcaggacccgaagctgctgtccgtgctggaagagctcaaacccgtgacggaaaatgggcaaatctgattggtgaagggtgatcgcaatcataataagaatgtcatgctggaaaaatacattgcactgcagaataactctgaatcctgggctggaacctggaagtgagcatggatctgtgcagaagctggtgcctgctgcagtggctccttgcattcaactagcattgcggcgaagctcctggtcctccatgatatcagcttatgtcgccaaccttttttttttataacgcattgatttaaataaaggttttatgccagtcattgcatttgagggaaacttcatgtgccaacactaacgccctatttaatttggtgcgtgaaatagtttcttcagacaaaaaaaaaaaaaaaaaaaa

SEQ ID NO: 348 - protein, 241 aa, Panicum virgatum
  misc_feature: Ceres CLONE 1724685
  misc_feature (1)..(190): Pfam Name: Hydrolase Pfam Description: haloacid dehalogenase-like hydrolase
MATDSALRKLAPLEAILFDIDGTLCDSDPIHFSAFRELLQQIGFNDGVPITEEFYSANISGGHNDDLARSLFPDMDHQKAIQFMDDKEAFFRKLAPGQLKAVDGLHDLCRRIEGRNLKRAAVTNAPRANAELMLSLLGLTDFFPVLVIGSKCDRAKPFPDPYLKALELIGASPDHTFIFEDSASGIRAGVAAGMPVVGLTTRNPGKALSDAGASLLINDFQDPKLLSVLEELKPVTENGQI

SEQ ID NO: 349 - DNA, 1328 bp, Panicum virgatum
  misc_feature: Ceres CLONE 1724700
  misc_feature: Encodes the peptide sequence at SEQ ID NO. 350
gctcagcccgttttattcgctcccctcccccccatctccccgagcagaagaaatccagcagaggacggagcgagagctagggttttgattccggccgcgcgccgcctccccccgccctccctcccacacctcacccggcggcgtcggcgggcgaaggctcggggagacaccaaggccgggagagcctgaagcggcgtgccctccacccaatcgcagaccccccccccccccccccccgcgccgcgagagttgcaattgcactattggagtttgcccacttggttgttcatcgaacaatttaaatatgtcatattacgcaagaaggggtggagataggggtagtggccgtatccaaggaagtggtgggcgaggtggctatgccatgcgtggaagatcaggactgcctcctcgaggacctcttggtgttagctcccgaccatctgcacgcactattgctaagtcgtttagcagaaccaaagacatgacttggagacctgatctatttagtgatagtatggcggctagtggaatagaaactggtacaaaattgtacatttcaaacttggattatagggtttctaatgaggatataaaggagctgttttcagaagttggtcatttgaaacgctttgctgttcactatgatggttatggccgcccaaatggcactgcagaggtggtgtttacacggaggagtgatgcaatcgctgccctgaaacgttataataatgttctacttgatggtaaagctatgaagatagaagtcattggaagtgacttaggcttgcctatgacacctcgtataaatgttgttggggcatctaatggcagagctacaagaacagttgttatgacgcctgagtttagtcaacgtggcagaggttcaagcagtagacctttaagtaatccgagcaacaggtttaacaaccgtggtggtttccaaactggtcgaggccgtgcccagttccaggcccgtggcaggggccgtgcccagttccagagccggggcaggggccgcggccaattccagggccggggcagagggaggaagcctgagaagactgctgatgagctggataaagacctggaaagctaccacgcggaggccatgaaaaccgattgatggcaatgatggtgcttcctttcatgtctctactggaagattgtggtgtagccgtttgcgttgtattattttctgggagcatattacatctgtctcctttggtttgaggaaactattccccttacccatagtgatctcgaatgaaaaaccgccctagtgtctagtatctaatgattgccttaaaactcgcaacctgatagtgttt

SEQ ID NO: 350 - protein, 272 aa, Panicum virgatum
  misc_feature: Ceres CLONE 1724700
  misc_feature: Great-hit functional homolog of the protein sequence given in SEQ ID NO 9510
  misc_feature: Useful for making plants with altered alkaloid content
MSYYARRGGDRGSGRIQGSGGRGGYAMRGRSGLPPRGPLGVSSRPSARTIAKSFSRTKDMTWRPDLFSDSMAASGIETGTKLYISNLDYRVSNEDIKELFSEVGHLKRFAVHYDGYGRPNGTAEVVFTRRSDAIAALKRYNNVLLDGKAMKIEVIGSDLGLPMTPRINVVGASNGRATRTVVMTPEFSQRGRGSSSRPLSNPSNRFNNRGGFQTGRGRAQFQARGRGRAQFQSRGRGRGQFQGRGRGRKPEKTADELDKDLESYHAEAMKTD

SEQ ID NO: 351 - DNA, 1272 bp, Panicum virgatum
  misc_feature: Ceres CLONE 1724723
  misc_feature: Encodes the peptide sequence at SEQ ID NO. 352
gttgaacacaactgaacaagtgtatccctgcggttgctgcgtctcgcacacagaggagaggagaggagaggagagggctggggcgggaggagccgaggaggtagagatggaggtcggcttcctggggctgggcatcatgggcaaggcaatgacgaccaacctcctccgccacggctaccgcgtcaccgtctggaaccggaccaccgccaagtgccaagagctcgtcgcgctcggcgccaccgtcggggagacgcccgccgccgtcgtcgccaagtgcagatacaccatcgccatgctctccgaccccagcgccgccctatccgttgtcttcgacaaggatggcgtgctcgagcagatcggggatggcaaaggctatatcgacatgtccactgtcgatgccgcaacttcttcaaagattagtgaggcagttaaacgaaaaggcggcgctttcattgaagctcctgtttcagggagcaagaaaccagctgaagatggtcaattggtcattcttgctgccggggacaagacattgtatgatgaaatggttcctgcatttgatgtacttgggaaaaagtcattctttttgggagagattggaaatggagcgaagatgaagcttgtggtcaacatgatcatgggaagtatgatgaattctttgtctgagggactctgtttggccgacaaaagtgggttgagcccccagacgcttctcgacgtactggacctcgacgccattgcaaacccaatgttcaagctgaaggggcctgcaatgctgcagggcagctacagccctgcgtttcctctgaaacatcagcagaaggacatgaggttagctcttgccctgggagatgaaaacgccgtgtccatgccggtctcagcagctacgaatgaggcattcaagaaggccagaagcctggggctgggggacctagatttctcggcggtctatgaggtagcgaaggacgcaggtggctcaggacaggcgtgataggcaatcagtggtctcatttggatgctagatttgcagcagtgtctctcgttcattgtaaggcaattggctcgtcatcatagcgtgtgtatatccaggatctggagccccgacctcgctgaaaaaataaatcagcatttgatggtttgcttgcacgatagatgttactggaagctgggaactagctgattgcatcacgaatgattttttttgacctgcctcagcagattgaaaacatacaagaaatggcactatcttctccttaaaaaaaaaaaaaaaaaaaa

SEQ ID NO: 352 - protein, 293 aa, Panicum virgatum
  misc_feature: Ceres CLONE 1724723
  misc_feature (1)..(162): Pfam Name: NAD_binding_2 Pfam Description: NAD binding domain of 6- phosphogluconate dehydrogenase
MEVGFLGLGIMGKAMTTNLLRHGYRVTVWNRTTAKCQELVALGATVGETPAAVVAKCRYTIAMLSDPSAALSVVFDKDGVLEQIGDGKGYIDMSTVDAATSSKISEAVKRKGGAFIEAPVSGSKKPAEDGQLVILAAGDKTLYDEMVPAFDVLGKKSFFLGEIGNGAKMKLVVNMIMGSMMNSLSEGLCLADKSGLSPQTLLDVLDLDAIANPMFKLKGPAMLQGSYSPAFPLKHQQKDMRLALALGDENAVSMPVSAATNEAFKKARSLGLGDLDFSAVYEVAKDAGGSGQA

SEQ ID NO: 353 - DNA, 1106 bp, Panicum virgatum
  misc_feature: Ceres CLONE 1724733
  misc_feature: Encodes the peptide sequence at SEQ ID NO. 354
atcgccgccagtcacccaccccccaggcccccacaacactcgagagaccctcccaaagtcccaaaggccgccgccgccgccgccatggccgcgcagaccttcctcttcgcgccgcccgccgccctcttcgccgccccctcttcctccgcacgccctttccactcgctccgcctcgtcgctgggcccgggggtgccgccgccgccagggcgctcgtcctcgccgacgccaccaagaaggccgtcgccgtcctcaagggcacatccgaggtcgagggcgtcgtcacgctcacgcaggaggacgacggaccaaccactgtcaacgtccgtgtcactggacttactcctggacttcatggcttccaccttcacgagtttggcgataccaccaatggatgcatatccacaggaccacatttcaacccaaacaatttgacacacggtgcgccagaagatgaagtccgccatgcgggtgacctgggaaacattgttgccaatgctgagggagtcgctgaggcaaccattgttgataatcagattcctttgagcggcacaaattcagttgttgggagagcatttgtggttcacgagcttgaagatgatttggggaaaggcggccatgagcttagcctcagtactggaaatgctggtggaagactggcatgcggtgttgttggcctgactccattgtaggttgctcgctcgccggattgcagttgagacttccgtgtcacatccatggtggccttttggcttgaatcgtgctattggaggcagtgcctttttttgtattacttgaatttgcaccatgcatggtgtggtggttaatatatagcccttgcaggtcggtcggttggtcatattaaaaaaactaataattatctagctgaggaaaataagtgttgtcacatatcgtgaaggtcgatctatgaagcactatgaacatcaactctttactgccgtgttttgttgttgtaccagctgtaaaacttttgagcatgtgtttgttattgcattaagtgttactggacatccatcttaggtttatgtttaccatgcatataataagatgatgaatacctgcaagctaaaaaaaaaaaaaaaaaaaa

SEQ ID NO: 354 - protein, 201 aa, Panicum virgatum
  misc_feature: Ceres CLONE 1724733
  misc_feature (1)..(152): Pfam Name: Sod_Cu Pfam Description: Copper/zinc superoxide dismutase (SODC)
  misc_feature (1)..(201): SWISSPROT Homolog: EC 1.15.1.1 Superoxide dismutase [Cu-Zn], chloroplast precursor
MAAQTFLFAPPAALFAAPSSSARPFHSLRLVAGPGGAAAARALVLADATKKAVAVLKGTSEVEGVVTLTQEDDGPTTVNVRVTGLTPGLHGFHLHEFGDTTNGCISTGPHFNPNNLTHGAPEDEVRHAGDLGNIVANAEGVAEATIVDNQIPLSGTNSVVGRAFVVHELEDDLGKGGHELSLSTGNAGGRLACGVVGLTPL

SEQ ID NO: 355 - DNA, 1284 bp, Panicum virgatum
  misc_feature: Ceres CLONE 1724745
  misc_feature: Encodes the peptide sequence at SEQ ID NO. 356
gcattccccgcacatcggttgttcgatcgagtgcccagcaaagggtgtacgtcgcgacaatggcgaggcaacaggttgcttcttccatgcttgcagttgctctcatcgttgcctccattcctacagccgtggactccatcggcgtctgctacggcgtcgtgggcaacaacctcccgtccaggagcgacgtcgtgcagctctacaggtccaggggcatcaccggcatgcgcatctacttccccgacaggcaggccctcgacgccctccgcggctccggcatcgccctcatcctcgacaccggcaacgacgacaacgtcctcgcccggctcgcctccagcgcctccaccgccgcgtcgtgggtccagaccaacgtgcgcccctactacccggccgtcaacatgaagtacatcgccgtcggcaacgaggtccagggcgccgccgcgcaggcgaggatcctcccggcgatgcggaacctcgacgccgcccttgccgcggcggggctcggcggcagcattaaggtctccacgtcggtgcgcttcgacgccgtcgccagctcgttcccgccgtccagcggcgtgttcgcgcaggggtacatggccgacgtcgcgcggtacctggcgggcaccggcgcgccgctgctggccaacgtgtacccctacttcgcgtaccggggcaacccgcgcgacatcagcctgggctacgcgacgttccggccgggctcgacgacggtgagggacggcggcaacgggctgacctacaccaacctgttcgacgccatggtggacgcggtggtggcggcgctggagaaggccggcgcgccgaacgtgagggtggtggtgtcggagagcgggtggccgtcggccggcgggttcgcggcgagcgtggacaacgcgcggagctacaaccaggggctgatcgaccacgtcgggcgtgggacgcccaagaggcccggggcggcgctggagaccttcatcttcgccatgttcaacgagaaccagaagggcggggaccccacggagaggaacttcgggctcttctaccccaacaagcagcccgtgtacccgatccgcttctaaacaaccggagtatggaatgaagaagaagatgatgggaaggagatgcctctatcttcttcaatgcttttatcaccctaaataagtaataaatactaaatactagagtaataagctgcaagcacagcagtggtaactaaactaataaagtgcagcgtgcacgcatgaatgaagggaaagcaattctgatccaaaaaaaaaaaaaaaaaaa

SEQ ID NO: 356 - protein, 338 aa, Panicum virgatum
  misc_feature: Ceres CLONE 1724745
  misc_feature: Great-hit functional homolog of the protein sequence encoded by LOCUS At4g16260
  misc_feature (1)..(305): Pfam Name: Glyco_hydro_17 Pfam Description: Glycosyl hydrolases family 17
  misc_feature (1)..(338): SWISSPROT Homolog: EC 3.2.1.39 Glucan endo-1,3-beta-glucosidase GII precursor
  misc_feature (26)..(338): SWISSPROT Homolog: EC 3.2.1.39 Glucan endo-1,3-beta-glucosidase GI
  misc_feature: Useful for making plants with altered cell wall content and/or composition
MARQQVASSMLAVALIVASIPTAVDSIGVCYGVVGNNLPSRSDVVQLYRSRGITGMRIYFPDRQALDALRGSGIALILDTGNDDNVLARLASSASTAASWVQTNVRPYYPAVNMKYIAVGNEVQGAAAQARILPAMRNLDAALAAAGLGGSIKVSTSVRFDAVASSFPPSSGVFAQGYMADVARYLAGTGAPLLANVYPYFAYRGNPRDISLGYATFRPGSTTVRDGGNGLTYTNLFDAMVDAVVAALEKAGAPNVRVVVSESGWPSAGGFAASVDNARSYNQGLIDHVGRGTPKRPGAALETFIFAMFNENQKGGDPTERNFGLFYPNKQPVYPIRF

SEQ ID NO: 357 - DNA, 1379 bp, Panicum virgatum
  misc_feature: Ceres CLONE 1724749
  misc_feature: Encodes the peptide sequence at SEQ ID NO. 358
atcactccgatcgatcacgtagcaacaactgtccgacgatcagctcatcaccggccgtgatcgacaccgttgtgtgcggtcagagacagtgcgcgagtgcaatgggcgctgctaccgtggccgcctcctcctcgtcttggtccatgactgtcgttgccttggtggcggcagcttcgttcctggcggcgacgaccacggcggcgcccgtgccggcgatctacgtgttgggcgactccctcgcggacgtcgggaacaacaaccacctgccgaccatcctcagggcggacttcccgcacaacggcatcgacttcccggggggcaaggccaccggccggttcagcaacggcaagaactccgtcgatttcctcgccgacaaccttggggtggcgagcccgccgccatacctcgccctgtccagcaacgccaactacgcgaacggcgtcaacttcgcttccggtggtgccggcgtcctcaactccaccaacaaggaccaatgcatcagcttcgacaagcagatcgactacttgtcgtcggtgtcggcgtccctggcgcagagcctgggccaggcgcaggcggcggcgcacctgtccaagtccctcttcgccgtcaccatcggcagcaacgacatcatccactacgccaggtccagctccgccacggccaccggcgccggcgacccgtcgcagcagttcgtggacgccctgatccaggcgctcacgggccagctgcagcggctctacgacctgggcgcgcgcaagctggtgttcctgggcacggggcccgtcggctgctgcccgtcgctgcgggagctgagcgcctccaaggactgcagcgccgtggccaacggcgtctccgtccggtacaatgccgccgcggcgtcgctcctgggcgccatggcggcgcgccacccggacatgcgctacgcgctcttcgactcctcggcggcgctgctccggttcatcgaccagccggccaagtacgggttcgctgaggccagggcggcgtgctgcgggctcggcgacatgaacgccaagatcgggtgcacgccgctgagcttctactgcgccaacaggaccagccacgtcttctgggacttctaccaccccacggagaccaccgcgcggaagctcaccagcacggcgttcgacgggtcggcgccgctcatcttccccatcaacatcaggcagctcagtgctctgtaggcaacctgcaatcagagatccagagtatatataggtgttgtgtatagactatattgtggtgatagaagaaaccaaaggatatatacgtatatggccatcatagaagcttggttgtgcatgtactagggatttagctgaagtataatacatcataatcaaaaaaaaaaaaaaaaaaaa

SEQ ID NO: 358 - protein, 366 aa, Panicum virgatum
  misc_feature: Ceres CLONE 1724749
  misc_feature (1)..(309): Pfam Name: Lipase_GDSL Pfam Description: GDSL-like Lipase/Acylhydrolase
MGAATVAASSSSWSMTVVALVAAASFLAATTTAAPVPAIYVLGDSLADVGNNNHLPTILRADFPHNGIDFPGGKATGRFSNGKNSVDFLADNLGVASPPPYLALSSNANYANGVNFASGGAGVLNSTNKDQCISFDKQIDYLSSVSASLAQSLGQAQAAAHLSKSLFAVTIGSNDIIHYARSSSATATGAGDPSQQFVDALIQALTGQLQRLYDLGARKLVFLGTGPVGCCPSLRELSASKDCSAVANGVSVRYNAAAASLLGAMAARHPDMRYALFDSSAALLRFIDQPAKYGFAEARAACCGLGDMNAKIGCTPLSFYCANRTSHVFWDFYHPTETTARKLTSTAFDGSAPLIFPINIRQLSAL

SEQ ID NO: 359 - DNA, 1405 bp, Panicum virgatum
  misc_feature: Ceres CLONE 1724751
  misc_feature: Encodes the peptide sequence at SEQ ID NO. 360
cccagctccagccgctgtcgtgtgcttctcctccgcctctctgatggtaattcggagctgctcttctttcctccgtggactgctgatttccagagcggcgtggaggaggcagcaccccctcttcttggctctcaggcctcctgtgccgccgcccgcacgcttctcctcctcctcctcctcacggcgctccaccaagagatccgccgcaaagacgccaatggactccgcagcagccggcgagcccttctacgtcgtccgcaagggggacgtcatcggcatctacaagaccctcagcgaatgccaagctcaagtcagcaattcggtttgcgacccttccgtcactgtcttcaaaggctactctctgcgcaaagacaccgaggaatatctcgctgcgcgcggcttgaggaacgccctctacgccattgacgcagcagatgcacgagatgaattgttcgacgatctagttccctgccctttccagcaacctgatgcagctgcatcctcaactttgaaaaggccaaacgagattgaaactgggccatcaaagaagcatcccaaagttgatgagcaggaaccattacctgatagtcatctctcttgtattcttgaatttgatggtgcttctaagggaaatcctgggaaagcaggggctggagcaataataaggcggttagatggttctgtgattgctcagctgcgtgagggtctgggtattgcaacgaacaatgctgctgaatatcgtgcgctgatcctgggggctaaatatgcggccaaaaaaggattcaagtatatccgtgctcaaggagattctaagcttgtctgtaaccaggtccaagatctctggcgtgctaggaatgataatatggctggcttgtgcaagaaagttaaggagctgaaggggacatttcagttatttcaaatcaggcatgttttgagggattacaactcagctgctgacgctcaagctaactttgcagtcgaacttcctgttggtgaagttcaagagcagtcaaactttccatgctagtagttatgttgtgcaccggtctggtttgtgcatccatcgcttaggtgctgggactgaatatacgtcacgttcgttaagttcccattgacagtaaaggaagggataatacagcagctgtagtcaaagttgtagtgaatctgatatatctgcagggaattgaaccgtctgagttgagatattgagtacatttctaggagatttaatcaactcaaaacttgtgtagtgcattggctgcattgtaaagaaccagtgttttgctgatgtgcaatgtttgtattcgaaatattattgacgaacaaatctagatcaatgtgttcggcttgagattcttgatgcaacaagttatcatcagtaaagaaaattgaacaatttgcacac

SEQ ID NO: 360 - protein, 327 aa, Panicum virgatum
  misc_feature: Ceres CLONE 1724751
  misc_feature (1)..(122): Pfam Name: RnaseH Pfam Description: RNase H
MVIRSCSSFLRGLLISRAAWRRQHPLFLALRPPVPPPARFSSSSSSRRSTKRSAAKTPMDSAAAGEPFYVVRKGDVIGIYKTLSECQAQVSNSVCDPSVTVFKGYSLRKDTEEYLAARGLRNALYAIDAADARDELFDDLVPCPFQQPDAAASSTLKRPNEIETGPSKKHPKVDEQEPLPDSHLSCILEFDGASKGNPGKAGAGAIIRRLDGSVIAQLREGLGIATNNAAEYRALILGAKYAAKKGFKYIRAQGDSKLVCNQVQDLWRARNDNMAGLCKKVKELKGTFQLFQIRHVLRDYNSAADAQANFAVELPVGEVQEQSNFPC

SEQ ID NO: 361 - DNA, 1160 bp, Panicum virgatum
  misc_feature: Ceres CLONE 1724755
  misc_feature: Encodes the peptide sequence at SEQ ID NO. 362
ggccttttggcacctcccaaacaatatatataaacgcatcatctcctgtgccactattctggttctagggccttcggtcgcaacatctctagccgagacattgacttgagcaaatcttatcgacctctcccactccccacgccgccttttacgcttgaatcagcatacccgtttgggcagcagcagcagcagcgcggatcgagatcgatcgaaccatcgaggtggagtggccagagtagtagctagctagcaaggcggcggccggcatgaaggtgcagtgcgacgtgtgcgcggccgaggcggcctccgtcttctgctgcgccgacgaggccgcgctgtgcgacgcgtgcgaccgccgcgtccaccgcgccaacaagctcgccgggaagcaccgccgcttctccctcctccacccctcgccgtcgacgacgtcctcgtcggcgcagacgacgaagccgccgctctgcgacatctgccaggagcgaagggggttcttgttctgcaaggaggaccgggcgatcctgtgccgggagtgcgacgtgccggtgcacaccgcgagcgagatgacgcggcggcacagccggttcctgctcaccggcgtgcgcctctcgtcggcgccggtggactcccccgccgcgtcagaggaggaggagaacagcggcagcccctgcaacgccgactcctgcagcggcggcggcgccaccgccacggcgagcgcgagcgacgggagcagcatctccgagtacctcaccaagacgctgcccgggtggcacgtcgaggacttcctcgtcgacgacgcgtccgccggcgccctgggcgcctgctccaacgacgtcctctatgactatcaggaagagcaagggcagatcggcagtctgctgcaagaagcttacacgccgtggacggggcaggagcagctgctcgccgacgtcgttgtcaccaccgacgagcgggccagccgggagcggtgggtgccgcagatgcacgcggagttcgccggcggcagcaagcggccccgaccgtcgcctccctgcccgtactggtgaaaagctcgccgtcttttcagtaatatggtgatgatgatctgtactagactactactaccgtactactagaaggtagctaggaacgatggaaatgaaaaaagaaagcgataaacg

SEQ ID NO: 362 - protein, 259 aa, Panicum virgatum
  misc_feature: Ceres CLONE 1724755
  misc_feature (1)..(47): Pfam Name: zf-B_box Pfam Description: B-box zinc finger
  misc_feature: The sequence is a functional homolog of  SEQ ID NO 1023 in the  10/666,642 US patent application
  misc_feature: The sequence is a functional homolog of  SEQ ID NO 1645 in the  10/374,780 US patent application
  misc_feature: The sequence is a functional homolog of  SEQ ID NO 1671 in the  10/412,699 US patent application
  misc_feature: Useful for making plants with modulated growth and phenotype characteristics
MKVQCDVCAAEAASVFCCADEAALCDACDRRVHRANKLAGKHRRFSLLHPSPSTTSSSAQTTKPPLCDICQERRGFLFCKEDRAILCRECDVPVHTASEMTRRHSRFLLTGVRLSSAPVDSPAASEEEENSGSPCNADSCSGGGATATASASDGSSISEYLTKTLPGWHVEDFLVDDASAGALGACSNDVLYDYQEEQGQIGSLLQEAYTPWTGQEQLLADVVVTTDERASRERWVPQMHAEFAGGSKRPRPSPPCPYW

SEQ ID NO: 363 - DNA, 1464 bp, Panicum virgatum
  misc_feature: Ceres CLONE 1724758
  misc_feature: Encodes the peptide sequence at SEQ ID NO. 364
gtcatcctcttgctaggtcgtcgccgctccaggaccggaactctggataaacccggtttccttgctgttctggatccttcttctcgcttgtttttacgcgggttgcttgctctggtagtccggttcctgccctgaccgaggaagcagattcaggcttggtgatcgcgtagaagaagaagaagaagaagcactgaagaagaagcagaggctccgcgatctcttggctgttcttgatcaagaaggcggaggaacagagcgcaggcaaaggaggacgacatggacgaggaatacggcgcagcagcttccaggtacttctgccacatgtgctcactgatcatacggcccgagctgggcatcgatgaggtcaaatgcccccactgccacaccggcttcgtggaggaggtggccgtggactcgcgaggcggcgacggcgcggcgattccaggccgtgctgccggcgagccgagcgtgaacgccccggacgccgcgttggagcgcgaggtctcgctctgggcgcccgtgctcatggacttcctcgccgcctcgtccggccgccagggccacggcctcgacgccaccgccggcggaggggacctcgcggctttcgcgcgaaggcagtaccgcaacatcgccctcctgcagctcctcaacgcgctccacgaaggcgacgcagccgacgcggggcgcgagcgggtcgtgctcgtcagccccgcggacgcgcgcgccatgctcatgggacaagagctaggggacggcgccggcgccggcgccgctctgggccgcggcgggctgagtctcgggaacctgttcctcggccccgggctggacctgctgctggagtacctggccgagaccgacccgagccggcagggcacgccgccggccaggaaggaggccatcgccgcgctgccgacggtccgggtgcgcgaggccttcacctgccccgtgtgcctcgacgaggtggcggccggcggcgaggcgcgggagatgccctgcaagcaccggttccacgacccgtgcatcgtgccgtggctggagatgcacagctcctgccccgtgtgcaggcaccagctgcccgcggaggagccggctgagccggccggcagcggccggcgcgctggcgacgaggccagtggcaacgcgcgcggcggcgacgcgggaaggggcggcaggaggcattggttctcgtggccttttggcgggctgttctcgcaaagatcaaacgggagctcatcgtcgtcgtcgtcgtcttgatgcaatgaacagaataaagaagaaaatattgtagaagttcgtttttgattgctacgtgatgattgggttaatattggccattgtaaagctgcatttgtccctaggtttatttgaactagttttgcttcgttcaggtggatagagattattggggaatgcatctatcaacgctgccagagcatctaaaactaaaaaaaaaaaaaaaaaaaa

SEQ ID NO: 364 - protein, 325 aa, Panicum virgatum
  misc_feature: Ceres CLONE 1724758
  misc_feature (1)..(41): Pfam Name: zf-C3HC4 Pfam Description: Zinc finger, C3HC4 type (RING finger)
MDEEYGAAASRYFCHMCSLIIRPELGIDEVKCPHCHTGFVEEVAVDSRGGDGAAIPGRAAGEPSVNAPDAALEREVSLWAPVLMDFLAASSGRQGHGLDATAGGGDLAAFARRQYRNIALLQLLNALHEGDAADAGRERVVLVSPADARAMLMGQELGDGAGAGAALGRGGLSLGNLFLGPGLDLLLEYLAETDPSRQGTPPARKEAIAALPTVRVREAFTCPVCLDEVAAGGEAREMPCKHRFHDPCIVPWLEMHSSCPVCRHQLPAEEPAEPAGSGRRAGDEASGNARGGDAGRGGRRHWFSWPFGGLFSQRSNGSSSSSSSS

SEQ ID NO: 365 - DNA, 1175 bp, Panicum virgatum
  misc_feature: Ceres CLONE 1724762
  misc_feature: Encodes the peptide sequence at SEQ ID NO. 366
aagaagaaaggagagcagcagagcaacaggaaagactccgtcagatcgagccttgttctccctctcatccaagaacagcatcaaacaagaaaccagagaggttgaacagagcaagatggcctgagccaggctaagccaaacgcacgcacgcacgtagaggacggacgcgcaggaaggacttgcactccggcgcatgggtctcctggaccagctgtgggacgacacggtggccgggccgcgcccggactccggcctcggcaagctccgcaagtacgcctccttctcgccctcctcctcctcggtgtccgcggccgcggccgcgtcgccgcccgcggagggggcggccggcgccgtgccgccacccgtgacgcgcagcatcagcatgctccgcccctcggcgctgtccgtcttcacgtcgccgcgcagcgagtccagctctgcgccgtcgtcgccggccagcggcgccccggactcgcccttcggcgcagcgacgacgcccaagggagagggctggaagaagctgcgccggaaaggcaggatggccgccgacggcgccgacgcccccggcacgccgaggagccccaccgtctacgactgggtggtgatcagctcgctggaccggtgaacgacagccaactgaagggcgggtcggagcacaaggcccatgtgcatcctctctcagaggtcctgacgatggtgtttctgtgttttgtatacgttaaaattacccccaccttcttgtaaatccccgtgtgagatgctgctgtttctgtaagctctgctagtacgctcctcatcaggtcgtgcgtgtcaccgtgtacaaagctgcccaagccttgaacttgaagtgaaaacaggcaacgcaagctctgatgacctgaagggcccgcacgtcagtgatccaaccgcggggcagtactgtggaggagtcctgtccatgtagcacagtcctggtacctatactgttgaagagagctgtaacgttgtatgagtgaccgcgcagcgtccttctgctttgtacttctggacggtgctgcctgtgtaaaagacctataagagtatgtactcggtaataatgcgtgtggttgggtgatatggataaatgcatatccggtcgaacacttttttttattatgaaactcggtcgaacactttaaaaaaaaaaaaaaaaaaaa

SEQ ID NO: 366 - protein, 143 aa, Panicum virgatum
  misc_feature: Ceres CLONE 1724762
  misc_feature (1)..(26): Pfam Name: Auxin_repressed Pfam Description: Dormancy/auxin associated protein
MGLLDQLWDDTVAGPRPDSGLGKLRKYASFSPSSSSVSAAAAASPPAEGAAGAVPPPVTRSISMLRPSALSVFTSPRSESSSAPSSPASGAPDSPFGAATTPKGEGWKKLRRKGRMAADGADAPGTPRSPTVYDWVVISSLDR

SEQ ID NO: 367 - DNA, 1110 bp, Panicum virgatum
  misc_feature: Ceres CLONE 1724765
  misc_feature: Encodes the peptide sequence at SEQ ID NO. 368
aagacgaggcactaccaaaccaaagccccctccgcccaaaaccccactcgagctcctaccccatccatggcgaccgccaccgccgcctcttcctcctcgctgaccgcccctctcctccgcccgaaccccaaaaccaaccccgctaccagatccctgcctctcctcaggaacaggaggtgcattcgcgccgtgaccgccgccgtcgcagggggcgcgggggcgtacgggactgttcagcggcgtgggatttggtcgatcagggatgatctggtggtgccgaggtcgccctacttcccagtggagtacgcggcggggcaggaacgtgggccatcgcccatggtgatggagcggttccagagcgtcgtcagccagcttttccagcataggattatccggtgcggtggccctgtggaggatgatatggctaacatcattgttgcccagctgctctatcttgacgccgtcgatcccactaaggatatcattatgtatgtgaattcaccaggagggtcagtgacagctggaatggctatatttgatacaatgaagcatatcaggcctgatgtttccactgtttgtatcggattagctgcaagtatgggagcttttctacttagcgctgggactaaaggaaagcgatacagcttacctaactcaagaataatgatccatcaacctcttggaggagcccaaggacaagagactgatcttgagatccaggctaatgagatgctgcaccacaaggctaacttgaatggatacctggcataccacactggacagcccctggataagatcaacgaagatactgaccgtgattactttatgagtgcgaaagaagcgaaggagtatggcctcattgatggagtaattatgaatcccctcaaggcccttcaaccgcttccagcttccagctagtcattaagtgctagatctctgtcaaacatttttgttgtatccattagaaggtttccactacgctgtttctattagtctggctagattatgttgcaaagtttgcaccccgaggattcaaaggttgtactgtataaaacaagatttacagtcggatgtccatcttttgcgatagaaaaaaaaaaaaaaaaaaaa

SEQ ID NO: 368 - protein, 283 aa, Panicum virgatum
  misc_feature: Ceres CLONE 1724765
  misc_feature (1)..(182): Pfam Name: CLP_protease Pfam Description: Clp protease
  misc_feature (94)..(269): SWISSPROT Homolog: EC 3.4.21.92 ATP-dependent Clp protease proteolytic subunit 1
MATATAASSSSLTAPLLRPNPKTNPATRSLPLLRNRRCIRAVTAAVAGGAGAYGTVQRRGIWSIRDDLVVPRSPYFPVEYAAGQERGPSPMVMERFQSVVSQLFQHRIIRCGGPVEDDMANIIVAQLLYLDAVDPTKDIIMYVNSPGGSVTAGMAIFDTMKHIRPDVSTVCIGLAASMGAFLLSAGTKGKRYSLPNSRIMIHQPLGGAQGQETDLEIQANEMLHHKANLNGYLAYHTGQPLDKINEDTDRDYFMSAKEAKEYGLIDGVIMNPLKALQPLPASS

SEQ ID NO: 369 - DNA, 1008 bp, Panicum virgatum
  misc_feature: Ceres CLONE 1724775
  misc_feature: Encodes the peptide sequence at SEQ ID NO. 370
agaagccaccggcaaagagagagcctctgccgattcagtagcaattctctggttggtgttcgtcacttgatctcagctgctgctgctgctgctgctgctgtgtgtgtgtgtgtgtgtctgggaagaaacaaggagaggggagagatggcttgccctgcgcagtacatgctctcgtccagcggctgcatcttcctggggagctgcaagcctcagacgagcctcgtccgaggcgccgtcaccggcggcgtcagcggcagcaggccgttcctgctcacctgcagcgcctcgtcgtctccgtccccttcctcgccggtgccggcgcaggaggactccgactgcaacgaggaggagtgcgccccggagaaggaggtcgggagcctgagcgccgagtggctggcggaggagcggacccgggtcgtcggaaccttcccgcccaggaagagagggtggaccggcctcgtcgagaaggacaccgccggccagaccaacatctactccgtcgagccgacggtgtacgtggcggagagtgccatcagctccggcacggcgggcacgtcggcggagggggccgagaacacggctgccatcgcggcggggctcgtcctcatcaccgtcgccgcggcgtcgagcatcctcatccaggtgagcaagcagcagccgcaggtgcccgaggccgcctacagcggcccgccgctcagctactacgtcgccaagttccagcctgcggtggaagcgccggcgccggcggagcccctcgaggcccccgcccccgcggaggcggtcgtcgcccaggacacccccgccatcgaggcttctgcgccggcaccggaggctgatctgctgtcctcgtgagctcgtgttgtagtcaagattcagttttcgtggcagcttacacacatgagcttgtagtgaaggatacggtgggagagaatacagatggtcctcgtgagcatttccgaattgtaaaactttcgtgcatgtatatatatacagtgcatcagcatggct

SEQ ID NO: 370 - protein, 235 aa, Panicum virgatum
  misc_feature: Ceres CLONE 1724775
  misc_feature: Great-hit functional homolog of the protein sequence given in SEQ ID NO 9318
  misc_feature: Useful for making plants with modulated flowering time
  misc_feature: The plant flowers significantly late compared to wild-type.
MACPAQYMLSSSGCIFLGSCKPQTSLVRGAVTGGVSGSRPFLLTCSASSSPSPSSPVPAQEDSDCNEEECAPEKEVGSLSAEWLAEERTRVVGTFPPRKRGWTGLVEKDTAGQTNIYSVEPTVYVAESAISSGTAGTSAEGAENTAAIAAGLVLITVAAASSILIQVSKQQPQVPEAAYSGPPLSYYVAKFQPAVEAPAPAEPLEAPAPAEAVVAQDTPAIEASAPAPEADLLSS

SEQ ID NO: 371 - DNA, 1165 bp, Panicum virgatum
  misc_feature: Ceres CLONE 1724787
  misc_feature: Encodes the peptide sequence at SEQ ID NO. 372
actccctatccagtttatcctctccctaatggcgcttcctctgcgccccgccgctccggcgccaccgccttggcgatgctccggcgtgagctcctcgccgcgcgcatccctcctggacacggcctccaagcaagcatttcctgttccattaccagctgaccgggttgcaagattttccttatctgcaaagcgttctgcatctcggcttgtccagtcaatgactgatctcaccggttttagaagtgatgggatccatgcagccaatgaacattcacgtgatctcatgaggtccatatctgatcttcaggaagttgtattatcctcttttgggaaagcatgtattttcggtagttgcatcatatatgttctgcctcctgcttgtttagcagaaccatgcgagcaagagtactctctccctaacatgcctttgctgtttgcaatagccatggttggtgctactgttggagggctcctcgcaagacagaggagaggggagcttgcacggctgaatgatcagttacgtcagataaatgctgcactgagaagacaagccaagattgaatcttacgctcctactttgagctatgccccagttggtagtaagataccagaatcagaagttattgttaatcctcagaaagagcgcctgattgcatatctgaggactgggaagaactacctgagaaaccaagctcctgacaaggcatttcctgagtttaaagcagctcttgatcttgcacaagctttaggtgatcatgttgaagagaagaaagcagcacgaggattaggggcatcattccagagacaaggcaagtacaaggaagccataaagtatcactccatggtcctaaacatctctaagatgaccggagaggatgcgggtgtcactgaagcatatggagcaatagcagactgctacaccgagcttggtgagcttgagaaggctggcgagttctacgacaaatacattgcaaggttggagagtgactgaaaagaagagcaccgatcagaaaatatgttagagcattgacaagtctaatggaatttctaccctttttcgcttgtcatgtagtttattgtagatttgcagttcccagctcgaattgagttttattaccaccatgcaagttctttttggcaggattaaaaaaaaaaaaaaaaaaaa

SEQ ID NO: 372 - protein, 320 aa, Panicum virgatum
  misc_feature: Ceres CLONE 1724787
  misc_feature: Great-hit functional homolog of the protein sequence given in SEQ ID NO 9566
  misc_feature: Useful for biocontainment applications
  misc_feature: Useful for making plants with altered Lignin content
  misc_feature: Useful for making plants with altered alkaloid content
  misc_feature: Useful for making plants with modulated biomass
  misc_feature: The plant is abnormally small.
  misc_feature: The plant produces a reduced number of seeds.
MALPLRPAAPAPPPWRCSGVSSSPRASLLDTASKQAFPVPLPADRVARFSLSAKRSASRLVQSMTDLTGFRSDGIHAANEHSRDLMRSISDLQEVVLSSFGKACIFGSCIIYVLPPACLAEPCEQEYSLPNMPLLFAIAMVGATVGGLLARQRRGELARLNDQLRQINAALRRQAKIESYAPTLSYAPVGSKIPESEVIVNPQKERLIAYLRTGKNYLRNQAPDKAFPEFKAALDLAQALGDHVEEKKAARGLGASFQRQGKYKEAIKYHSMVLNISKMTGEDAGVTEAYGAIADCYTELGELEKAGEFYDKYIARLESD

SEQ ID NO: 373 - DNA, 1490 bp, Panicum virgatum
  misc_feature: Ceres CLONE 1724806
  misc_feature: Encodes the peptide sequence at SEQ ID NO. 374
atcatatcaactcccaaaacttgctccggaatatccatctccaaaccaggcgcgctactctactccgggccgcggcagcggccatggcttgctccgcgcacctactgtcccagagcctctactcgtcccaccgcgccagcccggccgcgcgcgggaacctccgctccggggagcgggcgtcccccgcggcgaggcccggctcgagcgtaagaggctgccgaggtgtcagcctgagggtcgccgcgtcgttcgagcaagggaggcggcaagtcgaggtctcttatgacccacaagcaaagtttaaccagctagcggaccaaattgacaaggatgcagggatgacacggctcaacctattctcaccttgcaaaattaatttgttcttgaggataacggggaagagaccagatgggttccatgacctggcttctctgtttcatgtcataagtttgggtgatacaatcaaattctcgttgtcaccaagtaagagcagagatcgcctgtcaaccaatgttccaggtgtccccgtcgatgaaagcaatttgatcatcaaggcactcaacctttaccgacagaaaactgggactgataactatttttggatacatcttgataagaaggtcccaactggtgctggtctcggtggtggaagcagtaatgctgcaactgcactatgggctgctaaccagtttgctggctgcatagcttcagaaaaggatcttcaagagtggtctggtgagattggatcagatatccccttcttcttttcacaaggcgcagcatattgtaccggtagaggagagattgtcgaagatatcccaaatcccttgccggaaaatttaccaatggctcttataaagccgcctgaagcatgcccaaccgctgaagtttacaagagattcaggttggaacaagctagcaaagatgatcctttgaccttgctcaaagaaataactcaaaatgggatatcacaagatctctgtgttaatgacttagagcctccagcttttgaggtgctaccatcacttaagaggttgaagaaaagaattattgcagctagcagggatgattacaatgctgtttttatgtcaggaagtggaagcacacttgttggaattggttctccagatccacctgcattcgtatatgatgaggaggactacaagaatgtttttgtgtcagaggcttgcttcctcactcgcgatgagaatgaatggtacagggagccaatctcgtccaaagctgcgttcagcaaagacgacttagcagcctcagttactgactgaattctgattgactccggttctgcatttaatctcaatttgtgggttatacaggtgagggtttattgtgtgttgggaaaaagaattgacaaggtcagtttgttcataagacaaatctgatcccacgaaatggatatcatttttttgagcatagcaatcatgatttctgtcaagagacagttcgtggaaaaaaaaaaaaaaaaaaaa

SEQ ID NO: 374 - protein, 400 aa, Panicum virgatum
  misc_feature: Ceres CLONE 1724806
  misc_feature (1)..(392): SWISSPROT Homolog: EC 2.7.1.148 4-diphosphocytidyl-2-C-methyl-D-erythritol kinase, chloroplast precursor
  misc_feature (50)..(390): SWISSPROT Homolog: EC 2.7.1.148 4-diphosphocytidyl-2-C-methyl-D-erythritol kinase, chloroplast precursor
MACSAHLLSQSLYSSHRASPAARGNLRSGERASPAARPGSSVRGCRGVSLRVAASFEQGRRQVEVSYDPQAKFNQLADQIDKDAGMTRLNLFSPCKINLFLRITGKRPDGFHDLASLFHVISLGDTIKFSLSPSKSRDRLSTNVPGVPVDESNLIIKALNLYRQKTGTDNYFWIHLDKKVPTGAGLGGGSSNAATALWAANQFAGCIASEKDLQEWSGEIGSDIPFFFSQGAAYCTGRGEIVEDIPNPLPENLPMALIKPPEACPTAEVYKRFRLEQASKDDPLTLLKEITQNGISQDLCVNDLEPPAFEVLPSLKRLKKRIIAASRDDYNAVFMSGSGSTLVGIGSPDPPAFVYDEEDYKNVFVSEACFLTRDENEWYREPISSKAAFSKDDLAASVTD

SEQ ID NO: 375 - DNA, 1042 bp, Panicum virgatum
  misc_feature: Ceres CLONE 1724818
  misc_feature: Encodes the peptide sequence at SEQ ID NO. 376
catcggagagaggcggccgctaggcacggcggcggccgcggcggaggtgaccgcggatgcggcggccgccggggtcgcgaggtgggagcccatgggcgcgcgggagtactacgactaccggcgggccatctacggcgacatcacgcacaaggccatcctcgtcgacgccgccggcacgctcctcgcccccaccgagcccatggcgcaggtatacagaacgatcggccagaagtatggagtggaatactcagaggatgaaatactgatgaggtatcggcgggcttatgcgcaaccatggggtagatcccgcctgaggtatgtcaatgatggaaggcccttttggcaacacatagtcagttcctctacaggctgctcagatctgcagtactttgaggaagtgtatcagtactatacgactgaaaaggcttggcatctctgtgatccagacgcagggcgcgttttccaggcattgagaagggctggtgtaaaaactgctgttgtgtccaactttgacactcgtcttcggccacttttacaggccctgaaatgtgatcaatggtttgatgcagttgctgtatctgctgaggttgcagcagaaaagccaaacccaacaatattcttgaaggcctgcgagctgttgggcgtgaaacctgaagaaactgtgcatattggggatgaccgtaggaacaatgtatggggagctagggatgcaggctgtgatgcctggctttggggcagtgatgtttactccttcaaggaggtcgcagagaggatcggggttgaggtataacgacttgactgcagagtcaactcaacatgagctgcaatacaaagaagaaaataggctgtggtgttgcctccttgtacatagtgtcaatacttgttgccccggcaccttgtacatactttccattttcccagggaataacagagagcagtttgtcctgcgcgacatgccccttcccgtagcaactgttgaatactgtatatgtgcgtttcactgtccaattggccgcctgtttaaaaaaaaaaaaaaaaaaaa

SEQ ID NO: 376 - protein, 232 aa, Panicum virgatum
  misc_feature: Ceres CLONE 1724818
  misc_feature (1)..(199): Pfam Name: Hydrolase Pfam Description: haloacid dehalogenase-like hydrolase
MGAREYYDYRRAIYGDITHKAILVDAAGTLLAPTEPMAQVYRTIGQKYGVEYSEDEILMRYRRAYAQPWGRSRLRYVNDGRPFWQHIVSSSTGCSDLQYFEEVYQYYTTEKAWHLCDPDAGRVFQALRRAGVKTAVVSNFDTRLRPLLQALKCDQWFDAVAVSAEVAAEKPNPTIFLKACELLGVKPEETVHIGDDRRNNVWGARDAGCDAWLWGSDVYSFKEVAERIGVEV

SEQ ID NO: 377 - DNA, 1085 bp, Panicum virgatum
  misc_feature: Ceres CLONE 1724819
  misc_feature: Encodes the peptide sequence at SEQ ID NO. 378
acggatatcttcgccgccctcagcccctcagcgtcgcgagctctcgccatggcgctccccctcgcccgcctcctccccgcgccccccgcctgccagagccagcccccgcttggcctgcgcttccccacgcgccacgtctccttcgctgcctgctcccgcggtcaccgcgccgccttcactttcgctgcccgcgcggccgctagtgcccccgcggccccggccccggaggcggtggcggaggagaaagtggagccgaggacgcggctcgtcgcgcagaacatcccgtgggactgcacggccgatgacatgcgcgcgctcttcgagaagcacggctccgtcgtcggcgttgagctttcaatgtacaatgccagtaaaaacagagggttggcatttgtaacgatgggttcagaagaggaggcttctgcagctctcaacaatctcaattcaactactttaaatgatagaaaaatcaaggtggactttgcgcaacctagaaagaagcaacctaagcaagttaagcaacctgttgtggtatcagatagcacggaaaagtacattctgtttgtcggaaatttgacatggagagttagaaatcggcaccttcgtgaattatttgcctcgaccccaggtgtcctatcagctgaagttatctttcataccactacaccaaggcgatccgctggttatgcatttgtttctttttcttcgaaagaggatgcagaggctgccatatctactttaaatggacagaatttgatgggacggcccattaatgtgatgttcaaagaagaaagtgctaagaagaatgaatcttctgtcccaaaggaagaggtgtccgaggtggaatcatctgagcagagtgatagctaaacactaacctttcagagaatcaagaaaagtgaaatgaattgatctgtggttatatattctgacccatggtatttcttttcagcaatagttatatcctttgttttatttagctctatttattccatgtacatattcgtttaccaagtttggaaactgtatttcatgtgagaaatggaacaacctccttaacatgtcaaaaaaaaaaaaaaaaaaaa

SEQ ID NO: 378 - protein, 273 aa, Panicum virgatum
  misc_feature: Ceres CLONE 1724819
  misc_feature: Great-hit functional homolog of the protein sequence given in SEQ ID NO 9248
  misc_feature: Useful for making plants with altered Lignin content
MALPLARLLPAPPACQSQPPLGLRFPTRHVSFAACSRGHRAAFTFAARAAASAPAAPAPEAVAEEKVEPRTRLVAQNIPWDCTADDMRALFEKHGSVVGVELSMYNASKNRGLAFVTMGSEEEASAALNNLNSTTLNDRKIKVDFAQPRKKQPKQVKQPVVVSDSTEKYILFVGNLTWRVRNRHLRELFASTPGVLSAEVIFHTTTPRRSAGYAFVSFSSKEDAEAAISTLNGQNLMGRPINVMFKEESAKKNESSVPKEEVSEVESSEQSDS

SEQ ID NO: 379 - DNA, 1070 bp, Panicum virgatum
  misc_feature: Ceres CLONE 1724832
  misc_feature: Encodes the peptide sequence at SEQ ID NO. 380
atcccccccgctagcctcatctcggcagctactacttacccctcctgctgccccgggcgctcctctgcttccactcgcttgccgctccctccgatcaccgcctgcccctctgctgagctcttctactactacgcagagcgatgaacatcttgaaccagcccatcaaccccggcggccacccggtgttcccggcggccaaggaggccgggcacctcacgccggcgtcggtgcgcttcgacggcgtgccggcgcagcccagcacggtggccgcggggcgctccagcgcgcactacccgaggtggcaggcgcagacgctgcgccgcgccagcagcttcgtcggcgtcgagcacgacggggcaaccgcggacgcgggcccggcgcccgccccgttcaagccgccaacgctcgacttcctgcggtcgctcctggacaggagctgcagcgcgagctccgccttggcgggcggcgagcccagcgccccgccgccgcagctgctcgcgctgcgggtggtcgtgacctccgccgtggagctggacgcgcgccagaccgagctcatcgcgcgcaagatgcgccggctcaccgggttcgtgaacctcacggtcgagaacgtcgtggacccgtcgctgatcgccggcttcgtcatctgctacggcgccgacgactcccacgtcatcgacctcagcgtcaagggccagctcgccgcgctcaagaaccgcgtggactccatcgaccagaccacccacggacacccgcacccctgatcgatcgaactgcacctgatgctctggagcaaggcgctccatcgctacaccgtgctatggagcaagcacactacaagcctacagcagcactgctatccccatgatcgtgacactatttatagtatacaaccgaacgccatgccaacaacagttttccgatctaatgttgttgtaaatcgcgagaaacttagctgctgcctccctgccgagccctatatacatgtttgtatgctacaccaaatgtcattgtatatgaagaatgcggaaacagcggcttatacggtgcaccaaaaaaaaaaaaaaaaaaaa

SEQ ID NO: 380 - protein, 206 aa, Panicum virgatum
  misc_feature: Ceres CLONE 1724832
  misc_feature (1)..(73): Pfam Name: OSCP Pfam Description: ATP synthase delta (OSCP) subunit
MNILNQPINPGGHPVFPAAKEAGHLTPASVRFDGVPAQPSTVAAGRSSAHYPRWQAQTLRRASSFVGVEHDGATADAGPAPAPFKPPTLDFLRSLLDRSCSASSALAGGEPSAPPPQLLALRVVVTSAVELDARQTELIARKMRRLTGFVNLTVENVVDPSLIAGFVICYGADDSHVIDLSVKGQLAALKNRVDSIDQTTHGHPHP

SEQ ID NO: 381 - DNA, 1182 bp, Panicum virgatum
  misc_feature: Ceres CLONE 1724861
  misc_feature: Encodes the peptide sequence at SEQ ID NO. 382
agggcccccaccaaaccaaatcgctttggacccgaagcgttttggccgccagagcaaagctgtgctcgtgcaacaagcgaagaggcgcaagcgttggtggcaaggccgatggcgtcgccgtcgtcgtcgctgtgctccggcttcgcctccctgcggacggcctcccttggccaccgccgcggcctcgtcttctccacccccaggaaagcattccaagtgagggcatcttctcgggttgacaagttctcaaagactgacatcattgtgtccccttccattctatctgcaaacttttccaagcttggtgaacaggtaaaagctgtggagatggcaggatgcgactggattcatgttgacgtcatggatggacgatttgtgccaaatatcaccattggacctttggttgttgatgctctccgtccggtgactgatcttccattggatgtacatctgatgattgtggaacctgagcagcgagtcccagattttattaaggcgggtgctgatattgttagtgtccactgtgaacaatcatcaaccatccatttgcaccgaacagtcaatcagattaaaagtctaggagcaaaggcaggagttgttttgaatccagcgactccactcactgcaatagattacgttcttgatgttgtcgacctggtcttgattatgtctgtgaatcctgggtttggtggccagagctttattgagagtcaagtaaagaaaattgcagagttgagaagattatgcgcagagaagggagtaaacccctggattgaggttgatggtggtgttggtccgcaaaatgcttacaaggtcattgaagctggggcgaatgccattgttgctggttctgcagtttttggggctccagactacgctgaagctatcaaaggaatcaagaccagccaaagacctgtagctgtaccggcatgaggaactggaactgtactcaattaccctgtgcgagtttagcagtgctgcgatttgtatagatgtgtttcttgatgagccatacgttatattggtatattggacatcaaagaagactggaggcagcgaagaaatatcccttttctttccttattttcctcaagggtgcctgccttgtactgcttccgagaatgttgtgtgatattaaaacatacatgggatgttcttggcgaaaaaaaaaaaaaaaaaaaa

SEQ ID NO: 382 - protein, 274 aa, Panicum virgatum
  misc_feature: Ceres CLONE 1724861
  misc_feature (1)..(203): Pfam Name: Ribul_P_3_epim Pfam Description: Ribulose-phosphate 3 epimerase family
  misc_feature (1)..(274): SWISSPROT Homolog: EC 5.1.3.1 Ribulose-phosphate 3-epimerase, chloroplast precursor
MASPSSSLCSGFASLRTASLGHRRGLVFSTPRKAFQVRASSRVDKFSKTDIIVSPSILSANFSKLGEQVKAVEMAGCDWIHVDVMDGRFVPNITIGPLVVDALRPVTDLPLDVHLMIVEPEQRVPDFIKAGADIVSVHCEQSSTIHLHRTVNQIKSLGAKAGVVLNPATPLTAIDYVLDVVDLVLIMSVNPGFGGQSFIESQVKKIAELRRLCAEKGVNPWIEVDGGVGPQNAYKVIEAGANAIVAGSAVFGAPDYAEAIKGIKTSQRPVAVPA

SEQ ID NO: 383 - DNA, 983 bp, Panicum virgatum
  misc_feature: Ceres CLONE 1724876
  misc_feature: Encodes the peptide sequence at SEQ ID NO. 384
gacttgcctccggacagatagccgagcaggaaccctagcagagggaggagaggaccgccgccgccgccgcaaggaagcaggagcaccatgccgaaatccaagcgcaatcgcccagtgaccttatcaaagaccaagaagaagcctggtttagagcgcaagggcaaagtagtttccgagattaaagatgctgtggagaaatacagcagcgcctacgttttcacctttgataacatgaggaatcagaagctcaaggacctcagggagcagctcaaatcctctagcaggatatttcttgctggaaagaaggttatgcagatagcgttggggcgttcacctgctgatgaagctaaaacaggcctccacaaactttccaagttccttcaaggtgattccggtctgctctttaccaatcttccaagggatgatgttgagaggctgtttcgagacttcgaggagcatgattttgcaaggacaggaagtactgcgacagaaacggtggagcttaaagaaggccctctggaacagtttacacacgaaatggaaccttttctacgcaagcaaggactgccagttcgcttgaacagaggtgtcgtagagttagttgcagatcatttagtgtgtgaggaaggaaaacccctttcaccagaagcagcacagactctgcgcttgcttgggatacagatggcaacattccggctataccttgtgtgccgctggtcttgtgatgactttgaagtgtacaaagaaggcttggcgcacctaggagctgatgatgattcctcttaagatctttatgttcccctctgcaaggatgcacttgttgtcttgtgttgggacagtttttggtattgtgtgtgcggccatgtaccccggaatgttggaaatttgaaagatgcagtgttggagggtgtaagctgattggtatatcttatgaacaagatgtggagttgagaagtggatcttaaaaaaaaaaaaaaaaaaaa

SEQ ID NO: 384 - protein, 232 aa, Panicum virgatum
  misc_feature: Ceres CLONE 1724876
  misc_feature: Great-hit functional homolog of the protein sequence given in SEQ ID NO 9674
  misc_feature: Useful for making plants with modulated nitrogen use efficiency
MPKSKRNRPVTLSKTKKKPGLERKGKVVSEIKDAVEKYSSAYVFTFDNMRNQKLKDLREQLKSSSRIFLAGKKVMQIALGRSPADEAKTGLHKLSKFLQGDSGLLFTNLPRDDVERLFRDFEEHDFARTGSTATETVELKEGPLEQFTHEMEPFLRKQGLPVRLNRGVVELVADHLVCEEGKPLSPEAAQTLRLLGIQMATFRLYLVCRWSCDDFEVYKEGLAHLGADDDSS

SEQ ID NO: 385 - DNA, 1465 bp, Panicum virgatum
  misc_feature: Ceres CLONE 1724882
  misc_feature: Encodes the peptide sequence at SEQ ID NO. 386
tagtagcgagcgagtggtctgatcgagcagcgagcgagcttcaggacgcgcgcgatggccttgcaggtcgccgccggcggcgtggcctgccgctgccctcccgcgctccccggcggcggcgggcggcgggcgcgcggccgcacgccccgcgcggtggcgtccggcgcggcggcggcggtcgaggagggcgagggcaaggtgcggctgggcgggtccggcgtcgccgtcactaagctcggcatcggcgcctggtcctggggcgacaccacctactggaacgactccgagtgggacgataggagactgaaggaggcacaggaggcgttcgatgcgagcatcgacaatgggatgaccttcttcgacacagcagaagtgtacggtacagcgctgatgggagcagtcaactctgagagtttactaggaggattcatcaaggaaaggcaacagaaggagcagattgaggtcgctgtcgcaacaaaattcgctgcccttccatggagatttggccgaggaagcgttctttctgcactcaagaaatcgctagactgtcttggcctgtcctcagtggagctctaccaacttcactggccagggatgtgggggaatgaagcgtaccttgatggcctggcagatgcttatgagcaaggccttgtaaaagccgttggagtctcaaactacaatgagaagcgccttcgggatgcacatgcacgcctgaagaagaggggtgttccacttgctgcaaaccaggtgaattacagcctgatatacagaactccggagttgaatggtgtgaaagcagcttgtgatgagctcggcatcaccttgattgcctattccccaatagcccaaggtgttctgacagggaaatacactccagaaaatccccctactggcccacgagcaaatacatacactcctgaattcctcaccaagctccaaccacttatgagcaggatcaaagagattggagcaagctacggcaagagtccaacccaggtgtctctgaactggctgacctgccaggggaacgtggtgccgatccccggggccaagaatgctagccaggccaaggagttcgccggcgctctcgggtggagcctgactggcgacgaggtcgaagagcttcgaactctggcgcgcgagatcaaagaaatgaacagaagttgcatatgttatgaccggcaagacctaccagcgccacaacaagatggtcgtgccgcaggagtccggcaacaaacgtggctaaaggagtcccagacggtctacaatccggctgcaagtccaacggatagatatggacgtttcggttagagaagatttaggagattggttgtgtactttcttgttgcttagttatatttgctttcctagagataatcttatataagatcacattgtatcagattggattaagcagttaatgagatacatctagcttcccagccaaaaaaaaaaaaaaaaaaaa

SEQ ID NO: 386 - protein, 418 aa, Panicum virgatum
  misc_feature: Ceres CLONE 1724882
  misc_feature (1)..(314): Pfam Name: Aldo_ket_red Pfam Description: Aldo/keto reductase family
  misc_feature (1)..(311): Pfam Name: Aldo_ket_red Pfam Description: Aldo/keto reductase family
MALQVAAGGVACRCPPALPGGGGRRARGRTPRAVASGAAAAVEEGEGKVRLGGSGVAVTKLGIGAWSWGDTTYWNDSEWDDRRLKEAQEAFDASIDNGMTFFDTAEVYGTALMGAVNSESLLGGFIKERQQKEQIEVAVATKFAALPWRFGRGSVLSALKKSLDCLGLSSVELYQLHWPGMWGNEAYLDGLADAYEQGLVKAVGVSNYNEKRLRDAHARLKKRGVPLAANQVNYSLIYRTPELNGVKAACDELGITLIAYSPIAQGVLTGKYTPENPPTGPRANTYTPEFLTKLQPLMSRIKEIGASYGKSPTQVSLNWLTCQGNVVPIPGAKNASQAKEFAGALGWSLTGDEVEELRTLAREIKEMNRSCICYDRQDLPAPQQDGRAAGVRQQTWLKESQTVYNPAASPTDRYGRFG

SEQ ID NO: 387 - DNA, 976 bp, Panicum virgatum
  misc_feature: Ceres CLONE 1724887
  misc_feature: Encodes the peptide sequence at SEQ ID NO. 388
agccacagttcggggataaacccaagcggaagcggccagccagctcagagcagcaagccatggcgcctcccgtctcctccctgtcccgcatggcgtccagcccaatcccgtcgacgcagctccccaagcccagcagaaggacgctcgccgtcgcgccctgcagctccgcctcctcctcgccgtctaccacctcgtcccctccgtgccacgccgccgcgcctcaggcggcgtcggcgggtcggagggggatgctggcgctgggcgggttcctggcctcggccgcgcttctgggtccggccggggacgccggggcgacgcgcatcgagtactacgcgacggtcggggacaagctctgcgacatgaacctcgtcaagtcggggctcgcgtactgcgacgtcgaggttggcaccggcgcccagcccccgcgcggcgagctcatcaatgttcactacactgcgagatttcctgatggtacagtgttcgacagcacctacaagcgcggcaggccactgacaatgcgtatcggcgcagggaagatcctccgtgggcttgaacagggaatcagtggaggtggaggtgtgccgcccatgcttgttggtggaaaacgcaagcttatgatacctgcaactctggcgtacgggcctgaaccagcaggctgcttctcaggagattgcaacattcctggaaactccacacttctatatgaccttttcctcgtcgggatttacaagtgagcatccgatgagatggcaatgaacattcaggaattagaacagacaagggagaagtctatcgatcatgcagataaaagataacggttcctggaacacatgatcccaataccgcagatgaagagaacgcttctggcaatactcgcgaaagcttgtgaataacatttctattttcttacctagccgatcggcaatgttcctgacctatttccgaagaaaatagtgcccacctggattgcatcagc

SEQ ID NO: 388 - protein, 224 aa, Panicum virgatum
  misc_feature: Ceres CLONE 1724887
  misc_feature (1)..(105): Pfam Name: FKBP_C Pfam Description: FKBP-type peptidyl-prolyl cis-trans isomerase
MAPPVSSLSRMASSPIPSTQLPKPSRRTLAVAPCSSASSSPSTTSSPPCHAAAPQAASAGRRGMLALGGFLASAALLGPAGDAGATRIEYYATVGDKLCDMNLVKSGLAYCDVEVGTGAQPPRGELINVHYTARFPDGTVFDSTYKRGRPLTMRIGAGKILRGLEQGISGGGGVPPMLVGGKRKLMIPATLAYGPEPAGCFSGDCNIPGNSTLLYDLFLVGIYK

SEQ ID NO: 389 - DNA, 1363 bp, Panicum virgatum
  misc_feature: Ceres CLONE 1724896
  misc_feature: Encodes the peptide sequence at SEQ ID NO. 390
atcggggggctcgggctcaccgctcacgcacccacctgcgccgagcagcagctagctgagccaaagaagaagccctgtcacttggcattccacggctagcttttgtttaggcgatcggagagtggtgagctcgtctcgggagggctgtggtgatggcgcgatgccaggggacggtcgagagcctgtgccaggggctgctggacctcgacgacgacaagttcggcgcaatgtgcagcgcgttcggctacctccaggagtggccggacctggcgggcgccatgtgcggcgcgggccttggtgcgacgcctgccgcggtggcgccgggcgccggcgccggcgccggcaacgacgactcctcctgcagcggcagcggcggcggcggcggcgggttcaggaagaggaggccggacgcgtgcctcgacgcgaagggtgatggcaacgacatgagcaagagacccagagggaagcagcagctgtgcggtctcggtgagatggcggcgcccgggaaagcgaagcaggagaggccaaaggcaggcgccaagaagaaggcggaggcggcgtcgacggcggcggcggcggccggccagaagaccgactacatccacgtccgggcacgccgcggccaggccacggacagccacagcctcgccgagcgggtgaggagggagaggatcagcgagcggatgaggtatctgcaggagctggtgcccgggtgcagcaaggtcaccggcaaggccggcatgctcgacgagatcatcaactacgtccagtccctgcagaagcaagtcgagttcctgtcgatgaagatcgccgcctccaacccggtggtgagcttcgacatcgtcgaggacctcttcggcaggcagctgaagcaggcgtgcagccctgccgcccttcccgcggcggctctgcctgccgggcagctggagccgacctgccttcagatgaacccattgcagcaggtgcacccatctgcggcaggaggctccaatggctttgggctggacatggtcgtcaacaacctgtaccctcccgccgccgcgagctgccccgtgtcggttgccacgccggcgatggcggcggccggaccgtcgatcgagccgtgcctcaacgtgaatggagctgctgctgctgcctgggatattggctcccagaacttgttcagtggatttgatgcacaatttcattcagtagaaagtgactgtttgctagacagcctcaagatggaaatgtaagaagaattaatccttgttattggaattttaaccacagaaaaatttgtggctgaagattctttattcgtagcaattgtaataatgaagtattctgtcagcaatggcaatacaagtacatttcacctgtt

SEQ ID NO: 390 - protein, 360 aa, Panicum virgatum
  misc_feature: Ceres CLONE 1724896
  misc_feature (1)..(51): Pfam Name: HLH Pfam Description: Helix-loop-helix DNA-binding domain
MARCQGTVESLCQGLLDLDDDKFGAMCSAFGYLQEWPDLAGAMCGAGLGATPAAVAPGAGAGAGNDDSSCSGSGGGGGGFRKRRPDACLDAKGDGNDMSKRPRGKQQLCGLGEMAAPGKAKQERPKAGAKKKAEAASTAAAAAGQKTDYIHVRARRGQATDSHSLAERVRRERISERMRYLQELVPGCSKVTGKAGMLDEIINYVQSLQKQVEFLSMKIAASNPVVSFDIVEDLFGRQLKQACSPAALPAAALPAGQLEPTCLQMNPLQQVHPSAAGGSNGFGLDMVVNNLYPPAAASCPVSVATPAMAAAGPSIEPCLNVNGAAAAAWDIGSQNLFSGFDAQFHSVESDCLLDSLKMEM

SEQ ID NO: 391 - DNA, 1417 bp, Panicum virgatum
  misc_feature: Ceres CLONE 1724913
  misc_feature: Encodes the peptide sequence at SEQ ID NO. 392
acatactcatcatcagcttactaagcaacacacaagagagccagagagagggagagggagagggagagggagagggagagagactagagagagatggcagctaccagcagcacgctctccttcccggtgatcaacatggagaagctccagaccgaggagaagccggcggccatggaggtcatccgcgacgcctgcgagaattggggcttcttcgagctgctcaaccatggcatctcccacgagctgatggacgaggtggagcggctgaccaaggcgcactacaccagctgccgcgagcccaagttccaagagttcgcggcgcggacgctggaagccggcgagaagggcgccgacgtcaaggacgtggactgggagagcaccttcttcgtccgccacctccccgcctccaacatcgccgacctccccgacctcgacgaccactacaggcaagtgatgaagcaattcgcatcggagatacagaagctgtcggagaagctgctggagctgctgtgcgagaacctgggcctggagccggggtacctgaagcaggccttcgcggggtccaacggcccgacgttcggcaccaaggtgagcgcgtacccgccgtgcccgcggccggacctcgtcaacggcctccgcgcgcacaccgacgccggcggcatcatcctgctgttccaggacgaccaggtgagcggcctgcagctgctcaaggacggcgagtgggtggacgtgccgcccgtgcgccacgccatcgtcgtcaacatcggcgaccagctggaggtgatcaccaacgggcggtacaagagcgtgatgcaccaggtgctcacgcgccccgacggcaaccgcatgtccatcgcgtccttctacaaccccggcgccgacgccgtcatcttcccggcgcccgcgctcgtcgccgccgccgacgccgacgaggagcgcgccgaggcggcgtacccgaggttcgtgttcgaggactacatgaacctgtacgtgcgccacaagttcgaggccaaggagccacggttcgaggccatgaagtccgccatcgccaccgcgtgagtgagaagcgcctactagctagcatcgagatcgaggtggctgcatgcttgcgtgtgccgtggcaagcattatattctcgacatgtgtgtattgtgtacggtagtagataggcacgtaatctgtgcttataggtggtgccacggtgtgagtgtatcgttgagtaatgtatagcttgcgtctcagataagtatgtacgtaagcatatatatatatatatatatatatatatatatatatatatatatatatatatatatatatatatttgtactgtaaagtttgtaccaccgcctatcttattattattaattggaggctccttttgaagggctccttttgaaaaaaaaaaaaaaaaaaa

SEQ ID NO: 392 - protein, 321 aa, Panicum virgatum
  misc_feature: Ceres CLONE 1724913
  misc_feature: Great-hit functional homolog of the protein sequence given in SEQ ID NO 9258
  misc_feature (1)..(101): Pfam Name: 2OG-FeII_Oxy Pfam Description: 2OG-Fe(II) oxygenase superfamily
  misc_feature (1)..(316): SWISSPROT Homolog: EC 1.14.17.4 1-aminocyclopropane-1-carboxylate oxidase 1
  misc_feature (9)..(316): SWISSPROT Homolog: EC 1.14.17.4 1-aminocyclopropane-1-carboxylate oxidase 2
  misc_feature: Useful for making plants with modulated heat sensitivity
MAATSSTLSFPVINMEKLQTEEKPAAMEVIRDACENWGFFELLNHGISHELMDEVERLTKAHYTSCREPKFQEFAARTLEAGEKGADVKDVDWESTFFVRHLPASNIADLPDLDDHYRQVMKQFASEIQKLSEKLLELLCENLGLEPGYLKQAFAGSNGPTFGTKVSAYPPCPRPDLVNGLRAHTDAGGIILLFQDDQVSGLQLLKDGEWVDVPPVRHAIVVNIGDQLEVITNGRYKSVMHQVLTRPDGNRMSIASFYNPGADAVIFPAPALVAAADADEERAEAAYPRFVFEDYMNLYVRHKFEAKEPRFEAMKSAIATA

SEQ ID NO: 393 - DNA, 1003 bp, Panicum virgatum
  misc_feature: Ceres CLONE 1724916
  misc_feature: Encodes the peptide sequence at SEQ ID NO. 394
acaaagcgcaaggccgtccacttctcttcgcgttccgtgttccaactccggcgactcgaccaccacccgagacccgagcagccagtctactccggccaccgcgatgtcgaggcgcggcgactgggtctacgagaacaacggcgggacgtgcgtggccatcgccggcgccgactactgcgtcgtcgcggccgacacccgtctctcggtcggatacagcatcctcacgcgcaaccactccaagatctgcgacttggctgacaaatgtgtactagcatcctctggctttcaaggtgatattaaggctctgcacaagaacctagctgccagagaattgctgtaccaacaccagcacaacaaaaggatgagctgtcctggtatggcacagctgctctccaataccctgtactacaagcggttcttcccgtattatgccttcaatgtgcttggtgggcttgacagtgagggtaaaggatgtgttttcacctatgacgctgttggttcctatgagaggaccggttacagtgctcaggggacaggatctagtttgatcatgccagtcttggataatcaacttaaatcaccaagccctctattactcccggccagagacgctgtcacacctttgtcggagtcagaagctgtcgatcttgttaaggatgtgtttgcatctgcaactgagagagacatctacactggagacaagctagagatcgtagtcattaacaaagccgggacaaagcgtgagtacatcgagctgaggaaggactaagctgacgcgtcggctgtgccggagctgccttatgcttccaacgtgttccctagtctggggattttatgtctaaagctgctgttgcttcatagaaagactcgtttgtttgcatctggctgtaccaggattcagtgagttttttctttgttgaaacaaattgcttggatactgaagaaatatttattggcaaggctacatggttggagagccctacaaaaaaaaaaaaaaaaaaaa

SEQ ID NO: 394 - protein, 221 aa, Panicum virgatum
  misc_feature: Ceres CLONE 1724916
  misc_feature (1)..(221): SWISSPROT Homolog: EC 3.4.25.1 Proteasome subunit beta type 1
MSRRGDWVYENNGGTCVAIAGADYCVVAADTRLSVGYSILTRNHSKICDLADKCVLASSGFQGDIKALHKNLAARELLYQHQHNKRMSCPGMAQLLSNTLYYKRFFPYYAFNVLGGLDSEGKGCVFTYDAVGSYERTGYSAQGTGSSLIMPVLDNQLKSPSPLLLPARDAVTPLSESEAVDLVKDVFASATERDIYTGDKLEIVVINKAGTKREYIELRKD

SEQ ID NO: 395 - DNA, 1068 bp, Panicum virgatum
  misc_feature: Ceres CLONE 1724926
  misc_feature: Encodes the peptide sequence at SEQ ID NO. 396
ctggaccactcattctgtttcagctataccaaaagcagcttctccaatctccagttctccacccttcttcatctccctcgtgagctcctttcttccacacctccacctccctggctccctctctcactctcatctcacccctgaacggcgcatgcagtgcagtggtgatcaaccaagatccgacaaccgtttccctgtttccttgatcaattttttctgatttgttccctgcgtcgtggagcactaccacccgcgctctttctgtcaggaggatggtggttctcgcgaagctcggggcgccgagcatgccaggttttatgatggacagaagaagactgatgttgctccctgcaattaccattggcatcgtctcctgtcagtacacatttgagaaagcagcggtgaaagctgaatttgctgatatgcctgcacttcgtggtaaagattatggaaagacaaaaatgcggtatccagattacactgaaacagaatcaggtcttcagtacaaggacttgcgggttggtgatggtccttccccaaaaaagggggagattgttgtggttgattgggatggctatacaattggatactatagccgtatttttgaagctagaaacaagacgaaaggaggttcgtttgagggtggtgacaaagacttcttcaagtttaaggttggatcgggacaggtcataccagcttttgaggaggctatatcaggcatggctccgggaggagttaggaggataatcgtaccaccggatcttggataccccgataatgactacaacaagttgggtccaagaccaacgacattctcgggacaaagagctcttgattttgttctacggaatcaaggcttgatagacaaaactctcctatttgacattgagcttctcaagataattccaaatcagtagtatatgaggtatgacgattattttggaacaaagaaacacatgttattatcatttgttattgaagaactgtgataaaaatatataatgtgtcatcgaatgtgaaaataaatttgctaggcatatgtgcacataaaaaaaaaaaaaaaaaaaa

SEQ ID NO: 396 - protein, 214 aa, Panicum virgatum
  misc_feature: Ceres CLONE 1724926
  misc_feature (35)..(146): Pfam Name: FKBP_C Pfam Description: FKBP-type peptidyl-prolyl cis-trans isomerase
MVVLAKLGAPSMPGFMMDRRRLMLLPAITIGIVSCQYTFEKAAVKAEFADMPALRGKDYGKTKMRYPDYTETESGLQYKDLRVGDGPSPKKGEIVVVDWDGYTIGYYSRIFEARNKTKGGSFEGGDKDFFKFKVGSGQVIPAFEEAISGMAPGGVRRIIVPPDLGYPDNDYNKLGPRPTTFSGQRALDFVLRNQGLIDKTLLFDIELLKIIPNQ

SEQ ID NO: 397 - DNA, 1366 bp, Panicum virgatum
  misc_feature: Ceres CLONE 1724943
  misc_feature: Encodes the peptide sequence at SEQ ID NO. 398
aagcagctcgatcggcgtgaccagctagcactgctgtgtgttcgggaaaaggaagtgttttgagcgagaggtcgaggctccaggtgatcagaccaacaatgtcacagtctggggccttccatctttctacgggcttccatggttctacgggcttgcaagggaaacaaattgacaaggatcaacttgaatcgaccgttgaacaatatgcaaagtatcatgacctgcacggaggtgatgaggaattcaggaagtcgaactatagtgacttggtgaacaagtattacgatcttgtaacaagcttcactgaataccactggggtcaatcattccatttcgcccaaagatggcgtggagaaaccattcgtgaaagcatcaagagatttgagcattttattgcccttcaattggggctcaagaagggaatgaaggtcctggatgtaggatgtggaattgggggacccttaagagaaatcgccagattcagctcaacagagataactgggttgaacaacaatgcttaccagatatcaaggggcaaggagctcatttctttggcaggtttgagtgaccagtgtaactttataaagggagacttcatgaagatgccattgcctgataacacctttgatgcagcctatgcaattgaggccacaatgcatgcacctgatgcactaggagcctacagggagatttacagagtgctgaaaccaggccagtattttgcactagatgaactgtgcttgactgataagtttgatccaaacaactctaagcatagggacatcaaggcagaaattgagcttggcactggcctgcctgccatccgtagcactcgcgagtgcatccaagcgatgaaagatgcaggattcgaggttatctttgcgaaggatcttgctgaggactccgactgcccttggtaccatgaaataaatcctggccatttctcattgaagagcatcagtaactcacgtgttggacacctcctcactcgtgcaattgttggcacactcgagttcctccatattgcccccaaaggctgcaatagactgttcagcatcctgcagactgcctcccacggcttggtgacgggcagccaggaacagatttttaccgtgagcttctttgtcctgggccggaaacctctcaaggagggtgaaatttaaagcagcctacaacaatgccgtatgtagtatgggctcttactctaaagttggctgtgatccttgcactgtactaaagtattgctagtcttaaaattctattaaaaatgctgggtttggttcccacgcttggttgtatgttgtgtactgaattactggttaagattactatctggaataaacatatttatagtatcaggataccg

SEQ ID NO: 398 - protein, 354 aa, Panicum virgatum
  misc_feature: Ceres CLONE 1724943
  misc_feature (1)..(98): Pfam Name: Methyltransf_11 Pfam Description: Methyltransferase domain
  misc_feature (1)..(130): Pfam Name: Sterol_MT_C Pfam Description: Sterol methyltransferase C-terminal
  misc_feature (1)..(351): SWISSPROT Homolog: EC 2.1.1.41 Cycloartenol-C-24-methyltransferase 1
  misc_feature (16)..(348): SWISSPROT Homolog: EC 2.1.1.41 Cycloartenol-C-24-methyltransferase
MSQSGAFHLSTGFHGSTGLQGKQIDKDQLESTVEQYAKYHDLHGGDEEFRKSNYSDLVNKYYDLVTSFTEYHWGQSFHFAQRWRGETIRESIKRFEHFIALQLGLKKGMKVLDVGCGIGGPLREIARFSSTEITGLNNNAYQISRGKELISLAGLSDQCNFIKGDFMKMPLPDNTFDAAYAIEATMHAPDALGAYREIYRVLKPGQYFALDELCLTDKFDPNNSKHRDIKAEIELGTGLPAIRSTRECIQAMKDAGFEVIFAKDLAEDSDCPWYHEINPGHFSLKSISNSRVGHLLTRAIVGTLEFLHIAPKGCNRLFSILQTASHGLVTGSQEQIFTVSFFVLGRKPLKEGEI

SEQ ID NO: 399 - DNA, 1097 bp, Panicum virgatum
  misc_feature: Ceres CLONE 1724944
  misc_feature: Encodes the peptide sequence at SEQ ID NO. 400
ggacggggacaggacaggtctcgcctttgatcgacggcggcggcgatgtctcttcctccggctccggcggaaggcggcggcggtggaggttccgccggcgacgactggttcctcgactgcggcatcctcgacgacctcccggccgcggcctgcggggccttcccgtggaacgcgtccccgtcgtcctccaaccccagtgtggaagttggcagctacgtaaacactggtgatgtcttcaaggagcctggcagtaataaacgtttaaggtcaggatcttctggtaggccaacatctaaagcttgtagggaaaaaatgagaagggacaagctcaatgacaggtttcttgaattgggctctaccttggaaccagggaaaccagtaaaagctgacaaagctgctatcctaagcgatgctactcgcatggttattcagcttcgctctgaagcacagcagctcaaggacaccaatggtagtcttgaagaaaagattaaggagctaaaggcagagaaggatgagcttcgtgatgagaagcagaagctgaaactagagaaggagagtttagaacaccagatgaagcttatgacctcaactccagcctacatgcctcatccaaccctgatgccagcacccttcccacaggctccgctagcaccattccatccccaggcgcaagctgcagggcagaagctgatgatgccctttgttggctacccgggatacccgatgtggcagttcatgccaccttctgaagtcgacacctcgaaggacagtgaagcgtgccctcctgtcgcttaatggcttcgagcgactggttgcgcttgcagcgtatgtggattaatcgcaactgaagcccctagttgtcggtccattgattgggtataactactgttcttatgtggtagttcgttggtgactgagtaagctgatgttcgtggcgccctatagaggctgctactagccccttcaatggctgtacaattttttgtggagaagagaagaatgttcattctttttctccatagcaacaatgccaaattaattatgggtcacatgtatggtacagtgtagtaaattcagtgatttttgtggtgcaatcc

SEQ ID NO: 400 - protein, 249 aa, Panicum virgatum
  misc_feature: Ceres CLONE 1724944
  misc_feature (1)..(52): Pfam Name: HLH Pfam Description: Helix-loop-helix DNA-binding domain
MSLPPAPAEGGGGGGSAGDDWFLDCGILDDLPAAACGAFPWNASPSSSNPSVEVGSYVNTGDVFKEPGSNKRLRSGSSGRPTSKACREKMRRDKLNDRFLELGSTLEPGKPVKADKAAILSDATRMVIQLRSEAQQLKDTNGSLEEKIKELKAEKDELRDEKQKLKLEKESLEHQMKLMTSTPAYMPHPTLMPAPFPQAPLAPFHPQAQAAGQKLMMPFVGYPGYPMWQFMPPSEVDTSKDSEACPPVA

SEQ ID NO: 401 - DNA, 710 bp, Panicum virgatum
  misc_feature: Ceres CLONE 1724952
  misc_feature: Encodes the peptide sequence at SEQ ID NO. 402
gaaaaccctagcctgcagcgccgcctaccccgagcagccgagcgaggaagcgaagactcctccccaccccagcgcaagagcaccatggcggcggcggcagtttacggtggcctcaaggggaagcttggcgtcgaggacgcccacgagctgcagctcaaccgcatccgcatcaccctgtcctccaagaacgtcaagaacttggagaaagtttgtgcggatttggtgaagggagccaaggacaagcagctgcgggttaagggtcctgtcaggatccctactaaggttctccacatcaccacccgcaagtccccttgtggtgaaggaacaaacacatgggatcgctttgagttccgcatccacaagagggtgattgacctgatcagctcccctgatgtggtgaagcagatcacctccatcaccatcgagcctggtgtcgaggtcgaggtgaccatcgcagacgtgtaatggcatgcagtttagctctgtcatcttatatcttgcgttgctttagttttgtgccccctttgtgtgcttgtatgagacatctgagtgattattagcatccaagactgtttttgcgccgcctactataatcccaccatagctgtttgtctggtctaaaggcctgtgcaactcgaaattttgattcagttcagttatctgtctgtttctccaaaatattattccccgaaaaaaaaaaaaaaaaaaaa

SEQ ID NO: 402 - protein, 126 aa, Panicum virgatum
  misc_feature: Ceres CLONE 1724952
  misc_feature: Great-hit functional homolog of the protein sequence given in SEQ ID NO 9345
  misc_feature: Great-hit functional homolog of the protein sequence given in SEQ ID NO 9386
  misc_feature: Useful for making plants with modulated biomass
  misc_feature: Useful for making plants with modulated flowering time
  misc_feature: Useful for making plants with modulated phosphate use efficiency
  misc_feature: The plant flowers significantly late compared to wild-type.
  misc_feature: The plant is abnormally large.
MAAAAVYGGLKGKLGVEDAHELQLNRIRITLSSKNVKNLEKVCADLVKGAKDKQLRVKGPVRIPTKVLHITTRKSPCGEGTNTWDRFEFRIHKRVIDLISSPDVVKQITSITIEPGVEVEVTIADV

SEQ ID NO: 403 - DNA, 1284 bp, Panicum virgatum
  misc_feature: Ceres CLONE 1724956
  misc_feature: Encodes the peptide sequence at SEQ ID NO. 404
acaccaccccccgctgcctgctgggggttccggcgacgacttggctagcggcggcgccctccgcgacgtcttcgccggggctttcgccggtgcccgtcgacgagcacccaccagatgggaatggactactacaacatcctcaaggtgaatcgcaatgcaaccttggatgacctcaagaagtcgtatcggcggcttgcgaggacatggcatccggacaagaacccaactggaggcgccgaggctgaggcaaagttcaagcagataactgaggcctatgaggtactaagtgatccagagaagcgtgcaatttatgaccaatatggtgaggaaggcttaaaggggatgcctccgcctggttcacagagccggtcctccacagctgctggcccaagcggtccaagtaatttccggtacaatcctagtgacccagatgatttctttgccgagttcatggcaggcaacaagacttactccttcgaccaagaccagacgcaatttcagcaaagatcacattggacttcagcaacaaacactaggagcgaagctccttctggttcacggaaggagagtggtgctagtacaagccagccagaaaagccactgcctgtggaaaaaacattaccttgcacccttgaagagttgtacaatggaacaaaaaggaaaatgaagatcactaggaacgttgcaaagccagatggaagagtagaagttgaaacagaggtcttggcagtggaagtgttgcctggctggaagaaaggaaccaagattacattcccaaacaaaggcgacaagctgcatggccagttggcacaggacctgaccttcatccttgacttgaagccccatgacgtgtacattcttgatgggaacaaccttcttgtaaagaaggagatccctctggtggatgcactcgcgggggcggcaataaacctcagaaccctagatggccggaatcttcctgtgagagtggaggaagtggtgcgccctgggtacgaggtggtgctggagaatgaagggtggccgatcagaaaggagccggggaagaaggggaatctggtaatcaagttcgacgtggcctttccaacaaggttgtcgtcgtcccagcgggcagctattaggcaaatcatgggctgctaaccagaaagggtcattgcattcttataggaacatgaaatagtggctatattggccctataatctagatagatagttgcttagttggaatttggaaattagacagataggcatttccatggttacaatgccccgtcgctaattctctct

SEQ ID NO: 404 - protein, 340 aa, Panicum virgatum
  misc_feature: Ceres CLONE 1724956
  misc_feature (1)..(64): Pfam Name: DnaJ Pfam Description: DnaJ domain
  misc_feature (1)..(123): Pfam Name: DnaJ_C Pfam Description: DnaJ C terminal region
MGMDYYNILKVNRNATLDDLKKSYRRLARTWHPDKNPTGGAEAEAKFKQITEAYEVLSDPEKRAIYDQYGEEGLKGMPPPGSQSRSSTAAGPSGPSNFRYNPSDPDDFFAEFMAGNKTYSFDQDQTQFQQRSHWTSATNTRSEAPSGSRKESGASTSQPEKPLPVEKTLPCTLEELYNGTKRKMKITRNVAKPDGRVEVETEVLAVEVLPGWKKGTKITFPNKGDKLHGQLAQDLTFILDLKPHDVYILDGNNLLVKKEIPLVDALAGAAINLRTLDGRNLPVRVEEVVRPGYEVVLENEGWPIRKEPGKKGNLVIKFDVAFPTRLSSSQRAAIRQIMGC

SEQ ID NO: 405 - DNA, 1041 bp, Panicum virgatum
  misc_feature: Ceres CLONE 1724967
  misc_feature: Encodes the peptide sequence at SEQ ID NO. 406
ctcctccgtcctccctccccaccccctcccgtctctctcgcccacacgcggagcggcagccgcgggacccccacccacgccgccggccatgtcggtggagacggagcggagctccaccgagtcctccgccgcctcgggcctcgacttcgaggacaccgcgctcgcgctcaccctccgcctcccgggctccgcgtcctcgtcctcgtcctcctccgccttccccgaccccgaccgcaagcgcgcctcctccgacgccgacgccgaccgctcctccccgctcgccgccgcgtcctccgatgctcccccggcacccaaggcgcgggtggtggggtggccgccggtgaggtcgtaccgcaagaacgcgctcgccgacgtcgtgggctccagcaaggctaagcaggccgccaagttcgtcaaggtggccgtcgacggcgcaccctacctgcggaaggtggacctcgaggcctacgcaggctacgaccagctcctccgcgcgctccaggacaagttcttctcccatttcaccatccgaaagttcgccgacgacgagaggaagctggtggacgcggtgaacgggacggagtacgtgcccacgtacgaggacaaggacggtgactggatgctcgtcggcgacgtcccctggaagatgtttgtggaagcctgccagcgccttcgtctgatgcaaagttcagaggctgttaacttagcaccaagagccgcccgatgaaacacactctctcgattcgcacggacttcttgaaggaaagatggaaccttgctgtcctgaggatcttcacgtgagatagaaatgtgtacagttgtcgcctaccccgcttttggtccccttatgctattgagctgagaaaaggttgtagttgctttacttgtctctagtttctacatatagatccgaagtttgaaatatacacgcctacagttcgtctctcgatgaataagaccagacatgcagaactcatgttcgatgcttgtcgcctgcttgccgttttgatgttaggtggttaaaaaaaaaaaaaaaaaaaa

SEQ ID NO: 406 - protein, 212 aa, Panicum virgatum
  misc_feature: Ceres CLONE 1724967
  misc_feature (1)..(180): Pfam Name: AUX_IAA Pfam Description: AUX/IAA family
  misc_feature: The sequence is a functional homolog of  SEQ ID NO 738 in the  10/374,780 US patent application
  misc_feature: Useful for making plants with modulated growth and phenotype characteristics
MSVETERSSTESSAASGLDFEDTALALTLRLPGSASSSSSSSAFPDPDRKRASSDADADRSSPLAAASSDAPPAPKARVVGWPPVRSYRKNALADVVGSSKAKQAAKFVKVAVDGAPYLRKVDLEAYAGYDQLLRALQDKFFSHFTIRKFADDERKLVDAVNGTEYVPTYEDKDGDWMLVGDVPWKMFVEACQRLRLMQSSEAVNLAPRAAR

SEQ ID NO: 407 - DNA, 1236 bp, Panicum virgatum
  misc_feature: Ceres CLONE 1724968
  misc_feature: Encodes the peptide sequence at SEQ ID NO. 408
gattcttcgcagctaacagcacggcctgctaagtccactctctagtcgagactccacggcatgagctccgcggcggcggcgatgacgggggcggggaaggtggtgtgcgtgaccggcgcgtcggggtacatcgcgtcctggatcgtcaagctgcttctcgcccgcggatacaccgtccgtgccaccgtgcgggacaccgctgacccaaagaaaacattgcacctgagtgcgttggatggagctaaggataggctgcatttctttaaagcaagtctgctagaagagggatcatttgatgctgcagttgagggctgtgaaactgtgttccatactgcttctcccttttatcacaatgtcaaggatcctaaggctgagttacttgacccagcagttaagggaacgctcaatgttcttggttcatgcacgaaagcttctattaaaaaggttgttgtgacatcatccgttgctgctgttgcctacaatggaaagccaagaactcctgaagttatagttgatgagacatggttttctgatccacaaatttgtgaaaagaataagcaatggtatgttgtgtccaagacgcttgcagaggaggctgcatggaagttctctagagataatggattggaaattgttatgataaacccagcaatggttattggaccccttttgcagcctacactaaatactagtgctgaagcaatcctaaagctaattaacgggtcatggtctacatatcccaatttcagctttggatgggtgaatgttaaagatgttgcactggcacatatccttgcatatgaagttccctcagcaaatggaagatattgcatggtggaaagagttgttcactactcagaagttgtcaacatcatacgaaagatgtatcctacaattcctcttgcagacaagtgtgcagatgacaagccatttgtcccaacataccaggtatcaaaggagaaaataagaagcttaggcatcgagttgattccactggagacgagcatcagggagaccatcgagagcttaaaagagaagggatttgttagttttgactcgagcaatctgtgaaagaaagcaaaagcttgatgttacaagatcagtggtctgtaccagacttcgcagttcacatgattgtatggtacgccaagtagtatcgtggcctgtaactgtaaggtgacctgaaataaacgaggcattctgtagtttttggaccaaaaaaaaaaaaaaaaaaaa

SEQ ID NO: 408 - protein, 336 aa, Panicum virgatum
  misc_feature: Ceres CLONE 1724968
  misc_feature (1)..(242): Pfam Name: Epimerase Pfam Description: NAD dependent epimerase/dehydratase family
MSSAAAAMTGAGKVVCVTGASGYIASWIVKLLLARGYTVRATVRDTADPKKTLHLSALDGAKDRLHFFKASLLEEGSFDAAVEGCETVFHTASPFYHNVKDPKAELLDPAVKGTLNVLGSCTKASIKKVVVTSSVAAVAYNGKPRTPEVIVDETWFSDPQICEKNKQWYVVSKTLAEEAAWKFSRDNGLEIVMINPAMVIGPLLQPTLNTSAEAILKLINGSWSTYPNFSFGWVNVKDVALAHILAYEVPSANGRYCMVERVVHYSEVVNIIRKMYPTIPLADKCADDKPFVPTYQVSKEKIRSLGIELIPLETSIRETIESLKEKGFVSFDSSNL

SEQ ID NO: 409 - DNA, 1068 bp, Panicum virgatum
  misc_feature: Ceres CLONE 1724972
  misc_feature: Encodes the peptide sequence at SEQ ID NO. 410
gtacccaagcaatgaacacctctaattccatatccagagctgagagcctgagactgagagagcttcttccgtacatccaccaaagtcccccaaaagacaacagcaagcaagcaagcaagaggaagggacatcgcaggccattagttagttcagccggcgagcaacatccccggtggcagccatggcgtccattgtaacagcagctaacagccattggggagccctgcacacctgcacagcctcctcaagggcgctcactggttggagccggcgcgcgctctccgtgccatcagcacaccgcgtgcggtcgccgagagctcgggtcgtcgtccgagccagcgcccagcgcgcgacctggttgcccgggctggacccgcctgctcacctcgacggcacgctaccgggtgacttcggcttcgatcccctggggctcggggaggaaccggctgccttgaagtggtacgtgcaggccgagctcgtgcactgccggttcgccatggcaggggtcgccggcatccttgtaaccgacttgcttcgcgtatcagggatccgggatctaccagtgtggttcgaggcaggtgcagccaaatttgacttcgccaacaccacgtcactcttcttcgttcagcttctcctgatgggattcgctgaaaccaagaggtacatggatttcatcaatccgggatcacaagcagaggaaggaaccttcataggcctagaggctgcactcgtgggctcacagccaggctacccaggaggtccactgtttaatccgttaggactcgcaaaagatatagagaatgcacatgaagagaagctgaaagaaatcaagaatgggaggttggcaatggtagccatgctaggcttcattgtgcaagcatcagtaactcatgttggccccatcgacaaccttttgacacatctttccgacccattcaacaaaaatatcattcacgcaatctcttcctgagaattctgcccccaatgcaaacgtttgtttttgctgtacagtgctatggcacaaaaagataacaatgtttcccaacagaaaaaaaaaaaaaaaaaaaa

SEQ ID NO: 410 - protein, 262 aa, Panicum virgatum
  misc_feature: Ceres CLONE 1724972
  misc_feature: Great-hit functional homolog of the protein sequence given in SEQ ID NO 9575
  misc_feature: Useful for making plants with modulated nitrogen use efficiency
MASIVTAANSHWGALHTCTASSRALTGWSRRALSVPSAHRVRSPRARVVVRASAQRATWLPGLDPPAHLDGTLPGDFGFDPLGLGEEPAALKWYVQAELVHCRFAMAGVAGILVTDLLRVSGIRDLPVWFEAGAAKFDFANTTSLFFVQLLLMGFAETKRYMDFINPGSQAEEGTFIGLEAALVGSQPGYPGGPLFNPLGLAKDIENAHEEKLKEIKNGRLAMVAMLGFIVQASVTHVGPIDNLLTHLSDPFNKNIIHAISS

SEQ ID NO: 411 - DNA, 1095 bp, Panicum virgatum
  misc_feature: Ceres CLONE 1724980
  misc_feature: Encodes the peptide sequence at SEQ ID NO. 412
ggacgcaggagaccacaggggagaggcaaggagcagcacgggcgatgggcgcgccgaagcagaagtggacgtcggaggaggaggatgcgctccgccgcggcgtgctcaagcacggagccggcaagtggcggaccatccagaaggaccccgagttcagcccagtcctctcgtcccgctccaacatcgacctcaaggacaaatggaggaatctaagtttcagtgcaagtggaatgggttcaagggataaaacgaaaaggacaactggaccctcatgttccccatcgtctacctcacaggcttcctcacaggcttcggctgtcccagtggcaaataaagttgctgaagctccaccagatgctgagaaaaagcaacaggaagtgaaacctcaaccaaagtatggtgccatgatcctggaagctctttcggagttgaatgagccaaatggtacagaacttactgaaatctgcagcttcatagagcaaaaacatggagtgccaacaacctttagaagagcgattggtacaaagttacggcgacttgtagattcaaaaaaaattgaaaaggttgatactaagtcctataggctcaccgattcctttgcgacaagaactccagctccaataaaagcttcagctccaaaacagaaggatccatccaagccatcaaaggtgtcaaagaacctaggattgtttgccacctccagccctgcactagaggcagccattgcggcagcagccaaagtagctgatgcagaggtgaaagcacatgatgcacatgatcagatgatggaggcagaaaggatcctcaagatggctgaggagacggagtctctcctcacgattgcagcagagatctatgatcgatgttcaaggggagagataaccacattaaatccggcgcaaagggaggtctgaaacctaccggagacctctgttctcatgtacatggataggttgtcctggattatctgcccatattgctcctgtgttgtataatttaagtgtttgtgctgtacttgggatatcgggttaaactaaatgacaccagtgcaccgcctgacatcaatcttttaatgatttgtagagaggtagtcgc

SEQ ID NO: 412 - protein, 289 aa, Panicum virgatum
  misc_feature: Ceres CLONE 1724980
  misc_feature: Great-hit functional homolog of the protein sequence given in SEQ ID NO 9316
  misc_feature (1)..(53): Pfam Name: Myb_DNA-binding Pfam Description: Myb-like DNA-binding domain
  misc_feature: The sequence is a functional homolog of  SEQ ID NO 1219 in the  10/666,642 US patent application
  misc_feature: Useful for biocontainment applications
  misc_feature: The plant produces a reduced number of seeds.
  misc_feature: Useful for making plants with modulated growth and phenotype characteristics
MGAPKQKWTSEEEDALRRGVLKHGAGKWRTIQKDPEFSPVLSSRSNIDLKDKWRNLSFSASGMGSRDKTKRTTGPSCSPSSTSQASSQASAVPVANKVAEAPPDAEKKQQEVKPQPKYGAMILEALSELNEPNGTELTEICSFIEQKHGVPTTFRRAIGTKLRRLVDSKKIEKVDTKSYRLTDSFATRTPAPIKASAPKQKDPSKPSKVSKNLGLFATSSPALEAAIAAAAKVADAEVKAHDAHDQMMEAERILKMAEETESLLTIAAEIYDRCSRGEITTLNPAQREV

SEQ ID NO: 413 - DNA, 1289 bp, Panicum virgatum
  misc_feature: Ceres CLONE 1724988
  misc_feature: Encodes the peptide sequence at SEQ ID NO. 414
agcggatcatcatcttggcccccttttctgcgttcaccggccgcggcctagtcccctccgccagtccctcctcctcctcctcctccgggcgccgcgtcgctttcctggtcgcagcagaaccggcttgatcaatccccggccgggcgagcgcgaggaggaaggcaagcgagcggccatgtgcccggggtcggtggacgcggcgccggcggcggggaagagcgtgtgcgtcatggacgccgcgggggcgctgggccacgcgctcgtcgaccgcctcctccaccggggctacaccgtccacgccgccacgtacggccgcggggaggacgaggacggcgcggaggacccggcggcggccgcgctgctcaagcacctgtcgcgcggcggcgacgcgtacgggcaccgcctcaaggtgttccgggccgaccccttcgactaccacgccatcgccgacgccgtccgcgggtgcgccggcgtcttctgcatgttcaacacgcccgacgaccaggcgcaatgcgatgaggtgacggtggaggaggaggttcgcgcggcgcacaacgtgctggaggcgtgcgcgcagacggacgccatggagcgggtcatcttcacctcctccctcaccgccgtcgtctggaacggcgacgccgacaaggaggaggagcacctcgccgtcgacgagaggtgctggagcgacctcgccttctgcaggaaattcaagctgtggcacgccctggccaagacgctctcggagaagacggcgtgggcgctggccatggaccggggcgtcgacatggtggccgtcaacgccggcctgctcacggcgccggggctcaccgccgcgcacccctacctcaagggcgcccccgacatgtacggcgccggcgtcctcgccaccgtcgacgtcgacttactcgccgacgcgcacgtcgccgcctacgagtgccccaccgcctacggcaggtacctctgcttcaacaacgccgtgtgccggcccgaggacgccgtcaagctcgcgcagatgctctcgccggccgcgccacgctcgccaccaagcgacgagctgaaggtgatcccacagaggatccagaacaagaagctcaacaagctcatgctggagttcgccggcggggtatacggggagctggactagggatttcccctatatttattcagttgattaattacatcccacagatgcaactagggttgtactcgtattcttttgtatctatactagtagtggttgtattcttttgtttcccctcaaaaatgggaaatttgtttggcttgcc

SEQ ID NO: 414 - protein, 323 aa, Panicum virgatum
  misc_feature: Ceres CLONE 1724988
  misc_feature (1)..(244): Pfam Name: Epimerase Pfam Description: NAD dependent epimerase/dehydratase family
MCPGSVDAAPAAGKSVCVMDAAGALGHALVDRLLHRGYTVHAATYGRGEDEDGAEDPAAAALLKHLSRGGDAYGHRLKVFRADPFDYHAIADAVRGCAGVFCMFNTPDDQAQCDEVTVEEEVRAAHNVLEACAQTDAMERVIFTSSLTAVVWNGDADKEEEHLAVDERCWSDLAFCRKFKLWHALAKTLSEKTAWALAMDRGVDMVAVNAGLLTAPGLTAAHPYLKGAPDMYGAGVLATVDVDLLADAHVAAYECPTAYGRYLCFNNAVCRPEDAVKLAQMLSPAAPRSPPSDELKVIPQRIQNKKLNKLMLEFAGGVYGELD

SEQ ID NO: 415 - DNA, 1208 bp, Panicum virgatum
  misc_feature: Ceres CLONE 1724990
  misc_feature: Encodes the peptide sequence at SEQ ID NO. 416
aacgccaaggaagggaaaaatcagaaacttttttttcgagatatttcggaagaggagggagtgcctgcctcgcaggctcgcagctcattcgccgagcgcacgagatcctccagagttttgagcgttttgctgccaaatttcgtgggtgatttgcgcgtatgggggctcatgtcgcggtggatgttggggagctcgtggcgtcccgacccggcgaggcagtggggttggtgcccggcggcaaggaggaagccgaggcgctgattgggatggtggagtgccgcatttgccaggaggaggacctggccaagaacctcgagagcccgtgcgcttgcaacggtagcctcaagtatgcccacagggaatgtgtgcaacgttggtgcaatgagaaaggagacataacctgtgaaatctgccatcagtcgtacaagcatggctacactgctccaccccaggtgcatcatgatgaaactaccatagagataagtggtggagattggaccatctctggcaaccgtttggatctacatgatcctagaatcttggcaatggctgctgctcaacaccgattgcttgaagatgagtatgatgagtatactgcaacaaacaacaacgctgctgcgttttgccattctatatttctgattttgatggctctgctgctcctgaggcatacactaaccattactaatagtgacgatgaagatgatgcatctgctatcttctcgctatttcttctgagagctgctggatttttactgccttgctacattatggcgtgggctattagtatcatgcagcgccaaagacaaagacaggaagaagcaatgctattaccaacggaagtggcaatcattctgcaccggaatggaagaacaatgcaattttctgtagcaccaccagaatctcctatctcccctcagccggaaccaaaccaatagaataataagcaacaggtcatctcttgagtcataccagatgcgtatcagcatctgtggttaggaactgaagcacattctgcaggcctgttgcctcagccacctggaatggccatgatgcaggaaaatggtgtgaccttcttcggattgtgttaacacttcacagctgaggttcaatgcttctttgacaggctctcggcatcttctgtacataaagacgtttctttaataagtgaatataagttaaatcaacaaaaaaaaaaaaaaaaaaaa

SEQ ID NO: 416 - protein, 259 aa, Panicum virgatum
  misc_feature: Ceres CLONE 1724990
  misc_feature (1)..(46): Pfam Name: zf-C3HC4 Pfam Description: Zinc finger, C3HC4 type (RING finger)
MGAHVAVDVGELVASRPGEAVGLVPGGKEEAEALIGMVECRICQEEDLAKNLESPCACNGSLKYAHRECVQRWCNEKGDITCEICHQSYKHGYTAPPQVHHDETTIEISGGDWTISGNRLDLHDPRILAMAAAQHRLLEDEYDEYTATNNNAAAFCHSIFLILMALLLLRHTLTITNSDDEDDASAIFSLFLLRAAGFLLPCYIMAWAISIMQRQRQRQEEAMLLPTEVAIILHRNGRTMQFSVAPPESPISPQPEPNQ

SEQ ID NO: 417 - DNA, 1063 bp, Panicum virgatum
  misc_feature: Ceres CLONE 1725019
  misc_feature: Encodes the peptide sequence at SEQ ID NO. 418
ggtcctctccatttaagctccacacctacaacttctctctccctgtctctctcttgcctccattgggcaagctgccaggccgcgtggctagctagccccgtgctgtgcgccggtgagaggcatagagagatgatgtcgagggaacgcaagaagcaggcggcggccgctcttcaggagaagctcaagatcctccgctccatcactcactcccacgctctgagcgacgcatccataatcatggacgcttcggcgtacatcaaggagctgaagcagaaggtggtgaggttgaaccaggagatcgcctgcgcgcaggacgcgcggagacacggctcctcctacccgacggtgaccgtggaaaccctagtgggcgggcacggcgggttcctcatcaacgtcttctccgacaagagctgcccggggctgctcgtctccgtgctcgaggccttcgacgagctggggctcagcatcctccaggccaccgcgtcctgcgccgacgactccttccgcctcgaggccgtgggtggggagaacgtggcggagaacgtggacgagcacgtcgtgaagcaggccgtgctgcaggccatcaggagctgctccgagagcggcagcgagcacgacgaggagtaggcggggctagctagctagctagcgcgtaagcgcacgcgccgcgtcgtcgccctcccgtcctgatgatgagcgtctcaagaagccgggatctcttttgcccgctccgttttttcctcccccctacctgctgtatttttttttttttttggcttcgatctacatttcctctctatcgctggcgaaacgagcagtagctcttccctatctactagtgctggcgatgatctcgatcggtgaataatccgtagcagcaagcagcaccatttccagtgtgatatatagtattattaattagcgctatatttatatatatgtctatgacgacaataagatgatcgatcaggcatgtaatgtaagaatgatgggaggttggaagcaaagctgaacggagctagcattcgactgcccttccacataaaaaaaaaaaaaaaaaaaa

SEQ ID NO: 418 - protein, 165 aa, Panicum virgatum
  misc_feature: Ceres CLONE 1725019
  misc_feature: Great-hit functional homolog of the protein sequence given in SEQ ID NO 9740
  misc_feature: Useful for making plants with modulated biomass
  misc_feature: The plant is abnormally small.
MMSRERKKQAAAALQEKLKILRSITHSHALSDASIIMDASAYIKELKQKVVRLNQEIACAQDARRHGSSYPTVTVETLVGGHGGFLINVFSDKSCPGLLVSVLEAFDELGLSILQATASCADDSFRLEAVGGENVAENVDEHVVKQAVLQAIRSCSESGSEHDEE

SEQ ID NO: 419 - DNA, 1238 bp, Panicum virgatum
  misc_feature: Ceres CLONE 1725025
  misc_feature: Encodes the peptide sequence at SEQ ID NO. 420
gggattgctaacattgactgctcgcataatggaagcagtaacgggggagagtacgaccctcgcgctcctcgcctccacctcggcgtcgctcggggccgggcgccgcgcgtgggctcgcctggccgtctcctcctctctggcggggccggctctccccaggctccgcggccgccgcgcgttcgccgccgcggccgggggcgccgtgatggggaaggccggacccggcgccgtcgaagccgacgcggggatggacgccgcgcagcggcgcctcatgttcgaggacgagtgcattctagttgatgaacaggacaacgtcgtcggccacgagtccaagtataactgccatctcatggaaaagatagaaactggacatgccctacacagagctttcagtgttttccttttcaactccaaatatgggttgctacttcagcaaaggtctgcaacaaaagtgacatttccacttgtatggacaaacacttgctgtagccatcctctctaccgtgagtcagagttgattgaggaaaattgtgtaggggtgagaaatgcagcccagcgcaagctatttgatgaattgggaatagtggctgatgaattaccactagacgagttcattcctctcgggaggatgctttataaggctccttcagatggaaaatggggcgaacatgagttggattacctgctgttcatggttcgtgatgtgaagctcaacccaaatccagaagaagttgcggacgtcaagtacatgaaccgggatcagctgaaggagctgctgaggaaagcagatgccggggaggatggtgttaagctgtccccttggttcaggctggtggtggacaacttcctcatgggctggtgggatcatgtcgagcaagggaccctccaggaggctgctgacatgaaaaccatccataagttgtagacttgtagatcacccagcacttgttttctccgttaagaaatagccgctgctgttgcggttggcgcatgttttgtaatagctgtcatttcgatgctaataatccataaagtaacactagagtgttcttatacccaaaatgatagtgaaaacagatactcataaagagtgggtagatttctgcgttttcatttgtaagaactagcaaggtgtcccgtgcaaatagcgcgggtagctagttttttggttctatgtgttattgtttttattacttgaaaatagatgcatatatttttttcagaccatctaaaccgat

SEQ ID NO: 420 - protein, 298 aa, Panicum virgatum
  misc_feature: Ceres CLONE 1725025
  misc_feature (71)..(298): SWISSPROT Homolog: EC 5.3.3.2 Isopentenyl-diphosphate Delta-isomerase I
MEAVTGESTTLALLASTSASLGAGRRAWARLAVSSSLAGPALPRLRGRRAFAAAAGGAVMGKAGPGAVEADAGMDAAQRRLMFEDECILVDEQDNVVGHESKYNCHLMEKIETGHALHRAFSVFLFNSKYGLLLQQRSATKVTFPLVWTNTCCSHPLYRESELIEENCVGVRNAAQRKLFDELGIVADELPLDEFIPLGRMLYKAPSDGKWGEHELDYLLFMVRDVKLNPNPEEVADVKYMNRDQLKELLRKADAGEDGVKLSPWFRLVVDNFLMGWWDHVEQGTLQEAADMKTIHKL

SEQ ID NO: 421 - DNA, 1466 bp, Panicum virgatum
  misc_feature: Ceres CLONE 1725032
  misc_feature: Encodes the peptide sequence at SEQ ID NO. 422
aatctccaaaagaacccaccaatcaaccccatcgccccgcggcgacgatgagaggcctcctcgcgtgcgccaagctcgcccgccgcgccgtcggcttctccggcgcggcgcccgcgcgcgtccgccacctggcgagcgcggcggaggcggcggaggccgagctcaagaagacggcgctctacgacttccacgtcgccaacggcggcaagatggtgccgttcgccgggtggagcatgcccatccagtacaaggactccatcatggagtccaccgtcaactgccgcaccaacggcggcctcttcgacgtcgcccacatgtgcggcctcagcctcaagggccgcggggccatccccttcctcgagtccctcgtcatcgccgacgtcgccggcctcaaggacggcaccggcacgctcaccgtcttcaccaacgagaaaggcggcgccatcgacgactccatcgtcaccaaggtcaccgaccagcacatatacctcgtcgtcaacgccggctgcagggacaaggacctcgcccacatcgaggcgcacatggaggccttcatcaagaagggcggagatgtcaagtggcacatccacgatgagcgctcgctgctcgcattgcagggtcctcttgctgcacctaccctccagttgctgacaaaagaagatttgagcaaaatgtacttcagtgacttcaagatgattgacatcaatggatatgcatgctttcttacaagaacaggttatactggtgaggatggctttgaaatctctgttccatcagagaatgcagtcgatcttgcaaaggctatcctggaaaaatcagaggacaaggtccggttgactggcttgggtgcccgtgacagtctccgcctggaggctggcctctgcctgtatggcaacgacatggagcaacacatcacgccagtcgaagccggcctctcatgggcaatcggcaaaaggaggagagcagaaggtggtttccttggtgcagatgtgatcctcaagcagcttcaggaaggtccaaagatcaggcgtgttggcatgttcacacaagggccgcctgcacggggtcacagtgagcttgtgagcagctctggggagaaaatcggtgaggtgaccagcggagggttcagcccctgcctgaagaagaacatcgccatgggttacgttaaatcaggtttgcataaggctgggacagaattcaaggttgttgttcgtggcaagtcctatgacgctgttgtgacaaagatgcccttcgtgccaaccaagtactacaagccctcatagattgtacaaacggatgttctttcagctacagttctctcttgcaattctcttgtcgcagtctgtccctgacgggcttctgcagtgttgcagctgtaacttctgtaagactccctcgtacagcttgacattttacttctgtctgctaataatgctttatattttcaaaaaaaaaaaaaaaaaaaa

SEQ ID NO: 422 - protein, 411 aa, Panicum virgatum
  misc_feature: Ceres CLONE 1725032
  misc_feature (1)..(216): Pfam Name: GCV_T Pfam Description: Aminomethyltransferase folate-binding domain
  misc_feature (28)..(411): SWISSPROT Homolog: EC 2.1.2.10 Aminomethyltransferase, mitochondrial precursor
  misc_feature (34)..(410): SWISSPROT Homolog: EC 2.1.2.10 Aminomethyltransferase, mitochondrial precursor
MRGLLACAKLARRAVGFSGAAPARVRHLASAAEAAEAELKKTALYDFHVANGGKMVPFAGWSMPIQYKDSIMESTVNCRTNGGLFDVAHMCGLSLKGRGAIPFLESLVIADVAGLKDGTGTLTVFTNEKGGAIDDSIVTKVTDQHIYLVVNAGCRDKDLAHIEAHMEAFIKKGGDVKWHIHDERSLLALQGPLAAPTLQLLTKEDLSKMYFSDFKMIDINGYACFLTRTGYTGEDGFEISVPSENAVDLAKAILEKSEDKVRLTGLGARDSLRLEAGLCLYGNDMEQHITPVEAGLSWAIGKRRRAEGGFLGADVILKQLQEGPKIRRVGMFTQGPPARGHSELVSSSGEKIGEVTSGGFSPCLKKNIAMGYVKSGLHKAGTEFKVVVRGKSYDAVVTKMPFVPTKYYKPS

SEQ ID NO: 423 - DNA, 1241 bp, Panicum virgatum
  misc_feature: Ceres CLONE 1725056
  misc_feature: Encodes the peptide sequence at SEQ ID NO. 424
aaaattgttttctgtccactgcctctagtcgtcttccgccggcgccgccgccgatggcttcctccatggccgccgcctgcaccgccgccgcggcctccctctcaccggcgcagtcggcgaaccagaggacgcctgcccagggccgcgtcctcttcccctgcgcggcccccagctcccgctcccttcggctcagccccgccggccgccgctcgccggcgacccgctcctcgcgtcgggcggccaaggctgtggtggcagcgttggctgaccctctcaaggtcatgatagcgggggctcccgcatcaggcaagggcacgcaatgtgagctcatcaaggccaaatttggtctggtgcacatctctgctggagatttgttacgggcagagatcgctgctgggtccgagaatgggaagcaggccaaggaattcatggagaagggccagctagtgcctgatgagattgtagtcaatatggttaaggaacgccttctgcaaccagatgctcaggaaaacggttggctattggacgggtacccaagaagctattcacaggccatggcgttggaaactcttggaatccggcctgatattttcattttgttagatgttccagaggaactccttgttgaaagggtggttggaagacgttctgatcctgtcacagggaaaatatatcatttgaagtattctccaccagagaatgaagaaattgcttcaaggcttacacaaagatttgatgatacagaagaaaaggtcaagttgaggctgcagacttattatcaaaatatcgactccttactaacaacatatgaggatgttattgtcaaagtgaaaggagatgccaccaaggaagaagttttttcggagatcgaaaagctgctgagctctagcctggacaagaaaacagtaattgtggccagcgcctgagcgggtaatatctatgcaggtcaggcatgtttatgcatgctcccttacatgctaagaaaacttctccatttggatgtggttgaaacatagggtttgcctggaattgtaccatgtgttgttgtacacaaatggaagtgacagatcattcatagggatgaggacttcagagatcctttctaaccatacctgcgctgtacatggtttgtttccatcctgtaaacatacatgttatgtttctcagctggagaaatggtcagtgattgatttttatttgtttgctgcaacaggttttggcattaatccttttatactttc

SEQ ID NO: 424 - protein, 290 aa, Panicum virgatum
  misc_feature: Ceres CLONE 1725056
  misc_feature (1)..(180): Pfam Name: ADK Pfam Description: Adenylate kinase
  misc_feature (69)..(289): SWISSPROT Homolog: EC 2.7.4.3 Adenylate kinase, chloroplast
MASSMAAACTAAAASLSPAQSANQRTPAQGRVLFPCAAPSSRSLRLSPAGRRSPATRSSRRAAKAVVAALADPLKVMIAGAPASGKGTQCELIKAKFGLVHISAGDLLRAEIAAGSENGKQAKEFMEKGQLVPDEIVVNMVKERLLQPDAQENGWLLDGYPRSYSQAMALETLGIRPDIFILLDVPEELLVERVVGRRSDPVTGKIYHLKYSPPENEEIASRLTQRFDDTEEKVKLRLQTYYQNIDSLLTTYEDVIVKVKGDATKEEVFSEIEKLLSSSLDKKTVIVASA

SEQ ID NO: 425 - DNA, 979 bp, Panicum virgatum
  misc_feature: Ceres CLONE 1725086
  misc_feature: Encodes the peptide sequence at SEQ ID NO. 426
atccaagtccaagaagctccactgctccactgatcccagctcgaccagagaccacgctactgccaagctgctgatcctcagcgagcctgcaatggacacgccctcgccgccgccgccgccgtccgcggagcacgaggagtacaggacggtgtggtcggcgccgcccaagaagccggcggggcggaccaagttccgggagacgcggcacccggtgttccgcggcgtgcggcgccgcggccaggcggggcggtgggtctgcgagctgcgcgtcccgggccggcgcggctccaggctctggctcggcaccttcgccacgcccgagctggcggcgcgcgcgcacgacgccgccgccatcgcgctctccggccgcgccgcctgcctcaacttcgccgactccgcgtggctgctcccgccgctgatgcccgcggcgctggccagcgcgcgggaggtcagggacgcggtcgccgaggccgtcgaggcgttccggcagcagcggggctcggcgtcggcatcggcgccgtcgtcgccagcggtggaagcggccgacgaggacgaggatggcagcggctcgcctggcgcggcgccgtcgcccgacgtcttgttcgagctcgacgacgtgttcgggttggacggcatggttgatgctggatcgtactacgcgagcttggcgcaggggctgctcctggacgcgccggccgcagctggagcgggagcgtggtgggaggacgtcgagcatggcaccgctgacattgcactgtggagctactagcgtaatgctacctccaataaaaaaaaagggatgaccgtcacacaaggagaattagcacacagaaagcactgtcctgcttgtctgaaacgtcaagagtagcagcttgcttctgacaaatttcggatggttcacaattgagagaaacagagcaacgtctagtgagggggggctctctgggcgcatcagcagcaaaaaaaaaaaaaaaaaaaa

SEQ ID NO: 426 - protein, 225 aa, Panicum virgatum
  misc_feature: Ceres CLONE 1725086
  misc_feature (1)..(66): Pfam Name: AP2 Pfam Description: AP2 domain
  misc_feature: The sequence is a functional homolog of  SEQ ID NO 1227 in the  10/374,780 US patent application
  misc_feature: The sequence is a functional homolog of  SEQ ID NO 706 in the  11/435,388 US patent application
  misc_feature: The sequence is a functional homolog of  SEQ ID NO 780 in the  11/435,388 US patent application
  misc_feature: Useful for making plants with modulated growth and phenotype characteristics
MDTPSPPPPPSAEHEEYRTVWSAPPKKPAGRTKFRETRHPVFRGVRRRGQAGRWVCELRVPGRRGSRLWLGTFATPELAARAHDAAAIALSGRAACLNFADSAWLLPPLMPAALASAREVRDAVAEAVEAFRQQRGSASASAPSSPAVEAADEDEDGSGSPGAAPSPDVLFELDDVFGLDGMVDAGSYYASLAQGLLLDAPAAAGAGAWWEDVEHGTADIALWSY

SEQ ID NO: 427 - DNA, 982 bp, Panicum virgatum
  misc_feature: Ceres CLONE 1725087
  misc_feature: Encodes the peptide sequence at SEQ ID NO. 428
atcactctgctgtctgtcttgctctgctctgcttgcggcggccttggactcccctgttcggccgttcctctccccctgcccgcgcctctgttcggccgctttccctccctccgagatcatggggctactcagcatcatcaggaagatcaagcgcaaggagaaggagatgcgcatcctcatggtgggtctggacaactcggggaagacgaccatcgtgctcaagatcaacggggaggacaccagcgtcatcagccccaccctcggcttcaacatcaagaccatcaagtaccacaaatactcgttgaatatatgggatgttggaggacagaagactatccgatcttattggagaaattactttgagcagacagatggcctagtttgggtggttgatagttcagacgtacgaaggcttgatgattgccgtgctgaactccacaatctcttgaaagaagagagactagccggagcttcgttgttagtttttgcaaataaacaagacatacagggagctctcaaaccagctgaaattgctaaggttctgaatctggaggtgatggacaggagcaggcactggaagatcgttggctgcagcgcctacaccggcgaggggctcctcgacggattcgattggctcgtgcaggacatcgcttctcggatctacgtcctagactgatattttgtcatgccttgtcatgataaaagctgtcataaatcttcgaactggaagataggggtctcctcggtaagtgaactggaagcttgatttttttcccccatcccagtgtgcatcacatttaatgtgctattgagcttatgtgaatccctttgtcttagcttgaaatggtaatgaaatagcatttcaaacattgagggatactgtttcttcgccaccctaggctaaaaactatatgtattcagaccgtattccaattgaatgatccttgaatattgaatttaacaaaaaaaaaaaaaaaaaaaa

SEQ ID NO: 428 - protein, 185 aa, Panicum virgatum
  misc_feature: Ceres CLONE 1725087
  misc_feature (1)..(176): Pfam Name: Arf Pfam Description: ADP-ribosylation factor family
MGLLSIIRKIKRKEKEMRILMVGLDNSGKTTIVLKINGEDTSVISPTLGFNIKTIKYHKYSLNIWDVGGQKTIRSYWRNYFEQTDGLVWVVDSSDVRRLDDCRAELHNLLKEERLAGASLLVFANKQDIQGALKPAEIAKVLNLEVMDRSRHWKIVGCSAYTGEGLLDGFDWLVQDIASRIYVLD

SEQ ID NO: 429 - DNA, 1049 bp, Panicum virgatum
  misc_feature: Ceres CLONE 1725098
  misc_feature: Encodes the peptide sequence at SEQ ID NO. 430
gcacaccggcacacgcccccatccatctggtcaccatctctccccctcgccactcgctgcagcagccaccgacgagcaccggaggaaccctagccgccgcaagcccaccgcgcacaacatgagcgcctccaggaagctgttccaggccgccgccaggtccttcctctccgcctcccagcgctcctcccccgccgccctcctcgccgccgagggccgcaccgccgcgctcgccacgctcaccaacctgggcaggaagaccctccctgccgcctacgcctaccacaagcaggaatcccaccgcgcctcctcgggatggggagccttcgccgccgccgtccccgctgcagtttacatgctccaggaccaggaggctcacgccgcagagatggagcgcaccttcattgccatcaagcctgacggcgtccaaagaggcctgatttctgagattgtatctcgatttgagagaaaaggttacaagcttgttgccatcaagttgattgttccatccaaagaattcgctcagaagcactatcatgatctcaaagacagacctttcttcaatggactgtgtgactttctcagctctggccctgtacttgcgatggtttgggaaggagagggtgttatcaagtatgggagaaaactaattggtgccacagacccacagaaatctgaaccaggaaccatcaggggtgatcttgccgttgttgttggaagaaacatcattcacggaagtgatggcccggagacagcaaaggatgagattgctttgtggtttgaacccaaggagcttgtctcttacaccagcaacgcggagaagtggatctacggggtgaactaaccagcgaatcattttgtttctattttgctctccattatcacataattgccaatagaccaaggcaggatgtactaataaagttgcgaccgtcgcttttgagttggattgtgaccttctggtgcagtaaggcacaaggaaggaaggaaatgtaccttgaaatatagagcgtgcacttagtcgcgatgttcaaaaaaaaaaaaaaaaaaaa

SEQ ID NO: 430 - protein, 240 aa, Panicum virgatum
  misc_feature: Ceres CLONE 1725098
  misc_feature (1)..(135): Pfam Name: NDK Pfam Description: Nucleoside diphosphate kinase
  misc_feature (11)..(240): SWISSPROT Homolog: EC 2.7.4.6 Nucleoside diphosphate kinase 4, chloroplast precursor
  misc_feature (11)..(240): SWISSPROT Homolog: EC 2.7.4.6 Nucleoside diphosphate kinase IV, chloroplast/mitochondrial precursor
MSASRKLFQAAARSFLSASQRSSPAALLAAEGRTAALATLTNLGRKTLPAAYAYHKQESHRASSGWGAFAAAVPAAVYMLQDQEAHAAEMERTFIAIKPDGVQRGLISEIVSRFERKGYKLVAIKLIVPSKEFAQKHYHDLKDRPFFNGLCDFLSSGPVLAMVWEGEGVIKYGRKLIGATDPQKSEPGTIRGDLAVVVGRNIIHGSDGPETAKDEIALWFEPKELVSYTSNAEKWIYGVN

SEQ ID NO: 431 - DNA, 886 bp, Panicum virgatum
  misc_feature: Ceres CLONE 1725099
  misc_feature: Encodes the peptide sequence at SEQ ID NO. 432
gctttccggccgagctcattttttctgcccccgcaccacgcccggctgcgtttcggagatcaggtaggaagcggagccctgctagcgctagcgagtgaggagccgcgcgaacgagggtttttgatccgaatcccatggccggcgccggggcggacggggagcgccggatcggcgtggcgatggactactcggacagctccaagaaggcgctggcgtgggccgtcgacaacctgctccgccacggggacaccctcgtcgtcctccacgtcctgcaccacggcggggaggaggccaagtccggatccccgctgatccctctctccgagttccgggagcccgaggtgatgaagaactacggcgtcaaagccgacgccgaggtgctcgacatgatcgacacggcggcgcgccagaagcagctcaaggtggtggccaagctttactggggcgacgccagggagaagatctgcgacggcgtcgaggagctcaagatcgactccctcgtcatgggcagccgcggcctcggcccgatccagaggatccttttgggaagtgtgacaaactacgtgctgtcgcacgcatcgtgcccggtgacagtcgtcaaggggaagtaatgacccggccaacctaccagctatatgatcgaggatggtagcatgcagtttgtgtggattaagcactgtgaatctgtgatcggtgttgttaccgcatttgaataaagtgtggctttttattatttgcgatgccgcagctttcagaaaccctgtcgatctctagtctttgaacgctactagtactagtgctctctagtcttaattattcagatccaatttgagggtttttttttaagaaatcgaatttgaggtttcaaaaaaaaaaaaaaaaaaaa

SEQ ID NO: 432 - protein, 158 aa, Panicum virgatum
  misc_feature: Ceres CLONE 1725099
  misc_feature (1)..(154): Pfam Name: Usp Pfam Description: Universal stress protein family
MAGAGADGERRIGVAMDYSDSSKKALAWAVDNLLRHGDTLVVLHVLHHGGEEAKSGSPLIPLSEFREPEVMKNYGVKADAEVLDMIDTAARQKQLKVVAKLYWGDAREKICDGVEELKIDSLVMGSRGLGPIQRILLGSVTNYVLSHASCPVTVVKGK

SEQ ID NO: 433 - DNA, 1243 bp, Panicum virgatum
  misc_feature: Ceres CLONE 1725100
  misc_feature: Encodes the peptide sequence at SEQ ID NO. 434
aagcatagtagtgtgcgactgccacaagagctcactcactcttctgtgatctgtactgaaagtcctgaacctgaccagctaagcagcgagaacgatggcggaagagtacggccgcagcggctacggcaggtcaggcgccggcgacgactacgagagcggctaccacaagtccggcaccgacgactacggccggggcgaaggcgggtacaacaagtcgggcaccgacggtggctacggcggcgggtacaacaagtccggcggtgacgagtacggccgcagcggcggggacgggtacaacaggcccggaaccgatgagtacggccgcggcggcggcgacaggtccggcacggacgactacggcagcggctacaagaagtccggcaccgacgactacgatcgcagcggcgggtacaacaaatcggccaccgacgactacaacagcggcggcggcggcgcgtacaacaagtcctccggcggtgacgacgagtacaccaccggtggcggcaggtacaagaagacctctggcgacgacgagtacaccggcggtggcgggtacgacagcaagtccgatggcggcgtcgacgagtacggctcctcccggaacgactcggagaagtacaggaaggaggagaaggagcacaagcacaaggagcacctcggcgagatgggcgccctcgccgccggcgccttcgccatgtacgagaggcacgaggcgaagaaggacccggagcacgcgcagcgtcacaagatcgaggagggcgtggcggcggtgggcagcggcgggttcgcgttccacgagcaccacggcaagaaggaggccaaggacgcggcggaggacgccgaggaggaggaggaggaggccgcccgcggcgagggcaagaagaagcaccacttcttcggctagctagctgttgcgtgactggcctcctgcgtgctcctccagcagcgggtgaataaaagccggggacgtttcgtgcgtacggctctgcgtatccgtgtaccacgtatccgtatgtgctacgtacgtcactgtggttactgatgatgtggctgcagctgtgtggagtggagtctgttggtgtacgtgtctgcatgtgcatttgtctacgtcgttttgtttctacgtggtatatatgtatgtacgtggtttgcacttgatgactttgtaaccggcactctcgcgtagaatccgtgtatattttaataaaaaagtgacaccggtgcctgatttgcttctcttgcg

SEQ ID NO: 434 - protein, 269 aa, Panicum virgatum
  misc_feature: Ceres CLONE 1725100
  misc_feature (1)..(54): Pfam Name: ABA_WDS Pfam Description: ABA/WDS induced protein
MAEEYGRSGYGRSGAGDDYESGYHKSGTDDYGRGEGGYNKSGTDGGYGGGYNKSGGDEYGRSGGDGYNRPGTDEYGRGGGDRSGTDDYGSGYKKSGTDDYDRSGGYNKSATDDYNSGGGGAYNKSSGGDDEYTTGGGRYKKTSGDDEYTGGGGYDSKSDGGVDEYGSSRNDSEKYRKEEKEHKHKEHLGEMGALAAGAFAMYERHEAKKDPEHAQRHKIEEGVAAVGSGGFAFHEHHGKKEAKDAAEDAEEEEEEAARGEGKKKHHFFG

SEQ ID NO: 435 - DNA, 1091 bp, Panicum virgatum
  misc_feature: Ceres CLONE 1725114
  misc_feature: Encodes the peptide sequence at SEQ ID NO. 436
accaactgcagcagcgagacagagaatggctgcggcgccgtggtccctcgcgtgctcctcccgcgtctcccgccccgcggacctccgccgcacggcggcggcccctgctgatgccccgcagcagctccgcctcggccgctcccgccgccgcgcgcagcgcaccgtcgccatggctggatccggcaagttcttcgtggggggcaactggaagtgcaatggaacaaaggactccattagcaagcttgtctctgaattgaatgctgctacactcgaaactgatgtagatgttgtggtggcacctccattcatttatattgaccaggtcaagaattcactaactggtcgtattgaggtttctgctcagaatgtatggatcggaaaaggaggagcctacactggagagatcagtgcagaacaattggtggacataggctgtcaatgggttattcttgggcactctgagcgtagaaatattattggtgaaactgatgagtttatcgggaagaaggctgcatatgcattgagccaaaatattaaggttattgcctgcataggagagctgttggaagagagggaagcagggaaaactttcgatgtttgttttaagcagatgaaggcttatgcagatagtatttcaaactgggccgatgttgtaattgcatacgagcctgtttgggcaattggaactggaaaagttgctactcctgaacaagcccaggaagtccatgctgccatacgcgattggttgaagaccaatgtatcacctgatggtgcctctagcattcgaataatttatggaggttctgtaaatgctggcaattgtgcggagcttgcaaagaaagaagacattgatggttttcttgttggtggtgcctctttgaagagcccggacttcgccaccattatcaactcagtgacttctaagaaagttgcagcatgatgcactcggctagaaataagtgatcgcaagagaggcagctcggctgccgtaccataggccttgtgggaggtgctccgtgtgatggtgtgcagtcacctcctccgtctggttttttgctgatttgtagcacgaaaaaaaaaaaaaaaaaaaa

SEQ ID NO: 436 - protein, 304 aa, Panicum virgatum
  misc_feature: Ceres CLONE 1725114
  misc_feature: Great-hit functional homolog of the protein sequence given in SEQ ID NO 9556
  misc_feature (1)..(240): Pfam Name: TIM Pfam Description: Triosephosphate isomerase
  misc_feature (43)..(304): SWISSPROT Homolog: EC 5.3.1.1 Triosephosphate isomerase, chloroplast precursor
  misc_feature: Useful for making plants with modulated biomass
  misc_feature: The cauline leaves are abnormally small.
MAAAPWSLACSSRVSRPADLRRTAAAPADAPQQLRLGRSRRRAQRTVAMAGSGKFFVGGNWKCNGTKDSISKLVSELNAATLETDVDVVVAPPFIYIDQVKNSLTGRIEVSAQNVWIGKGGAYTGEISAEQLVDIGCQWVILGHSERRNIIGETDEFIGKKAAYALSQNIKVIACIGELLEEREAGKTFDVCFKQMKAYADSISNWADVVIAYEPVWAIGTGKVATPEQAQEVHAAIRDWLKTNVSPDGASSIRIIYGGSVNAGNCAELAKKEDIDGFLVGGASLKSPDFATIINSVTSKKVAA

SEQ ID NO: 437 - DNA, 1419 bp, Panicum virgatum
  misc_feature: Ceres CLONE 1725117
  misc_feature: Encodes the peptide sequence at SEQ ID NO. 438
agcgggagggagaggtcgtcgtcgtcggccgccgatcgattggtccagggatcgcacggtctctcgctcccctcctctcttctcgctcgctcccaggctcctcccatacagcggttacgttgattgctggtgccatggagatggaggcgaggcgggtgctgtggctggcggcggtggcgtggtgggcggcggcggtggcgcggagcgacccgcaggtgccgtgctacttcatcttcggcgactcgctcgtggacaacggcaacaacaactacatcgtgtcgctggcgcgcgccaactacccgccctacggcatcgacttcgccggaggcccgtcggggcgctttaccaacgggctcaccaccgtcgacgtcatcgctcaactcctgggtttcgacgacttcatccctccgttcgcggccacgagcggtgaccagctcctcggcggcgccaacttcgcctccgccgccgcgggcatccgcgccgagaccgggcagcagctgggcgggcgcatcccgttcgcggggcaggtgcagaactaccagacggcggtggcgacgctggtgagcatcctgggcgaccaggacacggcgtcggaccacctcagccgctgcatcttcagcgtcggcatgggcagcaacgactacctcaacaactacttcatgccggccttctacatcaccggcagccgcttcacgccggagcagttcgccgacgcgctcatcgccgactaccgccgctacctgcaggtgctctacagctacggcgcgcgcaaggtggtgctgatcggcgtggggcaggtcgggtgcagccccaacgagttggcccgctacagcgccgacggcgccacctgcgtggaccgcatcgacggcgccatccagatcttcaaccgccgcctcgtcggcctcgtcgacgagttcaacgcgctccccggtgcccacttcaccttcatcaacggctacaacatcttcgctgacatcctcgccaacgccgcatcctacgggttcacggtgacgaacgcggggtgctgcggagtgggcaggaacaacgggcaggtgacgtgcctgccgttccaggcgccgtgcgccaacagggacgagcacatcttctgggacgccttccacccgtcggaggcggccaacatcatcgtcggccggcgatcctaccgcgcccagtcgcccaacgacgtctaccccatggacatcagcacgctcgcgtccatctgatcgcaggccgggcgattccgctaatccacgcagcaatggtggaaacgggattcagccgtgcgattcttttttttttctgtacaagcaagcgcgtatatctgtaattcttttttttaccaggcatacttggtatatctgcagtggatacttactcctagataataatttatttccataaaaaaaaaaaaaaaaaaaa

SEQ ID NO: 438 - protein, 362 aa, Panicum virgatum
  misc_feature: Ceres CLONE 1725117
  misc_feature: Great-hit functional homolog of the protein sequence given in SEQ ID NO 9523
  misc_feature (1)..(313): Pfam Name: Lipase_GDSL Pfam Description: GDSL-like Lipase/Acylhydrolase
  misc_feature: Useful for making plants with modulated phosphate use efficiency
MEMEARRVLWLAAVAWWAAAVARSDPQVPCYFIFGDSLVDNGNNNYIVSLARANYPPYGIDFAGGPSGRFTNGLTTVDVIAQLLGFDDFIPPFAATSGDQLLGGANFASAAAGIRAETGQQLGGRIPFAGQVQNYQTAVATLVSILGDQDTASDHLSRCIFSVGMGSNDYLNNYFMPAFYITGSRFTPEQFADALIADYRRYLQVLYSYGARKVVLIGVGQVGCSPNELARYSADGATCVDRIDGAIQIFNRRLVGLVDEFNALPGAHFTFINGYNIFADILANAASYGFTVTNAGCCGVGRNNGQVTCLPFQAPCANRDEHIFWDAFHPSEAANIIVGRRSYRAQSPNDVYPMDISTLASI

SEQ ID NO: 439 - DNA, 865 bp, Panicum virgatum
  misc_feature: Ceres CLONE 1725131
  misc_feature: Encodes the peptide sequence at SEQ ID NO. 440
aatccatcccgcgctgcaagctgccatccatccattccattcgcatccaatggcgctctcactctccctggcgccgccagtagccgcagcagccgccgccggcggcagcagcagcccgagcttcctccggccggcggcggtggcgatgaggcgtggtcgaaggagtaatgcgcgcggcagcgtggtggcgatggccgacctgctgggcgacttcggcgcgcgcgatcccttcccggaggagatcgagagcaagttcggagagaaggtgctgggcaacgtggacaccctccaccagatcctcatcccgaccctgtcggcgctctcgctggctcgcctcccgctgcagcccgacgcggaggcgctctccctggacgatgcgcgcaggctgctcctcaaggtggtcgggtggaggctgctgctctccgacgacgagcagcggcccgcgcggctgcagtgcgtctggaaggtccgcgacgagtcctgcggccaggagctcatcgccaggatcaacgcagcgctcgacggtgccggccacgcgccggcagcactggtctgggaggcccccagccaggtgagggccgagctctcaacgccctccgccgccggcgacagcctcaccgtcaacgactacatcgtcgccgccaggatagacaaagtcaagacgctcgatcttatctccaagaagcgagtctgggcatgaatggcaattggatcttacattttctgtcccttcaattaattaattagaattacttgcctgcttgaatttattggttgtattaattgtactttcaattcctcctgcgggctgccatgtgtgtattgtacttgcaattactgagtggaaaaaaaaaaaaaaaaaaaa

SEQ ID NO: 440 - protein, 216 aa, Panicum virgatum
  misc_feature: Ceres CLONE 1725131
  misc_feature: Great-hit functional homolog of the protein sequence given in SEQ ID NO 9689
  misc_feature (2)..(52): Pfam Name: Pterin_4a Pfam Description: Pterin 4 alpha carbinolamine dehydratase
  misc_feature: Useful for making plants with altered alkaloid content
  misc_feature: Useful for making plants with altered terpenoid content
MALSLSLAPPVAAAAAAGGSSSPSFLRPAAVAMRRGRRSNARGSVVAMADLLGDFGARDPFPEEIESKFGEKVLGNVDTLHQILIPTLSALSLARLPLQPDAEALSLDDARRLLLKVVGWRLLLSDDEQRPARLQCVWKVRDESCGQELIARINAALDGAGHAPAALVWEAPSQVRAELSTPSAAGDSLTVNDYIVAARIDKVKTLDLISKKRVWA

SEQ ID NO: 441 - DNA, 1331 bp, Panicum virgatum
  misc_feature: Ceres CLONE 1725135
  misc_feature: Encodes the peptide sequence at SEQ ID NO. 442
atcaagaacccacccgaatcccccccgcggccccgcctccgcgcgccaatcaccaccaacccaccagtagcacagcagcagctcactctcgcctcgcctccgcggcaggaggagccatgcagcccgacgccatcgcccccttgcaccgcctcgcccgcgtcgccgcgcacctcaacccgcagatggaggaggacgcggtggcgctgaggcccgcggcgtgccgcgccaagggcggcgcgccggggttcaaggtcgccatcctgggcgcggcgggcgggatcggccagccgctgtcgatgctcatgaagatgaacccgctcgtgtccgtgctgcacctctacgatgtcgtcaacacgcccggggtcaccgccgatatcagccacatggacaccggcgccgtggttcggggcttccttggcgcacagcagcttgatgcagcacttacaggaatggaccttattatcatacccgctggcctccctaggaaaccaggaatgacaagggatgatttattcaacaagaatgccgggattgttcgcatactttgtgaaggtgttgccagatgctgtcctgatgcgattgtgaatttgatcagcaacccagtgaactcaactgtacccattgctgctgaggttttcaagaaagctggaacatataatcccaagcgtctccttggagtcacgacacttgatgttgtgagggctaacacctttgtggctgaagtgcttggagttaatccaagagatgtcaatgttcctgttgttggcgggcatgcaggggtaaccatattacccctcctctcccaggtcacccctccaagctcattcactcaggaagaaatcaaatatttgacgaaccgcatacagaatggtggcacagaagttgtggaggcaaaggctggggcaggctctgcaactctgtcaatggcttttgctgctgcgaaatttggtgatgcatgcttgcgagcaatgtgcggtgaagatggcatcgtggaatgctcatatgttgcgtctgaggtgacagagctaccgttctttgcaacaaaagtgaggctgggccgtggtggagctgaggagatcctccctcttggacctctcaacgaatttgaaagagttggcctggaagcggcaaagaaggaactgagcgagagcattcggaagggcgtcgctttcgtgaacaagtgaagtgatacgaatcgtccccgagatcctcgaccgtacatagatgtaagagcgttgtggtatagtgctcctgtacctgtaaatatcacttttgtaagacaatagtaaaataaggtaattacaatttagtaaaaaaaaaaaaaaaaaaaa

SEQ ID NO: 442 - protein, 355 aa, Panicum virgatum
  misc_feature: Ceres CLONE 1725135
  misc_feature (1)..(165): Pfam Name: Ldh_1_C Pfam Description: lactate/malate dehydrogenase, alpha/beta C-terminal domain
  misc_feature (1)..(353): SWISSPROT Homolog: EC 1.1.1.37 Malate dehydrogenase, glyoxysomal precursor
  misc_feature (4)..(355): SWISSPROT Homolog: EC 1.1.1.37 Malate dehydrogenase, glyoxysomal precursor
MQPDAIAPLHRLARVAAHLNPQMEEDAVALRPAACRAKGGAPGFKVAILGAAGGIGQPLSMLMKMNPLVSVLHLYDVVNTPGVTADISHMDTGAVVRGFLGAQQLDAALTGMDLIIIPAGLPRKPGMTRDDLFNKNAGIVRILCEGVARCCPDAIVNLISNPVNSTVPIAAEVFKKAGTYNPKRLLGVTTLDVVRANTFVAEVLGVNPRDVNVPVVGGHAGVTILPLLSQVTPPSSFTQEEIKYLTNRIQNGGTEVVEAKAGAGSATLSMAFAAAKFGDACLRAMCGEDGIVECSYVASEVTELPFFATKVRLGRGGAEEILPLGPLNEFERVGLEAAKKELSESIRKGVAFVNK

SEQ ID NO: 443 - DNA, 1260 bp, Panicum virgatum
  misc_feature: Ceres CLONE 1725144
  misc_feature: Encodes the peptide sequence at SEQ ID NO. 444
accaccgatcgaccaaccaccgcactccactgatctctggtcgatcactaacaagctccttccctagaagaagctccagctagtagatcgagcggcagctagcaaccatggcggcgcggcgggctccgctggctctgctcgcggcgtccgtggccctcctggccgccgccgcgtcggcggactcctggctctacgagaagttcaacacggacggcaccgtccgcgccgactacgacgcgtcgggccagcaggtcgccatgctcaacctcgaccggagctccggcgccgggctcaactccaaggagcagtacctctacggcgagttcagcatccagatgaagctcatccccggcaactccgccggcaccgtctcgtgcttctatcttacctcgggtgacagcgacgaccacgacgagatcgacatggagttcatgggcaactcgagcgggcagccggtggtgctcaacaccaacgtgtgggccagcggcgacggcaagaaggagcaccagttcgacctgtggttcgacccggccgccgactaccacacctacaccatcgtctggaaccccaccaacatcctcttcaaggtcaacggcaacgtcatccgctgcttcaagcgctacgccgacctgccctacccgagctcgaggcccatggcgctgcacgccacgctgtgggacggcagctactgggccaccgagaaaggcaaggtacccatcgactgggcgggggcccccttcgtcgtctcctaccgcggctactccgccgacgcctgcgtcagcggcggcgcgtgccccgccggcagcgaccggtggatgaacaagcagcccgacgccgccgagtgggggacggtcaagtgggcggagagcaactacatgcgctacaactactgcgaggacgggtggaggttcccgcaggggctccccgccgagtgcagccgcagctgatcgagctgatggtgattcgtccgccgtctgatgcattcatcaggcgtgcattattgttaataagctcttgatttatttcttttaattttgtcggacgatgtccgtatgattcttgatctgtgattgtgaatttgtgattattaaaaggcagccccgcatggagccatgcaagggcgagaaaataccagttttcttgtaaaagataagctttattcctactactttggataaaggcgatacttctgtcacttgtgggtagaatcatctaatggacaagttgaaaatgagaacccaaaaaaaaaaaaaaaaaaaa

SEQ ID NO: 444 - protein, 279 aa, Panicum virgatum
  misc_feature: Ceres CLONE 1725144
  misc_feature (1)..(180): Pfam Name: Glyco_hydro_16 Pfam Description: Glycosyl hydrolases family 16
  misc_feature (3)..(278): SWISSPROT Homolog: EC 2.4.1.207 Xyloglucan endotransglycosylase/hydrolase protein 8 precursor
MAARRAPLALLAASVALLAAAASADSWLYEKFNTDGTVRADYDASGQQVAMLNLDRSSGAGLNSKEQYLYGEFSIQMKLIPGNSAGTVSCFYLTSGDSDDHDEIDMEFMGNSSGQPVVLNTNVWASGDGKKEHQFDLWFDPAADYHTYTIVWNPTNILFKVNGNVIRCFKRYADLPYPSSRPMALHATLWDGSYWATEKGKVPIDWAGAPFVVSYRGYSADACVSGGACPAGSDRWMNKQPDAAEWGTVKWAESNYMRYNYCEDGWRFPQGLPAECSRS

SEQ ID NO: 445 - DNA, 1441 bp, Panicum virgatum
  misc_feature: Ceres CLONE 1725155
  misc_feature: Encodes the peptide sequence at SEQ ID NO. 446
aaatctcggcgaggctcgccagatctaatccagtcttgcagcagctgaggcagccacccggcggaggagggagagcagaaaggcacccaagaaccgtggagagcgagtgagcatggcgggggatggcgacggccgcgcgggccttcctcggatcgcggtggtcggcgccggcatcttcgcgcgcacgcagtacatccccaggctccgcgagatcgcgcacctcgtcgtcctcaaggccatctggagccgcacccaggaatccgcaaaggcggctgcggagcttgctcgcgactttgcccctgagatcgagtgcaaatggggtgatgcggggctggaggagatcatgggagactgttcaatcatgggcgtcgctgttgttcttcctgggcaagtacaggttgagctttccctaaagatgctcaaggcaggaaaacatgtgattcaagagaaacctgcttctgcatcaacaacagaagcagaaaccgcactttcagtctacaattcatttccaaatcagtttccatataaaccaatttgggctgtcggagaaaactacagatttgaacctgcctttgtggagtctagcaagctgatcaaagatatcggtgatatgatgcacatccaagttatcattgaagggtcaatgaacagttcaaacccatatttcaatagctcctggagacgaaattttgtgggtggtttcgttctggacatgggtgtccacttcattgcaggactccgaatgcttgtaggttcagaaatcacaagtgtatcatctatctcccgtcatgtggatatggctttgccaccaccagataacatatgttcccttttccaactggaaaatggatgtgctggtgtctttgtatttgcagtcaattcaaggtcaccaaagctattatggcgggtcgacggaacaaaaggaacaattgaagtagaacgtggagttgatagtgggaaacatggttaccaggtgttattctctggtgaaaatgggcagtgccagaagacgttttacccattctgcggagtgaatgaagaactgaagatgtttgtccaggacatgttggcggctagcaaagatggagaccatgaggctgaaccccgcagttcttatgtcgagggtgcccgtgatgttgccgtgctagaagccatgctagaatctagtgcgaagcaaggggccccagttcaagtgaagagattcccatagatgtgaattatatcacacaaaagactgtttcttctagcgtgattgtccattggaacagcatagattcatgatagtaaaatgaacactgctccatcttccaacttcataccatttatggtataaaatgcaaaaatggtagatctagaaccaccattctttaactctgatctaccaggtatatatcttcataaaatcatgtattttttcatagaaaaaaaaaaaaaaaaaaaa

SEQ ID NO: 446 - protein, 365 aa, Panicum virgatum
  misc_feature: Ceres CLONE 1725155
  misc_feature (1)..(98): Pfam Name: GFO_IDH_MocA_C Pfam Description: Oxidoreductase family, C-terminal alpha/beta domain
  misc_feature (1)..(103): Pfam Name: GFO_IDH_MocA Pfam Description: Oxidoreductase family, NAD-binding Rossmann fold
MAGDGDGRAGLPRIAVVGAGIFARTQYIPRLREIAHLVVLKAIWSRTQESAKAAAELARDFAPEIECKWGDAGLEEIMGDCSIMGVAVVLPGQVQVELSLKMLKAGKHVIQEKPASASTTEAETALSVYNSFPNQFPYKPIWAVGENYRFEPAFVESSKLIKDIGDMMHIQVIIEGSMNSSNPYFNSSWRRNFVGGFVLDMGVHFIAGLRMLVGSEITSVSSISRHVDMALPPPDNICSLFQLENGCAGVFVFAVNSRSPKLLWRVDGTKGTIEVERGVDSGKHGYQVLFSGENGQCQKTFYPFCGVNEELKMFVQDMLAASKDGDHEAEPRSSYVEGARDVAVLEAMLESSAKQGAPVQVKRFP

SEQ ID NO: 447 - DNA, 1182 bp, Panicum virgatum
  misc_feature: Ceres CLONE 1725157
  misc_feature: Encodes the peptide sequence at SEQ ID NO. 448
gtatcgcccacttcctctctcagctcctctgctagctctctcacgcacaagcacacacacctgcaacttcaggtcgacgcgcgccgatcgatcgtacgtgtcagcagcgagccatcatggccttggcacgcggcggcagggggtcgtcatcccgggcggcggcggcggcgctggcggcggcgcttgccgcggcggtgctggcgggcgtggcgagcggggacttcgcggcggaccgagcggagtgcgcgaaccagctgatgggcctggcgacgtgcctgacgttcgtgcaggacaaggcgacggcggtggcgccgacgcgcgactgctgcgcggggctcaagctggtggtggccgccagcaagaagtgcatgtgcgtgctggtcaaggaccgcgacgagccggcgctgggcttcaagatcaacgtcacccgcgccatggacctgccctccctctgcaactaccccgcgaccttctccgactgcccaaagattcttgggatgtcgccggacgcccccgaggcggagatcttcaaggagtacgcgaggaagcacgagtcccagaacggcaccgccaccatacccgccgctgcaaccggtgccgcgggcgggaagagcgccacgagctcgtcgccggcgggcggggccggcgccgggagcaagccgggcgcggtcgtcgtctacctcgcgtcggcgctggtcgcattcgtctccgtcctcgcgtgatgggcgccgggcgcgacgacgcagtcgatcggcattcatagcaggcaggggagatacactattatactacggatgatcggaggagaaggaagccggagagggataaagcgacgagcagcaaaagacacgcgtactctttttttttttccttttttcttttttagcttttgtgatgaggcgtcgggatgtgctgctgactgtgcactagcgacgcagctttgtactccccgctgttgggctgtgctgccttccagcctgggatttaaatgtggtgggcggagactgtcgagctgtctgtctgaatctgatcgatttgccttactgcaagtttggtttgcaaattttagttcatcttcttgtttgaaacagttttcatgtcatcttctgtaagcaacatttggggcacatgtaatagaaattatacctggattgtttatgctaaaaaaaaaaaaaaaaaaaa

SEQ ID NO: 448 - protein, 201 aa, Panicum virgatum
  misc_feature: Ceres CLONE 1725157
  misc_feature (1)..(80): Pfam Name: Tryp_alpha_amyl Pfam Description: Protease inhibitor/seed storage/LTP family
MALARGGRGSSSRAAAAALAAALAAAVLAGVASGDFAADRAECANQLMGLATCLTFVQDKATAVAPTRDCCAGLKLVVAASKKCMCVLVKDRDEPALGFKINVTRAMDLPSLCNYPATFSDCPKILGMSPDAPEAEIFKEYARKHESQNGTATIPAAATGAAGGKSATSSSPAGGAGAGSKPGAVVVYLASALVAFVSVLA

SEQ ID NO: 449 - DNA, 1525 bp, Panicum virgatum
  misc_feature: Ceres CLONE 1725161
  misc_feature: Encodes the peptide sequence at SEQ ID NO. 450
aagcagagtagtcgggtgaaagtttctccccgggagaggcagctcggcggcaacggagagaggccttccgcctgcggcctgcggcctgctctaccgactaccgtcggttccatacttccatgtccttctccgtctcgagatgaggttctgatgccggaatcctgcttttccggctattttaccgcctgggggtttcacgttgatgcggcgtggtttcaagtccccactccctgaattctgtctccacggcttccagtcagacgctcaaagcttcgctctaccatctcgctgaattgcttttcgtccaatttgggcagctcgctgttgcttgcaggagatcgctgccctttcttggatgctgcggaggtctactgctgtgttcggtggtgaggtctgctgctgccctgcaagttagtttgatctcaatctctgatcggcaattcaattgttacagcctctagcagcatccttgcagaaccaagttctttgattctttcatcctgcttctctttctttttgggtatctcccccgtgcaacttgtccattgaccataggaggaggaaattgttctttggctcattctctgtcacaatggacgatggagctgacctcccctgccaattgctcttctcccacccggaggtgcctggcagtttcgacgagctcttcaacagcgccacaacgacctgcacccacacgcacagctgcaaccctcccggcccgtcgggccccatgcacacccacacgtgcctgcacacgcacacccaggtcctcgccggaggcgccgagggcgacgacgccagagaggacccggccaagccacggagaccgttggggaacagggaggccgtgcgcaagtaccgggagaagaagaaggcgcacgcggctttcttggaggaggaggtcaagaagctccgagccgccaaccagcagctgctggggaggctgcaggaccatgccgcactggaggcagaggtgatgaggctcaggagcctcctgctcgatgtccgtggtaagattgacgccgaggtcagcgcgtcccctttccagaagccgtgcagtgttggctctgtggtctctgctgatcctgctccgtgcttcaatggcaactctgaggtagcaggagcctgggaggagagctccataccatcggctgcagattgcaggatagatgaaggcggtggtgtgtcacgagaaattgatgttccagaaggtttgcatcattccatggatgttgttgcaaactttgtgggttctgattctctagctgaatgagcgcttgcctgattggcagttttttttttaacctctgccagcttctttgatcttacttcagagatcaattctcatggaataaagaatgaggaactgactatagaatagaagtgtagaactatctttagatgtactatatgtttcttatgttgatgttcagtgtggacagtgtacagacttgttgtatagtagcactggaaatttaaaaactgccaatatctaagacattctacaaaattctttgccggc

SEQ ID NO: 450 - protein, 227 aa, Panicum virgatum
  misc_feature: Ceres CLONE 1725161
  misc_feature (1)..(58): Pfam Name: bZIP_2 Pfam Description: Basic region leucine zipper
MDDGADLPCQLLFSHPEVPGSFDELFNSATTTCTHTHSCNPPGPSGPMHTHTCLHTHTQVLAGGAEGDDAREDPAKPRRPLGNREAVRKYREKKKAHAAFLEEEVKKLRAANQQLLGRLQDHAALEAEVMRLRSLLLDVRGKIDAEVSASPFQKPCSVGSVVSADPAPCFNGNSEVAGAWEESSIPSAADCRIDEGGGVSREIDVPEGLHHSMDVVANFVGSDSLAE

SEQ ID NO: 451 - DNA, 1358 bp, Panicum virgatum
  misc_feature: Ceres CLONE 1725177
  misc_feature: Encodes the peptide sequence at SEQ ID NO. 452
aaagacgtggttcgagtctttcagaacactcgtcagatggctccggcggcgacggtgcaggcgaggtgcctgctggccgcggcgctgctcctcgtggtggggacccccggcggcggcgcgcagccgctggtgccggcggtgatgacgttcggcgactcgtcggtggacgtcgggaacaacgactacctccacaccatcatcaaggccaacttcccgccctacggcagggacttcgccaaccacgccgccacggggcggttctgcaacggcaagctcgccaccgacatcaccgccgacacgctggggttcaccacctacccggcggcgtacctcagcccgcaggcgtccgggcagaaccttctgatcggcgccaacttcgcgtctgcaggatccggatactacgaccacacggcactcatgtatcacgcgatcccgctgtcccagcagctggagtacttcaaggagtaccagtcgaagctggcggcggtggccggcgccgggcaggcccggtccatcgtcaccggcgcgctgtacatcatcagcttcggcgcgagcgacttcgtccagaactactacatcaaccccctgctcttcaagacccagaccgccgaccagttctccgaccgcctcgtcggcatcttcagcaacaccgtctcgcaactctacggcatgggggcgcggcgcatcggcgtgacgtcgctgccgccgctggggtgcctcccggcgtcgatcacgctgttcgggcacggtggcgacgggtgcgtggcgaggctcaaccgcgactcccagagcttcaaccggaagatgaacgccaccgtcgacgcgctgtcgagccggtacccggacctcaagatcgccgtcttcgacatctacacgcccctctacgacctcgccaccgacccgcaggcgcagggcttcacggaggcgcggcgggggtgctgcgggacggggacggtggagacgacggtgctcctctgcaaccccaagtcggtgggcacgtgccccaacgccacgtcctacgtgttctgggacgccgtccacccgtcggaggcggccaaccaagtcatcgccgactcgctcatcaccgagggcctcgtcctcgtcacgtgaaccactcgctcggtcaccggagttgctgctgctgcatctgtttgtgtgcagggcagtgtccttagacgaaacaggctacatcattgtgcgcatcctgtgagaaaataacgtttggtgaatcgtaggggggcagggtttatttgcttcaaacagtacaataacatttacttggtgtctctgggttctgaagagtctgtaaaattactctttttctgggttttgaaatttaactgtataatgttaatgtc

SEQ ID NO: 452 - protein, 357 aa, Panicum virgatum
  misc_feature: Ceres CLONE 1725177
  misc_feature (1)..(314): Pfam Name: Lipase_GDSL Pfam Description: GDSL-like Lipase/Acylhydrolase
MAPAATVQARCLLAAALLLVVGTPGGGAQPLVPAVMTFGDSSVDVGNNDYLHTIIKANFPPYGRDFANHAATGRFCNGKLATDITADTLGFTTYPAAYLSPQASGQNLLIGANFASAGSGYYDHTALMYHAIPLSQQLEYFKEYQSKLAAVAGAGQARSIVTGALYIISFGASDFVQNYYINPLLFKTQTADQFSDRLVGIFSNTVSQLYGMGARRIGVTSLPPLGCLPASITLFGHGGDGCVARLNRDSQSFNRKMNATVDALSSRYPDLKIAVFDIYTPLYDLATDPQAQGFTEARRGCCGTGTVETTVLLCNPKSVGTCPNATSYVFWDAVHPSEAANQVIADSLITEGLVLVT

SEQ ID NO: 453 - DNA, 1436 bp, Panicum virgatum
  misc_feature: Ceres CLONE 1725181
  misc_feature: Encodes the peptide sequence at SEQ ID NO. 454
ggattttgttcctgctcccttcccttgaccctcctcagtcctcgcacaaggcctcttctacagttctacctgacagggccaccatgtctgcttttgtgggaaaaaacgcagatgagctgatcaagaccgccaagtgcctggcgacgccgggcaagggcatcctggcctccgacgagtcgacgggcaccatcgggaagcgcctcgccagcatcaacctcgagaacgtggagcccaaccggcaggcgctccgcgagctgctcttcacggcgcccggcgcgttcgactacctctccggggtcatcctcttcgaggagaccctgtaccagaagacctccgacgggacgccgttcgtggacctgctcgtcgccggcggcgtggtcccggggatcaaggtggacaagggcaccgtcgagattgcgggcaccaacggcgagaccaccacccaggggcacgactccctgggcgcgcgctgcgccaagtactacgaggccggcgcgcgcttcgccaagtggcgcgccgtgctcaaggtcagcgccgccggggagccgtccgagctcgccgtcaggcagaacgccgaggggctcgcgcggtacgcgctgctctgccaggagaacgggctcgtccccatcgtcgagcccgagatcctcaccgacggcgggcacgacatcaagacctgcgccgccgccaccgagcgcgtcctcgccgccgtctacaagtcgctcagcgaccataaggtcctcctcgagggcacgctcctcaagaccaacatggtcacccctggctccgacagccccaaggttggcgcggaggtgatcgcggagtacacggtggcggcgctgcggcgcacggtgccgccggcggtgcccggggtggtgttcctgtcgggcgggcagagcgaggaggaggcgacgcagaacctgaacgccatgaacaagctggaggtgctcaagccctggtcgctctccttctccttcggccgcgcgctgcagcagagcaccctcaagaagtggctcggcaagaaggagaacgtcgccgccgcgcaggccgccttcgtcgctcggtgcaaggccaactccgaggccacgctcggcaagtacgccggctccggcgccggggacgccgccgcctccgagagcttgtacgtcaaggggtacaagtactagccgctgccacgccggtggcctcggcctgggacccaataatccttgtggtccacgtggcagcgtttggaccatgtcaagattcgtgcggatatatgtgcttcacttgtctagttgtgttgtgtactaaactgtctcttccctccagcatctagttaaccaaaacaccgtcccaaaatgttgatttgtttgcagtttgcatgtacactgatactagtattactgaagatacaggtgtaatacatggatgttactgaaaaaaaaaaaaaaaaaaaa

SEQ ID NO: 454 - protein, 359 aa, Panicum virgatum
  misc_feature: Ceres CLONE 1725181
  misc_feature (1)..(348): Pfam Name: Glycolytic Pfam Description: Fructose-bisphosphate aldolase class-I
  misc_feature (1)..(352): Pfam Name: Glycolytic Pfam Description: Fructose-bisphosphate aldolase class-I
  misc_feature (1)..(349): Pfam Name: Glycolytic Pfam Description: Fructose-bisphosphate aldolase class-I
  misc_feature (1)..(359): SWISSPROT Homolog: EC 4.1.2.13 Fructose-bisphosphate aldolase, cytoplasmic isozyme
  misc_feature (1)..(359): SWISSPROT Homolog: EC 4.1.2.13 Fructose-bisphosphate aldolase, cytoplasmic isozyme 1
MSAFVGKNADELIKTAKCLATPGKGILASDESTGTIGKRLASINLENVEPNRQALRELLFTAPGAFDYLSGVILFEETLYQKTSDGTPFVDLLVAGGVVPGIKVDKGTVEIAGTNGETTTQGHDSLGARCAKYYEAGARFAKWRAVLKVSAAGEPSELAVRQNAEGLARYALLCQENGLVPIVEPEILTDGGHDIKTCAAATERVLAAVYKSLSDHKVLLEGTLLKTNMVTPGSDSPKVGAEVIAEYTVAALRRTVPPAVPGVVFLSGGQSEEEATQNLNAMNKLEVLKPWSLSFSFGRALQQSTLKKWLGKKENVAAAQAAFVARCKANSEATLGKYAGSGAGDAAASESLYVKGYKY

SEQ ID NO: 455 - DNA, 1084 bp, Panicum virgatum
  misc_feature: Ceres CLONE 1725190
  misc_feature: Encodes the peptide sequence at SEQ ID NO. 456
atgcatagatgcatagggtcgacccggcggcgtgactcttccccacgcgagtcgcgacccttgcgccgtcagactccctctcgcatcggcacggaggcgagcgagcaggcggcggcgggcgcgccatcctcccccggcagcggcgcctcggcggctcgccctcccctccggcggatctcccctccggaggaagctatgggtgccgaggaggacgctgccgcccgccgcgagcgcctccgtgccctccgcgccgccaaggagctcctctccaccccagcccccgacggagagcagcaaaatgggacccatggtgccactgaagaacatgtggaacagccagcattactagctccactggatgcacctgatgaggcttctaaggagaatattagctcgattgaggagatcgatgaggttgaagatgatggtgagcttcctgccatgaagttcagaaactaccttcctcatgatgaacaactccgaggtggtaagatggctccagtttctcttcctaaatttgaagatccaatcagtgccgaagctacagaaccaaagcaagtggagaatccctttggaaacatagccccaaagaatccaaactgggatctgaaacgtgatgtgcagaagagaattgacaaactagagaagcgcacacagaaagcattggctgagattgcattggagcaacagagggagaaagaagcactggaggaagctcaagattgatccacctgaatcagtgacagaaaccgtaatgtgtaaggtactgggggtgcttagtgtatctactggtggggatgaactgaagtgaatcaaccttgatgagtatgagatgtggtgcctggctaggccttgtttttgagaggaaagctaatatataaaactagagtgaactttgcccagtgcctcttgaaaagcctgagctgtagacctgcagtagttgtgtcctgttttgcgtagaccatatcaatctagtgtgttgattacaaagcatgccttcatgctgcttttaacagagtgaatattttacattctggctctttcagaaaacttaatttgcaacagaaaaaaaaaaaaaaaaaaa

SEQ ID NO: 456 - protein, 176 aa, Panicum virgatum
  misc_feature: Ceres CLONE 1725190
  misc_feature: Great-hit functional homolog of the protein sequence encoded by LOCUS At3g05070
  misc_feature: Useful for making plants with altered cell wall content and/or composition
MGAEEDAAARRERLRALRAAKELLSTPAPDGEQQNGTHGATEEHVEQPALLAPLDAPDEASKENISSIEEIDEVEDDGELPAMKFRNYLPHDEQLRGGKMAPVSLPKFEDPISAEATEPKQVENPFGNIAPKNPNWDLKRDVQKRIDKLEKRTQKALAEIALEQQREKEALEEAQD

SEQ ID NO: 457 - DNA, 1473 bp, Panicum virgatum
  misc_feature: Ceres CLONE 1725192
  misc_feature: Encodes the peptide sequence at SEQ ID NO. 458
atccgcctgctcctgccaaaccattctcccccaaatctccctcgcaatccccgtagccctcccagcgagcatcgaccatgtcggcctactgcggaaagtacaaggatgagctcatcaagaacgctgcctacattggcacccctgggaagggtatccttgcagctgatgagtccactggcaccattggcaagcgtctttccagcatcaatgtcgagaacgttgaggagaaccgccgtgccctccgtgagctcctgttctgctgccctggtgccctccagtacataagtggtgtgatcctcttcgaggagaccttgtaccagaagaccaaggatggcaagcccttcgtcaatgtcctcaaggagggaggcgctctccccggcatcaaggttgacaaggggaccattgaggttgctggcactgataaggagaccaccacccagggccatgatgaccttggcaagcgctgcgccaagtactacgaggctggtgcccgctttgccaagtggcgtgctgtcctcaagattggccccaacgagccatcacagcttgccattgacctgaacgctcagggtcttgctcgctatgccatcatctgccaggagaatggtctggtgccgatcgtggagcctgagatccttgtcgatggccctcatgacattgagcgctgcgcatatgtcactgaagtggtccttgctgcctgctacaaggctctcaacgagcaccatgtcctccttgagggtaccctcctgaagcccaacatggtcacccctggctccgactccaagaaggtgactcctgaggtcattgctgagtacaccgtccgcaccctccagaggactgttcctgctgctgtgcctgccatcgtcttcctctctggtggacagagcgaggaggaggccaccctgaacctgaatgccatgaacaagctcaacaccaagaagccttggtccctgtccttctccttcggccgtgccctccaggcaagcacactcaaggcctggcttggcaaggtggagaacgtggagaaggctagggcggccttccttgccaggtgcaaggccaactctgaggctaccctcggcacatacaaaggtgacgctgctgctggagagggtgtctctgagagccttcacgtgaaggactacaagtactgatctacctcgtcttgcctacccgtgctggtgtctgcctacgagcatttaggttgctgagtgtcatttgctccttagagcctatatccggacctctaaaaaaaccctgaacttaatcttcccttttgtggatgatggtttgttaccttatttttgtattcgtatattaactagtctatttggtgttaaatctcgtgtaatttggtcctgccgatggagaatcgcgcagccacattttgtttatctttcatgtaatgctggttacatatcggcaaaaccattttatatgctgagctggccggggtgcaggcgttttgctcct

SEQ ID NO: 458 - protein, 358 aa, Panicum virgatum
  misc_feature: Ceres CLONE 1725192
  misc_feature: Great-hit functional homolog of the protein sequence given in SEQ ID NO 9254
  misc_feature (1)..(348): Pfam Name: Glycolytic Pfam Description: Fructose-bisphosphate aldolase class-I
  misc_feature (1)..(347): Pfam Name: Glycolytic Pfam Description: Fructose-bisphosphate aldolase class-I
  misc_feature (1)..(345): Pfam Name: Glycolytic Pfam Description: Fructose-bisphosphate aldolase class-I
  misc_feature (1)..(349): Pfam Name: Glycolytic Pfam Description: Fructose-bisphosphate aldolase class-I
  misc_feature (1)..(358): SWISSPROT Homolog: EC 4.1.2.13 Fructose-bisphosphate aldolase cytoplasmic isozyme
  misc_feature: Useful for making plants with modulated phosphate use efficiency
MSAYCGKYKDELIKNAAYIGTPGKGILAADESTGTIGKRLSSINVENVEENRRALRELLFCCPGALQYISGVILFEETLYQKTKDGKPFVNVLKEGGALPGIKVDKGTIEVAGTDKETTTQGHDDLGKRCAKYYEAGARFAKWRAVLKIGPNEPSQLAIDLNAQGLARYAIICQENGLVPIVEPEILVDGPHDIERCAYVTEVVLAACYKALNEHHVLLEGTLLKPNMVTPGSDSKKVTPEVIAEYTVRTLQRTVPAAVPAIVFLSGGQSEEEATLNLNAMNKLNTKKPWSLSFSFGRALQASTLKAWLGKVENVEKARAAFLARCKANSEATLGTYKGDAAAGEGVSESLHVKDYKY

SEQ ID NO: 459 - DNA, 1181 bp, Panicum virgatum
  misc_feature: Ceres CLONE 1725204
  misc_feature: Encodes the peptide sequence at SEQ ID NO. 460
gtcaccgctgacgcccgcctccacctccacctccacctccgcccccgtcaccactgacgccccgccggcgcgtataaagattcgccgcccccgccgcgaagctcaccgcatcgccgcgcagaaaccctcccgaatcgtcgccatggcagccgccgcaccggcaagcttcgtcaaggaagtgctcccgtctcccctgacctccgtctccgagcccccgcccctcttcgacggcacgaccaggttgtatgttgcgtaccactgcccatacgcgcagcgcgcttggattgccaggaactacaagggtttacaggacaagatcaagatagttgcaatcgatcttgctgacaggccagcatggtacaaggagaaggtttatccagagaacaaggtgccttccctagagcacaacaaccaggtgaaaggagagagcttggatttggttaagtacattgatagcaatttcgaaggcccgtcattgcttcctgatgatcctgcaaagaagcagttcgctgaggagctgcttgcttttaccgatgcttttaacagagcactgtactcatctatagtctctaaggaagatgtgtccgaggaaactgttgctgctctggataaaatagaagaggccctggggaaatttactgacggaccattcttcctcggccagttcagtctggtggacatagcatatgtgccatttatcgaaaggtttcagatattctttcaaaacatcaagaattacgacatcacaaagggcagacccgaccttcagaggttcattgaggaagtgaacaagattgatgcgtacacacagactaaacaggacccacagtttttgcttgagcacacaaagaagcggcttgggattgcatgaagcttgtgaccaaggatgaaaatctcaccagggggctacctgtataagactgcattgtttgcaagaatggccttctatgcgctatgctggtcgtgcttttgaaataaactagttatcctggattatagcttttgtagtgcatcgacgtcattatgtgcagggtgctctgttaaatgtgcagggtcctctcatagtctcatattaatattatccctgtggtattcttgtagtatggtacttttgcgaaagtgtgatcagacaaataaataagagcatatccaagagttttcaaaaaaaaaaaaaaaaaaaa

SEQ ID NO: 460 - protein, 242 aa, Panicum virgatum
  misc_feature: Ceres CLONE 1725204
  misc_feature (1)..(74): Pfam Name: GST_C Pfam Description: Glutathione S-transferase, C-terminal domain
  misc_feature (1)..(76): Pfam Name: GST_N Pfam Description: Glutathione S-transferase, N-terminal domain
MAAAAPASFVKEVLPSPLTSVSEPPPLFDGTTRLYVAYHCPYAQRAWIARNYKGLQDKIKIVAIDLADRPAWYKEKVYPENKVPSLEHNNQVKGESLDLVKYIDSNFEGPSLLPDDPAKKQFAEELLAFTDAFNRALYSSIVSKEDVSEETVAALDKIEEALGKFTDGPFFLGQFSLVDIAYVPFIERFQIFFQNIKNYDITKGRPDLQRFIEEVNKIDAYTQTKQDPQFLLEHTKKRLGIA

SEQ ID NO: 461 - DNA, 1323 bp, Panicum virgatum
  misc_feature: Ceres CLONE 1725208
  misc_feature: Encodes the peptide sequence at SEQ ID NO. 462
atccggtggctgcggctgcgcgcatcatccgacctcgcgaaccggaaccaccaccaggacggctgctagactcgagcctcgcctccccctcctcccaccaaccgcagcagcgagacagagaatggctgcggcgccggggtccctcgcgtgctcctcccgcctctcccgcctcgcggacctccgccgcacgccggcggcccctgctgcctcgcagcgggtccacctcggctgctcccgccgccgcgcgcagcgcaccgtcgccatggctggatccggcaagttctttgtggggggcaactggaagtgcaatggaacaaaggactccattagcaagcttgtatctgaattgaatgctgctacactcgaaactgatgtagatgttgtggtggcacctccattcatttatattgaccaggtcaagaattcactaactggtcgtattgaggtttcttctcagaatgtatggatcggaaaaggaggagcctacactggagagatcagtgcagaacaattggtggacataggctgtcaatgggtaattcttgggcactctgagcgtagaaatattattggtgaaactgatgagtttatcgggaagaaagctgcatatgcattgagccaaaatgttaaggttattgcctgcataggagagctgttggaagagagggaagcagggaaaactttcgatgtatgttttaagcagatgaaggcttatgcagatagtatttcaaactgggccgatgttgtaattgcatacgagcctgtttgggcaattggaactggaaaagttgctactcctgaacaagcccaggaagttcatgctgccatacgcgattggttgaagaccaatgtatcacctgatgttgcctctagcattcgaataatttatggaggttctgtaaatgctgccaattgtgcggagcttgcaaagaaagaagatattgatggttttcttgttggtggtgcctctttgaagggcccggacttcaccaccattatcaactcagtgacttccaagaaagttgcagcctgacgcattcggttagaaataagtgattgcaagagaggcagctcggttttgctgtaccataggccttgtgggaggtgctctgtgtgatggtgtgcagtcacctcctccgtctggtttagctgatttgtagcacgaaaataaaaaaataatgcagatccaaccatcttttttgtcgtcgacttgttgtagaccttgtgtacgtgaagggagctgtacgtgggtggtcagtaaaacacgtgaaataataatgagaaaatttcttatttgacactgaaaaaaaaaaaaaaaaaaaa

SEQ ID NO: 462 - protein, 303 aa, Panicum virgatum
  misc_feature: Ceres CLONE 1725208
  misc_feature: Great-hit functional homolog of the protein sequence given in SEQ ID NO 9556
  misc_feature (1)..(240): Pfam Name: TIM Pfam Description: Triosephosphate isomerase
  misc_feature (42)..(303): SWISSPROT Homolog: EC 5.3.1.1 Triosephosphate isomerase, chloroplast precursor
  misc_feature: Useful for making plants with modulated biomass
  misc_feature: The cauline leaves are abnormally small.
MAAAPGSLACSSRLSRLADLRRTPAAPAASQRVHLGCSRRRAQRTVAMAGSGKFFVGGNWKCNGTKDSISKLVSELNAATLETDVDVVVAPPFIYIDQVKNSLTGRIEVSSQNVWIGKGGAYTGEISAEQLVDIGCQWVILGHSERRNIIGETDEFIGKKAAYALSQNVKVIACIGELLEEREAGKTFDVCFKQMKAYADSISNWADVVIAYEPVWAIGTGKVATPEQAQEVHAAIRDWLKTNVSPDVASSIRIIYGGSVNAANCAELAKKEDIDGFLVGGASLKGPDFTTIINSVTSKKVAA

SEQ ID NO: 463 - DNA, 1171 bp, Panicum virgatum
  misc_feature: Ceres CLONE 1725233
  misc_feature: Encodes the peptide sequence at SEQ ID NO. 464
aacgccagtcaccactcaccactccccactcccattctccccgtctccaccgtaccggaaggcgaaggcccggcgtggatccagcgatggcggcgagacctcccacaacggaggtggagctgctgagcaccaacaagatgttcggcggccataacctccgctaccgccaccagagcgccaccctcggctgccccatgaccttcaccgtctacctgcccccgttcccggcgtccaatgtccccgtcctgtactggctctcgggcctcacctgcactgacgagaacttcattattaaggccggcgctcagcgcgcggccgccgcccacggcatcgccctcgtcgcgcccgacacctctccacgcggattaaatattgaaggagagtcagacagctatgattttggtgtcggtgctgggttttatttgaacgccacaaatgaaaaatggaaaaactggcgcatgtatgactatgttgtgaaagagcttccaaaagttttgagtgatcactttgaacagctcaacatttcacaagcatccatttctgggcactctatgggaggccatggtgcactgacaatttactcgaaaaacactgataaatacaagtcagtatcagcatttgctccaattatcaatccgataaactgcccgtggggtcagaaagcattctcaaattacctgggctcaactaaatcagattgggaggaatatgatgctacctgcctgattaaaaagaacagcaaagtttctactcctatcctaattgaccagggggaggatgacaagttcctggctgagcagctgctacctcgcaacttcgaggaggcgtgcaaggccgcgggggttcctctgatcttgcgcatgcagcctggatacgatcattcgtactttttcgtcgctacatttatcgatgatcacattgcgcaccatgctcaatttctgaagagcgcctgacctcggtgtcacctgtaatgtgaggaagctatcaaaagaagggagttggggaggcagctctgtaattgctgcggtgtccccgcttaaagcatgtcactatatcccgctgccaacagtcttttggacttctcttgtctgctaggtgctagcttcaggtgaacaatatagctacatgcaaataagatgaaagacttgtgcaaaaaaaaaaaaaaaaaaaa

SEQ ID NO: 464 - protein, 288 aa, Panicum virgatum
  misc_feature: Ceres CLONE 1725233
  misc_feature: Great-hit functional homolog of the protein sequence given in SEQ ID NO 9565
  misc_feature (1)..(259): Pfam Name: Esterase Pfam Description: Putative esterase
  misc_feature (13)..(286): SWISSPROT Homolog: EC 3.1.2.12 S-formylglutathione hydrolase
  misc_feature: Useful for making plants with altered cell wall content and/or composition
  misc_feature: Useful for making plants with modulated biomass
  misc_feature: The plant is abnormally small.
MAARPPTTEVELLSTNKMFGGHNLRYRHQSATLGCPMTFTVYLPPFPASNVPVLYWLSGLTCTDENFIIKAGAQRAAAAHGIALVAPDTSPRGLNIEGESDSYDFGVGAGFYLNATNEKWKNWRMYDYVVKELPKVLSDHFEQLNISQASISGHSMGGHGALTIYSKNTDKYKSVSAFAPIINPINCPWGQKAFSNYLGSTKSDWEEYDATCLIKKNSKVSTPILIDQGEDDKFLAEQLLPRNFEEACKAAGVPLILRMQPGYDHSYFFVATFIDDHIAHHAQFLKSA

SEQ ID NO: 465 - DNA, 1514 bp, Panicum virgatum
  misc_feature: Ceres CLONE 1725234
  misc_feature: Encodes the peptide sequence at SEQ ID NO. 466
atccagtccccaatccgtcgagaaattcctcccgagccatcgaaatcgaagcgaagcgaagcggcctcccccgatcctctcaagatgcagatctttgttaagaccctcaccggcaagaccatcactttggaggttgagtcgtctgacaccattgacaatgtgaaggccaagatccaggacaaggagggcatccctccagaccagcagcgtctgatcttcgctggcaagcagcttgaggatggccgcaccctagcagactacaacatccagaaggagtccaccctccacctggtgctccgcctgcgtggtggtatgcagatctttgtgaagaccctcactggcaagaccatcaccttggaggtggagtcttccgacaccatcgacaatgtgaaggcgaagatccaggacaaggagggcatccccccggaccagcagcgtctgatcttcgccggcaagcagctggaggatggccgcaccctggcggactacaacatccagaaggagtccaccctccacttggtactccgtctgcgtggtggtatacagatctttgtgaagaccctcactggcaagaccatcaccttggaggtggagtcttctgacaccattgacaacgtgaaggcgaagatccaggacaaggagggcatccccccggaccagcagcgtctgatctttgctgggaagcagcttgaggatggccgcaccttggcggactacaacatccagaaggagtccaccctccacttggtgctccgtctgcgtggtggtatgcagatctttgtcaagactctcaccggcaagactatcaccttggaggtggagtcttcagataccatcgacaacgtgaaggcgaagatccaggataaggagggcatccctccggaccagcagcgtctgatctttgcaggcaagcagttggaggatggccgcaccttggctgactacaacatccagaaggagtctaccctccatctggtgctccgtctgcgtggtggtatgcagatctttgtcaagactctcaccggcaagaccatcaccttggaggtggagtcttcagataccattgacaatgtgaaggcgaagatccaggacaaggagggcatccccccggaccagcagcgtctgatcttcgccggcaagcagctggaggatggccgcaccctggcggactacaacattcagaaggagtcgacccttcacctggtgctccgtctccgtggtggacagtaagtccatggagctgctgttgtctctgggttcacaagtctggtgcctgccttgtctcaccgatggagattgtctgcatttcctgtggtcgtgtccttgtcatgcctgtctgatgtgagtctttatgtcgtctggttgtgttttgtgaacactcagcagtttggttgaactatgtaatgaataagtgagccctgaaattactctggtaatcttgcaaatctggatgagtcgtcattattatatggttaatggtttattcatgtttgtaaaaaaaaaaaaaaaaaaaa

SEQ ID NO: 466 - protein, 381 aa, Panicum virgatum
  misc_feature: Ceres CLONE 1725234
  misc_feature: Great-hit functional homolog of the protein sequence given in SEQ ID NO 9688
  misc_feature: Useful for making plants with modulated cold sensitivity
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGIQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGQ

SEQ ID NO: 467 - DNA, 1362 bp, Panicum virgatum
  misc_feature: Ceres CLONE 1725256
  misc_feature: Encodes the peptide sequence at SEQ ID NO. 468
ttcctcccctgcttcgtcctcttcgaccaccagcatgatgttactggagacgaccctgctggccgccacccggtcgtgctgctgccgggcagcacgtgcagccagctcgaggcccgcctcaccgacgcctaccagccgccggcgccgcaatgcggcgcgggcaagggcaacggccggtggttccggctgtggaagaactcgacggcgatgcaggaccccaaactcgcgccgtgcctctccgaccagctccgcctcgtctacgaccccgtcgcgcgcgacttccgcaacgtgccgggcgtggagacccgcgtcctcggcttcggctccacccgcggcttcctcgccgacactccggccaataaggatctctgcatgggaaggctcgttgaggcgctggagaaggccggataccgcgacggcgagaccctcttcggcgcgccgttcgacttccggcaagctcccgccgcgccggggcagccgtgccgggcgttctcgcagttcagccggcggctcagggcgctcgtggagcacgcgagcaggaagaacgggggcaagccggtcgtcgtcatgtcgcacagccagggtggctacttcgcgctcgagttcctcaaccggagccccctgccgtggcgcaggaggtacgtcaggcactacgtcatggcctccaccggccccggcgggttcctggtgtcgatgcagctgctcgccgccaacccgagcgccgcgctgagttccggcagcgcgttcaccgcgctgccgtcgccgaaggtgttcggccccgacgcgccgctggtcgtcacgcgggccaggaactacaccgcgcaggacatcccggagttcctgacggcgatcgggttgccccggctcgctgtgacgctgtacaagacgcgggcgctgccggtgcagctgaacttccgggcgccggtggtgccgacgacctgcatcagtggcgtcggcgtgcccacgatgaaggagctggtttactgggacggcaacttcagcaaggccccggaagtggtgtacggcgacggcgatgatcttatactcctggagagcacgctggcccttgacacggtgatcggcgatgatccgagacaggagtactacaagtccatcaagttagccggcacgtctcatgccggggttgtctcagatcaagcggccgtggagcgtgtcatcgttgagatccttggagtagtacacgagtaaatgtctaaatgactgtgtttgagatcaacttttgtatttaagagcaccatcccaatccaagccgtaccacccctccagcctccaaaaaccaaccctatctttttttctggcaaagaacaatcaattcgatcccaaaaaaaaaaaaaaaaaaaa

SEQ ID NO: 468 - protein, 333 aa, Panicum virgatum
  misc_feature: Ceres CLONE 1725256
  misc_feature (13)..(352): Pfam Name: LACT Pfam Description: Lecithin:cholesterol acyltransferase
MQDPKLAPCLSDQLRLVYDPVARDFRNVPGVETRVLGFGSTRGFLADTPANKDLCMGRLVEALEKAGYRDGETLFGAPFDFRQAPAAPGQPCRAFSQFSRRLRALVEHASRKNGGKPVVVMSHSQGGYFALEFLNRSPLPWRRRYVRHYVMASTGPGGFLVSMQLLAANPSAALSSGSAFTALPSPKVFGPDAPLVVTRARNYTAQDIPEFLTAIGLPRLAVTLYKTRALPVQLNFRAPVVPTTCISGVGVPTMKELVYWDGNFSKAPEVVYGDGDDLILLESTLALDTVIGDDPRQEYYKSIKLAGTSHAGVVSDQAAVERVIVEILGVVHE

SEQ ID NO: 469 - DNA, 1371 bp, Panicum virgatum
  misc_feature: Ceres CLONE 1725266
  misc_feature: Encodes the peptide sequence at SEQ ID NO. 470
acgtttcgccctgccacagccagcgcctccacagttgcacggtgcaagcgcagcacagcgcgcagagccgccacacccctcgcctcgcctccgcctccgcctcctttaaatacggccgcaaatggctcccgcggcgctgctccaccctgccctcccctccacgagcgctgccgcagcccgccgccgctacggccgcagccaccgcgcccctccgcccgtcgcgcgccgctcccgccgccacctgctgcgcccgatggtctcgccgacgacggcccaggcccccgcgtcggcgcccccgggcctgaaggagggcatcgcggggctctacgacgagtcgtcggggctctgggagagcatctggggcgaccacatgcaccacggcttctacgactccggcgaggcggcctccatggcggaccaccgccgcgcccagatccgcatgatcgaggaggcgctcgccttcgccgccgtcccagatgatccggagaagaagcccaaaacggtagtcgatgtaggatgcggaattggtggtagctcgaggtacctggccaagaaatacgaagcacagtgcaagggcatcacgctgagccccgttcaagctgaaagaggaaacgctctcgccgctgcgcaggagttgtccgatcaggtttctctgcaagttgctgatgctctggagcaaccgtttcctgatggacagttcgatcttgtgtggtccatggagagtggcgagcacatgccggacaagagcaagtttgttagtgagctggcatgcgtggcggctcctggagggacaataatcatcgtgacatggtgccatcggaacctggagccatctgaaacctcgctgaaaccggatgaactgaacctcctcaagaggatttgcgatgcgtactaccttcctgactggtgctcaccctcagactatgtgagcatcgccaagtctctgtctctcgaggatgtcaagacagccgattggtcggagaacgtggccccattctggccggccgtgataaaatcagcactgacatggaagggcatcacctctctcctgacaagcgggtggaagacgatcaaaggggcgatggtgatgccgctgatgatccagggctacaagaaggggctcatcaagttcaccatcatcacctgtcgcaagcccggaggagcgtaggaggtcaagttaccgtcgcggcgcctctgttcggcgcaataacgtagaaccaaatacctaccaatggcgagctagaaactagaaggcgccccgtcgtcgtcttctctttctttctgtacgcgcacgcacgtttggccatgtgccccattcccaataattttctaccactcgttgagatagcagaaaaaaaaaaaaaaaaaaaa

SEQ ID NO: 470 - protein, 348 aa, Panicum virgatum
  misc_feature: Ceres CLONE 1725266
  misc_feature: Great-hit functional homolog of the protein sequence given in SEQ ID NO 9478
  misc_feature (1)..(99): Pfam Name: Methyltransf_11 Pfam Description: Methyltransferase domain
  misc_feature (53)..(345): SWISSPROT Homolog: EC 2.1.1.95 Tocopherol O-methyltransferase, chloroplast precursor
  misc_feature: Useful for making plants with modulated nitrogen use efficiency
MAPAALLHPALPSTSAAAARRRYGRSHRAPPPVARRSRRHLLRPMVSPTTAQAPASAPPGLKEGIAGLYDESSGLWESIWGDHMHHGFYDSGEAASMADHRRAQIRMIEEALAFAAVPDDPEKKPKTVVDVGCGIGGSSRYLAKKYEAQCKGITLSPVQAERGNALAAAQELSDQVSLQVADALEQPFPDGQFDLVWSMESGEHMPDKSKFVSELACVAAPGGTIIIVTWCHRNLEPSETSLKPDELNLLKRICDAYYLPDWCSPSDYVSIAKSLSLEDVKTADWSENVAPFWPAVIKSALTWKGITSLLTSGWKTIKGAMVMPLMIQGYKKGLIKFTIITCRKPGGA

SEQ ID NO: 471 - DNA, 1325 bp, Panicum virgatum
  misc_feature: Ceres CLONE 1725280
  misc_feature: Encodes the peptide sequence at SEQ ID NO. 472
atcaaagccagccgcggcgcccgctcttcttcttcccccaaacccagaggaggaaggagagcgcgtcctcgcctcgtccccgttccgccaccgcaccccgctcgccgaggcctccggcaccgggccaatccgcggcgagtggatccctccccttgactctgctccaccgcagcggcctcgggcgattcgggaccgggctgccgcgagctcgccggcgctccccttgcttgccggctgccgccgccggtgctggttggagatgacacacatgtttccaagggatggtgcctcatctagctcaacctctatgagcagccagaggagtgagacggatgatgatcggatgattgcaatggttctctccgaagaatatgccaagttagatggtgctatggccaagcgtcttacaaatttaacatcaattcctcatgttccccggattaacacatacttcccgacatatagtgatgccactatggaccactatcgccttcttgataggctaaatgcatatggcttgtttgaagtgcgagtagctggtgatggaaattgtcagtttcgtgcactctcagaccagctataccgttcacctgattatcacaggcatgttcgaaaggagattgtaaagcagctcaaggaatgtaactccttgtacgaaggttatgttccaatgaaatataaacattattgcaagaaaatgaagaaatctggtgaatggggtgaccatgtcacacttcaagcagctgctgacaagtttgctgcgaagatctgtcttctaacatcattcagagatacatgttttgttgaaattgttccacaatatcaaacaccacagagagagatatggctaagtttctggtcagaagtacattacaactcactgtacgatgctcgagatatacctagcaagtacaagcctagaaagaagcactggttattgttttgataaccatgagggattttgctccatactggtgggtccatatacttaactgttacaccattgttggctggtggcatcctggggataacccttatgtgggtttaccccctatagctctgagtgaacaatccatggcgcatgctccttgggacagcatcatacatgcatacagcagcggatacagttacaatgctgacctgaaccttgtgaatatagatacaccctgtacttttgaagtggaagatacaccctgtactgacaaacaggttgattgtatacctttgcctctttgttcgttgttttattctttatacagctatactcgttggtgcccttcatcagttcattattcacatcattttacaaaaaaaaaaaaaaaaaa

SEQ ID NO: 472 - protein, 228 aa, Panicum virgatum
  misc_feature: Ceres CLONE 1725280
  misc_feature (1)..(113): Pfam Name: OTU Pfam Description: OTU-like cysteine protease
MTHMFPRDGASSSSTSMSSQRSETDDDRMIAMVLSEEYAKLDGAMAKRLTNLTSIPHVPRINTYFPTYSDATMDHYRLLDRLNAYGLFEVRVAGDGNCQFRALSDQLYRSPDYHRHVRKEIVKQLKECNSLYEGYVPMKYKHYCKKMKKSGEWGDHVTLQAAADKFAAKICLLTSFRDTCFVEIVPQYQTPQREIWLSFWSEVHYNSLYDARDIPSKYKPRKKHWLLF

SEQ ID NO: 473 - DNA, 1187 bp, Panicum virgatum
  misc_feature: Ceres CLONE 1725298
  misc_feature: Encodes the peptide sequence at SEQ ID NO. 474
gactataacaggcagttaaacctctcccgagaaaaatcgtacgtggcgtgcgcgcggcgagatccgacgcgaaagcgcacgcgacggtctcgatcgcattgccaaccattcacggcaacgtcgtttcttcgtcctagatagcagccagccgggcagctctatatattcggctccaaaccacgagcagctagctcagccatccatcaatcccagttacatacaccgacctacgtgcaacgacgaacaactgagagctagcatggcgaggtctgtgctgccggcggcggcggccatggcggtgctgctggcggtggcggcggccgacgtggggtccatcatcacgcaggacgtgtacaacagcatgctgcccaaccgcgacaactccatctgcccggccaacgggttctacacctacgacgccttcatccaggccgccgccgccttcccgggcttcggcaccggcggcggcgacgaccagaacaagcgcgacctcgccgccttcttcggccagacctcccacgagaccaccggtggcactaggggcgccgccgaccagttccagtggggctactgcttcaaggaagagatcacccccaccgatcctccctactatggacggggacccattcaattgacagggcaggccaactaccagcaggccggcgacgcgatcggcgtggacctggtgggcaacccgggcctggtggcctccgaccccgtggtctccttcaagacggccatctggttctggatgacggcgcaggggaacaagccgtcgtgccacgacgtcgccctcggcaactggacgccctccgccgccgacaccgccgccgggcgggtgccggggtacggctgcatcaccaacatcatcaacggcgggatcgagtgcggcgtcggcgccaacgacgccaacgtcgaccgcatcggctactaccagcggtactgcggcatgctgggcatcgacgccggcgctaacctcgactgctacacccagcagcatttctgatgatcaaactgctgatgaacagaacagtcgttactacataactccatatacgtatcgatatatatacgtatccatgaacagctgtgaataagtggtatatggatgccaatgtgtaccatgcatgtatgttatgatgtctcaataaactaagcatgtcttccaaaaaaaaaaaaaaaaaaaa

SEQ ID NO: 474 - protein, 248 aa, Panicum virgatum
  misc_feature: Ceres CLONE 1725298
  misc_feature (1)..(219): Pfam Name: Glyco_hydro_19 Pfam Description: Chitinase class I
  misc_feature (20)..(248): SWISSPROT Homolog: EC 3.2.1.14 Acidic 27 kDa endochitinase precursor
  misc_feature (20)..(248): SWISSPROT Homolog: EC 3.2.1.14 Acidic endochitinase Q precursor
MARSVLPAAAAMAVLLAVAAADVGSIITQDVYNSMLPNRDNSICPANGFYTYDAFIQAAAAFPGFGTGGGDDQNKRDLAAFFGQTSHETTGGTRGAADQFQWGYCFKEEITPTDPPYYGRGPIQLTGQANYQQAGDAIGVDLVGNPGLVASDPVVSFKTAIWFWMTAQGNKPSCHDVALGNWTPSAADTAAGRVPGYGCITNIINGGIECGVGANDANVDRIGYYQRYCGMLGIDAGANLDCYTQQHF

SEQ ID NO: 475 - DNA, 1229 bp, Panicum virgatum
  misc_feature: Ceres CLONE 1725309
  misc_feature: Encodes the peptide sequence at SEQ ID NO. 476
actctctctccttcccctctctttctccccccacacacacggaaacagccactcctcacctcccccaccctccggttcatgtcctgctgctccccatgtcgcccccactcgagctcgactacataggactctcgccgccggaggtcgccgccgccgcagatgccgccgacgacctgaagggcaccgagctccgcctcggcctgccggggtccgagtcgccggggcgccgcgtcgcggctgccacggcgaccaccctggacctgctcccagccaagggcgccaagcgcgggttctccgacgaggtgccgccgccgtcgcccgccgccgctgcgggcaagggcaagaaggtggcggacgaggaggacgacgacaagaaggtggcagcgaccccgcagccggccgccaaggctcaggtggtgggatggccaccaatccgcagctaccgcaagaacacgatggctactacccagcagaagggcagcaaggaggatgctgaggccaagcagggccaagggttcctctacgtgaaggtcagcatggatggcgccccgtacctcaggaagattgacctcaagacatacaagaactacaaggatctctccactgcacttgagaagatgttcagtggctttagtaatggcaaggacggcttatctgagtaccacaaggatggtgaatatgttctgacttatgaagacaaggatggagattggatgctcgtcggcgacgtgccatgggagatgtttgctgactcttgccgtaggctcaggatcatgaaaggttcagatgcaattggacttgctccaagggcagctgataagtccaagaaccgcaactagaatggttgctactacagtccagagcaagagggagatccaatgactgtagggccctttatgaaaatcgaaaagtctaacagttataagacgaattctgccttatggtctgtactacatggtttgctgttacgcgagtaaagaactccatgtctgttatgttagtttctcaaaatcgtctatggaccaaacctctatccgattgtggttagggctttgtatgggtgttattcgtatcagtgtaaatggtttggttcattgtgtgctgctactttgattgagcagtcctcctacctagtttgcaaaatggtgtccatgaactgtttgtcggtcctctatataatgttcaatgaagctcgtgaatgtattgtctaaaaaaaaaaaaaaaaaaaa

SEQ ID NO: 476 - protein, 247 aa, Panicum virgatum
  misc_feature: Ceres CLONE 1725309
  misc_feature (1)..(223): Pfam Name: AUX_IAA Pfam Description: AUX/IAA family
  misc_feature: The sequence is a functional homolog of  SEQ ID NO 890 in the  10/412,699 US patent application
  misc_feature: Useful for making plants with modulated growth and phenotype characteristics
MSPPLELDYIGLSPPEVAAAADAADDLKGTELRLGLPGSESPGRRVAAATATTLDLLPAKGAKRGFSDEVPPPSPAAAAGKGKKVADEEDDDKKVAATPQPAAKAQVVGWPPIRSYRKNTMATTQQKGSKEDAEAKQGQGFLYVKVSMDGAPYLRKIDLKTYKNYKDLSTALEKMFSGFSNGKDGLSEYHKDGEYVLTYEDKDGDWMLVGDVPWEMFADSCRRLRIMKGSDAIGLAPRAADKSKNRN

SEQ ID NO: 477 - DNA, 1258 bp, Panicum virgatum
  misc_feature: Ceres CLONE 1725313
  misc_feature: Encodes the peptide sequence at SEQ ID NO. 478
aacgctcacacacaaacgcaagaagctcaaagaagctgaggcaagctcaagagagaaaaagaaaaagaagcctagctagaactagaaggaggctcaaagggatgatgggaagcgaaggcagcacgagcccagcggcggggggagcctcctgcgcggtctgcggcggcgcggcggcggtgtactgcgcggcggacgcggcggcgctctgcagcccctgcgacgccgctgtgcacgcggccaacctgctggcgtcgcgccacgagcgcgtgcctctcgccatggccgcggcggcggcggcggcatccggcgtgtacgacgacctcttcgcgcccgacgacgtcgacgccgcgtcgtcgtggccggaggcggcggcgcccgcgcaggggcaggggagcccccaccagaacggcagctcgtcgaccagcttcaccaccagcgacagcggcgcggagggcaggagcctgttcgacctgctctccgacgtcgacctcgcgacggccgcctgcgtcacgggcggcgggtacctgccggacggcttggcacccgtccatcacggcggcgctgcggctccgctgtggtcgcagcccggcatggccgcgtgggcggccgcgtggtcctccccagcggataccgcggccgtcgtcgtcccgggcgccgccgccgtggtcgccgcggcggcggagcgggtggcgagggtgcagaggtaccgcgagaagcgcaagaaccgcaagttccagaagaccatccgctacgcgtcccgcaaggcctacgccgaggcccgcccgaggatcaagggccgcttcgtcaagcgcgcccccgccgccgccgccgccacgaacgcctccgacacggccaagttctggctctccttctccgacgacgcccgcgacgacggcgtcgggttctacgtcgacgccgcggcctacggtgtcgtgccaagcttctagaatgtttcgccctgcaggcccagcttaaagcaagttaagaaatgggcgtgcgccatgtcgccatgctaagggcgctatcatcgttcttgttcgtctcatttcactcttgtggtcaattattcgtggtgaaattccgctgccatcgctatttttaaaagatggcccgggatttccatgggtcagttggtgaacatgaactagggattcacgtgttgtaaggtagcctaagtagatgttcaccttaagtctccatggattgattttctatgctaagatgcttagttctgtggtaaaaaaaaaaaaaaaaaaaa

SEQ ID NO: 478 - protein, 281 aa, Panicum virgatum
  misc_feature: Ceres CLONE 1725313
  misc_feature (2)..(47): Pfam Name: zf-B_box Pfam Description: B-box zinc finger
MMGSEGSTSPAAGGASCAVCGGAAAVYCAADAAALCSPCDAAVHAANLLASRHERVPLAMAAAAAAASGVYDDLFAPDDVDAASSWPEAAAPAQGQGSPHQNGSSSTSFTTSDSGAEGRSLFDLLSDVDLATAACVTGGGYLPDGLAPVHHGGAAAPLWSQPGMAAWAAAWSSPADTAAVVVPGAAAVVAAAAERVARVQRYREKRKNRKFQKTIRYASRKAYAEARPRIKGRFVKRAPAAAAATNASDTAKFWLSFSDDARDDGVGFYVDAAAYGVVPSF

SEQ ID NO: 479 - DNA, 1304 bp, Panicum virgatum
  misc_feature: Ceres CLONE 1725325
  misc_feature: Encodes the peptide sequence at SEQ ID NO. 480
cgcaaacaagcagcatcgtttatccccagcacttcgggctccctcgtccctccctctgcgctccatggcttccgacttcaaggcgatccccctgatcgatgttggcccgcttgtcgaaaagatcgatgatccgaatatggccaacgacgcggatttgctggaggttgtgcggatgctggacgacgcttgtaaggaggccggattcttctatgtgaaaggccatggtattgctgagtcgctaatgaaggaagtcagggatgtgacacgcaaattctttcaccttccttatgaggagaaattaaagattaagatgacacctgagagtgaatatagagggtatcaaaggataggggagaatgttaccaagggtaaacctgatatgcacgaagcaattgattgctacactcctattagacctggcaaatatggagatcttgctaaaccaatggagggatctaatttatggccagaaaatccatcaaattttgaagcactgctggagaactacatcaatctatgcagagatctttcaagaaagatcatgcgtggtatagccttggcattgggaggggcaattgatgtgtttgaaggagaaacagctggagatcctttctgggtgctaaggttgattggttatccagtagacattccagaagagcagcgcactgatactggatgtggagctcatacagattacggacttctgacactggttaaccaggatgatgacatatgtgcccttgaggtgcaaaaccgctctggtgagtggatatatgcaactccaattccaggaacctttgtttgtaacattggtgacatgctgaaggtatggtccaatggaatatatcagcccacacttcacagagttgtcaacaactcccctcgttaccgcgtatctgttgctttcttctatgagtccaactttgacgctgccatagagcctgttgagttctgccgggagaaaaccggcggtgctgccaagtacgaaaaggttgtgtacggggaacatttggtaaagaaagtgctgacgaactttgtcatgtaaatttgctgggctgcagatgtggaaggaaaaaaaaactgtatcgaaatattcatcaataaacatgtctgtccattcgtgtcattgcagtgaatttattgtctttcagttttgttctgtaaagttttttctttcagtctctataccttgtatgtttagtcttgttttctcttctgttgtgtaaataccctttctttcaataaaatttcaatagcggggccctccctcgctgttttcggttcaaaaaaaaaaaaaaaaaaaa

SEQ ID NO: 480 - protein, 326 aa, Panicum virgatum
  misc_feature: Ceres CLONE 1725325
  misc_feature (1)..(106): Pfam Name: 2OG-FeII_Oxy Pfam Description: 2OG-Fe(II) oxygenase superfamily
MASDFKAIPLIDVGPLVEKIDDPNMANDADLLEVVRMLDDACKEAGFFYVKGHGIAESLMKEVRDVTRKFFHLPYEEKLKIKMTPESEYRGYQRIGENVTKGKPDMHEAIDCYTPIRPGKYGDLAKPMEGSNLWPENPSNFEALLENYINLCRDLSRKIMRGIALALGGAIDVFEGETAGDPFWVLRLIGYPVDIPEEQRTDTGCGAHTDYGLLTLVNQDDDICALEVQNRSGEWIYATPIPGTFVCNIGDMLKVWSNGIYQPTLHRVVNNSPRYRVSVAFFYESNFDAAIEPVEFCREKTGGAAKYEKVVYGEHLVKKVLTNFVM

SEQ ID NO: 481 - DNA, 1188 bp, Panicum virgatum
  misc_feature: Ceres CLONE 1725330
  misc_feature: Encodes the peptide sequence at SEQ ID NO. 482
gagcgcgcactggcggcggcggaggctgagttaacacaacacaagagctgggtcactcgctgccggccggcgtgcgcattgccagccagccagccagctagtcgcccgcgcgcgcatggcgcagctgccgcccaggatcccggccgcggtgcaccactggccggaggggggccaccacggggccgcggtggcgtgggccgacgacttcgccgagttcgcggcgtcgcggcggggcgcgcaccgcaggtcgctcagcgactcggtggccttcgtcgaggtggcgcccgcggacggcgcggccggcgagttcgaccgcctcgacgacgaccagctcatgtccatgttccccgacgaggccggcggcgggtcgtcgtccgcgccgggctccgagaacggcggcagcagcgacagcgacggcgacaagcgcggcggcggcggcgcccccgcgggcggcgccaccaatggctgcgacgacgagcggaacgaggccgcggacgcgcaggcgccggcgacggggcagcccgccgcctccacggagctgatccgggaccccaagagggtgaagaggatcctggccaatcggcagtcggctcagaggtcgcgggtgcggaagctgcagtacatctccgagctcgagcgcagcgtgacgaccctgcagaacgaggtgtccgtgctctcgccgcgggtggcgtttctggatcagcagcggacgatcctgaccgtcgggaacagccacctcaagcagcggatcgcggcgcttgctcaggacaagatcttcaaggatgctcatcaagaggcgttgaggaaggagatcgagaggctgcggcaggtctacgagcagcagaacctcaagatgtcagccggcgctgcagcttctgaccacgggccgccacccccggtgcgcgcagagaaagagctcatgagctagctcatccatgcctgtccgctgtgcagtctgcttatcattaacttggagggaacactgcatcatttttttttttcagattctgtggatgttttcttcttcttcttcttcttctccattgacatgtgcattaattctttgtactttgagttggattggtttactgtgcaaattgtggtaaagtcgtcaggaaaacagaactttcatgtaaatcatttttgaagcattacatcgatctctggcaaaaaaaaaaaaaaaaaaaa

SEQ ID NO: 482 - protein, 270 aa, Panicum virgatum
  misc_feature: Ceres CLONE 1725330
  misc_feature (1)..(55): Pfam Name: bZIP_2 Pfam Description: Basic region leucine zipper
  misc_feature (3)..(64): Pfam Name: bZIP_1 Pfam Description: bZIP transcription factor
  misc_feature: The sequence is a functional homolog of  SEQ ID NO 1362 in the  10/374,780 US patent application
  misc_feature: The sequence is a functional homolog of  SEQ ID NO 1482 in the  10/412,699 US patent application
  misc_feature: Useful for making plants with modulated growth and phenotype characteristics
MAQLPPRIPAAVHHWPEGGHHGAAVAWADDFAEFAASRRGAHRRSLSDSVAFVEVAPADGAAGEFDRLDDDQLMSMFPDEAGGGSSSAPGSENGGSSDSDGDKRGGGGAPAGGATNGCDDERNEAADAQAPATGQPAASTELIRDPKRVKRILANRQSAQRSRVRKLQYISELERSVTTLQNEVSVLSPRVAFLDQQRTILTVGNSHLKQRIAALAQDKIFKDAHQEALRKEIERLRQVYEQQNLKMSAGAAASDHGPPPPVRAEKELMS

SEQ ID NO: 483 - DNA, 1058 bp, Panicum virgatum
  misc_feature: Ceres CLONE 1725354
  misc_feature: Encodes the peptide sequence at SEQ ID NO. 484
atcggcgcctcactcacctgcagatcatcaaagcattgctcccttgcctgctcgctcgccaaggaagcaaggaaccagcaggaacaatcttttgagcaatggcggcggcagggctgcaggtgttcggacagccggcgtccaccgacgtggcgagggtcctgacctgcctcttcgagaagaacctcgagttcgagctcgtccgcatcgacaccttcaagaagtcgcacaagctccccgagttcatcaagctacgggatccaactgggcaggtgacattcaaacatggtgacaaaaccattgtcgattctagggccatctgccgctacctgtgcaccagtttcccggaggacggcaacaggacgctctacggcacggggtcgctggagcgggcgtcgataaagcagtggctgcaggccgaggcccagagcttcgacgctccgagctcggagctcgtcttccagctggcgttcgcgccccacctcaaggacgtgcaccccgacgaggcccgcatcgcggagaacgagaagaagctgcagaacatgctgggcgtctacgacgagatgctgtccaagcacaagtacctggccggcgacgagttcaccctggccgacctgtcccacctgcccagctcgcactacatcgtcaactcctccgacaggggccggaagctcttcaccgccaagaagcacgtggccaagtggtacgagaagatctccacccgcgactcgtggatgcaggtggtgaagatgcagaaggagcacccaggcacgttcgagtgatcggcaggtaacgtcggtcggcggcgcggcgaggtccgatccttgtcggcggcggcttcgatctatcgtcaggcttcaaaccgtgaaccgtgatgtggttgtcaccaagttcgtcgtcgtatcgtatcgtacgtcctgtgggctaaaataacctgaagcctgccttacggtgtctcaatgtcttcctttcgctgcatacgcacgcgatgtccttgtttctttctgggtattgtattggtcagttccttttggttgatccaaaaaaaaaaaaaaaaaaaa

SEQ ID NO: 484 - protein, 226 aa, Panicum virgatum
  misc_feature: Ceres CLONE 1725354
  misc_feature (1)..(99): Pfam Name: GST_C Pfam Description: Glutathione S-transferase, C-terminal domain
  misc_feature (1)..(76): Pfam Name: GST_N Pfam Description: Glutathione S-transferase, N-terminal domain
MAAAGLQVFGQPASTDVARVLTCLFEKNLEFELVRIDTFKKSHKLPEFIKLRDPTGQVTFKHGDKTIVDSRAICRYLCTSFPEDGNRTLYGTGSLERASIKQWLQAEAQSFDAPSSELVFQLAFAPHLKDVHPDEARIAENEKKLQNMLGVYDEMLSKHKYLAGDEFTLADLSHLPSSHYIVNSSDRGRKLFTAKKHVAKWYEKISTRDSWMQVVKMQKEHPGTFE

SEQ ID NO: 485 - DNA, 1204 bp, Panicum virgatum
  misc_feature: Ceres CLONE 1725356
  misc_feature: Encodes the peptide sequence at SEQ ID NO. 486
aacccgatcacgttgctcccgcggctagactagccccacgacctccccgcctcgaccattcccgtggactcccggcttgcctcgcctccctgctgtgtgctgcctcgctccagcattccctgcggtcgccggagcgagcagagcagccggagggcacgtcggatccgccgccgccaagatgaacgacgccgatgtctccaagcagatccagcagatggtgcggttcatccaccaggaggccgaggagaaggccagcgagatctccgtctccgccgaggaggaattcaacatcgagaagttgcagcttgttgaagctgagaaaaagaagatcaggcaagagtatgagcgtaaagagaagcaggttgaagtacgtaagaaaattgagtactctatgcagttgaacgcttctcgcatcaaagttcttcaagctcaggatgatctagttaacaaaatgaaagaggatgccgtgaaggaactccttcgtgtcagcgacaaccaccatgaatacaggaaccttttgaaagatctaatcgttcagggcttgctccggttgaaagagccagccgtactgctccgttgccgtaaagaggaccaccatcacgtggaatctgtactgcattcagcaaagcatgagtatgcatcaaaagcagatgtccatcaaccagagataattgttgaccatgatgtgtacctgccacctgccccaagccatcatgatgctcatggccagttttgctctggaggtgttgtcctggcttctcgagatggaaagattgtgttcgagagtacacttgatgcaaggctggaagttgttttccgcaagaaattgccagagatccggaagcttctttttagcaagaatgcagtctaatagacgttcctacgagggtacagctgcttctatgtaatggctgctgccctgcagccttaagcgactccacctgtttttggcaaattgattgtttaaagtattcatcccctatgtacaaactacctatttgttcattattatcgccgagcaccgactgtttgcactatgtttgctccgaggaataaggataaagcaccgccagactttccactgcgaagctgaataaatattgtaaatcatttgctgtgctaaactgtctgttttgggcctgtcgagctgtatattcagttcttgtcggattggattccttcggaaaaaaaaaaaaaaaaaaaa

SEQ ID NO: 486 - protein, 230 aa, Panicum virgatum
  misc_feature: Ceres CLONE 1725356
  misc_feature (1)..(210): Pfam Name: vATP-synt_E Pfam Description: ATP synthase (E/31 kDa) subunit
  misc_feature (1)..(229): SWISSPROT Homolog: EC 3.6.3.14 Vacuolar ATP synthase subunit E
MNDADVSKQIQQMVRFIHQEAEEKASEISVSAEEEFNIEKLQLVEAEKKKIRQEYERKEKQVEVRKKIEYSMQLNASRIKVLQAQDDLVNKMKEDAVKELLRVSDNHHEYRNLLKDLIVQGLLRLKEPAVLLRCRKEDHHHVESVLHSAKHEYASKADVHQPEIIVDHDVYLPPAPSHHDAHGQFCSGGVVLASRDGKIVFESTLDARLEVVFRKKLPEIRKLLFSKNAV

SEQ ID NO: 487 - DNA, 1196 bp, Panicum virgatum
  misc_feature: Ceres CLONE 1725358
  misc_feature: Encodes the peptide sequence at SEQ ID NO. 488
aaccatccaaacactgaatcttgtgtctgtctgctcggcactagctagcagtagctacctgccttccttcttaggcttggagtaggattgtgcttgctgctctgagcaaagatggcctccgccttctcttccaaggctgctgcacttgcagcactagtcttctcgctcctggtcacttacggctcgtgcgctaggccggtgaacttcaacacctccgccttcaccggcgatcccaactgggaggccgccagggccacctggtacggcgcgcccaccggcgccggtcctgacgatgatggtggcgcctgcgggttcaagaatgtcaacctgccaccgttctcggccatgacgtcgtacggcaacgagccgctgttcaaggacggcaagggatgcggctcttgctaccagataagatgtaccaaccacgctgcgtgctccggcaacccggagacggtgatcatcaccgacatgaactactacccggtggccaaataccacttcgacctcagcggcacggccttcggcgccatggccaagcccggccgcaacgacgagctccgccatgccggcatcatcgacatccagttcaagagggtgccctgcaactaccccgggcagaaggtgacgttccacgtcgaggagggctcgaacgccgtctacctggcggtgctcgtcgagttcgaggacggcgacggcgacgtggtgcaggtggacctgatggaggccaactccgggtcgtgggcgccgatgcgcgagtcctggggatccatctggaggatggactccaaccaccggctgcaggcgcccttctcgctgcgcatcaccaacgagtccggcaagcagctggtggccagcaatgtcatcccggccaactgggtgcccaacacctactaccgctccatcatccagtactagcactgcagcccatgcccgtcatctggtgctgcatgcccacaataattcggtcattgatttttggttattcgtctggtgctatttcgttgttgcattggattgaggtgccttaattaactagttagtaccagtaggtaagatatcaggtgtccggccggctatgctggcattggcagtcgtagtaggagttgtctgtacctgtaagagagattggcgagtgggaaatagaggaggcaagtttgctattgtgctttcccgcccaaaaaaaaaaaaaaaaaaaa

SEQ ID NO: 488 - protein, 267 aa, Panicum virgatum
  misc_feature: Ceres CLONE 1725358
  misc_feature: Great-hit functional homolog of the protein sequence encoded by LOCUS At1g65680
  misc_feature: Useful for making plants with altered cell wall content and/or composition
MASAFSSKAAALAALVFSLLVTYGSCARPVNFNTSAFTGDPNWEAARATWYGAPTGAGPDDDGGACGFKNVNLPPFSAMTSYGNEPLFKDGKGCGSCYQIRCTNHAACSGNPETVIITDMNYYPVAKYHFDLSGTAFGAMAKPGRNDELRHAGIIDIQFKRVPCNYPGQKVTFHVEEGSNAVYLAVLVEFEDGDGDVVQVDLMEANSGSWAPMRESWGSIWRMDSNHRLQAPFSLRITNESGKQLVASNVIPANWVPNTYYRSIIQY

SEQ ID NO: 489 - DNA, 1035 bp, Panicum virgatum
  misc_feature: Ceres CLONE 1725366
  misc_feature: Encodes the peptide sequence at SEQ ID NO. 490
gctgctctcgcgccgccactcccctcccgttccactcgcccaaaaccctagcgctccccaccgctcgccgccgccgcagcgagcgcctcctcttcctccgtcaaccatggcgacccagatcagcaagaagaagaagttcgtcagcgatggtgtgttctacgcggagctgaacgagatgctgacgcgggagctcgcggaggacggctactccggcgtggaggtgcgcgtcaccccgatgcgcacggagatcatcatccgcgccacgcgcacccagaacgtgctcggcgagaagggccgcaggatcagggagctcacctccgttgtccagaagcggttcaacttccccgagaacggcgtcgagctctacgccgagaaggtcgtgaaccgcggcctctgcgccatcgcccaggccgagtccctccgctacaagctccttggaggcctcgctgtccgcagggcttgctatggtgttcttcgctttgttatggagagtggtgccaagggttgtgaggtcattgtgagtggaaagctcagggcccaaagagccaagtccatgaagttcaaggatggctacatgatctcttctggtcagcctgtgaatgagtacatcgactctgctgtcagacatgtccttctcagacagggtgttcttggcatcaaggttaagatcatgctcgactgggacccgaagggcaagcttggcccggtcaccccgctgccagacctggtgaccatccacgcccccaaggaggaggatgagctgcgccctccagtcctggtcccagagctctaagctcccaacatagtccatgaaatggcagtttgagcagtcctagctaggtttctatctcatgacaagggcaatgcgaagacacttggttaccttaagctttgtggacagaggttatgtattagttctgtgttactttcgtttaagctaagttttgccgaaacagctaccttgatatgtactggatgtgaaattatggtttcttattctcagtgctcttcctttaaaaaaaaaaaaaaaaaaaa

SEQ ID NO: 490 - protein, 228 aa, Panicum virgatum
  misc_feature: Ceres CLONE 1725366
  misc_feature: Great-hit functional homolog of the protein sequence given in SEQ ID NO 9400
  misc_feature: Useful for making plants with modulated biomass
  misc_feature: There is no branching.
MATQISKKKKFVSDGVFYAELNEMLTRELAEDGYSGVEVRVTPMRTEIIIRATRTQNVLGEKGRRIRELTSVVQKRFNFPENGVELYAEKVVNRGLCAIAQAESLRYKLLGGLAVRRACYGVLRFVMESGAKGCEVIVSGKLRAQRAKSMKFKDGYMISSGQPVNEYIDSAVRHVLLRQGVLGIKVKIMLDWDPKGKLGPVTPLPDLVTIHAPKEEDELRPPVLVPEL

SEQ ID NO: 491 - DNA, 1184 bp, Panicum virgatum
  misc_feature: Ceres CLONE 1725378
  misc_feature: Encodes the peptide sequence at SEQ ID NO. 492
actgagcagctgcccgccccaccgctgcccctagaggccgggagcgagagaggaggaggaagagatggcgatggcgacggcgaggacggcggtgtgcgtgctggtggtctgggcgctggtggccgccggcctgggctccgtctccgcgcgcgcgccgctgggccgcaagccgcaacgcgagttcgactacttcgcgctctccctgcagtggcccggcaccatctgcgcctccacccgccactgctgcaccaccaacgggtgctgccgctcggagccgctccagtggttcacgatccatggtctgtggccggactatgacgatgggacatggccgtcgtgctgccgccgcacccagttcgagatgaacaagatactgccactgaaggatatccttgacaagtactggccgtccttgtactgctcctcctcttccacttgcttcagtggcaagggacccttctgggctcacgagtgggagaagcatggaacatgctctgcccctgtggttcaggatgaattacaatatttcaccattgcccttgacctctacttcaaatataatgttacggaaatgctgtcaagtggaggtatacagatttcaaatggtaaggaatatgcactgagcgatgtcattgataccatcaaacatgcttttggggggtcaccacaaattgtttgcaagaagggctcagttgaagagctcaggttatgcttcgacaaagaattgaagcctcgtgattgccttactacttctttgacgaatggaagtatgtcaaaaacaaagcattgcccacagtacatcacactgccaaaatatgatccccttgtgcttgccaattcaactggagagatcatgaaacagttcgacgactttgaggtgtctgcagcaatttatacagcctaacttgtagttgttgcagcagagcaatccatggctgtgacgaaacaaatgtcttcagggccacgaactgcatttatgatagcaggtggttgcctgagcactccagggaaattgatgtctgtgaatcaattttttgtacactaggaagaggaccgtactcttttagatccatgcgaattgaaatttacaggttttacgaaaccttaaaggtcggatcaatgtatatacacattccatagctggatggtgtccttgttgccattaaaaaaaaaaaaaaaaaaaa

SEQ ID NO: 492 - protein, 279 aa, Panicum virgatum
  misc_feature: Ceres CLONE 1725378
  misc_feature (1)..(209): Pfam Name: Ribonuclease_T2 Pfam Description: Ribonuclease T2 family
  misc_feature (10)..(254): SWISSPROT Homolog: EC 3.1.27.1 Ribonuclease 2 precursor
MAMATARTAVCVLVVWALVAAGLGSVSARAPLGRKPQREFDYFALSLQWPGTICASTRHCCTTNGCCRSEPLQWFTIHGLWPDYDDGTWPSCCRRTQFEMNKILPLKDILDKYWPSLYCSSSSTCFSGKGPFWAHEWEKHGTCSAPVVQDELQYFTIALDLYFKYNVTEMLSSGGIQISNGKEYALSDVIDTIKHAFGGSPQIVCKKGSVEELRLCFDKELKPRDCLTTSLTNGSMSKTKHCPQYITLPKYDPLVLANSTGEIMKQFDDFEVSAAIYTA

SEQ ID NO: 493 - DNA, 1072 bp, Panicum virgatum
  misc_feature: Ceres CLONE 1725396
  misc_feature: Encodes the peptide sequence at SEQ ID NO. 494
agactccatacacccaccctctctacgcgcagctcctcgctgaaccggaacacccgcacacacacgccacttggacaccatggcgccccgggcggcggacaagtcgccggtgccgccggccaccggcctcggtctcggcgtcggcggtgccgtcggaggcctgggcatgggcccgcactacaggggcgtgcggaagcgcccgtgggggcggtacgccgcggagatccgcgacccggccaagaagagccgcgtgtggctgggaacgtacgacaccgccgaggaggccgcccgcgcctacgacgctgccgcgcgcgacttccgcggcgccaaggccaagaccaacttcccgttcgcgtcccagtgccccgtcgccgccggcgccggcgccggcagccccagcagcaactgcaccgtggaatcgcgcggaggcggcagcggctacggcgtccaggcgcccatgcaggccatgccgctgcccccggccctcgatctcgatctcttccaccgggcggcggccgtgaccgcggtctcccccggcggcatgcggtttcccttcaaagggtaccctgtcgcgcgcccgaccccgaacccctacttcttctacgaacaggcggcagcggccgcggccgcggcggccggctaccggatgctcaaggtcgccccgccgccggtcaccgtggccgccgtcgcgcagagcgactccgactcctcgtcggtggttgatcgcaccccttcgccgcccgcggttgccgcaaaaaaggaggtctccttcgatctggatctgaactggccgccgccggcggagaactagccacacccaccagagtttttagctgacgacttcgtagtttctctttcctttttgccttgaggaatattacttctgttatttttttttggtcctctagcctgtagttttgttcagtagcctgtgagagacggagaagcctgtgtacatagtttttccgccagaggacggaattgatctgttgctttcccaccccataaaccataaacgcaaaaaaaaaaacatcacatttgaatggttctagaaaaaaaaaaaaaaaaaaaa

SEQ ID NO: 494 - protein, 243 aa, Panicum virgatum
  misc_feature: Ceres CLONE 1725396
  misc_feature (1)..(64): Pfam Name: AP2 Pfam Description: AP2 domain
MAPRAADKSPVPPATGLGLGVGGAVGGLGMGPHYRGVRKRPWGRYAAEIRDPAKKSRVWLGTYDTAEEAARAYDAAARDFRGAKAKTNFPFASQCPVAAGAGAGSPSSNCTVESRGGGSGYGVQAPMQAMPLPPALDLDLFHRAAAVTAVSPGGMRFPFKGYPVARPTPNPYFFYEQAAAAAAAAAGYRMLKVAPPPVTVAAVAQSDSDSSSVVDRTPSPPAVAAKKEVSFDLDLNWPPPAEN

SEQ ID NO: 495 - DNA, 1309 bp, Panicum virgatum
  misc_feature: Ceres CLONE 1725400
  misc_feature: Encodes the peptide sequence at SEQ ID NO. 496
attccatcactcgatcgctctcccactcacgtcacggctcacgggtcgccgtcgtcaacatggctcggagctgcagcggcatgatgagtccgacatcatcgtcgtcggtgccggcgacgctgctgctgctggtggtggtgctactgctggcgggcggctgccacggctcgccgccgctgaaggcgcacttctaccggcgcagctgcccggcgccggaggcggtggtgcgcgacatcgtggtggcccgcgtcgccgccgaccccgccgcgctccccgccaagctgctccgcctcttcttccacgactgcttcgtcagagggtgcgacgcgtcggtgctgatcgactcgacgccgggcacgggcggcggcgacggcggcgcggcggagaaggacgcggcgccgaacgcgtcgctgggcgggttcgacgtgatcgacaccgccaaggccgtgctggaggccgtgtgccccggcaccgtctcctgcgccgacatcgtcgcgctcgcggcccgcgacgccgtctccttccagttcgggcgggagctgtgggacgtgcagctggggcggcgcgacggcgtggtgtcgcgggcgtcggaggcggcggcgggcatcccctcgccgtcggacaacttcaccgccctcgaggccaacttcgccgccaagggcctcgacgtcaaggacctcgtcatcctctccggcgcgcacacgatcggcgtggcccactgcaacaccttcgcggcgcgcctgggcggcggctccggctccaactccgccgccggcgccgacccggcgctgaacgcggcgtacgcggcggagctccgggcgcggtgcggcccggcggcggcgtccaacaacgccacggcggtgcccatggaccccgggagccccgcccggttcgacgcgcactacttcgtcaacctcaagctcgggcggggcctcttcgcctccgacgccgcgctgctcgccgaccgccgcgccgcgggcatgatccaccgcctcactaggcaggcccacttcctccgcgagttcaggaacgccgtccgcaagatggggcgcgtcggcgtgctcaccggcgagcgcggggagatccgccgccactgcagggccgtcaaccgccgctgatggagatggacaccacccggcggccggggctctcgcttcgctcgtatgttcttggaagctgctggattttcgcttcgtttttgtttggttgcaggagattaaatataatacgtgtaatttatttggggcgcgattaagttttttttttgttgaagtcgtatatatataatatgtggcgcctattcttgtgg

SEQ ID NO: 496 - protein, 352 aa, Panicum virgatum
  misc_feature: Ceres CLONE 1725400
  misc_feature (1)..(255): Pfam Name: peroxidase Pfam Description: Peroxidase
  misc_feature (40)..(350): SWISSPROT Homolog: EC 1.11.1.7 Peroxidase 24 precursor
  misc_feature (40)..(350): SWISSPROT Homolog: EC 1.11.1.7 Peroxidase 3 precursor
MARSCSGMMSPTSSSSVPATLLLLVVVLLLAGGCHGSPPLKAHFYRRSCPAPEAVVRDIVVARVAADPAALPAKLLRLFFHDCFVRGCDASVLIDSTPGTGGGDGGAAEKDAAPNASLGGFDVIDTAKAVLEAVCPGTVSCADIVALAARDAVSFQFGRELWDVQLGRRDGVVSRASEAAAGIPSPSDNFTALEANFAAKGLDVKDLVILSGAHTIGVAHCNTFAARLGGGSGSNSAAGADPALNAAYAAELRARCGPAAASNNATAVPMDPGSPARFDAHYFVNLKLGRGLFASDAALLADRRAAGMIHRLTRQAHFLREFRNAVRKMGRVGVLTGERGEIRRHCRAVNRR

SEQ ID NO: 497 - DNA, 1268 bp, Panicum virgatum
  misc_feature: Ceres CLONE 1725403
  misc_feature: Encodes the peptide sequence at SEQ ID NO. 498
gttttattccccaaatctccccccacccactgatccaccccaaaacccttgcggcggcgttgcgctcccatcagctaccaaccccagaccccccttcttctccggctgcggagcggggggttcggcgcgagggaacgagatggaccgtccggcggccggcgcgtcgtaccagcgcttcccccgcgtccggatccgcgagctcagggacgactacgccaagttcgagctccgcgacaccgacgccagcatagccaacaccctccgccgcgtcatgatcgccgaggtccccacggtggccatcgacctcgtcgagatcgaggtcaactcctccgtcctcaacgacgagttcatcgcgcaccgcctgggcctcattcccctcacctccgccgccgccatgcaaatgcgcttctcccgggactgcgacgcctgcgacggcgacggctcctgcgagcactgctccgtcgagttccttctctccgcgcgtgccaccgactccgaccagacgctcgaggtcacatccaacgacctgaggtccgccgaccccaaggtctgccccgtcgaccaggcgcgcgcctaccagcaggcgctcaacgccgacttcgaggccaccgccggggagaacaggggaatacttattgtaaagctgcgtcgggggcaagaactgaggcttcgtgccattgctaggaaaggaatcggcaaggaccatgccaaatggtcaccagctgctaccgtgactttcatgtatgagcctgacatacgtatcaatgaagaactcatggatacattgacgcttgatgagaaaagaagttgggtcgatagtagccctacaaaagtatttaaccttgatcctattaccaaacaggtgacggtgtgtgatgctgaggcatacacctatgacgatgaggtgatcaagaaggcggaggccatggggaagccaggcctggtgaagatcaacgcgaaggaggacagcttcatcttcaccgtggaaacaaccggcgccatcacggcctacgagctgatcatgaacgcgatcacggtcctgcggcagaagctggacgcggtccgcctccaggacgacgacggcgaccttggcgagctcggcgcccacctcggcggaccttaggcatcttcctccccttccccattgtagtagtctcatctaactgccctgctagtcgaacagcctgatgcccctctaaattgtccagactatggatttccgaagcatccagtacgatgttgtggactaaaaaaaaaaaaaaaaaaaa

SEQ ID NO: 498 - protein, 327 aa, Panicum virgatum
  misc_feature: Ceres CLONE 1725403
  misc_feature (1)..(294): Pfam Name: RNA_pol_L Pfam Description: RNA polymerase Rpb3/Rpb11 dimerisation domain
  misc_feature (7)..(324): SWISSPROT Homolog: EC 2.7.7.6 DNA-directed RNA polymerase II 36 kDa polypeptide B
  misc_feature (7)..(326): SWISSPROT Homolog: EC 2.7.7.6 DNA-directed RNA polymerase II 36 kDa polypeptide A
MDRPAAGASYQRFPRVRIRELRDDYAKFELRDTDASIANTLRRVMIAEVPTVAIDLVEIEVNSSVLNDEFIAHRLGLIPLTSAAAMQMRFSRDCDACDGDGSCEHCSVEFLLSARATDSDQTLEVTSNDLRSADPKVCPVDQARAYQQALNADFEATAGENRGILIVKLRRGQELRLRAIARKGIGKDHAKWSPAATVTFMYEPDIRINEELMDTLTLDEKRSWVDSSPTKVFNLDPITKQVTVCDAEAYTYDDEVIKKAEAMGKPGLVKINAKEDSFIFTVETTGAITAYELIMNAITVLRQKLDAVRLQDDDGDLGELGAHLGGP

SEQ ID NO: 499 - DNA, 1135 bp, Panicum virgatum
  misc_feature: Ceres CLONE 1725406
  misc_feature: Encodes the peptide sequence at SEQ ID NO. 500
ctccctccgcggcccagcccaccccccaatccagtgagcacccgcctcccctgcggcggcgcaatgcgtctccttcctctcgtcttcgtcctcgcgctcgccgcggcgtccgccgccgcgagcgcgagcggcccccggtccgtcctccgcacggtcacggacgtcccggcggcggtctcctccggcgacgacgccgacgcgctcttctgcgacagctggaggctgtccgtcgagacggccaacgcggggtcctgggtcgccatccccgcgccctgcgcggcgttcgtgcgggactacatggaggggccccgctacgcgtccgactccgccgtcgccgccgccgactccctcgcgttcgcctccggcgcgctggccgcagccggggcgggggccgcgaggcccgcgtgggtgttcgacgtcgacgagacgctgctctccaacgcgccctactacgcggtcaacggctggggatctcaggaattcaatgaaacgtcctttgatgaatgggtagatgcagcaaaggcgcctgcattgccatctagcctgaaattgtacaacgagcttcagggacttggtttccacgttatcctcttgactggccgggctgaattccagcgtaattcgacggaagcaaatcttttgtttgctggataccaatcatgggaaaaactaatactaaggcaaccttctgatattggcaagactgctgtgcagtacaaatcagagagacgagctgccatggaggctgaaggattcaagatactcggaaattcaggggatcaatggagtgatttgattggatctccaatggcaacgagatctttcaagcttccaaatccaatgtacttcatcagttgattttgttggatgaatgttggaaatagctgttcctttggctgggcattcctaccatcggtcccactgctttcattgtaaagatttcattagccatcattctggacataaatttgggtttatctccaagcatgttgaaaccgcgctgggattaaaggccattgaatctgcccaatgatggtttgtaactacacatcctttcccatactgtggaaaggattcgtggttatgtaaattggatggacattcaaattgccttcaaaaaaaaaaaaaaaaaaaa

SEQ ID NO: 500 - protein, 264 aa, Panicum virgatum
  misc_feature: Ceres CLONE 1725406
  misc_feature (9)..(231): Pfam Name: Acid_phosphat_B Pfam Description: HAD superfamily, subfamily IIIB (Acid phosphatase)
  misc_feature (45)..(263): SWISSPROT Homolog: EC 3.1.3.2 Acid phosphatase 1 precursor
MRLLPLVFVLALAAASAAASASGPRSVLRTVTDVPAAVSSGDDADALFCDSWRLSVETANAGSWVAIPAPCAAFVRDYMEGPRYASDSAVAAADSLAFASGALAAAGAGAARPAWVFDVDETLLSNAPYYAVNGWGSQEFNETSFDEWVDAAKAPALPSSLKLYNELQGLGFHVILLTGRAEFQRNSTEANLLFAGYQSWEKLILRQPSDIGKTAVQYKSERRAAMEAEGFKILGNSGDQWSDLIGSPMATRSFKLPNPMYFIS

SEQ ID NO: 501 - DNA, 1378 bp, Panicum virgatum
  misc_feature: Ceres CLONE 1725410
  misc_feature: Encodes the peptide sequence at SEQ ID NO. 502
gaaacccctccattccgctcccaagctccaggataacactagcagcagaaagtccgccgccgcgggccaagaaatggaagccgtggcagcaaccatggcggcgctcccagcgcttccctgcacttcctccactccatcgtccactttcctcacccccagctcctccactggccggaggatggcgccaagggcagtggccgtccgtgcatctgtggcaacagcggcccgagggacgcactccgttgggtgggacccgtccgggctggcagcagccaggccggcggccagaaaggcgcgcctcgaggagctcgacaccaccaacatgctccttcgccagcgcatcgtcttcctcggctccccggtggatgatacaagtgctgatcttattatcagccagctcttactattggatgcagaggacaaaactaaagacattacgttgtttatcaactcacctggaggttccataacagcaggtatgggagtatatgatgctatgaaattttgtaaggctgacatctcaactgtttgctttggattggcggcttctatgggtgcatttttacttgctgctgggacaaagggtaagaggtattgcatgccaaatgcgaggattatgatccatcagccatcaggtggtgctggtgggaaagtcacagagatgggactacagataagagagatgatgtacgagaagattaagatcaataaaatattgtcgagaattactggaaaacctgaagagcagattgatgaggacacaaagtttgactatttcatgagtccttgggaagccaaggattatgggatagttgacagcattatagacgagggaaaaccaggtttggtggctcccttggcaggagctgtgccgcctccaaaatcacgtgtgtggtacttgtggaaggcttcagggccgactaggaagatcatgacggatctaccttcggaggagaaactagttctcaatggtaatggcagtgcaactggagatgatggtaggctcaagaaggcctcggcaagttgaagcctgccttctctcttacagtaatttaatggaaggtggctttgctatggtggaaggcaataataggatgatggataaagaattgagcttactgcggtacctgtatgccagatcattgtttgcttacatattatggcccacctggtagttggtagagaaatgatgtttgtggagatgaatccaaaacaatgtcttgtatggtgcattcttttttattctttccttccgatgcaccattagttcgaaacgccaggatatgctgtcattttaggccctgtttgcaaatattcgattgttttgcaaagtgaattagacctgctactttttgtgcaaaaaaaaaaaaaaaaaaaa

SEQ ID NO: 502 - protein, 317 aa, Panicum virgatum
  misc_feature: Ceres CLONE 1725410
  misc_feature: Great-hit functional homolog of the protein sequence given in SEQ ID NO 9505
  misc_feature (1)..(180): Pfam Name: CLP_protease Pfam Description: Clp protease
  misc_feature (80)..(257): SWISSPROT Homolog: EC 3.4.21.92 ATP-dependent Clp protease proteolytic subunit 1
  misc_feature: Useful for making plants with modulated biomass
  misc_feature: The plant is abnormally small.
MEAVAATMAALPALPCTSSTPSSTFLTPSSSTGRRMAPRAVAVRASVATAARGTHSVGWDPSGLAAARPAARKARLEELDTTNMLLRQRIVFLGSPVDDTSADLIISQLLLLDAEDKTKDITLFINSPGGSITAGMGVYDAMKFCKADISTVCFGLAASMGAFLLAAGTKGKRYCMPNARIMIHQPSGGAGGKVTEMGLQIREMMYEKIKINKILSRITGKPEEQIDEDTKFDYFMSPWEAKDYGIVDSIIDEGKPGLVAPLAGAVPPPKSRVWYLWKASGPTRKIMTDLPSEEKLVLNGNGSATGDDGRLKKASAS

SEQ ID NO: 503 - DNA, 1204 bp, Panicum virgatum
  misc_feature: Ceres CLONE 1725424
  misc_feature: Encodes the peptide sequence at SEQ ID NO. 504
gcgagggcgtgcctcctgccgccagaagcttccggggaggcgcggcgatggtgtggttccagtgcgaggactgcggcgagaacctcaagaagcccaagctcgccggccacttccgctcttgctacgcctccaagctatcgtgcatcgattgcggcgagttcttcagccaggacaccgtgcaggggcacacccagtgcatctccgaggccgagaagtatggtcccaagggacaaagcaactcatccaagggtgcgcagggtaaggcagataaaccaaagccaaatgcagatgtagatatcaatgttgggctgtcgacacggcctccttggttctgcagcctatgcaataccactgccactagcaagcagactctcttactgcatgctgatggaaagaagcatagggcaaaagcgaaagctttccatgcttcccagaagcaagcaaatggagctgaacaaactgcagatgtgaaggaaaccacggctgttcctacaatagaatctgctcaagcaaatgggggtaagagtggcgatcatgaaagagatgaagaaaaggatgctggcaaaagaaagagagtggatgacatggccatagaggagccatataacacaaaaagacagcatttaacaagttcaaacattggagaggtgatacaatctaaagatgggaagtcagaaaacaaaacaaagagtgctgcagatgaactcgcaggtggtgctgactgtaaaagtgttcagaaacaaaagatcaagtggaagaagattattactaagacactgaagacgagtccggatggagttatgaagcttaagaaactgcaaaagcttgtcgccaaggagctgcaggaatgtggcttgactgaagacaaagaggggctctatgctaccttgatggataaaatagcttcaagctccagattttctgttgatggcaagcgcgttagattggtggcgaagaatgatgacgaatcttagatactggttgtcagtcgatttttggcattgttggtccgtctgattctttggtgtctacttcctgatggcttgtggccaagttttggttaaattgaatgtaacgcatggattgtcaatgaaatccagtaactgtcagacattatgggaacttgggagctcaattctcgcggcgaccattttgaagtgaatttgcaacttttacatgctgtcaaaaaaaaaaaaaaaaaaaa

SEQ ID NO: 504 - protein, 308 aa, Panicum virgatum
  misc_feature: Ceres CLONE 1725424
  misc_feature: Great-hit functional homolog of the protein sequence given in SEQ ID NO 9361
  misc_feature: Useful for making plants with altered alkaloid content
MVWFQCEDCGENLKKPKLAGHFRSCYASKLSCIDCGEFFSQDTVQGHTQCISEAEKYGPKGQSNSSKGAQGKADKPKPNADVDINVGLSTRPPWFCSLCNTTATSKQTLLLHADGKKHRAKAKAFHASQKQANGAEQTADVKETTAVPTIESAQANGGKSGDHERDEEKDAGKRKRVDDMAIEEPYNTKRQHLTSSNIGEVIQSKDGKSENKTKSAADELAGGADCKSVQKQKIKWKKIITKTLKTSPDGVMKLKKLQKLVAKELQECGLTEDKEGLYATLMDKIASSSRFSVDGKRVRLVAKNDDES

SEQ ID NO: 505 - DNA, 1407 bp, Panicum virgatum
  misc_feature: Ceres CLONE 1725430
  misc_feature: Encodes the peptide sequence at SEQ ID NO. 506
atcactcgatcgacacatccactcgatcgctctctcactcacgtcacggctcacgggtcgccgtcgatcgatatggctcggtgctgcagcggcatgacgagtccgacgtcgtcgtcggtgccgccggcgctgctcgtggcggcgacgctgctgctgctgctggcgggcggctgccacgtgcacggcgcgccgctgaaggcgcacttctaccggcgcagctgcccggcggcggaggcggtggtgcgcgacatcgtgctggccagcgtcgccgccgaccccgccgcgctgcccgccaagctgctccgcctcttcttccacgactgcttcgtcagagggtgcgacgcgtcgatgctgatcgactcgacgccgggcagcggcagcgcggcggcggagaaggacgcggcgccgaacgcgtcgctgggcgggttcgacgtgatcgacaccgccaaggccgtgctggaggccgtgtgccccggcaccgtctcctgcgccgacatcgtcgcgctcgccgcccgggacgccgtctccttccaattcgggcgggacctgtgggacgtgcagctggggcggcgcgacggcgtggtgtcgcgggcgtcggaggcgagggcgagcatcccctcgccgtcgggcaacttcaccgccctcgaggccaacttcgccgccaagggcctcgatgtcaaggacctcgtcatcctctccggagcgcacacgatcggcgtcgcccactgcaacaccttcgcggcgcgcctctccagcggctccggccccaactccgccgccagcgccgacccggcgctgaacgcggcgtacgctgcggagctccgggcgcggtgcggcccggcggcggcgtccaacaacgccaccgcggtgcccatggaccccgggagccccgcccggttcgacgcgcactacttcgtcaacctcaagctcgggcggggcctcttcgcctccgacgccgcgctgctcgccgaccgccgcgcggcggggatgatccacggcctcaccaggcaggaacacttcctccgcgagttcgggaacgccgtccgcaagatggggcgcgtcggcgtgctcaccggcgagcacggggagatccgccggcactgcagggccgtcaacagccgctgatgggcattggttggacacgacccggcggccgccggccggccgggctctcgttcgttcttggaagctgctggatgtgttacgtacttcgcttcgatttttgtttggttgcaggagattttaaatataatacgtgtaatttatttggggtgggattaagtagttttttttctatcgaagtcgtaatttatttggagtatatcatatatgtggtgcccattgtggaagcacttttggcgccgtggtggagttgagaagggcaataaaaactatattaattaaccc

SEQ ID NO: 506 - protein, 350 aa, Panicum virgatum
  misc_feature: Ceres CLONE 1725430
  misc_feature (1)..(255): Pfam Name: peroxidase Pfam Description: Peroxidase
  misc_feature (41)..(348): SWISSPROT Homolog: EC 1.11.1.7 Peroxidase 24 precursor
MARCCSGMTSPTSSSVPPALLVAATLLLLLAGGCHVHGAPLKAHFYRRSCPAAEAVVRDIVLASVAADPAALPAKLLRLFFHDCFVRGCDASMLIDSTPGSGSAAAEKDAAPNASLGGFDVIDTAKAVLEAVCPGTVSCADIVALAARDAVSFQFGRDLWDVQLGRRDGVVSRASEARASIPSPSGNFTALEANFAAKGLDVKDLVILSGAHTIGVAHCNTFAARLSSGSGPNSAASADPALNAAYAAELRARCGPAAASNNATAVPMDPGSPARFDAHYFVNLKLGRGLFASDAALLADRRAAGMIHGLTRQEHFLREFGNAVRKMGRVGVLTGEHGEIRRHCRAVNSR

SEQ ID NO: 507 - DNA, 1356 bp, Panicum virgatum
  misc_feature: Ceres CLONE 1725434
  misc_feature: Encodes the peptide sequence at SEQ ID NO. 508
tccccgagacgcagcagcagcagctaggtgcggacaggcagagctcccctcacagtctcacactccactctgccaccccctgtctgagctgcgtctgttgccatggccgcgcggatcttgctcccgctgctgctcttcctcctcggctcgcattgctggtccggggcggcggcggcggggaggcggcagctgctgcaggcgcggcgcgccggggaccccaactcgcaggtcaagttcgacttctcgccgttcctcatcgagtacaagagcgggcgcgtgaagcggctgatgggcaccgacgtggtggcggcgtcctcggacgcgctcacgggcgtcacctcccgcgacgtcgtcatcgacccgtccacgggcgtcgcggcgcggctctacctcccgagcttccgcggcggcgcccgggtgcccgtgctggtctacttccacggcggcgcgttcgtggtggagtccgcgttcacgcccatctaccacgcctacctcaacacgctggcggcgagggcgggcgtggtggccgtgtccgtcaactaccgcctggcgccggagcacccgctcccggcggcgtacgacgactcgtgggcggcgctccggtgggtactcgcgagcgcggccgggtcggacccggacccgtggctgtcccagtacggcgacctgtcccggctgttcctcgccggcgacagcgcgggcggcaacatcgcgcacaacctggcattgcgcgccggggaggagggcctggacggcggcgtgcggatcaagggcgtggcgctactggacccctacttccagggccggagcctcgtgggggccgacgccgcggacccggcgtacctccagtcggcggcgcgcacctggagcttcatctgcgcggggcggtacccgatcacccacccctacgccgacccgctggtgctgccggcggcgtcgtggcagcacctgggcgcgtcccgcgtgctggtgaccgtgtcggagcgggaccggctgagcccctggcagcgcgcctactacgccgcgctccggggcagcggctggcccggggaggcggagctgtacgagacccccggcgagggccacgtctacttcctcaccaagctcggctcgccgcaggcgctcgccgagatggccaagctcgtcgccttcattaaccgcgactagtagccggggtggcgatcggagccgccggctcgccgctgcggcagctcagtaacccatcagtatactacagtagtggcggtaactagcgaggagtgaggggtggttagtactagtaattactagtttttttgtccttgatggtgattaccggtcaattagtactattcactataaaaaaaaaaaaaaaaaaaa

SEQ ID NO: 508 - protein, 353 aa, Panicum virgatum
  misc_feature: Ceres CLONE 1725434
  misc_feature (1)..(222): Pfam Name: Abhydrolase_3 Pfam Description: alpha/beta hydrolase fold
MAARILLPLLLFLLGSHCWSGAAAAGRRQLLQARRAGDPNSQVKFDFSPFLIEYKSGRVKRLMGTDVVAASSDALTGVTSRDVVIDPSTGVAARLYLPSFRGGARVPVLVYFHGGAFVVESAFTPIYHAYLNTLAARAGVVAVSVNYRLAPEHPLPAAYDDSWAALRWVLASAAGSDPDPWLSQYGDLSRLFLAGDSAGGNIAHNLALRAGEEGLDGGVRIKGVALLDPYFQGRSLVGADAADPAYLQSAARTWSFICAGRYPITHPYADPLVLPAASWQHLGASRVLVTVSERDRLSPWQRAYYAALRGSGWPGEAELYETPGEGHVYFLTKLGSPQALAEMAKLVAFINRD

SEQ ID NO: 509 - DNA, 1050 bp, Panicum virgatum
  misc_feature: Ceres CLONE 1725455
  misc_feature: Encodes the peptide sequence at SEQ ID NO. 510
aggtgatcaccaatccatcgtcatccggggctcgacacagccgtcagccgttgcgcgcggagctcttggtgggccgcgaggagaccgatcgaggagaggaagcagtaggaagagacggacagagatcggggaggaatgggtggcgccggcgcgcggtgcgagctctgcgggggcacggcggcggtgcactgcgccgcggactcggcgttcctctgcctgcgctgcgacgccaaggtgcacggcgccaatttcctggcgtccaggcacctgaggcgccgcctgggcagcgcgccgcccgcccgctcgccggggtcctcggcgtcgtccgcgtcgagcagcagctcctgcgtgtccacggccgactccgccgagtcgtcggccgccgcgcccgcggcggcgcggaagcggcgggcgcgcgcggaggcggtgttggaagggtgggccgggcggatgggcttcgcgccggggtcagcccgccggcgcgcggccgcggccgcttgcgcgctccaggcgctgggccggggcgtggccgccgcccgcgtcccgctccgcgtcgcgatggccgcggcgctctgggccgagatcgcgtccgcccccgccgcgtgcaagggaggggaggccgcgctgctccggcggctggaggccgcggcgcacgtgccggcgaggctggtgctcaccggggcgtcgtggatggcgcgcgcggcgagccaccgcgcgctgccgcccgccgaggctgacgacgaggagggctgggacgagtgctcctgaccaaccagggcccccaccgctcatccgctgctgctgtttgcggcactgtacgagctgccgctgagccagcgagcgcgtgccgcgtccaggagacagatcagagacgggctgagcgtagcagcatcatgtgggcatcgttcgtttgttcttttcctcccctaattaactagtatttgatttgtaacaagggtccagcaaatcttgtggttaggagggccaagaaagaaggctggttaacaaaaggctactgcttgatttgattaaaaaaaaaaaaaaaaaaaa

SEQ ID NO: 510 - protein, 210 aa, Panicum virgatum
  misc_feature: Ceres CLONE 1725455
  misc_feature (1)..(47): Pfam Name: zf-B_box Pfam Description: B-box zinc finger
  misc_feature: The sequence is a functional homolog of  SEQ ID NO 328 in the  10/666,642 US patent application
  misc_feature: Useful for making plants with modulated growth and phenotype characteristics
MGGAGARCELCGGTAAVHCAADSAFLCLRCDAKVHGANFLASRHLRRRLGSAPPARSPGSSASSASSSSSCVSTADSAESSAAAPAAARKRRARAEAVLEGWAGRMGFAPGSARRRAAAAACALQALGRGVAAARVPLRVAMAAALWAEIASAPAACKGGEAALLRRLEAAAHVPARLVLTGASWMARAASHRALPPAEADDEEGWDECS

SEQ ID NO: 511 - DNA, 1354 bp, Panicum virgatum
  misc_feature: Ceres CLONE 1725471
  misc_feature: Encodes the peptide sequence at SEQ ID NO. 512
ccccgcatcctcttcccatgcacacccgcctccgcttcagccctctgctccacttcccggcgcattaaacaagtcgcgcggcgcgccgagtttggtgcagttcagttgggttcagctcgttctttgttggagaaattgagagatgggtatcctctcgctcatcaccggtaaggcgggcgccagcgggttcgggtcggcgtccacggcggagcaggtcaccaacggcgtcgacgccagccgccttaccgtcatcattacaggaggagctagtggcattggtctggagacatcaagagtttttgcccttagaggagcccatgtcatcattgccgcgagaaacactgaggctgcatcagaagcaaggaagaccatcttggagaagaacccaacagcacgtattgatgttctgaagcttgacctcagctccctcaagtctgtcagggcttttgcagaccagttcaactcgatgaaacttcctctgaacatcttgataaataatgcaggtgtgatgttctgcccttttcaactgtctaaagatggagtcgagatgcaatttgccaccaatcatctcggacactttctgcttaccaatctcctccttgataatatgaaagccactgccaagtctacgggtattgagggtcgcatcgtgaacttgtcatcagttgcccacgcccatacatacccaaagggaattgaatttgacagaatcaatgatgagaaaagataccatgataaaatggcttatggacaatctaagctggcaaacttactgcacgcaaatgagctctctagacggctcaaggaagaaggagcaaacatcacagttaatagtgttcatcctggattgatcatgaccaatttgatgaggcattcctacgttctcttgaagatcgttcaagttgcaactttcgtactgtggaagaatgtacaccagggagcagcaactacttgttacgtaggactgaacccacagctgaggggagtgacaggaaaatactttgctgactgcaacgaggagaagacgaccaaactgggacagagtgatgagttggcaaagcaactctgggacttcagcgaggagctgatcaagtccacgcaatgagagccataggagctggatcagaggagtgttctgattgtgcttggcatttggtattaccagtggttaatatattagcagtggttattggaacctgatcaatggtggagctggtggtgttcagaaataaatctccacgcatgctttcctagattattctgatgtgacaaagatcaacctgtgtactcttttttaatacccgtgcaatatatgtccagctgagttctggtttaaaaaaaaaaaaaaaaaaaa

SEQ ID NO: 512 - protein, 320 aa, Panicum virgatum
  misc_feature: Ceres CLONE 1725471
  misc_feature (1)..(143): Pfam Name: adh_short Pfam Description: short chain dehydrogenase
MGILSLITGKAGASGFGSASTAEQVTNGVDASRLTVIITGGASGIGLETSRVFALRGAHVIIAARNTEAASEARKTILEKNPTARIDVLKLDLSSLKSVRAFADQFNSMKLPLNILINNAGVMFCPFQLSKDGVEMQFATNHLGHFLLTNLLLDNMKATAKSTGIEGRIVNLSSVAHAHTYPKGIEFDRINDEKRYHDKMAYGQSKLANLLHANELSRRLKEEGANITVNSVHPGLIMTNLMRHSYVLLKIVQVATFVLWKNVHQGAATTCYVGLNPQLRGVTGKYFADCNEEKTTKLGQSDELAKQLWDFSEELIKSTQ

SEQ ID NO: 513 - DNA, 1475 bp, Panicum virgatum
  misc_feature: Ceres CLONE 1725476
  misc_feature: Encodes the peptide sequence at SEQ ID NO. 514
ccaaaacacgcgaaaaccccctctcccgcctccacccatggcgtccctcccgaacggcgccgccgccgccgccggctcctccggcgcgcacccggtggataaggaagtggacttcgccaactacttctgcacctacggttacctctaccaccagaaggagatgctatgcgaccgcgtccgcatggatgcctaccactcctccgtcttccgcaacactccccacttcgagggaaaggtagtccttgacgtgggtactgggagcggcatccttgccatctggagcgcgcaggccggggccaggaaggtgtacgctgtcgaggcgactaatatggcggagcacgcgcgggagctcgcgcgtgccaacggcgtagcggacatcgtcgaggtgatacagggcaccgtggaagatgttgagctgccggagaaagttgatgtaattatatcagaatggatgggctactttcttttgagagaatccatgtttgattctgtcatttgtgcgcgtgaccggtggttgaagccagatggtgtgatgtatcctagtcatgctaggatgtggctagcgcccataagaacgggtttgggtgacaaaaagatggaagacttggatattgctatggatgattggaatctatttgttcaggacactcaaacttattatggggtcaatatgaatgctttgacaaaagcatatcgtgcagaacacgaaaaatactatctcaagtcttcgatatggaacaatcttcatccaaaccaagtcattggccaacctgcagttattaaggaaattgattgcttaacagccactgttgatgagattcgagaagttagagcacaagttatgttgccaatcagcctggaaggaactagattatcagctctggctggatggtttgatgttcactttagaggtagtacgcaaaaccctgcagtggaggaagttgagttgaatacagctccagatgagcagggggggactcattggggccagcaggtattcttgctgactccacctctgaaagtatctaaaggagacaatgttaatgtttccttctcgatggttcgctcaaaggaaaatcatcgactgatggatatggagttcacctatgaattgcatgaattctctggcaggaagcatccagcaatcacaaccaagatgtacttggagtagagcaagaatactgactagacctggttcattcgatgaaagacgggcaccgattaccaattgtccgggtgtcgctgtcactgaacctttaaatctttgctcagaagctgagcaactgtaatccctagtatgatgtggggtattcatacatgggcttaaggccatgatttgtacaagaagaccatgaggcatgatgtagtgccagagattttgttgtattggtaatatcttattgttggattactcaagtaggggagccattgcttggttgctgggttgtcagattttgatccacagtacggtattt

SEQ ID NO: 514 - protein, 377 aa, Panicum virgatum
  misc_feature: Ceres CLONE 1725476
  misc_feature (1)..(98): Pfam Name: Methyltransf_12 Pfam Description: Methyltransferase domain
  misc_feature (4)..(76): Pfam Name: MTS Pfam Description: Methyltransferase small domain
  misc_feature (1)..(100): Pfam Name: Methyltransf_11 Pfam Description: Methyltransferase domain
MASLPNGAAAAAGSSGAHPVDKEVDFANYFCTYGYLYHQKEMLCDRVRMDAYHSSVFRNTPHFEGKVVLDVGTGSGILAIWSAQAGARKVYAVEATNMAEHARELARANGVADIVEVIQGTVEDVELPEKVDVIISEWMGYFLLRESMFDSVICARDRWLKPDGVMYPSHARMWLAPIRTGLGDKKMEDLDIAMDDWNLFVQDTQTYYGVNMNALTKAYRAEHEKYYLKSSIWNNLHPNQVIGQPAVIKEIDCLTATVDEIREVRAQVMLPISLEGTRLSALAGWFDVHFRGSTQNPAVEEVELNTAPDEQGGTHWGQQVFLLTPPLKVSKGDNVNVSFSMVRSKENHRLMDMEFTYELHEFSGRKHPAITTKMYLE

SEQ ID NO: 515 - DNA, 1220 bp, Panicum virgatum
  misc_feature: Ceres CLONE 1725479
  misc_feature: Encodes the peptide sequence at SEQ ID NO. 516
aggcgcagcggagtactgcatcctttagtcggcattgaagtgccctggtgcagcatgacgcttagactcttggctgaagtgagtccacaggacctgctggtagctctttcagagctccaaaaccacctgctgggttacgttaagtccatggccctcaagtgtgccgtggatctccgcatccccgacgccatccatcgccgcggtggtgtcgccaccctcgccgacattgtagccgacaccgagatacatccagcaaatgtccctgacctcaagcgcatgatggaactgctcagcactatgggcatcttcacagccaccgccgcaaaggacagcggtggcatcggtgatgtcgtgtacggcctaacgacggcgtgctacttccttgtcggtcggtgcaacctgtcacctgtggtgccgtacttggtgagccctcacatcgtatcctccttcttcggcatgtctgactggttcaggaaggagccggcggtcgctggcggatccctcttcgagctggcacacggctgctccctgcaggagatggcgagcaaggacgctgcgtttagcagcctcctgaacgactccatggcatctgacagccagctcttcctagaggtgattattttggacaagggccgcatcttccgcgggctcaattcgctggtcgacgtaggcggcggccatggcgcggccacactggtcatcgcgagggcattcccacgcattaagtgcaccgtgctggacctgccgcacgtggtcagccaggccaccaccagcgaggatggtaacttgcatttcatcgccggtgacatgtttgagtcgattccacctgcgaatgctgtcttactcaagaacgttttacatgactggagcgatgaagattgtgtcaagatacttcaacgctgcaagcaagcgatccccgctagaaccaaaggaggaaaggtgataatcatagagatggtgagaggatcagcacagggagatcgcaaaatcagcgagatggaagacatacagaatgtgttcatgttgcatatcaatggagtggaacgaggcataaatgagtggaaaaggatcttttctgatgctggattcagcgatgattacaaaatcatgccagtgttgggcccctattctgtaattgagatctacccatgaataaagcttgaactaccgcactatgtatatacaaggcagtaagatacacatacctgaacttggttgtt

SEQ ID NO: 516 - protein, 365 aa, Panicum virgatum
  misc_feature: Ceres CLONE 1725479
  misc_feature (6)..(249): Pfam Name: Methyltransf_2 Pfam Description: O-methyltransferase
MTLRLLAEVSPQDLLVALSELQNHLLGYVKSMALKCAVDLRIPDAIHRRGGVATLADIVADTEIHPANVPDLKRMMELLSTMGIFTATAAKDSGGIGDVVYGLTTACYFLVGRCNLSPVVPYLVSPHIVSSFFGMSDWFRKEPAVAGGSLFELAHGCSLQEMASKDAAFSSLLNDSMASDSQLFLEVIILDKGRIFRGLNSLVDVGGGHGAATLVIARAFPRIKCTVLDLPHVVSQATTSEDGNLHFIAGDMFESIPPANAVLLKNVLHDWSDEDCVKILQRCKQAIPARTKGGKVIIIEMVRGSAQGDRKISEMEDIQNVFMLHINGVERGINEWKRIFSDAGFSDDYKIMPVLGPYSVIEIYP

SEQ ID NO: 517 - DNA, 1917 bp, Panicum virgatum
  misc_feature: Ceres CLONE 1725868
  misc_feature: Encodes the peptide sequence at SEQ ID NO. 518
actcgtctcctctcctcccactccactgccctcagcagcctctgcgcccactccgccttctagaacatctagggagcatcccactccgcatggtcgccccatagcgcccccaagctccctcgagacaccgtaccacccccaccgacgcaccggcggcaatggcgttcggcggcggcctggccatgtaccacgtcctcggcgtggccacctgcgtggcgctgctctacttcaccttcggcgcggtggacctccgccacatctcgctcccgtccctgcccggctccggcgcctccccccgcgcggccgccgtggcggcgcccttcgtggagcggcgcggcgcgcagctattcctggagggcgagccgttctacccgaacgggtggaactcgtactggctcatggaccagaccgtggagccgaggtcccgggaccgcgtgtcccgcatgttccgcgccgccgccgagatgggcctcaccgtgtgccgctcctgggcattcaacgacggcgcctacaacgccctccaggtctccccaggccacttcgacgagcgcgtcttcaaggcgctggaccgggtgctggtggaggccgggcggcacggcgtgcggctgatcctgagcctggcgaacaacctggaggcgtacggcgggaagacgcagtacgtgcggtgggcgtgggaggagggcgtcggcctctccgcctccaacgactccttcttcttcgaccccgccatccgcgactacttcaaggtctacctcaagacgctgctgacgaggaagaaccacttgacgggggtggagtacagggacgaccccaccatcctcgcttgggagctgatgaacgagccccgctgcaccacggacctatccggcgacacgctccagcgctggatcgaggagatggcggtgtacgtgaagtccatcgacaggaagcacctgctcaccgtcggcgccgaggggttctacgggccgacgagcccccccagcaagctggacgtcaacccggggacctggaaggacaacaactacggctccgacttcatccgcaacgccaagatcccggacattgacttcgcctccatccacctctaccccgacacctggctgctgaagcagcgcgccacggcggaggagaagctcgagttcgcgaagcggtgggtggcctcccacatcgaggacggggacacggagctgggcaagccggtgctcaccaccgagttcgggctgtccaagcgcgcccagggcttcgacccctcccaccgcgacgtcctctacagggccatctacgacatcgtctacgggtcggccgcacggggcggcgcgggcgccgccgccttcgtgtggcagctcgcgccggagggcatggaggagtaccacgacgactactcggtcgtgcccagcgagcacccgtcgctgcgcaggctgatcaaggagcagtcgtgcaggctcgccaagctgaggcgcggcgccggggaggaggccaagcgggcgctggcggcgtgcgccgccggctcgtcgtaggaagagaagccatctccttgcgtcctctgagcttctgttgcgcccaggtcgagcttttttgtcgtttgtcttgtcctccgaatcaagcgagtggtgaagtgtgtcagaaaaaaaaatcaccagaaaacgaatagaaagcaggtaaaaaaaagggtgcgcctcgtgaggctgctggttagattagttttaagattgcttaaaaaaaaggattcgtttaggcattgtcgccagcgccaagccgccgacacccgcggaagagcagatctgcataggtgaagctacagtttccttgatgtgcaacggcacggtagatgcccttgacctttgatatgtaaagtcatcgtggaggggcatccaatggtaatagccgtcctatatataaaaaaaaaaaaaaaaaaaa

SEQ ID NO: 518 - protein, 452 aa, Panicum virgatum
  misc_feature: Ceres CLONE 1725868
  misc_feature (1)..(338): Pfam Name: Cellulase Pfam Description: Cellulase (glycosyl hydrolase family 5)
  misc_feature (1)..(448): SWISSPROT Homolog: EC 3.2.1.78 Mannan endo-1,4-beta-mannosidase 2 precursor
  misc_feature (12)..(448): SWISSPROT Homolog: EC 3.2.1.78 Mannan endo-1,4-beta-mannosidase 2 precursor
MAFGGGLAMYHVLGVATCVALLYFTFGAVDLRHISLPSLPGSGASPRAAAVAAPFVERRGAQLFLEGEPFYPNGWNSYWLMDQTVEPRSRDRVSRMFRAAAEMGLTVCRSWAFNDGAYNALQVSPGHFDERVFKALDRVLVEAGRHGVRLILSLANNLEAYGGKTQYVRWAWEEGVGLSASNDSFFFDPAIRDYFKVYLKTLLTRKNHLTGVEYRDDPTILAWELMNEPRCTTDLSGDTLQRWIEEMAVYVKSIDRKHLLTVGAEGFYGPTSPPSKLDVNPGTWKDNNYGSDFIRNAKIPDIDFASIHLYPDTWLLKQRATAEEKLEFAKRWVASHIEDGDTELGKPVLTTEFGLSKRAQGFDPSHRDVLYRAIYDIVYGSAARGGAGAAAFVWQLAPEGMEEYHDDYSVVPSEHPSLRRLIKEQSCRLAKLRRGAGEEAKRALAACAAGSS

SEQ ID NO: 519 - DNA, 2334 bp, Panicum virgatum
  misc_feature: Ceres CLONE 1725874
  misc_feature: Encodes the peptide sequence at SEQ ID NO. 520
aacgggcggtggctcctctcctctcctctgctctgcggttcggaacacgggaacagcctgctcctccctgactcctccatcttccttcgcgcgaggcctggtcgaccgattggctggttccatatccggcggggcttggtgctcgaggcgatcgcatcgtcatccgccgctcgcgccgttcgattggtacgcgtcgagatgcctttccctctgcttctgcagtcgcgcggcgagttgatccgtcctgcccctgctgttttctcttctcctctccctcgggatgcccgtgcccgtagctgcgctcgtgatttggtctgggctccctagattcgctgtcttgattggacacagttccttgttaattccccttctctttctccatttcttctctgaattgctgctgttttacccagaaaaggcggaaattacggcaaatttagtccaggcctgaacctatgagttttttgtttcacaatttttgttgaattcttggcttctggtaaaaaatttaggaggatagattgcgtttcagtcacccagatttctgcgttgcaaattatttttggcgtttttctgaccgaaatctgcttcacagggccatggacaacccagcgccgccaacgaatgccgcggccggtgcgccagagccgtcgccgtcgccgtcgcggcggctgccggacttccagcagtcggtgcggctcaagtacgtgaagctggggtaccactacctcatctcccacggcatgtacctgctgctcaccccgctgatggtgctcgtggccgtgcacctctccacgctctccccgcgcgacgtcgccgacctgtggccgcacctccgcctcaacctcgtctccgtgctcgcctgctccgcgctcctcgtcttcctcgccaccgcctacttcctcacgcggccgcggcccgtgtacctggtcgacttcgcctgctacaagccggggcccgagcgccggtgctcgcgcgacaccttcatgcgatgctcgcgcctcacgggctccttcaccgacgccagcctcgagttccagcgcaagatcctggagcgctcggggctcggcgaggacacgtacctgcctcccgccgtgacgcgggtgccgcccaacccgtccatggacgcggcgcgcgccgaggcgcgggaggtcatgttcggcgccgtggacgagctgctcgccaagacgggcgtgaggcccaaggacatcggcgtcctggtcgtcaactgcagcctcttcaacccgacgccgtcgctgtccgccatggtcgtcaaccactacaagctccggggcaacatcgtgagctacaacctcggcggcatgggctgcagcgcggggctcatctccgtcgacctcgccagggacctgctgcagacgcacccggggtcgtacgcgctggtgatcagcacggagaacatcacgctcaactggtacccgggcaacgaccgctccaagctcgtgtccaactgcctgttccggatgggcggcgcggcggtgctgctctcgaaccggcgcgccgaccggcggcgggccaagtacgagctggtgcacaccgtgcgcacgcacaagggcgccgacgaccggtgcttcggctgcgtgacgcaggaggaggacggcgagggccgggtcggcgtgtcgctgtcgcgggacctgatggccgtggccggggacgcgctcaagaccaacatcacgacgctgggcccgctggtgctgccgctgtcggagcagctgctgttcatggcgtcgctggccgccaagaagctgctcagggtgaagggggtgcggccctacatcccggacttcaagctggcgttcgagcacttctgcatccacgccggcggccgcgccgtgctggacgagctggagagcaacctggcgctcacggactggcacatggagccgtcgcggatgacgctgcaccgcttcgggaacacgtccagcagctcgctctggtacgagctcgcctacagcgaggccaagggcaggatccgacggcgcgaccgggtgtggcagatcgccttcggctcggggttcaagtgcaacagcgccgtgtggcgggcgctccggtcggtgaacccggcggaggagaccaacccgtggatggacgagatccacaggttccccgtggatgttcccaaggtctccaaggtttccagcgcctgaaatgttcttgccctgctgccatgccattccttcagttcagagttggcaattctttggaccaaattcaggggtctgcaggtgggaattcgtcatagatcatcatcagctctctgactctgagctcgggttatatatactacgtacgtgacaaaaaaaaaaaaaaaaaaaa

SEQ ID NO: 520 - protein, 521 aa, Panicum virgatum
  misc_feature: Ceres CLONE 1725874
  misc_feature (1)..(290): Pfam Name: FAE1_CUT1_RppA Pfam Description: FAE1/Type III polyketide synthase-like protein
  misc_feature (1)..(288): Pfam Name: FAE1_CUT1_RppA Pfam Description: FAE1/Type III polyketide synthase-like protein
  misc_feature (20)..(518): SWISSPROT Homolog: EC 2.3.1.- 3-ketoacyl-CoA synthase 11
  misc_feature (23)..(512): SWISSPROT Homolog: EC 2.3.1.- 3-ketoacyl-CoA synthase 1
MDNPAPPTNAAAGAPEPSPSPSRRLPDFQQSVRLKYVKLGYHYLISHGMYLLLTPLMVLVAVHLSTLSPRDVADLWPHLRLNLVSVLACSALLVFLATAYFLTRPRPVYLVDFACYKPGPERRCSRDTFMRCSRLTGSFTDASLEFQRKILERSGLGEDTYLPPAVTRVPPNPSMDAARAEAREVMFGAVDELLAKTGVRPKDIGVLVVNCSLFNPTPSLSAMVVNHYKLRGNIVSYNLGGMGCSAGLISVDLARDLLQTHPGSYALVISTENITLNWYPGNDRSKLVSNCLFRMGGAAVLLSNRRADRRRAKYELVHTVRTHKGADDRCFGCVTQEEDGEGRVGVSLSRDLMAVAGDALKTNITTLGPLVLPLSEQLLFMASLAAKKLLRVKGVRPYIPDFKLAFEHFCIHAGGRAVLDELESNLALTDWHMEPSRMTLHRFGNTSSSSLWYELAYSEAKGRIRRRDRVWQIAFGSGFKCNSAVWRALRSVNPAEETNPWMDEIHRFPVDVPKVSKVSSA

SEQ ID NO: 521 - DNA, 1807 bp, Panicum virgatum
  misc_feature: Ceres CLONE 1725890
  misc_feature: Encodes the peptide sequence at SEQ ID NO. 522
atcgcagaaggcgaacgaaaccccccttccttcacctccccgttcccgtacagttcatcaaagaaatctgaaaaccaaccaacagacccaaccaaaatcccctcgccgccccttccgggtcccgtcccgtcccttctcgtcgcgcgggcggtcgcctccctcaatctcgaagcctccagcgccgccgctcattcgagaagcctccagcacaaaatcctagggttctcgcgtcgcccgtcgccatgggctccaagaagcggtcgccccagcatcccgcctccccggccagcggcgaggtcgccggcgatgccggcgccccaccggcgggtaaggccccgccggcggcggcaccggtgggggtggtgccgaagcctccggacgtggcgccgttcctgaccaaggtctacgacatggtctccgacccggcgaccgacgcggtcatctcctggggccctggcggcggcagcttcgtgatctgggactcgcacgcctttgagcgggacctgctggcgcggcacttcaagcacaaccacttcaccagcttcatacgccagctcaacacctatggatttcataaagttgatcctgatagatgggaatgggccaatgaaggttttgttaaggaccaaaagcatcttctgaagaccatcaagagaaagaagaaatctgctcaggatgcgactagtgacctgcagccggcacctgtcaaaactgcacctggcactaaaaatatcgaaattggaaaatatggaggtcttgaaaaggaggttgaaacccttaagagggacaaagcccttctaatgcagcagctagtagatctcaggcagtaccagcaatcatctagccttgaagtgcagaatttaattcaacgcctacatgtgatggaacaaaaccaacagcagatgatggcacttctggcaatagttgtccagaatccaaatttcctcaatcagctggtgcagcaacagcgcaggagtaattggtggaatgatgatgggcgcaggaaaaggagattccgtgctctggaacaaggtcctgcagctgatcaggagacttccgttgctggcgcacaaattattcagtaccatcctcccattcctgaaacctccaatcaagtaataccagtaaatggagctttttctccaactactgcacagccagtttcaagccctgaaactgccatgcccatggatgtagaaacaacttctaacagtgtggatcctctggcttcaactggggacctttttactaacacctttgctctatctggttgggatgatatgtttcttggttgcgaaatagaagacatacttgcatcagagcaggactttgagatgggagaacaacagaactctcaagtggagcctccgttgactgtcgaagattacactgagtatcctgtttttcacactccgcaattagagctggagcagcagccgcaggactgtcagatggtagcacaacagggccacaaaaatcctcaatatggtatccactaagtgccgtaagcttgtctgatgctgttaccttttattctacaaagcatgtatttgatgtgcacaagtacaggcctgcctattgaatgttgtgatagggttttcagttttgcgaaaacggaacaccttctgagtcacatttctgttttttgttcgctgcttgctagaatgctcatgctgactcatttctttatcttggtggaaacaaggcataacaagctgagcgattacttctatttggctaaatctgacacagggtcattcttttataagttaatagttgcagaacagaaaaaaaaaaaaaaaaaaaa

SEQ ID NO: 522 - protein, 418 aa, Panicum virgatum
  misc_feature: Ceres CLONE 1725890
  misc_feature: The sequence is a functional homolog of  SEQ ID NO 1805 in the  10/374,780 US patent application
  misc_feature: Useful for making plants with modulated growth and phenotype characteristics
MGSKKRSPQHPASPASGEVAGDAGAPPAGKAPPAAAPVGVVPKPPDVAPFLTKVYDMVSDPATDAVISWGPGGGSFVIWDSHAFERDLLARHFKHNHFTSFIRQLNTYGFHKVDPDRWEWANEGFVKDQKHLLKTIKRKKKSAQDATSDLQPAPVKTAPGTKNIEIGKYGGLEKEVETLKRDKALLMQQLVDLRQYQQSSSLEVQNLIQRLHVMEQNQQQMMALLAIVVQNPNFLNQLVQQQRRSNWWNDDGRRKRRFRALEQGPAADQETSVAGAQIIQYHPPIPETSNQVIPVNGAFSPTTAQPVSSPETAMPMDVETTSNSVDPLASTGDLFTNTFALSGWDDMFLGCEIEDILASEQDFEMGEQQNSQVEPPLTVEDYTEYPVFHTPQLELEQQPQDCQMVAQQGHKNPQYGIH

SEQ ID NO: 523 - DNA, 2069 bp, Panicum virgatum
  misc_feature: Ceres CLONE 1725908
  misc_feature: Encodes the peptide sequence at SEQ ID NO. 524
cttgctggctctgcctcacctcacctccctccaggaccctctctcatctctcccctcctcccggtctggttgcttctcctgtagtttttttgttctctctcgctttgcgcttccgctcttcatatatcgtgtggagcggagcgggtgctctgatctgtctgcctgttcttcgatcgagtctgggagacttggaaggaggagggggaagcaaagcggaacagcccatctttttttagtcttttcggttcggtttcctggttgcttcttttggatcccgcggaggagcccaccgtttctacaaaaacccaatctttgctgccctctccgcggccgagatcgataggtttccagatctaaggcccccttcccctggctcggagatcgcgggcgcagcaatccggcgcgctgctactagggaaaaatatcctagaaaagattttgcgggtgcgacggggcaggaagaaggtatattggggaacacaagggtaaagaaatggtcttcgtgaccaagtgggcgatggggcggtggcggagatgagggatgctatcggctgtgatggattacttgagatcttgctgggggccggcttcgccgaccgggcgcccccgcagaggatcggacgctgccggccgccaggacgggctcctttggtacaaggacggcgggcaggtcgtcgacggtgagttctccatggccgttgtccaggccaacaacctgctggaggaccatagccaggtggaatcggggccgctcagcgcaacggaccccagcctccaaggcaccttcgttggcgtctatgatgggcatggtggcccggagacggcgcgctacatcaatgatcatctcttcaaccacctgaggagatttgcatccgagcacaagtgcatgtcagcagatgtgattcggaaggctttccgagcgaccgaggaggggttcatttctgtagttagtagccaatggtcattgagacctcaattagcagcggttggctcttgctgtcttgttggcgtgatttgcagtggaactctatatgttgcaaaccttggggattcccgtgctgttcttgggagactggtgaagggaactggagaggttttagcaatgcaactctcagcagaacacaatgcatcctatgaggaggttaggcgagagctgcaggcagcacatcctgacgatccccatattgttgtcctaaagcacaatgtttggcgtgtgaagggcatcatccagataacaaggtcaattggagatgtatatctgaagaaaccggagttcaatagagaacctttgcatgccaagtttcgccttcaggaaactttcaggagaccgcttcttagttctgatccagcaattactgtacaccaaatacagccaactgataagttcatcatttttgcatctgatggactctgggagcatcttagtaatcaggaagctgttgacatggtgcagagtagccctcgaaatggaattgctcgaagattagtaaaggctgcaatgcaggaagcagcgaagaagagggagatgaggtattccgacctcaagaaaattgatcgtggggtgaggaggcacttccatgatgatataactgtcatcgtggtctttttcgattcaaatgccacggcaactgctgcctggagcagacccacagtctccctacgtgggggcggtgttccaatcccttccaacacccttgctccattctcagttcccacagagctaaacagctcttactgaaaccatactggaggtgaaagggggccaggcaagaagatcaaaagaaagtaaagaaaaaaaaaagaagaaaaaagagcagcagttgtgatcagcagtagtgtattttgtcgtctgccgtgttcttgtaaaaccttttttagattctcaacctggcgactagcgtactgatagcaaggtataagattagattattcttagtttttttcttctcttttttttcttaccctttagatttactcatgggatatcaggtggctgtacattctccggatcaacttgtgataatagttcatcgcggccttcttttgcgcaaaaaaaaaaaaaaaaaaaa

SEQ ID NO: 524 - protein, 398 aa, Panicum virgatum
  misc_feature: Ceres CLONE 1725908
  misc_feature (1)..(279): Pfam Name: PP2C Pfam Description: Protein phosphatase 2C
MLSAVMDYLRSCWGPASPTGRPRRGSDAAGRQDGLLWYKDGGQVVDGEFSMAVVQANNLLEDHSQVESGPLSATDPSLQGTFVGVYDGHGGPETARYINDHLFNHLRRFASEHKCMSADVIRKAFRATEEGFISVVSSQWSLRPQLAAVGSCCLVGVICSGTLYVANLGDSRAVLGRLVKGTGEVLAMQLSAEHNASYEEVRRELQAAHPDDPHIVVLKHNVWRVKGIIQITRSIGDVYLKKPEFNREPLHAKFRLQETFRRPLLSSDPAITVHQIQPTDKFIIFASDGLWEHLSNQEAVDMVQSSPRNGIARRLVKAAMQEAAKKREMRYSDLKKIDRGVRRHFHDDITVIVVFFDSNATATAAWSRPTVSLRGGGVPIPSNTLAPFSVPTELNSSY

SEQ ID NO: 525 - DNA, 1621 bp, Panicum virgatum
  misc_feature: Ceres CLONE 1725914
  misc_feature: Encodes the peptide sequence at SEQ ID NO. 526
gggtcacgagacgcgcgccgcggccgggtgctggggctgctggtgggaggactgatcgataaaacctctgggtggcgccggcgggggagactagaggcggagccgcgcagggagggagggaggccaaccgataatggaccgggcagcggtgaccgtggggcccgggatggacatgcccataatgcacgacggcgaccgctacgagctcgtccgcgacatcggctccggcaacttcggcgtcgcgcgcctcatgcgcaaccgcgccgacggccagctcgtcgccgtcaagtacatcgagcgaggcgagaagattgacgagaacgtgcagcgcgagatcatcaaccaccgctcgctgcgccaccccaacatgatccgcttcaaggaggtcatcctcaccccgacgcacctcgccatcgtcatggagtacgcctccggcggggagctcttcgagcgcatctgcaacgccggcagattcagcgaggacgaggcgcgtttctttttccagcaactcatatcaggggtcagctactgccattccatgcaagtatgtcatcgagacttgaagctggagaacaccttgctggatgggagtacggctcctcgcctcaagatatgcgactttggctactcaaagtcctcagttctacattctcagccaaaatctacagtgggaactcctgcatacattgctcctgaggttcttctgaagaaagagtacgatggaaaggttgctgacgtgtggtcttgcggagtaaccctttatgtgatgctggttggtgcatatccatttgaggacccagatgagcccaagaatttcagaaagacaattcagagaatattgggtgtgcagtactcaattccagattatgtccatatatctccagagtgccaagatcttatttctaggatttttgttgccaacccagccactagaatcaccatccctgagataagaaaccatccatggttcttgaagaacctcccagccgacctaatggatgacagcacgatgagcaaccagtacgaggagccagagcagccaatgcagagcatggatgagatcatgcagatactggctgaggcgactataccagcagctggttctagtggaatcaaccagttcttgaatgacggtcttgacctcgatgatgacatggaggaccttgactcagacgccgatctcgacctagaaagcagtggggagatcgtttatgctatgtgatgtcaccaaatactcttcaactaagcaatgcgtatcatcccctgggctcagattggcatgttgctttgtagattattgagaggggatgtgaactgagggtagtattacagtgcaggttctgttaccggtgctgctcatgcctgatccggtgatgcccctttcaccatcctgttgttttggctgttgttttgtgcacctccagtgttgtacaacagtttagccttttggatgtgcctgtgttgctgctgctgttctgagtctcatccatctgagaagaaccctggtctctacacaccccaactaagggacggtgatgtacttgtgttattcgattgtgtttgtatcatagtatgtattttgctgtaggcaaataaagagatgctacaatttgccgttctc

SEQ ID NO: 526 - protein, 362 aa, Panicum virgatum
  misc_feature: Ceres CLONE 1725914
  misc_feature (1)..(362): SWISSPROT Homolog: EC 2.7.11.1 Serine/threonine-protein kinase SAPK10
  misc_feature (1)..(362): SWISSPROT Homolog: EC 2.7.11.1 Serine/threonine-protein kinase SAPK9
MDRAAVTVGPGMDMPIMHDGDRYELVRDIGSGNFGVARLMRNRADGQLVAVKYIERGEKIDENVQREIINHRSLRHPNMIRFKEVILTPTHLAIVMEYASGGELFERICNAGRFSEDEARFFFQQLISGVSYCHSMQVCHRDLKLENTLLDGSTAPRLKICDFGYSKSSVLHSQPKSTVGTPAYIAPEVLLKKEYDGKVADVWSCGVTLYVMLVGAYPFEDPDEPKNFRKTIQRILGVQYSIPDYVHISPECQDLISRIFVANPATRITIPEIRNHPWFLKNLPADLMDDSTMSNQYEEPEQPMQSMDEIMQILAEATIPAAGSSGINQFLNDGLDLDDDMEDLDSDADLDLESSGEIVYAM

SEQ ID NO: 527 - DNA, 2035 bp, Panicum virgatum
  misc_feature: Ceres CLONE 1725920
  misc_feature: Encodes the peptide sequence at SEQ ID NO. 528
gccacagcctccaccacaactagagcgccagccccccccccccccccagcccccccgtccccatggccgccgacgccgttgcggcggcgatggctgcgtcctccctcggcggcgacctagagcccgccaccgtccgcaccgccatccgcgacgtcctggccgcgggcaccgcgcgggccggcgagcgcgtcgtggtcgggggctgggtccggacgggcagggagcagggtaagggcaccttcgccttcctcgagctcagcgacggctcctgcgcttccacgctccaggtgattgtcgacgccgccgtgcacccgctcgcgcgcctcaccgccacgggcacctccgtgctcgtcgagggcgagatcaaggaaccgcccgaggggaccaagcagaacgtcgagctcaaggtcagccgcgtgctcgaggtcggcgaggtcgacgccgctgcctacccgctgcccaagggcaaggtcaagctcacgctcgagaagctcagggatgtcgttcacctccgctcgcgcactaacacgattggtgcagttgctaggattaggcaccagctagcctttgcaacacacaggttcttccacgagaatgcatttctctatgtacatacaccaataataactacaagtgactgtgagggtgctggtgagatgttccaagtaacaactttgtttagccaggctgaaaaaactgaaaaggaattgaaagagaaccctgcaccttctgaatctgaaatcgaggcagctaaagttattgtcaaggagaaaggagatgccgttgcgcagcttaaagctgcaaaagccagcaaacaagacatatcagctgctgttgatgtgcttaatagggcaaaggaacatgtttcaaagctggaggagaggtctaagttaaagcctggtattccacgcagggatgatgggtcaatagcttttgaaaatgacttcttcaagcgtcaagcttttctgactgtgtctggacagcttcaggttgagacatacgcatgtgctcttagtagcgtgtatacctttggaccaacattccgggcagaaaactcacatacatcacgccatttggcagagttttggatggttgaaccagaaatcgcatttgcaaacttgcaggatgatatgaactgtgcggaaaaatatatacaatacctttgcaagtggctgcttgaccattgccgggaagatatggaattcatggtgaaaaattatgataagagtgcaattgaacgtctggagctcgtttcctcgactccttttgtgcggatttcatatacaaaggctgtggagctcttgaaaaatgttactgacaagaagtttgataacaaagttgaatggggaattgatttagcctctgagcacgaaaggtatttgacggaggatatatttaagaagccagttattgtttataactatccaaaaggaataaaggcattttatatgaggctcaatgatgatgacaagacggtggctgcaatggatgttcttgtgcccaaggttggtgagttggttggtggaagtcaaagggaggaacgtctagatgttctcaaacagaggatacttgacgctggcttgcctttggaaccctatgaatggtacttagacctccgccgctttgggtccgcaaagcacagcggctttgggttgggtttcgaaaggatgattctttttgccactggtatggagaacatcagagatgttatacccttcccgaggtacccagggagggctgacctgtaatctttgaagactttggttaaacagatgcgaattgattcattcaacatgctggcaagattttggaatgattttgccgatcagttgccctactttgcacattagatatattggagtatactgatacggttgtctagtgtcatgtaatttccagtgtactaaatttgcctttgttagttaaatgctcaactagagccaaaattttaatcataacactgtaaggaattatagttttgtggggtgaagttggtctctttcgcctattcagccaaaaaaaaaaaaaaaaaaaa

SEQ ID NO: 528 - protein, 561 aa, Panicum virgatum
  misc_feature: Ceres CLONE 1725920
  misc_feature: Great-hit functional homolog of the protein sequence given in SEQ ID NO 9742
  misc_feature (1)..(561): SWISSPROT Homolog: EC 6.1.1.22 Asparaginyl-tRNA synthetase, cytoplasmic 1
  misc_feature (7)..(561): SWISSPROT Homolog: EC 6.1.1.22 Asparaginyl-tRNA synthetase, cytoplasmic 3
  misc_feature: Useful for making plants with modulated biomass
  misc_feature: The rosette leaves do not appear in the normal fashion, i.e., their phyllotaxy may be abnormal or too many leaves may be emerging in comparison to the control.
MAADAVAAAMAASSLGGDLEPATVRTAIRDVLAAGTARAGERVVVGGWVRTGREQGKGTFAFLELSDGSCASTLQVIVDAAVHPLARLTATGTSVLVEGEIKEPPEGTKQNVELKVSRVLEVGEVDAAAYPLPKGKVKLTLEKLRDVVHLRSRTNTIGAVARIRHQLAFATHRFFHENAFLYVHTPIITTSDCEGAGEMFQVTTLFSQAEKTEKELKENPAPSESEIEAAKVIVKEKGDAVAQLKAAKASKQDISAAVDVLNRAKEHVSKLEERSKLKPGIPRRDDGSIAFENDFFKRQAFLTVSGQLQVETYACALSSVYTFGPTFRAENSHTSRHLAEFWMVEPEIAFANLQDDMNCAEKYIQYLCKWLLDHCREDMEFMVKNYDKSAIERLELVSSTPFVRISYTKAVELLKNVTDKKFDNKVEWGIDLASEHERYLTEDIFKKPVIVYNYPKGIKAFYMRLNDDDKTVAAMDVLVPKVGELVGGSQREERLDVLKQRILDAGLPLEPYEWYLDLRRFGSAKHSGFGLGFERMILFATGMENIRDVIPFPRYPGRADL

SEQ ID NO: 529 - DNA, 1674 bp, Panicum virgatum
  misc_feature: Ceres CLONE 1725928
  misc_feature: Encodes the peptide sequence at SEQ ID NO. 530
acttcacagtctccattcccccactcgtctcctcccactcccactccactgccctcagcagcctccgcgcccactccgccttctagaacaactagggagcatcccactccgcatggtcgccccgtagcgccccagcaagctcccccaagaccccgcaccggccggcggcaatggcgctcggcggcggcctggcgctgtaccacgtcctcggcgtggccacctgcgtggcgctgctctacttcaccttcggcgaggtggacctccgccacatctcgctcccgtccctgcccggctccggcgccgcctccccgcgcgcggccgccgtggcggcgcccttcgtggagcggcgcggcgcgcagctgttcctggagggcgagccgttctacccgaacgggtggaactcgtactggctcatggaccaggccgtggatgcgaggtcccgggaccgcgtgtcccgcatgttccgcgccgccgccgagatgggcctcaccgtgtgccgctcctgggcgttcaacgacggcgcctacaacgccctccaggtctcccccggccacttcgacgagcgcgtcttcaaggcgctggaccgggtgctggtggaggccgggcggcacggcgtgcggctgatcctgagcctggccaacaacctggaggcgtacggggggaagacgcagtacgtgcggtgggcgtgggaggagggcgtcggcctctccgcctccaacgactccttcttcttcgaccccgccatccgcgactacttcaaggtctacctcaagacgctgctgacgaggaagaaccacttgacgggagtggagtacagggacgaccccaccatcctcgcgtgggagctgatgaacgagccccgctgcaccacggacctatccggcgacacgctccagcgctggatcgaggagatggcggcgtacgtcaagtccatcgacaggaagcacctgctcaccgtcggcaccgaggggttctacgggccgacgagcccccccagcaagcaggacgtcaacccgggcatctggaaggacaacaactacggctccgacttcatccgcaacgccaagatcccggacatcgacttcgcctccatccacctctaccccgacacctggctgctgaagcagcacgccacggcggaggagaagctcgagttcgcgaagcggtgggtggcctcccacatcgaggacggggacacggagctgggcaagccggtgctcaccaccgagttcgggctgtcgcgccgcgcccagggcttcgacccctcccaccgcgacgtcctctacagggccatctacgacatcgtctacgggtcggccgcccggggcggcgcgggcgccgccgccttcgtgtggcagctcgcgccggagggcatggaggagtaccacgacgactactcggtcgtgcccagcgagcacccgtcgctgcgcaggctgatcaaggagcagtcgtgcaggctcgccaagctgaggcccggcgccggggaggaggcaaggcgggccctggcggcgtgcgccgccggctcttcgtaggaagagaagccatctctgcgtcctctgagcttttgttgcgcccaggtcgagcgcgctttttgtcgtttgttttgtcctccgaatcaagcgagtggtgaagtgtgtcagagaaagatcaccggaaaaaaaaaaaaaaaaaaaa

SEQ ID NO: 530 - protein, 453 aa, Panicum virgatum
  misc_feature: Ceres CLONE 1725928
  misc_feature (1)..(338): Pfam Name: Cellulase Pfam Description: Cellulase (glycosyl hydrolase family 5)
  misc_feature (1)..(449): SWISSPROT Homolog: EC 3.2.1.78 Mannan endo-1,4-beta-mannosidase 2 precursor
  misc_feature (12)..(433): SWISSPROT Homolog: EC 3.2.1.78 Mannan endo-1,4-beta-mannosidase 2 precursor
MALGGGLALYHVLGVATCVALLYFTFGEVDLRHISLPSLPGSGAASPRAAAVAAPFVERRGAQLFLEGEPFYPNGWNSYWLMDQAVDARSRDRVSRMFRAAAEMGLTVCRSWAFNDGAYNALQVSPGHFDERVFKALDRVLVEAGRHGVRLILSLANNLEAYGGKTQYVRWAWEEGVGLSASNDSFFFDPAIRDYFKVYLKTLLTRKNHLTGVEYRDDPTILAWELMNEPRCTTDLSGDTLQRWIEEMAAYVKSIDRKHLLTVGTEGFYGPTSPPSKQDVNPGIWKDNNYGSDFIRNAKIPDIDFASIHLYPDTWLLKQHATAEEKLEFAKRWVASHIEDGDTELGKPVLTTEFGLSRRAQGFDPSHRDVLYRAIYDIVYGSAARGGAGAAAFVWQLAPEGMEEYHDDYSVVPSEHPSLRRLIKEQSCRLAKLRPGAGEEARRALAACAAGSS

SEQ ID NO: 531 - DNA, 2131 bp, Panicum virgatum
  misc_feature: Ceres CLONE 1725931
  misc_feature: Encodes the peptide sequence at SEQ ID NO. 532
accatacaactcctacaaaaccgaaagcctcgcctcctgccgcataaacagcatcgacacccacccgcctcaccaccacacccagatttcctctcctcgccgcggcctccattgaccgcccgcgattcccccgcgcgccgcgccagcccagccaccttcttcgtgccgccgccgagctagggacggccgccctcactcgccgctgcgccctgctgcttctcttcgtcctcgcccgtccggatctgaactggcctttcaataacaaggaaacaccttagggaatgcagaaagatgtgcttgcatgttaaagagctacctagtgagggacttggcagggtagccgcccatatttcttctttgccgcctcttgatgacattggggctcatcaacacgcacagctcctgctccttgtgcttctgcacaatggggttcaacgtggcagctcaaccatcttcttagagaaccaccttgggggagacggttgaagtcttcaataaacacttgcaggcttcttgttagtccgtttcaagtcttggatcagtgcggccttttgtgtacatatagtatacattcagcttgatggcggagcataaaggaaatattttgatgcagaaatatgagatgggaaagatgcttggacaagggacctttgcaaaggtctaccatgcccgtaacatgaacactttagaaagtgtggcgataaaggtgattgacaaggagaaggttatgaaggttggcctcatcgatcagatcaagcgggaaatctctgtcatgaagctagtgaggcatcccaacattgtccaactatatgaggttatggctactaaaaccaagatatactttgtgttggagcatgtgagaggtggagaattgttcaataaagttcagcggggacgtctcaaggaggatgctgctcgcaagtactttcagcagctgatttgtgcggtggacttttgccatagcaggggtgtctatcatcgagatttgaagccagagaaccttctgcttgatgagaatagcaatctaaaggtgtcggatttcggtctgagtgcacttgctgaatgcaaaagacaagatggcctgctccacacgacttgtggcacacctgcttatgtcgcacctgaagtgatcaatagaaaaggttatgatggtgccaaagctgatatctggtcttgcggggtcatcctttttgtgctactggctgggtatctcccgttccatgataaaaacttgatggatatgtataagaagattgggaaagcagatttcaagtgcccaagttggttctctactgatgttcgaaggcttttgctaaggattcttgatcctaaccccagtacaaggatctcaatggaaaaaatcatggagaatccatggttcaggaagggtctagatgcaaagctactcaggtataacttgaaaacaaaggacgcccctcctgtggtcatgaatgcagattttgattcgatgggtaccatcctagctacagagggcaaggaacaagaagcaagaaagcccgccaacgtgaatgcatttgatataatatctctatcaactggtttggacctgtcaggtatgtttgaagaatctgacaagaagagagagtccaagttcacgtccaccaagacaagctcaacgattatatcaaagattgaggatatggcgaagaacttgcgactgaagctcgcaaagaaggatggtggtttactgaagatggaaggtgccaagcctggaaggaaaggggtgatgggcatcgatgctgagatatttgaggttagcccgaatttccatcttgtggagataaagaagacaaacggtgatactctagagtaccagaaggttttcaaccaagagatgaggccagcgctagcggacattgtatgggcttggcaaggtgagcagccgaagcagcagcaacagacgtcatgttaaatattgtgataagtgcaacgtttccaacattcatgtagtatttgtttttaccattatgtgatttgtttttgcaacccccccccccccttcctgtattaccaatataaacatctgtgttaggagtatcttgtaagacaattttatctcaaaggtaaacaagtatcgtctcattttatctaaaaaaaaaaaaaaaaaaaa

SEQ ID NO: 532 - protein, 450 aa, Panicum virgatum
  misc_feature: Ceres CLONE 1725931
  misc_feature (12)..(440): SWISSPROT Homolog: EC 2.7.11.1 CIPK-like protein 1
  misc_feature (3)..(437): SWISSPROT Homolog: EC 2.7.11.1 CBL-interacting serine/threonine-protein kinase 15
MAEHKGNILMQKYEMGKMLGQGTFAKVYHARNMNTLESVAIKVIDKEKVMKVGLIDQIKREISVMKLVRHPNIVQLYEVMATKTKIYFVLEHVRGGELFNKVQRGRLKEDAARKYFQQLICAVDFCHSRGVYHRDLKPENLLLDENSNLKVSDFGLSALAECKRQDGLLHTTCGTPAYVAPEVINRKGYDGAKADIWSCGVILFVLLAGYLPFHDKNLMDMYKKIGKADFKCPSWFSTDVRRLLLRILDPNPSTRISMEKIMENPWFRKGLDAKLLRYNLKTKDAPPVVMNADFDSMGTILATEGKEQEARKPANVNAFDIISLSTGLDLSGMFEESDKKRESKFTSTKTSSTIISKIEDMAKNLRLKLAKKDGGLLKMEGAKPGRKGVMGIDAEIFEVSPNFHLVEIKKTNGDTLEYQKVFNQEMRPALADIVWAWQGEQPKQQQQTSC

SEQ ID NO: 533 - DNA, 1429 bp, Panicum virgatum
  misc_feature: Ceres CLONE 1725932
  misc_feature: Encodes the peptide sequence at SEQ ID NO. 534
taccacactgattacttggttacgactaggcccagaagtacgcatcgacctcgccatacttccattccaatgagggcggacagatgaccgaacgaaaaccgcacaaatgctggggagagctgctggcgtgccaaatatccatcaaaacgtgtgatcgccgtcagcatctgcaatactacgccattccctccccaaaaaaagtatctatagaccattaccctaagcgctctcctttcgctcgagcgtgcagggaagggtcacggagatggagagcgctatccccaatcccccccaacgcaaggatcgcggtggtcaccggcgggaacaaagggatcgggctggaggtgtgccggcagctcgccggcgccggcgtcaccgtcgtcttgacggccagggacgagacgaggggcgcagccgccgtggagaagctcagagaagcagggctctccgatgtcattttccatcagctggagatcaccgatgccccgagcatcgctaggttggctgatttcttgaaggcccgttttgggaagctagatatcctgataaataatgctgcaatcggtggggttgagtacctcctagatccttttgatcgttcactgaccagcgaggaaaagttcagtggcatggataagggtcagaggcttgagtggctgaccagtggcgtccgggggacctacgacgctgccagagagggcctgcagacaaactactacggcaccaagcatgtcatcgaagccttactgccgctgctgcaagcttcttccgatgggagaatcgttaatgtctcatccgaatgggggctgctaaggctaatcaccaacgaggagctgaagcaggagctgaacgacgtcgagaagctcaccgaggcgaggctggacgaggtgctcgacgcgttcctgaacgacttcaagcctggggagctgggggcgcacgggtggccggagcatttctcggcgtacaaggtgtccaaggtaaccatgaacgcctactcgaggatcctggcgaggcggcaccccgagctgcgcgtcaactgcgcgcatccsggctacgtgaacaccgacatgaccatccactccgggcccctgacgcccgaggagggcgcggccaacgtggtgaaggtggcgctgctgccggagggcggggtcaccggcgccttctttgcagacggcgaggaggcgccgttcgtgtgacgctcacactgcacacgcggcctacacgggcacggccgatcggcagttcggcactggccctgtcgttcgccgttctactccaactgccttgtatcaacgtgcagtgaagattattagctgctggatctttagttcctctgtccatggtgtcgaagtccaaaattgttggcacacgctggtattttaatttgtccacggaagtgtacttgttactttgaattactcattcacgg

SEQ ID NO: 534 - protein, 370 aa, Panicum virgatum
  misc_feature: Ceres CLONE 1725932
  misc_feature (1)..(100): Pfam Name: adh_short Pfam Description: short chain dehydrogenase
MTERKPHKCWGELLACQISIKTCDRRQHLQYYAIPSPKKVSIDHYPKRSPFARACREGSRRWRALSPIPPNARIAVVTGGNKGIGLEVCRQLAGAGVTVVLTARDETRGAAAVEKLREAGLSDVIFHQLEITDAPSIARLADFLKARFGKLDILINNAAIGGVEYLLDPFDRSLTSEEKFSGMDKGQRLEWLTSGVRGTYDAAREGLQTNYYGTKHVIEALLPLLQASSDGRIVNVSSEWGLLRLITNEELKQELNDVEKLTEARLDEVLDAFLNDFKPGELGAHGWPEHFSAYKVSKVTMNAYSRILARRHPELRVNCAHPGYVNTDMTIHSGPLTPEEGAANVVKVALLPEGGVTGAFFADGEEAPFV

SEQ ID NO: 535 - DNA, 2734 bp, Panicum virgatum
  misc_feature: Ceres CLONE 1725935
  misc_feature: Encodes the peptide sequence at SEQ ID NO. 536
gtttccccatcgccctcgcgccgctccctccctaccgccctcgccctcggcctccccgtctcgctcgcggacgccgccgctccgtgcatccccctcaccggaagcgagggggacccgagggcgccgcgtcgcgccaccacgctctctccgccaccggtgtggaagtggcgggcccgcgccatcagcagctccctccgccgccgctagcgccctcctccattgcgtcgcctggccggctctaaggtcgcggttggccccgccggccctgcggtcgtctgccccgattgaactggattgaagcagctctgaagccggccgccgcagcagagggcgtgtccacggcgtggatcgggagggggctctcgtgcgtctgcacggcgacgcgcgcctctcgttcgatctgacagccattgaggaagagtgctggcatagattgcagaacttgatagaggtgcagtatgatagttcaaatctagagcatcaggtatgagctctagcattttttctttgttaccgacgacaaattcaagatggcaactgacatggtataaagtgtgtttatatacctaacagtggagttgcattctcatgctttcccaagaactcaacgtttcatgatacatgtgctgcaattgttattgtgctaactgctagcgacaatcgtaatttaggcaacccttttattcttgctggggaaattaataattattcgagatgaagcttctcactgagagcattaagcctctcattgagaacaaaagttggaaacaccagctgtaatatcatttgcattcagtgtttgaaattccactttccaaatcatctaaccccttagaggcttttcagcaatacctaaaggtgcaggacatgattgataatctgcagttacaagatggaacaccagatttaatatcttaaatttggggcagcaagtctttctcctagaataatcagatcaatcaacaacagttatgccattaggaagcccagtagctagcacacattgattggaactcaaactagattctgtaagttttttttctttggtctaagtttttctcttgctgatagtgctattgctcatcatcttatgcagtttcagaacaactgttagaagctgaaaactgcactgaattgtcccattttttcaacattatatagaatctattctgtctttacaaaaagacaactgtagaatagttgatggtatgtactcgacagtatacctaaaatagtgaattgccaacattttctgaggtgcttatcatttttatttgttcttacgatgtaattctgatcttactgatacattatttatcacacatgatacatggtgggcctcaaataaggtacaggtcttgttttattctgattgatgctatccgttgtcatgcagaaggacacaggtatcatacaaagcttccattatttattgtgacttctgatgatacgcatgccctaaccatcaatcttttggagtcaaactcctacttttggaacggaaccatctcaagtgaaaagactaaagcaggtgtcactctggcagcacatttctgaaagagttcagaacggtggctttgaaccaaaataaccgtttgtgtcacatgtggtgaagatttttttgtctaactttcatgaaggaccgcaacattccacaagtgggcaactgatgccggacaaatgcaagtttgagcactgaagatgttttaatggccaccaattcgtgacctttggcgtggctcagagcctgattcttctagcagaaatcactgcaatacattatgaagagtagcgatggaaaccggatcaggttacagccaatgtggagaaaagttgcctatgggggaaggcaaccagggtatgatgacaactacactgacgagtcgttcctcgaggagatggttatgaatgctaatgtcgtcaagagggaccttctgaaagtgatgattgactccgtctccatttctcaatatctctgcatcgttgctcttgtggtttcgacatggaccctgacgttgaacttggacattgatgaggctacccttctcaaactagatgttggtctcctactggttgggttctctgtcctattgctcacgacttgtccattctcgctgaagcttctgacaaagtatgtcctcaacatatcattcttcatcagtggtctttatgttcttgcgccaatttaccataccctcactaggtccatcagttcagactcaatatgggcccttgctgtatctcttctgctggttcatctctttctgcatgactattctggttcaactataaggcctccaggagcactcaacaatccaaagttaaccagcaacatctccttgaatgcgtcgatagttgcatccgtccttgtggcttcacgtctgccgtcaaggctgcatgtctttgcgatcatgctcttctccttgcaagtcttcttgtttgcacccctcattacattttgtgtcaagaagtaccactttaggcttcatctgctgttctccttcgcattgatggttgtgaccctgagtgtcacctaccagttgcaccgaatgttcttcattctactgttgtcacttgtgtttatttcagttgtttgcccttactggcttattaggattcaagaatataagtttgagatcaatggcccctgggatgaagcaaaactatgctttgatataactgaatgaatagccgtgctgcattggtttgattgcaaaaaaaaaaaaaaaaaaaa

SEQ ID NO: 536 - protein, 301 aa, Panicum virgatum
  misc_feature: Ceres CLONE 1725935
  misc_feature (1)..(224): Pfam Name: GPI2 Pfam Description: Phosphatidylinositol N- acetylglucosaminyltransferase
MKSSDGNRIRLQPMWRKVAYGGRQPGYDDNYTDESFLEEMVMNANVVKRDLLKVMIDSVSISQYLCIVALVVSTWTLTLNLDIDEATLLKLDVGLLLVGFSVLLLTTCPFSLKLLTKYVLNISFFISGLYVLAPIYHTLTRSISSDSIWALAVSLLLVHLFLHDYSGSTIRPPGALNNPKLTSNISLNASIVASVLVASRLPSRLHVFAIMLFSLQVFLFAPLITFCVKKYHFRLHLLFSFALMVVTLSVTYQLHRMFFILLLSLVFISVVCPYWLIRIQEYKFEINGPWDEAKLCFDITE

SEQ ID NO: 537 - DNA, 1823 bp, Panicum virgatum
  misc_feature: Ceres CLONE 1725937
  misc_feature: Encodes the peptide sequence at SEQ ID NO. 538
gcgggaactgaaatgaaaccgaaaaagaaacagagaaggcctcactccccactccactcccctctcccctcccctcccctccccggccccggtgctttcttggattgcgagaaaaccactcgagaaactcgcaatcgtagggaactgtatcggcaggagcacgaggaagtagacgaggggtggtgcaaggtgccggccgccatggatcacggcaggggacggagacgagcagggaggcagcagcggccgtcccggtctctggtcctgttctcgctgtaacgagagtcggtgccctctgaattccacttgatcggtccaactccagtcgccatgaagcggccacgcggcggcagcccctccctccttccgacggccagagcggatgatgatggttacggcgcggcagctgggatggaggcggagggggacgcggaggaggagatggtggcgtgcggcggcggcggggagaagaagcggcggctgagcgcggagcaggtgcgcgccctggagcggagcttcgaggtggagaacaagctggagccggagcgcaaggagcggctggcgcgcgacctcggcctgcagccgcgccaggtcgccgtctggttccagaaccgccgcgcgcgctggaagaccaagcagctcgagcgcgactacgccgcgctgcgccgctcctacgacgcgctgcggcacgaccacgacgcgctctgccgcgacaaggacgccctcctcgccgagatcaaggagctcaaggcgaagctcggggacgaggaggcagcggcaagcttcacgtcggtcaaggcggagccggcggcctccgacgggccgccggccgcgggcgtgggatcgtccgagagcgactccagcgcggtgctgaacgacgcggacgcgcccgcgggcgcggcggaggcgccggtgccggaggtgcagggcgccctcctccccgcgcccgccgcggccgcgggcgccggagctgccggcgccgcgacgagccacggcggggcgttcttccacgggggcttcctgaaggtgaaggaggacgagacggggttcctggacggcgacgagccgtgcggcgggttcttcgccgtggagcacccgccgccgatggcgtggtggaccgagcccacggagcactgctgctggaactgagctgaagctgaggtggtggtggatgagagcgcaggcttgggatctgagccagccgaggcacgcggtggggaataaaggattaggagcgagagacgggggctattctgcaaattttgtaaaatggaattttacctagtccccttctgtcaattcttgcgcgtattagcagggtagcacagtagcagtagtgccgtggtggtaataagcaacctagaatcaacctaagtacggagtgtttggttaaaactttggacccgagggcaaaaatgcaaccgaaaaatgcgaccagaatcgacgaagagggggacagcgacagtgggaagagaggagtgtagaggaagaggtgggcgaggaaacggccaaaccggcggtcactgttggcgggcccgcggccacgtgaaagtcaggcattgctggcgccaccattgaccgccggacctgccggtgacgccgatcggcgacgtggacgtgcctggccgtgcgcgcccgtgaaagcgttggctccgctctccctgtccctggtcgacctgtctgcgcttctctgtatctgatttggaatcttgccgctcgccgtggagcgatcggtgtctctgtgttctcttgctcttgctcaggagctccgatcgagaagatgaggagcaacccgttctggccaaaaaaaaaaaaaaaaaaaa

SEQ ID NO: 538 - protein, 272 aa, Panicum virgatum
  misc_feature: Ceres CLONE 1725937
  misc_feature (1)..(55): Pfam Name: Homeobox Pfam Description: Homeobox domain
MKRPRGGSPSLLPTARADDDGYGAAAGMEAEGDAEEEMVACGGGGEKKRRLSAEQVRALERSFEVENKLEPERKERLARDLGLQPRQVAVWFQNRRARWKTKQLERDYAALRRSYDALRHDHDALCRDKDALLAEIKELKAKLGDEEAAASFTSVKAEPAASDGPPAAGVGSSESDSSAVLNDADAPAGAAEAPVPEVQGALLPAPAAAAGAGAAGAATSHGGAFFHGGFLKVKEDETGFLDGDEPCGGFFAVEHPPPMAWWTEPTEHCCWN

SEQ ID NO: 539 - DNA, 3425 bp, Panicum virgatum
  misc_feature: Ceres CLONE 1725946
  misc_feature: Encodes the peptide sequence at SEQ ID NO. 540
ctccacattctcttccacctccgttcccctttcttctcctcctcttcttcctcctcctcccttcctcttccatggccgtttagctcctcaggatctccccgtctcatctccacctcttgctagctacccttctgagcttgcacgcggtaaaggatcgtttcgagagctgaaacttgcaggcagacgacacacacagagatcagagttctatttttgcaaagcaacacacacatatatagtcgttcttctgctagatctcactgccagtctcacagagaaggatcttcggactagcttgtccctagatctgttgctggttgtgttgttgcttggcaggcaaggtatctctatataggattaagattagcgcctgttctttggctgtggagggggtatacccatgtgcctgtgaacaaatggaaaggagttgagacggcaagaatttagggctcgagaggtggcgacaggagaatgatgatcccggcgaggcacatgccgccgatgatcggccggagcagcgcggcggcggcgtacgggtcctcgtcggcactatcactcggtcagccaaacctgctggacaaccacccgcagctccagcaggcgctgcagcagcagcatctgctggaccagatcccggcgacgacggcggagagcggcgacaacatgatgcgcggcggccggagctccgacctgctgggggacgagttcgagagcaagtccggcagcgagaacgtggacggcgtctccgtggacgaccaggaccccaaccagccgcccagcaagaagaagcgctaccaccgccacactcagcaccagatccaggagatggaagccttcttcaaggaatgccctcacccggacgacaagcagcgcaaggagctgagccgggagctcgggctggagccgctccaggtcaagttctggttccagaacaagcgcacgcaaatgaagaaccagcacgagcggcaggagaactcgcagctgcgtgcagagaacgagaagctccgggccgagaacatgcggtacaaggaggccctgagcagcgcgtcctgccccaactgcggcggccccgctgcgctcggcgagatgtccttcgacgagcaccacctccgcatcgagaacgcgcgcctccacgaggagatcgacaggatctccgccatcgcggccaagtacgtgggcaagcccatggtgtccttccccgtcctctccagcccgttggctgccgcacgcgcgtcgcctctggacatcggtgtcggtgccgccgccgcagccgccgcggcagcgtacggcgctactgacatcttcggtggtgtcgctgctggtgccgccggggagctgctgaggggcgctgcgcagtcgggcgccgataagcccatgatcgtggagcttgctgtggcggccatggaggagctggtccagatggtgcagctggatgagccactttggaacgcgccgggggtcgatggatcgatcgagacgctgaatgaggaggagtattcgcgcatgttctcccgcgggctcggacccaagcagtacggcctcaagtcggaggcctcccgcgatagcagtgtggtgatcatgacacatgccaatcttgttgagatcctcatggacgtgaatcaatatgcaactatgttctcaagcatcgtgtcgagagcggcggcgctggaggtgctgtccaccggcgtggcggggaactacaatggcgcattgcaagtgatgtcagtggaatttcaggtgccgtcgccactggtgccgaccagggagagctacttcgtgaggtactgcaagcagaacgctgatgggacatgggccgtcgtggacgtctcattggacagcctgcgccctggatctgtcctcaagtgccggcgccggccgtctggctacctgatccaggaaatgcccaatggctactcaaaggtgacatgggtggagcacgttgaggtggacgacaggtcggtgcacaacatctacaagctgctggtgaactcgggccttgccttcggtgcacgccgatgggtcgggacactggatcgccaatgcgagcgccttgccagcgtcatggccagcaacatcccgaccagcgacattggtgtgatcacgagcagtgaggggaggaagagcatgctgaaactggctgagaggatggtgatgagtttctgtggcggcgtgacagcctccgcggcgcaccagtggactacgctgtctggcagcggggctgaggacgtccgtgtcatgaccaggaagagcgtcgacgacccgggcaggccgccaggcatcgttctcaatgccgccacttcattttggctccctgtcccgcccaagcgcgtctttgatttcctccgcgatgagagctctcgtagcgagtgggacatcctctccaatggtggcattgttcaagaaatggctcacattgccaatggccgggatcatggcaactgtgtctcgcttcttcgtgtcaatagcacaaactcaaaccaaagcaacatgctgatcctgcaagagagctgcactgactcgtcgggttcctatgtcatctatgctccggtggacgtcgtggccatgaatgttgtcctcaatggcggcgatcccgactatgtggcactcctgccgtcgggcttcgccatccttcctgatggcccagccaggggaaacatgcaaggcgaaggtggcgtcggctcaggtgggtcgctcctgacagtggcgttccagatacttgtggactctgtgcccacagccaagctctcgctggggtcagtggcaacggtgaacagcctcattgcctgcactgtggagcgcatcaaggccgcggtctcaggcgagagcaatccccagtagcttcgttgaatcacaaaatgttcttatcctcgcattggaggagctagcagcaaattttatagctttcatcagcgggaagtcaagaacgcacctcagactctccttgccatgtggtgctgatagtttggattattttttttgcctagtttccgcaaaatttatggaaattccaagaaatgttcagttatcaaagagaatgcgtcaccactacgcaagggcagttggttcgggtattgacttcctcttcgtgttggcttctcggatgctgctacctgttaatttaggtttcttgtcttgtggagtacaaaaccgtaatttagcctgtaatttgtgctgttgttgcttttgttcagacttttccactatcctggtaggaattccagaatagagatttgtgcttgtatcctggtaggctttagttctatacttttgtagtgtttctggtgttaggcccccatttcaatcccaaatgtttgcatgatgtgcttgcactgctgcatgtcttgttgcttcaagttctcttatattcggttatatagtgccatggccatggaatgctaatttctcaaaaaaaaaaaaaaaaaaaa

SEQ ID NO: 540 - protein, 788 aa, Panicum virgatum
  misc_feature: Ceres CLONE 1725946
  misc_feature (1)..(57): Pfam Name: Homeobox Pfam Description: Homeobox domain
  misc_feature: The sequence is a functional homolog of  SEQ ID NO 244 in the  10/412,699 US patent application
  misc_feature: The sequence is a functional homolog of  SEQ ID NO 2670 in the  10/374,780 US patent application
  misc_feature: The sequence is a functional homolog of  SEQ ID NO 334 in the  10/225,066 US patent application
  misc_feature: The sequence is a functional homolog of  SEQ ID NO 424 in the  11/435,388 US patent application
  misc_feature: The sequence is a functional homolog of  SEQ ID NO 519 in the  11/479,226 US patent application
  misc_feature: The sequence is a functional homolog of  SEQ ID NO 58 in the  10/286,264 US patent application
  misc_feature: The sequence is a functional homolog of  SEQ ID NO 666 in the  11/435,388 US patent application
  misc_feature: Useful for making plants with modulated growth and phenotype characteristics
MMIPARHMPPMIGRSSAAAAYGSSSALSLGQPNLLDNHPQLQQALQQQHLLDQIPATTAESGDNMMRGGRSSDLLGDEFESKSGSENVDGVSVDDQDPNQPPSKKKRYHRHTQHQIQEMEAFFKECPHPDDKQRKELSRELGLEPLQVKFWFQNKRTQMKNQHERQENSQLRAENEKLRAENMRYKEALSSASCPNCGGPAALGEMSFDEHHLRIENARLHEEIDRISAIAAKYVGKPMVSFPVLSSPLAAARASPLDIGVGAAAAAAAAAYGATDIFGGVAAGAAGELLRGAAQSGADKPMIVELAVAAMEELVQMVQLDEPLWNAPGVDGSIETLNEEEYSRMFSRGLGPKQYGLKSEASRDSSVVIMTHANLVEILMDVNQYATMFSSIVSRAAALEVLSTGVAGNYNGALQVMSVEFQVPSPLVPTRESYFVRYCKQNADGTWAVVDVSLDSLRPGSVLKCRRRPSGYLIQEMPNGYSKVTWVEHVEVDDRSVHNIYKLLVNSGLAFGARRWVGTLDRQCERLASVMASNIPTSDIGVITSSEGRKSMLKLAERMVMSFCGGVTASAAHQWTTLSGSGAEDVRVMTRKSVDDPGRPPGIVLNAATSFWLPVPPKRVFDFLRDESSRSEWDILSNGGIVQEMAHIANGRDHGNCVSLLRVNSTNSNQSNMLILQESCTDSSGSYVIYAPVDVVAMNVVLNGGDPDYVALLPSGFAILPDGPARGNMQGEGGVGSGGSLLTVAFQILVDSVPTAKLSLGSVATVNSLIACTVERIKAAVSGESNPQ

SEQ ID NO: 541 - DNA, 1163 bp, Panicum virgatum
  misc_feature: Ceres CLONE 1725949
  misc_feature: Encodes the peptide sequence at SEQ ID NO. 542
actcatcacactcatcgctggagcgcaggaggagcttgtttgtttccgcaaacctgcttacacacgcagtataatccagctgccatcagctcattgcaagcttagcggcggcagtgtagcagaggaagcaagggagagcagagcaggagagccgatagagatagctccgtgctgctgccggtcgtctcgtcctcgatagagaattagagatagcagcaggttgaggacccggccggtcgagctgatcggatcgtcatcggagggagggagagggaggatggtgaacacggcggcgagcctgggcggcggcagggcgggcggcgtgctgccgctggcatcgctgaaccacatcagcatcgtgtgccggtcggtggaggagtcgctgcgcttctacaccgacgtgctgggcttcgcccccatccgccgcccgggctccttcgacttcgacggcgcatggctgttcaactacgggatcggcatccacctgctgcagtcggaggaccccggcagcctgccggagaagagggagatcaaccccaaggacaaccacatctccttccagtgcgagagcatggcggcggtggagcggcggctcaaggagctgggcatcccgtacgtgcagcggtgcgtggaggagggcggcatcaacgtcgaccagatcttcttccacgaccccgacggcttcatgatcgagatctgcaactgcgacaacctccccgtcatcccgctcgccggcgcgcccgtcctgggggcctgcaagcgcgcctccgtcgtcaagcaacagggaggcgcggtgccctcctccgcccccgcggcggcggccgcgcagtgcgtgccgtcggccgcggcggcgcaggccatccgcgtcggcgaggaggcgcacatctcgtgcgcgtgatgagcagctagccacggcgtgcgcggctgcgcgtggtcaactggtcatgtcgtcggcggtgacgcttcggagccgtgcgtgcgtgcgccgccgtcgaccgtggtgacgaggcggcgccgcacgaggcgcccgtgtgcggctggcgtcgccgtctgtatatgcgtcgagtttagtagggttgtgtgtaagagtaaaaactccctttctaagtgaagaataaaccaaggcaggaagatttcttctttaaaaaaaaaaaaaaaaaaaa

SEQ ID NO: 542 - protein, 206 aa, Panicum virgatum
  misc_feature: Ceres CLONE 1725949
  misc_feature (1)..(120): Pfam Name: Glyoxalase Pfam Description: Glyoxalase/Bleomycin resistance protein/ Dioxygenase superfamily
MVNTAASLGGGRAGGVLPLASLNHISIVCRSVEESLRFYTDVLGFAPIRRPGSFDFDGAWLFNYGIGIHLLQSEDPGSLPEKREINPKDNHISFQCESMAAVERRLKELGIPYVQRCVEEGGINVDQIFFHDPDGFMIEICNCDNLPVIPLAGAPVLGACKRASVVKQQGGAVPSSAPAAAAAQCVPSAAAAQAIRVGEEAHISCA

SEQ ID NO: 543 - DNA, 1900 bp, Panicum virgatum
  misc_feature: Ceres CLONE 1725956
  misc_feature: Encodes the peptide sequence at SEQ ID NO. 544
gtgaaaaatcgatccgtgcaagcacacaccaagcaaatcgaggaaagtgcaaagcgcggcgtcccaatcagcggacgtggtgagcagcagcaaatccatggaggccgtgctgatgcagcgggcggcggcggcgaggtgggggttcgtaggggaggcggcgacgggtggcgccgggcagcagccggccggcgttttccggctcggtgcggcgcggcgcgcacccggcggggccgtccgggccagcaggcttgggggtcccgtgcgggcgcacgtctcggaggagcggagcagggaggccgccggcgaggcggtggcggtggcggaggaggaggacgctgtgaggctgttcgtgggcctccccgcggacgtggtggtctcggacgggcgcggggtgagccgcccaagggccgtctcggcggcgctgcgcgcgctcagtctgctcggcgtcgacggcgtggagctgccggtgtcctgggccgccgtgcagcccgggtccgggggctggttcgagtgggccgggtcccgcgccgtcgccgccatggtccgcgacgcggggctcgacctccgcgtctcgctccgcaccgacggcgacgcggtccccgagtgggtggccgacgccgcggccgccgaccccgacgtcctcttcaccgatcgcaacgggcaccgccgcgaagggtgcctctccttcgccgtcgacgagctcccggtgctcgtcggcaagtccccgctcgaggcctacgaggccttcttccgcagcttcgctgacgagttcaaggacctcctggggtcaaccatcacggatgtgactgtgagcctgggtcccaacggcgagctccggtacccgtcgtacccgccggggagcaacggcgccgacggctactccggcgcgggcgagttccagtgctacgataagtacacgctggcccggctgaagcgtcacgccgagtcgtccgggcagccgctgtggggcctgtcgggcccgcacgacgggccgcggtacgacgagtcgccggagtcgtcggccttcttccgggagccggggggctcgtgggagagcgcgtacggggagttcttcctgtcctggtacgccggcgagctcctcgtgcacggcgaccgcgtcctggccgcggcgtcaagggcgttcggcggccagcccgtggagctgtccgccagggtgccgctcctgcgcgggtcctcgcgccccgcggaggccgccgcggggctccacggcgggtacggcccggtggccgcgatgttcgcgcggcgcgggtgcacggtgatcgcgtgcggcgtgggggcgcggctcgacccccccgcggaggaggccctggcgcgggtcaagggcgcctgcgcggagcacggcgcgcggctcgccgcggagagcgcgccgctcgccgtggcgcgcgacggcgcggtgtccgcgggcgtctggctgtccgccgggcgcacccggccgcggcagttcacgtaccagcggatgggcgcggacttcttctcgccgggccactggccgctgttcgtgcagttcgtgcgcgcgctggagtgccccgaggaggcccacgcggacgaccttcccggcggcgagcggctcaccgtaccgtccgcctccgccgcgcaggaagatgccagggcagtgcagaccgtgtgaatggacacggcattaatcgtaactcctcgatgtacaaatgcagtatagcactactgcaatggtagttgtattttagtagtgctccattcagtaggattaagcagtaagtacattttagctgcgagatgagatgagttgatcctttgtatcagtgggaaccaagagcaggagtgtaccactatattgtactccctccgttttaaattataagtcgtttgattttttttatatcaaaaaaaaaaaaaaaaaaaa

SEQ ID NO: 544 - protein, 516 aa, Panicum virgatum
  misc_feature: Ceres CLONE 1725956
  misc_feature (1)..(317): Pfam Name: Glyco_hydro_14 Pfam Description: Glycosyl hydrolase family 14
MEAVLMQRAAAARWGFVGEAATGGAGQQPAGVFRLGAARRAPGGAVRASRLGGPVRAHVSEERSREAAGEAVAVAEEEDAVRLFVGLPADVVVSDGRGVSRPRAVSAALRALSLLGVDGVELPVSWAAVQPGSGGWFEWAGSRAVAAMVRDAGLDLRVSLRTDGDAVPEWVADAAAADPDVLFTDRNGHRREGCLSFAVDELPVLVGKSPLEAYEAFFRSFADEFKDLLGSTITDVTVSLGPNGELRYPSYPPGSNGADGYSGAGEFQCYDKYTLARLKRHAESSGQPLWGLSGPHDGPRYDESPESSAFFREPGGSWESAYGEFFLSWYAGELLVHGDRVLAAASRAFGGQPVELSARVPLLRGSSRPAEAAAGLHGGYGPVAAMFARRGCTVIACGVGARLDPPAEEALARVKGACAEHGARLAAESAPLAVARDGAVSAGVWLSAGRTRPRQFTYQRMGADFFSPGHWPLFVQFVRALECPEEAHADDLPGGERLTVPSASAAQEDARAVQTV

SEQ ID NO: 545 - DNA, 2079 bp, Panicum virgatum
  misc_feature: Ceres CLONE 1725970
  misc_feature: Encodes the peptide sequence at SEQ ID NO. 546
gatctgtctctcccctcctctcacatttccccaatacctggagtgccggggtaggagcacaagcacaggcacctacctctcttgctggttgcttccatcatctggccacaattatctggattttggaccagaaactctcatgtagatcccctgctccagtctgctgctagaactcggcaatctcaggaggattgtctgagatagaagttgctgagatttgccctgcgttggggctcaatcctcttcccagtcagcccatagaagttgctgagatttgccctgcgttggggctcaatcctcttcccagtcagcccaccggtgttgcttggttgttgttgctgtgcttctttcttccatggcggcggtggcctcgtcttctcctccagcaacaattgttgggccgcagccgacgtgggtgccctatgagccaacccgggactgctcccagggcctctgcagcatgtactgcccgcagtggtgctacttcatcttcccgcccccgccgccggccttcgacctcggcggccccggcagcgacgactcctccggccccaccttctcgcccctcgtcatcgccatcatcggcgtgctggccagcgccttcctcctcgtcagctactacaccatcatctccaagtactgcggcaccttcagctccctgtggaacaggttgttcggctccggcaggggccgtggccatggcggcggcgacggcggcggcggcggcggcggctcgcggagtcaggagccgtggagcgccgtgccgtcggacgggctggacgagacgctgatcaacaagatcacagtgtgcaagtacaagcgcggcgacgggttcgtggacagcaccgactgctccgtctgcctcggcgagttccgggacggcgagagcctccggctactccccaagtgcagccacgcctttcacctaccgtgcatcgacacgtggctcaagtcccactccaactgcccgctctgccgctgcaacatcacgttcgtcaccgtcggtgtggtgtcgccgtcaccggagccggaacgccgcggcacgcgggaggagcggacagacaacctcgagctggtcctgaccatagacgactactcggagcaggcgcgcgacgagccccagaatcagaatgcggagaacggcggcggcggccaggaggcgccgaaagattgtccagggagatcggaggaggtcagcggcattgtcgagatcaaggaggacggcgcgccgccagtgagggcgtcgtcgtcgctgtcggacacgcaccgcgacggccgcatgtccatcgccgacgtgctgcaggccagcctggaggacgagctgatgatggcccgggagagcggcctcctggcaggctcctcggggacggggtcgtcaagacggctccacggggagcacagcaacaaggacggtggcggcggccgcagcggccgcacattgccggatgcagccaagagactgccgtcggtgggaagatcgtgcttcagcagcaggagcggcagggggaaggattcagttcttccgatgtgaggccattgcttctcagtggttcttcttctgactaggatacatgacatcgatacttttttgtgtgcgtgtgcttccggtgaagatcaaggtgcgaactaccaaatactctaccaaagtctgcagatttcatcttgttccaatcaggaatcgtggtgccacaggctgcagaaaccgtccgtctgcaagactgcaacggttgatgagtggtgagatcttctgcacctgcttggtgtttctactggataaatgtatagtgcttgaaaaccattttttttctttcccctctttcttccatcttgccgctcctcctctctccaaaacattgggttctactacagataatcccccccccctctgcattagtgagttttaagacttaggccgaaggtttttctccaggcgagaagtgagtaagtttcagcactggccattacttttctactagttgtcagtttagaacaatcatttgctgatgtgtgtgttgaacttggaaaagggaagtgtgaccggttcagcgtggttcatgccaaaaaaaaaaaaaaaaaaaa

SEQ ID NO: 546 - protein, 391 aa, Panicum virgatum
  misc_feature: Ceres CLONE 1725970
  misc_feature (1)..(42): Pfam Name: zf-C3HC4 Pfam Description: Zinc finger, C3HC4 type (RING finger)
MAAVASSSPPATIVGPQPTWVPYEPTRDCSQGLCSMYCPQWCYFIFPPPPPAFDLGGPGSDDSSGPTFSPLVIAIIGVLASAFLLVSYYTIISKYCGTFSSLWNRLFGSGRGRGHGGGDGGGGGGGSRSQEPWSAVPSDGLDETLINKITVCKYKRGDGFVDSTDCSVCLGEFRDGESLRLLPKCSHAFHLPCIDTWLKSHSNCPLCRCNITFVTVGVVSPSPEPERRGTREERTDNLELVLTIDDYSEQARDEPQNQNAENGGGGQEAPKDCPGRSEEVSGIVEIKEDGAPPVRASSSLSDTHRDGRMSIADVLQASLEDELMMARESGLLAGSSGTGSSRRLHGEHSNKDGGGGRSGRTLPDAAKRLPSVGRSCFSSRSGRGKDSVLPM

SEQ ID NO: 547 - DNA, 1803 bp, Panicum virgatum
  misc_feature: Ceres CLONE 1725992
  misc_feature: Encodes the peptide sequence at SEQ ID NO. 548
agcgctactggaaagttttaaaactcacggggagctcggaggcgcgacgaccgccgcttccccacctgccattgccgaggaagggagcgcgcgggacggcgggagcgacctaggccggcggggtcctgcagcgtcgcgtcggcgatctgcgatgatgaacctgcgcgtcgccaccgcggcgccctctgcggccggcgcgcgcgtgctcggcgggggcgttgcgcgcgtgccgccgcgcccgtgggcgctccgcggcaggagacgcctctccgtgcgcatgtccgtcgcgaccaccgaggccgctgccgccgccgtgggcgcctccgaggacgaggcgctggaggccaggaactccaagacggtggtggcggtcatcctcggcggcggcgctgggaccaggctcttcccgctcactaagcgcagggcgaagcccgcggtgccgattggcggcgcgtaccggctgatcgacgtgccgatgagcaactgcataaacagcgggatcaacaaggtgtacatcctcacccagttcaactcggcgtccctcaaccgccacctctccagggcctacgatttcagcaatggcgtggcgtatggagacggattcgtcgaggttctagcagcaacacagaggcctggaacggagggaaagaggtggtttcagggtacagccgatgcagttcggcagttcgactggctttttgatgatgccagagctaaagacattgaagatgtgttgattctttctggtgatcacctctaccgtatggattacatggactttgttcagagtcatcggcaaagaggtgcaggcatcagcatatgttgtttaccaattgatggcagccgggcatctgattttggtctaatgaagatagatgacactggaagaatagtttcattcagcgagaagccaaaaggagatgatttaaaggcaatgcaagttgacaccacggtgctaggcttatcaaaggaggaagcagaacagaaaccctacatagcgtcaatgggggtttatatttttaagaaagacatactcctaaaccttttaagatggcgttttcccactgcgaatgattttggttctgaaataattcctgcttcagcaaaggaaatcaatgtaaaggcatatcttttcaatgattactgggaagatattggaactattaagtccttctttgaagcaaaccttgcccttgctgagcagcctccaaggttcagcttctatgatgatgacaaaccaatgtacacatcacggagaaacctaccgccgtctatggtcaacaatagtaagatcactgattcaatcatttcccatggatgtttcttggatgactgcaggatagaacatagtgtagttggagtccgttctcggataggctccaatgtgtacctcaaggatacagtaatgctcggtgctgattactacgaaactgatccggaaagaggacaactgcttgctgaaggaaaagttcccattgggattggggagaatacgacgattcaaaagtgtatcatagacaagaatgcgaggatagggaagaacgtgacgatctccaacgctgagggcgtagaggaagctgatagaacatccgaaggattctacatccgatccggcatcactgtcgtcctgaagaactcaataatcgccgatggattggtcatatgagctgaaaaaagctcaccagacaggcatttgcagcataaataatgataggagttctttgtagttttacaataagctgacgtgcagcattcaagagcttttgcttgtctatacaagatcaaaaaaaaaaaaaaaaaaaa

SEQ ID NO: 548 - protein, 504 aa, Panicum virgatum
  misc_feature: Ceres CLONE 1725992
  misc_feature (1)..(280): Pfam Name: NTP_transferase Pfam Description: Nucleotidyl transferase
  misc_feature (33)..(504): SWISSPROT Homolog: EC 2.7.7.27 Glucose-1-phosphate adenylyltransferase large subunit 1, chloroplast precursor
  misc_feature (40)..(504): SWISSPROT Homolog: EC 2.7.7.27 Glucose-1-phosphate adenylyltransferase large subunit 3, chloroplast precursor
MMNLRVATAAPSAAGARVLGGGVARVPPRPWALRGRRRLSVRMSVATTEAAAAAVGASEDEALEARNSKTVVAVILGGGAGTRLFPLTKRRAKPAVPIGGAYRLIDVPMSNCINSGINKVYILTQFNSASLNRHLSRAYDFSNGVAYGDGFVEVLAATQRPGTEGKRWFQGTADAVRQFDWLFDDARAKDIEDVLILSGDHLYRMDYMDFVQSHRQRGAGISICCLPIDGSRASDFGLMKIDDTGRIVSFSEKPKGDDLKAMQVDTTVLGLSKEEAEQKPYIASMGVYIFKKDILLNLLRWRFPTANDFGSEIIPASAKEINVKAYLFNDYWEDIGTIKSFFEANLALAEQPPRFSFYDDDKPMYTSRRNLPPSMVNNSKITDSIISHGCFLDDCRIEHSVVGVRSRIGSNVYLKDTVMLGADYYETDPERGQLLAEGKVPIGIGENTTIQKCIIDKNARIGKNVTISNAEGVEEADRTSEGFYIRSGITVVLKNSIIADGLVI

SEQ ID NO: 549 - DNA, 1655 bp, Panicum virgatum
  misc_feature: Ceres CLONE 1725994
  misc_feature: Encodes the peptide sequence at SEQ ID NO. 550
aaccccaaccccgtcgagccatctcctttctcctgagctccttccattccattcccaagctaagctagcagacaaggccgcggatccatgggcgtcttcacggtgaccaagctgtccgagggccccgtgcggccgtccgccgccacgccgtcggggacgctgcccatggcctgggtcgaccggtacccgacgcaccgcggcctcgtcgagtccgcgcacatctaccgcaacgtcgacgacatgccggcgccggcatcggagcgagaggctggtggcactggcgccaaggccgccgccgccgccctcgccctgcaggcgccggacaaggaggcgatgatgaacggcagcaagtccccggccgcggtggtgcgcggcgcgctggcggacgcgctggtgcactactacccgttcgcggggcggatcgtggaggacgtccccggccggcccgccgtgctgtgctccggcgagggcgtctacttcgtggaggccgccgccaactgcaccctcgccgacgtcaacttcctggagcgcccgctgctgctcgccaaggagcagctcgtgccgtgcccgacgccggagctctggcccgtcgagccgcacaacaccctcgccatgatacaggtcacgaccttcacctgcggcggcttcgtggtcggcctgcgcaccaaccacgcggtggcggacggcacgggcgcggcgcagttcctgaacgccgtcggcgacctcgcccgcgggctgccggagccccgcgtgaagcccgtctgggcccgggaccgcttccccgacccggacatcaagcccggcccgctcccggagctgccggcgctggccctcgagtacatcgcgttcgacttcccggccgcctacctcggcaagctcaagtcgcagtacgcggcgtccacgggcggcaagatctgctccgccttcgacatcgtcatcgccaagctctggcagtgccggacgcgcgccatcggcgccgctcccggcgccgacgtcaggctctgcttcttcgccagcgcccgccacgtgctgaagctggagccggggtactacggcaacgccatcttccccgtgaaggtgtcggcgccggcggagaaggtggccgggtcgtcggtgatcgagctcgtcggcatggtgcgcgacgcgaagcggcggatggccgaggagtgcctgagctgggcggagggccgcaccggcgggcgcgacccgttccagatgaccttcagctacgagtccgtgtacgtgtcggactggagcaagctcgggttcaacgacgtggactacgggtacggcacgccggtgtccgccggcccgctggtgaactgcgacctcatcgcgtcggccatcgtcatgagggcgccggcgccgctcgccggcacgcggctgctggccagctgcgtcaccaaggagcacgccgacgacttcgcccgcaggatgcgggaggatctcgtgtgatgatgcgggcttgcatacgtgaaggaactcggccgccgtaccgtatgtccgtatcacatatctacctatctacgatacgtgtcatcgatcagagctagtggtggtgggagctacatacgaaatgggaattggtgttcctgtctggaccgtaactatatagtattgcactagttgttgtacaaaaaaaaaaaaaaaaaaaa

SEQ ID NO: 550 - protein, 455 aa, Panicum virgatum
  misc_feature: Ceres CLONE 1725994
  misc_feature (1)..(316): Pfam Name: Transferase Pfam Description: Transferase family
  misc_feature (45)..(411): Pfam Name: Transferase Pfam Description: Transferase family
MGVFTVTKLSEGPVRPSAATPSGTLPMAWVDRYPTHRGLVESAHIYRNVDDMPAPASEREAGGTGAKAAAAALALQAPDKEAMMNGSKSPAAVVRGALADALVHYYPFAGRIVEDVPGRPAVLCSGEGVYFVEAAANCTLADVNFLERPLLLAKEQLVPCPTPELWPVEPHNTLAMIQVTTFTCGGFVVGLRTNHAVADGTGAAQFLNAVGDLARGLPEPRVKPVWARDRFPDPDIKPGPLPELPALALEYIAFDFPAAYLGKLKSQYAASTGGKICSAFDIVIAKLWQCRTRAIGAAPGADVRLCFFASARHVLKLEPGYYGNAIFPVKVSAPAEKVAGSSVIELVGMVRDAKRRMAEECLSWAEGRTGGRDPFQMTFSYESVYVSDWSKLGFNDVDYGYGTPVSAGPLVNCDLIASAIVMRAPAPLAGTRLLASCVTKEHADDFARRMREDLV

SEQ ID NO: 551 - DNA, 1058 bp, Panicum virgatum
  misc_feature: Ceres CLONE 1726003
  misc_feature: Encodes the peptide sequence at SEQ ID NO. 552
atttggggctcacctgctcctcagagtccagccaatttttgggttcacctactactgtatctcatcgtcatctgttttgaggaggacgacaaagcagcgtccatggcgacagcgaggcccatcctgtacaacgcctggatcagctcctgctcccaccgtgtccgcatcgctctcaacctcaaaggtgtggactatgagtacaagtcagtaaatcccaggacagacccagattatgaaaaaatcaacccaataaaatatattcctgcactagtagatggggacatagtcgtttccgactctcttgccatctcattgtatttggaagacaaatatcctgcgcattctctcctgcctaaagatctgaagacgaaagctcttaatcttcagattgctagcatagtttgttcaagcattcaacctcttcaaggctatgccgttattggtttgcatgagggaagcatgagccctgatgagggccttcaaattgttcagcgttatactgacaagggattcagagcgattgaaaagcttttggatggatgcgagagtaaatatgctactggagatgatatccaattgggtgatgtgtttctagagccacagatccatgccggcataaatcgcttccaaattgatatgtcaaagtacccgattttggcaagacttcatgatgcatacatggaaatccccgcatttcaagctgcgcttccgaaaaatcagccagatgcaccgtcattgtaaagaatcaagattaccatgctacatcaaaatcaatgcttttcaataataagttggaagagaagctctcgcgggctgctggcttttggagctcgctctcagccagcaaatccgggttcgagccctgcctccttccaagtgcaatgcaaggaggcggtctgcctcttcccgtctcatttttttaataataagttggaagagtttgttcaaacaataataatttggaaggatggtgactgcttcaacactgggttggatgttagcttacccattcatgaagactccggcatatgtttaagcaaaaaaaaaaaaaaaaaaaa

SEQ ID NO: 552 - protein, 212 aa, Panicum virgatum
  misc_feature: Ceres CLONE 1726003
  misc_feature (1)..(93): Pfam Name: GST_C Pfam Description: Glutathione S-transferase, C-terminal domain
  misc_feature (2)..(72): Pfam Name: GST_N Pfam Description: Glutathione S-transferase, N-terminal domain
  misc_feature (1)..(211): SWISSPROT Homolog: EC 2.5.1.18 Glutathione S-transferase
  misc_feature (8)..(211): SWISSPROT Homolog: EC 2.5.1.18 Glutathione S-transferase zeta class
MATARPILYNAWISSCSHRVRIALNLKGVDYEYKSVNPRTDPDYEKINPIKYIPALVDGDIVVSDSLAISLYLEDKYPAHSLLPKDLKTKALNLQIASIVCSSIQPLQGYAVIGLHEGSMSPDEGLQIVQRYTDKGFRAIEKLLDGCESKYATGDDIQLGDVFLEPQIHAGINRFQIDMSKYPILARLHDAYMEIPAFQAALPKNQPDAPSL

SEQ ID NO: 553 - DNA, 1856 bp, Panicum virgatum
  misc_feature: Ceres CLONE 1726005
  misc_feature: Encodes the peptide sequence at SEQ ID NO. 554
ctggtactggtgggtaccaaatccgtggccgattcccagattgcaaggcctccttcccctactgcttcggttaatcatcaattatcacttgctgtcttctcttgcacggttccagcttctccgcttcggttccggcggcgatggcgatggcggcggaggccaaggacgtcggcatcctcgccatggacatctacttcccgcccacctgcgtgctccagaaagagttggaaactcacgatggcgtgagcaaagggaaatacaccattgggcttgggcaggattgcatggcattttgcactgaagttgaggatgttatttcaatgagcttgacagtggtgaagtccctactgaaaaattataacattgacccgaagtgcattggacgtttggaagttggcagtgaaacagtaatagacaagagcaagtctataaagacatggttgatgcaaatttttgaggaatgtggcaacactgatattgaaggagttgactcctcaaatgcatgctatggtggaacagctgcgttgtttaattgtgttaactgggttgaaagcaactcgtgggatgggcgctatggacttgttgtttgcacagacagtgcggtttatgctgaaggtccggctcgtcctactggtggtgcagctgctattgcaatgttgattggaccaaacgctcctatttcttttgaaagcaaatataggggatctcacatggcccatgcatatgacttttacaagcctgatcttgcaagtgaatatccggtggttgatggaaagttgtcgcagacatgctatctcatggcattggattcctgctataatgtattttgtaaaaagtatgaaaagcatgagagaaagcaattttcaatttttgatgcagattatgttgtatttcattctccatacaacaagcttgtacagaaaagctttgctcgtttgtgctacaacgatttcttgagaaactgcagcacggttgatgaagagtctagggaaaaattggcaccctatactggtttgtcatctgaagaaagctaccagagccgagaccttgaaaaggcatcccagcaagttgcgaagaaactgtacgagtccaaggttcagccaacaacattgatcccaaaacaagttgggaatatgtatacagcatcactctatgccgcttttgcttcagttatctataatagacatgaaactctggcaggccagaggattgttatgttttcatatggaagtggcttgacatcaacaatgttctctttcaaaattaatgaaggccagcatccattcagtctgctaaacattgcaaacatactggatatttccaagaaactggaggcacgacatgtggttcccccgaagaaatttatcgagacactgaaattgatggagcaccgctatggggcaaaagatttcgtgaccagtcaggacacaagtttgctacctgcaggcacatattatctcacccacgtcgactccatgtaccgaaggttctacgccgtgaaagatgacgctgtcaccactgcagtgtccaatggccactgatttgtcttcagcttgaagctgccacgagtcaataacagaggcaggtgtaataagcatgcgagttttcttagattatctgttaggaggggaagctggaggctggagcttaggtcaatctccagtcctaaggttgtaaagttagttagagctatgcgattgttgtaatggttgcttagtaaaaatgctcgcttagcaggaatggcagtgcctgcgaaattcagatcaagcacactgctgggttgtaagaattctgaataatctgccgaggaacagttggattaagttatgttgttgaaataaatgattacttgtacc

SEQ ID NO: 554 - protein, 466 aa, Panicum virgatum
  misc_feature: Ceres CLONE 1726005
  misc_feature: Great-hit functional homolog of the protein sequence given in SEQ ID NO 9379
  misc_feature (1)..(275): Pfam Name: HMG_CoA_synt_C Pfam Description: Hydroxymethylglutaryl- coenzyme A synthase C terminal
  misc_feature (2)..(466): SWISSPROT Homolog: EC 2.3.3.10 Hydroxymethylglutaryl-CoA synthase, cytoplasmic
  misc_feature (7)..(466): SWISSPROT Homolog: EC 2.3.3.10 Hydroxymethylglutaryl-CoA synthase
  misc_feature: Useful for making plants with modulated nitrogen use efficiency
MAMAAEAKDVGILAMDIYFPPTCVLQKELETHDGVSKGKYTIGLGQDCMAFCTEVEDVISMSLTVVKSLLKNYNIDPKCIGRLEVGSETVIDKSKSIKTWLMQIFEECGNTDIEGVDSSNACYGGTAALFNCVNWVESNSWDGRYGLVVCTDSAVYAEGPARPTGGAAAIAMLIGPNAPISFESKYRGSHMAHAYDFYKPDLASEYPVVDGKLSQTCYLMALDSCYNVFCKKYEKHERKQFSIFDADYVVFHSPYNKLVQKSFARLCYNDFLRNCSTVDEESREKLAPYTGLSSEESYQSRDLEKASQQVAKKLYESKVQPTTLIPKQVGNMYTASLYAAFASVIYNRHETLAGQRIVMFSYGSGLTSTMFSFKINEGQHPFSLLNIANILDISKKLEARHVVPPKKFIETLKLMEHRYGAKDFVTSQDTSLLPAGTYYLTHVDSMYRRFYAVKDDAVTTAVSNGH

SEQ ID NO: 555 - DNA, 2285 bp, Panicum virgatum
  misc_feature: Ceres CLONE 1726006
  misc_feature: Encodes the peptide sequence at SEQ ID NO. 556
agcgcccgcccgcagcgcacgaacaagaacaaatatcctacgccccgcccgcccgctcgctcgccactccgccgccgcactcccgtccaaccgcttattccgggctcccggcgatgtcggcggcggtcgggggcgctgagttccacgggttccgcggcgcggcggcgcagctccccaggtcgcggatgctcgggaggccgctccgggtggcgccacccgccgccgccccggcgggcgggggcgcgtcctcgggcagcatacgcgccgtctccgcgcctctgaagaaggatgcagctgaagtgaagcgaagcaaggttgagataatcaaggaaaagagcaatttcctccggtaccctttgaacgaggagttggtctcagaggccccaaatatcaacgagagtgctgtccagttgatcaagtttcatggaagctatcagcagactgatcgagatgtccgcgggcagaagaattactcttttatgctccggacaaagaatccttgtgggaaagttccgaaccagctttacttggctatggatacacttgctgatgagtttggcattgggacactccgattgaccaccaggcagacattccagctgcacggcgttcttaagaaaaacctgaagactgttctcagcactgtcataaagaatatgggctcaacattgggtgcttgtggagatctcaataggaatgtgcttgcacctgcagcgccttatgtcagaaaagatatcctttttgctcaacagacagcagagaacattgcagcacttcttacaccacaatctggagcttattatgacctgtgggtggatggagaaaagataatgtcagctgaagagcctcctgaggtcacaaaagcccggaatgacaactcacatggaacaaacttccctgactctcctgaaccaatctacggcacccagtatctgccgaggaagttcaagattgcagttactacggctggtgataactctgttgatattctgaccaatgacatcggtgttgttgttgtttcagatgatgcaggagagcctgttggctttaacatctatgttggtggtggcatgggaagaacacaccgagtggaaactacattccctcggctggctgatccattgggttatgttccaaaagaagatatattatatgctataaaggccattgtcgtcacacagagagaaaatggaagaagggatgaccgcaagtatagtaggatgaagtatttgattgaccgttggggaattgacaagttccgagctgaagttgagaaatactatgggaagaagtttgaaagtttccggccattgcctgagtggcagtttaacagctaccttggttggcaagaacagggtgatgggaaattattctatggagtgcatgttgataatggtcgtgttggtgggcaagcaaagaaaactctacgagagataattgagaagtataatttggatgttagtattaccccaaaccaaaatcttattttatgtgggatcgatcaggcatggagagaacccatcactaaagctcttgctgaagctggcctgctggagccaaaggatgtggaccccctgaatttaactgctatggcatgccctgccttgccgctgtgccctttggcacaaacagaagctgaacgtgggatcttaccaattcttaatcgaattagagcagttttcgataaggttggtatcaaggattcggagtctgtggttgtgaggataactggttgccctaatggatgtgctaggccatatatggcagagcttggttttgttggtgatggtccgaaaagttaccagatctggctggggggaacaccaaaccagagtaccctagcagaatcatttatggataaagtgaagctcgatgacatcgagaaagttttagaacctctgttctcctattggaatagcacacgccaggaaggtgaatcgtttggaagcttcacaaaccgaacaggattcaacaaattgaaagaggtagtggacaagtgggcagagtcaccatcagccgcataaaaggatcgctaatgtcagataaaatcccaggctcgtgcacaattttggctccgggattacagcttgccgaaaggctctccagataaacgtgacaagaggttgtcaaccccgttgacaatggaaaacaaggctcgttttggatttgttgtaagcttgttgggttgagtgatcaaaagaattttgcgtgtactttgaagaaaacctatgctgacttgaataaattcctcacaaagttgtactcaaaaaaaaaaaaaaaaaaaa

SEQ ID NO: 556 - protein, 636 aa, Panicum virgatum
  misc_feature: Ceres CLONE 1726006
  misc_feature (1)..(182): Pfam Name: NIR_SIR Pfam Description: Nitrite and sulphite reductase 4Fe-4S domain
  misc_feature (60)..(624): SWISSPROT Homolog: EC 1.8.7.1 Sulfite reductase [ferredoxin]
  misc_feature (60)..(629): SWISSPROT Homolog: EC 1.8.7.1 Sulfite reductase [ferredoxin]
MSAAVGGAEFHGFRGAAAQLPRSRMLGRPLRVAPPAAAPAGGGASSGSIRAVSAPLKKDAAEVKRSKVEIIKEKSNFLRYPLNEELVSEAPNINESAVQLIKFHGSYQQTDRDVRGQKNYSFMLRTKNPCGKVPNQLYLAMDTLADEFGIGTLRLTTRQTFQLHGVLKKNLKTVLSTVIKNMGSTLGACGDLNRNVLAPAAPYVRKDILFAQQTAENIAALLTPQSGAYYDLWVDGEKIMSAEEPPEVTKARNDNSHGTNFPDSPEPIYGTQYLPRKFKIAVTTAGDNSVDILTNDIGVVVVSDDAGEPVGFNIYVGGGMGRTHRVETTFPRLADPLGYVPKEDILYAIKAIVVTQRENGRRDDRKYSRMKYLIDRWGIDKFRAEVEKYYGKKFESFRPLPEWQFNSYLGWQEQGDGKLFYGVHVDNGRVGGQAKKTLREIIEKYNLDVSITPNQNLILCGIDQAWREPITKALAEAGLLEPKDVDPLNLTAMACPALPLCPLAQTEAERGILPILNRIRAVFDKVGIKDSESVVVRITGCPNGCARPYMAELGFVGDGPKSYQIWLGGTPNQSTLAESFMDKVKLDDIEKVLEPLFSYWNSTRQEGESFGSFTNRTGFNKLKEVVDKWAESPSAA

SEQ ID NO: 557 - DNA, 2687 bp, Panicum virgatum
  misc_feature: Ceres CLONE 1726009
  misc_feature: Encodes the peptide sequence at SEQ ID NO. 558
gctggtctataaatagaaagctaggctaacgatgtatgtacctcagccagccagcgagcaaagggtctcctcctgacctcaagtttcttggcagctcggaagaagaaagtttgcattgggagagcggagaggcagcatgtggaggctgaaggtggccgagggcggcggcccgtggctgagatccacgaacaacttcgtcgggcgctcgttttgggagttcgaccctgacctcggcacgccggaggagcgcgccgaggtggagagggtgcgtcgggagttcacggagcgccgtttcgaccggagggagcctgctgacctcctcgtgcgcatgcagcacgccaaggaaaaccaggttcaccgacgacgccatctgccgccccaagccaagctcgaagaagatgtggtgatgaccgaaggcattgtggtcgactccttgaggcgagcgctggatcagttctcttccgtgcaagcgagagacggccattggcctggcggttacagcggggtcatgttcattttgcctggcatgatatttgctatgcatgtcactggatcactcaatgctgttgtgtcgggggaacatcgccgtgagatactccgcttcatctacaaccatcagaacgaagacggtggatggggcacggatgtccggtgctcaagcaccatgtttggaacatgcacaaactacgtcaccttgaggctgcttggcaaggagccaaatgatgacaagttggctaaagggcgtgattggattttgtcccgtggtggtgcaactttaatacccgaatgggggaaaatatggctgtcggtgcttggtgtgtatgattggtctggaaacaacccaattttcccggaactatgggtcgctccaaagtttcttccatttcatccagggagactctggtgcttgtgccgtatgctttatcagccagtagctgttctttacggcaagaggtttgttggacaacttacaccaactatactagcgctaagagaagagatctataacactgcgtacgacaagattgactggaacgaagctcgcagtgcctgtgcaaaggaggacgtcctctgtccacgcggaatgttgcagaatgtgatctggacttcactatccaagggtgtggagccactgttgagtagttggcctgtcaacaagctgagggagagagctctgagcaatctcatggagcatatccattacgaagatgagaacacaaactatatctgtgtagatgctgtaagcaagcctctaaacatggtctgctgctgggtagaagatccgaattctgatgctttcaagcgtcaccttgcgaggatacctgacttcttgtggctcgaagaagatggcatgacatcactggtatatgatggctgtaacagctgggaaacttcattcataattcaagcattttgcgctactgatcttgtaaatgagtatggtgcaactgtccaaagagcccatgacttcttgaaacattcccagcttatgtggaatcatcctggtgacctaagttactggcatcgtcatataacaaagggttcatgggctcattcaactgcagacaatggatggggtgtatctgataataccggagaagcactcaaggctacactcttactatcaatgatgaagagcagcattgttggtgatccaatacagagagataggttgcatgatgctgttgatttccttctatcaattatgaacaaagatggttccttttcaacgtacgaatgtgaaagaacttattcctggttagaggttctcagcccttgtcagaattttccaaatgtgatggtcgattatccatctctagaatgcacttcctcggcgattcaaggcctggcacttttcaccaaattatatccttattaccgtaaaaaagagatcgatgattgtatttcaggagcagcaaaatttatggagggtaaacaacgagaagacggttcatggttaggtacttgggctgtatgtttcacctatgccgcgttcttttcagttaaaggattagttgatgcaggaaaaacatatgagaatagctcttccatcaggaatgcatgccacttcctattgtcaaagcagctcattactggtggatggggagaaagccatgtttctatgagaactgaggtttatgaaaatatcaaaggcaatcgtgctcatggagtgaacactgcatgggctatgctggctttactctatgctggacagatggagagagatccgacaccactacatcgtgctgcaaaagaactaatcaatatgcagttggaaacaggagagtttccccaacaagaacatgttggaagctacaactgtgctattatcttcaattaccccaactaccgcaacgcattccctatttgggctcttggagaatatcgctgtcgtcttcgtgctatgaatgagaaatgagtccaagcatataacatggtgacaaacaagtgcgtatggctatgctagaggatattatatacccagcccatcatacaaacattgtcataaataaaatccgcacggttctatatatgtataggatctgcaggagtatcagtgcatcacatatactactaaataaatgtgaagatgtaaagctaaggttgcttgatgttgtatgtttctaacccacttctttcgagaacacaaaaagcaggattatatagaaaaaaaaaaaaaaaaaaaa

SEQ ID NO: 558 - protein, 760 aa, Panicum virgatum
  misc_feature: Ceres CLONE 1726009
  misc_feature (1)..(56): Pfam Name: Prenyltrans Pfam Description: Prenyltransferase and squalene oxidase repeat
  misc_feature (1)..(754): SWISSPROT Homolog: EC 5.4.99.8 Cycloartenol synthase
MWRLKVAEGGGPWLRSTNNFVGRSFWEFDPDLGTPEERAEVERVRREFTERRFDRREPADLLVRMQHAKENQVHRRRHLPPQAKLEEDVVMTEGIVVDSLRRALDQFSSVQARDGHWPGGYSGVMFILPGMIFAMHVTGSLNAVVSGEHRREILRFIYNHQNEDGGWGTDVRCSSTMFGTCTNYVTLRLLGKEPNDDKLAKGRDWILSRGGATLIPEWGKIWLSVLGVYDWSGNNPIFPELWVAPKFLPFHPGRLWCLCRMLYQPVAVLYGKRFVGQLTPTILALREEIYNTAYDKIDWNEARSACAKEDVLCPRGMLQNVIWTSLSKGVEPLLSSWPVNKLRERALSNLMEHIHYEDENTNYICVDAVSKPLNMVCCWVEDPNSDAFKRHLARIPDFLWLEEDGMTSLVYDGCNSWETSFIIQAFCATDLVNEYGATVQRAHDFLKHSQLMWNHPGDLSYWHRHITKGSWAHSTADNGWGVSDNTGEALKATLLLSMMKSSIVGDPIQRDRLHDAVDFLLSIMNKDGSFSTYECERTYSWLEVLSPCQNFPNVMVDYPSLECTSSAIQGLALFTKLYPYYRKKEIDDCISGAAKFMEGKQREDGSWLGTWAVCFTYAAFFSVKGLVDAGKTYENSSSIRNACHFLLSKQLITGGWGESHVSMRTEVYENIKGNRAHGVNTAWAMLALLYAGQMERDPTPLHRAAKELINMQLETGEFPQQEHVGSYNCAIIFNYPNYRNAFPIWALGEYRCRLRAMNEK

SEQ ID NO: 559 - DNA, 2121 bp, Panicum virgatum
  misc_feature: Ceres CLONE 1726015
  misc_feature: Encodes the peptide sequence at SEQ ID NO. 560
gtgctaggtagccagccggagccgccgctgccgccgcgcccatggcctccgtggcggccacctccacgctggccccggccctcgccgctcgacggcgccgggagcggccagggatggggccgctgccgctgccgctgccgcagcgccgggccgcggtcgtgcggtgctcgctcgaaagcaacgtctccgacatgggcgtcaacgctcccaaaggattgttcccacctgagccggagcactacagggggcccaagctcaaggtggccatcataggtgcaggactcgcaggcatgtccactgccgttgagcttttggaccagggacatgaggttgatttgtacgagtcccggccgtttattggcggcaaggttggctcatttgtcgataggcaaggaaaccatatcgagatggggctgcacgtgttcttcgggtgttacagcaatctgttccgcctcatgaagaaggttggtgctgataataacctgctggtgaaggaacacacacacacttttgtaaacaaagggggcgcagtcggtgaacttgattttcggttcccggtgggagctccattacatggtattcaagcgttcctccgaactaaccaactgaaggtgtatgataaagcaagaaatgcagttgctcttgcgctaagcccagttgttcgggctttggttgaccccgatggtgcattgcagcaagtgcgggacttggatgatgtaagtttcagtgattggttcatgtccaaaggtggtactcgggagagcatcacaaggatgtgggatcctgttgcttatgctctgggtttcatcgactgtgataatattagtgcacgttgcatgcttacaattttcactctgtttgccacaaaaacagaggcatctttgttacgcatgctaaagggttcgcctgatgtttatttaagtggcccaataaagaagtacataacagacaggggtggtaggtttcacttaaggtggggatgcagggaggttctctatgagaaatcacctgatggagagacctacgttaaaggccttcttctctccaaggccacaagcagagagataataaaagctgatgcatatgttgcagcttgcgatgtaccggggatcaaaagactactaccgtcagaatggagggattgggaaatgtttgacaatatctacaagttggatggtgttcctgttgtcactgttcagcttcgctacaatggatgggttactgaacttcaagatttagaaaaatcaagacaactagaaaaagcggtcggtttggataacctcctgtacactccagatgcggacttttcctgtttttcggaccttgcactctcatctcctgctgattactacattgaaggacaaggttccctgatccaagctgtgctaactcctggtgatccatacatgccattgccaaatgaggagatcatcagtaaggttcaaaagcaggttgtagaattgttcccatctgcccggggattggaagtcacatggtccagtgtggtgaaaattggacaatctttgtatcgcgaggctcctggaaatgacccattcagacctgaccagaagacgcctgttaaaaacttcttcctgtctggatcttacacgaaacaggactacatcgacagcatggaaggagcaactctctctggcaggcgaaccgcagcctacatctgcggtgctggggaggagctgctggccctgcgaaagaagctagtgatcgacgacagcgagaaggcgttgggaaatgtccaagtcctgcagacaagttgagccttgccatcgcacatgctggaacagccagatcatatctttctcgattctggttgcaggcgacctcttgtaaatcctatttgagcattacatccgccgcggcttttccggtccagatctgagaaccaggtatctaggtggcatacgggattacatcaggcagtgtgtatgttaagctggaacttgattgatcattcatcgggacgattgattgctgatatatacctacagcacacactgttcttacgctttgcgagaaaacagcaagcgattatccgagggcaattgctggatgatttttatcaaggtgtggcttttacacacacaaaaaaaaaaaaaaaaaaaa

SEQ ID NO: 560 - protein, 577 aa, Panicum virgatum
  misc_feature: Ceres CLONE 1726015
  misc_feature: Great-hit functional homolog of the protein sequence given in SEQ ID NO 9757
  misc_feature (1)..(466): Pfam Name: Amino_oxidase Pfam Description: Flavin containing amine oxidoreductase
  misc_feature (2)..(384): Pfam Name: Amino_oxidase Pfam Description: Flavin containing amine oxidoreductase
  misc_feature (1)..(465): Pfam Name: Amino_oxidase Pfam Description: Flavin containing amine oxidoreductase
  misc_feature (1)..(461): Pfam Name: Amino_oxidase Pfam Description: Flavin containing amine oxidoreductase
  misc_feature (1)..(464): Pfam Name: Amino_oxidase Pfam Description: Flavin containing amine oxidoreductase
  misc_feature (1)..(577): SWISSPROT Homolog: EC 1.14.99.30 Zeta-carotene desaturase, chloroplast/chromoplast precursor
  misc_feature (36)..(569): SWISSPROT Homolog: EC 1.14.99.30 Zeta-carotene desaturase, chloroplast/chromoplast precursor
  misc_feature: Useful for making plants with modulated biomass
  misc_feature: Useful for making plants with modulated flowering time
  misc_feature: The plant flowers significantly late compared to wild-type.
  misc_feature: The plant is abnormally small.
MASVAATSTLAPALAARRRRERPGMGPLPLPLPQRRAAVVRCSLESNVSDMGVNAPKGLFPPEPEHYRGPKLKVAIIGAGLAGMSTAVELLDQGHEVDLYESRPFIGGKVGSFVDRQGNHIEMGLHVFFGCYSNLFRLMKKVGADNNLLVKEHTHTFVNKGGAVGELDFRFPVGAPLHGIQAFLRTNQLKVYDKARNAVALALSPVVRALVDPDGALQQVRDLDDVSFSDWFMSKGGTRESITRMWDPVAYALGFIDCDNISARCMLTIFTLFATKTEASLLRMLKGSPDVYLSGPIKKYITDRGGRFHLRWGCREVLYEKSPDGETYVKGLLLSKATSREIIKADAYVAACDVPGIKRLLPSEWRDWEMFDNIYKLDGVPVVTVQLRYNGWVTELQDLEKSRQLEKAVGLDNLLYTPDADFSCFSDLALSSPADYYIEGQGSLIQAVLTPGDPYMPLPNEEIISKVQKQVVELFPSARGLEVTWSSVVKIGQSLYREAPGNDPFRPDQKTPVKNFFLSGSYTKQDYIDSMEGATLSGRRTAAYICGAGEELLALRKKLVIDDSEKALGNVQVLQTS

SEQ ID NO: 561 - DNA, 1879 bp, Panicum virgatum
  misc_feature: Ceres CLONE 1726023
  misc_feature: Encodes the peptide sequence at SEQ ID NO. 562
ataaaaaagaagaaaaagcacgccgtcgcgtcgatctcgaattctcgccgccgccgcccgccccgcgcaacttcgcctcggccggacccgcgcgcgcctccatccgcgccgccccgagcgaatcgccgtccgaagctctcgtgctccctccgtctcctcaggcgacaggacgccggcgggagcagcagcagcagacgtgcggggcggtccggaggcatcagcgcttgcgcgccctgcggcgacggagggcgggactcgttctcggtgcgcggagatttaggagcggcgtccggcgcgcaggaaaaaccagtgcccgcgggaacaaccattgaataatcatgagctcgctctgccctttcgctggagctactgctggtggtggcgtatgccctgtgaaatccgataagagcagtgccggagtatgccctgcaaaatctgacaagagcataagcggtgtatgccccgtcaccggcaaggatcacggtagcgaccacaaggaaagtactggccatgctgaggataaaggcaccgatccccgtatggtgccagcaaagtgcccatttggctacgacagcaacacgttcaagctgggtccgctcagctgcattatctgccaggcactgctccatgaaagcagcaaatgcaagccgtgtgcccataagttctgcaaggcatgtgtatcacgctttaaagactgcccactgtgtggtgctaacatagaggggattgagcctgatactgagcttcaaactctcgttgatcgcttcattgatggccatgccagaatcaaacgatcacatgccgcaggggatgtggaagcagcaggtggcaataacaaagtcatatatgaggatgtttccatggaaagaggagcttttctggtgcagcaagctatgagggcttttcgtgcccagaacattgaaagtgcaaaatcgagactcactatgtgtgcagatgacatcagggaggagttgaaatcgtcagaagttaatttagatctatgttcgcagcttggagctgtgttaggaatgcttggggactgctgtcggaccttgggagatgctccttcagcaatcacttactatgaagaaagtgctgaattcctttcaaaactccccacaaaagatcttgagttggttcatactctctcggtttcactaaataaaattggtgaccttcgctactatgatggggacctccaatctgcaagaaactattatgcccgttcattggatgttcgcagaaatgcagtagaagaacattcaacagtagcttcccaggtcatagatctagcaacttctcttgcaaaagttgcggatgttgatagaaatcttgggaacgaaagtgctgccgttgagggttttgaggaagcgattcagtgccttgagaagttgaagctggattctaaacaagctaatcttgagcaacggcgcttctcggttcttgacttcctgcacaaccagttggcagataagtaagactttgtcatcctaagaatacaccaactacagatgtgtcttctcctggtgtgcaactccactatttttttcttgttgcctacggaaagagttgtactagaaatggcaattagcgcattttattgccacatgaaagtttgccgtggcacaaaataagtactcaagcactgtaaatttatcatatgtattctcagcgaggagagtgctcttgatggctgcgaatatgctccagcagcctatatccctggttagtggtttgtccttgtcatagcctaggacagcgcgtaagatgtaacttgtgggaagttccatctcgccttaacgtgtcatgcctgaacgctaatcccgttgtgtattgacaataagacagggcggtactacaaaaaaaaaaaaaaaaaaaa

SEQ ID NO: 562 - protein, 379 aa, Panicum virgatum
  misc_feature: Ceres CLONE 1726023
  misc_feature (1)..(35): Pfam Name: zf-C3HC4 Pfam Description: Zinc finger, C3HC4 type (RING finger)
MSSLCPFAGATAGGGVCPVKSDKSSAGVCPAKSDKSISGVCPVTGKDHGSDHKESTGHAEDKGTDPRMVPAKCPFGYDSNTFKLGPLSCIICQALLHESSKCKPCAHKFCKACVSRFKDCPLCGANIEGIEPDTELQTLVDRFIDGHARIKRSHAAGDVEAAGGNNKVIYEDVSMERGAFLVQQAMRAFRAQNIESAKSRLTMCADDIREELKSSEVNLDLCSQLGAVLGMLGDCCRTLGDAPSAITYYEESAEFLSKLPTKDLELVHTLSVSLNKIGDLRYYDGDLQSARNYYARSLDVRRNAVEEHSTVASQVIDLATSLAKVADVDRNLGNESAAVEGFEEAIQCLEKLKLDSKQANLEQRRFSVLDFLHNQLADK

SEQ ID NO: 563 - DNA, 1998 bp, Panicum virgatum
  misc_feature: Ceres CLONE 1726033
  misc_feature: Encodes the peptide sequence at SEQ ID NO. 564
gcctagttctttcgtgatttagggcttagttgccggtgatgcggattttatggatgcggcgtttagtggccctgattcgatgggtggattttgcgctaggtctgattgctctcgatttgggggcggggatttcctggcgatttagaatgggtcgggggaacgaacggggtcgtggtttgaatgctaatctgatctgttggcgcgggtcggtgatatcggggggggaagaatttgggtttgcttcagagaggaggttggaatctcctcggaagggttaacgatttctgtcctgggcgagcggtcgtgatgaaattcgattggctcccgttggtaatttacatgttcttctagagtttggcgtgaagcttcaaactaatctcgtgggtattcgatttttacccctttgagttattgtgggtgtcttttctagggaattactttacctgacttgtgtttaggataatagaatctctattctgaaatcgtcaggttgtgcatcaagaagagtttctagggaattactttacctggctcgttgtcagaaataaaattttagatttttggggagtttctggtcatggtatatctatcttatcataactatttgttcaatctttctttctgctatacttactggcttgcagcttgattctacttaaggccatgagaattttacccctcccctaaacatgaactcttttggtggcttacacggtgccaagtagaaaaatggaatgctgtttgtagctgtatgtaatagtttcttacttgtttgttgtactagaattattattctcagtcatttttatgaattttattggtagccattttgttgatcatgttatctttgggaattacagtttaatttattccgaatatcatcaagatgtcaaccaatgtcggtgaatcagcaagtgctggcagcagcagcgacgcggctggggggagttttgagtgcaatatatgctttgagctgcctcaggagccaatagtgaccctctgtggccatctcttctgctggccatgcctttaccgctggttgcatgtccatgcacactcaccagagtgcccagtgtgcaaggcccttgtcgaggaagacaagcttgttcccctttatggacgtggcaaggaccgtgttgacccaagatcaaagaacatgcctgaatctgacattcctcaccgcccgactggccagaggcctgccacagctccacaggctgatgctaacaacaacttccccaatgccaatgcaaacccatggttcatgggcacaggagtcccattggcgaatgcaaggtgggggaattatgcattttcagctgcttttggaggcctgttccctatgcttagcttccaagtccatggattccccgatgccgctgcttatgcgcagccagctgggttccactatgggtacggccatgggcatggattccatggtgggcatatgggacacgctcacggcgtccaccggcaagcacctttggggcaacagcagcaggcagatatctacctgaaggccctgcttctcatggttggagttctagtgattgcgagcctcattgcattttaaagctgttgaacctggaggccctgcatggttggaattctcgggggtgcaatgcaaggctcctggcatttctgatgctgtgatggcagattggcttaagaattgtcttatttcagtgttggttctgtattatagcttggtgctgaatgttgcatgagttattcttgtatttgcatgaagtgtccatagaatatgtatttatagctccaggcaagtatctgccttttacagcaccttatatagtattaggaggaacctggtgcaattattgctgtttagttttgatgatttttggaggtgaacgtgatgtacaattgttgggtagccatctcccacctgcatctgttgtctgtaccatttagattggaaatggatagcatgagactgaatatatgagaatttggaattaaaaaaaaaaaaaaaaaaaa

SEQ ID NO: 564 - protein, 228 aa, Panicum virgatum
  misc_feature: Ceres CLONE 1726033
  misc_feature (1)..(41): Pfam Name: zf-C3HC4 Pfam Description: Zinc finger, C3HC4 type (RING finger)
MSTNVGESASAGSSSDAAGGSFECNICFELPQEPIVTLCGHLFCWPCLYRWLHVHAHSPECPVCKALVEEDKLVPLYGRGKDRVDPRSKNMPESDIPHRPTGQRPATAPQADANNNFPNANANPWFMGTGVPLANARWGNYAFSAAFGGLFPMLSFQVHGFPDAAAYAQPAGFHYGYGHGHGFHGGHMGHAHGVHRQAPLGQQQQADIYLKALLLMVGVLVIASLIAF

SEQ ID NO: 565 - DNA, 1876 bp, Panicum virgatum
  misc_feature: Ceres CLONE 1726036
  misc_feature: Encodes the peptide sequence at SEQ ID NO. 566
aggtgcgcaactgctgtggtgtggtggtggcctccctcctctgcatccgcggcgcgattcacaccccaccggcgatccttccccatccccggcgcaggtcaaacgaggcgcccagatggcgctcacaagaatcggtcttgctggccttgctgtcatggggcagaaccttgccctcaacattgcagagaaaggcttccccatctccgtctacaacaggacggcctccaaggttgatgagaccgtgcagcgtgccaaggcagaaggaaaccttcccctttacggtttccatgaccctgcatcttttgtcaactccattcagaagccacgtgttgtcatcatgcttgtcaaggctggtgcgccagttgaccagaccattgcaacacttgcagctcacttggagcagggtgactgtatcattgatggaggaaatgagtggtacgagaacacagacaggagggagaaggccatggaggagcgtggcctcctctatcttggcatgggtgtatctggaggagaggagggtgcccgcaacggcccttccttgatgcctggaggctcatttgaggcgtacaagtacatcgaggatattcttctcaaggtggctgctcaggtccctgacaatggcccgtgtgtcacatatattggcaaaggtggatctggcaactttgtcaagatggttcacaatgggattgaatacggtgatatgcagctgattgctgaggcatacgatgtcctcaagtcggttggcaagctcaccaacagtgagctgcagcaggtgttctctgaatggaacaagggagagctcctcagtttcttgattgagatcactgcggacatatttggcatcaaggacgaccagggtgatggctacttggtcgacaaagtcctggacaagactgggatgaaaggaactgggaaatggacagtgcagcaggctgctgaactctctgtggctgctcctacaatcgaggcatccttggactccaggttcctgagcggtctgaaggacgagcgtgtcgaggcttccaaaatcttccaaggtgactactccactggcctaccagtggacaaggcacagctgatcgaagatgtgaggcaagccctctacgcttccaagatctgcagctacgcgcagggcatgaacatcatcaaggccaagagctcggagaaaggatggggccttaaccttggcgagctggcgaggatctggaagggagggtgcatcatccgcgccatcttcctcgaccgcatcaagaaggcctacgacaggaaccccaacctcgccaacctcctcgtggacccagagttcgcccaggagatcatggacaggcaagcggcgtggcgcagggtcatctgcctcgccatcaacaacggcgtcagcaccccgggcatgtctgctagcctggcctacttcgactcatacaggagggacaggcttcctgccaacctggtgcaggcgcagagggactacttcggagctcacacctacgagagggtcgacatgccaggttctttccacaccgagtggttcaagaccgcgcgcagcaactcccagaactgagctgctccagaggtggcacgccaacgccatggcacgatgttgacatggttctcgtattttatcatcgttattgctgcgcggtgttgagtaatcggtaatgtaggggagggaggtgttgtggttaaatttgatttttcaggcgcggtgcttaatttgagtcaggaagttgtagttgtcttccatgctttccgttgtaagaagtctgggatggagaacaatggtacttcttggaacttctatgtttgtaagtttgttctatgaataagagcattttgacatgctttggctgttaacaaaaaaaaaaaaaaaaaaaaa

SEQ ID NO: 566 - protein, 481 aa, Panicum virgatum
  misc_feature: Ceres CLONE 1726036
  misc_feature (1)..(295): Pfam Name: 6PGD Pfam Description: 6-phosphogluconate dehydrogenase, C-terminal domain
  misc_feature (1)..(283): Pfam Name: 6PGD Pfam Description: 6-phosphogluconate dehydrogenase, C-terminal domain
  misc_feature (1)..(291): Pfam Name: 6PGD Pfam Description: 6-phosphogluconate dehydrogenase, C-terminal domain
  misc_feature (1)..(292): Pfam Name: 6PGD Pfam Description: 6-phosphogluconate dehydrogenase, C-terminal domain
  misc_feature (1)..(176): Pfam Name: NAD_binding_2 Pfam Description: NAD binding domain of 6- phosphogluconate dehydrogenase
  misc_feature (1)..(471): SWISSPROT Homolog: EC 1.1.1.44 6-phosphogluconate dehydrogenase, decarboxylating
  misc_feature (1)..(472): SWISSPROT Homolog: EC 1.1.1.44 6-phosphogluconate dehydrogenase, decarboxylating
MALTRIGLAGLAVMGQNLALNIAEKGFPISVYNRTASKVDETVQRAKAEGNLPLYGFHDPASFVNSIQKPRVVIMLVKAGAPVDQTIATLAAHLEQGDCIIDGGNEWYENTDRREKAMEERGLLYLGMGVSGGEEGARNGPSLMPGGSFEAYKYIEDILLKVAAQVPDNGPCVTYIGKGGSGNFVKMVHNGIEYGDMQLIAEAYDVLKSVGKLTNSELQQVFSEWNKGELLSFLIEITADIFGIKDDQGDGYLVDKVLDKTGMKGTGKWTVQQAAELSVAAPTIEASLDSRFLSGLKDERVEASKIFQGDYSTGLPVDKAQLIEDVRQALYASKICSYAQGMNIIKAKSSEKGWGLNLGELARIWKGGCIIRAIFLDRIKKAYDRNPNLANLLVDPEFAQEIMDRQAAWRRVICLAINNGVSTPGMSASLAYFDSYRRDRLPANLVQAQRDYFGAHTYERVDMPGSFHTEWFKTARSNSQN

SEQ ID NO: 567 - DNA, 2694 bp, Panicum virgatum
  misc_feature: Ceres CLONE 1726040
  misc_feature: Encodes the peptide sequence at SEQ ID NO. 568
gccccccgatctcttctcttctcttcccttccgcatccgccggccgctccgggcccctcccccgccggaaagatcccggctttcttgggttcccggcgagggtcaggctccaagaagcaggagtgcctcccggcggcggccccgcggtcgatgcgatcggtcgacgcggagggagcggagaggtcgtcggatcagcacaaccgcaagaagccgcgcctggagaccggggccgggatgccgcttgcggacgccctggcgcccggcggcagcggcgtggaggcggcggcgggcgccgacttctccggcatggcggtggaggagatcgtgcagcacccgctgccgggctacggggcgcccgtggcgctcagcttctgccccgacgaccgccgggtggcctacctctacagccccgacggcacgctccaccgcaaggtgtacaccttcgacaccgcgcagcgccgccaggagctgctcttcggcccccccgacggcggcgggctcgaggaggggaacctctccgccgaggagcggatgcggcgcgagcgcgcgcgggagcgcggcctaggggtcacgcgctacgagtggcgcgcccgccactctgggggccactcttctcgcgctggcattgtcgtgccgctgccgtccggggtttacttccaggatttgtctggctcggaaccagtcctgaagctgcgaagttctcccacatccccaataattgaccctcttctatctccaaatggaagcatgattgcgtatgttaaggatgatgagctgcatattttgggtttctctaatggagaaattaagcaattaactttcggtgcaagagaaagtaggaagatccatggacttgccgagtatattgcacaggaagagatggaaaggaagacggggttctggtggtctcctgacagcaaacaccttgcatttactgaagtggattcaactgagattccactgtatagaattatgcatcagggtaaaagttacgttggtccagatgctcaagaagaccatgcgtacccctttgcaggtgcagctaatgttaaagtgcgacttggtgttgttccttccaatggaggagaagtaacttggatggatctgctttgtggacatccacatggttcccacagtgatgaagaatatctggctagagtcaactggatgcacaataatgctgttgctgttcaagttcttaacagatctcacacaaaacttaaattgcttaagtttgatattactacgggtaaaagggaagtcttactagaagaacaacatgatacatgggtcacattgcatgattgtttcaccccgctagacaaaggagtgaatagtaaacatccaggtggttttatttgggccagtgaaaagacaggattcaggcacttgtatgttcatgacaagaatggtgtgtgcttaggacccctcacacaaggtgagtggatggttgaacaaattgctgctgtgaatgagagtaatgggcttatatatttctgtggcacactggatggaccattggagacaaatttgtaccaaaccaatctctttccagattggaaccttcccttgcaacccccgaaaaggttgactcatggaaccggccggcattcagtaattcttgatcatcagttgctgagatttattgatgtatatgactcaataaaatctccacctgtgatcttactgtgctctttacttgatggaagtgtaattatacccctgtttgagcagccatcgacagtcccatcacttaaaaagttccagcagctgtctccggagatagttgaaattacagcgaaggatgggaccactttatatggcactctctaccttcctgacgagagaaaatatgggccacctccctacaaaacattggttagtgtttatggtggccctggcgttcagcttgttagtgacacatggatgagtacagttgacatgagagctcaatacctacgaagtaagggtatattagtttggaagatggataatcgtggatctgcaaggagaggactacattttgagggacaactaaagtacaacatcggccgtgttgatgctgaagatcaattagaaggggccgagtggttaataatgaaaggccttgcaaaacctgggcatattggtatttatggctggagctatggcgggtttctgtcagcaatgtgcctcgcaaggtttccggatacattctgttgtgcggtgtctggtgctccagtgacggcatgggatggttacgataccttttatactgagaagttcatgggtctcccctccgagcatcctgatgcttacgagtatgggtcgatcatgcatcacacaaagaacctgaaagggaaactgctcctcgtccatgggatgatcgatgagaacgtgcattttaggcacacagcgaggctcatcaactcgctgatggcagagcgcaagccttatgagatcctcctcttccctgacgagaggcacatgccacgccggcttggtgaccggatctacatggaggagaggatctgtgattttgtagagaggagcctttgaaaggacgcttgtataaattcaattgcccattgtgggctgggattgggatgtttttggcacatgcattcgagttcttttttcattcccacctgtaatttatccacaagcgcagttattttgattcttttatctgctcaaaaaaaaaaaaaaaaaaaa

SEQ ID NO: 568 - protein, 795 aa, Panicum virgatum
  misc_feature: Ceres CLONE 1726040
  misc_feature: Great-hit functional homolog of the protein sequence given in SEQ ID NO 9708
  misc_feature (1)..(202): Pfam Name: Peptidase_S9 Pfam Description: Prolyl oligopeptidase family
  misc_feature (1)..(310): Pfam Name: DPPIV_N Pfam Description: Dipeptidyl peptidase IV (DPP IV) N- terminal region
  misc_feature: Useful for making plants with modulated salt sensitivity
MRSVDAEGAERSSDQHNRKKPRLETGAGMPLADALAPGGSGVEAAAGADFSGMAVEEIVQHPLPGYGAPVALSFCPDDRRVAYLYSPDGTLHRKVYTFDTAQRRQELLFGPPDGGGLEEGNLSAEERMRRERARERGLGVTRYEWRARHSGGHSSRAGIVVPLPSGVYFQDLSGSEPVLKLRSSPTSPIIDPLLSPNGSMIAYVKDDELHILGFSNGEIKQLTFGARESRKIHGLAEYIAQEEMERKTGFWWSPDSKHLAFTEVDSTEIPLYRIMHQGKSYVGPDAQEDHAYPFAGAANVKVRLGVVPSNGGEVTWMDLLCGHPHGSHSDEEYLARVNWMHNNAVAVQVLNRSHTKLKLLKFDITTGKREVLLEEQHDTWVTLHDCFTPLDKGVNSKHPGGFIWASEKTGFRHLYVHDKNGVCLGPLTQGEWMVEQIAAVNESNGLIYFCGTLDGPLETNLYQTNLFPDWNLPLQPPKRLTHGTGRHSVILDHQLLRFIDVYDSIKSPPVILLCSLLDGSVIIPLFEQPSTVPSLKKFQQLSPEIVEITAKDGTTLYGTLYLPDERKYGPPPYKTLVSVYGGPGVQLVSDTWMSTVDMRAQYLRSKGILVWKMDNRGSARRGLHFEGQLKYNIGRVDAEDQLEGAEWLIMKGLAKPGHIGIYGWSYGGFLSAMCLARFPDTFCCAVSGAPVTAWDGYDTFYTEKFMGLPSEHPDAYEYGSIMHHTKNLKGKLLLVHGMIDENVHFRHTARLINSLMAERKPYEILLFPDERHMPRRLGDRIYMEERICDFVERSL

SEQ ID NO: 569 - DNA, 2072 bp, Panicum virgatum
  misc_feature: Ceres CLONE 1726057
  misc_feature: Encodes the peptide sequence at SEQ ID NO. 570
acttcatccatctcatcacctcctcgtcctcctccctccttctcccccgtgctcccagctctcagcagctcgtctccctgctctccaacctccaccaacaaggccgagaagcactctcaaaaaaaaaaaaaacaaggccgagaagcgcgcggagcggaaggcgtagcgagaccaagggccgggctggcggcaatggcgcggtgcctggcgttcatgctgctcgtcctcatctcctccctcatctcgaccgtggggctgcccgtcgagccgcccgcggagctcctgcagctcggcgacgtcgcgggcggcggccgcctcagcgtcgacgcgtccgacgtccgcgaggcgtcgcgggacttcgggggcctcgcccgcgccgagccggtggcggtgttccagccccgcggcgccggcgatgtggcggccctggtccgcgccgcgtacgggtcggcgcgcgggttccgcgtctcggcgcgcggccacggccactccatcagcgggcaggcgcaggcgcccggcggggtggtggtggacatgagccacggccccggcgccgcagcacgggccggggcgcgggcattgcccgcctactcgtcggcgctgggcgggcactacgtggacgtgtggggcggcgagctgtgggtggacgtgctcaactggacgctctcccacggcgggctcgcgccgcggtcctggacggactacctctacctgtccgtgggcggcaccctctccaacgccggcatcagcgggcaggccttccaccacgggccccagatcagcaatgtctacgagctcgacgtcgtcacggggaagggtgaggtggtgacctgctcggaggcgcagaacccggacctcttcttcggcgcgctcggcggcctcggccagttcggcatcatcacgcgcgcgcgcatcgccctcgagcgtgctccccaaagggttcggtggatccgggcgctctactccaacttcgccgagttcacggcggaccagcagcgcctcatctccctcggcgccggcggccgccggttcgactacgtggagggcttcgtcgtcgccgccgggggcctcatcaacaactggcgctcctccttcttctcgccgcagaacccggtgaagctcagctccctcaagcaccactccggcgtgctctactgcctcgaggtcaccaagaactacgacgaagacgacgccgagtccgtcgaccaggacgtggacgcgctgctgggcgagctcaacttcctgccgggcacggtgttcacgacggacctgccgtacgtggacttcctggaccgcgtgcacaaggcggagctgaagctgcgcgccaagggcatgtgggaggtcccgcacccgtggctcaacctcttcgtgccggcgtcccgcatcgccgacttcgaccgcggcgtcttccgtggcatcctcggcggccgcaccgccggcgccggcgggcccatcctcatctaccccatgaacaagcacaagtgggacccgcggagcgcggtggtgacccctgacgaggaggtgttctacctggtggcgttcctgcggtcggcggtgccgggcgcgccggagagcctggaggcgctgtcccggcagaaccagcggatcctcgacttctgcgcggaggccggcatcggcgccaagcagtacctgcccaaccacaaggcgcggcacgagtgggcggagcacttcggcggcgcgcggtgggagcgcttcgcgcggctcaaggccgagttcgacccccgggccatcctggccgccgggcagggcatcttcccgccgcccggctcgccgccggcgctcgtctccgactcgtaggctcgtcgtggtggtggtggtcgtcgtcgtcgagctgctactgattgttttgttaggcgcgtgtaggtagttacagtatacgaggaagattatttagttggttgattatagttagcgctccctggttgatcatcgatgtacaaaagtggggtggttcgtcacgtagtggtgtggcatagcagttgtgattggttctctgtatagggcaggtgagagtaaatgtcaatgtggcaaagtgaaatttttttggcggt

SEQ ID NO: 570 - protein, 541 aa, Panicum virgatum
  misc_feature: Ceres CLONE 1726057
  misc_feature (1)..(282): Pfam Name: Cytokin-bind Pfam Description: Cytokinin dehydrogenase 1, FAD and cytokinin binding
  misc_feature (22)..(528): SWISSPROT Homolog: EC 1.5.99.12 Cytokinin dehydrogenase 1 precursor
  misc_feature (6)..(541): SWISSPROT Homolog: EC 1.5.99.12 Cytokinin dehydrogenase 5 precursor
MARCLAFMLLVLISSLISTVGLPVEPPAELLQLGDVAGGGRLSVDASDVREASRDFGGLARAEPVAVFQPRGAGDVAALVRAAYGSARGFRVSARGHGHSISGQAQAPGGVVVDMSHGPGAAARAGARALPAYSSALGGHYVDVWGGELWVDVLNWTLSHGGLAPRSWTDYLYLSVGGTLSNAGISGQAFHHGPQISNVYELDVVTGKGEVVTCSEAQNPDLFFGALGGLGQFGIITRARIALERAPQRVRWIRALYSNFAEFTADQQRLISLGAGGRRFDYVEGFVVAAGGLINNWRSSFFSPQNPVKLSSLKHHSGVLYCLEVTKNYDEDDAESVDQDVDALLGELNFLPGTVFTTDLPYVDFLDRVHKAELKLRAKGMWEVPHPWLNLFVPASRIADFDRGVFRGILGGRTAGAGGPILIYPMNKHKWDPRSAVVTPDEEVFYLVAFLRSAVPGAPESLEALSRQNQRILDFCAEAGIGAKQYLPNHKARHEWAEHFGGARWERFARLKAEFDPRAILAAGQGIFPPPGSPPALVSDS

SEQ ID NO: 571 - DNA, 2097 bp, Panicum virgatum
  misc_feature: Ceres CLONE 1726064
  misc_feature: Encodes the peptide sequence at SEQ ID NO. 572
aacccacggccgcaccaaccccgtctctaatcatccccccaaccaaaccaaaaccaaaacccaaacaagtcttctcctcccgatccccgacgtcgccggaggcttcgccggagcagcgtcgacggttgcctaatcaaaaggagcatggcctcgcttgcaagtccatcttcctcagtcgccgccgccctcacccgtcaaccgacgcggttcttgaaagggtgcagtgtctccaaggagacaaagggctcggtttgcaacctcttcactccaaattcaaataatgccaaagtaaaatcagtgggctcgagaatatcatcatccttgaaaagggatggtggctatccagccgctggtgcctctgggaatggcgacgtgctattggcaagaagtacttccgtacgtggccaggaccattcggttgctgaccctgtactctcgacggattccatggttgcgccagaaatcctctctgctaatctggcacgtgttgtggacaagtttgcagatgaagacacagacactgaacttgatttggatagcccgacagagggctttgcatctattgcagatgccattgaggacatacggcaaggaaaacttgtgattgttgttgatgacgagtcaagggaaaatgaaggagaccttataatggctgcttccttggttacctcagaggctatggcttttatagtaaggcatgggactggaattgtgtgtgtcagcatgaaagaagaagatctggaaagactggaccttccattgatggttactgcgaaagaaaatgaggagaagctatgcactgctttcactgtcacagtggatgcgaaagagggcacaacaactggggtatctgccaaggacagggcaaaaacagtcatgactcttgcatctcctgactcaaagcctgaggatttcaatcgccccggtcatattttccctttgaaatacagagaaggaggtgttctgaaacgagctggacacaccgaggcttctgttgaccttgccatgctggctggattacctcctgttgctgtcctttgtgagattgtggacgatgtagatggctccatggctcgcctaccaaaactacgtgtgtttgctgaaagggagaatttgaagattatatctattgctgacttgattagatataggaggaaaagagacaggctaattgaacgtgcttctgttgcacgtttgcctttgagatggggcaatgtccgtgcctattgctacagatctgtcattgatggaattgaacatattgcaatggtgaaaggtgagattggtgatggtcaagatattttggtgagggttcactccgagtgcctgactggagacatttttggatctgcaaggtgtgattgtggtgaccagcttgccatgtcaatggaaatgattgagaaggctggaagaggtgtattagtttaccttcgtggtcatgaaggaaggggtattggtctgggtcacaagctccgtgcttacaacttgcaagatgacgggcgtgacactgtggaagctaatgaagagctagggcttcctgttgattcacgggaatacgggattggtgcacagatattacgggatctaggagtccgttcaatgaagttgatgaccaataaccctgcaaagtatagcggcctcaagggttacggattaagcattgcgggcagggtgcccttgctgacgccaataaccagtgagaataggaggtacatggagaccaaaagaacaaagatggggcatgtgtatggacaggctaaccaagcaagtgacagcaacagcgcaggagagaagcactaataagccaacaaccaacaaggcatgccaccagcccaccattggcattccagtcggtgatatggtgatgccatattcttctctggtggagtttgccaaatgagctctttccagatattccagtagattgatttgttcttcaattgtaacagtaggttcaaagatgggtaataataagaatggcccccttcttcattttctgccccatgtttgttattcgctactgccatcatattatcactgtaaatacatggtaacaacctccacacagtacataatcaaaaaaaaaaaaaaaaaaaa

SEQ ID NO: 572 - protein, 551 aa, Panicum virgatum
  misc_feature: Ceres CLONE 1726064
  misc_feature (1)..(199): Pfam Name: DHBP_synthase Pfam Description: 3,4-dihydroxy-2-butanone 4-phosphate synthase
  misc_feature (1)..(170): Pfam Name: GTP_cyclohydro2 Pfam Description: GTP cyclohydrolase II
  misc_feature (137)..(535): SWISSPROT Homolog: EC 3.5.4.25 Riboflavin biosynthesis protein ribAB [ Includes: GTP cyclohydrolase-2
  misc_feature (3)..(536): SWISSPROT Homolog: EC 3.5.4.25 Riboflavin biosynthesis protein ribAB, chloroplast precursor [Includes: GTP cyclohydrolase-2
MASLASPSSSVAAALTRQPTRFLKGCSVSKETKGSVCNLFTPNSNNAKVKSVGSRISSSLKRDGGYPAAGASGNGDVLLARSTSVRGQDHSVADPVLSTDSMVAPEILSANLARVVDKFADEDTDTELDLDSPTEGFASIADAIEDIRQGKLVIVVDDESRENEGDLIMAASLVTSEAMAFIVRHGTGIVCVSMKEEDLERLDLPLMVTAKENEEKLCTAFTVTVDAKEGTTTGVSAKDRAKTVMTLASPDSKPEDFNRPGHIFPLKYREGGVLKRAGHTEASVDLAMLAGLPPVAVLCEIVDDVDGSMARLPKLRVFAERENLKIISIADLIRYRRKRDRLIERASVARLPLRWGNVRAYCYRSVIDGIEHIAMVKGEIGDGQDILVRVHSECLTGDIFGSARCDCGDQLAMSMEMIEKAGRGVLVYLRGHEGRGIGLGHKLRAYNLQDDGRDTVEANEELGLPVDSREYGIGAQILRDLGVRSMKLMTNNPAKYSGLKGYGLSIAGRVPLLTPITSENRRYMETKRTKMGHVYGQANQASDSNSAGEKH

SEQ ID NO: 573 - DNA, 1798 bp, Panicum virgatum
  misc_feature: Ceres CLONE 1726068
  misc_feature: Encodes the peptide sequence at SEQ ID NO. 574
gagcggcgggggcgcccctcttggctcggctgccgctgcgttcacactgaggaatcagattcggaaggaagacgctagcgcaatccaatccagggggaggagaatggcggcggccgtggcgtcgctgtaccggcgggtcctcccgtcgccgccggcggtggacttcgcctcgccggagggcaagcgcctcttcgcggaggccctggcggcgggcaccatggagggcttctttcccctggtctcctgcttccagacgcagtcggagccggccttctgcggcctcgcctccctcgccgtcgtcctcaacgcgctcgccatcgaccccggccgccgctggaaggggccctggcggtggttcgacgagtccatgctcgactgctgcgagcccctcgacaaggtcaaggccgagggcatcaccttcggcaaggtcgcctgcctcgcgcgctgctccggcgccgacgtccagtccttccgcgccagccgggtcaccatcgacgacctacgacggaatctcctccgatgcgtcgtctcccaggactgccatctcatcgcctcctaccacaggcagcctttcagacagactggaactgggcatttctccccaatcggtggctaccatgccggacaggatatggctctcatcttggatgtcgctcgcttcaaataccctccccattgggttcccgtggaacttctttgggctgccatgaatacgactgatgactcaactggacttcttagggggttcatgcttatatcaagaaagacagcagccccttcatcattgtacacagtgagttgcagggacgagaactggaaaagtatagcaaagtattgtgctgaagatttaccaaatcttttgaagggggagaatctagataatgttccaacacttttgtcccatttaattgagtctcttccagctgatgctgaagctttgatcaaatgggttgttgaagttaggagaaaggaggaaggggaaccaagcttaagcaaagaggagaaagaaaggcttttcttgaaggaaaatgttctacaacaagttcgtgataccagactatttgccatagtctacgaccaacaatatgctaataactcatgttgtaattgctcatcatctagcgaagaagattcccttactaggattgcagctgctgtatgctgtcaaggagctgcgatgctatcaggaaaccttgcatcaagaaatggtttctgctgcaaagaaacatgtttaaaatgtgtccaagagaatggtgatggccttaagactgttatctcagcctctgtggtatctgaaggcaatgaacagggtgttgatatgcttttaccaatgtcttcgcctggttccagtttgtgcaattcaaacttgaagaaggatgccgtgaaatatccttcaagtgcagatgttctgactgttcttctgctggctttacatcccaacacatggttgggcatcaaagatgagaagcttaaagctgaacttcagactcttgtttcaatagataatctacctgatgatcttaaacgagagataatgcatctaaggcggcaattttattatctgaaggcttgtaaagaaaaggaggaagatgatggtgatgatccaccatcacctaagtatcaatgctaaagcaggaacgtgcccacggcataaatttattttccagaaattcatgtcaagagaaaagttgtgagagagtggttcttgactatagtgagcactgagcagaattatggtaggaatgatgatatatatcttaatccctccgtttttatttaaaaaaaaaaaaaaaaaaaa

SEQ ID NO: 574 - protein, 508 aa, Panicum virgatum
  misc_feature: Ceres CLONE 1726068
  misc_feature (1)..(133): Pfam Name: Phytochelatin Pfam Description: Phytochelatin synthase
MAAAVASLYRRVLPSPPAVDFASPEGKRLFAEALAAGTMEGFFPLVSCFQTQSEPAFCGLASLAVVLNALAIDPGRRWKGPWRWFDESMLDCCEPLDKVKAEGITFGKVACLARCSGADVQSFRASRVTIDDLRRNLLRCVVSQDCHLIASYHRQPFRQTGTGHFSPIGGYHAGQDMALILDVARFKYPPHWVPVELLWAAMNTTDDSTGLLRGFMLISRKTAAPSSLYTVSCRDENWKSIAKYCAEDLPNLLKGENLDNVPTLLSHLIESLPADAEALIKWVVEVRRKEEGEPSLSKEEKERLFLKENVLQQVRDTRLFAIVYDQQYANNSCCNCSSSSEEDSLTRIAAAVCCQGAAMLSGNLASRNGFCCKETCLKCVQENGDGLKTVISASVVSEGNEQGVDMLLPMSSPGSSLCNSNLKKDAVKYPSSADVLTVLLLALHPNTWLGIKDEKLKAELQTLVSIDNLPDDLKREIMHLRRQFYYLKACKEKEEDDGDDPPSPKYQC

SEQ ID NO: 575 - DNA, 1273 bp, Panicum virgatum
  misc_feature: Ceres CLONE 1726087
  misc_feature: Encodes the peptide sequence at SEQ ID NO. 576
aagacgagccacccaaattcgtatcagcgcgcacggaacggagctccatcaccaattcaccaccatacccgccatggcggccggtgattccagcagacgagggacggcaaccgcggccgtcacggtgccagcggtggcgctgagctccgggaagccgatgccgcgggtgggcttcggcacggcgacggcgacgctcggccaggccgagggccacgccgtcgtgacggaggccgtcctccgcgccatcgacgccggataccgccacttcgacaccgccgcggtgtacaacacggaggccgcgctcggggacgccatcgccgaggccatccgcgcggggaccatcgcctcccgcgacgaggtctacgtcacctccaagctctggatcgccgacgcgcaccccggccgcgtccttccggcgctccagaagacactagagaatctgcggatggagtacgtggacctgtacctgattcaccacccggtgagcctgcgcccgccggagggtgatgaagcagcctcggcggcgttggtggtgaagaagaacctggtggcgatggacatgaagggggtgtgggaggagatggaggagtgccaccggcgagggctggccagggccatcggcgtcagcaacttcgcctgcaagaagctcgagcacctgctctccttcgcgaggatccctccggcagctaaccaggtggaggtccacccgtactgccgccagaacaagctgagggagttgtgcagggagaaggggatccagctctgcgccttctcccccctgggcgccaacggcacgccatgggccaacacttccgtcatggacagccctgtcctcaagcagatcgcccaggacaggggcaaaaccgtcgcccaggtgtgcattaggtgggtgtacgagcagggagactgcgtgatcaccaagagcttcaacgagagtaggatgcgagagaacctcgacatcttcggctgggagctcaccgacgccgaccaccggaagatcagtgaactcccggaatccaggggaaactacaatttcttggtgcatgaatccgggccgtacaaaacagtggaggagttgtgggacggcgagatcacttccggccactgcatcccaacggcgcttgtttcatctgattgattaactagtacagatgcacgcgccacaggcacgtgtttaaaaaacaaaattattcaaaaataattggattatatcaaatgaattactaaaattatcataaataaatttggttgcgaaaaaaaaaaaaaaaaaaaa

SEQ ID NO: 576 - protein, 354 aa, Panicum virgatum
  misc_feature: Ceres CLONE 1726087
  misc_feature (1)..(288): Pfam Name: Aldo_ket_red Pfam Description: Aldo/keto reductase family
MAAGDSSRRGTATAAVTVPAVALSSGKPMPRVGFGTATATLGQAEGHAVVTEAVLRAIDAGYRHFDTAAVYNTEAALGDAIAEAIRAGTIASRDEVYVTSKLWIADAHPGRVLPALQKTLENLRMEYVDLYLIHHPVSLRPPEGDEAASAALVVKKNLVAMDMKGVWEEMEECHRRGLARAIGVSNFACKKLEHLLSFARIPPAANQVEVHPYCRQNKLRELCREKGIQLCAFSPLGANGTPWANTSVMDSPVLKQIAQDRGKTVAQVCIRWVYEQGDCVITKSFNESRMRENLDIFGWELTDADHRKISELPESRGNYNFLVHESGPYKTVEELWDGEITSGHCIPTALVSSD

SEQ ID NO: 577 - DNA, 2624 bp, Panicum virgatum
  misc_feature: Ceres CLONE 1726105
  misc_feature: Encodes the peptide sequence at SEQ ID NO. 578
agtcactgggctcaacaaaccgcactgcgccgccggcccggccgcgatcaaagcaaatcccgtcgcaacgcaacgcaacgcaactgcctcctcgaactcggcaagcattcggagcaattcggtcgcctgcagtgcgatgatcagcggagaggtcgcgggcgccgggaaccccaggaggaggcggccatgaaggcgcagccgctgctgccggcggcgctcaagaggcggaggggcccgcgcgtggcggtgctggcgctcgtcttctgctccctgctcgtgcccttcgccttcctcttcgaccgcgccccctccgggtacgtgacgacggaggagcggcaccgacaggaggtcgttctgccttcgttggatcacgccgagaagaggggtcgtcctggcgctatcagcggacggagacaggatgcaccagaaaagaagatccccagaggcagtgcaggagtcattcatcagcatgtaccagagaagaggatctccaaagttagtgcaggagtcattgatcagcataagcaaattgatagccattcgacaagtggtggtgctaaatcaaaagctcttccagcaccaaaagttgaaccatcaaaggctatggcggaatcaactcgagagacaagagagattagcaaagatgtacaagggcgacaaaaagttgcaaaagctgatgaagtggaaaaggcgaaggcttgtcaacttgaatttggaagttattgtctctggtccatagaacacaaagaagtaatgaaagattccatagtgaagaggctaaaagaccaactctttgtagcacgctcatactatccgagtattgcaaaacttcaaggacatgaagctctgactcaggaaatgaagcaaaacatacaagaacatgagtgggtgcttagtgtatcaacagtcgatgctgatctaccatcatttatcaacaagaggatggagcagatggagcgaacaattgcgagatccaaatcttgcacggtggactgtaagaatgttgacaggaagcttcgccaaatacttgatatgactgaggatgaagctcattttcatatgaagcagagtgcattcctgtacaaccttggtgcccagacattacagaaaagtcatcattgccttaatatgaggttgacgttagagtatttcaaatcatcttcattggattcagatgattctccttctggcaagttcaacagtccaaaatatatgcactatgttatactatctaagaacgttcttgcggcttctgtagtgatcaactcaactgtgagcagttgcaaggagccaggcaatcttgcttttcatatcctaactgatgctcagaacttctatgccatgaaatactggtttgccaggaattcatataaaaatgcagttatccatgttataaactatgaggccattattttggagaagctgccaaagtataatatccagcagctgtacttgccagaggagtttcgtgttctcattaggagcattaagcagcctactgagaacacaagaatggaatacctgtcactgttcagccattcacatttccttattccagaaatattcaagtatctaaacaaggtggttctgttggatgatgatgtagttgttcaacgtgatctgtctttcttgtggaatattgatatgggagacaaggttaatggtgctgtcaaattttgtggtctgaaactgggtcaaatgagaaatgtactgggcaaaacagcatatgatcccaagtcatgtgcatggatgtcaggcgtgaatttgattaatttggataaatggagggaacataatgttacagagaactatctgctgctcatgaaaaagtttaaattcaaggatgagcgatctctgcgagcggcagcaattcctctaagcttgctatccttccaacatctcatctatcccctagatgaaaaattgaccctggctggacttggatatgattatggaattgatgaagaggttgctcggagagccgcatcgttgcactacaatggcaacatgaaaccttggcttgaactaggtataccggactacaaaaagtactggaggaggtttcttgttcgaggagaccgatttatggacgagtgcaacgtaaatccttgacacaggtggacctgaaatcagaacaatggcaatagattgctgcatctaatggcctcactaaagtttgtgaactgtcgacgcaagacttctcaaaagctctgcaccggaacaacaaacacagctgttgaacaggaaaagaggtgcggttgttggccattagtgttgtacggactacggagtagaggcagcagcttctgttcaccgaaaacaaacttgattgacgatttctgtattctaagactagtcgtgagtcagaatatgcagcaaggatggttgaatgtgcatgaggcttcaagtagccagtagacctcactgtccagattttttagataggatttttgacgagtcgtggcacctttgctaaaagtggtgtgtcacgctcgtcgatgctgatttgtttgtttgttttttccttatgccaataagggcgcacatgtattctcatatagtcattttttcgttcttatagtcgtcacacattgtttatttaccaaaaaaaaaaaaaaaaaaaa

SEQ ID NO: 578 - protein, 641 aa, Panicum virgatum
  misc_feature: Ceres CLONE 1726105
  misc_feature: Great-hit functional homolog of the protein sequence encoded by LOCUS At2g38650
  misc_feature (1)..(304): Pfam Name: Glyco_transf_8 Pfam Description: Glycosyl transferase family 8
  misc_feature: Useful for making plants with altered cell wall content and/or composition
MKAQPLLPAALKRRRGPRVAVLALVFCSLLVPFAFLFDRAPSGYVTTEERHRQEVVLPSLDHAEKRGRPGAISGRRQDAPEKKIPRGSAGVIHQHVPEKRISKVSAGVIDQHKQIDSHSTSGGAKSKALPAPKVEPSKAMAESTRETREISKDVQGRQKVAKADEVEKAKACQLEFGSYCLWSIEHKEVMKDSIVKRLKDQLFVARSYYPSIAKLQGHEALTQEMKQNIQEHEWVLSVSTVDADLPSFINKRMEQMERTIARSKSCTVDCKNVDRKLRQILDMTEDEAHFHMKQSAFLYNLGAQTLQKSHHCLNMRLTLEYFKSSSLDSDDSPSGKFNSPKYMHYVILSKNVLAASVVINSTVSSCKEPGNLAFHILTDAQNFYAMKYWFARNSYKNAVIHVINYEAIILEKLPKYNIQQLYLPEEFRVLIRSIKQPTENTRMEYLSLFSHSHFLIPEIFKYLNKVVLLDDDVVVQRDLSFLWNIDMGDKVNGAVKFCGLKLGQMRNVLGKTAYDPKSCAWMSGVNLINLDKWREHNVTENYLLLMKKFKFKDERSLRAAAIPLSLLSFQHLIYPLDEKLTLAGLGYDYGIDEEVARRAASLHYNGNMKPWLELGIPDYKKYWRRFLVRGDRFMDECNVNP

SEQ ID NO: 579 - DNA, 2337 bp, Panicum virgatum
  misc_feature: Ceres CLONE 1726125
  misc_feature: Encodes the peptide sequence at SEQ ID NO. 580
acgccgccacaacttgctgtgcttcagcatcggagacctcaccgccggctaccgggctgagcaagacagcgtccttccaccgtagaagtcatctgtcgcccagaagcgctgcgccgcagttttttttttgaaataatttggcgatttgactgaacgccaatgccccgcgtgaagcccatccctgagatggaagaggaggcggaggaggttaggcaggaagtcgaaggtgccagcggggcggaggggagcccggatgctggggccggcggcgaggagggggcggaggaggaagagaaggaggtgagcttcgatgagctgggcctggacgagcagctgaagagggctctgaggaagaagggcatcgcgaaggcaaccccgatacagcaggaggccatccctctcatcctggaaaggaaggatgtagttgcaaaggcgaagactggctctggaaagacctttgcctaccttctcccgttgctgcatgacctactgaagttatcctcagaaggccgtactcgtaaacccgcaccaaatgccttcatcctggtgcctacacgagagttatgccagcaggtttataatgaggcatcatctctccttgagttctgtacatccaaattaaaggtcgtccaagtgactgctagcatgtcggataaggatattactgttgcattgtctggcccccctaatattcttgtgtcaactccagcttgtgttgcaacatgcatatcaaagggcattatgcgtggctcatcaatcaaagaatctctttcaatgatgattctcgatgaggctgaccttcttctgtcctatcgctgtgaagatgacttgaaagctctcatcccacatatcccaagaagctgtcagtccattctgatgtctgcaacctcaagctctgatgtcgacaaattgatcaagctacttctgcacaacccatttgttctaactcttactgaggttggtcgagctaaggatgatgtgatccccaaaaatgttcaacagttttggatctcatgcgatgccaaggataagatacttcatatccttgcactcttaaagtttgagcttattcagaagaaagttcttatatttgtcaactcgattgatgcggcattcagattacgactgttcttggaaaagtttgggataagatccgcggtgttgaatgctgagttgccacaaaattctcggctacatattatcgaggcattcaatgctagattatttgattatctgatagcaacggatgacactaaaacaaaggaggataagcaaactgataagaaaaacaagaaagaggcaagggtgtcccgcaaacatttgcagcagactttagatgctgaatttggagttgtcagaggaatcgacttcaaaaatgtattcacagtagttaattttgacatgccaccggatcctgctgggtatgttcacagaataggacgaacagggagagcaaataagaccggtgcatctgtatcgcttgtttcggaagaggagagtagtatttttgaagacattgagcatatgttgcaagaagttgaaaataaagatatagattgcatttcacctttccccctacttacaaaagatgctgtcgactctctacgatatagggctcaggatgttgcgaggagtgtgacaacacgtgatatacaggaagcacgtcgccaagacataaagaatgaaatcctgaattctgagaaattgaagtctcattttgaagagaatccaagagaccttgatttgctcaagcacgataagttgttaagcaacaaagaaattcccgcacacctgcgtgatgttcctgactacctaattgatccaaaaacaaaagaagccagcaatgttgtcaaactttccagggctgctatgggtattgacaaaccccaaaggaggaaacgacagggattcaagggaggatctggcaaaagtagagacccccttaggactttctctgctgagggcaaatcacggagacgacgcaggaaagatagagagggggagcaggatagaagaaagaagagtaagaaggcagaaagctgatgtcttccaagtagttttacaattagctcgctcagttttgtaggcttctcgactttttgtttttactctactcaactgtggaatctttagacaggttgtgtaaacaacggcaagggtgacagtgacactagcgaccatggggtgtagaatttgtttctcgcctgacgggaaacttctaatttctttccaagtatcatgcacttctcttgaatccatgttcagggaaacattaacagtgatgcgaacacaagtttcaggatttgattgaactactaaaaaaaaaaaaaaaaaaaa

SEQ ID NO: 580 - protein, 627 aa, Panicum virgatum
  misc_feature: Ceres CLONE 1726125
  misc_feature (1)..(180): Pfam Name: DEAD Pfam Description: DEAD/DEAH box helicase
  misc_feature (1)..(109): Pfam Name: Helicase_C Pfam Description: Helicase conserved C-terminal domain
MPRVKPIPEMEEEAEEVRQEVEGASGAEGSPDAGAGGEEGAEEEEKEVSFDELGLDEQLKRALRKKGIAKATPIQQEAIPLILERKDVVAKAKTGSGKTFAYLLPLLHDLLKLSSEGRTRKPAPNAFILVPTRELCQQVYNEASSLLEFCTSKLKVVQVTASMSDKDITVALSGPPNILVSTPACVATCISKGIMRGSSIKESLSMMILDEADLLLSYRCEDDLKALIPHIPRSCQSILMSATSSSDVDKLIKLLLHNPFVLTLTEVGRAKDDVIPKNVQQFWISCDAKDKILHILALLKFELIQKKVLIFVNSIDAAFRLRLFLEKFGIRSAVLNAELPQNSRLHIIEAFNARLFDYLIATDDTKTKEDKQTDKKNKKEARVSRKHLQQTLDAEFGVVRGIDFKNVFTVVNFDMPPDPAGYVHRIGRTGRANKTGASVSLVSEEESSIFEDIEHMLQEVENKDIDCISPFPLLTKDAVDSLRYRAQDVARSVTTRDIQEARRQDIKNEILNSEKLKSHFEENPRDLDLLKHDKLLSNKEIPAHLRDVPDYLIDPKTKEASNVVKLSRAAMGIDKPQRRKRQGFKGGSGKSRDPLRTFSAEGKSRRRRRKDREGEQDRRKKSKKAES

SEQ ID NO: 581 - DNA, 1654 bp, Panicum virgatum
  misc_feature: Ceres CLONE 1726136
  misc_feature: Encodes the peptide sequence at SEQ ID NO. 582
aactcgtctccctcccctcgccaaatcctccttgtcctctgcaatcgccaggcccgccgcgcaggcagactggactgactggtcactggtaactcgatcgatcggatcatcggaggcaggtaggcatgtccgggaagcacttcaagtacgtcatcctcggcggcagcgtcgcggcggggtacgcggcccgggagttcgccaagcagggagttcagccaggggagctcgccatcatctccaaggaggcggtggctccgtacgagcgtcctgccctcagcaagggttacctcttccctcagaatgctgcaaggctcccaggatttcatgtgtgtgtcggaagtggtggagaaaggctattgcctgaatggtactcggagaaaggtattgagctgatcctcagcactgaaattgtgaaagctgatctttccaccaagactctgactagtgcagctggagcaacctttacatatgacatcctgctcattgcaactggatcctcggtcatcaagctcactgattttggcacacaaggagctgattctaacaacattctatatctaagggaaattgatgatgctgacaagctggttgcagctatccaggcaaacaagggtgggaaggcagtggttgttgggggaggttatattgggcttgaacttagtgcagcactgaagatcaatgactatgatgtcactatggtgtttcctgaaccttggtgcatgccccggctcttcactgccgatattgctgctttctacgaggcttactatactaacaaaggggtaaaggttttgaagggcacattagctgttggttttgatgccaatgccaatggtgatgtcactgcagttaagctaaaggatggcacagtacttgaagctgatattgttgttgtcggtgttggaggcagaccattgactgctctcttcaaagggcaagttgctgaggagaaaggtggaatcaagactgatgctttctttgaaacaagtgttcctggagtatatgccattggcgatgttgctaccttccccttgaagatgtacaatgagttgaggagagtagaacacgttgaccatgctaggaagtctgcagagcaggctgtaaaggcaatcaagggaaaggagtccggggagtcggttccagagtacgactaccggccatacttctactcccgatccttcgacctggggtggcagttctacggcgacaacgtcggcgaaaccatcctgttcggcgacagtgaccccgcctccagcaagcccaaattcgggtcgtactggatcaaggacggcaaggtcttgggcgcctttctggaaggcgggtctccggacgagaacaaggccatcgccaaggtggcgaaaacccagccggctgtctccagcgtcgaggagctcaaggagggcctccagttcgcgagcaagatctgagactgctccctgtttcattgttccatgtacatctcgcgtcatcatttaggtgttcttgtgtttatggtcgcagtgttctacgacagatgttgccatgcgtacttgaccacatggcattcggtttctgattgtgatgtctgaattacacatatacccactctttctgtaccacttgagatttgaataaagcctgcagcctcagccctcaaaaaaaaaaaaaaaaaaaa

SEQ ID NO: 582 - protein, 433 aa, Panicum virgatum
  misc_feature: Ceres CLONE 1726136
  misc_feature (2)..(297): Pfam Name: Pyr_redox_2 Pfam Description: Pyridine nucleotide-disulphide oxidoreductase
  misc_feature (1)..(297): Pfam Name: Pyr_redox_2 Pfam Description: Pyridine nucleotide-disulphide oxidoreductase
  misc_feature (1)..(433): SWISSPROT Homolog: EC 1.6.5.4 Monodehydroascorbate reductase, seedling isozyme
MSGKHFKYVILGGSVAAGYAAREFAKQGVQPGELAIISKEAVAPYERPALSKGYLFPQNAARLPGFHVCVGSGGERLLPEWYSEKGIELILSTEIVKADLSTKTLTSAAGATFTYDILLIATGSSVIKLTDFGTQGADSNNILYLREIDDADKLVAAIQANKGGKAVVVGGGYIGLELSAALKINDYDVTMVFPEPWCMPRLFTADIAAFYEAYYTNKGVKVLKGTLAVGFDANANGDVTAVKLKDGTVLEADIVVVGVGGRPLTALFKGQVAEEKGGIKTDAFFETSVPGVYAIGDVATFPLKMYNELRRVEHVDHARKSAEQAVKAIKGKESGESVPEYDYRPYFYSRSFDLGWQFYGDNVGETILFGDSDPASSKPKFGSYWIKDGKVLGAFLEGGSPDENKAIAKVAKTQPAVSSVEELKEGLQFASKI

SEQ ID NO: 583 - DNA, 1747 bp, Panicum virgatum
  misc_feature: Ceres CLONE 1726143
  misc_feature: Encodes the peptide sequence at SEQ ID NO. 584
acatatcacactgattgctgaagatgagttcctccacgtccagcgctctcgtgctagcagcagcagtgctcctagcagcactgaccgtagcacagcatggctccctcgccgcagccgccggccccagggtcatcatcgtcggcgccggcatgtccgggatctcggctgctaagacgctgtcggaggccgggataaccgacctgctgattctggaagcaacggaccgcatcggcggccggatgcacaagaagaacttctccggcatcaacgtcgagatcggcgccaactgggtggagggcgtcaacggcggcaagatgaaccccatctggcccatcgtcaacgaaacgctcaagctccgcaacttcctcaccgactttagtgtcgccacaaacatctacaaggaggacggtggcctctacgatgaagcttacgttcagaagataattgaccgagcggatgccgtggaaagtaaaggagagaagctgtctgccagtttgcccgccagtggaagcgacgacatttcaatccttgcaatgcagcgcctctacgatcaccagccgaacgggccggcgacgccggtggacatggtggtggactacttcaagtacgacttcgagggggcggagccgccgcgcgtgaccagcctgcagaccaccgtccctaacccgacgttcaccgacttcggcgaagacgaatacttcgtcgccgaccatctaggctacgagaccgtcgtgcactacctcgccggccagtacctcaagaccgacagctctggaaagatcgtcgatccacggctgctgctcaacaaggtggtgacagagatcagctattcttcttctggtgtctccgtgaggacggaggacaagtcggtgtacaaggcagactatgttatggtttctacaagcctgggtgtcctgcaaaccgatctcattcacttcaagcccaaactacctacatggaagattctggtgatctaccaattcgacatggccgtgtacaccaagatcttcctcaagttccccaagaggttctggcctgtagggaaaggaaaagagttcttcctctacgcgagcaccaggagaggttactacgcagcgtggcagcaacttgagaagcagtatcctggtgccaacgcccttcttgtgaccgtgactgacgaggagtcaaggcgtattgagcagcagtcggacaaccagaccaaggcagagatcatggaagtgctgaggaagatgttccccggcgaggacgtcccggatgccaccgacatcctcgtcccgagatggtggtctgacaggttctacaagggcacctacgccaactggccagtcggtgtcagccgctacgaagtcgaccagcttagggcaccggttgggagggtgtacttcactggtgagcacaccagcgacaaatacactggctatgtccatggcgcttatcttgcaggtattgactctgctgaaattctcatcaattgcgcccagaaaaagatgtgcaagtaccttgtcaagggcaagtatgactagaaggcataagctccagcaaacgtctcctcttgttgcaccaatgagaatctacctatggatgtgcatttatttatttataaataagtagatgacagccatgtcttggcatgtctcttttccttgctgtaataaggcggctgatttataaagcttcaatcattgttaccatctatgatttgtgattaagtattctgcttaagtacgaaaaaaaaaaaaaaaaaaaa

SEQ ID NO: 584 - protein, 499 aa, Panicum virgatum
  misc_feature: Ceres CLONE 1726143
  misc_feature (1)..(440): Pfam Name: Amino_oxidase Pfam Description: Flavin containing amine oxidoreductase
  misc_feature (1)..(433): Pfam Name: Amino_oxidase Pfam Description: Flavin containing amine oxidoreductase
  misc_feature (1)..(442): Pfam Name: Amino_oxidase Pfam Description: Flavin containing amine oxidoreductase
  misc_feature (1)..(499): SWISSPROT Homolog: EC 1.5.3.11 Polyamine oxidase precursor
MSSSTSSALVLAAAVLLAALTVAQHGSLAAAAGPRVIIVGAGMSGISAAKTLSEAGITDLLILEATDRIGGRMHKKNFSGINVEIGANWVEGVNGGKMNPIWPIVNETLKLRNFLTDFSVATNIYKEDGGLYDEAYVQKIIDRADAVESKGEKLSASLPASGSDDISILAMQRLYDHQPNGPATPVDMVVDYFKYDFEGAEPPRVTSLQTTVPNPTFTDFGEDEYFVADHLGYETVVHYLAGQYLKTDSSGKIVDPRLLLNKVVTEISYSSSGVSVRTEDKSVYKADYVMVSTSLGVLQTDLIHFKPKLPTWKILVIYQFDMAVYTKIFLKFPKRFWPVGKGKEFFLYASTRRGYYAAWQQLEKQYPGANALLVTVTDEESRRIEQQSDNQTKAEIMEVLRKMFPGEDVPDATDILVPRWWSDRFYKGTYANWPVGVSRYEVDQLRAPVGRVYFTGEHTSDKYTGYVHGAYLAGIDSAEILINCAQKKMCKYLVKGKYD

SEQ ID NO: 585 - DNA, 2431 bp, Panicum virgatum
  misc_feature: Ceres CLONE 1726181
  misc_feature: Encodes the peptide sequence at SEQ ID NO. 586
atctccactccccttcgcaacccccgcccgccccgcgcgatggactcggcgtcggcggggctgaagccctcggcgctggacctgctggcggcgctgctgacggggcggggccccgaggggggcggggcgccctgggcgttctcgctcgccgagaaccgccacctgctcgtgctgctcaccacctccctcgccgtgctcgtcggctgcggggtcgcgctgctcgcccgccgctccaccgcggcggctgcccaggcgcagccgccgcggcccctcgccgcgaagcccagggacgagccggaccccgacgacggcaggcagagggtcgtcatcttcttcgggacgcagaccggcaccgccgagggcttcgccaaggcgctcgcggaagaggccaaggcgaggtacgacagggccgtcttcaaggtggtcgatctggaggactacgccgccgaggacgaggagtacgaggagaagctcaagaaggagaacattgcgttgttcttcctggcgacttatggtgatggggagccaactgacaacgtggcgaggttttataaatggttctcggaggggaatgagagaggtgagtggttgagtaatcttcggtttggggtgtttggccttggaaatagacagtacgagcactttaacaagattggaaaggtggttgatcagctccttgcagaacaaggtggcaaacgtattgttcctgttggtcttggagatgacgatcaatgcattgaggatgacttcaatgcatggaaggaacttctatggccagaattggataaattgctccgccaggaagatgattcttcagcagcagcaactacttacacagctgctattccggaatatagagttgtgtttgtcaaaccagaggatgccacaaacatcaacaagtctttaagtctcagtaatggtcatgctgtctatgacattcaacatccttgcagggcaaatgtggctgtgcggcgagagcttcatacaccagcttctgacagatcctgcattcatttagaattcgatatttctggaactggactcaaatacgagactggagaccatgttggtgtctacgctgaaaactgcattgaaattgttgaagaggcagaaaagctgctaggttattcaccggatactttattctcaatttatgctgaccaagaggatggtaccccgctttgtgggggttctttgccacctcctttcccatccccctgcacagtcaggactgcacttaccagatatgcagatctattgaattcgcctaagaagagtgctttgcttgctttggccactcatgcatctgatcccaaagaagctgagcggcttagacaccttgcatctcctgctggaaagaaggagtattcacaatgggtagtcacgagccaaagaagtctattagaagttatgtcggagtttccatcagcaaagcctccacttggtgtcttctttgcagctatttctcctcgcctgcagccaagatattactcaatatcttcctcaccgagaatggcaccaacaaggattcatgtgacgtgtgcactagtatatgggccaacccctactggaagaatccacaaaggagtttgttctacttggatgaagcgttcaactcccttagaagagagccaagaatgtagttgggcaccaatttttgtcaggcagtcaaacttcaaactgcctgctgatcctaatgtgcccattgtaatgattggccctgggactggcctggcaccttttagggggttcttacaggaacgattagctttaaaagaggcaggggtggaactaggccgtgctatcctcttctttgggtgcagaaatcggaagatggacttcatatatgaggatgagcttaataactttgttgatactggtgccctttctgagttgattgtagccttttcccgcgagggtcctacaaaagagtatgttcagcacaaaatggcacagaaggctgccgagctttggagcatcatttctcagggtggttatatttatgtctgtggtgatgcaaagggcatggctagagatgtgcaccgcacactacataccatcatccaggagcaggggtcactggataactcaaagacagaaagctacgtgaagagcctacagacggaagggagatacttgagagatgtctggtgacgtgctgcacacacagaaactagcctgtagttgcgagtttccccacaaatacaaaagaatgtgttcgtgtaggaagctagtggtgccaactgggatccatttcagtagggggtatacaaggatctgaaatatacagattaatcatcactaatatgaagcatagcagggttgtctatgtataggagtgcagggagctattatttattcaaggaatcactgttgtgatttctgatactaaataaaacagccatcatattaaaaaaaaaaaaaaaaaaaa

SEQ ID NO: 586 - protein, 704 aa, Panicum virgatum
  misc_feature: Ceres CLONE 1726181
  misc_feature (1)..(113): Pfam Name: NAD_binding_1 Pfam Description: Oxidoreductase NAD-binding domain
  misc_feature (1)..(704): SWISSPROT Homolog: EC 1.6.2.4 NADPH--cytochrome P450 reductase
  misc_feature (42)..(704): SWISSPROT Homolog: EC 1.6.2.4 NADPH--cytochrome P450 reductase
MDSASAGLKPSALDLLAALLTGRGPEGGGAPWAFSLAENRHLLVLLTTSLAVLVGCGVALLARRSTAAAAQAQPPRPLAAKPRDEPDPDDGRQRVVIFFGTQTGTAEGFAKALAEEAKARYDRAVFKVVDLEDYAAEDEEYEEKLKKENIALFFLATYGDGEPTDNVARFYKWFSEGNERGEWLSNLRFGVFGLGNRQYEHFNKIGKVVDQLLAEQGGKRIVPVGLGDDDQCIEDDFNAWKELLWPELDKLLRQEDDSSAAATTYTAAIPEYRVVFVKPEDATNINKSLSLSNGHAVYDIQHPCRANVAVRRELHTPASDRSCIHLEFDISGTGLKYETGDHVGVYAENCIEIVEEAEKLLGYSPDTLFSIYADQEDGTPLCGGSLPPPFPSPCTVRTALTRYADLLNSPKKSALLALATHASDPKEAERLRHLASPAGKKEYSQWVVTSQRSLLEVMSEFPSAKPPLGVFFAAISPRLQPRYYSISSSPRMAPTRIHVTCALVYGPTPTGRIHKGVCSTWMKRSTPLEESQECSWAPIFVRQSNFKLPADPNVPIVMIGPGTGLAPFRGFLQERLALKEAGVELGRAILFFGCRNRKMDFIYEDELNNFVDTGALSELIVAFSREGPTKEYVQHKMAQKAAELWSIISQGGYIYVCGDAKGMARDVHRTLHTIIQEQGSLDNSKTESYVKSLQTEGRYLRDVW

SEQ ID NO: 587 - DNA, 1985 bp, Panicum virgatum
  misc_feature: Ceres CLONE 1726189
  misc_feature: Encodes the peptide sequence at SEQ ID NO. 588
agaaacaccgccacactcccgccgccgcactccaccccgctccgccgccgccgtccgatccgctgatccgggcccttctgggagcgcgccctccgcgcgagcggcggccatggcgctcgccttcgacgagttcgggcggcccttcatcatcctcagggagcaggagaagaagacgcgcctgcgcgggctcgacgcgcagaaggccaacatcgccgcgggcaaggccgtcgcgcggatcctccgcacctcgctcgggcccaagggcatggacaagatgctccagtcccccgacggcgacgtcaccatcacaaatgatggcgccacgatcctggagcagatggatgttgacaaccagattgcgaaactgatggtggagctgtcctgcagtcaagactatgaaatcggggatggtaccactggggtggtggtcatggcaggggctctcctagagcaggctgagaaacttctggaacgtggcattcacccattaagggttgctgaaggttatgagatggcatcaaggatagcttttgatcaccttgagcgtatctcccaaaagtttgagttcagtgcggacaatatagaacccctggttcagacctgcatgacgacactgtcatcaaagattgtaaaccgctgcaagcgggcactggcagagattgccgtcaaagctgtccttgcagttgctgatttggagaggaaggatgttaacttggatttaattaaagtagaaggcaaggttggtggaaagctggaggacacggagctcatatatggaattgttgtcgacaaagatatgagtcacccgcaaatgccaaagagaattgaggatgctaagatagctatcctgacttgcccatttgagcctccgaagcctaagacaaagcataaggttgacattgacactgtacagaaattccagaccctgcgcgatcaagagcagaagtacttcgatgaaatggttcaaaagtgtaaggatgttggtgcgacccttgttatatgtcaatggggttttgacgatgaagccaatcatcttttgatgcacagaaatctgccagctgtcagatgggttggtggtgttgaattagaattgattgccattgctacaggaggccggattgttccgagattccaagaactgagtcctgaaaagctcgggaaggctggattagtcagagagaagtcatttggaacaaccaaggaccggatgctttacattgagcagtgtgccaattccagagctgtaactattttcattcgtggtggaaacaaaatgatgattgaggagaccaagcgcagtcttcatgatgctctttgtgtggcaaggaatctaatccgcaataactcaatcgtgtatggtggaggctcagtggagatatcttgctcgattgctgttgaaactgctgctgatcgacaccctggagttgagcagtatgctatcagatcatttgctgatgcattagaggctgttccactagccttagcagaaaatagtggtctgccgcccattgatacgttaactgctgtgaaagcacaacaagttaaggagagcaacccccactgcggcatagactgcaatgatgttggcatgaatgacatgaaggagcagaatgtctttgagactctgattggcaagcagcagcagatcttgcttgccacgcaggtggtgaagatgattctcaagatcgacgacgtgatctcgccatccgagtactgatgaaggaagcctgagaaagaaggggagctgcgcttggtgacgatctaaagaaccattccacatgctatacggggtctcattttcaatttatgctgtttcatggggcttattccagaaccaaatcatcctaaaaatctgtaagaatttattgaggtcatcagaaactgatggttatgttgtggtaaatttgacggttgttgccataccatcaatattgttatgtgacgaaatgcgaacacctgttctccaaaaaaaaaaaaaaaaaaaa

SEQ ID NO: 588 - protein, 535 aa, Panicum virgatum
  misc_feature: Ceres CLONE 1726189
  misc_feature (1)..(474): Pfam Name: Cpn60_TCP1 Pfam Description: TCP-1/cpn60 chaperonin family
  misc_feature (1)..(489): Pfam Name: Cpn60_TCP1 Pfam Description: TCP-1/cpn60 chaperonin family
  misc_feature (1)..(491): Pfam Name: Cpn60_TCP1 Pfam Description: TCP-1/cpn60 chaperonin family
  misc_feature (9)..(384): Pfam Name: Cpn60_TCP1 Pfam Description: TCP-1/cpn60 chaperonin family
  misc_feature (1)..(495): Pfam Name: Cpn60_TCP1 Pfam Description: TCP-1/cpn60 chaperonin family
MALAFDEFGRPFIILREQEKKTRLRGLDAQKANIAAGKAVARILRTSLGPKGMDKMLQSPDGDVTITNDGATILEQMDVDNQIAKLMVELSCSQDYEIGDGTTGVVVMAGALLEQAEKLLERGIHPLRVAEGYEMASRIAFDHLERISQKFEFSADNIEPLVQTCMTTLSSKIVNRCKRALAEIAVKAVLAVADLERKDVNLDLIKVEGKVGGKLEDTELIYGIVVDKDMSHPQMPKRIEDAKIAILTCPFEPPKPKTKHKVDIDTVQKFQTLRDQEQKYFDEMVQKCKDVGATLVICQWGFDDEANHLLMHRNLPAVRWVGGVELELIAIATGGRIVPRFQELSPEKLGKAGLVREKSFGTTKDRMLYIEQCANSRAVTIFIRGGNKMMIEETKRSLHDALCVARNLIRNNSIVYGGGSVEISCSIAVETAADRHPGVEQYAIRSFADALEAVPLALAENSGLPPIDTLTAVKAQQVKESNPHCGIDCNDVGMNDMKEQNVFETLIGKQQQILLATQVVKMILKIDDVISPSEY

SEQ ID NO: 589 - DNA, 2109 bp, Panicum virgatum
  misc_feature: Ceres CLONE 1726203
  misc_feature: Encodes the peptide sequence at SEQ ID NO. 590
acccacacacatgacacaccacgctcgttactgctagagctggcggcttggagtgtgttcgctgagcaagaactcgcgcactgtcacaccacacatctcctccggtttccctctcgtccatcgccaccatttccatgagcagcaaccccacgcgccgcgcattgccagcatcttcctcactgcacgtctagcccctgcaggtatatctccccgcctcttggctcttgacaagaacaagagcgggagcaagaagtacttgcagcggcgacggcggcgatggaggtggcgacgatgctgacgctgacgctgctggcgtactcggcagcgatgcttgcgcggctgctggtggcgcggtcgcggcggcggcggtgctacctgctggaccacgtgtgctacaaggcgacggacaaccggaagctgccgacggacctgtgcggcgagatcatacagcggaacaagctgctggggctggaggagtacaagttcctgctcaaggtcatcgtcaactccggcatcggcgaggagacgtacggcccgcgcaacatgatcgagggcggcgaggcccggcccgaccgcctccgggagggcatggaggagatggacgagaccttccacgccgtcctcgacgagctcttcgcccggtccgcggcgccggggggcctcggcatccgccccgccgacgtcgacatcctcgtcgtgaacgtgtccatgttctcgccggcgccgtcgctgtcggcgcgcatggtgcgccgctacgggctccgcgaggacgtcagggtgtacaacctcaccgggatggggtgcagcgccacgctcatcgccctcgacctcgtcaacaacttcttcaggacgcacgcggggcaggtggcgctggtgatgacgtcggagtcgatcgcgcccaactggtacgccggcaaccggcgctccttcatgctgggcaactgcctcttccgctccggcggctgcgcctacttcctcaccaacgacccgcgcctccgcccgcacgcccggctccgcctccgccacgtcgtgcgcacccacaccggcgcctccgaggaggcctacaactgcgcgctccagatggaggacgacgccgcccgcccgggcttccacctcggcaaggagctgccccgcgccgccgtgcacgccttcgtccacaacctccgcgtcctggcgccccgggtgctgccgctgccggagctcatccgcatcgcctgcgccaccctctcggcgcgcctggcccgcaagaaggcgcagccgcgcggggccggcggcggccacctcaccatccgcatgcgggccggcgtcgaccacttctgcgtccacacgggcggcgccgccgtcatcgacggcgtcggcaaggggctcacgctcacggagcacgacctggagccgtcgcgcatgacgctgcaccgcttcggcaacacctccgccagcagcgtctggtacgtgctcgggtacatggaggccaagggccgcctgcgcaagggcgaccgcgtgctcatgctcaccttcggcgccggcttcaagtgcaacagctgcgtgtggacggtggagaagcccgccgccggcgccggcggcgtctgggaggaccgcatcgaccagtacccgctcaaggacgtctccaaccccttcctggagaagtacggattcgtcaaggacatgatgaacttgtgatcgatctgccggattggagccagcagcccagcatgcagtgatctcaacccgatcgacgaccatgcacccggccgccggccgcatactgctccacctcacatacatcatatatacatgcatagacgacaggcatcgattgattcttttggtgatggtgatgcatagaccatgagctgatgaggattcgtcataggtataagcagtagcagcgcgcttatgattcttttggtggtggtggtggtggtggcaactggcaagacttatgttacgtttagcaggggatcgatatggtttcttctcttctttttttttcttcttctaccattttctgtttggtcttcagtcggtgtcgtgttgtactgccattatttactatgaatgatgatggattaaagtgaaattattctttattaaaaaaaaaaaaaaaaaaaa

SEQ ID NO: 590 - protein, 466 aa, Panicum virgatum
  misc_feature: Ceres CLONE 1726203
  misc_feature (1)..(293): Pfam Name: FAE1_CUT1_RppA Pfam Description: FAE1/Type III polyketide synthase-like protein
MEVATMLTLTLLAYSAAMLARLLVARSRRRRCYLLDHVCYKATDNRKLPTDLCGEIIQRNKLLGLEEYKFLLKVIVNSGIGEETYGPRNMIEGGEARPDRLREGMEEMDETFHAVLDELFARSAAPGGLGIRPADVDILVVNVSMFSPAPSLSARMVRRYGLREDVRVYNLTGMGCSATLIALDLVNNFFRTHAGQVALVMTSESIAPNWYAGNRRSFMLGNCLFRSGGCAYFLTNDPRLRPHARLRLRHVVRTHTGASEEAYNCALQMEDDAARPGFHLGKELPRAAVHAFVHNLRVLAPRVLPLPELIRIACATLSARLARKKAQPRGAGGGHLTIRMRAGVDHFCVHTGGAAVIDGVGKGLTLTEHDLEPSRMTLHRFGNTSASSVWYVLGYMEAKGRLRKGDRVLMLTFGAGFKCNSCVWTVEKPAAGAGGVWEDRIDQYPLKDVSNPFLEKYGFVKDMMNL

SEQ ID NO: 591 - DNA, 2032 bp, Panicum virgatum
  misc_feature: Ceres CLONE 1726208
  misc_feature: Encodes the peptide sequence at SEQ ID NO. 592
actcccatcggccctcccctcctcacgctgtcacgcaccccgtgtccccgtctcgtctcgtgggcgctcctcctcctctgctcggctgctctgcttctcgccatggcgtcctcgacggggagcttggagcacgggggtttcacgttcacgccgccgcccttcatcacctccttcaccgagctgctctccggctccggggacatgctcggcgcggaccaggagcggtcgccgaggggcctgttccaccgcggggccaggggcggcgtgcccaagttcaagtccgcgcagccgcccagcctgcccatctcgccgccgcccatgtcgccgtcctcgtacttcgccatcccggccgggctcagtcccgccgagctgctcgactcgcccgtcctgctcaactcctcctctaacatcctggcgtccccgaccaccggcgccatcccggcgcagaggttcgactggaagcaggccgccgagctgatcgcctcgcagcaggaggacagccgggcggcgggcggcggcttcaacgacttttccttccacacggccagctccaactccatgcccacgcagacagcttccttcccagcattcaaggaggagcagcaagtggaagccgtgaacaagcagagcgtcgccgccgcgaccaacagcaacaaggccagcagcggcaacaacaacagcagcagcaacaccaagctcgaggacggttacaactggcgcaaatacggccagaagcaggtgaaggggagcgagaacccgcgcagctactacaagtgcacctaccacagctgctccatgaagaagaaggtggagcggtccctggccgacgggcgcatcacgcagatcgtgtacaagggcgcgcacaaccaccccaagccgctctcgacgcgccgcaactcctccggcggcgccgctgcggcggaggaccagcaggccgccagcggcctctcccaagcagccgccggctgcgggccggagcactccggcgcgacgcccgagaactcgtcggtgacgttcggcgacgacgaggccgagaacgggtcgaagcggagcgacggcgacgagcccgacgccaagcgctggaaggaggatggggagaacgagggcagctccggcggccccggcggcagcaagcccgtgcgcgagccccggctggtggtgcagacgctgagcgacatcgacatcctggacgacgggttccggtggcgcaagtacgggcagaaggtggtgaaggggaacccgaacccgcggagctactacaagtgcacgacgccggggtgccccgtgcggaagcacgtggagcgcgcgtcgcacgaccaccgcgccgtgatcaccacctacgagggcaagcacaaccacgacgtgcccgtgggccgcggcgccgccagccgcgccgccgcgccggtggcccagccgctggcggcgcccggcgccatgatgccctacaccctggagatgctcggcggcgcaggaggcgcctacggcggctacgcggcggcggccaaggacgagccgcgggacgacctgttcgtcgactcgctcctctgctagcgacagccaggcaggcacacctctgtctccgtgcgcggcgggcggctcgccggcctctgtacgtgtacagccgctatacgcgcgcgcgcgcgcacacgaacgcgatgtgtacacactttgtaggtgtttttagcttagcagataggaagggaaatttgttgattcgttggtggaaggccttttttcctccagggcggctggcgggctgggcgatcagcgagagcagagcagtacgcgtacacgtatactgtatactgtatacggttttgtatctttgccctgatagtataaggtcggtcgggtcggaaaggccgtatatatatagtgatggaaaagtcaataaagactgaaaaattttattctatgtcttctactgtagtagtagtagtgtgaattatagaaaaaatttatacctagagtacagagtatgtacacaatcaagcagttttggttttgttctcaaaaaaaaaaaaaaaaaaaa

SEQ ID NO: 592 - protein, 482 aa, Panicum virgatum
  misc_feature: Ceres CLONE 1726208
  misc_feature: The sequence is a functional homolog of  SEQ ID NO 1326 in the  11/479,226 US patent application
  misc_feature: The sequence is a functional homolog of  SEQ ID NO 618 in the  10/412,699 US patent application
  misc_feature: Useful for making plants with modulated growth and phenotype characteristics
MASSTGSLEHGGFTFTPPPFITSFTELLSGSGDMLGADQERSPRGLFHRGARGGVPKFKSAQPPSLPISPPPMSPSSYFAIPAGLSPAELLDSPVLLNSSSNILASPTTGAIPAQRFDWKQAAELIASQQEDSRAAGGGFNDFSFHTASSNSMPTQTASFPAFKEEQQVEAVNKQSVAAATNSNKASSGNNNSSSNTKLEDGYNWRKYGQKQVKGSENPRSYYKCTYHSCSMKKKVERSLADGRITQIVYKGAHNHPKPLSTRRNSSGGAAAAEDQQAASGLSQAAAGCGPEHSGATPENSSVTFGDDEAENGSKRSDGDEPDAKRWKEDGENEGSSGGPGGSKPVREPRLVVQTLSDIDILDDGFRWRKYGQKVVKGNPNPRSYYKCTTPGCPVRKHVERASHDHRAVITTYEGKHNHDVPVGRGAASRAAAPVAQPLAAPGAMMPYTLEMLGGAGGAYGGYAAAAKDEPRDDLFVDSLLC

SEQ ID NO: 593 - DNA, 1358 bp, Panicum virgatum
  misc_feature: Ceres CLONE 1726215
  misc_feature: Encodes the peptide sequence at SEQ ID NO. 594
gcttgctccgcccacccgcattcccttccctcccgtcgcctcgccgcctccgcacgcgcaccgcaacgcgacgcaccgggaaccgccgctacctccgcccacccatcctctgcgcgcgagaggaaggaggaaggaagggtcttcttcttggtgggaaggagggagatggcgatcgaccacgagtccccgttcaaggagctccgcctcaagaaccgcaggatcatgggaggcggcggccccgagccggaggaggaggccgcctcggcggcgtaccgggaccagtggccgcgctggctgcagccgctgctctccgcgcgcttcttcgcgcactgcaagacgcacagcgactcgcaccgcagcggcgagtgcaacatgttctgcctcgactgctccgccgccgcgggcgccggcgccggcgccgccgcgggcgcgctctgctccctctgcctcgcgcacgcccaccgcgaccaccacaccatccagatccgccgctcctcgtaccacgacgtcatccgggtctccgacatccagcgcttcatggacatcgccggcgtgcagacctacgtcatcaacagcgcccgagtcgtcttcctcaacgagcggccccagcagcagaagcccggctgcggcggcaaggccgcctccgcctccgcctccgccaacctctgcgaggtctgcgcccgcagcctcctcgacaacttccgcttctgctccctcgggtgcaaggtcgtcggctgcgcccccgacgccgcaatggccaggagctggctcctccggcccgccgccgcctccgactgcaacgcctcctcctccgccctgcggaatgccgacaggaagcagagcttcacgcctcccacgccgccgagcatgccagcgaagcggcgcaagggcatcccgcaccgcgcgccgttcggcagcctcatcgtcgagtactagccctcgtcggcggcggcggacggcggatgcattggcattacacgcgcgctgcaaagtaaaagtactcctcaaccaacggaatcgctcgcacagtgagtcactgaatccgtgcatgaatcagagtccgccattacggcaatgggatggccaccacttcggtggccgccttcctttgccttggcactttggggttggtggtgcttctcgaggtggatgccatttgctcgctggctttgctttccacatagggagagggaaagaaaggtggagaagaagaaaggagggtgcttgctgccgctagacaatgcaatcaaaaactagctttttcgttaagagttgattactgttgttaggacagaagatatatatttctgatagaaatatatgtgcatgttttagtccaaaaaaaaaaaaaaaaaaaa

SEQ ID NO: 594 - protein, 256 aa, Panicum virgatum
  misc_feature: Ceres CLONE 1726215
  misc_feature (1)..(121): Pfam Name: PLATZ Pfam Description: PLATZ transcription factor
MAIDHESPFKELRLKNRRIMGGGGPEPEEEAASAAYRDQWPRWLQPLLSARFFAHCKTHSDSHRSGECNMFCLDCSAAAGAGAGAAAGALCSLCLAHAHRDHHTIQIRRSSYHDVIRVSDIQRFMDIAGVQTYVINSARVVFLNERPQQQKPGCGGKAASASASANLCEVCARSLLDNFRFCSLGCKVVGCAPDAAMARSWLLRPAAASDCNASSSALRNADRKQSFTPPTPPSMPAKRRKGIPHRAPFGSLIVEY

SEQ ID NO: 595 - DNA, 1743 bp, Panicum virgatum
  misc_feature: Ceres CLONE 1726239
  misc_feature: Encodes the peptide sequence at SEQ ID NO. 596
gttgtcgacgccacaaactcgcgtccgccgcacgagtcaaacttgtgcggatcaagttggacttttcagtcagtggcctggtagggggattgttttcgcgagtttcagtgcttgtcgctgctataagagtaagacggccatggaccatgttcttgcatgtgcgtcctctccgctcacttgccacgaggtgctccaaggccctctcctgagctccttgtcctccatcagagccggcctcacgatgtacctgatcgaggacaagggcggcgccatcgcgctgatgctggcgtcgctcctgttcctgggcacctggccggccgtgctcacactcctggagcgccggggccggctgccacagcacacctacctggactactccctcaccaacctcctcgccgccgtgctcatcgcgctcaccttcggccagctcggggacagcaaggacggcatgcccaacttcttcacccagctcggccaggacaactggccctccgtgctgttcgccatggcaggaggtgtggtcctcagcattgggaacctgtcgacccagtatgcttgggcgtatgtgggtctctcggtgactgaggttatcagctccagcatggtggtggtgataggcacgacactgaactacttcctggacaaccgcatcaacaaggcagagattctgttcgccggtgtggcatgcttccttgttgccgtcatccttggctccgctgtccatgcctccaatgccgccgataacgaggagaaactcaatgcctccaacaaacttggagcaaatggaagtgtggaaccaagtaaaggaatccctgacaaagacgctcccaaggacttggagaatccctctggaaccaagcatgttaccagagctgaggcagggacagcagagtacctcattgagctcgaagagaggcgatccattaaggtcttcggatcaagcaccttcatcggacttggcatcgtcttcttctccggtgtgtgcttctcgctcttctccccggcattcaacctggctaccaacgatcagtggcacacccttaaggatggcgtgccacacctggtggtgtacaccgccttcttctacttctccatctcgtgctttgtcatcggcatcgggctgaacatcctgttcctctaccgcccaatggccggcgtgcccaagtcctccttcaaggcctacctcaatgactggaacggccggcagtgggctctcctcgccggtttgctctgcgggttcggcaacgggttccagttcatgggtggccaggctgccggctatgcagctgctgatgctgttcaggcgctgccgcttgtcagcacattctgggacataatgctgttcggtgagtaccggaagtcatcgcggaagacctacatcctgctcggtttcatgctgttcatgttcatcgctgccgtggcgacgctcatggcttcatcaggtcacaggagcacgaagtgatccccctgttgttcttcaagtgttgctcatcttgtgtttgcaagcgcaaactactcttgcagtcaagacgcaaaagaaattcgagcagcaaagcaagggaccctgctccaggaagcaaatgggagggtattccattccattcacgaaattttcagtagaacgaagatatacataagaaatgtttgtgtttcgattgttagtagttgtttatatattctttccaaagggaacttgcagataggatatgaaatgaaattgttccaaaaaaaaaaaaaaaaaaa

SEQ ID NO: 596 - protein, 440 aa, Panicum virgatum
  misc_feature: Ceres CLONE 1726239
  misc_feature (1)..(345): Pfam Name: FAE_3-kCoA_syn1 Pfam Description: Fatty acid elongase 3-ketoacyl-CoA synthase 1
MDHVLACASSPLTCHEVLQGPLLSSLSSIRAGLTMYLIEDKGGAIALMLASLLFLGTWPAVLTLLERRGRLPQHTYLDYSLTNLLAAVLIALTFGQLGDSKDGMPNFFTQLGQDNWPSVLFAMAGGVVLSIGNLSTQYAWAYVGLSVTEVISSSMVVVIGTTLNYFLDNRINKAEILFAGVACFLVAVILGSAVHASNAADNEEKLNASNKLGANGSVEPSKGIPDKDAPKDLENPSGTKHVTRAEAGTAEYLIELEERRSIKVFGSSTFIGLGIVFFSGVCFSLFSPAFNLATNDQWHTLKDGVPHLVVYTAFFYFSISCFVIGIGLNILFLYRPMAGVPKSSFKAYLNDWNGRQWALLAGLLCGFGNGFQFMGGQAAGYAAADAVQALPLVSTFWDIMLFGEYRKSSRKTYILLGFMLFMFIAAVATLMASSGHRSTK

SEQ ID NO: 597 - DNA, 1722 bp, Panicum virgatum
  misc_feature: Ceres CLONE 1726241
  misc_feature: Encodes the peptide sequence at SEQ ID NO. 598
gaaaatcccagagcaggtaatccgtcttcccgccggccggattatcagatgccgtcgctactctcccaccggcccccacccgccgccgcccacctccgcgccgctgcgcccgcctggacgcagccgcttcacgcgcgccggcgggccggtcctccccaagcctccgcctccgcctccgcctcagccgagttcccgggatccgttccaggcggtgcccagatgccgcccctccggcgccggcgccggagcgtggccggcatcgaccaggacgagctcctcgacccggaggccctcgccgacccggacagcagcttctacgagatcaacggcgtcaggctccaccacaaggtgtgcagccacgaggatgaggactcaccaagcgaccaatcctcggacgccactgtctcagctcctggccagagtcggatcagccttcccatacttctgcttcacggcttcggcgcctcggtgttctcctggagccgtgtcatgcggccactggcccgcattgccggtgccaaggtccttgcattcgaccggccagcgtttgggctgacgtcccgggcaagctggtccggtgatgacagcaagcctctcaacccgtactccatggctttctcggtcatggccacattggcattcatcgactaccttggcgccgagaaggctgtccttgtcgggcactcagctggctgccttgtagcagtggatgcatactttgaggcaccggaacgggtcgctgctcttgtgctagttgcaccaacaatatttgcaccgaggaagggagtgaaagatagcggtacaggggaacaggaagggcaaaagcagagtgttcccaatgatgaaaattcacctctcaatctctttgctagtatttggggtggatttttggcgctatgcaagcacattgcaggacttgtttccaagatgataatggcaataggaggcgtagttcaagctttgtatgttaaagctcttgttgcttttcttcgatcatcattgggtgcgatgctgataagatgggtcatggataaatttggaatactaggcgtccgtaatgcatggtatgacgcaagcaaagtaactgatcatgtcatacaagggtacacaaagccgctaaaatccaggggttgggagactgctcttctggagcacaccatatccatgatcatagattctgcatcagcgactagagtaccagtttctaagaggctttctgagatctcatgcccagtgctagtggtgactggtgatactgaccgcattgttcctgcttggaacgctgagcgtgtagcacatgctatacctagggcaagctttgaggtgatcaagagttgtgggcacttgccccaggaggaaagacctgaagaattcctgtcagtcgttggaaggtttctacggacagtgttccgaactccaaatgagcaggtgttccaagcagcagtatgacactatgttgattcatacatgcaacacacagatttgcggattggagatacgaagagaaatactgtaaagcaaaagaactactgaagatgggtcggctgtaattgtgggaaatttaggggttcaattggaatttattgcatcgtaaggtttgttagaataactgatttgtataagtatcaacctcccataaatcttgtatatacacttagaaatgtgaattgtatctaccttgattaagcaatcttttttggttaaaaaaaaaaaaaaaaaaaa

SEQ ID NO: 598 - protein, 466 aa, Panicum virgatum
  misc_feature: Ceres CLONE 1726241
  misc_feature (1)..(295): Pfam Name: Abhydrolase_1 Pfam Description: alpha/beta hydrolase fold
MPSLLSHRPPPAAAHLRAAAPAWTQPLHARRRAGPPQASASASASAEFPGSVPGGAQMPPLRRRRRSVAGIDQDELLDPEALADPDSSFYEINGVRLHHKVCSHEDEDSPSDQSSDATVSAPGQSRISLPILLLHGFGASVFSWSRVMRPLARIAGAKVLAFDRPAFGLTSRASWSGDDSKPLNPYSMAFSVMATLAFIDYLGAEKAVLVGHSAGCLVAVDAYFEAPERVAALVLVAPTIFAPRKGVKDSGTGEQEGQKQSVPNDENSPLNLFASIWGGFLALCKHIAGLVSKMIMAIGGVVQALYVKALVAFLRSSLGAMLIRWVMDKFGILGVRNAWYDASKVTDHVIQGYTKPLKSRGWETALLEHTISMIIDSASATRVPVSKRLSEISCPVLVVTGDTDRIVPAWNAERVAHAIPRASFEVIKSCGHLPQEERPEEFLSVVGRFLRTVFRTPNEQVFQAAV

SEQ ID NO: 599 - DNA, 2487 bp, Panicum virgatum
  misc_feature: Ceres CLONE 1726243
  misc_feature: Encodes the peptide sequence at SEQ ID NO. 600
atcacccccgggcctcgcaaaccctagctccgtcacgccgcggcgccatgtcgaagcggccaaagctcgaggggttcagcatcccgcggcctacctcctacagtttcgagcgctcgcagcccgtacctcggctctaccgtcctactgacgacccggacctcgacgacatcgccttctccgacgacgctcccacagacgcccccgcctccgctgcggcagccagcaagtcggaggatggggaggagatcgacccgctcgacgccttcatggcggagatccaggaggagatccgcgcgccgcccccgccgcccaagccggaggcgcttcgccgagcagactctgacgatgacgaggatgaccccgtcgagagcttcctgcgggcaaagaaagacgccgggctcgcgctcgccgccgacgctatgcgcgccggttacgactccgacgaggaggtctacgccgctgccaaggccgtcgacgccggcatgatggagtacgactccgacaaccccatagtcgtggacaagaagaaaatcgagcccataccagcactggaccactcgaccatcgagtacgatgccttcaccaaagatttctatgaggagaagccgtcaatttcaggtatgagtgaccaagaagtggcagattatatgaaaagtttggcaattagggtttctggttttgatgtgccaaggccaataaaaaacttcgaggattgtgggtttcctgtaccgttaatgcatgctattgccaagcaggcttatgaaaaaccaacaacaattcagtgccaggctttacctatcgtactttcaggcagagatatcattggaattgcaaaaactggttcaggcaaaactgcagcttttgtactcccaatgattgtacatattatggatcagcctgaacttgagaaagaagaaggaccaataggagtgatttgtgctccaacaagagaactggcccatcagatatatctcgaagctaagaagtttgcaaaaccttacaaccttcgagttgccgctgtatatggtggggtttccaaatttgaccagtttaaagaactgaaagcaggctgtgaagtagtcattgcaaccccagggagattaatagacttgctgaagatgaaggcattgaagatgttcagggcaacttatttggttcttgatgaagctgatcgcatgtttgatcttggatttgagccacaaataagatccattgttggtcaaatcagaccagaccgacaaaccttacttttttccgcaacaatgccatacaaagtggagcgtttggcaagagaaatattgactgatcctattagagttacagttggtcaagttggcagtgctaatgaagacattaaacaagttgtcaacgtactcccttctgatgctgagaaaatgccttggcttttggagaaattgcctgggatgattgatgatggagacgttcttgtatttgcatctaagaaagctagagtggatgagatagagaaagagttgaatcagagaggattcagaattgcagcacttcatggtgacaaggatcaagcttctcgtatggagaccctacagaagttcaaatctgggacctaccatgttctggttgcaactgatgttgctgcaagaggtcttgacattaagtcaattaaaacagttgttaactttgatattgcaaaggagatggatatgcatatccaccgtattggaagaactggccgtgctggggataaagatggcactgcatacactatgattacacagaaggaggcacgctttgctggtgaattggttcatagtttgattgctgctggtcaggatgtacccaatgaactcatggatctggctatgaaggatggaagatttagagcaaaacgggactccaggaaaggtgggaaaaaaggtggcaaaggaaaaggtgggggtgggggtgctgggcgcggtcgtggtgtgcgaggagttgattttggccttggcataggttacaatgctgaatctggttcacaagtgcctgctccgagaaccgctgctgtaaattcattgaagacggggatgatgcagcaatttaagagcagctttgtatctggatcttcgaatacaccaagcagcagcgcaccttcctttgtaagaccagcacttcgcggctttgtatctgggggcaccataggaggggacgcgcggccagcacaatcagccccctccttcgtccctgcatcccaaccagcacagtcggccctctccttcgttcctgcatcccagcctgcaggaaatagcaatgaaaatgggaaccaaaatccagaaagttcatgggatcggtccagggagagaaaacgaccatcgggttgggatcgctagtccccgttaaatgatgtaccaaattgtgatatcttttccccctttgttaaagcatattgatgtacactatagatcacatgatgtgaaattgtgaatgataagtgttgtttttactttttaaaaaaaaaaaaaaaaaaaa

SEQ ID NO: 600 - protein, 766 aa, Panicum virgatum
  misc_feature: Ceres CLONE 1726243
  misc_feature (1)..(172): Pfam Name: DEAD Pfam Description: DEAD/DEAH box helicase
MSKRPKLEGFSIPRPTSYSFERSQPVPRLYRPTDDPDLDDIAFSDDAPTDAPASAAAASKSEDGEEIDPLDAFMAEIQEEIRAPPPPPKPEALRRADSDDDEDDPVESFLRAKKDAGLALAADAMRAGYDSDEEVYAAAKAVDAGMMEYDSDNPIVVDKKKIEPIPALDHSTIEYDAFTKDFYEEKPSISGMSDQEVADYMKSLAIRVSGFDVPRPIKNFEDCGFPVPLMHAIAKQAYEKPTTIQCQALPIVLSGRDIIGIAKTGSGKTAAFVLPMIVHIMDQPELEKEEGPIGVICAPTRELAHQIYLEAKKFAKPYNLRVAAVYGGVSKFDQFKELKAGCEVVIATPGRLIDLLKMKALKMFRATYLVLDEADRMFDLGFEPQIRSIVGQIRPDRQTLLFSATMPYKVERLAREILTDPIRVTVGQVGSANEDIKQVVNVLPSDAEKMPWLLEKLPGMIDDGDVLVFASKKARVDEIEKELNQRGFRIAALHGDKDQASRMETLQKFKSGTYHVLVATDVAARGLDIKSIKTVVNFDIAKEMDMHIHRIGRTGRAGDKDGTAYTMITQKEARFAGELVHSLIAAGQDVPNELMDLAMKDGRFRAKRDSRKGGKKGGKGKGGGGGAGRGRGVRGVDFGLGIGYNAESGSQVPAPRTAAVNSLKTGMMQQFKSSFVSGSSNTPSSSAPSFVRPALRGFVSGGTIGGDARPAQSAPSFVPASQPAQSALSFVPASQPAGNSNENGNQNPESSWDRSRERKRPSGWDR

SEQ ID NO: 601 - DNA, 1497 bp, Panicum virgatum
  misc_feature: Ceres CLONE 1726259
  misc_feature: Encodes the peptide sequence at SEQ ID NO. 602
aaaacaagcgtctttcctcccaaaacacgcgaaaacctcctgtcggctgcccccaactcccgcctccacccatggcgtccctcccgaacgccgccgccgccgccgccgccgccggctcctccggcgcgcgcccggtggacaaggaagtggacttcgccaactacttctgcacctacggttacctctaccaccagaaggagatgctatgcgaccgcgtccgcatggacgcctaccactcctccgtcttccgtaacgctccccacttcgagggaaaggtagtccttgacgtgggtaccgggagcggcatccttgccatctggagcgcgcaggccggggccaggaaggtttacgctgtcgaggcgactaatatggcggagcacgcgcgggagctcgcgtgtgccaacggtgtggcggatatcgtcgaggtgatacagggcaccgtggaagacgttcagctgccggagaaagttgatgtcattatatcagaatggatgggctactttcttttgagagaatccatgtttgattctgtcatttgtgctcgtgatcggtggttgaagccagatggtgtgatgtatcctagtcatgctaggatgtggctagcacccataagaacgggtttgggtgacaaaaagatggaagacttggatattgctatggatgattggaatctatttgttcaggacactcaaacttattatggggtcaatatgaatgccttaacaaagccatatcgtgcagaacacgaaaaatactatctcaagtcttcgatatggaacaatcttcatccaaaccaagtcattggccaacctgcagttattaaggaaattgattgcttaacagccactgttgatgagattcgagaagttagagcacaagttatgttgccaatcagcatggaaggagctagattatcagctctggctggatggtttgatgttcacttcagaggtagtgcgcaaaaccttgcagtggaggaagttgagttaaatacagctccagatgagcagggggggactcattggggccagcaggtattcttgctgactccacctctgaaagtatctaaaggagacaatgttaatgtttccttctcgatggttcgctcaaaggaaaatcatcgactgatggatatggagttcacatatgaattgcatgaattctctggcaggaagcatccagcaatcacaaccaagatgtacttggagtagagcaagaatgctgactatacctggttcattcgatgaaagacggggcaccgattaccaattgtccgggtgtcgctgtcgctgaacctttaaatctttgctcagaagctgagcaactgtaatccctagtatgatgtgtggtattcatagatggcctcaaggccttgatttgtacaaggataccatgaggcatgatgtagtgccagagattttgttgtattgataatatcttattgtttgattactcgagtagtggagccattgttcctcaaaaaaaaaaaaaaaaaaa

SEQ ID NO: 602 - protein, 379 aa, Panicum virgatum
  misc_feature: Ceres CLONE 1726259
  misc_feature (1)..(99): Pfam Name: Methyltransf_12 Pfam Description: Methyltransferase domain
  misc_feature (1)..(100): Pfam Name: Methyltransf_11 Pfam Description: Methyltransferase domain
  misc_feature (4)..(76): Pfam Name: MTS Pfam Description: Methyltransferase small domain
MASLPNAAAAAAAAGSSGARPVDKEVDFANYFCTYGYLYHQKEMLCDRVRMDAYHSSVFRNAPHFEGKVVLDVGTGSGILAIWSAQAGARKVYAVEATNMAEHARELACANGVADIVEVIQGTVEDVQLPEKVDVIISEWMGYFLLRESMFDSVICARDRWLKPDGVMYPSHARMWLAPIRTGLGDKKMEDLDIAMDDWNLFVQDTQTYYGVNMNALTKPYRAEHEKYYLKSSIWNNLHPNQVIGQPAVIKEIDCLTATVDEIREVRAQVMLPISMEGARLSALAGWFDVHFRGSAQNLAVEEVELNTAPDEQGGTHWGQQVFLLTPPLKVSKGDNVNVSFSMVRSKENHRLMDMEFTYELHEFSGRKHPAITTKMYLE

SEQ ID NO: 603 - DNA, 1594 bp, Panicum virgatum
  misc_feature: Ceres CLONE 1726265
  misc_feature: Encodes the peptide sequence at SEQ ID NO. 604
aatagacagacagctacagctcggcgccccaccccaaaagtccaaagcaccaccagccacgcagtcacctccatcttcctcgaacgcgccggcgcctcgtgccctcgtctcaccgcgccgcctggcctcgcccagtcgccgtcgccggcggccgatcgacgcgtcgcgccttcggatccggtcaccctgaagggagcgatgggggagaagcgcgcggtgctggtggggatcaactacccgggcaccaaggcggagctcaagggctgccacaacgacgtcgcgcgcatgcgccgctgcctcgtcgaacgcttcggcttcgacgagtccggcatccgcgtcctcgtagacgacggctccgggccgcagcccacgggggccaacatccggcgggagctccagcgcctcgtcggggacgcggcgcccggggacctgctcttcttccactacagcgggcacggcgcgcggctgcccgccgagaccggccaggacgacgacaccgggtacgacgagtgcatcgtgccctgcgacatgaaccttatcacagaccaagatttcacggagcttgtgcgaaaagtccccgagggatgtctgttcaccatagtatctgattcgtgccacagtggtggactacttgacaagaccaaggagcagattggacacagcaccaagcagaaccaggccgagcggtctgattccggcagcagcggcggcttccgttcattcctcaaaggggctgtccgggacgtgttcgagtcccagggaatccacttgccccaccgtagccaccggcagagcgatgacggggacgatggtgacgaggagccccgctacatcgacacagcagacgcccatgtcaagaaccggtcgctacctctctcgacactgatcgagatgctcaaggagaagaccgggaaggacgacatcgatgtgggctcgctccggctgacgctctttgacctcttcggagacgacgctagccccaagatcaagaagttcatgaaggtcatgctgaacaagctccagcagggccagcacggcggcgtcgtgggcttcgtgggcgccctggcgcaggaactcctgaaagcgaagctggacgggaagcaggagcagctcgaggcggccatggaacaggaggtgcacagcgagcaggaggtgtccgcggggacgacggccagggtgccgagcaacggcgtcctgatcagcgggtgccagaccgaccagacctccgccgacgcgaccacgcccaagggctcctacggcgcgctcagcaacgccatccaggccatcctcgcggagcacgggacggtgacgaacacggagctcgtgatgaaagctcgcaagatactgtcgaggcaggggtacacccagcagcctggactttactgcagcgatgagcacgccagtgtggctttcatatgctgaagcatcgatttatgtcgtgtcgacttcaatctttgtacgctgttactgtctgtggactatggagtgttgtgggttggtggttacgctattgagatctgggaattaaagtgtctgcaggttatattgaagcacattatcggcacatttcgtttaaaaaaaaaaaaaaaaaaaa

SEQ ID NO: 604 - protein, 407 aa, Panicum virgatum
  misc_feature: Ceres CLONE 1726265
  misc_feature (1)..(412): Pfam Name: Peptidase_C14 Pfam Description: Caspase domain
  misc_feature (1)..(414): Pfam Name: Peptidase_C14 Pfam Description: Caspase domain
  misc_feature (1)..(413): Pfam Name: Peptidase_C14 Pfam Description: Caspase domain
MGEKRAVLVGINYPGTKAELKGCHNDVARMRRCLVERFGFDESGIRVLVDDGSGPQPTGANIRRELQRLVGDAAPGDLLFFHYSGHGARLPAETGQDDDTGYDECIVPCDMNLITDQDFTELVRKVPEGCLFTIVSDSCHSGGLLDKTKEQIGHSTKQNQAERSDSGSSGGFRSFLKGAVRDVFESQGIHLPHRSHRQSDDGDDGDEEPRYIDTADAHVKNRSLPLSTLIEMLKEKTGKDDIDVGSLRLTLFDLFGDDASPKIKKFMKVMLNKLQQGQHGGVVGFVGALAQELLKAKLDGKQEQLEAAMEQEVHSEQEVSAGTTARVPSNGVLISGCQTDQTSADATTPKGSYGALSNAIQAILAEHGTVTNTELVMKARKILSRQGYTQQPGLYCSDEHASVAFIC

SEQ ID NO: 605 - DNA, 1742 bp, Panicum virgatum
  misc_feature: Ceres CLONE 1726273
  misc_feature: Encodes the peptide sequence at SEQ ID NO. 606
acttcacccgccattcacacatctgcacaatcaaggaaaagcttccgcgaccactgccccgccggcaatgcagagcccggcagcgctcggcatcggcggcgacgccagcccgcacgtcatgttcatccccagcgccggcatgggccacctgctcccattcttccgcgtcatcgccgctctcgcgaaccacgacggcgtcgacatctccgtggtgaccgtccttcccaccgtgtcggccgccgaggccgaccacctcgccggcctcttcgcggcgttccccgccgtccgccgcgtcgacctccacctcctgccgttcgacgacgcgtccgagttctcgggccacgacccgttcgtgctccggtgggaggccctgcgccgctccgtgcacctcctccggccgctcatcgccggcgccccgcgcgtctcggccgtcgtcacggacgtgaccctggcctcgcacgtcatccccatcgccagggagatccgcgtcccgtgccacgtcctcttcgtctcctgcgtgaccatgctctcgctcctcgcgtacgtcccggtccacctcgccggcgacaagaaggccgagctggggcctggggtcggcgccggcgacgtcgacatccccggcgtgcggcgcatcccgcagtcctgcctcccgccgccgctgctcgacctgagcagcctcttcgccaagcagttcgtcgacaacggccgcgcgatcaccagcgccgacggcatcctggtcaacacgttcgaggccctggagccggcggcgctcgccgccctgcgagacggcaaggtcgtcccggggttcccgccggtatacgccgtcggcccgctcaagccgcacacgtcgtcgtctccggcgaccgacgacacgaataagccggtgggctcgggctcccccgccgcctggcttgacgagcagccaccgcgatccgtggtgtacgtcgcgttcggcaaccgcagcgccgtgggccgggaccagctccgggagatcgccgccgggctggaagcgagcggctgccggttcctctgggtgctcaagacgacgacggtggacagggacgacgccgccgagctggcggacgtgctcggcggcgggttcctggagcgcgtgcggcaggggcggcgcggcctggtgacgaaggcgtgggtggaccaggaggccctgctgaggcacccgtccgtggggctgttcctgagccacggcgggtggaactcggtgacggaggcggccgccgccggggtgccgctgctggcgtggccgcgcatcggcgaccaacgcgtgaacgccgcggtggcggcgagcggcggcgccggggtgtggatggagcgctggagctgggacggggacggggaggggaggctggtgagcggggaggagatcggccggcgagtgaaggaggtgatgtccgacgcggcggtgagggcgagggccgccaggaccggcgaggcggcggccttggccgtcgctgagggcggcacgagctaccgaagcatgcaggcgtttattagcaagctcaaggcaacctaagtaatcatttgtctttcatatccagctattttgtgatgcctctgtcgtgctgctgctacctagctactaagagtgagcctactatcaagaaataagtacatgtgagcctactaagtgtgcatgtacagtgttgtatattcagatcctgtcaacaatttatgttttaccgtacgataaatacattgttgtacaaaaaaaaaaaaaaaaaaaa

SEQ ID NO: 606 - protein, 487 aa, Panicum virgatum
  misc_feature: Ceres CLONE 1726273
  misc_feature (8)..(149): Pfam Name: UDPGT Pfam Description: UDP-glucoronosyl and UDP-glucosyl transferase
MQSPAALGIGGDASPHVMFIPSAGMGHLLPFFRVIAALANHDGVDISVVTVLPTVSAAEADHLAGLFAAFPAVRRVDLHLLPFDDASEFSGHDPFVLRWEALRRSVHLLRPLIAGAPRVSAVVTDVTLASHVIPIAREIRVPCHVLFVSCVTMLSLLAYVPVHLAGDKKAELGPGVGAGDVDIPGVRRIPQSCLPPPLLDLSSLFAKQFVDNGRAITSADGILVNTFEALEPAALAALRDGKVVPGFPPVYAVGPLKPHTSSSPATDDTNKPVGSGSPAAWLDEQPPRSVVYVAFGNRSAVGRDQLREIAAGLEASGCRFLWVLKTTTVDRDDAAELADVLGGGFLERVRQGRRGLVTKAWVDQEALLRHPSVGLFLSHGGWNSVTEAAAAGVPLLAWPRIGDQRVNAAVAASGGAGVWMERWSWDGDGEGRLVSGEEIGRRVKEVMSDAAVRARAARTGEAAALAVAEGGTSYRSMQAFISKLKAT

SEQ ID NO: 607 - DNA, 2263 bp, Panicum virgatum
  misc_feature: Ceres CLONE 1726295
  misc_feature: Encodes the peptide sequence at SEQ ID NO. 608
ggcctcccgcaacaagcggaggacgattatattaaaaaaaaaaacaagcggaggacgccggcctccatccacggggtccctccgccgacagcctcttccacgctcctgcggaggcttgactccctctccatcagacgccgcccgcctctctaccacctccctccttaatcccgcgaccgcaaccaccgtttcccaaccggacgccgccgtcttccttctacctcccgcggccgctgtcctctcgaaggcctgcacacggtttgaagggaaggataattgcggtgctgtgtttgatttcactgcgaggagtgagatgaggctaagtattggacaagtccatcgaaatgttcttgcgctggcatcttcccgatcgggctttgttcttggagaccgtctttcattcaggatgctgtcacaaccacgggcagctggatttcatcagactgcttggcgtggtagtcaaattgtagaagataagggagggccattaactcttgctagcttagaagtgcaaaacagggttgaatatgtgaataaggaaaaaatggcacgaactggaggtccgaagcaaagttcgagaggttcttcttccctcaaggtgaaacctagtgtttcttcgcttaatgtcaaaccagtgaagactgcattgccaaagtcagctgggataaagaagagactgaaggtagatgaggctatgttttctgccaagtcatttgaagagcttggtttgccgcctttgcttgttgaccggttgaacaaggagggtctagctgcgccaactgaggtccaatctgctgctattcctataatagcacaaaagcatgacgtggtgatccaatcatatactggctcagggaaaacacttgcttatcttctcccaattctttccgaaataggcccactgacgaggcctatggggcaagataattctgagaaaagatcaggtattgaagcagttattgttgctacttccagagaattaggaatgcagattgtgcgagaagtagagaagattttgggtcctaacgataagagacttgtccagcaacttgttggtggtgctaatcgttccagacaagaagaagcattgaagaagaacaagccaatcattgttgttggtacacctggtcgtatatctgaaatttctgcagcaggtaagctacacacccatagctgccgcttccttgtactggatgaagttgaccagcttttgtcttttaattaccgtgaggatatgcatagaattttggagcatgttggaaggaaatctggttccacatctagggatattcttggcccacttgctaggcgttctgagcgccaaactatcttggtttctgcaacaattccattttcagttatacgagcagcaaggagttggggtcatgatccagctcttattagagctaagagtgtagttccgcttgactcaatcactgttccaagacctgcgttatcccaaactgatgctaactccagctctccatcaaactcagtgaaccaagctgctgttggcagcttgccgccatcattggaacactactactgtacagccaaggcacaacacaaagttgacaccttacggagatgcatccatgccctggaagcacagacagtgattgcatttatgaacaacacaaagccactgaaggatgttgtatttaagttggaggcccgtggtatcaaatccactgaactacatggggatcttgggaagcttgcaaggtctacagtcttgaagaagttcaaagacggagaatacagagttctggttacaaatgagctgtctgccagaggactggatgtgccagaatgtgaccttgtggttaatctggaccttccaactgattctacacattatgcccacagagctggaagaactggacgtcttgggcggaaagggattgtggtcacaatatgcgaagaaaacgaggcattcgttgtaaggaaaatgcgcaagcaattggctgtgcccatcaagccatgtgaattcactgaaggcgagcttgttgttcataaggaggaagatgtggaataaattttcctagtttgcattattacatctgtttacatgtagctttttgtaatatgattttgcaaattcaactgttagtactccactggcctttgcttgtcctgctggatatttatataggctgggtttttctttttcgaaacacatgtctgcaaccaaattaagtcatagctacctcttaacttctgcagggagctattttctgcggaaaaaaaaaaaaaaaaaaaa

SEQ ID NO: 608 - protein, 574 aa, Panicum virgatum
  misc_feature: Ceres CLONE 1726295
  misc_feature (1)..(77): Pfam Name: Helicase_C Pfam Description: Helicase conserved C-terminal domain
  misc_feature (1)..(198): Pfam Name: DEAD Pfam Description: DEAD/DEAH box helicase
MRLSIGQVHRNVLALASSRSGFVLGDRLSFRMLSQPRAAGFHQTAWRGSQIVEDKGGPLTLASLEVQNRVEYVNKEKMARTGGPKQSSRGSSSLKVKPSVSSLNVKPVKTALPKSAGIKKRLKVDEAMFSAKSFEELGLPPLLVDRLNKEGLAAPTEVQSAAIPIIAQKHDVVIQSYTGSGKTLAYLLPILSEIGPLTRPMGQDNSEKRSGIEAVIVATSRELGMQIVREVEKILGPNDKRLVQQLVGGANRSRQEEALKKNKPIIVVGTPGRISEISAAGKLHTHSCRFLVLDEVDQLLSFNYREDMHRILEHVGRKSGSTSRDILGPLARRSERQTILVSATIPFSVIRAARSWGHDPALIRAKSVVPLDSITVPRPALSQTDANSSSPSNSVNQAAVGSLPPSLEHYYCTAKAQHKVDTLRRCIHALEAQTVIAFMNNTKPLKDVVFKLEARGIKSTELHGDLGKLARSTVLKKFKDGEYRVLVTNELSARGLDVPECDLVVNLDLPTDSTHYAHRAGRTGRLGRKGIVVTICEENEAFVVRKMRKQLAVPIKPCEFTEGELVVHKEEDVE

SEQ ID NO: 609 - DNA, 2157 bp, Panicum virgatum
  misc_feature: Ceres CLONE 1726304
  misc_feature: Encodes the peptide sequence at SEQ ID NO. 610
atttctactaggatgtactgtaccacgattgctcttgttcagctcgcgtggttttggtgactgtctgtgctaatatccactgatgccgatccttataagttattaccttgattcattgtagctgtaccgaatctgtaggtttcgtagtatgtttcttctgttggggctttgacttccagttgagctctgctttagtgaaagtctgaaactttcctgaatacaagcatctccattggttgactttcgagtttgctgagcagcaaggataaggacaagcgcatggagtgctcttggttctctgggatgatgaggcgcaggcagctcttgctggcgaccgcctgcttgtgggctctgtcgtgcgcctcgctgctccgtgcttccacccctgacgggcttctcagggtcagcctgaacaaggacaagctcgaccgcgaggcgctggccgcggccaaggttggcaggcagcacgacagccgccgcctgagggctgccggcggcgacgaggtccctctcatcgactacctcaacacccagtacttcggggtcatcggcatcggcacgccgccgcagaacttcaccgtcatcttcgacactgggagctccaacctctggatcccctcctccaaatgttatttctcgatagcatgctacttccaccacaaatacaagtccagcaagtctagcacttacaaggctgatggggagacttgcaaaattacttatggctctggatcaatttccggattcttcagcaaggataacgtgcttgttggagaccttgttgttaaaagccagaagttcattgagactactcgcgaacccagtttctcattcatccttgggaagtttgatggcattcttggtcttggataccctgaaatctctgtcggcaaagctcctcccatttggcagagcatggaagagcagaaacttcttaaggacaacgtcttctctttttggctcaaccgaaaccctgatgcatcttccggtggcgagcttgtctttggcggcgtggaccctaaacacttcaaggggaaccacacctatgttcctgtttcccgcaaaggttactggcagttcaacatgggggatctcctcattgatggtcactcaactggtttctgtgcaaaaggctgtgctgctattgccgactctgggacttctttgttggctggtcctacagctatagttgctcaagtgaaccatgcaattggggcagagggaattatcagcacggaatgcaaagaagtggtgagccagtatggagagatgatcctcaacttgctcatagcacagacagatccacagaaagtttgcagccagattggtctgtgcatgtttgatggtattcagtctgtcagtgaaggaattgaatctgttgtcgggaaagaaaacctgggctcagatgttatgtgcacagcctgtcagatggctgttgtgtggatagagaatcagctccgtgaaaacaaaacaaaggagataatattgcaatatgctaaccagctatgtgagcgtctaccaagtcccaatggcgaatcaacagtcagctgccatcagatatcaaagatgccaaatctttcattcactattgcaaacaagagcttcaccctaacaccagagcagtacattgtgaagctggagcaaggagggcaaactatctgcatcagtgggttcatggcattcgacataccacccccgcgtggtcctctctggattcttggggatgtcttcatgggagcttaccacacagtgttcgactttggcaaggacaggatcggcttcgcggaatctgcattagtgtgtcagcactctgctccgttagtgtagcttctctatcagctacatgcaggcagtacactgcaaataaatggatcgcgaaaaatgctaaaaccgggaacatgatttagcacacgggcagacctttctttctgaaaaagactaaatgaatgcttggagagctatgcttgaagatatgtatgcttgatgtttactgaagaaaggaacactgagaaataatatcatgctcatgtcatcccatcttgaaaattgtgtgatcatatttgtacaagctatcgtttgtaaaataacttctggattgacttggaactgatgtgcatgttacaatgcaatttgcttcaaaaaaaaaaaaaaaaaaaa

SEQ ID NO: 610 - protein, 515 aa, Panicum virgatum
  misc_feature: Ceres CLONE 1726304
  misc_feature (1)..(387): Pfam Name: Asp Pfam Description: Eukaryotic aspartyl protease
  misc_feature (1)..(411): Pfam Name: Asp Pfam Description: Eukaryotic aspartyl protease
  misc_feature (1)..(401): Pfam Name: Asp Pfam Description: Eukaryotic aspartyl protease
  misc_feature (1)..(425): Pfam Name: Asp Pfam Description: Eukaryotic aspartyl protease
  misc_feature (1)..(420): Pfam Name: Asp Pfam Description: Eukaryotic aspartyl protease
  misc_feature (1)..(424): Pfam Name: Asp Pfam Description: Eukaryotic aspartyl protease
  misc_feature (10)..(505): SWISSPROT Homolog: EC 3.4.23.40 Phytepsin precursor
MECSWFSGMMRRRQLLLATACLWALSCASLLRASTPDGLLRVSLNKDKLDREALAAAKVGRQHDSRRLRAAGGDEVPLIDYLNTQYFGVIGIGTPPQNFTVIFDTGSSNLWIPSSKCYFSIACYFHHKYKSSKSSTYKADGETCKITYGSGSISGFFSKDNVLVGDLVVKSQKFIETTREPSFSFILGKFDGILGLGYPEISVGKAPPIWQSMEEQKLLKDNVFSFWLNRNPDASSGGELVFGGVDPKHFKGNHTYVPVSRKGYWQFNMGDLLIDGHSTGFCAKGCAAIADSGTSLLAGPTAIVAQVNHAIGAEGIISTECKEVVSQYGEMILNLLIAQTDPQKVCSQIGLCMFDGIQSVSEGIESVVGKENLGSDVMCTACQMAVVWIENQLRENKTKEIILQYANQLCERLPSPNGESTVSCHQISKMPNLSFTIANKSFTLTPEQYIVKLEQGGQTICISGFMAFDIPPPRGPLWILGDVFMGAYHTVFDFGKDRIGFAESALVCQHSAPLV

SEQ ID NO: 611 - DNA, 1827 bp, Panicum virgatum
  misc_feature: Ceres CLONE 1726313
  misc_feature: Encodes the peptide sequence at SEQ ID NO. 612
atgatcgccgctttgcctcttgatccgatcccttcgaattaattgcccgctacacactgctgccgttctcctcctcgctcccctctccacatctcatcctgatctccactcactcatcatcacctagctagctgctactacctagccagccatagctccatccggggatctcgagcgcaagttcctctcgctcccatgtctgccatctacatgagccagctctccactgccctccctctcatggagggagctgatcaccaccaggatcaccaccaccaccaccaaggccacttccaggccttcaccctccccaaggatcccccgatcctgttcccctttgtgatcagcagcagcagcagcgccagcgagagcagcctgagctatggatcgccagaaggccatcatcacttgttcaggcagcagcatcaagctatgctggagccccaacatatgatcggcggatcatcgtctgccagtgtctttgcgacgccgttcccgaccgtggagagcatccgggacgacatgatcgagccgtcctcgtacgatccatacgatatggggaggctgcaggtcgttggatcacttgagactgccggaagctggacgccgccggccaagatgaggatcacgaggaaggcgaccgccgatcctggtgcggcggcgaagaagcccaggaggaaggcgcaagggtacgaggacatgatgagcatgggtggccagccaaatctgggtgttattagggtgtgctccgactgcaacaccaccaagacgcccttgtggaggagtggtccttgcggccccaagtcgctgtgcaacgcgtgcggcatcaggcagcggaaggcgcggcgggcgatgatggcctccggcggtggcggatcagggccggtgccggccgacggcgccaaagcagccacggccacgcccaggggcgccatggccgcaccagcacacccgaaggtgaagaaggagaagagaggggacctggaccggtcgctgccgttcaagaaacggggcaaggtggtccaggatcacgctggcgccgccgcccctcctgctgccgctcacaaggccgtcgtccagcccgccgccgaggttgctgatgacgccggtccgagcagcagggacctcgtcgacaacattgggctcctcagctggagcaggagcccaccagctcccccatctgccgccgctgcttcctgcagcttccgagcgtcgccgggcctgccggtgcagcaggacgagatcacggatgccgccatgctgctcatgacgctgtcctgcgggcttgtccggagctgatgatgatcgatctacctctacacaccaggcacgcacgacgaccagcaccgtataggccttttgcagcagctaggccggtgcctttgattgttagtgttaccgtcgtctaccttccgcgctgtagtgtttttttggcttcttgttcgtggtgccagtgtaacccgtgtcactgttcgaatcatgtgattcgttcgtgtatgtgagagagatcagagagagggggaagagttgagatgataggagcgagaagatcacgagcgagggaagtaataaggcaaaatcgtgagattaccatctagctagaatatagctaggatataattattgcatgtagtgtgaggagtttcagttttgagtaatagtttttttctgtgtgctggggctataaaaaacattggtcgctggctgctagtaggctgctagatgtatttttgttctttgttgttttggttcagtttcttgtactggagctaaaaataatagcaatatgcatggagagaggtcgagcaaaaaaaaaaaaaaaaaaaa

SEQ ID NO: 612 - protein, 367 aa, Panicum virgatum
  misc_feature: Ceres CLONE 1726313
  misc_feature: Great-hit functional homolog of the protein sequence given in SEQ ID NO 9296
  misc_feature (1)..(36): Pfam Name: GATA Pfam Description: GATA zinc finger
  misc_feature: Useful for making plants with modulated biomass
  misc_feature: Useful for making plants with modulated low light sensitivity
  misc_feature: The plant is abnormally small.
MSAIYMSQLSTALPLMEGADHHQDHHHHHQGHFQAFTLPKDPPILFPFVISSSSSASESSLSYGSPEGHHHLFRQQHQAMLEPQHMIGGSSSASVFATPFPTVESIRDDMIEPSSYDPYDMGRLQVVGSLETAGSWTPPAKMRITRKATADPGAAAKKPRRKAQGYEDMMSMGGQPNLGVIRVCSDCNTTKTPLWRSGPCGPKSLCNACGIRQRKARRAMMASGGGGSGPVPADGAKAATATPRGAMAAPAHPKVKKEKRGDLDRSLPFKKRGKVVQDHAGAAAPPAAAHKAVVQPAAEVADDAGPSSRDLVDNIGLLSWSRSPPAPPSAAAASCSFRASPGLPVQQDEITDAAMLLMTLSCGLVRS

SEQ ID NO: 613 - DNA, 1167 bp, Panicum virgatum
  misc_feature: Ceres CLONE 1726318
  misc_feature: Encodes the peptide sequence at SEQ ID NO. 614
actcgcagcccgctccgcctctgctcctagcttccggcccccacgcaacgctccccggcgatgtcgtcgccggcgccgcccgacgactgcgagggggaggggagcggggggaggtcgttgagctacggggaggcggagtactgggacgcgcggtacgtcgaggagggcggcgcgccgtacgactggtaccagcgctacgacgcgctccgccccttcgtcctccgcttcgcgccgccggcgtcccggctcctcatgattggatgcggctccgctcttatgtccgaggacatggtcaccgatggttatgtggagattgtgaacattgacatttcttcggttgtgattgagatgatgagaaagaaatatttcaacattccgcagctgcaatacctgcgcatggatgtcagagatatgagtatgtttcctgatgaatcgtttgattgtgcaatcgataaaggtactctggactcattgatgtgtggtgtggatgctcctctcagtgcagctcagatggttttggaagtggacaggcttcttaaaccaggcggtgtctttattttgataacatatggtgatccatcagtgcgtgttcctcatttgaatcaaccaggatgcaaatggaagattgtactttacattctaccaagacctgggttcactggaaagataaggaggcatgtattggatcctgttccactgacagagaggggtagactccctgatggatttgttccagaggatcctgactcccattatgtctatgcctgcgaaaagatgcaaggattgacatgttcagcttccccaaccgtagagaggcaaggggaagaatagatgatttcatcccacaagatttgtggattatgtgatttatacatgatcagatgacgcgatgttgccaccattgttatggccatccagatagagcaagcatgccattgcatgcatttatatttaacaaatcttgcaagaatcagggtgtcgatgtgttgtgcaaccactgtttttctctctcatttttgtatcgtcttggaagcacaaaagaatcatttggtagattcgaggaaggaaatttttcattaggagaaaggaattggcctttttcaaggaatactctattttgtttatgtggaagtgaaattctttatctctgcaagaactgctttcact

SEQ ID NO: 614 - protein, 256 aa, Panicum virgatum
  misc_feature: Ceres CLONE 1726318
  misc_feature (1)..(104): Pfam Name: Methyltransf_11 Pfam Description: Methyltransferase domain
MSSPAPPDDCEGEGSGGRSLSYGEAEYWDARYVEEGGAPYDWYQRYDALRPFVLRFAPPASRLLMIGCGSALMSEDMVTDGYVEIVNIDISSVVIEMMRKKYFNIPQLQYLRMDVRDMSMFPDESFDCAIDKGTLDSLMCGVDAPLSAAQMVLEVDRLLKPGGVFILITYGDPSVRVPHLNQPGCKWKIVLYILPRPGFTGKIRRHVLDPVPLTERGRLPDGFVPEDPDSHYVYACEKMQGLTCSASPTVERQGEE

SEQ ID NO: 615 - DNA, 2610 bp, Panicum virgatum
  misc_feature: Ceres CLONE 1726319
  misc_feature: Encodes the peptide sequence at SEQ ID NO. 616
tgcgtggacctcgccctcatctcgtcgccttcgcctgcccccccaataattccaccgccgcacaagctcctgccttcgactcgccgccgcccaccgccgccgccgccgattcgctctgctctgacctctgaccagtccaatatcgccggagggagaaccgccagcagaagcagcgccggaaagctgcgagcggcacccctgcctccggccaccgccggggataaagtggggccggtaggggagtcctagggggtgcaaaagggatcggatcgggagagatgaagctatcaaattcttcttcgtccgccgtcgttcctgctaccgccgccgcaactaaccctaggatcattatctcttatctcgtttgtgatccgactctttttcgttttagccctgttgacaatgaggttgagcttcttcagaggtttttctcttagattagtgtaaatattagacttgttcgggtttagcttggttggaagaattagtctcttgtccgtgttcatttctgctagcaataatggctgcgatgaacgaaaaggtattgggtaaatgtggaaggaatgtaagtagtctcaagagaaagtgggagagccccgctgcatatgatgctgaggcctgccgcacctctgaattgcatcagcgtcctgccgatgattctgctgttaggtttcatgttgatcaagaccgcaaggcaaagattgtgtggcacttcaacaagcaggttttgcagagctataagaatttcatgactagcgcaccacctaagcgtattctgcttcgccaaggtgctgactggaaagactttccagaaaagattgtcaagttagcccgagctgacttcagggaaaaaaagactatcactgaaactggatatcggaaccagctttttttgctagattttgtgcatatgacattcatagactcgaagacaggtcttcagaggccgatagcttggatcgatgaaaatggaaagggttacttcccagaaacatttctgcaagatcagaagttatttatgaagaaagattttggcaacggaaatcatgagtacattagtgtggagccaaatgggacacgagaaatgaatggacatcttggaacttcagaaagttctgcggaaagctcaaatttcgatccgagcactgaagatgtttccagtcctaagagagctagggctgaaaagagttccataggaaaaagttatggtgatattagcgaagctgttggagaaaatgagccatgcacattgttgcccacagccaatctgctgtcacaccaagctaatctgggtgaggtatcacgtgctcagcgcacgatggaagccgtggagaaactgttgttacaggggatgggttctgttattgaatccaaggacatcattggaatctacagaactccaattttggatgattgcggacaagtccgttaccatctccaccaaaagcaagtacatgttactggatgtaaccgtgaaaatgcaaatgtccgttatgcatggcttgcttgctccaaaagcactgtgcatgaaatgatgctgaatggagttttgcaagttcataaacccatcaagtgcccagcctatggagagggcaccctccttacaccagcaaatcgttctgatacctgtgtgaaatactctgatgttgatgaaaatggcattgtccatatgatgttgtgccgtgttataatggggaacgtagaaatagttcaccctggatctaagcagcaccgacctagtagtgactattttgatagtggagtagatgaccttaaaaacccacaacattacattgtgtgggatatgaatctgaataggcacatctattctgagtttgtagtcaccatcaaaatgccgtccataaccaaagattcccttgtgactcaagaagattgtcagaattcatctgatgtgtcactggtcgtgaattcacacgactgtttgtcagaggagatgaaccttgaggcacctccagcattgggaggtggatgtgcagcccccatgctaggagattcgatggaaaaggctccaagctcaccttggatgcctttctccatgttgtttgcagcaatttcgaccaaagtgtctcctgagaatatggacatggttattggttgttatgaagaattcaagagcaagaaaataagtcgagctgaactagtaaagaagctgaggcatgtagttggtgatagagtgctaatatcgacaataatgcggctccaagataagcagttacctccagtggggaggcgcgaggcacccaacgcatcggcggccaagatgatggcgaaaccgtgaagtggggtcagtgggcgagggagataaaaggagcaactggccgacttgacatagaaatgcagcagtgatgaagcctcttgcgtcagtctgtgtatggctgctgtttgttcttttggtggtgaagaatttgtatcttgtgcttttcgttgcgaataggaaacaatgcgtgcagtgcttgtgaaccgattattcggtttaccagagagaaaaagcctccttgtttaccttcccgtttaccctttttataagagaacatcgagtcagatattgttaatcaatgttgtcttgtgcaaaaaaaaaaaaaaaaaaaa

SEQ ID NO: 616 - protein, 592 aa, Panicum virgatum
  misc_feature: Ceres CLONE 1726319
  misc_feature (1)..(189): Pfam Name: PARP Pfam Description: Poly(ADP-ribose) polymerase catalytic domain
MAAMNEKVLGKCGRNVSSLKRKWESPAAYDAEACRTSELHQRPADDSAVRFHVDQDRKAKIVWHFNKQVLQSYKNFMTSAPPKRILLRQGADWKDFPEKIVKLARADFREKKTITETGYRNQLFLLDFVHMTFIDSKTGLQRPIAWIDENGKGYFPETFLQDQKLFMKKDFGNGNHEYISVEPNGTREMNGHLGTSESSAESSNFDPSTEDVSSPKRARAEKSSIGKSYGDISEAVGENEPCTLLPTANLLSHQANLGEVSRAQRTMEAVEKLLLQGMGSVIESKDIIGIYRTPILDDCGQVRYHLHQKQVHVTGCNRENANVRYAWLACSKSTVHEMMLNGVLQVHKPIKCPAYGEGTLLTPANRSDTCVKYSDVDENGIVHMMLCRVIMGNVEIVHPGSKQHRPSSDYFDSGVDDLKNPQHYIVWDMNLNRHIYSEFVVTIKMPSITKDSLVTQEDCQNSSDVSLVVNSHDCLSEEMNLEAPPALGGGCAAPMLGDSMEKAPSSPWMPFSMLFAAISTKVSPENMDMVIGCYEEFKSKKISRAELVKKLRHVVGDRVLISTIMRLQDKQLPPVGRREAPNASAAKMMAKP

SEQ ID NO: 617 - DNA, 1930 bp, Panicum virgatum
  misc_feature: Ceres CLONE 1726321
  misc_feature: Encodes the peptide sequence at SEQ ID NO. 618
agctggaggtgcagcaccgagccatgagccatccgtccccggcaggctagcggctaagacaagaggcctgccagccagtgccagccgcgagccaatgggttgccgcgggggcgctaggctgctgccgctcgtgaggcgcctctgcttcgtcgtcgtgctcctgtgcgccccgtgcctctgctccgtctccgctgccaagaggacgccgcgtcccgcggtgaagccaccgccgtcgccggcgccggcgtacccggctctccccgtccgagcggtgtgcctgggcgggtggctcgtcaccgagggatggatcctgccgcccctcttcgacggcatccccaacaaggacctcctggacgggacgcaggtgcagttcaagtcggcgctgcggaagacgtacatcaccgccgaccagggcggcggcggcgccgtgctggccaaccggacgctggcctccggctgggagacgttcaagctgtggcggatcaacgagacgaccttcaacttccgggcgcccggcggccagttcgtcggcatcggcgccagcgacggcatcatcgtcgccaccgccaccgcgccggcgctgccggagacgttccagatcgtgcgctgcccgttcgacaaggacagggtccgggtcaaggcggcaaacggatacttcgtccaggcgatcgctaccggcgaggtgatagcggactacggcgagcccacgcggtggtcggactgggacgcgtcggtcttcctgatgaccaaggtcggccagcagctgcagggggagtaccagctctgcaatggctacggcaccgacaaggccgcacccgtgctcagggaccactggaacacctacatagttgaggacgatttcaagttcatcgcgtcgagcgggctgacagcagtgaggattccagtaggctggtggatcgctagtgaccccaaccctccggctccgtatgttggaggctccctgcaggccctggacaacgccttcaaatgggcagagaagtacaagctgggcgtcatcatcgaccttcacgcagctcccgggtcccagaacccctgggagcacagctcctccagagacggcacgcaggagtggggaacaaccgacgccaacatcgcacagaccgtgcaagtgatcgaattcctcgcgtccaggtacgcgacgagccccagcctgttcgcggtggagctgatgaacgagccgctggcgccccgggcgacgctggacagcctgaccaggtactaccgcgacggctacgacgccgtgaggaggcactcgccggcggcgtacgtggtgatgtcgaaccggctgtcggggaacaagacggagctcctcccgttcgccgccgggctccagggggcggtcatcgacgtgcactactacaccgtgttcaacagcatgttcagcaacttcaccgtgcagcagaacatcgatttcgtcaggaccaacttctccggcgagctcgccgccgtcaccacccagaacgggccgctcaccttcgtaggagaatgggttgcagagtggaaggtgccgaacgcgaccaaggaagagtaccagaagtacgcggcggcgcagatgagtgtgtacggccaggccacgtttggatggtcctactggactgtcaagaacgccaacaaccactgggatctggagtggatgatcaaaaatggatacatctcgttgaaaggctagctagggctgaaatcaatactagtgtgcttctaggctacgagatgatcgatcttgatctacaagtgtgtgtcaaggcgaattagttcgtgttacattggagggcaaaagttcagtgcccatggctttgtaaaattgatcctatgatacgattgtgtatctaaggctctaaaccctcgcggcgctatttaactgcccaatataaaccttcatatctgcattcaaaaaaaaaaaaaaaaaaaa

SEQ ID NO: 618 - protein, 531 aa, Panicum virgatum
  misc_feature: Ceres CLONE 1726321
  misc_feature (1)..(289): Pfam Name: Cellulase Pfam Description: Cellulase (glycosyl hydrolase family 5)
MGCRGGARLLPLVRRLCFVVVLLCAPCLCSVSAAKRTPRPAVKPPPSPAPAYPALPVRAVCLGGWLVTEGWILPPLFDGIPNKDLLDGTQVQFKSALRKTYITADQGGGGAVLANRTLASGWETFKLWRINETTFNFRAPGGQFVGIGASDGIIVATATAPALPETFQIVRCPFDKDRVRVKAANGYFVQAIATGEVIADYGEPTRWSDWDASVFLMTKVGQQLQGEYQLCNGYGTDKAAPVLRDHWNTYIVEDDFKFIASSGLTAVRIPVGWWIASDPNPPAPYVGGSLQALDNAFKWAEKYKLGVIIDLHAAPGSQNPWEHSSSRDGTQEWGTTDANIAQTVQVIEFLASRYATSPSLFAVELMNEPLAPRATLDSLTRYYRDGYDAVRRHSPAAYVVMSNRLSGNKTELLPFAAGLQGAVIDVHYYTVFNSMFSNFTVQQNIDFVRTNFSGELAAVTTQNGPLTFVGEWVAEWKVPNATKEEYQKYAAAQMSVYGQATFGWSYWTVKNANNHWDLEWMIKNGYISLKG

SEQ ID NO: 619 - DNA, 2013 bp, Panicum virgatum
  misc_feature: Ceres CLONE 1726324
  misc_feature: Encodes the peptide sequence at SEQ ID NO. 620
ctgaacgcagtcagcaacatccaataacaacacctctttcacgtgccggcatgaacgggtgcatggcgagcgcctgcgccacctccagccccctcgtcccggcggcggccgccaagtcccctgcatgcccgtccaagaagagctccgccgccagcttccgcgcccgcgcggtgtcgtgcagggccaccgggggcggcgacgacggcggcctcctctggctcccccggcgggagatcctcactggcctgggcggcgtcgccgccggcctcgtcgggtaccagagcctcgcctccgtcgccaacggcgcggagctcaaggaacagtgcgccaagggtgatcaggtcaacgacacgctcgtcgagtgcatggaccggaccatcccgtgcccaccgacgcggaaggtgcccgtcgtcgacttcacgccggagtcgggggtgaagcgcgtccgccggccggtgcacctcctcagccgggagtaccaggagaagtacaaggaggcggtggggaagatgaaggcgctgccggcgtcgaacccgctgagcttcgtggcgcaggcggcgatccacgaggcctactgcgaccaccactaccggtacgacccggagaacaaggacgcacccttcgacgtgcacttctcgtggatcttcgcgccgtggcaccgcatgtacatctacttctacgagaaggcgctcgggcagctcatcggcgacgacaccttcgcgctgccgttctggaactgggacacgccggccggcatggtcgtgccggcgctcttcaaggactccttcgccagcccgctctacgaccgcaaccgcaaccccgacaacctcgacaaggtggtgcacctcgacctcaaggacaagtccgtgcccgtctctttcaacgggccacatgacaaggcataccaggatgccatctacaagaacctctgcaccttacaccagcagcaaatccggggcggccgttgcgccagggcattcctaggcgagaagctgtgcagcgagatgacgcgggacgccaacagccagggctcgctggagcggatggcgcacaccgccctgcacgtctgggtcggccggaagagcaccgacagctgcaccggcggcgtcgtcggccaggacaacaccacctactgcaccaacgacatgggcttcctcggctcgtcggggcgcgacccgctcttctactcgcaccacgccaacgtggaccgcctctggcacatctgggccaccaagctcggcggcgagggcttcaaggaccccgagtggctcgacgccagcttcgtcttctacgacgacgtcgagaacccccgccccgtccgcatcaagttccgcgacgtcatcgacacgcagaacctcggctacacctacgatgccgagtccgacaaggacctgccgtggaaggactgccagctcacctcgctggtcccccacgccaagggtggcgctgtccggtcgaggtcggcgtcgaccaagacggccggggcgccgctgttcccggtgacgctgaagaaggaccaggtcgtggaggtaccggcggtggctgtgccggccaagaaggcggggcagcagcgggtgctcgtgatccagggcatcgagtacgaccccaggggcgagaacaagttcgacgtggccatcaacgtgcccaagggttcggccctggaggtgggcccgcagaacttcgagttcgccggcagctttgccgtcgtgccgagctccaacgcggctggcgggaagctcaaggggggcatcacgctctccatcgacgacgtgctgaaggacatcaaggccgccgacgacagcaccgtcgacgtcatcatcgtgccgcgcacggaaggggagatcaagatcaactcttccccgacgatccagagctagatcgattgatctaccctcgatctcaccgtactgggccatccatcgtcccgtgcagtggccatattggtgtccggccgcaagaataaagtgaacatgtcgtgtcgtgtgcttgtagcaaaaaaaaaaaaaaaaaaaa

SEQ ID NO: 620 - protein, 608 aa, Panicum virgatum
  misc_feature: Ceres CLONE 1726324
  misc_feature (3)..(352): Pfam Name: Tyrosinase Pfam Description: Common central domain of tyrosinase
MNGCMASACATSSPLVPAAAAKSPACPSKKSSAASFRARAVSCRATGGGDDGGLLWLPRREILTGLGGVAAGLVGYQSLASVANGAELKEQCAKGDQVNDTLVECMDRTIPCPPTRKVPVVDFTPESGVKRVRRPVHLLSREYQEKYKEAVGKMKALPASNPLSFVAQAAIHEAYCDHHYRYDPENKDAPFDVHFSWIFAPWHRMYIYFYEKALGQLIGDDTFALPFWNWDTPAGMVVPALFKDSFASPLYDRNRNPDNLDKVVHLDLKDKSVPVSFNGPHDKAYQDAIYKNLCTLHQQQIRGGRCARAFLGEKLCSEMTRDANSQGSLERMAHTALHVWVGRKSTDSCTGGVVGQDNTTYCTNDMGFLGSSGRDPLFYSHHANVDRLWHIWATKLGGEGFKDPEWLDASFVFYDDVENPRPVRIKFRDVIDTQNLGYTYDAESDKDLPWKDCQLTSLVPHAKGGAVRSRSASTKTAGAPLFPVTLKKDQVVEVPAVAVPAKKAGQQRVLVIQGIEYDPRGENKFDVAINVPKGSALEVGPQNFEFAGSFAVVPSSNAAGGKLKGGITLSIDDVLKDIKAADDSTVDVIIVPRTEGEIKINSSPTIQS

SEQ ID NO: 621 - DNA, 2048 bp, Panicum virgatum
  misc_feature: Ceres CLONE 1726327
  misc_feature: Encodes the peptide sequence at SEQ ID NO. 622
attccttttccccacggaaacgcagctccccctcctcctccggcctcatgtccacgccgccgggcgagcagccgcgggccgcggccaccaagtacgtgctgatcacgggcggcgtcgtcagcgggctcggcaagggcgtcaccgccagcagcgtcggcgtcgtcctcaaggcctgcggcctccgcgtcacctgcatcaagatcgatccatacttgaacacagatgctggtactatgtcccccttcaagcatggtgaggtgtttgtccttgatgatggtggagaggttgatttggacttaggaaactatgagcgtttcatagatgttactctgactagggacaacaatattaccactggaaagatatatcagtctgtcattgagaaggagagaaagggcgattatcttggaaagacagtccaggttgtccctcatgtaaccgatgaaataaaacagtggatacagtcagtgtcctctgttcctgtggatgggcagactcgtccagctgatgtttgtgttattgagttgggaggcactgtaggtgatattgagtcaatgccattcattgaagctttgcgccaattgtccttctctcttggcaaggagaatttctgcctcatacatgttagccttgttccggtattgggtgtagttggtgagcagaaaactaagccaacacaacacagtgtacgggaattgagggccttgggtctgactcctgatcttctagcatgccggtcagcgcagccactaataggatctgttaaagagaagctttcccaattctgccatgtcccggttgagaacatacttaacatccatgatgttccaaatttatggcatgtcccacttattcttagaaatcaaaaggctcatgaagctataatcaaacagctaaaccttgcagggtctgctggaccacctgagttacgagattggacagagatggctgagtcatatgacaaccttaagaactctgttaaaattgctttggttgggaagtatactaacttgacagattcttatctatcagtggtgaaggctctcctacatgccagtgttgcctgttcattgaagccatctatccagtggattgcagcttcagatcttgaagatgcaactgcaataaatgcaccagatgcccatgcaaaagcctgggaaactcttaaaggttcagcatgcattttgatacctggaggatttggagatcgtggaatctcagggatgatattggctgccaaatatgcccgtgagaataaagttccatatcttggtatttgcttgggcatgcagatatcagtgattgagatatccagacatgtcttgggcctggaagatgcagacagtgaagagttcaacaaggatgtaccaaaccgtgttgttatgtacatgcctgaggtttcgaaaacacatatgggaaacacgatgaggttgggctgcaggagaacattctttcgcaaacctgattgtcttacatcaaaactgtatggaagtcctccacatgtagatgagcgtcatcgtcatagatacgaggtcaatccctattttgttcccatgcttgaaaatgctggtcttcattttgttggctgtgatgaaagtggaaataggatggagattgtggagctacaggatcaccctttctatttaggtgttcagttccatccagagttcaaatcaaggcctcgaagaccttcacctccttttacagggctaataatggcagccactaaacaactgggagcaatttcaaatcactcgaatggctacattggagcttctgagtaagatattgatcttcctttgggtggagttgaagcattttgctccttgctgctgaggttcaagctctttctgtacacatggtaccggaaatggaactgcattagaagagacttgtgcccttagagaccactcgagtggcgtagctgatgatcagtatacagggtcgaacctcatgattttgttgacagttattagtgtatggggtcgaacctcatgattttgttgacagttatgagcatatcatctcaaaaaaaaaaaaaaaaaaaa

SEQ ID NO: 622 - protein, 578 aa, Panicum virgatum
  misc_feature: Ceres CLONE 1726327
  misc_feature (1)..(263): Pfam Name: CTP_synth_N Pfam Description: CTP synthase N-terminus
  misc_feature (1)..(284): Pfam Name: CTP_synth_N Pfam Description: CTP synthase N-terminus
  misc_feature (1)..(238): Pfam Name: GATase Pfam Description: Glutamine amidotransferase class-I
  misc_feature (15)..(563): SWISSPROT Homolog: EC 6.3.4.2 CTP synthase 1
MSTPPGEQPRAAATKYVLITGGVVSGLGKGVTASSVGVVLKACGLRVTCIKIDPYLNTDAGTMSPFKHGEVFVLDDGGEVDLDLGNYERFIDVTLTRDNNITTGKIYQSVIEKERKGDYLGKTVQVVPHVTDEIKQWIQSVSSVPVDGQTRPADVCVIELGGTVGDIESMPFIEALRQLSFSLGKENFCLIHVSLVPVLGVVGEQKTKPTQHSVRELRALGLTPDLLACRSAQPLIGSVKEKLSQFCHVPVENILNIHDVPNLWHVPLILRNQKAHEAIIKQLNLAGSAGPPELRDWTEMAESYDNLKNSVKIALVGKYTNLTDSYLSVVKALLHASVACSLKPSIQWIAASDLEDATAINAPDAHAKAWETLKGSACILIPGGFGDRGISGMILAAKYARENKVPYLGICLGMQISVIEISRHVLGLEDADSEEFNKDVPNRVVMYMPEVSKTHMGNTMRLGCRRTFFRKPDCLTSKLYGSPPHVDERHRHRYEVNPYFVPMLENAGLHFVGCDESGNRMEIVELQDHPFYLGVQFHPEFKSRPRRPSPPFTGLIMAATKQLGAISNHSNGYIGASE

SEQ ID NO: 623 - DNA, 1548 bp, Panicum virgatum
  misc_feature: Ceres CLONE 1726342
  misc_feature: Encodes the peptide sequence at SEQ ID NO. 624
agatccagcagctctctgtcgccgccgtctcccgtccaatccaccagccgccttttccctatataaacagctatctcctcgccagtcgggcgcgctccgcatccgccaatccttcgcctacctgccgccagtgcatcgaggagagtttgggggaccggccggcgcggaagggaccgaccccccagagttgagttcccatggcttctgaatcaggggacggcaactgcgatgcttgggcagcgagagatccttctggagttctctcaccatacaagtttgaccgcaggtcagtgcaaagtggcgatgtttcgctgaagattacacactgtggagtctgttatgctgacgttatttggacacaaaataggcacaatgattcgaaatatcctttggttcctgggcatgagatagcaggagttgtaactgaggtcggttcagacgtcaaaggctttaaagtaggtgaccatgtaggtgttggaacctatgtgaactcatgccgagattgtgagaattgcaatagctctctagagaaccactgcccaagatcagtttttactttcaatggcattgatacagatggcactgtcacaaaagggggttactccactcacattgtagtccatgaaaggtactgcttcaaaataccagatggctaccctttggcaaaggcagcacctcttctatgtgccggaatcactgtgtatgctccaatgatgcgacacaacatgaaccaacctggaaaatcactaggggtcattggactaggtgggctgggtcacatggcagtgaaatttggtaaagcctttggtcttaaggtcacagttttcagtacaagtgaatcaaagagagatgaagccatcaacctccttggagcagataattttgttatatcatcaaacacacagcagatggagtccctcaaaaactctctgcacttcatagttgacactgcttctggtgaccatccatttgatccgtatctctcactccttaaggttggtggtgtgatggcaatagtgtgctttccaagtgagatcaaagtgcatcctgcaagccttaatcttggtgcacgtaccttgtctggtagtattactggaggtacaaaagacatccaagaaatggttaacttctgtgcagcaaacaaaatctatccagagattgagatcatcaagatagattatatcaatgaggctctcacaaggctcgtcaatcgagacgtgaaataccgcttcgtaatcgacatagagaactctttcaagtagcatgcctcattctcatgctctcgtctttctgtcgatatatgaggaagcacatgtgggaatcatgtcgccatgtcggataaacttgatgtaatgctgcattgcatttgtattattcttatttcttagtgtgtgctgtgcggttacctgcactcctatatacggttagcgttgcctgcatcatatgaccaattggcagcgacgctgtacttggtgtgacattgttgtaaatcttatagcaatattaatatacataattattcaacatcaaaaaaaaaaaaaaaaaaaa

SEQ ID NO: 624 - protein, 354 aa, Panicum virgatum
  misc_feature: Ceres CLONE 1726342
  misc_feature: Great-hit functional homolog of the protein sequence encoded by LOCUS At1g72680
  misc_feature (1)..(116): Pfam Name: ADH_N Pfam Description: Alcohol dehydrogenase GroES-like domain
  misc_feature: Useful for making plants with altered cell wall content and/or composition
MASESGDGNCDAWAARDPSGVLSPYKFDRRSVQSGDVSLKITHCGVCYADVIWTQNRHNDSKYPLVPGHEIAGVVTEVGSDVKGFKVGDHVGVGTYVNSCRDCENCNSSLENHCPRSVFTFNGIDTDGTVTKGGYSTHIVVHERYCFKIPDGYPLAKAAPLLCAGITVYAPMMRHNMNQPGKSLGVIGLGGLGHMAVKFGKAFGLKVTVFSTSESKRDEAINLLGADNFVISSNTQQMESLKNSLHFIVDTASGDHPFDPYLSLLKVGGVMAIVCFPSEIKVHPASLNLGARTLSGSITGGTKDIQEMVNFCAANKIYPEIEIIKIDYINEALTRLVNRDVKYRFVIDIENSFK

SEQ ID NO: 625 - DNA, 2134 bp, Panicum virgatum
  misc_feature: Ceres CLONE 1726352
  misc_feature: Encodes the peptide sequence at SEQ ID NO. 626
ggaaggatcaggttggcaggatcagggacgaagccatcctctctcgcggtcgcgacctcgccccgctgcggcctggccccgctccggcatccccaccgcgcctcctcaccgactagctagcggtatgcacgggtatggcccggcataccctagcgcagcccagcccaacaaggactcccgcccggtccggcgaccggagcccctgccccgtcgccggactcccgctaccgtgccaaatcccctactcgcacgtcagcgttagcacgggcacccttactagttggaaggaagggggaaaaagcaccaaatcgagaaggcgaatcgagttcgccatggctgctccgcgcgcactgctcccccagctactgctccttgttgtcgccgcgctcgtcgcggccgcccccgtcccgagggcgtccggagccgggcagttcgacgtccgccgccacctctcaaccgtcaccagatacgatgtggccagagggtccactagtgtcgactctatgccacgaatcccaaatgggtgccgtgtgatccacctcaatctagtggcaagacatgggactcgtgctcctaccaagaagcgaatcaaagagctggatagattggcaattaggctgggagctcttattaatgaggcaaaacaaggtctcaagagtgattctctgaagaaagttccatcctggataaagggctgggagtcacgttggaagggtagaactaaaggtggtgagctgactagtgaaggagaagaagagctctacaacttagccaccagagtgaaggagaggtttcaggacctgtttgatgatgaatatcaccctgatgtatattcaataagagcaactcaggtttctcgagcatcagctagtgcagtagcatttggtttgggattgctttctgggaaagggaagcttggaccaggaaagaaccgtgccttttctgttctgagcgagagtcgtgcaagtgatatttgtctgagattctttgacagctgtgaaacatacaaggcatacaggaaaaggaaggagcctgatgtcgaaaagcaaaaggaaccgatcctagagcatgtcacagctgcacttgtcaatcgttatcacctcaattttacaactcaggatgtctcttccctctggtttctttgtaagcaggaagcatctttattgaatataaccaatcaagcttgtggactttttaatgaagctgaggtttattttctggagtggacagatgatttggagggttttgttctaaaaggctatggtgagtcaattaactaccgtatgggactgccgttgctcaaggatgttgtccagtccatggaagaagcaatcatagctaaagaagaaaaccaccctgatggtacgtatgaaaaagcaaggctccgatttgcacatgcagaaactgttgttcctttcagctgccttcttggtcttttccttgaaggtccagattttgaaaaaatacagcgggaggaagcattggacgtaccccctatgccaccacagggaagaaactggaagggcagtgttgtagctccttttgctggtaacaatatgctggttttatatcaatgcccagggaaaactttagatgccagcacttctgggggtcaaaataactcgtacttcgtccaagttctacacaacgaagtcccagtttcaatgccagggtgcggcaacaaatatttctgtccattcgaggagttcaaggagaggatagtcaaaccacacctgaagcatgactacaatatgatatgcaagatcaatccccctgtggcgagcaaggagcctgcttcgttcaccaccaaggtgtcaagtttcttggtaggattgttctcgcagaaagggtaccgcgacgtgagcgctgaaagcgtcaagacggagttgtaagccacgcaagccatctgcgagcacgagcaaggaacgagattaaccgacgcactaacccgaggtgttttttgtacggccgagtcgaaactcgaatgtgtagcctttcaaaaaaagaaactcgaaagtcctataaaaaaagaaactcgaaagtgtacgaggcgtcagttcttcagggaaagatgcctctgacaatgtaaattcatcagtttcagttcgtcagtcaaaaaaaaaaaaaaaaaaaa

SEQ ID NO: 626 - protein, 585 aa, Panicum virgatum
  misc_feature: Ceres CLONE 1726352
  misc_feature (1)..(374): Pfam Name: Acid_phosphat_A Pfam Description: Histidine acid phosphatase
MARHTLAQPSPTRTPARSGDRSPCPVAGLPLPCQIPYSHVSVSTGTLTSWKEGGKSTKSRRRIEFAMAAPRALLPQLLLLVVAALVAAAPVPRASGAGQFDVRRHLSTVTRYDVARGSTSVDSMPRIPNGCRVIHLNLVARHGTRAPTKKRIKELDRLAIRLGALINEAKQGLKSDSLKKVPSWIKGWESRWKGRTKGGELTSEGEEELYNLATRVKERFQDLFDDEYHPDVYSIRATQVSRASASAVAFGLGLLSGKGKLGPGKNRAFSVLSESRASDICLRFFDSCETYKAYRKRKEPDVEKQKEPILEHVTAALVNRYHLNFTTQDVSSLWFLCKQEASLLNITNQACGLFNEAEVYFLEWTDDLEGFVLKGYGESINYRMGLPLLKDVVQSMEEAIIAKEENHPDGTYEKARLRFAHAETVVPFSCLLGLFLEGPDFEKIQREEALDVPPMPPQGRNWKGSVVAPFAGNNMLVLYQCPGKTLDASTSGGQNNSYFVQVLHNEVPVSMPGCGNKYFCPFEEFKERIVKPHLKHDYNMICKINPPVASKEPASFTTKVSSFLVGLFSQKGYRDVSAESVKTEL

SEQ ID NO: 627 - DNA, 4000 bp, Panicum virgatum
  misc_feature: Ceres CLONE 1726371
  misc_feature: Encodes the peptide sequence at SEQ ID NO. 628
atcgcgaaaaaatctttttctcgcttctcctcgctcctcgccgtttctctctcctcccctccgcctcacccgccgctcgccgcgaaatccgcccgcggacgccgccggttcgccgtggagagcctccgattagagcgcgccccgtcgagggccttcatggacaaacttctagatgcaggcacggaggtacctgcatgaactttctgagagatttcgaagcaactatgtttgggtttggttgatatcatacttgttcacgttgggggatgcagaccccccctctgcgggggttgattgaagaatttaacagtactcttaggcgaacttgtgtcttactgaaagtttcttggtttcgaggcaagtagcattactaagagtaggaccttggtggcatagatggatgaactgattgacaacttcaacacggtgttgattacaggctcttgagctaccaagtatgtcagcttcaaatgagaattggattgatgggctccagttcacatcactgttctggcctccaccccaggatgtgctgcagaaacaggcacaaattttggcctatgttgagtactttggccagtttacagctgacagcgagcaattccctgaagatgtagcacagctcattcaaagttgctacccatcgaaagaaaaacgcttggtagatgaagtgttggcaacttttgttcttcatcatcccgagcatggtcatgcagttgtacatccaattctttcacgtatcatagatgggacactgtgctatgatagacatggtcccccattcagctccttcatctctttgtttagtcatacttctgagaaagagtactcagagcagtgggccttggcatgtggtgaaattctcagagtcttgactcactacaataggccaatattcaaagctgagcgccaacgttgtgaagctgaatgtagcagcacatctgatcaggcaacatccagtgattccacggatgagaaatctgatggttccccaggaaatgaacctgatcggaagccattgaggccattaactccatggatcactgacatattgctcgctgcacctttgggaattagaagcgactactttagatggtgtggtggtgtaatgggaaaatatgctgctggtggagaattgaagcctccaacaactgcttgcagccgaggatctgggaagcacccgcaacttatgccatccacccccagatgggctgttgccaatggagctggtgttatattaagtgtctgtgatgaggaggtagctcgttatgagacagcaaatttaaccgcagcagctgttcctgcgcttctgctacctccaccgacaacaccattggatgagcatttggtggctggcctgccccctctcgaaccatatgctcgtttgttccatagatactatgcaattgctactccaagtgctacacagaggctgctttttggtcttctcgaagcacctccatcatgggctccagatgcactggatgcagcggtgcaactagttgaactacttagagcagcagaagattatgctactggcatgcggcttccaaagaattggatgcatctacacttcttgcgagcaattggaactgcaatgtcaatgagagctggtattgctgccgataccgctgctgctttgcttttccgcatactttcccaaccaacactactttttccacctctgagacataccgaaggagttgaagtacatcatgaaccactgggtggctatgtatcatcttataagaggcagttggaagttcctgcttctgaagccactatcgatgccactgcacaaggcattgcgtccttgttgtgtgctcatggccctgatgtcgagtggagaatatgtaccatctgggaagctgcctatggtttactgcctctaagttcatcagcagttgatttacctgaaattgtcgtagctgccccgcttcaaccacctacactgtcatggagcctgtacttgccattattaaaagtatttgagtacctacctcgtggaagtccatctgaagcatgcctgatgaggatatttgtggcaacagttgaagctatactcaggagaacttttccttctgaaacctcagaacaatccagaaaaccaagaagtcaatctaagaaccttgctgtcgctgaactccgcacaatgatacattcacttttcgttgaatcctgtgcctcaatggatcttgcctcccggttactatttgtggtgctaactgtttgtgtcagtcatcaagctttaccagggggcagcaaaagaccaactggtagtgataaccattcttctgaggaggtcgctgagaattcaagattaacaaatggaagaaacagatgtaagaagagacaagggcctgttgctacatttgattcatatgttttagctgcagtttgtgccttgtcttgtgagcttcagctgttccctctcatttctaagaacggttcacattcaagtataaaggattccatgaagattattgtacctggaaaaaccaatgggatcaatactgagctacacaatagcatcagctcagcaattcttcatactcgcagaattcttggcatcttggaagctcttttctccctgaagccatcatcagttggcacctcgtggggctatagctcaaatgaaatagttgcagcagctatggtcgctgctcatgtttctgagttattccgtagatccaggccgtgcctaaatgcactctctgcactgatgcgatgcaagtgggatactgagatttctaccagggcatcgtccctttaccatttgattgatttgcacggtaaaacagtgtcctccattgtgaacaaggctgagcctcttgaagctcacctgacccttacaccagttaagagggataatctacagcactctgagggaaacaatatcagctcatcggatagtggcaagatggagaacaagaatggttcaacctcacataagaaaaatggtttctcaagaccactcttgaaatgtgcagaggaggttctactaaatggagatgttgcaagtacatctgggaaagccattgcaagcttacaagtggaagcatctgatttggcaaacttccttaccatggatcggaatgggggttaccgaggttctcaaactctcctacgatctgtactgtcagagaaacaagaactgtgcttctctgttgtctcactgctctggcagaagctcatagcttctcctgaaatgcagatgtctgcagagagtacgtcagctcaccaaggatggagaaaggttgtagatgcgctttgtgatgttgtttcagcctcaccaaccaaggcttcaactgctattgttctccaggccgagaaggacttgcagccttggattgctagagatgacgagcaaggtcagaagatgtggagagtcaaccagcgaatagtgaagcttatagctgaggttatgaggaaccatgacagcccagaagcattggtgattcttgctagtgcttcagaccttctacttcgtgctactgatggaatgcttgttgatggtgaagcttgtactttgccacaacttgagcttctggaagtaaccgctcgagcagtccatctcatcattgaatggggagattcaggtttatcagttgctgatggcctctctaatctgctgaagtgccgtctatcgcccacaatccgttgcctttctcacccaagtgcacatgtgcgagcactcagcatgtccgttctccgcgacatcttgaacaacggacacattaaccccagcaagatcatccaaggggaacaacaacggaacggtatccagagctcgtcctaccggtgcctggcagcatccatcaactggcaggcggacgtgcagaggtgcatagagtgggaagctcacagccgccgcgccaccgggctgacgcttgccttcctcagtgcagcggctaaggagctcggctgccccctcccttgctgacaagacaaggccatttccctgggactgatttcggcagccagtgcaggcagtcgctgc

SEQ ID NO: 628 - protein, 1161 aa, Panicum virgatum
  misc_feature: Ceres CLONE 1726371
  misc_feature: Great-hit functional homolog of the protein sequence given in SEQ ID NO 9496
  misc_feature: Useful for making plants with modulated biomass
MSASNENWIDGLQFTSLFWPPPQDVLQKQAQILAYVEYFGQFTADSEQFPEDVAQLIQSCYPSKEKRLVDEVLATFVLHHPEHGHAVVHPILSRIIDGTLCYDRHGPPFSSFISLFSHTSEKEYSEQWALACGEILRVLTHYNRPIFKAERQRCEAECSSTSDQATSSDSTDEKSDGSPGNEPDRKPLRPLTPWITDILLAAPLGIRSDYFRWCGGVMGKYAAGGELKPPTTACSRGSGKHPQLMPSTPRWAVANGAGVILSVCDEEVARYETANLTAAAVPALLLPPPTTPLDEHLVAGLPPLEPYARLFHRYYAIATPSATQRLLFGLLEAPPSWAPDALDAAVQLVELLRAAEDYATGMRLPKNWMHLHFLRAIGTAMSMRAGIAADTAAALLFRILSQPTLLFPPLRHTEGVEVHHEPLGGYVSSYKRQLEVPASEATIDATAQGIASLLCAHGPDVEWRICTIWEAAYGLLPLSSSAVDLPEIVVAAPLQPPTLSWSLYLPLLKVFEYLPRGSPSEACLMRIFVATVEAILRRTFPSETSEQSRKPRSQSKNLAVAELRTMIHSLFVESCASMDLASRLLFVVLTVCVSHQALPGGSKRPTGSDNHSSEEVAENSRLTNGRNRCKKRQGPVATFDSYVLAAVCALSCELQLFPLISKNGSHSSIKDSMKIIVPGKTNGINTELHNSISSAILHTRRILGILEALFSLKPSSVGTSWGYSSNEIVAAAMVAAHVSELFRRSRPCLNALSALMRCKWDTEISTRASSLYHLIDLHGKTVSSIVNKAEPLEAHLTLTPVKRDNLQHSEGNNISSSDSGKMENKNGSTSHKKNGFSRPLLKCAEEVLLNGDVASTSGKAIASLQVEASDLANFLTMDRNGGYRGSQTLLRSVLSEKQELCFSVVSLLWQKLIASPEMQMSAESTSAHQGWRKVVDALCDVVSASPTKASTAIVLQAEKDLQPWIARDDEQGQKMWRVNQRIVKLIAEVMRNHDSPEALVILASASDLLLRATDGMLVDGEACTLPQLELLEVTARAVHLIIEWGDSGLSVADGLSNLLKCRLSPTIRCLSHPSAHVRALSMSVLRDILNNGHINPSKIIQGEQQRNGIQSSSYRCLAASINWQADVQRCIEWEAHSRRATGLTLAFLSAAAKELGCPLPC

SEQ ID NO: 629 - DNA, 1676 bp, Panicum virgatum
  misc_feature: Ceres CLONE 1726374
  misc_feature: Encodes the peptide sequence at SEQ ID NO. 630
aaatctgatgctaagcaaattctcgcgcaacacgctcaatccctcacgcaccctccgctcaagcgatgccctgcctctcctcctcctcctcctcctccgccgccgccgccgcaccgttccagccggcagatccggcgtcgcgaggcgccatggcgtggcagcagctgagctcccgcacgcgggagttcgaccactttgtcgtgatcgactttgaggcgacctgcgaaaggaattccaagatctacccgcaggaaatcatcgaatttcccgcggtcctcgtcgacgccgccaccggcggcctcgtcgcctccttccgcacctacgtgaagccgcgccaccacccgcgcctgaccgcgttctgctccgagctgacggagatccagcaggagcaggtcgacggcggcgtagatctcgcgacggcgctggccatgcacgacgcgtggctggcggcggcgggcgcagccaagaaccgcctcgccgtcgtcacctgggatggatcaaccttcgcatccccttcgaggccgcgttcggtgctgggcggcgcaaccttcaggaggcggtcagggaggcgggtctgcagtggagcggccgcctccactgtgggctcgacgatgcgctcaatacggcctgcctcctcgccgagctgatgcggcggggagttcccatctccattaccggctcgctggtgccgccgccgccgccgccaccggagcagaagcctgaggtgcaacttcagcaacaactcttgccggcgaatcacaacttccgctggtgcgtcggtggcgctgctgctactgactgctgctgctactgctactgcggcgtggccgtcagagccgacgtggtgacgacgccgggccctatgcaaggacgctgcttcttcagctgcgggaactggacgccgctggggccgatgtgcccgttctttctctgggcggcttgattgccagccgtccagactccaacgcatcgtcgtcaatatggaaatattgccaccgcaggctgatgtcacaatctttttcctacagataagcttctttcctttgtttttttatctgcactgcactcatgtagcatatttgttttttattttactgagtttcctagtctaaatactatcatctcttctgtagcggacttgatggtactcggaccacccaaagaggcagcagaaatggagacgtacatcatcacttcagcatcagacgtgatggccaattgtcatacaaccaaaagacttcggcagcagaaaagaagacatgatcaagctggtgtcacgtggtcttcggcaaggggatcctctccgcccagtgctgttcattctagtaatggacgtgctgaattctctgatcaagtttgctatccagcagcaacttctgcagccacttgcggttcagcatgttacacaccggtcctctttctacgcagatgatgccatggtctcacgccgatcggcagcagaaaaggagacttgatcaagctctggtgtccaaattgaatttgctttccatcttggtttgttacagggggtcagacagctagagttggcttgttaggagttttactcaatgattagttgggagttgttgcttgccttataaatatgaaatccatgtaattggaagatcaagtaatgaaatcaatctagtttcccctaaaaaaaaaaaaaaaaaaaa

SEQ ID NO: 630 - protein, 193 aa, Panicum virgatum
  misc_feature: Ceres CLONE 1726374
  misc_feature (1)..(101): Pfam Name: Exonuc_X-T Pfam Description: Exonuclease
MPCLSSSSSSSAAAAAPFQPADPASRGAMAWQQLSSRTREFDHFVVIDFEATCERNSKIYPQEIIEFPAVLVDAATGGLVASFRTYVKPRHHPRLTAFCSELTEIQQEQVDGGVDLATALAMHDAWLAAAGAAKNRLAVVTWDGSTFASPSRPRSVLGGATFRRRSGRRVCSGAAASTVGSTMRSIRPASSPS

SEQ ID NO: 631 - DNA, 2017 bp, Panicum virgatum
  misc_feature: Ceres CLONE 1726387
  misc_feature: Encodes the peptide sequence at SEQ ID NO. 632
tgttcaaatcgcgtcagatccgagccaacgactcataacgaccgggaaggaagcggagggggacggcatggccgccaaccaggagcaggagcaggagcaggagcagcgccgccgcctcctcgacgtcgcgtcccgcttccctctcccaagcggctgcaggttctcctatggcacggcgggattccgcgcttacggcgccaccatggcgcccgccgtctgccgcgccggcatcctggccgcgctacgctccgtcaagctcgccggcgccgccgtcgggatcgtcatcaccgcctcccacaaccccgtcggcgacaacggcgtcaagatcgccgaccccgacggcggcatgatggcccagcactgggagcccttcgccgacgccctcgccaacgcccccgaccccgacgccctcctgcagctggtgcttcagtttgtcaagaacgagggaattccattggggggccaccacatggcgcaagtgctgcttggccgagatactaggccaacaggagagtacctgctcgatgctgcactgcaggggataaatgctatagttggcgcacacgcaattgatttgggaattttgaccacccctcaactgcattggatggtccggagcaaaaacaaaggcatcaaggcttcagagtcagattattttacgcaacttatcgactcattcaggcgtatgctggaattagtgccaaaagataaaagtggggatgagcttgccaagaaactaattgttgatggagcaaatggtattggtggggtaaagcttgaacaaataaaggcaaagctttcaggcatagatattaatgtgaggaattcaggtaaggaaggagaaggcatactaaaccatatgtgtggtgcagactttgttcaaaaggagcgagttactcctcatgggtttagccctgaagatgttggtgtcaggtgtgcaagtttggatggtgatgctgatcgacttgtctatttccgcgtgtcatcgcctagcgacaataaggttgatcttgttgatggtgacaagatactatctctgtttgccctgtttatcagagagcagctagatattatcaataacaatggtagtcaagtaaacaaatcattgtcggcaaggcttggcatagttcagacagcttatgcaaatggggcatcgacccaatttctcaagaaccttggccttgaagtggtattcactcctacaggagtgaaatatctgcacaaaaaggctttggagtatgatataggtatatattttgaagccaatggacatgggactatagtattctcggaggattttctctctcaactggagtcattaatcaatgaccactcctctgaagctgccaatggttcagcacagtatcatgcggcaatgagattgatggcagctagtcagctgattaatcaggcagtaggtgatgctctgagtggttcgcttttggtggaggctattttgcagtataagggatggtcatttcagaattggtgtgaactatattgtgatttgcccagtagacagttgaaggtgaaagttatagatcgaagttcaattgtcacaacagacgcggagacaaaagttagtcaaccttctaatttgcaagaattgatagataaggagactgccaactatacccatgggcgatgctttgtgcggccatctggtacagaagatgtggtacgggtgtatgccgaggcatctatgcaggtggaagctgatagtcttgcaagatctgtggcacaacatgtggaacatcttcttggataatcatttacattcttgtttgcgattttgactagactaaatttcctagggctctcccttctatgttttaattcgtgagtccaaacttttgaatttcactgtttatatgcacagaacaaaaagcacttggttcttgtatccaaacatcataaaacatttacaccattgtaaaatcattcccttcctgtactcatgctttcagatggattttgcacatctgctaagacggatcaaaaaaaaaaaaaaaaaaaa

SEQ ID NO: 632 - protein, 566 aa, Panicum virgatum
  misc_feature: Ceres CLONE 1726387
  misc_feature (1)..(55): Pfam Name: PGM_PMM_I Pfam Description: Phosphoglucomutase/phosphomannomutase, alpha/beta/alpha domain I
  misc_feature (2)..(116): Pfam Name: PGM_PMM_II Pfam Description: Phosphoglucomutase/phosphomannomutase, alpha/beta/alpha domain II
  misc_feature (10)..(566): SWISSPROT Homolog: EC 5.4.2.3 Phosphoacetylglucosamine mutase
  misc_feature (12)..(566): SWISSPROT Homolog: EC 5.4.2.3 Phosphoacetylglucosamine mutase
MAANQEQEQEQEQRRRLLDVASRFPLPSGCRFSYGTAGFRAYGATMAPAVCRAGILAALRSVKLAGAAVGIVITASHNPVGDNGVKIADPDGGMMAQHWEPFADALANAPDPDALLQLVLQFVKNEGIPLGGHHMAQVLLGRDTRPTGEYLLDAALQGINAIVGAHAIDLGILTTPQLHWMVRSKNKGIKASESDYFTQLIDSFRRMLELVPKDKSGDELAKKLIVDGANGIGGVKLEQIKAKLSGIDINVRNSGKEGEGILNHMCGADFVQKERVTPHGFSPEDVGVRCASLDGDADRLVYFRVSSPSDNKVDLVDGDKILSLFALFIREQLDIINNNGSQVNKSLSARLGIVQTAYANGASTQFLKNLGLEVVFTPTGVKYLHKKALEYDIGIYFEANGHGTIVFSEDFLSQLESLINDHSSEAANGSAQYHAAMRLMAASQLINQAVGDALSGSLLVEAILQYKGWSFQNWCELYCDLPSRQLKVKVIDRSSIVTTDAETKVSQPSNLQELIDKETANYTHGRCFVRPSGTEDVVRVYAEASMQVEADSLARSVAQHVEHLLG

SEQ ID NO: 633 - DNA, 1516 bp, Panicum virgatum
  misc_feature: Ceres CLONE 1726388
  misc_feature: Encodes the peptide sequence at SEQ ID NO. 634
gcctcccaccagtagctccacctcatcagtttccttcccggccaggtaagcaagcagccatgtcggcgctcggcgcgctctccggcggcgccgccggtgtcgccggcctcctcagcctccgccgccgcgccgcgccaccaccctctggcctcgcatcctcgccgcacctcccgtctctcaagtgcgccgtcccgcccgatgccggccagctcgtctggggccgccagctccgcccggcgctcctccccgccgccctcctcccgccgcagcccgccaggaggaacgccctgcgcccgcccgcagcagccgcaggggaggccaagcccgcgggtttcctcgacaagtatcctgccctggtcaccggcttcttcttcttcatgtggtacttcctcaacgtcatattcaacatcctcaacaagaagatctacaactacttcccctacccatactttgtgtcgctcatccatctcgtagtgggtgtcatatactgcctcatcagctggtctgtcggtctccccaagcgtgcgcctatcaattcgacgctcctcaagctgctctttccagtggcgctgtgccatgctcttggtcatgtcactagcaacgtctccttcgctgctgttgcagtctcatttgcccacactatcaaagctctggagcccttcttcaacgcagcggctactcagtttgtccttggacagcaggttcccttgtctctgtggttgtcccttgcccctgttgtcattggtgtttcgatggcatccctcactgagctctcattcaactggactggcttcatcaatgccatgatctccaacatctcattcacttacaggagtatttattccaagaaagctatgactgacatggatagcaccaacgtgtatgcttacatctcgataatttcgctccttgtttgcattccacctgcactgatttttgaagggcctcaactgatgcagcacggatttagcgacgctattgctaaagtaggtctgcaaaagtttgttactgaccttttcttggttggactgttctaccatctgtacaaccagcttgctacaaatactttggagcgagtggctcctctgacacacgctgttggcaatgtgttgaaacgtgtgtttgtcattggtttttcaatcattgtttttggcaacagaattacgacacaaactggaattggcacttgcattgccatagctggtgtggccatgtactcttacatcaaggctaggattgaagaggagaaaaggaaaaagagcgcatgatgaggtgactactgtgaatatgtgtcgggtggctgagttgtacttcctgagacaacatcgtcgacaatcatgacttccttctctgccttgttttttgttttcaccttgagtcatttggtcaattgtttgttcccaacctggtcatgaacagcagcacattgcagatggcaagtatattgttcttcataccatcagaacagataatcgttgcgtgtgcatgaatgtgtagaaaataaacgctcatactt

SEQ ID NO: 634 - protein, 402 aa, Panicum virgatum
  misc_feature: Ceres CLONE 1726388
  misc_feature (1)..(145): Pfam Name: TPT Pfam Description: Triose-phosphate Transporter family
MSALGALSGGAAGVAGLLSLRRRAAPPPSGLASSPHLPSLKCAVPPDAGQLVWGRQLRPALLPAALLPPQPARRNALRPPAAAAGEAKPAGFLDKYPALVTGFFFFMWYFLNVIFNILNKKIYNYFPYPYFVSLIHLVVGVIYCLISWSVGLPKRAPINSTLLKLLFPVALCHALGHVTSNVSFAAVAVSFAHTIKALEPFFNAAATQFVLGQQVPLSLWLSLAPVVIGVSMASLTELSFNWTGFINAMISNISFTYRSIYSKKAMTDMDSTNVYAYISIISLLVCIPPALIFEGPQLMQHGFSDAIAKVGLQKFVTDLFLVGLFYHLYNQLATNTLERVAPLTHAVGNVLKRVFVIGFSIIVFGNRITTQTGIGTCIAIAGVAMYSYIKARIEEEKRKKSA

SEQ ID NO: 635 - DNA, 2314 bp, Panicum virgatum
  misc_feature: Ceres CLONE 1726402
  misc_feature: Encodes the peptide sequence at SEQ ID NO. 636
gacgacatctatttaacgcctgaatccacctcacctgcgtggccctcctccccatcgcttcctctccgctacccccctcccccgaccagatcgcgacgacgcgccgcgcgatccgacccaggccgacgccgacgaccccactcgctgccggcggccatggcgtacggcgaccgcgtcaccaccttcgaggactccgagaaggagagcgagtacggctatgtccgcaaggtctctggacctgtcgtcgtggctgatggaatgggcggtgctgccatgtatgagcttgttcgtgtcggccatgataacctcatcggggaaattatccgtcttgagggtgattcagctacaatccaagtttatgaggaaactgctggacttatggttaatgatcctgttttgagaacaagaaagcctctttctgttgagttgggacctggaattctaggaaacatttttgatggtatccagcgccctctaaaaaccattgctattaaatcaggagatgtgtacattcctcggggtgtttcagttcctgcccttgacaaagatacattgtgggaatttcagccaaataagctaggtgttggagatgtcatcacaggcggagatctatatgctactgtctttgagaacacattaatgcagcaccatgttgctcttccacctggtgctatggggaaagtaagttacattgcgccagctggtcagtacagcctgcaggatacagtgctagaattggaattccagggcattaaaaaacaatttaccatgcttcagacatggcctgtgcgatcaccaagacctgttgcgtcaaaggttgctgcagatacacctcttctgacagggcagcgtgtacttgatgcgttgttcccctcggttctgggaggaacttgcgctattccaggagcttttggttgtgggaaaactgtcatcagtcaggcactttcaaagtactccaattctcaagctgttgtttacgtgggctgtggtgaaagaggaaatgagatggctgaggttcttatggacttcccccagttgacaatgacattggaagatggccgtgaggagtcagtcatgaagagaacaaccctagtggctaacacatctaacatgcctgtcgctgctcgtgaagcctccatttatacaggaattacaattgctgagtatttccgtgacatgggctacaacgtcagtatgatggctgactccacctcccgatgggccgaggcattgcgtgagatctcagggcgtttggctgaaatgcctgctgacagtggttacccagcttatttggcttcacgattggcatccttttatgaacgtgctggtaaggtgaaatgtctaggaagtccagacaggactggcagtgtcacaattgttggagctgtctctcctcctggtggtgatttttcagaccctgttacctctgcaaccctcagtattgttcaggtcttctggggtttagataaaaagcttgctcaaaggaagcatttcccttctgtgaattggctcatttcctattcaaaatactctaaggcccttgagtccttttatgagaagtttgatccagatttcattgatattaggacaaaagcacgtgaggtgttgcagagggaggatgatctaaatgaaattgtgcagcttgttggtaaagatgcgctggcagaatctgacaagattacgctagagacagcaaagcttctgagagaagattatttggcacaaaatgcgtttaccccatatgataagtactgcccattctacaaatctgtttggatgatgcgcaacattattcacttcaacacattggcaaatcaggctgtggagcgggcagctggtactgatggccaaaagataacatacagtgtcataaagcatcgcttgggcgatctgttctatcgcttagtatcacaaaagtttgaggatcctgcggaaggcgaagcagctttggttgccaaatttcagaaactacatgatgaccttaccaccgggttccgcaatctagaagatgaggcgcggtgaactgctgtagattttgtgtaaacaataaggactgccagatgtttcataagatacggaagttgtagattgagatcacgtatgagaatttttccgaactgctactccatccctttgccatatcactgttttggccatcagtgctcgacagacaccctgtttatctctgtatcatttattgctatcaacattgtaataagcgatggacatgcttgtagttgaataagtacaatgtccatgtatctaaacatcaatgtcatcttgatttgtttgttaaaaaaaaaaaaaaaaaaaa

SEQ ID NO: 636 - protein, 621 aa, Panicum virgatum
  misc_feature: Ceres CLONE 1726402
  misc_feature (1)..(228): Pfam Name: ATP-synt_ab Pfam Description: ATP synthase alpha/beta family, nucleotide-binding domain
  misc_feature (1)..(145): Pfam Name: ATP-synt_ab_C Pfam Description: ATP synthase alpha/beta chain, C terminal domain
  misc_feature (3)..(621): SWISSPROT Homolog: EC 3.6.3.14 Vacuolar ATP synthase catalytic subunit A
MAYGDRVTTFEDSEKESEYGYVRKVSGPVVVADGMGGAAMYELVRVGHDNLIGEIIRLEGDSATIQVYEETAGLMVNDPVLRTRKPLSVELGPGILGNIFDGIQRPLKTIAIKSGDVYIPRGVSVPALDKDTLWEFQPNKLGVGDVITGGDLYATVFENTLMQHHVALPPGAMGKVSYIAPAGQYSLQDTVLELEFQGIKKQFTMLQTWPVRSPRPVASKVAADTPLLTGQRVLDALFPSVLGGTCAIPGAFGCGKTVISQALSKYSNSQAVVYVGCGERGNEMAEVLMDFPQLTMTLEDGREESVMKRTTLVANTSNMPVAAREASIYTGITIAEYFRDMGYNVSMMADSTSRWAEALREISGRLAEMPADSGYPAYLASRLASFYERAGKVKCLGSPDRTGSVTIVGAVSPPGGDFSDPVTSATLSIVQVFWGLDKKLAQRKHFPSVNWLISYSKYSKALESFYEKFDPDFIDIRTKAREVLQREDDLNEIVQLVGKDALAESDKITLETAKLLREDYLAQNAFTPYDKYCPFYKSVWMMRNIIHFNTLANQAVERAAGTDGQKITYSVIKHRLGDLFYRLVSQKFEDPAEGEAALVAKFQKLHDDLTTGFRNLEDEAR

SEQ ID NO: 637 - DNA, 2454 bp, Panicum virgatum
  misc_feature: Ceres CLONE 1726420
  misc_feature: Encodes the peptide sequence at SEQ ID NO. 638
gtcgcgccgtctcccgaagcatccgtcccctcccaaaaccctcgccgccgtctcgcagtcgaaggcagcaggtgccgcagcgccgccgaaaccctcctcgccccgcgaccgggactagccagccacgcatggcggcgtcgctgctcctccgcgccgcgcggcggcgggaactcgcgtcccctctcggatctctgggcgccagcttacagtcgacatgtgctgccaatgtgtgctcaaaatggggtaattttgcaaggcctttcagtgcaaaagcagctggaaatgaggttattggaattgatctgggaacaactaactcatgtgttgctgttatggagggaaagaacccaaaagtcattgagaacgctgaaggtgcgcgaacaacaccatctgttgttgcttttactcagaaaggtgaaaggcttgttggaactccggccaagcgccaggcagtaaccaacccccagaatactttctttggaacaaagcggttgattgggcgccgctttgatgatccacagacacagaaagagatgaagatggtgccatacaaaattgtgaaggctccaaatggtgatgcttgggttcaaacaacagatggcaagcagtactcgccaagtcaggtcggtgcatttgtgctgaccaagatgaaggagacagctgaatcttaccttggcaaatctgtctctaaggcagtgattactgttcctgcttatttcaatgatgctcagcgtcaggccacaaaggatgctggccgcattgctggccttgatgttgagaggatcatcaatgaacccacagctgctgctctgtcttatggaatgaacaacaaggagggtttgatagcagtctttgatcttggtggaggaacttttgatatctctattctggagatctcaaatggagtttttgaggtcaaagcaacaaatggtgataccttcttgggtggtgaagattttgataacacactgttggaattcttggtgagtgatttcaagaaaactgagggcattgatctgtctaaggacaggttggccctgcagagacttcgtgaagctgctgagaaggcaaaggtcgaactttcatcgacttctcagactgaaatcaatctaccattcataacagctgatgcttctggagcaaagcatttgaacatcacattgacaaggtcaaagtttgaagctcttgtgcacaacctgattgagaggactagggatccatgcaagaactgcttgaaggatgctggaatatccactaaggaggtggatgaagttctgcttgttggtggaatgaccagggttccaaaggtacaggaggtggtctctgaaatttttggaaagagcccaagcaaaggagtcaacccagatgaggctgtggccatgggtgctgccattcagggtggtattctccgtggagatgttaaggagcttcttctccttgatgttactcccctgtcacttggtattgagacacttggtggtatcttcaccagattgatcaacaggaacactacaattcccacaaagaaaagccaggcgttctcaactgctgcggataatcagacccaagttggtatccgggtgttgcaaggtgagcgtgagatggctgcagacaacaaacttcttggtgaatttgaccttgtgggcattcctccggccccaagaggtctgcctcagattgaggtcacatttgacatcgatgccaatggaatcgtgactgtctctgccaaagataaggccactgggaaggagcagaatatcaccatccggtcctctggtgggctgtctgaggctgacatccagaagatggtccaagaagctgagctgcatgcccagaaggatcaggagcggaaggccctcattgacatcaggaacactgcagacaccactatttacagcatcgagaagagtctcggagagtacagggacaagatcccagctgaggttgcatctgagattgaggcagccattgctgacctccgccaggagatggcctcagacgacattgagaagatcaaggccaaacttgaggcagccaacaaagctgtctcaaagatcgggcagcacatgtctggtggtggctcaggtggttcacagtcaggatctggacctcagagcggtggcgatcaggctccagaggctgagtatgaggaggtcaagaagtgaggtgaagggattgaacagtagcatcccttagaaatagctactcttttttgggaacacatgatagtcagatgtgatgtaacctgttctgtaataatcctttggattttcccccttgtttctcctcagcagcgatgcgaggtcacacaacattgtctggtaggtcatggctttgttgcatgatgccttgtccaggccttgatccacgagcacagtgaaccattggcggattttgctaatgcgcgaaggtatatgtttttcagattttttttaaaaaaaaaaaaaaaaaaaa

SEQ ID NO: 638 - protein, 678 aa, Panicum virgatum
  misc_feature: Ceres CLONE 1726420
  misc_feature (1)..(597): Pfam Name: HSP70 Pfam Description: Hsp70 protein
  misc_feature (1)..(599): Pfam Name: HSP70 Pfam Description: Hsp70 protein
  misc_feature (1)..(593): Pfam Name: HSP70 Pfam Description: Hsp70 protein
  misc_feature (1)..(591): Pfam Name: HSP70 Pfam Description: Hsp70 protein
  misc_feature (1)..(592): Pfam Name: HSP70 Pfam Description: Hsp70 protein
  misc_feature (1)..(594): Pfam Name: HSP70 Pfam Description: Hsp70 protein
MAASLLLRAARRRELASPLGSLGASLQSTCAANVCSKWGNFARPFSAKAAGNEVIGIDLGTTNSCVAVMEGKNPKVIENAEGARTTPSVVAFTQKGERLVGTPAKRQAVTNPQNTFFGTKRLIGRRFDDPQTQKEMKMVPYKIVKAPNGDAWVQTTDGKQYSPSQVGAFVLTKMKETAESYLGKSVSKAVITVPAYFNDAQRQATKDAGRIAGLDVERIINEPTAAALSYGMNNKEGLIAVFDLGGGTFDISILEISNGVFEVKATNGDTFLGGEDFDNTLLEFLVSDFKKTEGIDLSKDRLALQRLREAAEKAKVELSSTSQTEINLPFITADASGAKHLNITLTRSKFEALVHNLIERTRDPCKNCLKDAGISTKEVDEVLLVGGMTRVPKVQEVVSEIFGKSPSKGVNPDEAVAMGAAIQGGILRGDVKELLLLDVTPLSLGIETLGGIFTRLINRNTTIPTKKSQAFSTAADNQTQVGIRVLQGEREMAADNKLLGEFDLVGIPPAPRGLPQIEVTFDIDANGIVTVSAKDKATGKEQNITIRSSGGLSEADIQKMVQEAELHAQKDQERKALIDIRNTADTTIYSIEKSLGEYRDKIPAEVASEIEAAIADLRQEMASDDIEKIKAKLEAANKAVSKIGQHMSGGGSGGSQSGSGPQSGGDQAPEAEYEEVKK

SEQ ID NO: 639 - DNA, 1764 bp, Panicum virgatum
  misc_feature: Ceres CLONE 1726424
  misc_feature: Encodes the peptide sequence at SEQ ID NO. 640
atacgatttctctccattcttctcccgtcctcctcctcatcccctcccctccctcccttctcctctcttgaacactccgccgaaaagtccgaattgcttgacatcagtatcaggcccagctcgaggaggggggtgattggacgagcagccgctgatttgtttggtcggtcggagcgcacgatgatggcgaacgcgaagctccagaagcaggcgctgctgccgccgcgcagcccgttcccgacggcggcggcaggggcgccgtcgccgtacgccgaccggggcccgatcgcccggccgcagggcgccgccgtccacccccgttacggccacgggcaccaccagcgcacgtcgtccgagagcttcatcgaggagcagccgccatcgtggctagacgacctgctcaacgagcccgagacgccagcagcgcggcagcacggccgggccggccaccgcaggtcgtcaagcgactcttttgcgctgtttgacggagctgctgctggcgccggtgcttgtgccaatggcttcgaggggatggggggacgaggtgggcagcctgcgccatgggctggtgttcaggagtactatgtcaagccaggttcgtttgggagggcacatggccagccatgggagcaaggcatgccgaatctgtctggtttccggcatggcggtggcctgccgatgccgacaaaagacaaggttggggggcatcatggactaccgaacatgttgagggataataaccatggcatggacaagagaactcctgatgatgccagtcatgatcaaaaggttggggcgaaggagggtgtgccgccgaagcatgcacagtcagaggtagacaacaagcgggctaaacagcagtatgctcagaggtcccgtgtccggaagcttcagtatattgcagagctggagggtagagttcaggcattacagtcagaaggggtagaagtgtctgctgaaatggagtttcttacccagcagaatattatgctagacctggaaaataaagctttgaagcaaagactggagagtctagcacaggaacaactaattaaacgctttcaacaggagatgtttgagcgggaaattggtcgtctcagatcactatatcagcagcagcagcagcagcagcaggctcctgctcttgttcgcagtaacagcagagaccttgatgcccagtttgccaacttgtctctgaaacacaaagaccccagctcgggccgggatgctctctctgggcctcttcgtacttaattcttttcatccttccgttcttgtgggttctatatcaatcgccaccactgtgtggttgtcatctccatcaagaaaggagaagtgcgcttgaattgcgtgaataacaccggaaaaggctaatagctatggatctgatctttattctttctggatatgcacctggcggtcatcctcagcttgcgtccattgttgatgctcgaccagtcggcggtgtttaggttttctttttagctagatgctttccatgcatcattgtaccatttcgcatgctagggttctaatctgtcactatcctcatgtttcctgagctttcttcatacattgtagccatgtttggattagttctgccttatcagtggaatgtggagcactagtcagcatcagataagttgtgctttgaaaatgtgccacatccctgataactgtatgttgtgttattatttatcagtacccaataagctagtacaaatgaagtattagcatttttcacaaaaaaaaaaaaaaaaaaaa

SEQ ID NO: 640 - protein, 357 aa, Panicum virgatum
  misc_feature: Ceres CLONE 1726424
  misc_feature: Great-hit functional homolog of the protein sequence given in SEQ ID NO 9622
  misc_feature (1)..(49): Pfam Name: bZIP_1 Pfam Description: bZIP transcription factor
  misc_feature: Useful for making plants with altered terpenoid content
MMANAKLQKQALLPPRSPFPTAAAGAPSPYADRGPIARPQGAAVHPRYGHGHHQRTSSESFIEEQPPSWLDDLLNEPETPAARQHGRAGHRRSSSDSFALFDGAAAGAGACANGFEGMGGRGGQPAPWAGVQEYYVKPGSFGRAHGQPWEQGMPNLSGFRHGGGLPMPTKDKVGGHHGLPNMLRDNNHGMDKRTPDDASHDQKVGAKEGVPPKHAQSEVDNKRAKQQYAQRSRVRKLQYIAELEGRVQALQSEGVEVSAEMEFLTQQNIMLDLENKALKQRLESLAQEQLIKRFQQEMFEREIGRLRSLYQQQQQQQQAPALVRSNSRDLDAQFANLSLKHKDPSSGRDALSGPLRT

SEQ ID NO: 641 - DNA, 1592 bp, Panicum virgatum
  misc_feature: Ceres CLONE 1726435
  misc_feature: Encodes the peptide sequence at SEQ ID NO. 642
agactccgcgccttctcttcccctccccaccctcacccgacgcgcttttccccgcaccaaggcctcgtgcctgctacttaacctaacccacctcagaacaattccccattcctgattccaaccagctcacacgagtcggtactggatagagaggaaggaggaagccaagaacaagcagtcgtactcgtcttgcgcgcgcgtggagaggaaagattggattttgtgttacgttttggtgagcagagatgttgagggcggtggcgaggtgctgcggcccctggccgccgagcgcggcggcggcggacgggatgctgtggcagacggagctgcggccgcacgcggcgggggagttctcgatggccgcggcgcaggccaacctggccatggaggaccaggcgcaggtgctggcctccccgtccgacacgctcgtcggcgtctacgacggacacggcggggccgacgcctcccgtttcctccgatctcgactcttcccccatgtccaacgcttcgcgacggagcaggggggcatgagcacggaggtgatccggagggcgttcagcgagacggaggaggagttccatacgcaggtgaggcaggagtggaggaggcggccgcggatggccgccgtgggctcgtgctgccttctcggggctatctccggggacacgctctacgtggccaaccttggggactcccgcgccgtgctcgggcgtcgagtggtggggggcggggtggccgtcgccgagcggctgtccagcgagcacaacacggcgtccgaggaggtgcggcgggagctcgccgctctcaaccccgatgacgcgcagatcgttgtgcacgccagaggggcgtggagagtgaaggggataattcaggtgacaagatccattggtgatttttatctgaagaaacctgagtatagtttggaccccttgtttcgggaagttggcccccctattgcattgaagagaccagctcttagcgctgaaccatcaattcaagttcacaaactgaatccaaacgacctatttctgatatttgcttcagatggtctttgggagcacctcagtgatgatgatgcggtgcaaattgtcttcaagaatccaagaactggaatagccaacagattggtgaaggctgccttgaaggaagcaacaagaaagagggaggtcaggtaccgtgacctgaggacgatcgaaaggggtgtgaggcggcatttccatgacgacatcagtgttgtggtggtctacctcgaccgccaccgtgagcgccgccacaccagggtcatcgattctagcagcaactgcaccagcgcccccgttgacatttactcatccaacagtcttataagagctgaactccgtgtagtggactgggcagcgtgcgagttcgctatctctggctggtgaactgcagttgcatgcagatcagggtgcgcgaactggggtgccattaccattgcaggggctcgagatgtacatagatagtgtgggtgcgtggcgttttgatgccggagaagatcatctggtcttggattgtgtagcataattggttaatcgcagcatttcttctttcaaaaaaaaaaaaaaaaaaaa

SEQ ID NO: 642 - protein, 386 aa, Panicum virgatum
  misc_feature: Ceres CLONE 1726435
  misc_feature (1)..(282): Pfam Name: PP2C Pfam Description: Protein phosphatase 2C
MLRAVARCCGPWPPSAAAADGMLWQTELRPHAAGEFSMAAAQANLAMEDQAQVLASPSDTLVGVYDGHGGADASRFLRSRLFPHVQRFATEQGGMSTEVIRRAFSETEEEFHTQVRQEWRRRPRMAAVGSCCLLGAISGDTLYVANLGDSRAVLGRRVVGGGVAVAERLSSEHNTASEEVRRELAALNPDDAQIVVHARGAWRVKGIIQVTRSIGDFYLKKPEYSLDPLFREVGPPIALKRPALSAEPSIQVHKLNPNDLFLIFASDGLWEHLSDDDAVQIVFKNPRTGIANRLVKAALKEATRKREVRYRDLRTIERGVRRHFHDDISVVVVYLDRHRERRHTRVIDSSSNCTSAPVDIYSSNSLIRAELRVVDWAACEFAISGW

SEQ ID NO: 643 - DNA, 1819 bp, Panicum virgatum
  misc_feature: Ceres CLONE 1726450
  misc_feature: Encodes the peptide sequence at SEQ ID NO. 644
tccctccctcccctccccattccgccgcccgccgactcctcccaatccctcccactccgcccgcccgcccgctgccatggcgctctccgtggagaagacctcgtcgggccgggagtacaaggtcaaggacctgtcccaggccgacttcggccgcctcgagatcgagctggccgaggtcgagatgcccggcctcatggcttgccgcgccgagttcggcccctccaagcccttcgccggcgccaggatctccggctccctccacatgaccatccagaccgccgtcctcatcgagaccctcaccgcgctcggcgccgaggtccgctggtgctcctgcaacatcttctccacgcaggaccacgccgccgccgccatcgcgcgggactccgccgccgtcttcgcctggaagggggagacgctcgaggagtactggtggtgcaccgagcgatgcctcgactggggcggggccggcggccccgacctcatcgtcgacgacggcggcgacgccacgctcctcatccacgagggcgtcaaggccgaggaggagtacgagaagaccggcaagatcccggacccggactccaccgacaatgccgagttcaagatcgtgctcaccatcatccgcgacgggctcaaggccgaccccaagaagtaccgcaagatgaaggagaggctcgtcggcgtctcggaggagaccaccaccggggtcaagaggctctaccagatgcaggagaccggcgcactcctcttccccgccatcaacgtcaatgactccgtcactaagagcaagtttgacaacctgtatggttgccgccactccctccctgatggtttgatgagggccaccgatgttatgattgccggcaaggttgcagtggtctgcggttatggtgatgttggcaagggctgtgctgctgccctcaagcaggctggtgcccgtgtcatcgtgactgagattgaccccatctgtgcccttcaggccctgatggagggtcttcaggtccttaccttggaggatgtcgtttctgaagctgacatctttgtgactaccactggtaacaaggacatcatcatggttgaccacatgaggaagatgaagaacaatgcaattgtctgcaacattggtcactttgacaatgagattgacatgcatggtcttgagacctaccctggtgtcaagcggatcaccatcaagccccagactgatcgctgggtgttccctgagaccaacactggcatcattgtccttgctgagggtcgtctgatgaaccttgggtgcgctactggccaccccagctttgtcatgtcctgctcattcactaaccaggtcattgctcaacttgagctgtggaagaagcggagctcaagcaagtatgagaagaaagtgtatgtgctccccaagcaccttgatgagaaggttgccgccctccacttgggcaagcttggtgccaagctcaccaagctcaccaagtctcaggctgactacatcagtgtcccgatcgagggtccctacaagcccgctcactaccggtactaggttacccagcatgactagaagcccactcggccagccggttgtggtgtgtgccattacgaagttcactacaccggcttgtcaattatcttttgcatgcattatcatatgcgccattgcgtaggaggatttgttattatcattgcttgcgcctggttgtgtggggagaggagggaagagctgtttgctttttgcagaagaacaatggcgtatttggttgtagggtgaggcagtgtgcgttaccagaactatacagtttctgattatcaaaaaaaaaaaaaaaaaaaa

SEQ ID NO: 644 - protein, 485 aa, Panicum virgatum
  misc_feature: Ceres CLONE 1726450
  misc_feature (126)..(429): Pfam Name: AdoHcyase Pfam Description: S-adenosyl-L-homocysteine hydrolase
  misc_feature (2)..(465): Pfam Name: AdoHcyase Pfam Description: S-adenosyl-L-homocysteine hydrolase
  misc_feature (2)..(460): Pfam Name: AdoHcyase Pfam Description: S-adenosyl-L-homocysteine hydrolase
  misc_feature (3)..(460): Pfam Name: AdoHcyase Pfam Description: S-adenosyl-L-homocysteine hydrolase
  misc_feature (5)..(461): Pfam Name: AdoHcyase Pfam Description: S-adenosyl-L-homocysteine hydrolase
  misc_feature (3)..(463): Pfam Name: AdoHcyase Pfam Description: S-adenosyl-L-homocysteine hydrolase
  misc_feature (2)..(473): Pfam Name: AdoHcyase Pfam Description: S-adenosyl-L-homocysteine hydrolase
  misc_feature (2)..(474): Pfam Name: AdoHcyase Pfam Description: S-adenosyl-L-homocysteine hydrolase
  misc_feature (141)..(429): Pfam Name: AdoHcyase Pfam Description: S-adenosyl-L-homocysteine hydrolase
  misc_feature (1)..(376): Pfam Name: AdoHcyase Pfam Description: S-adenosyl-L-homocysteine hydrolase
  misc_feature (1)..(485): SWISSPROT Homolog: EC 3.3.1.1 Adenosylhomocysteinase
MALSVEKTSSGREYKVKDLSQADFGRLEIELAEVEMPGLMACRAEFGPSKPFAGARISGSLHMTIQTAVLIETLTALGAEVRWCSCNIFSTQDHAAAAIARDSAAVFAWKGETLEEYWWCTERCLDWGGAGGPDLIVDDGGDATLLIHEGVKAEEEYEKTGKIPDPDSTDNAEFKIVLTIIRDGLKADPKKYRKMKERLVGVSEETTTGVKRLYQMQETGALLFPAINVNDSVTKSKFDNLYGCRHSLPDGLMRATDVMIAGKVAVVCGYGDVGKGCAAALKQAGARVIVTEIDPICALQALMEGLQVLTLEDVVSEADIFVTTTGNKDIIMVDHMRKMKNNAIVCNIGHFDNEIDMHGLETYPGVKRITIKPQTDRWVFPETNTGIIVLAEGRLMNLGCATGHPSFVMSCSFTNQVIAQLELWKKRSSSKYEKKVYVLPKHLDEKVAALHLGKLGAKLTKLTKSQADYISVPIEGPYKPAHYRY

SEQ ID NO: 645 - DNA, 1559 bp, Panicum virgatum
  misc_feature: Ceres CLONE 1726453
  misc_feature: Encodes the peptide sequence at SEQ ID NO. 646
agaggcgcggcgaggcgacgggcagcaccaccaccacttgctcctcatctcgtctctcttccactcgctcgcgagcaatcctacctacaaactctaaacccaatcccctcccctcctctcgctcgtctaccttcccctccatcccatctcaccgtaccgtacgtaccaggtagcagctagctaggcgcaggccatggccgcagtgaccgtctctctgtcgtccttcccggccgctgccaaggcggccgctgcttcgccgtccccgtactcgtcatgcacgtacccgcggcgcagcgccgcccgggcggtgcgggtgcgcgttcaggtgtcgacgacggagaccgctgaggcggggccggcgccggtgaagacggagaagatctccaagaagcaggacgagggtgtggtgaccaacaagtacaagcccaaggagcccttcgtggggaggtgcctgctcaacaccaggatcacaggagacaaggcgccgggggagacgtggcacatggtcttcagcacagaaggcgagatcccttacagagaagggcagtccatcggcgtcatcgccgacggcgtggacaagaacggcaagccgcacaagctcaggctctactccatcgccagcagcgccctcggggatttcggcgactccaagaccgtgtcgctgtgcgtgaagaggctcgtgtacaccaacgatcaaggagaggtcgtcaaaggagtctgctccaactacctatgtgacctgaagcccggcgctgaggtgaagatcacagggccagtcggcaaggagatgctcatgcccaaagaccccaacgcaacaatcattatgctggcgacgggtaccggtatcgcccccttccgctccttcttgtggaagatgttcttcgagaagcacgacgactacaagtacaacggcctggcctggctgttcttgggagtcccgacgagcgacaccctgctgtacaaggaggagctggagaagatgaaggagatggcgccggacaacttccggctggacttcgcggtgagccgggagcagacgaacgcggcgggggagaagatgtatatccagacgcggatggccgagtacaaggaggagctgtgggagctgctcaagaaggacaacacctacgtctacatgtgcggcctcaaggggatggagaagggcatcgacgacatcatggtcgacctcgcagcaaaggacgggatcgactggattgagtacaagaagcagctcaagaagggcgagcaatggaacgtcgaagtctactaatccatcgtcgattctcactagctagtacatacaggcgcacgtcagtacattatatccatcattttgttgtgcgataaatttgcctgcctgccggcctctgcctttgatttccctcatgctttcatgctctactagtagctttttaactcagcttgcatgctgaattcaaacgtccgatcgattgttgtacatatttgtttcatggtcgtcgatcggtccagacctcatgtatttattatttattattatataggtatattttctctcctaaaaaaaaaaaaaaaaaaaa

SEQ ID NO: 646 - protein, 358 aa, Panicum virgatum
  misc_feature: Ceres CLONE 1726453
  misc_feature (1)..(118): Pfam Name: NAD_binding_1 Pfam Description: Oxidoreductase NAD-binding domain
  misc_feature (1)..(358): SWISSPROT Homolog: EC 1.18.1.2 Ferredoxin--NADP reductase, leaf isozyme, chloroplast precursor
  misc_feature (13)..(358): SWISSPROT Homolog: EC 1.18.1.2 Ferredoxin--NADP reductase, leaf isozyme, chloroplast precursor
MAAVTVSLSSFPAAAKAAAASPSPYSSCTYPRRSAARAVRVRVQVSTTETAEAGPAPVKTEKISKKQDEGVVTNKYKPKEPFVGRCLLNTRITGDKAPGETWHMVFSTEGEIPYREGQSIGVIADGVDKNGKPHKLRLYSIASSALGDFGDSKTVSLCVKRLVYTNDQGEVVKGVCSNYLCDLKPGAEVKITGPVGKEMLMPKDPNATIIMLATGTGIAPFRSFLWKMFFEKHDDYKYNGLAWLFLGVPTSDTLLYKEELEKMKEMAPDNFRLDFAVSREQTNAAGEKMYIQTRMAEYKEELWELLKKDNTYVYMCGLKGMEKGIDDIMVDLAAKDGIDWIEYKKQLKKGEQWNVEVY

SEQ ID NO: 647 - DNA, 2674 bp, Panicum virgatum
  misc_feature: Ceres CLONE 1726467
  misc_feature: Encodes the peptide sequence at SEQ ID NO. 648
acacacgccagcgggctcagaagacaaccggagtaccttcctcttcgcgagcagcgcgacatcacgcgcctgcacgatctcctcccgtgagcgagatctcaccaccgcagccatggcggggaggtacaaccagggctacggcggcggcggcggcgcgtccatggaggtggtcagcacgccgaaccaggagctcgccctcaccaactgcgcctacgtctccccaggcgacctccgccgcttccccaacgcgctcgccctcgtcgccgacgtctgggtcttcaccctaagggcccatgatgctgtcacaagtggacgcattgctttgaatgctattcagcgtcggcaggcgaaggtttcaactggggattctgttaccgttagcagttttgcccctcctgatgatttcaagttggcattgctcactttagaactagagtatgccaaggcaagagccaaccgaaatgacgagctggatgctgttgtgcttgcccaacaacttcggaagaggtttctggatcaggtcatgacctcagggcaaagggtgccatttgaattttatggaacaaactatgtattcactgtcaatcaagctttgctagagggtcaagagagttccataccgttggacagaggattcctatcaagtgatacatacatcatatttgaggctgctcctaattcaggaattaaggtgatcaaccaaaaggaagctgctagcagcaagcttttcaagcataaagagtttaacctagaaaaattggggataggtgggctaagcgctgaattcactgacatatttcgtagggcatttgcttcaagagtatttcctcctcacgttgttagtaaattgggcatcaaacatgtaaagggtatattactatatggacctcctggtactggcaagactcttatggcccggcaaattggaaagttgttgaatggaaaagaccccaagattgtgaatggacctgaagttctgagcaagttcgttggagaaacagagaagaacgtgagagatttgtttgctgatgctgaaaatgagcagaagacacgaggtgatcagagtgacctccatgttatcatatttgatgaaattgatgccatctgcaagtctagaggatcaactcgtgatggtacaggtgtacatgatagcattgtaaaccagctcctgacaaagatagatggtgttgaggcgttgaataatgtgttgcttattgggatgacaaatcgtaaggatttacttgatgaagctttattgagacctggacgattggaagttcacatcgagataaacttacctgacgaaaatggtcgtttgcaaatccttcaaattcatacaaataagatgaaagagaattctttcctatctccggatattaatcttcatgagctagctgcacggacaaagaactacagtggagcagagttggaaggtgttgtcaaaagtgctgtctcatttgctttgaaccggcagataaccatggatgatctcacaaaacctttggatgaggaaagcattaaggtcactatggatgattttgtgaatgcacttcatgaaattactcctgcatttggtgcttctactgatgaccttgaaagatgcagattgcgtggtattgtagactgtggcaaggcacataagcacatttaccaaagagctatgcttcttgtggagcaagttaaagtaagcaaaggtagcccacttgtgacttgcctcttggaaggtcctgctggaagtggtaaatcagctatggcagccagtgttggcattgacagtgattttgcatatgtcaaaattatatcagcagaaacaatgattggtttcagtgaaagcagcaaatgtgcacagatttgcaaggtttttgaggatgcatacaaatctcaattcagcatcataattcttgatgatattgaaaggttactggagtatgtggccattggaccacgcttctcaaacttgatctcacaaactcttctggttctcctcaagagggtccctcctaagggaaaaaacttgcttgttattggaacaacaagcgaggtaggcttcctagaatctgttggaatgtgtgatgtgttctctgtgacctaccatgttcccaaactgaaaaaggaagatgccaaaaaggtgctgcagcatcttaatgtgttcgatgaaggagatcttgatgcagcagcagaagcactggatgatatgccaatcaagaagttgtacacacttgttgagatggctgcacaggggccaacagggggaagcgcagaagcaatttatgccggagaggagaagatagatatcaaccatttctttagcatcttgagtgatattatccgttactaagcatgcttggaacagaaatggactgttaggtgtccatctaggaatttgtttacacctttacttcatcactcctatcatcctcacagcgtgtagagtggtttggtgagttgtgtttctttgatgcgcctattcgatctgttgctcttgtgctgaatggatcataggttaattacacgatgtagcatttttgtatttttttcccgaaagatgcactccatttttgtattgtatgctgatgtgtatacagttgatgtggatccagctatacaccgcagaatacaactgaaatttgatgtggatccagctatatcgttccaaaaaaaaaaaaaaaaaaaa

SEQ ID NO: 648 - protein, 741 aa, Panicum virgatum
  misc_feature: Ceres CLONE 1726467
  misc_feature (1)..(741): SWISSPROT Homolog: EC 3.6.4.6 Vesicle-fusing ATPase
MAGRYNQGYGGGGGASMEVVSTPNQELALTNCAYVSPGDLRRFPNALALVADVWVFTLRAHDAVTSGRIALNAIQRRQAKVSTGDSVTVSSFAPPDDFKLALLTLELEYAKARANRNDELDAVVLAQQLRKRFLDQVMTSGQRVPFEFYGTNYVFTVNQALLEGQESSIPLDRGFLSSDTYIIFEAAPNSGIKVINQKEAASSKLFKHKEFNLEKLGIGGLSAEFTDIFRRAFASRVFPPHVVSKLGIKHVKGILLYGPPGTGKTLMARQIGKLLNGKDPKIVNGPEVLSKFVGETEKNVRDLFADAENEQKTRGDQSDLHVIIFDEIDAICKSRGSTRDGTGVHDSIVNQLLTKIDGVEALNNVLLIGMTNRKDLLDEALLRPGRLEVHIEINLPDENGRLQILQIHTNKMKENSFLSPDINLHELAARTKNYSGAELEGVVKSAVSFALNRQITMDDLTKPLDEESIKVTMDDFVNALHEITPAFGASTDDLERCRLRGIVDCGKAHKHIYQRAMLLVEQVKVSKGSPLVTCLLEGPAGSGKSAMAASVGIDSDFAYVKIISAETMIGFSESSKCAQICKVFEDAYKSQFSIIILDDIERLLEYVAIGPRFSNLISQTLLVLLKRVPPKGKNLLVIGTTSEVGFLESVGMCDVFSVTYHVPKLKKEDAKKVLQHLNVFDEGDLDAAAEALDDMPIKKLYTLVEMAAQGPTGGSAEAIYAGEEKIDINHFFSILSDIIRY

SEQ ID NO: 649 - DNA, 1510 bp, Panicum virgatum
  misc_feature: Ceres CLONE 1726472
  misc_feature: Encodes the peptide sequence at SEQ ID NO. 650
gcttgcccgctgctgttcggattccgcttcgcctcctccgtcgtccctggacgcccacgcggccacgtctccggggctgcaccacctcgtcccgacctcccatggcggcgctgggcgccgcgaccacccccgcagcggctcccgcggcgccgtgcggcaacaaccggcacccacggcaccgcgtcgcggcgcgccgcggccgggccgtcccggcgaggaggctcgagctgcgcgcgggcgtctcacccgccgtcacagcggacgcgcccgacgaggcggccgcggaacctctggtggaagtggaaccggcgccggagacgaagctgagcaagctggcgtgcccaatctgctactatcccctcgtgagcgcgagcgatcagtcaggtgatgcttcgagtctcgagtgttctacctgcaaaaaggtgtaccccaataagcaggattactgggaccttactgtggcagttggctcgtccgagtactcggagtccatgccggcagcaactgaattattcaggactccgctggtatcatttctttacgagagaggatggcgccaaaatttcatatggggtggtttcccaggcctagagagagagtttgaaatggcaaaaacttatttgaagccgacaattggagggactgttgttgatgctagttgtggaagtggcttgttttcaagattatttgttaagagcggactatattctcttgtcgtggcactagatttctcagagaatatgttgaagcagtgcaatgaatacatcaagcaggaaaatatttcagatgagagattagaattggtgagggctgacatatccaggctcccttttgtgagtggctcaattgatgctgtgcatgcaggcgctgcaattcattgttggccatccccagcttgtgctgttgcagaaatcagtagagtccttcgcccagggggagttttcgttgcttctacatttgtagcagatattattccgccagctatcccgttattgaggattggacgcccgtacattagccaaatcactggcaataataccttcttatctgaagtggaatttgaagatctttgcaaagcatgtgggttggttgatttcaaatttgtcagaaatgggttctatataatgttctctgctactaaagcaagctaagagctgcgattatccagaagtttatgatgggattccttagtctgatacttcaaatagtttctttctgtgcatggcgccctttgctcttagggctgctacttttgctcaagggacgtgtcatatgatctgtgaatacacaggtctaacttgactgacctcattatggcatatattatctcatttctttgtatatagcctcagatatgttacaattatgtaatttatcaacttctctttagtgttgatatatgtggttgccttgattgaagacttactaacgtgctataaattattctggagtataagtatcagcaggacgataaatacgttttatctgttaaaaaaaaaaaaaaaaaaaa

SEQ ID NO: 650 - protein, 349 aa, Panicum virgatum
  misc_feature: Ceres CLONE 1726472
  misc_feature (1)..(103): Pfam Name: Methyltransf_11 Pfam Description: Methyltransferase domain
MAALGAATTPAAAPAAPCGNNRHPRHRVAARRGRAVPARRLELRAGVSPAVTADAPDEAAAEPLVEVEPAPETKLSKLACPICYYPLVSASDQSGDASSLECSTCKKVYPNKQDYWDLTVAVGSSEYSESMPAATELFRTPLVSFLYERGWRQNFIWGGFPGLEREFEMAKTYLKPTIGGTVVDASCGSGLFSRLFVKSGLYSLVVALDFSENMLKQCNEYIKQENISDERLELVRADISRLPFVSGSIDAVHAGAAIHCWPSPACAVAEISRVLRPGGVFVASTFVADIIPPAIPLLRIGRPYISQITGNNTFLSEVEFEDLCKACGLVDFKFVRNGFYIMFSATKAS

SEQ ID NO: 651 - DNA, 1610 bp, Panicum virgatum
  misc_feature: Ceres CLONE 1726473
  misc_feature: Encodes the peptide sequence at SEQ ID NO. 652
atcactagcaccaaacgggcccctgtccgtgtcaccggccaccggcggcggcggagcagagcagagcagcaagcaagccgcggcgagcgcggccatggaggaggagcagcttcaggcgctgctccgcgacctcgacgcgctcaggcagcgccccgacgaccccgcctccatcgatcggatgcgggagcgggtggtggcgatgatgaacccggccgccggcgccgcttcgcgatcgaagatcaaggacatgagcgcggaggtggtggacagcaacccttacagcaggcttatggcgctgcagcggatgggcgtcgtggagaattatgagcgcatcagggactactccatcgccatcgttggcataggtggtgttggtagtgttgctgcagagatgctcactaggtgtggaatcggacgtctcttgttgtatgactatgacacagtcgagttggctaacatgaataggttgttctttcgtccagaacaggttggaatgacaaaaacagatgctgctgtacagactctttctggaataaatcctgatgttgtgttggagagctactcattgaatattactacagtcaaagggtttgaaacatttttggcaagcctaaaagccaggagctctcatgagcgtagcactggagttgatcttgtcttgagctgtgttgataactatgaagctcgtatggttgtgaatcaggcatgcaatgagcttggtcagacttggatggagtctggtgtctcagaagatgctgtttctggtcatatacaactgctggttccaggtgaaactgcatgctttgcatgtgctcctccattggttgtagcatcaggagtggatgagcgtacacttaagagagaaggggtttgtgctgcctctttgccaactacaatgggtgttgttgccggtctgctggtccagaatgctctgaaatatctgttgaattttggacaagtttccccatacttggggtataactcacttaaggattatttcccaacaatggaaatgaggccaaatccccagtgttcgaatccagcatgtgttcagagacagaaagagtatatggactccaaacctgctagagatgcagcagcaaaggctaagatggaagctgaagcatctgcagcaagtgaaggcccagtccaccaagacaacgagtggaacattagtgttgttgatgatgaagacacagcatcatcaagtattcgaagcactgcagatgtcctaccagaaggccttgtccgcgaactcccagctgctgatttgtatccagaactacctgctgcggcgagctccagtgctattgatgatgatctcgaggaactccagcggcaacttgatgccctaaactcgtcttagccaggctggttcatctgattctcgccttttttccccccaaaatcccaacttggacgggaaaaaggctttgcatacagttgttttgtgtctgttctaacagagtcttgcttcaccggatatagtcttcatccttagcaccgaggtacacaaaaaaaatgatagttatacaatttttgtgttttgacttacaattttggctgggaaaatatacatttatgagccagaaaaaaaaaaaaaaaaaaaa

SEQ ID NO: 652 - protein, 423 aa, Panicum virgatum
  misc_feature: Ceres CLONE 1726473
  misc_feature: Great-hit functional homolog of the protein sequence given in SEQ ID NO 9384
  misc_feature: Useful for making plants with modulated oxidative stress sensitivity
MEEEQLQALLRDLDALRQRPDDPASIDRMRERVVAMMNPAAGAASRSKIKDMSAEVVDSNPYSRLMALQRMGVVENYERIRDYSIAIVGIGGVGSVAAEMLTRCGIGRLLLYDYDTVELANMNRLFFRPEQVGMTKTDAAVQTLSGINPDVVLESYSLNITTVKGFETFLASLKARSSHERSTGVDLVLSCVDNYEARMVVNQACNELGQTWMESGVSEDAVSGHIQLLVPGETACFACAPPLVVASGVDERTLKREGVCAASLPTTMGVVAGLLVQNALKYLLNFGQVSPYLGYNSLKDYFPTMEMRPNPQCSNPACVQRQKEYMDSKPARDAAAKAKMEAEASAASEGPVHQDNEWNISVVDDEDTASSSIRSTADVLPEGLVRELPAADLYPELPAAASSSAIDDDLEELQRQLDALNSS

SEQ ID NO: 653 - DNA, 2126 bp, Panicum virgatum
  misc_feature: Ceres CLONE 1726488
  misc_feature: Encodes the peptide sequence at SEQ ID NO. 654
gggggaggaaatcggaagcgatcagagcgagagagcaagcttgcttgcttacccgaatccccaatccccatcctccctctctccccaacgatggaccagctcgtcaatttcatcatccgcccgcccagagctgactacagtcctaatgacgatctgttagaacaggagtttatgctgaaggggagatggttccagaggaaggacttggaggtcaaaaatggcctgggcaagaaattgcaatgtagtcattatatgcctgttgtgattcctgaaggaaatgctctcccatgtgtcatatattgtcatggtaacagtgggtgcagagctgatgctagtgaagccgcaattattcttctaccatcaaacattacagtgtttacactggacttttcagggtctggactctctgaaggagaacatgtcactttaggctggaatgagaaagaagatctgaaagctgttgttaactatttgcgtacagatggaaatgtatcttgcatagctttatggggtcgctcaatgggtgctgtcacaagtctaatgtatggagcggaggacccatcaattgctggaatggttcttgatagtccattctccaacttggttgacttgatgatggagctagtggacacgtacaaatatccactgccaaaattcacggtcaaacttgcaatacaacatatgcgaaagattgtcaagaggaaagctaattttgacatcatggatcttgatactattcaggtagcaaaatgttgtttcgttcctgctttgtttgggcatgcaactgaggatgattttatacttccccaccattcagacaagatatatgaatcatatatgggcgacaaaaacatcataaaatttgatggggatcacaattcaccacgtcctcaattttactttaactcaattacaatatttttccataatgtgctaaaccctcccgaagtggctgaggatcattatttcatgacaccacatggcagccttggtcagggtcgttgggatacagagcatgacatagaatataggttcgctcaatcacccacaggaacagcccatgcaactaccactgaagatgccattgcgcagttgcgttctagaaggcttatgagtagaatggaggtcccatctggtgccagtgccaccacagaagatagggccgtccgaactgagggattggatagcgatgttggtccctcctcatctagcgtatcaacagcaacccctcccaatggccgcaacggaaggctgctcactccaacctctgatgatggcgagtatgtggagtactcgtttgatagcttatcagatatgccttacaccgtggaagatgaagatagaatgctgatgcaagcaattcttgaatcactgaaggactatgaacagtcaaatacaaaaaatgcgcaatcagctgcatctgatgctgcacccaaagagaataataatactgtaaaagattgcaatggtgtggcagatgcagcactggagccagatgctcctggcaagcatactactgtctgcaacagtggagcaaaagctggtgcagagcaaagtgcagatagccacgctgtagacaacacttcttctgtcaatgcctctggctcttcagagaccctggcgtcaacacagattaccaatgggaagcctatctcatcggaatccaagaaaacaactcagaatgtcaatggagaggatggcacaagagctactcttgtagttcagaagagccggagcagtggcctgatagatggtttgacacaaaaatggggttccttcttcaagaacaatgactgagatgagcaaagtacacgaataacccccttgacaatacgtgttccagtgtgttaatagacatagagttgcctttggctgatgtccaacttgattcgttttacgtgtaaaatggaaaggaaacagatggtttcaggatgttcgtgtatatatagaactaggaattgtagctccccaattgattgtgtatcatgtgtcaaaacactcactactttggttctggtgaattggcaagccctttcttgctgatgggttgtaacataattggaaagctcattattttgtagtcgtatttgactatttgtggtttttaaaaaaaaaaaaaaaaaaaa

SEQ ID NO: 654 - protein, 568 aa, Panicum virgatum
  misc_feature: Ceres CLONE 1726488
  misc_feature (1)..(98): Pfam Name: Abhydrolase_1 Pfam Description: alpha/beta hydrolase fold
MDQLVNFIIRPPRADYSPNDDLLEQEFMLKGRWFQRKDLEVKNGLGKKLQCSHYMPVVIPEGNALPCVIYCHGNSGCRADASEAAIILLPSNITVFTLDFSGSGLSEGEHVTLGWNEKEDLKAVVNYLRTDGNVSCIALWGRSMGAVTSLMYGAEDPSIAGMVLDSPFSNLVDLMMELVDTYKYPLPKFTVKLAIQHMRKIVKRKANFDIMDLDTIQVAKCCFVPALFGHATEDDFILPHHSDKIYESYMGDKNIIKFDGDHNSPRPQFYFNSITIFFHNVLNPPEVAEDHYFMTPHGSLGQGRWDTEHDIEYRFAQSPTGTAHATTTEDAIAQLRSRRLMSRMEVPSGASATTEDRAVRTEGLDSDVGPSSSSVSTATPPNGRNGRLLTPTSDDGEYVEYSFDSLSDMPYTVEDEDRMLMQAILESLKDYEQSNTKNAQSAASDAAPKENNNTVKDCNGVADAALEPDAPGKHTTVCNSGAKAGAEQSADSHAVDNTSSVNASGSSETLASTQITNGKPISSESKKTTQNVNGEDGTRATLVVQKSRSSGLIDGLTQKWGSFFKNND

SEQ ID NO: 655 - DNA, 1566 bp, Panicum virgatum
  misc_feature: Ceres CLONE 1726489
  misc_feature: Encodes the peptide sequence at SEQ ID NO. 656
agagggaggcgaaacgggccccgtctctccccgcggaccgcatctcaattctcatcctcctgctcagtcctgcgatccagtgagcagcacctgccatcgccagctaccaacgggatgggtgaggaggagcagcggaagcacatggtgggttccgagctagaccaggagctggagccacggcaaggagaggaggagaaggtgaaggaggaggccaagaaatccgcgcctggggacgcggaggccggcgacggcgccgccgcggaggcggcgagctgcgactactgcggcgccgcggctgcggcggtctactgccgcgccgacgccgccaggctctgcctgccgtgcgaccgccacgtgcacggcgccaacgaggtctgctcccgccacgcccgcgccccgctctgtgccgattgccgtgccgccggggccgtcttccgccacgcctcctccgcggccttcctctgctccaactgcgactttgggaggcaccgggacggcagcggcggcgagccggcgttccacgaccgctgcgcggtgcagccctactccgggtgcccgccggcgaccgagctcgcggcgcttctcggggtgcccctcttcgacaagccggccgccgaagacggtggttggtggaacatctgggaggagccgcaggtgctcagcttggaggatctgatcgtgcccaccactccctgccatggctttcagcctctcctcacaccatcatctcccaagaaccggagcatctccgcagacgaaaacacgaacgaggagatcctccggcagctgggtgagcttgcagagtcagacggaggggtgcaggcagcagcaggtcacgaggaggcagagcaagctggagatcagttcccttcatggacaccgccaccacagtatattactgggcatggcaattttggagcagagaacagccatgaggtcgccgcgaccatgcctactcctggctttgagaatggcagttggaacaccaatgattatcatgtcctaaatgatgcctgcaaggtcgagctcgcatatgatccagctccagtcagctcatctgaagcttgcttgtcatcatttgttccaatgtcggaaatctgccccaacatgagcaatagtagcagtatggaggagaaccaccagactaatcctggccttggcacacctacgcaagctttccccaaaagaaccggctttgatgttgtgccctgccctgataggggctcggtcatctcgcgctataaggagaagaggaagacaagaagattcgacaggcaggttcggtatgaatcacgcaaagttcgtgctgatggcaggctcaggatcaaggggcgttttgcaaaggcaaaccagacttaaaatttaaggagcaaactgattagcagtgaagataatacaaaatctgccatagttttgtttgccttcagttccatagctgatagctcatagcctcatacacagtttgaatgttgtatgtatattgccgtcatatggatacacttatttgaaaagagatccagtccctgtaaatagtcttacacccacgaaaaaaaaaaaaaaaaaaaa

SEQ ID NO: 656 - protein, 414 aa, Panicum virgatum
  misc_feature: Ceres CLONE 1726489
  misc_feature (3)..(48): Pfam Name: zf-B_box Pfam Description: B-box zinc finger
  misc_feature: The sequence is a functional homolog of  SEQ ID NO 1628 in the  11/479,226 US patent application
  misc_feature: The sequence is a functional homolog of  SEQ ID NO 798 in the  10/412,699 US patent application
  misc_feature: Useful for making plants with modulated growth and phenotype characteristics
MGEEEQRKHMVGSELDQELEPRQGEEEKVKEEAKKSAPGDAEAGDGAAAEAASCDYCGAAAAAVYCRADAARLCLPCDRHVHGANEVCSRHARAPLCADCRAAGAVFRHASSAAFLCSNCDFGRHRDGSGGEPAFHDRCAVQPYSGCPPATELAALLGVPLFDKPAAEDGGWWNIWEEPQVLSLEDLIVPTTPCHGFQPLLTPSSPKNRSISADENTNEEILRQLGELAESDGGVQAAAGHEEAEQAGDQFPSWTPPPQYITGHGNFGAENSHEVAATMPTPGFENGSWNTNDYHVLNDACKVELAYDPAPVSSSEACLSSFVPMSEICPNMSNSSSMEENHQTNPGLGTPTQAFPKRTGFDVVPCPDRGSVISRYKEKRKTRRFDRQVRYESRKVRADGRLRIKGRFAKANQT

SEQ ID NO: 657 - DNA, 1732 bp, Panicum virgatum
  misc_feature: Ceres CLONE 1726495
  misc_feature: Encodes the peptide sequence at SEQ ID NO. 658
aaaaaaaaccttctgaagccaaagccaccgcatacaacaatggtttcagctgctatgcagagcaagaagctgcgcatccttgtggtgcccttcttcgccaccagccacatcctccccatgacagacctcgccttccacctcgccgcggttaggccggacgatgtcgaggtcgtcgtcgccgtaaccccggcaaacgcccccattgtgcagtcagcccttgcaaggcgcgagcccagccatgccagcgttgaggtcgcgacctacgccttcccaaaggtagacgggctcccaccaggggtcgagaacatgtccaccgtcacggtcgcgaactcaccgctcctcgaggcagcagccactgatgaggcgctaattaggccagctcaggagagcctcatcagggagagctcgcctgatgccatcgtcagcgacctgcacttcttccggtggaacgctggtattgccgccgaacttgggatcccctgtgttctattcaatgtcgtgggtattttctcgacgctagctacgtggcgccttgctttaagtggcattgttaaggacacccctcctgctagttcggtgaccgttcctcagttacccggtccagaaataagtctgccagttactgagctgtcagagtttttgaggaacccaccggaatttggcaaggacgcaggtgcttacttcatgatgttgctcaagagctctggctttatttccaacactttctatgatctcgagcatgagtactgtgagagctacgcggaaagcggctatgtgaagcgaacctactgtgttggtccgctttcactgcccttgccaccaccagcaagagcaggtactggccgctcagcttgcttggattggctggacacaaagcctgcccactccgttgtgtacttgtgcttcggcagcctgacaaacttttctgatgttcaacttaatgagctagccctcggactggaagcctctggtgtgccattcttgtgggttgttagggttaaaacatgggagccaccggtagggtggaaagaccgtgtagggaatagaggcatggttgtcatgggttgggccccacaaaccgatatactccagcacccagcactgggggcatttgtgacccaatgcgggtggaactccatcctggagacaattgcggttggcgtgcctgtcttgacatggccaaaggtgtacgagcagttcatcactgagaggtttgtgactcatgtgttgcaaatcggggagcgcctgtggccggagggtgctgggcggcgtagcacgaggagtgcagagcatgaagtgatccctgctaaggaaattgcgcaatctgttgccaagttcatgggacatggaggtgctgcagaagccgcgaggagaagggtaaaggaactttctccaaaggctcatgcggctttggcagaaggcggaacctctaaccgtgatctgcatcagcttattgatgatttcattgctgcaaaagcatctgctgctgggactacgacgtcatgaaaagattgagaatccaggtggaacgcaaggtttaatttcatgaagaagggggaggtggctatctatgcatgtgccatggtgtttcaagaataaaagtttgttgtcccgcaaacggttcactgtaaaatgtatctgcgagcggacatttcaaagatgatatgtattggtacttttaataaatttaaagtatcgcattgttgttggtcaaaaaaaaaaaaaaaaaaaa

SEQ ID NO: 658 - protein, 488 aa, Panicum virgatum
  misc_feature: Ceres CLONE 1726495
  misc_feature (2)..(125): Pfam Name: UDPGT Pfam Description: UDP-glucoronosyl and UDP-glucosyl transferase
MVSAAMQSKKLRILVVPFFATSHILPMTDLAFHLAAVRPDDVEVVVAVTPANAPIVQSALARREPSHASVEVATYAFPKVDGLPPGVENMSTVTVANSPLLEAAATDEALIRPAQESLIRESSPDAIVSDLHFFRWNAGIAAELGIPCVLFNVVGIFSTLATWRLALSGIVKDTPPASSVTVPQLPGPEISLPVTELSEFLRNPPEFGKDAGAYFMMLLKSSGFISNTFYDLEHEYCESYAESGYVKRTYCVGPLSLPLPPPARAGTGRSACLDWLDTKPAHSVVYLCFGSLTNFSDVQLNELALGLEASGVPFLWVVRVKTWEPPVGWKDRVGNRGMVVMGWAPQTDILQHPALGAFVTQCGWNSILETIAVGVPVLTWPKVYEQFITERFVTHVLQIGERLWPEGAGRRSTRSAEHEVIPAKEIAQSVAKFMGHGGAAEAARRRVKELSPKAHAALAEGGTSNRDLHQLIDDFIAAKASAAGTTTS

SEQ ID NO: 659 - DNA, 1921 bp, Panicum virgatum
  misc_feature: Ceres CLONE 1726498
  misc_feature: Encodes the peptide sequence at SEQ ID NO. 660
atttctctcgccaatgctcgaggactagtcagtcctctctctctccttttcgctcctcgcctccgccgtttctgctcgccattcctcgcccgcgtcttcgcgtccggccgccgcgggtcgccccctccccctcgtttcccacccccgctccacgtcgcgggcgccgggggtgccgctccggggcgccaggtgcgcgcgcgcgctcggttcgggagatctcgggggctgctggttgcttggtcctggagagggggcggaagaggagggcgctgtgttgctggggtgaggccagctaaggtttgcagctctgcggaggggtagctggtggagggcggttggggatgtacgggccgccgtcccgcggcggcgggggcgccggtgcctccggcgagcagcctagggtttaccaagtctggcggggaagcaacgagtttttgttacaaggccggttcatatttggacctgatgtgagatccttgtttctcactatattcctcattcttgcaccagtggtggtcttctgcatatttgtggccagacatcttatcaatgactttcctgatcactggggaatttcagttatggtcatagtgatcgtcttcacagcatatgatttgacactgctgcttcttacctctggtagagatcctggtatagtgcctcgtaacacccatcctcctgaacctgaagccattgatatgaacaatgattctggaaatggtcagacaccacagcaattgcgtttgccacggacaaaggatgtgatcgtaaatggagtcattgtgaaggtcaagtactgtgacacctgcatgctgtatcgaccacctcgatgctcgcactgttctatctgtaataactgcgtggagcgctttgatcaccactgtccttgggttgggcaatgcataggattgcgcaattatcggttcttctatatgtttgtattctctacgacattactctgcctatacgtgtttggcttctgctgggtgtatattgtcaagatcagagatgcagaacagtcgtcgatctggaaagcaatgttgaagacgccagcatcaatggttctgatcatctactgcttcatctgtgtgtggtttgtaggtggcctgtctgtcttccatttctacctgatgagcactaaccagacaacctatgaaaacttcagatatcgctatgatcgacgggccaatccatacaacatagggattgtgaacaacttcatggagatcttctgcactgcagtccctccttcaaagaacaatttccgagctagggtcccagcagagcaaggtttacagcaaccacgtgcaccagcaaggggattcatgagcccgaacatgggcaaacctattggtgattttgaactgggtaggaagccggtatcctgggatgaacctcggtcagcagctgatatcagagacttggaggttggtctaggcggtctattggacgagaaagaaggcagaatagctcatgcatccccagatttgagcagagaagaccttcctgagcttatggaaggaagggctggtatgcattcaaggcgatcaagttggggtcacagaagtgggacttcagagtcaatggacagtattgccgtgcaaatgggaactggagaatctcactggggctcgattagcagtgtccatggtggtacttccagtagagctcactagcgcaccgcagcacgttttaactcatcagaactcatcctctcgtgaaacctgcctctgatactgaacgaagaagcaacagccctgtgtgtttctgcgtgcttgtgctttcgctccgcctaggacatactttggtgctttcttactcgcgtccctgttgtttcatcctggaagcgaatcagttcttctgatgctgcccttcctgtttggtgttctaagcaaaaaataacagaagagctcttcaactc

SEQ ID NO: 660 - protein, 444 aa, Panicum virgatum
  misc_feature: Ceres CLONE 1726498
  misc_feature (1)..(65): Pfam Name: zf-DHHC Pfam Description: DHHC zinc finger domain
MYGPPSRGGGGAGASGEQPRVYQVWRGSNEFLLQGRFIFGPDVRSLFLTIFLILAPVVVFCIFVARHLINDFPDHWGISVMVIVIVFTAYDLTLLLLTSGRDPGIVPRNTHPPEPEAIDMNNDSGNGQTPQQLRLPRTKDVIVNGVIVKVKYCDTCMLYRPPRCSHCSICNNCVERFDHHCPWVGQCIGLRNYRFFYMFVFSTTLLCLYVFGFCWVYIVKIRDAEQSSIWKAMLKTPASMVLIIYCFICVWFVGGLSVFHFYLMSTNQTTYENFRYRYDRRANPYNIGIVNNFMEIFCTAVPPSKNNFRARVPAEQGLQQPRAPARGFMSPNMGKPIGDFELGRKPVSWDEPRSAADIRDLEVGLGGLLDEKEGRIAHASPDLSREDLPELMEGRAGMHSRRSSWGHRSGTSESMDSIAVQMGTGESHWGSISSVHGGTSSRAH

SEQ ID NO: 661 - DNA, 1559 bp, Panicum virgatum
  misc_feature: Ceres CLONE 1726505
  misc_feature: Encodes the peptide sequence at SEQ ID NO. 662
actctgacttgacatgggaacaaagccagccaccagccacacaagcatatcattcaccccctgtacctttcctcctctcttcaccccatcttctgctgatcttccatcccaaacatctctcaagcatatgtgtgagttcatctgttcttcccatccactgctagctagggtttcttgagtcttggcatcagttcgccttctttctcttttgattggcacacaaagaaaggactatggatagcttcagggatcttggcggcggaggcgggagcagtgcttccaaggcttccttcctgcagcttccgctgccggcgtcgtcgtcggctcagggttttccatcgccagacgggcatcaccacagctcacggctcgcgctgcagcagttacttgccgacccgtcagggtcgcagagtagccacaggatggacggagcagttctgcaaagagagatttcgccggtagatcatgccgagaccatcaaggccaagatcatgtcgcacccccaatactcggctctcgccgccgcctacttggactgccaaaaggtcgccgcgccgccggatgtgtcggataggctctcggccatggcggcgaagctggacgcgcagccggggccaagccggcggcggcacgagccggcgcgcgctgacccggagctcgaccagttcatggaggcttactgcaacatgctggtcatgtaccaggaggagctggcgcggccgatccaggaagccgccgagttcttcaagagcgtggagcggcagctcgattcgatcaccgacagtaactactgtgaaggcgccggctcgtccgaggatgaccaggacgcgagctgtcctgaagagatcgatccctgcgccgaggacaaggagctgaagcaccagctcctgaggaagtacggcggctacctgggcggcctccggcaggagttctccaagaggaagaagaaagggaagctcccgaaggaggccaggcagaagctgctgcactggtgggagctgcactacaagtggccctacccttccgagacggagaagctggcgctggcggagacgacagggctggaccagaagcagatcaacaactggttcatcaaccagcggaagcggcgctggaagccgacatcggaggacatgccgttcgcgatggtggaggcggcgggcgggttccacgccccgcagggcaccgcggcggcggcggcggcgctgtacatggcggacggcatgtaccggctggggtcgtgacgtgtcgagatcgatcgctcctgctgcatgcgcgtcacatgcatgctcggacgcccagcgaagctgccggcctgctgccaatccatggtacggggtttactgtggaatcacatccatggcatgcagtggcaaggtaaaaagcctagctaataaagctgctcgaggtacggtgtgattgctgatgaggatttattgaggtggatggtgtgcactttcaactgtggatggcgtcattgacttgatcaagaacgattgtaatccttctatctaatcaataaagctctcccttaccggcaaaaaaaaaaaaaaaaaaaa

SEQ ID NO: 662 - protein, 336 aa, Panicum virgatum
  misc_feature: Ceres CLONE 1726505
  misc_feature (1)..(60): Pfam Name: Homeobox Pfam Description: Homeobox domain
MDSFRDLGGGGGSSASKASFLQLPLPASSSAQGFPSPDGHHHSSRLALQQLLADPSGSQSSHRMDGAVLQREISPVDHAETIKAKIMSHPQYSALAAAYLDCQKVAAPPDVSDRLSAMAAKLDAQPGPSRRRHEPARADPELDQFMEAYCNMLVMYQEELARPIQEAAEFFKSVERQLDSITDSNYCEGAGSSEDDQDASCPEEIDPCAEDKELKHQLLRKYGGYLGGLRQEFSKRKKKGKLPKEARQKLLHWWELHYKWPYPSETEKLALAETTGLDQKQINNWFINQRKRRWKPTSEDMPFAMVEAAGGFHAPQGTAAAAAALYMADGMYRLGS

SEQ ID NO: 663 - DNA, 1454 bp, Panicum virgatum
  misc_feature: Ceres CLONE 1726522
  misc_feature: Encodes the peptide sequence at SEQ ID NO. 664
actgttccacagcacaacacataaggatccaggcagcagtacacaaacccaggaccgatcgaatcacgacgcatggcggccaaggccaactcgagcccatcagagcttgtgcaggcgcacgtcgacctctggaacctcacctacagctaccacaagtccatggccctgcagtgcgccgtggagctcgggatccccaccgccatccaccgccgcggcggcgccgcctccctccccgacctcctcgccaccctcccggtgccccaggccaggaagccccacctgcctcgcctcatgcggttcctcgtcgtgaccggcgtcctcgccctcgacgccgcccccgccggggacgccggcagcagcggcggcgtgtaccgcctcacgccgctgtctcgcctcctcgtggacgacgccggcgccggcgcccgcgccaacgggtgcacgggcacggccagcctcgcgccgttcgtgctcgcccagaccaacaggtaccacgtcggcgcggccatgcgcctgtcggagtggttccggggcggcccggacggcgacgacacgcccttccggatggcgcacggcacggaccagtgggacgcgtggcgccgcgacccggaggtgaacaaggtgttcatggacgggctcggggccgacagccagctcaccatggacttcgtggtgacccggtgcggcgaggtgttcgacggcgtcggcacgctggtcgacgtcggcggcgggaacggcagcacggcgagggccatcgcgagggcgttcccgcacgtcaggtgctcggtgctggacctcgcccacgtcatcggccacatccagccgtccgatggcgttcagtacatagtcggtgatatgatgagctcgatccctcctgctgacgctgtgctgctcaagcacgtcttgcatgactggaacgacgaggactgcgtcaggatcctaactcaatgcaagaaggccattgtttcggaggagaaaccatcaggagggaaagtgatcatcatagacacagtcgtcgggtctcctgccgatgacgtcatgttcctagcccaggtcacgttcgatctgaacatgctggtgacgacgccgggcagggagcgcgacgagcacgagtggcgcagtatattcacggccgcggggttcgggcaccacaagaagaggccagtcctggggtttctctcaatcatcgagctgtatccatagcgacaaaaaaaaaagcagcacacgtgcgagccacgaaaatacgtggtgtggattcattctatgatctatcatttgctggccaggcccagctgtgtctgtcagtttcacaaaataattaagaagtaaactgtgtacttgcgccttcagtggcttattaatgccagacgatcatggtctggccagttgcatgttcctttaaagggaaagaacgaataacagtagctcccttgagttaaaaaaaaaaaaaaaaaaaa

SEQ ID NO: 664 - protein, 375 aa, Panicum virgatum
  misc_feature: Ceres CLONE 1726522
  misc_feature (5)..(249): Pfam Name: Methyltransf_2 Pfam Description: O-methyltransferase
MAAKANSSPSELVQAHVDLWNLTYSYHKSMALQCAVELGIPTAIHRRGGAASLPDLLATLPVPQARKPHLPRLMRFLVVTGVLALDAAPAGDAGSSGGVYRLTPLSRLLVDDAGAGARANGCTGTASLAPFVLAQTNRYHVGAAMRLSEWFRGGPDGDDTPFRMAHGTDQWDAWRRDPEVNKVFMDGLGADSQLTMDFVVTRCGEVFDGVGTLVDVGGGNGSTARAIARAFPHVRCSVLDLAHVIGHIQPSDGVQYIVGDMMSSIPPADAVLLKHVLHDWNDEDCVRILTQCKKAIVSEEKPSGGKVIIIDTVVGSPADDVMFLAQVTFDLNMLVTTPGRERDEHEWRSIFTAAGFGHHKKRPVLGFLSIIELYP

SEQ ID NO: 665 - DNA, 1589 bp, Panicum virgatum
  misc_feature: Ceres CLONE 1726533
  misc_feature: Encodes the peptide sequence at SEQ ID NO. 666
cttccactccgtctcgcccaatcgccattattcagagctccgtggaggccaaatttcgcccccgaaatccttgctgccactgcccccctttccctccccccttgcttccccccacgcttcagttacctcttccgcgcaaagcatcacacccccccagctggaacccaccgtgcctgcaggcttaaccttgaagcttccgattacctttccgttccttgtccatttgcgaagggatataacgtgcagggcctgcggggatgcgccttcacgcggaggtgctggccgagatggaggggcaggaggaggagggagctgcgatggcctcgacggttctgtcgccgccgctcgtcggcgcggcggtggcggctgccacggcgcccaggctagtggtgggctacgccctcacgaagaagaaggtgaagagcttcctccagcccaagctgctcatgctggcgaggaggaacggaatcagttttgtttctattgatgagtctcttcccctctcagaacaaggaccttttgatgttattttgcacaagattactagcaaggaatggcagcaggttctggaggactaccttgaagaacatccagaagttactgtcctcgaccctccaaatgctatcgagcatctgaacaatcgacaatcaatgcttgaggaagtagctgatttgaacctatcgaatttctatggagaagtttgtaccccacggcaactggtcattacgaaagatccatcctctataccaacagctgtagcaatggctggactaacttttcccttggttgccaagccattggttgttgatggaacatcaaaaggtcacgaactatatcttgcatatgatgaggcctccttgtcaatgcttcatccacctctggttctacaggaattcataaaccatggcggtatcctctttaaggtctatatcattggtgaaacagtacaagttgtccgcaggttctcccttcctgatgtcaacacatatgacttgctaaacaacgttggcatctatcgattgccaagagtttcatgtgccacagctagtgcggatgatgcagaccttgaccctcttattgcagagcttcctccaaggccacttctggagaaactggggagggagcttcgcagccggctggggttgagattgttcaatgttgatatgattagagaacttggaaacaaagatcggtactacataattgacatcaactacttcccaggttttgggaaaatgccaggatatgagcacatgttcaccgacttcttactgagtcttgcgcaaagcaagtacaaaaggtacttaagcgggacctgaagcgcaaggaagcttgcgagcgaagaggcgtcactgacaaaatggcatataacggtggcagctgtgctcctccaccgatgtacatattccggagacaagcataagccggaggctcgaggaagtcgcagtttgtttcttcaaaagtggtggcacatggtggattctgagtaggaaatgaccaaggaaatgtttggatggcctgcgcccatgtggtaaaatgttgtttactgaatgcgtgcctttcttcgtgaaaaaaaaaaaaaaaaaaaa

SEQ ID NO: 666 - protein, 353 aa, Panicum virgatum
  misc_feature: Ceres CLONE 1726533
  misc_feature (2)..(305): Pfam Name: Ins134_P3_kin Pfam Description: Inositol 1, 3, 4-trisphosphate 5/6-kinase
  misc_feature (2)..(313): Pfam Name: Ins134_P3_kin Pfam Description: Inositol 1, 3, 4-trisphosphate 5/6-kinase
  misc_feature (10)..(348): SWISSPROT Homolog: EC 2.7.1.134 Inositol-tetrakisphosphate 1-kinase 2
MRLHAEVLAEMEGQEEEGAAMASTVLSPPLVGAAVAAATAPRLVVGYALTKKKVKSFLQPKLLMLARRNGISFVSIDESLPLSEQGPFDVILHKITSKEWQQVLEDYLEEHPEVTVLDPPNAIEHLNNRQSMLEEVADLNLSNFYGEVCTPRQLVITKDPSSIPTAVAMAGLTFPLVAKPLVVDGTSKGHELYLAYDEASLSMLHPPLVLQEFINHGGILFKVYIIGETVQVVRRFSLPDVNTYDLLNNVGIYRLPRVSCATASADDADLDPLIAELPPRPLLEKLGRELRSRLGLRLFNVDMIRELGNKDRYYIIDINYFPGFGKMPGYEHMFTDFLLSLAQSKYKRYLSGT

SEQ ID NO: 667 - DNA, 1799 bp, Panicum virgatum
  misc_feature: Ceres CLONE 1726554
  misc_feature: Encodes the peptide sequence at SEQ ID NO. 668
caccaagcagagaccaagccagtgggtgttccgagagcatagccagccagccacaatggcgggaaacctgctatctaactatgtccaggtctacgtcatgctcccgctggatgtcatcactgtcgacaacacgttcgagaaggccgacgagacgagggtgcagctgcagaagctggtggaggccggcgccgacggggtcatgatcgacgtctggtgggggctggtggaagggaaggcgcccggggtctacgactggagcgcctacaagcaggtgttcaagctggtgcaggaggccgggctgaagctgcaggccatcatgtcgtgccaccagtgcggcggcaatgtcggcgacatcgtcaacatcccgatcccgcagtgggtgcgggacgttggtgaggccaaccccgacatcttctacaccaaccggaggaagatgaggaacatcgagtacctcacgattggagtggatgaccagcctctcttccaggggagaactgcaattcagctctatgctgattacatgaagagcttcagggagaacatggcagagttcttggacgctggtgtcatcgtggacattgaggtcggacttggccctgctggagagatgaggtacccctcctatccacagagccagggatgggtgtacccaggcgttggagagttcatatgctatgacaagtacctggaagcagacttcaaagctgcagcaacaaaagctgggcatcctgagtgggaattgcctgatgacgctggggagtacaatgacactcctgagaaaacccagttctttgcggacaacggaacataccagaccgagaaggggaagttcttcctcacatggtactccaacaaactgatcaagcacggcgataagatcttggacgaagcaaacaaggtcttcttgggatgcagagtgcagctggccatcaaaatctctggcattcactggtggtacagggttccaaaccatgcagctgagctcactgccgggtactacaacttagatgacagagacggttacagaaccatagcgcacatgctcacaaggcatcgtgctagcatgaacttcacttgtgctgagatgagggacaatgaacagagttcggaagcaaaaagtgcacctgaggaactggttcagcaggtgctgagtgccggatggagggagggcctaaacatagcatgtgaaaatgcactcagtcgctatgatgccacagcttacaacacaatcctcaggaatgcaagaccacaaggaatcaacaagaatggccctcctgaacacaagttgtatgggttcacctacctccgagtatcgaatgagctccttgaaggacagaactatgccactttcaaaacttttgtcaggagaatgcatgctaacctggattataacgcaaacatcgatccacttgcacctatggaaagatcaaagccagagataccaatcgaacaaatcctggaagtagcacagccaaagctggagccatttcctttcatcgagaacacagatctaccagtttaaacatcccaatggttcaatttcaatctacaagaaggggcacaaggaactttaagaatcaagacaaacacagtacgcctattgtcgaacaatatgctgaaactaaataaactgctatgttaagcagactacaatcatgttgcaccaataatcttgtgttgttcaacctgaggcttgatgcttgtctaatgagctgtaataccttggccttcacattgttgtatgtatttgagctaatgaataaaaaagttatgtggctcaaaaaaaaaaaaaaaaaaaa

SEQ ID NO: 668 - protein, 488 aa, Panicum virgatum
  misc_feature: Ceres CLONE 1726554
  misc_feature (2)..(423): Pfam Name: Glyco_hydro_14 Pfam Description: Glycosyl hydrolase family 14
  misc_feature (1)..(423): Pfam Name: Glyco_hydro_14 Pfam Description: Glycosyl hydrolase family 14
  misc_feature (1)..(380): Pfam Name: Glyco_hydro_14 Pfam Description: Glycosyl hydrolase family 14
  misc_feature (1)..(488): SWISSPROT Homolog: EC 3.2.1.2 Beta-amylase
MAGNLLSNYVQVYVMLPLDVITVDNTFEKADETRVQLQKLVEAGADGVMIDVWWGLVEGKAPGVYDWSAYKQVFKLVQEAGLKLQAIMSCHQCGGNVGDIVNIPIPQWVRDVGEANPDIFYTNRRKMRNIEYLTIGVDDQPLFQGRTAIQLYADYMKSFRENMAEFLDAGVIVDIEVGLGPAGEMRYPSYPQSQGWVYPGVGEFICYDKYLEADFKAAATKAGHPEWELPDDAGEYNDTPEKTQFFADNGTYQTEKGKFFLTWYSNKLIKHGDKILDEANKVFLGCRVQLAIKISGIHWWYRVPNHAAELTAGYYNLDDRDGYRTIAHMLTRHRASMNFTCAEMRDNEQSSEAKSAPEELVQQVLSAGWREGLNIACENALSRYDATAYNTILRNARPQGINKNGPPEHKLYGFTYLRVSNELLEGQNYATFKTFVRRMHANLDYNANIDPLAPMERSKPEIPIEQILEVAQPKLEPFPFIENTDLPV

SEQ ID NO: 669 - DNA, 1903 bp, Panicum virgatum
  misc_feature: Ceres CLONE 1726555
  misc_feature: Encodes the peptide sequence at SEQ ID NO. 670
gaaaaaaggaaaaaagaaaaatccgaaatggccggtagtggccttggcctctccacctccttcctccccgcccacgacacgctcctccggcgccggcgccggcggccggcgagccccgccgccgtgtcgttccggccggtgacagcggagctcggcggcgtcgcgacggcgctggggcggcagctggtggaggcggtgggcgtggggctcccctgcaccgtcatgcagtgcggcgacgtcatctaccgcagcacgctgccccacaacgacgggctcaccatcacggcccccggcgtcgcgcttgctctcgccgccgtatcgtacctttgggccacacccggcgtggcgccggggttcttcgacatgttcgtgctcgccttcgccgagcgcctcttccgccctaccttccgcaaggacgacttcgtgctcgggaagaagcttggggagggcgcgttcggggttgtgtgcaaggcgtcactcgcgaaccccgaagccgcggagaagcaaggggatgtggttgtgaagaaggcaacagagtatggtgcagttgagatttggatgaatgagcgtgtcaggagggcttgtgctagtagttgtgcggattttctttatggatttcgcgagagcaaagcgaaagggaagggggctgaagaatattggcttatttggcgttttgaaggcgaggatacactttatgatctcatgcaaagcaaggaattcccttataatgtggagacgaagattcttggtgatgtccaggacttgccaaagggaatagcaagagagaataagatcattcaaacagtaatgagacaactcttatttgctcttgatggacttcattcgacggggattgttcacagagacataaaacctcaaaatgtgatattttcagagggatcgagaaccttcaaaattatcgatcttggagcagcagctgacttaagagtaggcatcaactacattcccaaagagttccttttggatccaaggtatgctgcaccagagcaatatatcatgagcacacaaacaccatccgctccttctgttccagttgcaacaactttgtctccagtcctgtggcagctgaatcttcctgacagatttgacatatatagcttgggcctcatattcttacagatggcatttccttctttacgaactgacagcagccttatacaattcaaccgccaactgaagaggtgtgattacaacttagaagcttggaggaatctggtggaaccacgagcgagcgctgagcttcggaggggctttgacatcatggatctagacaatggcattggatgggaactcctcacatcgatggtccggtacaaagcgcggcaaaggattagtgctaaggccgcgttggcacacccatacttcaaccgtgaagggcttcttggcctctctgtcatgcaaaacatacaactgcaactgttccgggcaacccagaaggactacagtgaagcagctcgatgggttgtcggcctcatggcaaggtcaagaactgaagatgtgggaggatttacagaagcacagcttcaagagcttagggaaataaagccaaagaaagtcagcgcccagcggaacgtgctggcctctgtgctgcgcgtgcagaggaagatcgtgacaacgatcaaagagagcatggacgagctcaccagccagcgcaaaagcatctggtggagccggtggatacccagggagtagtaggccggcgcacctgtacattgccctactcttctgtataaaacgtcgcccattagcgctggaccactggtcatggtacactatacaataccgcttacttcgtacatgctggagactggtgagtacaatttgtctgaaagactgcagtaacacgatgtatagatgtaaacaaaaaaaaaaaaaaaaaaaa

SEQ ID NO: 670 - protein, 561 aa, Panicum virgatum
  misc_feature: Ceres CLONE 1726555
  misc_feature (29)..(561): SWISSPROT Homolog: EC 2.7.11.1 Serine/threonine-protein kinase SNT7, chloroplast precursor
MAGSGLGLSTSFLPAHDTLLRRRRRRPASPAAVSFRPVTAELGGVATALGRQLVEAVGVGLPCTVMQCGDVIYRSTLPHNDGLTITAPGVALALAAVSYLWATPGVAPGFFDMFVLAFAERLFRPTFRKDDFVLGKKLGEGAFGVVCKASLANPEAAEKQGDVVVKKATEYGAVEIWMNERVRRACASSCADFLYGFRESKAKGKGAEEYWLIWRFEGEDTLYDLMQSKEFPYNVETKILGDVQDLPKGIARENKIIQTVMRQLLFALDGLHSTGIVHRDIKPQNVIFSEGSRTFKIIDLGAAADLRVGINYIPKEFLLDPRYAAPEQYIMSTQTPSAPSVPVATTLSPVLWQLNLPDRFDIYSLGLIFLQMAFPSLRTDSSLIQFNRQLKRCDYNLEAWRNLVEPRASAELRRGFDIMDLDNGIGWELLTSMVRYKARQRISAKAALAHPYFNREGLLGLSVMQNIQLQLFRATQKDYSEAARWVVGLMARSRTEDVGGFTEAQLQELREIKPKKVSAQRNVLASVLRVQRKIVTTIKESMDELTSQRKSIWWSRWIPRE

SEQ ID NO: 671 - DNA, 2716 bp, Panicum virgatum
  misc_feature: Ceres CLONE 1726558
  misc_feature: Encodes the peptide sequence at SEQ ID NO. 672
tctcttcagttccggagaaaccctcctcctccattggactgctccccgtttgaccattggtaattgagtaccattgagccatggctgccaagctgactcgcctccacagtcttcgcgaacgacttggtgccaccttctcctctcatcccaatgagctgattgcactcttttccaggtatgttaaccagggcaagggaatgcttcagcgccatcaactgcttgctgagtttgatgcgctgtttgatagtgacaaggagaagtatgcaccctttgaagactttcttcgtgctgctcaggaagcgattgtgcttcccccctgggttgcacttgctatcaggccaaggcctggtgtctgggactacattcgggtgaatgtaagtgagttggctgtggaagagctgagtgtttctgaatacttggcattcaaggaacagctggtggatggacacaacaacagcaactttgtgcttgagcttgactttgagcccttcaatgcctcattccctcgtccttccatgtcaaagtccattggaaatggagtacagttccttaacaggcacctgtcttccaagttgtttcaggacaaggagagcttgtaccccctgctgaactttctcaaagcccataactacaagggcacgacaatgatgttaaatgacagaattcagaatcttcgcgggctccagtcatccctcagaaaggcagaggagtacctactgagcatccctcaagatactccatactcagagttcaaccacaggttccaagagctcggcttggagaaaggttggggtgacaccgcaaagcgtgtacttgacacactccacttgcttcttgaccttcttgaggctcctgatcctgccaacttggagaagttccttggaactatgcctatgatgtttaatgttgttatcctgtctccacatggctactttgcccaatccaatgtacttggataccctgatacgggtggtcaggttgtgtacattttggaccaagtccgtgctttggagaatgagatgcttctcaggattaagcagcaaggccttgatatcacccctaagatcctcattgttaccaggttgttgcctgatgctgttggtactacttgtggccagcggctagagaaggtcattggaactgagcacacagacattattcgtgttccattcagaaatgagaatggtattcttcgcaagtggatctctcgttttgatgtctggccatacctagagacatacactgaggatgttgccagtgaaatcatgaaagaaatgcaagccaagcctgaccttatcattggcaactacagtgatggcaacctagttgccactctgcttgcgcacaagctgggagttactcagtgtaccattgcccacgccttggagaaaaccaaataccctaactcagacatatacttggacaaattcgacagtcagtatcacttctcatgccagttcacagctgaccttattgctatgaatcataccgatttcatcatcacaagtacattccaagaaatcgctggaagcaaggacactgttgggcaatatgagtcccacattgcatttacacttcctgggctctaccgtgttgtccatggcattgatgtttttgatcccaagttcaatatcgtctctcctggagcagacatgagtgtgtactacccatacactgaaactgacaagagactcactgccttccaccctgagattgaggagctcatttacagtgatgttgagaactcggagcacaagtttgtcttgaaggacaagaacaagccgatcattttctcaatggctcgtcttgaccgtgtgaagaacatgacaggcttggttgagatatacggtaagaatgcgcacctgagggaattggcgaaccttgtgattgttgctggtgaccatggcaaggagtccaaggacagggaggagcaggcagagttcaagaagatgtacagtctcattgaccagtacaatttgaagggccatatccggtggatctcggctcagatgaaccgtgtccgcaatggggagttgtaccgctacatttgtgacacaaagggagcatttgtgcagcctgcattctatgaagcgtttggcctgactgtcattgagtccatgacatgtggtttgccaacaattgcgacctgccatggtggccctgctgaaatcattgtggacggggtgtctggtttgcacattgacccttaccacagtgacaaagcggcagatatcttggtcaacttctttgacaagtgcaaggaggatccgagctactgggacaaaatttcacaaggaggcctgcaaagaatttatgataagtacacctggaagctgtactccgagaggctgatgaccctgactggtgtatacggattctggaagtatgtgagcaacctggagaggcgtgagactcgtcgctaccttgagatgttctatgctctcaaataccgtagcctggcgagttctgttccattgtccttcgattagtgcgtgaaagaagaacatcaagcgggagagctatcagctgcattacaattgtttactgcaatttgcattgttagtcatgtgtttgagtaatgtgtacttgaattccaagcactttactttttcgcgaggttttgggcggcgctggctggttcctgccctaggatactagctgcaccttttcgcttccaataaacgcctgctcatgtcaaaaaaaaaaaaaaaaaaaa

SEQ ID NO: 672 - protein, 802 aa, Panicum virgatum
  misc_feature: Ceres CLONE 1726558
  misc_feature: Great-hit functional homolog of the protein sequence encoded by LOCUS At3g43190
  misc_feature: Great-hit functional homolog of the protein sequence encoded by LOCUS At5g20830
  misc_feature (5)..(546): Pfam Name: Sucrose_synth Pfam Description: Sucrose synthase
  misc_feature (1)..(538): Pfam Name: Sucrose_synth Pfam Description: Sucrose synthase
  misc_feature (1)..(540): Pfam Name: Sucrose_synth Pfam Description: Sucrose synthase
  misc_feature (1)..(548): Pfam Name: Sucrose_synth Pfam Description: Sucrose synthase
  misc_feature (1)..(547): Pfam Name: Sucrose_synth Pfam Description: Sucrose synthase
  misc_feature (1)..(187): Pfam Name: Glycos_transf_1 Pfam Description: Glycosyl transferases group 1
  misc_feature (8)..(542): Pfam Name: Sucrose_synth Pfam Description: Sucrose synthase
  misc_feature (1)..(545): Pfam Name: Sucrose_synth Pfam Description: Sucrose synthase
  misc_feature (1)..(802): SWISSPROT Homolog: EC 2.4.1.13 Sucrose synthase 1
  misc_feature: Useful for making plants with altered cell wall content and/or composition
MAAKLTRLHSLRERLGATFSSHPNELIALFSRYVNQGKGMLQRHQLLAEFDALFDSDKEKYAPFEDFLRAAQEAIVLPPWVALAIRPRPGVWDYIRVNVSELAVEELSVSEYLAFKEQLVDGHNNSNFVLELDFEPFNASFPRPSMSKSIGNGVQFLNRHLSSKLFQDKESLYPLLNFLKAHNYKGTTMMLNDRIQNLRGLQSSLRKAEEYLLSIPQDTPYSEFNHRFQELGLEKGWGDTAKRVLDTLHLLLDLLEAPDPANLEKFLGTMPMMFNVVILSPHGYFAQSNVLGYPDTGGQVVYILDQVRALENEMLLRIKQQGLDITPKILIVTRLLPDAVGTTCGQRLEKVIGTEHTDIIRVPFRNENGILRKWISRFDVWPYLETYTEDVASEIMKEMQAKPDLIIGNYSDGNLVATLLAHKLGVTQCTIAHALEKTKYPNSDIYLDKFDSQYHFSCQFTADLIAMNHTDFIITSTFQEIAGSKDTVGQYESHIAFTLPGLYRVVHGIDVFDPKFNIVSPGADMSVYYPYTETDKRLTAFHPEIEELIYSDVENSEHKFVLKDKNKPIIFSMARLDRVKNMTGLVEIYGKNAHLRELANLVIVAGDHGKESKDREEQAEFKKMYSLIDQYNLKGHIRWISAQMNRVRNGELYRYICDTKGAFVQPAFYEAFGLTVIESMTCGLPTIATCHGGPAEIIVDGVSGLHIDPYHSDKAADILVNFFDKCKEDPSYWDKISQGGLQRIYDKYTWKLYSERLMTLTGVYGFWKYVSNLERRETRRYLEMFYALKYRSLASSVPLSFD

SEQ ID NO: 673 - DNA, 1933 bp, Panicum virgatum
  misc_feature: Ceres CLONE 1726560
  misc_feature: Encodes the peptide sequence at SEQ ID NO. 674
acgcgcacgctttattataccacaccgactggggtcatcgccacggcactccacgagtcagcacagcccgcgtcgtggtggaggtggtctggcagctagcaccgccaacccgcgagcagatcacgagagatggccacggcgacctacctctccttctcggcgccgccgtcgtcgtgcgccggccggcagcggcggcggcaggcgacgcgggcgtcggcgtccgcgacggaccggccgcgcgaggtggtgtcgccgaagcggcggctgccgctgcggaaggtgccgggcgactacgggccgccggtggtgggcgcgctccgggaccagctcgagtacttctacgggcccggcgggcgcgacggcttcttcacggcccgcgtccgcgcgcacggctccaccgtggtgcggctcaacatgccgccggggcccttcgtggcgcgcgacccgcgcgtggtggcgctgctcgacgccgcctccttcccggtgctcttcgacacctcgctcgtcgacaagacggacctcttcaccggcaccttcatgccctccaccgacctcaccggcggctaccgcgtgctctcctacgtggacccctccgagcccaaccacgggccgctcaaggcgctcctcttctacctcctctcgcaccgccgccagcacgtgatccccaagttccgcgaggtgtacggcggcctgttcggcctcatggagaaggagctcgccagggccggcaaggccgacttcggcaaccacaacgacgccgccaccttctccttcctctgccaggcgctgctggggcgcgaccccgccgagtccgcgctccagggcgacgggcccaagctcatcaccaagtgggtgctgttccagctcagcccgctgctcaacctcggcctgcccaagctcgtcgaggactccctgctccactccttccgcctcccgccggcgctggtcaggaaggactacgaccgcctcgccgacttcttccgcgacgcggccagcggcgtcgtcgacgagggcgagcgcctcggcgtcccgcgggaggaggcggtgcacaacatcctgttcgccatgtgcttcaactccttcggcggcatgaagatcctgttcccgtcgctcgtcaagtggctgggccgcgccggcgcgcggacgcacgggcggctggccacggaggtgcgcgacgccgtgcgcgcgcacggcggcgaggtcaccatgaaggcgctggcggagatgccgctggtgaagtcggcggtgtacgaggcgctgcggatcgagccccccgtggcgatgcagtacgaccgcgccaagcgggacatggtggtggagagccacgactacgggttcgaggtgcggcagggggagatgctcttcggctaccagcccatggccaccaaggacccgcgcgtcttcgcgcgcccagaggagtacgtgcccgacaggttcctcggcgaggacggcgcgcgcctgctccgccacgtcgtctggtcaaacgggcccgagacggcggcgcccacgctgcaggacaagcagtgcgccggcaaggacttcgtcgtcctcatcgcgcgcctcctcgtcgccgagctcttcctccgctacgactccttcgacgtccaggtcggcgcctccgcgctgggctcgtcggtgaccatcacctcgctcaagaaagccaccttctgatgagctcccgctcggatccaagtcgccggagccggcgacggccaattttttacagtagaagaatatactgcgctgtcctctgtctctcagtatagtaatttttctagtcttgtgctcctgaatgttcaaaaagaaaaaagtcttgcgctcctgtgtcagtgtcactgtgtctgtgatcgataggtatggatatgtaacagatttcttctcttagtaaaacgagagaacattttttcccctggaaaaaaaaaaaaaaaaaaaa

SEQ ID NO: 674 - protein, 513 aa, Panicum virgatum
  misc_feature: Ceres CLONE 1726560
  misc_feature: Great-hit functional homolog of the protein sequence encoded by LOCUS At5g42650
  misc_feature (1)..(513): SWISSPROT Homolog: EC 4.2.1.92 Cytochrome P450 74A, chloroplast precursor
  misc_feature (1)..(513): SWISSPROT Homolog: EC 4.2.1.92 Cytochrome P450 74A1, chloroplast precursor
  misc_feature: Useful for biocontainment applications
  misc_feature: Useful for making plants with modulated nitrogen use efficiency
  misc_feature: Described in US Patent 7,132,590
MATATYLSFSAPPSSCAGRQRRRQATRASASATDRPREVVSPKRRLPLRKVPGDYGPPVVGALRDQLEYFYGPGGRDGFFTARVRAHGSTVVRLNMPPGPFVARDPRVVALLDAASFPVLFDTSLVDKTDLFTGTFMPSTDLTGGYRVLSYVDPSEPNHGPLKALLFYLLSHRRQHVIPKFREVYGGLFGLMEKELARAGKADFGNHNDAATFSFLCQALLGRDPAESALQGDGPKLITKWVLFQLSPLLNLGLPKLVEDSLLHSFRLPPALVRKDYDRLADFFRDAASGVVDEGERLGVPREEAVHNILFAMCFNSFGGMKILFPSLVKWLGRAGARTHGRLATEVRDAVRAHGGEVTMKALAEMPLVKSAVYEALRIEPPVAMQYDRAKRDMVVESHDYGFEVRQGEMLFGYQPMATKDPRVFARPEEYVPDRFLGEDGARLLRHVVWSNGPETAAPTLQDKQCAGKDFVVLIARLLVAELFLRYDSFDVQVGASALGSSVTITSLKKATF

SEQ ID NO: 675 - DNA, 2069 bp, Panicum virgatum
  misc_feature: Ceres CLONE 1726566
  misc_feature: Encodes the peptide sequence at SEQ ID NO. 676
acagagagggaggcgcgcacacacagcagcccccacgtaatccttccccatccgtttgacacttgcccccttcaattcccagcggatttagaaattcaggccttgaggaggggggcatatacgcccgcgccaaggaattagcggctcttccgaggagctcggcgcgaaaaggaaaggagccgccaatttcgctacggccacaacgcgcagccgccgcgccgcgccgtgctcgctcctttctcgccgcgtctggtgtccgcaccccccccccacgtcggcccacccccgctgcggctgcctgccccgatgaggccgccggaggtggcggtggccgttgccgcggccgtcgcggtggcggcgctcctcgtgcccagggcggccgcggcggcgtcggttccgttgctgccggcggcgctggcgctgcagcgcgcggtgccgcacaagggggtggccctggaggagctgaggcggcgggactgggcgcggcaccggagctccaggagggggctgctcgggggcgtcgccggcgtggtggacttccccgtcgagggctccgccaacccgttcatggtcgggctctactttacccatgtaaaattgggaaacccggcgaaggaattctttgtccagattgacactggcagtgatatactgtgggtaacttgcagtccttgtacgggttgcccgacgtcaagtggactcaatatccagttggagtccttcagccctgacacttcatcaacatcatccagaataacatgctctgatgatagatgtacagctgcactccgaacaggggaagcagtctgccaaacctcggattccccaagcagcccttgtgggtacactttcacctatggtgatggaagtgggacatcagggtactatgtgtctgacatgatgtattttgatactgtcatgggaaatgagcagactgccaattcgtctgcctctattgttttcggatgtagcaactcacagtcaggagatctgacaaaggcagatagagcagttgatgggatttttgggtttggacagcatcagttatctgttgtctcacaactgaattcacttggagtgtcccctagggtgttttctcattgcctgaaaggttctgacaacggtggtggaattcttgtgcttggtgaaattgtggagccaggcctagtctataccccactggttccatcacagcctcattacaacttgaatctggaaagcatcgctgtcaatggtcaaaagctacccattgattcctccttgtttacaacgtcaaatacacaaggaacaattgtggattcaggaacgacattggcataccttgcagatggagcctatgatccatttgttactgcaatagctggtgcagtctctccatctgtacactctcttgtcagcaaagggaaccaatgctttcttacttccagcagtgttgacttatcgtttccaactgtgaccctttattttatgggtggtgttgcgatgacggttaagccagagaactatcttttgcagcaggcttctgttgacaacaatgtattgtggtgcattggttggcaaaggaaccagggccaagacataactatactcggagatcttgtcttaaaggataagatattcgtgtacgacttggcgaacatgcgcatgggttgggctgattacgactgttcgatgtcggtgaacgtcaccacatcgtcagggaagaaccagtacgtgaacaccgggcagtacgacgtgaacagctccacgcggcgcgcatcgtacaagagcttgataccagccgtgatcgcagccatggttgtgcatatgctcgttttcggcggcgccgtctcgcgtagatagcagtgcaggcgggctactgacaatgtgattcgattctttattgcgttggtgtattcagagctgagagacgtcgctgtctctgctgcccccagtcgtcagttccacgggcggagaagagctgccatgacttgcattcttactgtacatacagaaaatgaaaggtccattgttcatggagcgcggtcctttctctcaaattgccgccccaaaaaaaaaaaaaaaaaaaa

SEQ ID NO: 676 - protein, 511 aa, Panicum virgatum
  misc_feature: Ceres CLONE 1726566
  misc_feature (1)..(360): Pfam Name: Asp Pfam Description: Eukaryotic aspartyl protease
MRPPEVAVAVAAAVAVAALLVPRAAAAASVPLLPAALALQRAVPHKGVALEELRRRDWARHRSSRRGLLGGVAGVVDFPVEGSANPFMVGLYFTHVKLGNPAKEFFVQIDTGSDILWVTCSPCTGCPTSSGLNIQLESFSPDTSSTSSRITCSDDRCTAALRTGEAVCQTSDSPSSPCGYTFTYGDGSGTSGYYVSDMMYFDTVMGNEQTANSSASIVFGCSNSQSGDLTKADRAVDGIFGFGQHQLSVVSQLNSLGVSPRVFSHCLKGSDNGGGILVLGEIVEPGLVYTPLVPSQPHYNLNLESIAVNGQKLPIDSSLFTTSNTQGTIVDSGTTLAYLADGAYDPFVTAIAGAVSPSVHSLVSKGNQCFLTSSSVDLSFPTVTLYFMGGVAMTVKPENYLLQQASVDNNVLWCIGWQRNQGQDITILGDLVLKDKIFVYDLANMRMGWADYDCSMSVNVTTSSGKNQYVNTGQYDVNSSTRRASYKSLIPAVIAAMVVHMLVFGGAVSRR

SEQ ID NO: 677 - DNA, 1879 bp, Panicum virgatum
  misc_feature: Ceres CLONE 1726567
  misc_feature: Encodes the peptide sequence at SEQ ID NO. 678
cgcgagctactactacctgccaccatagtcgcgtctcttactctcttcgtctcggttgagagacagagagaagagggaggaaattaaaatgaagtcctccgtcatgattgctctagcagcagcggtgcttctggtcgcggcacagtacgcctccctcgccgacgccaaggggccaagggtcatcatcgtcggcgccggcatgtccgggatctcgacggggaagcggctgtgggagtcgggtgtccgggacctggtgatcctggaggcgacggagcgcgtgggcgggcggatgcacaagcacaacttcggcggcctcaacgtggagatcggggccaactgggtggagggcgtcggcggcgacaagctcaaccccatctggcccatcgtcaactccacgctcaagctcaggaacttctactccgacttcgacagcgtcgtcggcaacgtctacaaggaggacggcggtggcctctacgacgaggactacgtgcagcagcgcatggaccgcgcctacgaggtggacgacatgggcaccaaccttaccaaaatgatggaccccagcggccgcgacgacatctccatcttagccatgcaacggatgttcaaccaccagccgaacgggcctgcgacgccggtggacatggtgctggactacttcatctacgactacgagttcgcggagccgccgagcgtgaccagcctgcagaacacccacccgctgcccaccgaggccgacttcagcgaagacaaccatttcgtcgccgaccagcgggggttcgagtccatcatccactacatcggcagctcctacctcgccaccgacgccaacggcaccatctccgaccgcagggtcctgctcaacaaggtggtgcggcagatcgcctacaacaaccgaggtgtggtggtgaagacggaggacggctcgtcgtacggcgcggacttcgtggtcgtctccaccagcttgggcgtcctccagagcgacctcattcagttcacgccccagctgcctttctggaagctggccgcgatctaccggttcgacatggcggtgtacaccaagatcttcctcaagtttccccggcggttctggcccgtgggcgagggcaagcagttcttcgtgtacgcgagccggcgccgcggctactacggcatgtggcagtcgttcgagcgggagtacccgggcgccaacgtgctcctggtgacggtcaccggcgacgagtcgcggcggatcgagcagcagcccgacagcgtcaccaaggcggaggccgtcgccgtgctcaggaacatgttccccgacgccgacgtccccgacgccaccgacatctacgtcccgcgctggtggtccaaccgattcttcaagggctcctactccaactggcccatcggcgtcaaccgctacgaatacgaccagctcagggcgccggttgggagggtttacttcaccggtgagcacaccagcgagtactacaacggctatgtccacggagcataccttgcaggtgtcgactctgcggacatcctgatcaaccgcatcttcaagaacgaggagtacgaggtccgtggcaagtacgacaaccaagctgcagaggtaaacgggaaggttattgcagaggctaaatgaatgaccatgatgagctgacgtgccctgctacaccacaccagctcgatcatcaagggaataatgataagctactcgtcgagatgaaatcatgatgccttttttttcagtaaaacttttttttcaggctttaattcgcttcccagtcggtggttcatacgtttctgtcttgtgttctcggatgtattttctgccgtcgtaataaaagcacaggcactctgctcctgtttactggtttagcaaaaaaaaaaaaaaaaaaaa

SEQ ID NO: 678 - protein, 510 aa, Panicum virgatum
  misc_feature: Ceres CLONE 1726567
  misc_feature (1)..(442): Pfam Name: Amino_oxidase Pfam Description: Flavin containing amine oxidoreductase
  misc_feature (1)..(433): Pfam Name: Amino_oxidase Pfam Description: Flavin containing amine oxidoreductase
  misc_feature (1)..(440): Pfam Name: Amino_oxidase Pfam Description: Flavin containing amine oxidoreductase
  misc_feature (6)..(495): SWISSPROT Homolog: EC 1.5.3.11 Polyamine oxidase precursor
MKSSVMIALAAAVLLVAAQYASLADAKGPRVIIVGAGMSGISTGKRLWESGVRDLVILEATERVGGRMHKHNFGGLNVEIGANWVEGVGGDKLNPIWPIVNSTLKLRNFYSDFDSVVGNVYKEDGGGLYDEDYVQQRMDRAYEVDDMGTNLTKMMDPSGRDDISILAMQRMFNHQPNGPATPVDMVLDYFIYDYEFAEPPSVTSLQNTHPLPTEADFSEDNHFVADQRGFESIIHYIGSSYLATDANGTISDRRVLLNKVVRQIAYNNRGVVVKTEDGSSYGADFVVVSTSLGVLQSDLIQFTPQLPFWKLAAIYRFDMAVYTKIFLKFPRRFWPVGEGKQFFVYASRRRGYYGMWQSFEREYPGANVLLVTVTGDESRRIEQQPDSVTKAEAVAVLRNMFPDADVPDATDIYVPRWWSNRFFKGSYSNWPIGVNRYEYDQLRAPVGRVYFTGEHTSEYYNGYVHGAYLAGVDSADILINRIFKNEEYEVRGKYDNQAAEVNGKVIAEAK

SEQ ID NO: 679 - DNA, 1952 bp, Panicum virgatum
  misc_feature: Ceres CLONE 1726570
  misc_feature: Encodes the peptide sequence at SEQ ID NO. 680
atcatcccaacccaaacaccataaacctccgcttgccgtcttgccgatggcgtccgtatcagcaccatcagcggccctctccccgcaccgcacctccgcatccgccgcccttctattcccctacccctgcttctcaccgcgggtgtcgcctgctccgacagcccggccacggaggctcgcggtatcggcgcgcgcgatgccgtggccgcacgtgctgacggtggccggctccgactccggcgccggcgcgggcatccaggccgacatcaaggcgtgcgcggcgctcggagcatactgctcctccgtcatcaccgccgtcacggcgcagaacaccgtcggcgtccagggggtccatgctgtaccggaggagttcgttggggagcagctcaagtcggttctcgcggacatgtcggtggatgtggtgaaaacagggatgctcccttcagctggaatagttaaagttctctgtgagaatcttaggaagtttccagtcaaagctttagtggtggatccggtcatggtgtccaccagtggtgatactctttccggaccatcaactcttgctacatatagggatgaactatttcctatggctgacatagtcacccctaatgttaaagaagcatcaaagttacttggggatgtatcattgcaaacaatttctgacatgcgcagtgcagctgaatccatttacaaacttggtccaaaacatgtgcttgtgaaaggtggggatatgccagattcaacagatgcaattgatgtattttttgatggtgaggagttcattgagcttcacggtctgcgtataaagacccgtaacacgcatggaactggttgcactttagcttcatgtattgctgctgaattagcgaaaggtgcaacaatgctgcatgctgttgaggttgcaaagaaatttgtggagtctgctctttatcatagtaaagatcttgtgattgggaatggacctcaaggcccttttgaccacctcttcagtctcaagtctccattgcacaagatgggatccctgcacaagttcaatccagatgacctcttcctgtatgcggtgaccgactctgggatgaacaagaagtggggtcgttcaataaaagatgctgtgaaagctgccattgaaggaggcgctacaattgttcagttgagagagaaagacactgagacacgggagttcttggaagctgccaaggcttgcgtagagatatgcaggtccagtggagtgccactactgatcaacgaccgcgtagatgttgctctggcatgcaacgcggatggcgtccatgttggtcaatcagacatgccagcatgggaggtgcgggagctccttggaccaggaaaaatcattggcgtctcatgtaaaacccctgctcaggccgagcaggcttggaaggatggtgcggactacatcggttgcggaggtgtctttccaaccacaacgaaagcaaacaatcccacattgggttttgagggattgaggaccgtgtgcttggcttctaagttgcctgtggtggccatcggtggcatcaataccggaaatgcaggttcagtgatggagcttgggctcccaaatctgaaaggtgtggctgtggtctctgctcttttcgaccgggaatgtgttgccaccgagacaagaagcctcaggtccatcctgatgaacgcttgctccagatcttagagcaagctggcacttggcgcctgttcttctcgtttcttttttttaggcagaaataattttgtaatcaacattcactttgtcatatggggagacaaaaagtgttcccttgttcaataatttgtagggactgccctaaaaaaatagtttggcgaacatttcccaccaaaaagaaataacttgaaacttttcagagggcaggatttgtatatactaaactaataatgcatcagtattgtatttgatgcaaaaaaaaaaaaaaaaaaaa

SEQ ID NO: 680 - protein, 546 aa, Panicum virgatum
  misc_feature: Ceres CLONE 1726570
  misc_feature (1)..(250): Pfam Name: Phos_pyr_kin Pfam Description: Phosphomethylpyrimidine kinase
MASVSAPSAALSPHRTSASAALLFPYPCFSPRVSPAPTARPRRLAVSARAMPWPHVLTVAGSDSGAGAGIQADIKACAALGAYCSSVITAVTAQNTVGVQGVHAVPEEFVGEQLKSVLADMSVDVVKTGMLPSAGIVKVLCENLRKFPVKALVVDPVMVSTSGDTLSGPSTLATYRDELFPMADIVTPNVKEASKLLGDVSLQTISDMRSAAESIYKLGPKHVLVKGGDMPDSTDAIDVFFDGEEFIELHGLRIKTRNTHGTGCTLASCIAAELAKGATMLHAVEVAKKFVESALYHSKDLVIGNGPQGPFDHLFSLKSPLHKMGSLHKFNPDDLFLYAVTDSGMNKKWGRSIKDAVKAAIEGGATIVQLREKDTETREFLEAAKACVEICRSSGVPLLINDRVDVALACNADGVHVGQSDMPAWEVRELLGPGKIIGVSCKTPAQAEQAWKDGADYIGCGGVFPTTTKANNPTLGFEGLRTVCLASKLPVVAIGGINTGNAGSVMELGLPNLKGVAVVSALFDRECVATETRSLRSILMNACSRS

SEQ ID NO: 681 - DNA, 1606 bp, Panicum virgatum
  misc_feature: Ceres CLONE 1726577
  misc_feature: Encodes the peptide sequence at SEQ ID NO. 682
acccctcccctcacctcgccccacctctggccgccacctcgaccgctccactgctctcggctccggcgccggcccccctcacccctctcgcgaaggttctagagccttctggggatgcagagcgccgcggccttccggccgtgccccgcccggccgctggtgggccgcagccctagccggcccctcctcccggcccgcccaatccgcgtctccgccgccggcgccggcgccgctgccgcctccaccagatgcggcgccgcgggcccgcgcggcctcgggcacggcctgctgccggtctcgacggaccgggagggcaaggcccgccagcggccggtggcgtgcggcgcggtcgggaaggccggggaggcggaggaggaaagcggcgggtttctgaagacgctgcagctcggcgcgttcttcggcctctggtacctcttcaacatctacttcaacatctataacaagcaggttctcaaggttttcccatacccgataaacattacagaagttcaatttgctgttggagctgcagttgctgttttgatgtgggtcactggtattctgaagagaccaaagatttctggagcgcagcttgtagccatcctacctctggctattgtccatactatgggcaatcttttcaccaacatgagccttgggaaggttgcagtgtcatttacacataccatcaaggctatggaacctttcttttctgttgttctttctgcaattttccttggcgagttacctactgtttgggtaggactatctcttcttccaattgttggtggtgtagcattggcatctcttactgaggcatcctttaactgggctggcttttggagtgcaatggcttcaaatgttacctttcaatctcgcaatgtactgagcaagaagctcatggttaagaaagagggccaggaatctttggacaatattaatctcttctctatcattacagtgatgtcctttttcctattggcccctgttaccttctttacagaaggcgtcaaaatgactcctacattcttgcaatctgctggtctaaatgcaaatcaggtccttacaaggtctctgcttgctgcactgtgcttccacgcatatcaacaggtgtcgtacatgattctggcggtggtgtctcctgttactcattctgtgggcaactgtgttaagcgtgtcgtggttattgtaacatcagtgctgttcttcaggacacctgtttctcctatcaactccctcggtaccgcgattgcacttgcaggagttttcctgtactcacaactgaagagactcaagcccaagccgaagaccgcttaaatagtgaccatgttttctattttctctcttgtgtttatggagtcaaatcatggcagcacaccttgaaagtgttgattttagtttagaaatgtttttcttgatgcaatacgaattcacttttaggaagatttgtggtcttactgttttgatcaaaggaggttttgaaatgtgtgtctatagaagtacaggagctgtagcgtctatatatgttcccttggtgtctcaacaagagtagcagtattgcttaatatatgcgccgagtcacaacgaaaaaaaaaaaaaaaaaaaa

SEQ ID NO: 682 - protein, 400 aa, Panicum virgatum
  misc_feature: Ceres CLONE 1726577
  misc_feature (1)..(147): Pfam Name: TPT Pfam Description: Triose-phosphate Transporter family
MQSAAAFRPCPARPLVGRSPSRPLLPARPIRVSAAGAGAAAASTRCGAAGPRGLGHGLLPVSTDREGKARQRPVACGAVGKAGEAEEESGGFLKTLQLGAFFGLWYLFNIYFNIYNKQVLKVFPYPINITEVQFAVGAAVAVLMWVTGILKRPKISGAQLVAILPLAIVHTMGNLFTNMSLGKVAVSFTHTIKAMEPFFSVVLSAIFLGELPTVWVGLSLLPIVGGVALASLTEASFNWAGFWSAMASNVTFQSRNVLSKKLMVKKEGQESLDNINLFSIITVMSFFLLAPVTFFTEGVKMTPTFLQSAGLNANQVLTRSLLAALCFHAYQQVSYMILAVVSPVTHSVGNCVKRVVVIVTSVLFFRTPVSPINSLGTAIALAGVFLYSQLKRLKPKPKTA

SEQ ID NO: 683 - DNA, 1716 bp, Panicum virgatum
  misc_feature: Ceres CLONE 1726588
  misc_feature: Encodes the peptide sequence at SEQ ID NO. 684
aaaaaaaccagcggcgcaaagaccacatctttcctccccccctcccactccccggcgccgcccagctcctccacctccgtccggcccggcatggcggcgctgtcccgcgcggcctcctgcctgacccggcggccgcaggtgcagccgtcgaggctgcaggcggcgaaggcgatggcgtcgtcgctgttcggccacgtcgagccggcgcccaaggaccccatcctcggcgtcaccgaggcctacctcgcggacccctcgcccgacaagatgaacgtcggcgtcggcgcctaccgggacgacaacggccagcccctcgtgctcaactgcgtgcgcgaggccgagcgccggattgccggcaacctcaacatggagtacctcccaatgggaggcagtataaagacgattgaagaatctctgaagctggcgtacggagaggattccgaattcatcaaagacaagaggatcgcggcagtgcaggcgctttcgggcactggtgcctgtcggctctttgctgatttccaaaagcgattcttgcccgattcgcaaatctacatacctacaccaacgtgggccaaccatcacaatatttggagggatgctcaagtgccacagaagtcattcacatactaccatccagagtcgagagggcttgatttttcaggactaatgaatgacatcaagaatgctccagatggttcgttctttttgctgcatgcatgtgctcataatcctactggagtagatcctacagaggaacaatggagggaaatatcccatctgttcaaggtgaaaaaacattttccattctttgacatggcataccaagggtttgccagcggtgatccagagagagatgctaaggcaatccgaattttccttgaagatggacaccaaattggatgtgctcagtcatacgcaaagaacatgggactttatggacagagagtaggatgcctgagtattttgtgcgaggatgagatgcaagcagttgctgtcaagagccaactgcaacagattgcaagaccaatgtacagcaacccacctgttcatggtgcactagttgtttctataatcctcagtgatccagaattgaagagtttatggttaaaagaggtcaagggtatggctgatcgtatcattggaatgcggacggcacttaaggaaaatcttgaaaagctaggttcacctttgtcatgggagcacatcactaatcagattgggatgttctgctacagtgggatgacaccagaacaagttgaccggttgacaaatgaattccatatttacatgacccgcaacgggaggataagcatggctggtgtaacgacaggaaatgttcaatacttggcaaatgctattcacgaggttaccaaaccgaattgagtttggccctcctaccctcgtcggccgatgaaatgaggctttcaagtggctttttttggtgcctgacatatcaacattatcattcttgagaaataagttcaagcctgtttgggctgccccagagcgaatctcacatgtacgagagttatagatgtgatgaaacttcagtcttaagagctacatgatcctgtttcttttctttttctttcttttttcccatcttgtcatggcaatttttacacttagctgcaaatggttgtagcatgatctacagttctgaagaaaataaatatggcaaaattgagaacttgacaaaaaaaaaaaaaaaaaaaa

SEQ ID NO: 684 - protein, 430 aa, Panicum virgatum
  misc_feature: Ceres CLONE 1726588
  misc_feature (1)..(367): Pfam Name: Aminotran_1_2 Pfam Description: Aminotransferase class I and II
  misc_feature (30)..(428): SWISSPROT Homolog: EC 2.6.1.1 Aspartate aminotransferase, mitochondrial precursor
MAALSRAASCLTRRPQVQPSRLQAAKAMASSLFGHVEPAPKDPILGVTEAYLADPSPDKMNVGVGAYRDDNGQPLVLNCVREAERRIAGNLNMEYLPMGGSIKTIEESLKLAYGEDSEFIKDKRIAAVQALSGTGACRLFADFQKRFLPDSQIYIPTPTWANHHNIWRDAQVPQKSFTYYHPESRGLDFSGLMNDIKNAPDGSFFLLHACAHNPTGVDPTEEQWREISHLFKVKKHFPFFDMAYQGFASGDPERDAKAIRIFLEDGHQIGCAQSYAKNMGLYGQRVGCLSILCEDEMQAVAVKSQLQQIARPMYSNPPVHGALVVSIILSDPELKSLWLKEVKGMADRIIGMRTALKENLEKLGSPLSWEHITNQIGMFCYSGMTPEQVDRLTNEFHIYMTRNGRISMAGVTTGNVQYLANAIHEVTKPN

SEQ ID NO: 685 - DNA, 2041 bp, Panicum virgatum
  misc_feature: Ceres CLONE 1726601
  misc_feature: Encodes the peptide sequence at SEQ ID NO. 686
atactctcctgtcttcacgtggccacgttgctccgtgaagcagcccaccagcagccgcaacgcccggctgctcggctctgctgcgcgtagcagtagcatcccaaaaggccgctgatctgcggtggttgaagcccgaggatcggcggcctgagctcccaatccgcctccggtacccggatctccggcggaactcctggggtctccctcccatacgcggcttttctggggccgggactgcgggaacgaggaggagcgttgcgccagtgcgaccggcgtcggagggtatatctcgattaatccgcgcttgcttctccggcagatgcgaagttttactcgagaaaggtaggaaaacgaaacatggaggtgaggctgctgcttcttgcgctcatctgcctgcacgctgctcctcgttgggcttcggctcagcagccggaggaggcgacggtcatagttaaaggctcgactaggattgctgagacggatgagaactacgtctgtgctacaattgactggtggcccccggagaagtgcaactacaatcagtgtccatggggccagtcttcaattctgaatttggatttggatcacccatttctggctcaagccattcaagcatttgacaatttgaggattaggttgggaggctctttgcaagatagagttgtttatgatgtgggaacagaaagtccatgctccccgttcagaaatgtgtccaatggcttgtttggtttctcagttggttgccttggtatggataggtgggacaaactgaatgatttattccagaaaacaggagcaattgtcacatttggtgtgaatgcactctacgggaggtacaatgttagacgttccatctgggcaggcaaatggaactccacaaatgcgtatgattttgtaaaatacacaatctcaaagggatatccggttggctcatgggaattcggcaatgagctgagtgggcatggaattggagcaaaagttgatgctaaactttacggaaaggatgtagttgaatttaaatccatccttcgacaattgtataaggcgccactgtcccagccactcctgttagcccctggaggattttttgatcaacaatggtattctcagctgcttcagacttcaggtcatggtgttgttaatgccttaactcaccatgtatataatctcggaggaggggatgatgttcaccttataaggaagatattggatccaaagtacttagatcgtgctgaagatacttatagagacatgcagcttaccatccaaaggcatggaacatgggcttctgcttgggttagtgaaagtggtggtgttttcaacaatggcggcctgctggtgtcaaatacattcatcaacagcatctggtatctagatcagcttggaatggcatctaagtataacacaaaggtgttctgccggcagactctcatcggtgggaactacggtctgcttgacacacaaacttttcggccaaatcccgattactacagtgctctactatggcatcggcttatgggcaatggagttctttctattgatgtcattgcaccacgtaggctgcgtgcttatgctcattgtagaagacaacagcaaggcatcactcttctcttgatcaacctaagcaacactactggatacaatgtcactcttcagaatgacatcaacgtcagccttggtaaaagacccaaccttgagaagggcagttccttcacacaaaggctcaggaaagcagtttcatggctgggaagtaagccatcaagcgacaccaagaagagggaggagtatcatctgacggccaaggacggcaatctccagagcaagacaatgctgctcaacggtgttccgttggaactgggagatgatggcagtgttccagctatgaatccagtgctcgttgttgtcgattcgccactgtacctagcaccaacatccatcgcctttgtagttttacccaagtttgaggccaaggcttgttcttaggtttaatcttgaatcttgaaataaatatttttcgctgcaaaaaaaaaaaaaaaaaaaa

SEQ ID NO: 686 - protein, 541 aa, Panicum virgatum
  misc_feature: Ceres CLONE 1726601
  misc_feature (3)..(319): Pfam Name: Glyco_hydro_79n Pfam Description: Glycosyl hydrolase family 79, N-terminal domain
MEVRLLLLALICLHAAPRWASAQQPEEATVIVKGSTRIAETDENYVCATIDWWPPEKCNYNQCPWGQSSILNLDLDHPFLAQAIQAFDNLRIRLGGSLQDRVVYDVGTESPCSPFRNVSNGLFGFSVGCLGMDRWDKLNDLFQKTGAIVTFGVNALYGRYNVRRSIWAGKWNSTNAYDFVKYTISKGYPVGSWEFGNELSGHGIGAKVDAKLYGKDVVEFKSILRQLYKAPLSQPLLLAPGGFFDQQWYSQLLQTSGHGVVNALTHHVYNLGGGDDVHLIRKILDPKYLDRAEDTYRDMQLTIQRHGTWASAWVSESGGVFNNGGLLVSNTFINSIWYLDQLGMASKYNTKVFCRQTLIGGNYGLLDTQTFRPNPDYYSALLWHRLMGNGVLSIDVIAPRRLRAYAHCRRQQQGITLLLINLSNTTGYNVTLQNDINVSLGKRPNLEKGSSFTQRLRKAVSWLGSKPSSDTKKREEYHLTAKDGNLQSKTMLLNGVPLELGDDGSVPAMNPVLVVVDSPLYLAPTSIAFVVLPKFEAKACS

SEQ ID NO: 687 - DNA, 1358 bp, Panicum virgatum
  misc_feature: Ceres CLONE 1726608
  misc_feature: Encodes the peptide sequence at SEQ ID NO. 688
aaaaaaaaaagaaaaagctccgtccatctcgttcccgagtccgtcaccgtccggcgtccgcgcgcgtgctggtgcgacccccaacgcggcgacagctccaccgccgttcgcttccccgtcgccgccgagcgcatctccaccggtggcctcctccaggggtctgaaggaagcagccaatccacaaaaagagcctcacaagaaaagcaattgcaagcagctgagaagcttgctggtctctccatagcgcatcagcatggatcgcctgcagaggatattcggcgcctctgggatggggcagccaccttcggactcgccgctgctcgactcctctgagcaggtctacatttcctcccttgcactcctcaagatgctcaaacacgggagggctggtgtgccaatggaggtgatgggccttatgctgggtgagtttgtggatgactacacggtcagggtggtggatgtgtttgccatgccacaaagtggtactggggtcagtgttgaggctgttgatcatgtcttccagaccaacatgcttgacatgctcaaacagacagggagaccagaaatggttgtagggtggtaccactcccatcctggctttggttgctggctttctggagttgacatcaacacccaacagagttttgaagctttaaaccccagggcagttgctgttgtgatagaccccatccagagtgtcaaagggaaggtggtcattgatgcatttcgtctcattaacccccagaccatgatgcttggtcaggagccacgacagacaacatcgaatgttgggcacctaaataaaccatctattcaggctcttatccatgggctgaacaggcactactactccattgcaatcaactaccgaaagaatgagctcgaggagaaaatgttgctgaacttgcacaaaaagaaatggactgatggcctgattttgaagagatttgatactcattcgaaaactaatgagcagacagtgcaggaaatgctgaacctagctgtgaagtacaacaaggccgtgcaagaggaggatgagttgccaccagagaaattggctattgccaacgtggggcggcaggatgcgaagaagcatttggaagagcatgtctccaatttgatgtcttcgaacatagttcagaccctagggaccatgctcgacacggttgtcttttagttcggtaggagtggtgtctcaacgaacgcagtactgaaattatctttatgtttatttgtcttcgtgtttatcaaagctgccataatgcagtgagccaaatggcagtatgcatcgtgtttggacagttcggactttaatttgttataatttgctggagcaccaaaaaaaaaaaaaaaaaaaa

SEQ ID NO: 688 - protein, 307 aa, Panicum virgatum
  misc_feature: Ceres CLONE 1726608
  misc_feature: Great-hit functional homolog of the protein sequence given in SEQ ID NO 9211
  misc_feature: Great-hit functional homolog of the protein sequence given in SEQ ID NO 9447
  misc_feature: Useful for making plants with altered alkaloid content
  misc_feature: Useful for making plants with altered terpenoid content
MDRLQRIFGASGMGQPPSDSPLLDSSEQVYISSLALLKMLKHGRAGVPMEVMGLMLGEFVDDYTVRVVDVFAMPQSGTGVSVEAVDHVFQTNMLDMLKQTGRPEMVVGWYHSHPGFGCWLSGVDINTQQSFEALNPRAVAVVIDPIQSVKGKVVIDAFRLINPQTMMLGQEPRQTTSNVGHLNKPSIQALIHGLNRHYYSIAINYRKNELEEKMLLNLHKKKWTDGLILKRFDTHSKTNEQTVQEMLNLAVKYNKAVQEEDELPPEKLAIANVGRQDAKKHLEEHVSNLMSSNIVQTLGTMLDTVVF

SEQ ID NO: 689 - DNA, 1526 bp, Panicum virgatum
  misc_feature: Ceres CLONE 1726615
  misc_feature: Encodes the peptide sequence at SEQ ID NO. 690
actccgtttttttttttccttttccgttggcaactgctcactccactcgagattacgggattagtatatgagggtgagtaggaggcaatagggatcagcggccgctctcgctgcccgcgcgcccccgatcaggcgcctcgtcactttcccatctctccgcgacgccgccccccacatcgcctcgctctcccggcagcagcaaggaacaagatgtcaaatagagccacacattggtgttatgcctgtcggcggccaattcgcctccgcggacaggatatcatatgccccaactgcaacgatggttttatccaggaaatcagtgagatgggtggcatgttgaacacttatggactaattgaaccagactttgaagagcatcgagctagaagatttgggatgatggaggccatgtcttcccttatgcggcaacgtatggcagcaatggacaggatggcagaaatggacagaaacagtgtgtttgatatccatggtagacaagggaccagtactgaacatggaaggcggccaacttctgttcctacactgatatttggcagcaaccctgctccaggtcctggaagtgatagtggtaatgttaatgttgtcttctctggaggccgcagagttggcattgaccgtccaaatttcagtcgtttccttgttggtcccagccttgaagctctatttgagcagctactcctccagaataaccgtcaaggcccagctcctgctccacggtcggctattgactccatgcctgtggtgaagataagccgcaggcatctcaatgatgatccacagtgcccggtttgcacagacaagttcgagcttggagcagaggcacgggagatgccatgcaagcacttgtaccataccgactgcatcatcccctggcttgtccagcacaattcttgcccggtttgccgccatccgctgccatcgcaacgatcaggcattacgaatagcgcccgcgcaccttcagcctatcgcaacgaagctgctggtcctgttgtcaccgaagcagatcctgagcctgtgccagtaaacaatgatggtgcaagtcaggaaacacacagctccttctcgtctctctggccatttggcccgtcgagtttccatcccacttaccagtatcaagaaactgttgatgagtctgcagcatacgatccaaaccagataggatattccgagtggtactatgaccactgactgaacccctggaaccttcagatttacgtggatgtggtgcctgcgatggttgctcttggggtaaaaagggatggcccttgcctatagtcccgtgttcagtgtataccctgtttttcatgtgcaatgtggacctgtgtaagtctgtatagagacactagagactaccgagcgcaatgaacgctcctgtaatgcacgtatatccctgtttgtataagggtgctttctttcttgtactgggcacaacgaattctgcatatccagtcttatgctacacgtaagataagattccttactagcaaaaaaaaaaaaaaaaaaaa

SEQ ID NO: 690 - protein, 332 aa, Panicum virgatum
  misc_feature: Ceres CLONE 1726615
  misc_feature (1)..(41): Pfam Name: zf-C3HC4 Pfam Description: Zinc finger, C3HC4 type (RING finger)
MSNRATHWCYACRRPIRLRGQDIICPNCNDGFIQEISEMGGMLNTYGLIEPDFEEHRARRFGMMEAMSSLMRQRMAAMDRMAEMDRNSVFDIHGRQGTSTEHGRRPTSVPTLIFGSNPAPGPGSDSGNVNVVFSGGRRVGIDRPNFSRFLVGPSLEALFEQLLLQNNRQGPAPAPRSAIDSMPVVKISRRHLNDDPQCPVCTDKFELGAEAREMPCKHLYHTDCIIPWLVQHNSCPVCRHPLPSQRSGITNSARAPSAYRNEAAGPVVTEADPEPVPVNNDGASQETHSSFSSLWPFGPSSFHPTYQYQETVDESAAYDPNQIGYSEWYYDH

SEQ ID NO: 691 - DNA, 1760 bp, Panicum virgatum
  misc_feature: Ceres CLONE 1726626
  misc_feature: Encodes the peptide sequence at SEQ ID NO. 692
gtgagcttaagcggaggtcctctgctcaaaaaaaaaagactccttccgtcctctcctacttcgcagaccggtccaaatccccaactgaaattttgcgcccaggcccttcgccggagatggcgtcggagctcacgtaccggggcgccgccgcggcgcacggctccgcctccaacggcggggagtactccccgaagccctccaagccgctctcctggctctcgcgcgccgcccgctacgccgccgccgagcaccgccccgtcttcgccctcgccggcatgctcttcgccgccgccctcttcaccttctcctcctcctcctcctcctccacatccgactcgtcctacgccgccgcgtcggccggattcagacacctcgccatcgccgggcacccgtccttccgcgagtcctccgtcggcggcaaggtgcccctgggcctgcggcggcgcgcgctgcgggtgctcgtgacgggcggcgccgggttcgtggggagccatctggtggaccggctggtggagcgcggcgacagcgtgatcgtcgtggacaacttcttcacggggcgcaaggggaacatcgcgcaccacctccagaaccccaggttcgaggtgatccgccacgacgtcgtcgagcccatactgctcgaagtcgaccagatctaccacctcgcctgcccggccagccccgtgcactacaagtacaacccaatcaagaccatcaagacaaatgtagttgggacactgaatatgcttggattggcaaagaggattggggcaagatttctactcaccagcaccagtgaggtctatggtgatcctctccagcaccctcaggtggaaacttactggggcaatgtcaatcctattggtgtcaggagctgctatgatgagggtaagcgcactgctgaaacattaaccatggactaccatcgcggtgccaaccttgaggtaaggatcgcccggatctttaacacatatggtcctcgcatgtgcatcgatgatggccgtgttgtcagcaatttcgttgctcaggcgctgaggaaggagcctttgactgtctatggtgatggcaagcagactaggagctttcagtacgtctcggatttggtggaagggctgatgaagctaatggaaggggaccacattggaccgttcaacctgggaaaccctggtgaattcacgatgctggagctggctaaggtggtccaggacaccattgacccagaagcgcgcattgagttccgtccaaacactgcagatgatccacataagcgcaagcctgacatcagccgagccaaagagcttcttggctgggagcccaaggttcccctacatgagggccttcctctcatggtcactgacttccgcaaaagaatcttcggggaccaggaaaaatccactgaggcagctggtggcctttcataatcctcaacatgtcaaagttacgcatttgttcagtctctatgatcacatgacacgaaaatgggaggaaggagcaaacgatctggacagttttggtggtatatgccctttggctgctctgtacaacacggacaaaaggtcatggctgtacgtagttcttagaagatgttggatactaccaaaatatcttggtattgctgtaatgatgttcttttctttttggttcttttgccagtaataattctatatgtaacaacatacaatttgtaatggtgtcgttaacagataatctgggttgctaataatacattaaggttataagctcaaaaaaaaaaaaaaaaaaaa

SEQ ID NO: 692 - protein, 433 aa, Panicum virgatum
  misc_feature: Ceres CLONE 1726626
  misc_feature: Great-hit functional homolog of the protein sequence encoded by LOCUS At2g47650
  misc_feature: Great-hit functional homolog of the protein sequence encoded by LOCUS At3g62830
  misc_feature (1)..(234): Pfam Name: Epimerase Pfam Description: NAD dependent epimerase/dehydratase family
  misc_feature (113)..(418): SWISSPROT Homolog: EC 4.1.1.35 UDP-glucuronic acid decarboxylase 1
  misc_feature: Useful for making plants with altered cell wall content and/or composition
MASELTYRGAAAAHGSASNGGEYSPKPSKPLSWLSRAARYAAAEHRPVFALAGMLFAAALFTFSSSSSSSTSDSSYAAASAGFRHLAIAGHPSFRESSVGGKVPLGLRRRALRVLVTGGAGFVGSHLVDRLVERGDSVIVVDNFFTGRKGNIAHHLQNPRFEVIRHDVVEPILLEVDQIYHLACPASPVHYKYNPIKTIKTNVVGTLNMLGLAKRIGARFLLTSTSEVYGDPLQHPQVETYWGNVNPIGVRSCYDEGKRTAETLTMDYHRGANLEVRIARIFNTYGPRMCIDDGRVVSNFVAQALRKEPLTVYGDGKQTRSFQYVSDLVEGLMKLMEGDHIGPFNLGNPGEFTMLELAKVVQDTIDPEARIEFRPNTADDPHKRKPDISRAKELLGWEPKVPLHEGLPLMVTDFRKRIFGDQEKSTEAAGGLS

SEQ ID NO: 693 - DNA, 1789 bp, Panicum virgatum
  misc_feature: Ceres CLONE 1726629
  misc_feature: Encodes the peptide sequence at SEQ ID NO. 694
atcaggccgcgttgccagccgctcaagccaagacagccgcctaatccccctgggatcgcggctcgtgctgggctaatcggggcgccccaatcatccctcgccaagatctcgacaggactagcccatgctcgtgtcggttggagttgataaggggtgccatgggtttgaggagcaggcaccaaaaggcgtttggtctccgctgctatccagcacgccaccggtcggtaacactgttactgtggagcctagcggcgctggttgtcgtcgtgaatttccatcttctcatcattcataaggaggaggatgagagtatgagtacacgcgagatccgtcaatcgattatgagggaactggaggcagtggaggaggagaagttcaagttatctcctccccggagccggaggaatccctgggctgtgcggcgcaagggcgagaggaagcctcctacaatagtggatgagttcttggatgagtcttctgcagttcatgatatgttcttcccagaaccgaacatggctgtagatccaatcaatggtgggaatgacagcatgtacttctactacccagggagaatctggcttgataccgatggcaagccgatcaaagctcatggaggaggtgtactgtatgataagaagaccaaggcatatttctggtatggggagaataaggatggcaaaacctacaaagctcacagcaagggagcagaccgggttgacatcattggagtaagttgctattcttcgaaggacctatggacgtggaaaaatgaaggagttgtcctccagggtgaggaaaagaaaacacacgacctccacaaatccaacgtcctggagaggcccaaggtgatatacaatgaccggactggcaaatatgtgatgtggatgcacatagatgatgctaactacactaaagcttcagttggtgtggctgtcagtgattccccaaccggcccgttcacttatctctacagcaagcgcccacatgactgcgaaagtagagacatgaccatcttcaaggatgatgatgggaaggcctacctgatatattcttctgaggacaacagtgagctccacattggtccactaactgatgactaccttgatgtagctgatgagatgcggaggtttctcattgcacagcaccgagaagctcctgcgcttttcaagcatgaaggtacctactatatggtaacctctggctgcacaggctgggcaccaaacactgctctggctcacgcggcaacttcagtgatgggaccttgggagacactggggaacccctgcgtgggagggaatgaggtcttcagatcaacaacattcttctcccagagcacattcgtgttaccagttccagggctaccaggctcattcatcttcatggctgatcggtggaatccgtccaacctgagagattctcggtacgtctggctacctctgacgatagggggagtccctgatgaagctgcggactacagcttcatgttccctctctggtcccgggtgtccatttactggcacaaacggtggcgtctccctgaggggtggagggattcctgaaagttggaaatttcttcaaagaattgaagttcttatacgctgttacatggatagatatcaaagtgttgacatttgacacactgggctgcgctgtatagatcagatgtagatgcagagtttgtaaatgtgcagttgagtttgaactaaaatcagataaaagtttgtggccttttgggcgaggtgtggtgttgatccactcgtcttagtttcaaaaaaaaaaaaaaaaaaaa

SEQ ID NO: 694 - protein, 466 aa, Panicum virgatum
  misc_feature: Ceres CLONE 1726629
  misc_feature (1)..(96): Pfam Name: Glyco_hydro_43 Pfam Description: Glycosyl hydrolases family 43
MGLRSRHQKAFGLRCYPARHRSVTLLLWSLAALVVVVNFHLLIIHKEEDESMSTREIRQSIMRELEAVEEEKFKLSPPRSRRNPWAVRRKGERKPPTIVDEFLDESSAVHDMFFPEPNMAVDPINGGNDSMYFYYPGRIWLDTDGKPIKAHGGGVLYDKKTKAYFWYGENKDGKTYKAHSKGADRVDIIGVSCYSSKDLWTWKNEGVVLQGEEKKTHDLHKSNVLERPKVIYNDRTGKYVMWMHIDDANYTKASVGVAVSDSPTGPFTYLYSKRPHDCESRDMTIFKDDDGKAYLIYSSEDNSELHIGPLTDDYLDVADEMRRFLIAQHREAPALFKHEGTYYMVTSGCTGWAPNTALAHAATSVMGPWETLGNPCVGGNEVFRSTTFFSQSTFVLPVPGLPGSFIFMADRWNPSNLRDSRYVWLPLTIGGVPDEAADYSFMFPLWSRVSIYWHKRWRLPEGWRDS

SEQ ID NO: 695 - DNA, 1628 bp, Panicum virgatum
  misc_feature: Ceres CLONE 1727434
  misc_feature: Encodes the peptide sequence at SEQ ID NO. 696
agacacgctagtcaacccgcccacgtctcccggtccccaccgcctctgcctcggcgccgagcgcagggaaggatgcccacgcctcgccatggccgtgcgctgctcgccgcgctgctcgcgtccgcgctcgccgcggccagcgcgcagccctcgcggcccggcgtctatgatgactacatgtccgggcagcgggtgcacgtcagcacggccatgatcgtgctcctcgccgccgtaatcgcggtgttcgtcttcatcgccttcttcaccgtctacctccgccactgcaccggctacgcgttcaggcgcgacgacgaccgcgccgccgcccccaacttcgacgccttcatctcgcgctcgcggaggcagcggcgcccccgcgggctcgacgccgcggtggtcgaggcgttccccaccatgaagtacgccgaggccagggcgctgcgggtcgggaagggcggcgcgctcgagtgcgccgtctgcctcagcgagttcgaggacgaggagcggctcaggctgctgcccaagtgcagccacgccttccacccggagtgcatcggcgagtggctcgccagccacgtcacctgccccgtctgccgctgcaacctcgaccccaacaaggataccagcagcgacgaggacgcgagcttcccgtcgattccagtagcgagcagcatctccagcgaaacagcggttgcgcggatgggtgatggcccgctaccggtggccgtggtgatcgatgtggtaaccgaggaggaggaagaagagcggaggcaggaggcgctggagctgcagcagatagggacccagcggcgagccatgcggtcgcggtcggggtgccggacggcggcgccgacgcagctcgcccggtcgcactccacgggccactccctcgccctccggctcgaccgcgacctggagcggttcacgctgcggctgccggagcacgtgcgcagggagattgttgccgccggcgagcacagctcgcagttgcggcgcgggcgaagagccggggaaggaagcagccgcggtggcctcagcggtcccctcggccgggcgggcagatggcaatcgcttcttgcgaggaccttctccgggaagctctcgttcttttcggcgtccaggatgacggttagctccgacaggggagaagtgtcttccacgtcgtccacgaggctgagagggaagcgcgtggccgccgtcgatgccgccgacgttccaactacgagcgtccgccttgaccgcattggaggcagcgcgtccggtgcaaaagctggcgctgcgtcccgcgaggtggcggcggcggcggtcgacgaggagaaggcgcgcggttgcgcagcagcttccgacgtagaacgggaacagcagatttgaacgtagaaacttgaaactagtcttctttcacacgcgaaaaaaatggggttctttctgtctgtgtgcaacagccaacttgaacaaatgctaattttctgctgtaatcgtcgcagtactagctcgaagtttcgttgaagaacttgagatgtacaaaatgtaattataattttgtacaacagcggaaccataaggcaaaagccgtagacatggttgaaaaaatatttggattttcttctcaaaaaaaaaaaaaaaaaaaa

SEQ ID NO: 696 - protein, 432 aa, Panicum virgatum
  misc_feature: Ceres CLONE 1727434
  misc_feature (1)..(42): Pfam Name: zf-C3HC4 Pfam Description: Zinc finger, C3HC4 type (RING finger)
  misc_feature: The sequence is a functional homolog of  SEQ ID NO 1132 in the  10/666,642 US patent application
  misc_feature: The sequence is a functional homolog of  SEQ ID NO 1134 in the  10/666,642 US patent application
  misc_feature: Useful for making plants with modulated growth and phenotype characteristics
MPTPRHGRALLAALLASALAAASAQPSRPGVYDDYMSGQRVHVSTAMIVLLAAVIAVFVFIAFFTVYLRHCTGYAFRRDDDRAAAPNFDAFISRSRRQRRPRGLDAAVVEAFPTMKYAEARALRVGKGGALECAVCLSEFEDEERLRLLPKCSHAFHPECIGEWLASHVTCPVCRCNLDPNKDTSSDEDASFPSIPVASSISSETAVARMGDGPLPVAVVIDVVTEEEEEERRQEALELQQIGTQRRAMRSRSGCRTAAPTQLARSHSTGHSLALRLDRDLERFTLRLPEHVRREIVAAGEHSSQLRRGRRAGEGSSRGGLSGPLGRAGRWQSLLARTFSGKLSFFSASRMTVSSDRGEVSSTSSTRLRGKRVAAVDAADVPTTSVRLDRIGGSASGAKAGAASREVAAAAVDEEKARGCAAASDVEREQQI

SEQ ID NO: 697 - DNA, 1392 bp, Panicum virgatum
  misc_feature: Ceres CLONE 1727440
  misc_feature: Encodes the peptide sequence at SEQ ID NO. 698
accgaccaaaccctaggcgttcggcgggcgccaccgcggcggcgaagacgggggcctctcgtcgccttggtgtccccggagtcgtcgacggtgcagctcgatcccggctcggcaggcatgtcgaagagggtcccttgcaaattcttcttgcatggagcttgctacaaaggagattactgtgaattctcccatgactgcaatgatcgaccagataatgtttgcacattttaccagaaaggtgcatgctcctttggtagccgttgcagaaatgaacatgttgaaattcattggaaccgtccccaaccagcaaccactgcagcacatgtatcctccaattcttctcagctagtcgcttcttctggaggtcctcattgcagtgaatgccaaacggatcagtgtgaccaaacacaacagatatgcaagtctacgacaacacattctgcacaacaacctgcatgggcagatgattatcatgaacatgacactccaggggatgccaacagctggccatccgaccaagctgtggaaaaccaaacatcgcaacatcctgctcatatgccactttgctcttctgctgctgctggcacttgcccttatgggaaagactgttctcagatgcatggagatctatgcacattctgtgaaaaacaatgcttgcatcctcatcgtcccgacgaaagtggtttgcatgtcgagctatgcaagaaaaacaacagacttcttgaggccttgagaaaaagtgaagacattgagtgtggtgtgtgcttggaccgtgtgctctcaaaacctatggcagcggaaaggaggtttgggctgctgtctgactgtgaccattccttctgtatctcatgcattagaaattggcgtagtacctctcctacatctggcatggatgtcaactctacactcagggcttgtccaatatgccgcaaactgtcatactatgtagttcctagcactacgtggtactcctcaaaggaagaaaaacaggaaatcattgaaggctacaaggctaagctcaggtctattgattgtaagcactttgacttcggaaagggcacttgtccctttgggggcagctgtttttacaagcatgcctacagagatggccgtttggaagaggctttactgaatcacaatgatgctgacggtgcaagggcaacgattgccagacttatgaggttgtcgtacctactgactcggctgcatgtctagggaaaccccgatcgttatacctcgcgtacacgcctcgcgtagtatctttcaccaaacaggctgagttgattggagttgagtaatttggccaggcaggcattcctggatttggctttgtactgaatatttcaaacatccagaaaagagggcggtcatttctgaattttatcttctgct

SEQ ID NO: 698 - protein, 365 aa, Panicum virgatum
  misc_feature: Ceres CLONE 1727440
  misc_feature (1)..(58): Pfam Name: zf-C3HC4 Pfam Description: Zinc finger, C3HC4 type (RING finger)
  misc_feature (1)..(28): Pfam Name: zf-CCCH Pfam Description: Zinc finger C-x8-C-x5-C-x3-H type (and similar)
MSKRVPCKFFLHGACYKGDYCEFSHDCNDRPDNVCTFYQKGACSFGSRCRNEHVEIHWNRPQPATTAAHVSSNSSQLVASSGGPHCSECQTDQCDQTQQICKSTTTHSAQQPAWADDYHEHDTPGDANSWPSDQAVENQTSQHPAHMPLCSSAAAGTCPYGKDCSQMHGDLCTFCEKQCLHPHRPDESGLHVELCKKNNRLLEALRKSEDIECGVCLDRVLSKPMAAERRFGLLSDCDHSFCISCIRNWRSTSPTSGMDVNSTLRACPICRKLSYYVVPSTTWYSSKEEKQEIIEGYKAKLRSIDCKHFDFGKGTCPFGGSCFYKHAYRDGRLEEALLNHNDADGARATIARLMRLSYLLTRLHV

SEQ ID NO: 699 - DNA, 1719 bp, Panicum virgatum
  misc_feature: Ceres CLONE 1727456
  misc_feature: Encodes the peptide sequence at SEQ ID NO. 700
agaagggggagcaacacagagaaaaaaagctcgaggaaatggcggcctccggggagggcgcgtcgctgccgtctccggcgggcggcgaggacgcgcaccgccgccgcgtgagctacttctacgagccatcgatcggcgactactactacgggcagggccacccgatgaagccccaccgcatccggatggcgcactcgctggtcgtccactacggcctccaccgcctcctcgagctctcccgcccctacccggcctccgacgccgacatccgccgcttccactccgacgaatacgtcgccttcctcgcctccgccaccgggaacccgggcatgctcgatccgcgcgccgtcaagcgattcaacgtcggcgaggactgccccgtcttcgacggcctcttccccttctgccaggcctccgcggggggaagcatcggcgccgccgtcaagctcaaccgcggggatgccgacatcaccgtcaactgggcgggcggtctccaccacgccaagaagagcgaggcctctgggttctgctacgtcaacgacatcgtcctcgccatcctggagctcctcaagttccataggcgtgtgctatatgtagacattgatgtccaccatggagatggtgtggaggaggccttcttcactacaaaccgagtcatgacagtttcctttcacaaatatggggactttttccctggtactggacatatcactgatgttggggcagccgaagggaaacattatgctctcaatgttcccctgagtgatggtattgatgatgccaccttccgtgatctgttccaatgcatcatgaagaaagttatggaggtttatcagccagatgtggttgtcctccaatgtggagctgactcattggctggagacaggttaggttgtttcaacctgtctgtgaagggtcatgctgactgcctccgtttccttaggtcgtacaatgttcctatgatggttttaggtggtggaggttacaccatcagaaatgtcgcacgctgctggtgctacgagacagcagttgctgttggtgttgaacctgataacaaattgccttacaatgattactatgagtacttcggtcctgattatactcttcatatccaaccgaaaagtgtggagaacctgaatactacaaaggacttggagaacataaagaacatgatattggagaatctctcaaggatagaacatgttcccagcactcagttccatgacaggccgtcagatcctgaagctccagaggagaaagaggaggacatggacaagaggccacctcagcgcagcagattatggagtggaggagcttatgactctgatagagaggatcctgacaacatgaaaagtgagagtaaagacctaactgccagctccaagctgaaggatgaaccaaaggatgatctgtaggagagcccctgagcgagttctctgctctcttgatcgttgatgtaggtgcatgctgaagagtggggaagcatctgaacatatacccttccccagagcatccgtaaaacaccgaacgtttcgtctgcttctgacttcctgcatgttaactagatctggcagttaggcgcatccttaaacgtgttgacctagagaagcgaaatgattgcgctcccatgggttgcattcgtatggattatcatggaacaatgctgtagtgaatacatattcgcccatgatttttgggtaaaaaaaaaaaaaaaaaaaa

SEQ ID NO: 700 - protein, 458 aa, Panicum virgatum
  misc_feature: Ceres CLONE 1727456
  misc_feature (1)..(314): Pfam Name: Hist_deacetyl Pfam Description: Histone deacetylase domain
  misc_feature (1)..(312): Pfam Name: Hist_deacetyl Pfam Description: Histone deacetylase domain
  misc_feature (1)..(316): Pfam Name: Hist_deacetyl Pfam Description: Histone deacetylase domain
MAASGEGASLPSPAGGEDAHRRRVSYFYEPSIGDYYYGQGHPMKPHRIRMAHSLVVHYGLHRLLELSRPYPASDADIRRFHSDEYVAFLASATGNPGMLDPRAVKRFNVGEDCPVFDGLFPFCQASAGGSIGAAVKLNRGDADITVNWAGGLHHAKKSEASGFCYVNDIVLAILELLKFHRRVLYVDIDVHHGDGVEEAFFTTNRVMTVSFHKYGDFFPGTGHITDVGAAEGKHYALNVPLSDGIDDATFRDLFQCIMKKVMEVYQPDVVVLQCGADSLAGDRLGCFNLSVKGHADCLRFLRSYNVPMMVLGGGGYTIRNVARCWCYETAVAVGVEPDNKLPYNDYYEYFGPDYTLHIQPKSVENLNTTKDLENIKNMILENLSRIEHVPSTQFHDRPSDPEAPEEKEEDMDKRPPQRSRLWSGGAYDSDREDPDNMKSESKDLTASSKLKDEPKDDL

SEQ ID NO: 701 - DNA, 1637 bp, Panicum virgatum
  misc_feature: Ceres CLONE 1727465
  misc_feature: Encodes the peptide sequence at SEQ ID NO. 702
agaccgatccaaacaaaccgagaccagcgaaaaggcgttggactcgccaggaggccgtggccagcagcgccgaacacagcggttagagcccggaaaccctagccccgccgccgccgcctcgcgatgtcttgcacggtggccatcccgagctcgccggtcttctcgccgtcgcgccgcccgctctcctgcaaggccgcatcggcctcgccggagcccgccgtcaccgtctccgccgcctccccggcgcccgcggccgccgcccccgccggctcgccgctccgccccttcgccctccgcgcgctgctccgggaggagccctccccgtcgtcttcgccccaaccggcctcaaccgccgcggtggcctcggcaccggccgggcccgtgctgaagaggcggcgaccggcgccgctcgtggtgccggcggccggcgccgcggcggctgctgctgccgcggcagcggtggccgcggtggaggcggatccgaggaacgaggtggaggaggagggggaggagttcgcggcgtactgccgtaggggcaaggggaggagaagggtggagatggaggaccggcatgtggccaaggtcgcgctcggcggagatccccaagtggcgctgtttggtgtattcgatggtcacggtgggaagaacgcggcggagttcgctgctgagaacatgcccaagttcatggctgaagagttgaaggtaaacggcggagaggtcgaaggagcggtgaagaggggctaccttaagacggacgaggagttccttaagagggacgagagcgggggagcgtgctgcgtcacggctgtcctccgaaagggtggcctcgtcgtgtccaatgccggagactgccgcgcagtgctcagccgagcggggaaggcggaggcgctcacctctgaccacagggcctcacgggaggatgagaaggagagaattgagaatttgggtggattcgtggtaaattatcgcggaacatggagagtacagggctccttggcagtttcgagaggcattggggatgcacacctgaagcagtggatcgtggctgaccctgacaccaggaccatcctggttgatcagcagtgcgagttcttgatacttgcttctgatggcctgtgggataagattgataatcaggaggccgtagacctagcaaggcctctctgcaccaataatgacaaggcctctcgcatggctgcctgcaggatgctcactgaaacatccatttccaggggctcaactgacaatatcagcgtcgtgatcatacagttgcagaaatttacaagttcttgactattttctgagagaaactggaattagactctagccagtagtgctaacagactggtggaaggggggcagggtaggtagacatcacacatgttacttcgcaggccatagttttcatgagcttgcgctactttgtggggattttaacattcattctttggcgtagaacattctttttcttataacaattctttatgtacttagatctagttgattcattctttgacagtaccataataatgtggggtgatccctcgattcatattgtaaaaaggcaatttgcctacctacactgttacattctattcattaattaaacttttttccaaaaaaaaaaaaaaaaaaaa

SEQ ID NO: 702 - protein, 389 aa, Panicum virgatum
  misc_feature: Ceres CLONE 1727465
  misc_feature (1)..(248): Pfam Name: PP2C Pfam Description: Protein phosphatase 2C
MSCTVAIPSSPVFSPSRRPLSCKAASASPEPAVTVSAASPAPAAAAPAGSPLRPFALRALLREEPSPSSSPQPASTAAVASAPAGPVLKRRRPAPLVVPAAGAAAAAAAAAAVAAVEADPRNEVEEEGEEFAAYCRRGKGRRRVEMEDRHVAKVALGGDPQVALFGVFDGHGGKNAAEFAAENMPKFMAEELKVNGGEVEGAVKRGYLKTDEEFLKRDESGGACCVTAVLRKGGLVVSNAGDCRAVLSRAGKAEALTSDHRASREDEKERIENLGGFVVNYRGTWRVQGSLAVSRGIGDAHLKQWIVADPDTRTILVDQQCEFLILASDGLWDKIDNQEAVDLARPLCTNNDKASRMAACRMLTETSISRGSTDNISVVIIQLQKFTSS

SEQ ID NO: 703 - DNA, 1559 bp, Panicum virgatum
  misc_feature: Ceres CLONE 1727468
  misc_feature: Encodes the peptide sequence at SEQ ID NO. 704
tcgggctcggctcattcacaagcgccctcccgctcagggcctcagccctcaggttcatatcctccgctctgtttctcttctaaaaaaaaaaactttcctttctctcgtagagaaactttctcctgatctcctcccttgctcgagatcttccttccctggcgtcgacgactgggcgagcggcggcccagccctttgccggcgacgagcgcgtcctccaggcttgaactcgactgctagtcgcaacgatggacgacggggacctcgatttctcaaacccagacacgttcttgtgccctgccatcggcaacgatccgcccagcagctgctctatggacagctacttcgatgacatcttgaaggatacagagcaccatgcttgcacccacacccatacctgcaacccgccagtccacgacaattcacacacccacacctgtgtccatgtccacaccaagattgtcgcggcttcaccagacgccgctgagactgaagaatcgccatctgagaacaactccaagaagcgcccgtccggtaaccgagcagcggtgaggaagtaccgggagaagaagaaggctcacacagcattgttggaggaagaggtggtccacttgagggctttgaaccagcaactcatgaagaaactccagaatcacgccgcgcttgaggcagaggtagccaggcttcgctgcctgcttgttgatatcagagggaggattgagggggagattggtgctttcccttatcagaggccagtcaagaacattggtttgctgtctagtgttgaccagggaagcttccttggtggtgcccaggttaccaactcctgtgatttcagatgcaatgatcagatgtattgcaatcctggaatgcaggaggctatgagtgctcaggtcttggggcaaggtgcttgcgatattgctaatatccagtgcattagaagtgcaaagtctggatccacaaagctacctgtctgtgggggtgtggacacagtacctactggctgcttgccaaatgttgaaaagaagtgaaggactgctggtggcatggtctctcctttcagagactactgggtctcggcgttctgcatccaagaaatgctgtataaacactctggtggtggtgtttatggtctctccgttttcactgactactggttctcagcattctgcatccaataaaatgctgtataaactgctagcttctatatttagggccacatcttgttcaaactgttatgtgtctgagttggttgccgatgatgcttctatggtgcctgaggcgattcaagtttgttagctctgaagctgacaggacatcttcgttcttttacttagttgccagatgctctctgatgaagttcagaactgaagcagatctgaaggagttgaactggctaaattgtgccatctgtgcttgatctcaagtttgatgtgaatctatccgaaatcatttgtctattgtaggtgatatgtctctttgttgctgtgcccgtgattccaagtacatggattcgattattatttgaatatttcaccattcaaaaaaaaaaaaaaaaaaaa

SEQ ID NO: 704 - protein, 260 aa, Panicum virgatum
  misc_feature: Ceres CLONE 1727468
  misc_feature (1)..(58): Pfam Name: bZIP_2 Pfam Description: Basic region leucine zipper
  misc_feature: The sequence is a functional homolog of  SEQ ID NO 1707 in the  11/479,226 US patent application
  misc_feature: The sequence is a functional homolog of  SEQ ID NO 208 in the  10/225,068 US patent application
  misc_feature: The sequence is a functional homolog of  SEQ ID NO 2360 in the  10/374,780 US patent application
  misc_feature: The sequence is a functional homolog of  SEQ ID NO 372 in the  10/412,699 US patent application
  misc_feature: The sequence is a functional homolog of  SEQ ID NO 863 in the  11/479,226 US patent application
  misc_feature: Useful for making plants with modulated growth and phenotype characteristics
MDDGDLDFSNPDTFLCPAIGNDPPSSCSMDSYFDDILKDTEHHACTHTHTCNPPVHDNSHTHTCVHVHTKIVAASPDAAETEESPSENNSKKRPSGNRAAVRKYREKKKAHTALLEEEVVHLRALNQQLMKKLQNHAALEAEVARLRCLLVDIRGRIEGEIGAFPYQRPVKNIGLLSSVDQGSFLGGAQVTNSCDFRCNDQMYCNPGMQEAMSAQVLGQGACDIANIQCIRSAKSGSTKLPVCGGVDTVPTGCLPNVEKK

SEQ ID NO: 705 - DNA, 1265 bp, Panicum virgatum
  misc_feature: Ceres CLONE 1727474
  misc_feature: Encodes the peptide sequence at SEQ ID NO. 706
aagcatagtagtgtgcgactgcaacaagagctcactcactcttctgtgatctgtactgaaagtcctgaacgtgacaagctaagcagcgagaacgatggcggaagagtacggccgcagcggctacggcaggtcaggcgccggcgacgactacgagagcggctacaacaagtccggcaccgacgactacggccggggcgaaggcgggtacaacaagtcgggcaccgacggtggctacggcggcgggtacaacaagtccggcggtgacgagtacggccgcagcggcggggacgggtacaacaggcccggaaccgatgagtacgaccgcggcggcagcgacaggtccggcacggacgactacggcagcggctacaagaagtccggcaccgacgactacgatcgcagcggcgggtacaacaaatcggccaccgacgactacaacagcggcggcggcggcgcgtacaacaagtcctccggcggtgacgacgagtacaccaccggtggcggcaggtacaagaagacctctggcgacgacgagtacaccggcggtggcgggtacgacagcaagtccggtggcggcgtcgacgagtacggctcctcccggaacgactcgaagaagtacaggaaggaggagaaggagcacaagcacaaggagcacctcggcgagatgggcgccctcgccgccggcgccttcaccatgtacgagaggcacgaggcgaagaagaacccggagcacgcgcagcgtcacaagatcgaggagggcgtggcggcggtggcggcggtgggcagcggcgggttcgcgttccacgagcaccacggcaagaaggaggccaaggacgcggcggaggacgccgaggaggaggaggaggaggccgcccgcggcgagggcaagaagaagcaccacttcttcggctagctagctgttgcgtgactggcctcctgcgtgctcctccagcagcgggtgaataaaagccggggacgtttcgtgcgtacggctctgcgtatccgtgtaccacgtatccgtatgtgctacgtacgtcactgtggttactgatgatgtggctgcagctgtgtggagtggagtctgttggtgtacgtgtctgcatgtgcatttgtctacgtcgttttgtttctacgtggtatatatgtatgtacgtggtttgcacttgatgactttgtaaccggcactctcgcgtagaatccgtgtatattttaataaaaaagtgacaccggtgcctgatttgcttcaaaaaaaaaaaaaaaaaaaa

SEQ ID NO: 706 - protein, 272 aa, Panicum virgatum
  misc_feature: Ceres CLONE 1727474
  misc_feature (1)..(54): Pfam Name: ABA_WDS Pfam Description: ABA/WDS induced protein
MAEEYGRSGYGRSGAGDDYESGYNKSGTDDYGRGEGGYNKSGTDGGYGGGYNKSGGDEYGRSGGDGYNRPGTDEYDRGGSDRSGTDDYGSGYKKSGTDDYDRSGGYNKSATDDYNSGGGGAYNKSSGGDDEYTTGGGRYKKTSGDDEYTGGGGYDSKSGGGVDEYGSSRNDSKKYRKEEKEHKHKEHLGEMGALAAGAFTMYERHEAKKNPEHAQRHKIEEGVAAVAAVGSGGFAFHEHHGKKEAKDAAEDAEEEEEEAARGEGKKKHHFFG

SEQ ID NO: 707 - DNA, 1634 bp, Panicum virgatum
  misc_feature: Ceres CLONE 1727475
  misc_feature: Encodes the peptide sequence at SEQ ID NO. 708
aaaaaaagcacatccccaatcgcagcgcggcccttgcattgcctcttgtagtttagttttgtacaagccaagatcgagcgaagccatggccaagcctcacatcctcatggtgccgctgccggcccagggccacgtcacccccatgatggagctcgcccaccgcttggtcgagcacggcttcgaggtcacgttcgtcaacaccgaagagcctcacgcgcgggtcgtcggcgcgctgcaggcggcgggcggcacggcggcgctggccggcatccacctggcgtccatcccggacgggctggagcagggggaacgcttggacgtcgtcaaggtcatcgagtcctacgaccggcacattccggggcacctggagcggctcatcgccgaaatggaggcgtccgggaggcccaaggtgaactggatcgtctgcgacgtgtacatgtggccgtgtttcgtcgtcgccaaaaagttcggcatccgcctggccgcactctggccggcggcggcggcgtgcttagcctttaatatcaagatccccaagttattagaggatgggttagtcaacgacaagggtttgccagagcgtgatgagatggtccagcttgcccccggagtcccgccgctgcagacgtcgcagctgccgtggatcaacttcatgacgcccgcctggcagagggtcttgttttttctgggcaccaagacgtatgagatcagtaccctcgccgagatggtggtgtgcaactcgttccgtgagctcgaggccggcgcgttcaagctcctgcccaagaacgtcctgcccgtcgggcccctgacccccgacccggagctccggaagcccgtcgggcagctgctgccggaggacacccggtgcctcccgtggctcgacgcccagaccgacgggtccgtcgtgtacgtggcgttcggcagctcgaccatcttccacccgcgccagttccgggagctcgccgaggggctggagctcgccggccggccgttcctctgggtggtgcgcgcggacttcaccaccggcgacctgagcaaggagtggttcgacgagttcaaggcccgcgtcgcgggcacggggatggtggtcagctggtgcccccagcagaaggtcctggcgcaccgcgcggtggcgtgcttcgtgtcgcactgcggctggaactcgacggtggagggcgtcaggagcggcgtgccgttcctgtgctggccctacttctccgaccagttcctggaccggagctacgtcaccgacgtgtggcggaccggcctggctgtgtcgcccgacgcggacgggatcgtgaccaaagaggagctcaggagcaaagtggagcaggtcgtcggcgacaacgagatcagggagcgggcgcggctgctcagggacgcggccggccgggccattgaccaagggggagactcgtacgagaacatccaaaagttcgtggacctgctgcgtcaatgagatcgagagagtcgcctcgccgcgatccaagggatcgtgatcccatccttagctcgcacatgctcttctacccgtacgcgtggtgtgctgctgttcacttctgattgggaaccgacccttgtttaataatcgaataatcaaatcgatttcagatcaaaaaaaaaaaaaaaaaaaa

SEQ ID NO: 708 - protein, 457 aa, Panicum virgatum
  misc_feature: Ceres CLONE 1727475
  misc_feature (1)..(166): Pfam Name: UDPGT Pfam Description: UDP-glucoronosyl and UDP-glucosyl transferase
MAKPHILMVPLPAQGHVTPMMELAHRLVEHGFEVTFVNTEEPHARVVGALQAAGGTAALAGIHLASIPDGLEQGERLDVVKVIESYDRHIPGHLERLIAEMEASGRPKVNWIVCDVYMWPCFVVAKKFGIRLAALWPAAAACLAFNIKIPKLLEDGLVNDKGLPERDEMVQLAPGVPPLQTSQLPWINFMTPAWQRVLFFLGTKTYEISTLAEMVVCNSFRELEAGAFKLLPKNVLPVGPLTPDPELRKPVGQLLPEDTRCLPWLDAQTDGSVVYVAFGSSTIFHPRQFRELAEGLELAGRPFLWVVRADFTTGDLSKEWFDEFKARVAGTGMVVSWCPQQKVLAHRAVACFVSHCGWNSTVEGVRSGVPFLCWPYFSDQFLDRSYVTDVWRTGLAVSPDADGIVTKEELRSKVEQVVGDNEIRERARLLRDAAGRAIDQGGDSYENIQKFVDLLRQ

SEQ ID NO: 709 - DNA, 2749 bp, Panicum virgatum
  misc_feature: Ceres CLONE 1727478
  misc_feature: Encodes the peptide sequence at SEQ ID NO. 710
acacacaaaccagaacctcacctagctttctctctcctccaccacccctttttctctcatctgcgcacaagcattccgttcgctctcctctccccttgtcgtcctccctccctctgccacccccttgtcctagctcccagctcccattgtatctagcatctcagtactcctacttggctacaagtagtaggccttcggtactggcgaatcccagctcctgcgtcctactagaggctaaggactaaggcggcggcgccggcggctgcactgcgggcgggggagattctcgggttgttctttgagctcccactggttgcagggttggtgattccgccgccggaaaaagaaaatccaatcttggcgcggctcgtggcggtcagccgccggctgggttggttggttggaccttgtccgtggctaatttggtcagatatccgaggatccctgttggaagccccgcctctattgaggattggatcccggatttcaggtctcctgctgcaaggatcacggcttgggggcggcggcggcggggtggcagacccctcttgctgcctgcggcctgcagagcgggagctatgacacaatgacagaggagagcgccaagaagagcaagctttcatggtccaagtctctcgtgaggaagtggttcaacatccggcccaaggcgcaggacttccatgctgattctgacgccggccagggaagggatggaggtagtggatcatggaggcccagctgctccgccggggaagcaagtgcaagcatggccaagaaaagcagaactgaccggtcatcgtccaagcagagtgccgaacgcactcgccgaggcaagaataatttcgatatagcacgcctgactgaagttcaagattacaggatctttgcggcaacgtggaatgtcggtggtaaatcaccaccaagggggctgaatttagatgaatggcttcatacttctcctcctgctgatatttatgtacttgggtttcaggagattgtccccttgaatgctggaaatgttcttggcactgaagataaccttccagccaagaaatgggtgtcccttatcaggcggacactgaacaagaatccaggagccagtggttgcggtggctatcataccccttcaccggtcctggatccagttgtagaattagatgctgattttgagggatctgcgagaaggcaggataattttcctttcttccaccgccgctcgttccacaacctcagccgtagtttaagaatggatggggactacatgttcccgcaaccaaggctggatcgcaggtttagcgtttgtgatccagtcaacttgggaggcagacctagtgattttgatggaaatttgcaatgccctggatcgcctgttgaggagaacataaatatggaagtgagtgatgctgcacaattttcgccgttcctgcatagctacactgcatctgcaccttctgaacaaaatgatgagcaatcaagcagccctaggtattgtttggttgccagcaaacaaatggttggcatatttctcacagtttgggtacgcaatgaaataagagatgatgtgagaaacttgaaagtttcttgtgtcggcagaggattgatgggttatcttggaaataagggttcgatttcaataagcatgtctttgcaccagacaagcttctgcttcatctgttgtcatttgacctcaggggaaaaggaaggcgatgaactgcgcaggaattctgatgttctggaaattttaaagaagaccaggttcccacgggttcgtggtgccggtgatgttaagtcacctgaaaaaattcttgagcatgatcgtattatttggcttggggatttgaattatcggattgccctgtcgtactgttcggcaaaagctcttgtggaaatgcataactggaaacaattattggagaaagatcagctccgcatgcagaaaaggtatggacgagttttccagggttggaaagaagggaggatctattttcctcccacatacaaatattcatttaactcggatcggtacgccggagagggcatgcaccccaaagaaaagaggagaacaccagcatggtgtgatcgcattctctggtatggtaatggcctcaatcagctgtcttatgttcgcggagagtctcgtttctccgaccacaggccggtgtacagtattttcttggcagaggttgacattgtacaccataggaggagaaacatgggctatttcaattctagaattgaggtggaagaactcttgccacattctcagagctacagagaaataaaattttactgagttgacttatagcatgatgtaaggttaggaggctggtcaaatgttctatatgtagggttccagattcagctcactagacgatcagtatactgaagaaagaatgtgcaaatactaacataaaaggacattgggcgattttgctgcttgccactggaagatgacgaatgtgttgttggaaaagaatcaagcccatgccactaactatacagtacatccaactttaggctcttagttcctcctagcaaaatattcggttcaacttgtttcgtcctcttcttttttttcagtcagaccttgtagtgtcaacaaataccaaatgttactgtcttaccttcttccttttcttattttgagggtagaaactttgcaaaactcacaagtgtatcccatgcaagctgtgaattgttttaaggcagcggaattagctttaggttataaaaaaaaaaaaaaaaaaaa

SEQ ID NO: 710 - protein, 568 aa, Panicum virgatum
  misc_feature: Ceres CLONE 1727478
  misc_feature (1)..(431): Pfam Name: Exo_endo_phos Pfam Description: Endonuclease/Exonuclease/phosphatase family
  misc_feature (1)..(417): Pfam Name: Exo_endo_phos Pfam Description: Endonuclease/Exonuclease/phosphatase family
  misc_feature (173)..(453): Pfam Name: Exo_endo_phos Pfam Description: Endonuclease/Exonuclease/phosphatase family
  misc_feature (1)..(444): Pfam Name: Exo_endo_phos Pfam Description: Endonuclease/Exonuclease/phosphatase family
  misc_feature (1)..(429): Pfam Name: Exo_endo_phos Pfam Description: Endonuclease/Exonuclease/phosphatase family
  misc_feature (1)..(431): Pfam Name: Exo_endo_phos Pfam Description: Endonuclease/Exonuclease/phosphatase family
  misc_feature (1)..(423): Pfam Name: Exo_endo_phos Pfam Description: Endonuclease/Exonuclease/phosphatase family
  misc_feature (189)..(568): SWISSPROT Homolog: EC 3.1.3.56 Type I inositol-1,4,5-trisphosphate 5-phosphatase CVP2
  misc_feature (290)..(540): SWISSPROT Homolog: EC 3.1.3.56 Type I inositol-1,4,5-trisphosphate 5-phosphatase 2
MTEESAKKSKLSWSKSLVRKWFNIRPKAQDFHADSDAGQGRDGGSGSWRPSCSAGEASASMAKKSRTDRSSSKQSAERTRRGKNNFDIARLTEVQDYRIFAATWNVGGKSPPRGLNLDEWLHTSPPADIYVLGFQEIVPLNAGNVLGTEDNLPAKKWVSLIRRTLNKNPGASGCGGYHTPSPVLDPVVELDADFEGSARRQDNFPFFHRRSFHNLSRSLRMDGDYMFPQPRLDRRFSVCDPVNLGGRPSDFDGNLQCPGSPVEENINMEVSDAAQFSPFLHSYTASAPSEQNDEQSSSPRYCLVASKQMVGIFLTVWVRNEIRDDVRNLKVSCVGRGLMGYLGNKGSISISMSLHQTSFCFICCHLTSGEKEGDELRRNSDVLEILKKTRFPRVRGAGDVKSPEKILEHDRIIWLGDLNYRIALSYCSAKALVEMHNWKQLLEKDQLRMQKRYGRVFQGWKEGRIYFPPTYKYSFNSDRYAGEGMHPKEKRRTPAWCDRILWYGNGLNQLSYVRGESRFSDHRPVYSIFLAEVDIVHHRRRNMGYFNSRIEVEELLPHSQSYREIKFY

SEQ ID NO: 711 - DNA, 1901 bp, Panicum virgatum
  misc_feature: Ceres CLONE 1727486
  misc_feature: Encodes the peptide sequence at SEQ ID NO. 712
aacgccaaaccagaccaaaaccctcctctcctctccccccccacaacccaaaccctagccggcagcccccttgatgaccgccgccgtagatgcacaggctctccctcaccgtcattgacgccgctgccgtcgccatgcccgcggcgctccggctcgggggctccccggcgccccgcctcgccgccgcgcgccgccagggcccgcgccccccgccgtggctgcgcttcggctggggcggcggggcgcggagggggctgctctgttccgccgaggccgccaggcggggcggcgacggcgacgacgcggaggcggaggtggaggaggcgcggaggggaggcgggggccgcgcggcgacggagaggaggatgaggagcggggccgcggccgcggccgccgcggtggggacgagcgtcgagctgctggcgattcccggggtcgggccgcgcaacctcaggaagctcgtggacaatggcttcgagggcgtcgcgcagctcaagcagctctacagggataagttctttggcaagtctagtgagcagatggttgagttcttacagagttctgttggcattgtacataagaaccatgctgagagtataacttctttcatcaaagcgagtgtcgatgaggagctgaaggatacagattcatctaaacccactcagaagaagaggcttaccttttgtgtggaagggaatattagcgttgggaagactactttcctccaaagaatagctaatgagactattgaactgcgtgatcttgtagagatagttcctgagcctattgataagtggcaggatgttggacctgatcacttcaatatattggatgccttctatgctgagccacataggtatgcatacactttccaaaactatgtgtttgtgacaagggtcatgcaagaaagggaatctcaagctggaataaaacctctcaggctgatggaaagaagtgtattcagtgatcggatggtgtttgtccgtgccgttcatgaagctaattggatgaatgagatggagatcagcatctatgattcctggtttgatcccgttgtgtcatcgctcccaggtctcattccagatggatttatctatctaagagctagtccagatacttgccacaaaagaatgatgcatcggagaagatcagaagaaggtggtgttacacttgactacttgcaaggtttgcatgagaagcatgagagctggttgcttccttcaaaaggttcaggtcctggtatattatcagtcagtcaactgcccatgcatatggaaggctccttgcctccagaaatacaggatcgtgtattttacttggaaggaaatcacatgcactctagtatccaaaaggtccctgcccttgtcctggattgtgaatctgacattgatttcaacaaagacatagaagctaaacgacaatatgctcggcaagttgcagagttctttgaattcgtcaagaaaaagaaggaagaagctccatctgagcaatcgggtgccaacaagggtcgcatgaacccacaggtcatgcttcctaagagaggccgcctgtgggtccctgaaggcaaccctttcgcgggctcccctatgaacctggatttcagaagagccatgtcttcatacatttcaacctaggactccatgcggaaagaaacttgccatcctcactcattgacctcgcagctcaaaccgcctatgcttttgaggtaaaccttaggttgctcgatgctagccactgatgtaaaatagcccagctgtggctccgtcctgtaaattatgatcgtagtgctagttccacgttttgcagcactagcatcagcggctttccgatttgatactaatctgtaccttacgttcggctgcttgaagcattctgttgaacaaaaaaaaaaaaaaaaaaaa

SEQ ID NO: 712 - protein, 514 aa, Panicum virgatum
  misc_feature: Ceres CLONE 1727486
  misc_feature (1)..(165): Pfam Name: dNK Pfam Description: Deoxynucleoside kinase
MHRLSLTVIDAAAVAMPAALRLGGSPAPRLAAARRQGPRPPPWLRFGWGGGARRGLLCSAEAARRGGDGDDAEAEVEEARRGGGGRAATERRMRSGAAAAAAAVGTSVELLAIPGVGPRNLRKLVDNGFEGVAQLKQLYRDKFFGKSSEQMVEFLQSSVGIVHKNHAESITSFIKASVDEELKDTDSSKPTQKKRLTFCVEGNISVGKTTFLQRIANETIELRDLVEIVPEPIDKWQDVGPDHFNILDAFYAEPHRYAYTFQNYVFVTRVMQERESQAGIKPLRLMERSVFSDRMVFVRAVHEANWMNEMEISIYDSWFDPVVSSLPGLIPDGFIYLRASPDTCHKRMMHRRRSEEGGVTLDYLQGLHEKHESWLLPSKGSGPGILSVSQLPMHMEGSLPPEIQDRVFYLEGNHMHSSIQKVPALVLDCESDIDFNKDIEAKRQYARQVAEFFEFVKKKKEEAPSEQSGANKGRMNPQVMLPKRGRLWVPEGNPFAGSPMNLDFRRAMSSYIST

SEQ ID NO: 713 - DNA, 3011 bp, Panicum virgatum
  misc_feature: Ceres CLONE 1727503
  misc_feature: Encodes the peptide sequence at SEQ ID NO. 714
aggcaggctcgctcgagctcggctcgttgacagcccctccccctcaggctcatctctgtttcttcccccttccggcctttcccttccctctgtggctctgtctctctcctcgtcttcctttcagggcggcgaagccgacgactgggcgggcggcggcgccattcgtcccgcttcgcccggccccttgccggcgacgagcatccaccagaatggcgcagagcaactgggaagcggataagatgcttgacgtgtatatctatgactatttgctcaagaggaacctgcaaacgacggcgaaggccttcatggcagaggggaaggttgctgctgatccagtcgcaattgatgctcctggagggtttctctttgagtggtggtctgtcttttgggatatattcatagcaaggacgaatgagaagcattctgaagttgcagcggcatacctagaggcacaacaaataaaagcaagagagcaccagcagcagatgcagatgcagcaattgcaacttatgcagcaaagacatgctcaacttcagcgtactaatgcaagccatccttcacttaatggtccaataaatgctttaaactctgatggcattttggggccatcaacagccagtgttttagccgccaagatgtatgaagagcgcttgaagcacccacattcaatggactctgagggatcacagcttcttgatgctagcagaatggctcttctgaagtcagctgcaacaaaccatgcagggcaattagttccggggactcctggaaatgtgtctacaacgctgcagcaaatccaggctcggaatcagcaaacaattgatattaagagcgaaggtaacatgggagtacctcagagatctttgcccatggatccatcatccttatatggacaaggaataattcagcctaaacctggattgagtggtgcaggactgaaccaaggtgtgagcggtttaccattgaaaggctggccattaactggaattgatcaattgcggcctaatctaggtgctcaaatgcagaagccatttctttcaacacagtcacagttccaacttatgtcaccacagcagcagcagcaatacttagcacaggcccaagcgcaagggaaccttggaaactcaactaattatggggatattgatccccgtagacttacagcgctgaccaggagtgggttgaatggtaaagatggacaacctgctggaactgatgtgtgtattagttcccctatgcaatccagttcacccaaagtcagaccagaccaagagtatctcatgaagacatcttcacagcaaccacaggaacagcttcagcagcagcagaaccaacagcagcagcagcagcagcagcagcagcagcagcagcagagccagcagcaacaaatgcagcagaacaatagaaaacgaaagcagactacatcatcaggaccagcaaatagtactggtacaggaaacactgtgggtccttcaaccaattccccaccatctacaccatccacacatacccctggggatggacttggaatggctggtaatatgcgccacgttcctaagaacttgatgatgtatggtgcagatggaactggacttgcatcctcttcaaatcaaatggatgatcttgaacagtttggtgatgtgggctctttggatgataatgttgaatccttcttatccaacgacgatggagatgcaagggatatttttgctgcactcaaaagaagtcctgcagagcctaacccgaccacttcgaaaggttttactttcagtgaagttaattgttggcgcacaagcaacagcaaagttgtttgctgccacttctcttcagatggcaagattttggctagcgctggacatgaaaagaaggctgtactttggaacatggaaaatttccagacacagtatacatcagaagagcatggccttattattactgatgtccgtttcaggccaaacactaatcagctggcaacatcatctttcgatagaactattaaactttggaatgctgcagatcctggattctctttgcacaccttcaccgggcatagcttccaggtcacatcattagatttccatccaaagaaaacagatcttctgtgctcttgtgatggcaatggtgaaatacgatactggaatgtgacccagcttacgtgtatgcgtgccataaagggtggtactgctcaagttcggtttcaacctaatgctggacaatatttagccgcagctgctgaaaacgtggtttccatatttgatattgagacgcatgggaaaaaatacactctgcagggtcataacaccgatgtgcaatcagtgtgctgggataacagcggtgaatttattgcctcggtcagtcaggacctagttaaggtttggtcaatatcatcaggagagtgcattcatgagcttagctccaatggaaacaagttccactcctgtgtgttccacccgagctataccaatctcttggttattggaggctaccagtctctggaggtatggaacatggtgaagaaccagagcctgacagtacaagctcatgaaggtctaattgccgcgctggcacagtcaccagtcacagggatggtagcttctgcaagccatgaccactccgtcaaagtgtggaaataacaaaaacaacaaaaataatgaatctaggtagcttttttcttaacccggaaattgatttctcggatagaggtgcgggtgagcttggtgttgcgggctgtggagttctgctcaggcaaataagagtagtagtagcagcagcagctggttgcctgtcacggttgagctgtttaagtacttagtgcagcgagtttgtggatgtgttgtatttatcctgataggtcgtttgtgtagctcagaaacaaacaaaaaaaagaatagaactttggctgaaaggtggcctcctgttctatttttatttatgctgtatcatatgtaacttttatatgtttcaattggaactcgctgcaattggcctcttaaaaaaaaaaaaaaaaaaaa

SEQ ID NO: 714 - protein, 807 aa, Panicum virgatum
  misc_feature: Ceres CLONE 1727503
  misc_feature (351)..(400): Pfam Name: Cpn60_TCP1 Pfam Description: TCP-1/cpn60 chaperonin family
  misc_feature (343)..(408): Pfam Name: GAL11 Pfam Description: Transcription regulatory protein GAL11
MAQSNWEADKMLDVYIYDYLLKRNLQTTAKAFMAEGKVAADPVAIDAPGGFLFEWWSVFWDIFIARTNEKHSEVAAAYLEAQQIKAREHQQQMQMQQLQLMQQRHAQLQRTNASHPSLNGPINALNSDGILGPSTASVLAAKMYEERLKHPHSMDSEGSQLLDASRMALLKSAATNHAGQLVPGTPGNVSTTLQQIQARNQQTIDIKSEGNMGVPQRSLPMDPSSLYGQGIIQPKPGLSGAGLNQGVSGLPLKGWPLTGIDQLRPNLGAQMQKPFLSTQSQFQLMSPQQQQQYLAQAQAQGNLGNSTNYGDIDPRRLTALTRSGLNGKDGQPAGTDVCISSPMQSSSPKVRPDQEYLMKTSSQQPQEQLQQQQNQQQQQQQQQQQQQQSQQQQMQQNNRKRKQTTSSGPANSTGTGNTVGPSTNSPPSTPSTHTPGDGLGMAGNMRHVPKNLMMYGADGTGLASSSNQMDDLEQFGDVGSLDDNVESFLSNDDGDARDIFAALKRSPAEPNPTTSKGFTFSEVNCWRTSNSKVVCCHFSSDGKILASAGHEKKAVLWNMENFQTQYTSEEHGLIITDVRFRPNTNQLATSSFDRTIKLWNAADPGFSLHTFTGHSFQVTSLDFHPKKTDLLCSCDGNGEIRYWNVTQLTCMRAIKGGTAQVRFQPNAGQYLAAAAENVVSIFDIETHGKKYTLQGHNTDVQSVCWDNSGEFIASVSQDLVKVWSISSGECIHELSSNGNKFHSCVFHPSYTNLLVIGGYQSLEVWNMVKNQSLTVQAHEGLIAALAQSPVTGMVASASHDHSVKVWK

SEQ ID NO: 715 - DNA, 1724 bp, Panicum virgatum
  misc_feature: Ceres CLONE 1727515
  misc_feature: Encodes the peptide sequence at SEQ ID NO. 716
aaccagaccaccacggcaccaccaccacctcgagcttcccctcccctcccctcctctgctacaaccgcttcgtttcgtcccccccaaattgagctccgattcggcgtctccatcacgaatcgcgcactagttccaccccgaaaatcgccgccgcactggacccgcggatggagtgaccagttagggttccgaagccggcaatggaggcgcagtggctcgccgagtacccgcaccagggcgccgacaagcggccgcgcaagcggccccggctcgcctgggatgtcgcgcccacggtgttccagccccccaaggcaattccgatgctatattgtgggcaggaactaatcaatggtaattttgcgactgcttttgtgccaccgccgccgatttattacactggaccaccacgaaacctttcacctccttggaggccagatgacaaggatgggcactatgtttttgcagttggggagaatctcacaccaagatataggatacttagcaagatgggtgaagggacatttggacaagttttggagtgctgggacttagaaaaccaagaagcagtggcaatcaagattgtgcgctccctccagaaataccgggaggctgctatgatagaaattgacgtgcttcagagacttggaaagcatgattttactggcagccgttgtgtgcaaatacggaattggtttgactatcgtaatcatatatgtatagtatttgaaaagcttgggccaagcttatacgactttctgcgaaagaatagctaccgttcatttccgattgaccttgttcgtgaatttgccagacaaatattagagtctgttgcatttatgcatgacttgcgacttattcacacggacctcaagccagagaacattctccttgtttcagcggagtctattagggtgcctgattataaggtttttatacgaccacccaaggacggttctttcttcaagaaccttccaaaatctagtgcaatcaagctgattgattttgggagtacggcatttgagcaccaagaccacaattatgtggtgtcaacaagacattaccgtgcacccgaagttatccttggtcttgggtggaactatccatgcgacttgtggagcgtgggttgtattttagttgagctctgttcgggcgaagctctctttcaaactcatgaaaatttggagcatttggctatgatggagagggtcttaggacccttgccaaagcatatgattgtcagagctgatcgacgtgctgaaaagtacttcaagcgcggaggaagattggactggccagagggggcggcctcacgagagagcatgaaggcagtctggaaattgcctcgtctgcagaatcttgtgatgcaacatgttgatcattctgctggagatctaatagatcttcttcaaggacttcttcgatatgatcctaatgagcgccttaaagcctgtgaagctctacgacaccctttctttaccagatgcatcagaagatgtggtttctgaggctatactgagattgaaaatctcaatgctgtatttcttcattttgatgtgtaagaactacaaaaaagtggagatgttcaacaaaaaatgaaatatgctaacttgcattctgttcaatgatgtgaaaggtaattgctgtatataagcagagttcttcgtcagttgatccattttaactggatgttattttcccattcttaaaaaaaaaaaaaaaaaaaa

SEQ ID NO: 716 - protein, 434 aa, Panicum virgatum
  misc_feature: Ceres CLONE 1727515
  misc_feature (1)..(427): SWISSPROT Homolog: EC 2.7.12.1 Serine/threonine-protein kinase AFC1
  misc_feature (1)..(427): SWISSPROT Homolog: EC 2.7.12.1 Serine/threonine-protein kinase AFC2
MEAQWLAEYPHQGADKRPRKRPRLAWDVAPTVFQPPKAIPMLYCGQELINGNFATAFVPPPPIYYTGPPRNLSPPWRPDDKDGHYVFAVGENLTPRYRILSKMGEGTFGQVLECWDLENQEAVAIKIVRSLQKYREAAMIEIDVLQRLGKHDFTGSRCVQIRNWFDYRNHICIVFEKLGPSLYDFLRKNSYRSFPIDLVREFARQILESVAFMHDLRLIHTDLKPENILLVSAESIRVPDYKVFIRPPKDGSFFKNLPKSSAIKLIDFGSTAFEHQDHNYVVSTRHYRAPEVILGLGWNYPCDLWSVGCILVELCSGEALFQTHENLEHLAMMERVLGPLPKHMIVRADRRAEKYFKRGGRLDWPEGAASRESMKAVWKLPRLQNLVMQHVDHSAGDLIDLLQGLLRYDPNERLKACEALRHPFFTRCIRRCGF

SEQ ID NO: 717 - DNA, 2192 bp, Panicum virgatum
  misc_feature: Ceres CLONE 1727525
  misc_feature: Encodes the peptide sequence at SEQ ID NO. 718
ggccgcaagccactccatgggcccacctgctagcgccgtaggggtgggtggctccggcgtagcgtaggcatccgcctccgtgtcatctggccggcggctccgccccctctcatcgatccaccacccgcatgcgcatccacgttttaatggctccgctcctaacactcgccgccggctgtggctgagctcagaacctgcctcacactcgctgctcgtcctcacccgtccctttccctcccgctctccgttccctctctttccgggctctgactgacagtgacgaaccccatgggcgcggcggcgaggaagcggaagcccgcctcatctctgctgccaatctggctcctctgcctcgcctgcgctgcgagcgcgcagccgtacatcggcgtcaactacggcgaggtggcggacaacctgccgccgccggaggagacggcgcggctgctcaagtccacggccatctccaaggtccggctctacggcgtcgacgcggggctcatccgcgcgctggccggctccaacatctccgtcgtcgtcggcgtggccaacggcgacatcccctcgctggccgcggacccggccgcggcgtcgcggtggctcgccgccaacgtgctcccgttcgtcccggccacggccatctccgccgtggccgtgggcaacgaggtgctcgagtccggggacgcctccctggccgcggcgctgctcccggccatgcagaacctccgcgccgcggccgccgccgcgggcggcgccgccgcgggggtcaggttctccaccgtcaacaccatgggcgtgatggcgcagtcggacccgccgtccacgggcgcgttccacccggacatcgcgccgcagctgcagggcatcctgggcttcctcagcaagaccggctcgccattcatgatcaacccctacccgtggttcgcgtaccagtccgacccgcgcccggacacgctcgccttctgcctcttccagcccaacgccggccgcgtcgacgccgggtccaagatcaagtacaccaacatgttcgacgcgcagctggacgccgtcaagtccgcgatggtgcgcgccgggttcgggaacgtggacatcgtggtggcggagacggggtggccgacgaggggcgacgccggcgagcccggcgcctcggtggagaacgccagggcgtacgtgtcgaacctggtggcccacctgcggtccggcgccggcacgccgctgatgccggggaagccggtggagacgtacctgttcgcgctgtacgacgaggacctcaagcccgggccggcgtcggagcgctcgttcgggctgtaccacacggacctgagcatggcgtacgacgccgggctggcggcgggggccgcggccggggcgccggcagcggggcagccgagggccggcggcgggtggtgcgtggcgcgggacggcgcgtcggacgcggagctgcaggcggacctggactacacgtgcgcgcaggtgggcgtggactgcggcgccatccagcccggcggcgcgtgcttcgagcccaacacggtgcgcgcccacgccgcgtacgccatgaaccagctctaccaggcggcggggcgccacccctggaactgcgacttccgggcgtccgccacgctcacctccaacaaccccagctacggcgcgtgcgtgtacaccgggggaggccaatgatgggaggcagaggcagccactgtcgtctaaccccgacagccacctcccggcggcagcgtggcgcacgactcgtcctccgctccgactccgagggccatggtgattggcatgggctactgcggagggccctgggctctctggacggaccgaataaagcttggaataatggcggtggttgtcgagctgtcgtggtgtaggtagggacgccaagtgcatgtgcaatggcgaatgcaaagcgtccccttgtttggcttcgtcggagcagcagcagcagaagtttccccttgggttattcaaaaaagaagtttccccttgggtggcggctggccgctccttttgtgacagttgtggttagcgctttgggcagggttaattgggttgtttgcggctttgtgtaaaccgagtgtcagttgctgtcagtgatggcatgtgggcatgtggcgtgtgtctgtccattagtagaattttactgaattattcaaacttttacttaccccgaaaaaaaaaaaaaaaaaaaa

SEQ ID NO: 718 - protein, 461 aa, Panicum virgatum
  misc_feature: Ceres CLONE 1727525
  misc_feature: Great-hit functional homolog of the protein sequence encoded by LOCUS At2g16230
  misc_feature (1)..(321): Pfam Name: Glyco_hydro_17 Pfam Description: Glycosyl hydrolases family 17
  misc_feature: Useful for making plants with altered cell wall content and/or composition
MGAAARKRKPASSLLPIWLLCLACAASAQPYIGVNYGEVADNLPPPEETARLLKSTAISKVRLYGVDAGLIRALAGSNISVVVGVANGDIPSLAADPAAASRWLAANVLPFVPATAISAVAVGNEVLESGDASLAAALLPAMQNLRAAAAAAGGAAAGVRFSTVNTMGVMAQSDPPSTGAFHPDIAPQLQGILGFLSKTGSPFMINPYPWFAYQSDPRPDTLAFCLFQPNAGRVDAGSKIKYTNMFDAQLDAVKSAMVRAGFGNVDIVVAETGWPTRGDAGEPGASVENARAYVSNLVAHLRSGAGTPLMPGKPVETYLFALYDEDLKPGPASERSFGLYHTDLSMAYDAGLAAGAAAGAPAAGQPRAGGGWCVARDGASDAELQADLDYTCAQVGVDCGAIQPGGACFEPNTVRAHAAYAMNQLYQAAGRHPWNCDFRASATLTSNNPSYGACVYTGGGQ

SEQ ID NO: 719 - DNA, 2005 bp, Panicum virgatum
  misc_feature: Ceres CLONE 1727538
  misc_feature: Encodes the peptide sequence at SEQ ID NO. 720
gctagtagcggcggcgccagccctcgccacccaaatattccgcggagaacccacccactcgctgcctgcaatcgcctccccatccccacccccccgcgcgggcctcctaaccctagtcctcgtcccgtccccccatggcggcgtgaacggccgccgtacggatcgcgcgggatatgcagggcggtgtcgcggctgctgccgctgctgctgcggcggccgcggcgacggtgaccacggcggtggcgcctccagtggccccggcccctgcggccgcgaccgctcacgcggcggtgggtaacggcggggcggccgccgcgccgccgccgcccttcctcatgaagacctacgagatggtcgacgacccggccacggacgacgtcgtgtcctggggccccgggaacaacagcttcatcgtctggaacacgcccgagttcgccagggacctcctgcccaagtacttcaagcacagcaacttctcctccttcgtcaggcagctcaacacatatgggtttagaaaggttgatccagacagatgggaatttgcaaatgagggttttctgagaggacaaaaacatctattgaagactatcaacagaaggaaaccatcgttgcaggggaacagccagccgcagcagccccaattgcagaacgctcctttgccagcctgtgttgaggtcggtaaatttgggctggaggaagagatagaacggctgaaaagggataagaatgttcttatgcaagagcttgtcaggctgagacagcaacagcagacaactgaccatcagctgcagactttggggaagcgtcttcaagggatggagtcacggcagcaacagatgatgtctttcctggccaaagcaatgcaaagtcctggtttcctagcacagttcgtacagcaaaatgagaacagcaggaggagaatagtagccgtgaacaagaagaggaggctgcccaagcaagatgacggcctagactctgaaagtgcttctgcctcattggacggtcaaattgtcaagtatcagcctatgatcaacgaagctgccaaagcaatgctgaggaagatcctaaagctagatgtttcacatagatttgaatctgtgggcaattcagataattttctactggagaattatctgccagccgctcaaggttttgacagctcttcgtcgaccagaaattctggggtaacccttgcagaggttccagctaactcaggtttgccgtatgtggctgtgagctctgggctttcagctatctgttcgtcttcagtggctcctgaaatccagtgtccagttgttttggacaacagctcatccaaccaagttcccaacatgagtgttgtgcctcctgtttcaaagcctatagcaccagggagtgatatcactattccggaattcccagatctggctgacatagtatctgatgactctgatattcctggaggaccctttgggatgcctggacctgagtttcccctggccgaagagggtgatgacagtgtccccatcgagactgatgagattttgtacaatgatgagactcagaagctgccagcaattgtcgattccttctgggagcagttcctggttggcagccctctatctgttgataacgatgaagttgattcaggtgtactagatacaagggagacactaccggagaatggatggaaaaaagtggagcacgtggctaaccttacggaacagatgggccttctatcaccaaatcacagggggtgagatgtattatcctaaggtaggctggtaataagctttggaagcgtcgcctaccctttttgttaatgtttaagattgtccttattgctgaaatgatatgctgatatatcaaccactcaacctatatgcggggggattcaatgttccacccatgaatgatcttggtacgctccaggaattcacctgcttgtatctaggtttggcaggcttgagaacagaacaatggtaacttgtcaaatctgcatgattaaaaaaaaaaaaaaaaaaaa

SEQ ID NO: 720 - protein, 521 aa, Panicum virgatum
  misc_feature: Ceres CLONE 1727538
  misc_feature: The sequence is a functional homolog of  SEQ ID NO 142 in the  10/666,642 US patent application
  misc_feature: The sequence is a functional homolog of  SEQ ID NO 2201 in the  10/666,642 US patent application
  misc_feature: The sequence is a functional homolog of  SEQ ID NO 2203 in the  10/666,642 US patent application
  misc_feature: The sequence is a functional homolog of  SEQ ID NO 2205 in the  10/666,642 US patent application
  misc_feature: The sequence is a functional homolog of  SEQ ID NO 2207 in the  10/666,642 US patent application
  misc_feature: The sequence is a functional homolog of  SEQ ID NO 865 in the  10/666,642 US patent application
  misc_feature: Useful for making plants with modulated growth and phenotype characteristics
MQGGVAAAAAAAAAAAATVTTAVAPPVAPAPAAATAHAAVGNGGAAAAPPPPFLMKTYEMVDDPATDDVVSWGPGNNSFIVWNTPEFARDLLPKYFKHSNFSSFVRQLNTYGFRKVDPDRWEFANEGFLRGQKHLLKTINRRKPSLQGNSQPQQPQLQNAPLPACVEVGKFGLEEEIERLKRDKNVLMQELVRLRQQQQTTDHQLQTLGKRLQGMESRQQQMMSFLAKAMQSPGFLAQFVQQNENSRRRIVAVNKKRRLPKQDDGLDSESASASLDGQIVKYQPMINEAAKAMLRKILKLDVSHRFESVGNSDNFLLENYLPAAQGFDSSSSTRNSGVTLAEVPANSGLPYVAVSSGLSAICSSSVAPEIQCPVVLDNSSSNQVPNMSVVPPVSKPIAPGSDITIPEFPDLADIVSDDSDIPGGPFGMPGPEFPLAEEGDDSVPIETDEILYNDETQKLPAIVDSFWEQFLVGSPLSVDNDEVDSGVLDTRETLPENGWKKVEHVANLTEQMGLLSPNHRG

SEQ ID NO: 721 - DNA, 1178 bp, Panicum virgatum
  misc_feature: Ceres CLONE 1727569
  misc_feature: Encodes the peptide sequence at SEQ ID NO. 722
gaaagctgaaagcgaggagaggcattccccccctcgattcgaaaagggcaaaccagcagcggcggcggcgagtttgacctttggtgaactgttagaaaccataaacagtgaagatgtcgctgcctgctgagctttcccgtgaggaaaacgtttacatggccaagcttgcagagcaggctgagaggtatgaagagatggttgagttcatggagaaggtggctaaggcagttgattctgaggagcttactgtggaggagcgcaaccttctgtcagttgcttacaaaaatgtcattggagcccgacgtgcctcatggcgcatcatatcctccattgagcagaaggaagagggacgtggcaatgaggaccgtgtcactcttatcaaggactaccgtagcaagatagaagttgaactcaccaagatatgtgatggaattctcaagctccttgattcccaccttgtcccctcatccacggctccagagtccaaggtcttctacctcaagatgaagggtgactactacaggtaccttgcggagtttaaaactggatctgagaggaaggatgcagctgagaacaccatggtggcatacaaagcagctcaggatattgccctggcagagttggcccccactcatcctattaggctcgggctggcgctcaacttctcagtattttattatgagatcctcaactctcctgatcgtgcttgcagtcttgctaagcaggcttttgatgaggccatctcggagctggataccctgagcgaggaatcctacaaggacagcactctgatcatgcagcttctgcgtgataacttgaccctgtggacttcagacatctcggaggatgccgccgaagaaatcaaggaggctcccaagggcgagtctggagatgggcagtaaagatgatccatgtccccaaaaactacatttcagtgttcggtctcctagcgaatctgtcatgtgctctgggttctgatttcgtccatataggttgtattgctgcttgtgatagctggaaattggtgactcccttctgtgctgtggtagaaaggcttgcaagtaccatgctgcttggcaggtgtcgtcaagctacacttgattgagggagcctttatttgttcgaatcattggcgttactttgtatttgtaggttggtctacctgtttcttttgtctc

SEQ ID NO: 722 - protein, 262 aa, Panicum virgatum
  misc_feature: Ceres CLONE 1727569
  misc_feature: Great-hit functional homolog of the protein sequence given in SEQ ID NO 9428
  misc_feature: The sequence is a functional homolog of  SEQ ID NO 2350 in the  10/374,780 US patent application
  misc_feature: The sequence is a functional homolog of  SEQ ID NO 344 in the  10/412,699 US patent application
  misc_feature: The sequence is a functional homolog of  SEQ ID NO 790 in the  10/225,066 US patent application
  misc_feature: The sequence is a functional homolog of  SEQ ID NO 805 in the  11/479,226 US patent application
  misc_feature: Useful for making plants with modulated drought sensitivity
  misc_feature: Useful for making plants with modulated growth and phenotype characteristics
MSLPAELSREENVYMAKLAEQAERYEEMVEFMEKVAKAVDSEELTVEERNLLSVAYKNVIGARRASWRIISSIEQKEEGRGNEDRVTLIKDYRSKIEVELTKICDGILKLLDSHLVPSSTAPESKVFYLKMKGDYYRYLAEFKTGSERKDAAENTMVAYKAAQDIALAELAPTHPIRLGLALNFSVFYYEILNSPDRACSLAKQAFDEAISELDTLSEESYKDSTLIMQLLRDNLTLWTSDISEDAAEEIKEAPKGESGDGQ

SEQ ID NO: 723 - DNA, 1712 bp, Panicum virgatum
  misc_feature: Ceres CLONE 1727578
  misc_feature: Encodes the peptide sequence at SEQ ID NO. 724
acacctgtccaccattcccgtctcccctgggcttcgcctcgcctcgcctcgccgccgcggccgggcgacgcctctcgccgcatccaccaacgcgcgtcttccacctcgcccttctcaggtctccaccgaatccctcctaatccgcgggatttcccttgctaattctggcagctcttgtcgctaagccacgctgctctgccaaacccctgctctgcgcgcatccgattggcagctccggcccgggttttgaagcgcgggttggtggattttggtgggcgacgacgaatcagggatggatttcccgggagggagcgggaggcggccgcagcagcagccggagccggagaacctgccgccgatgacgccgctgccgctggcgcggcaggggtcggtctactcgctcacgttcgacgagttccaaagcgcgctcggcggggcgggcaaggacttcggatccatgaacatggacgagctcctccgcagcatctggacggccgaggagacgcacgccgtcgcggccgccaacgcatcggcggcgtccgcggccgcggcggaccacgccgcgcgggcggcgtccatccagcggcagggatcgctcaccctcccccgcacgctcagccagaagaccgttgacgaggtctggcgcgacatcatgtgcttcggcgggccctcggccgcgcaggccgaggcggcggcggcgccgcccccgccggcccagcggcagcagacgctcggggaggtcacgctggaggagttcctcgtgcgcgccggcgtggtgagggaggacatgacggcgccaccgccggtgacggtggcggcgccaccaccaccgcctcctccgcaaccgccaatgctatttccccatggcaatgtgtttgctcccttggcgcctccgccactgtctttcgggaatggattggtgtcgggagctgtcggtcagggaggtggtgccgcgccctcgggggtatcgccggtgaggccggttacgtccaatgggttcgacaagatggaaggaggggacttgtcctctctgtcgccatcaccggtgccgtacgttttcaacggtggtctgaggggaaggaagcctccagctatggagaaggtggttgagaggaggaagcggcggatgatcaagaaccgggagtccgccgcgaggtcgcgccagaggaagcaggcatatatgatggagttggaagctgaggtggcaaaacttaaagaattgaatgaggagttgcagaaaaagcagactgaaatgctggggaaacaaaagaatgaggtcctggagagaatgagccggcaagttggacccacagcaaagagaatttgtctgcggaggacattgacaggcccttggtaggctgtagacatgtacctagaagtatctctcgtccggtggacaggagtgtatatatatagtaggtgcaaatgaactcacccatcgccagagttgccgttgttgacacagccattaatcctgagcatcagtctcatatgcggatagattgcctgtaattttcactgcataggttttggccctttgtgaaaatgttccagtgagtagtagaggagattgtatgtagtctggtcagtttattgacccaaggagtgcgtgcttatactccatttaggctttatggtttgttgtgacaccatgtatcattagttcagcatgttagatgttacacatccggcaaaaaaaaaaaaaaaaaaaa

SEQ ID NO: 724 - protein, 354 aa, Panicum virgatum
  misc_feature: Ceres CLONE 1727578
  misc_feature: Great-hit functional homolog of the protein sequence given in SEQ ID NO 9422
  misc_feature (1)..(53): Pfam Name: bZIP_2 Pfam Description: Basic region leucine zipper
  misc_feature (1)..(65): Pfam Name: bZIP_1 Pfam Description: bZIP transcription factor
  misc_feature: Useful for making plants with modulated drought sensitivity
MDFPGGSGRRPQQQPEPENLPPMTPLPLARQGSVYSLTFDEFQSALGGAGKDFGSMNMDELLRSIWTAEETHAVAAANASAASAAAADHAARAASIQRQGSLTLPRTLSQKTVDEVWRDIMCFGGPSAAQAEAAAAPPPPAQRQQTLGEVTLEEFLVRAGVVREDMTAPPPVTVAAPPPPPPPQPPMLFPHGNVFAPLAPPPLSFGNGLVSGAVGQGGGAAPSGVSPVRPVTSNGFDKMEGGDLSSLSPSPVPYVFNGGLRGRKPPAMEKVVERRKRRMIKNRESAARSRQRKQAYMMELEAEVAKLKELNEELQKKQTEMLGKQKNEVLERMSRQVGPTAKRICLRRTLTGPW

SEQ ID NO: 725 - DNA, 2473 bp, Panicum virgatum
  misc_feature: Ceres CLONE 1727581
  misc_feature: Encodes the peptide sequence at SEQ ID NO. 726
gccatctccgcctctccccggcaagcacgccacacccccagagccgaccaaccatggccgcgcactccgtcgccgccgcgcacgccaccatcgccgcgcgcgcgggcgccgcggcgtcggccccggccgagcgcctcggcttccgccgcctcagctcgctcgccggccgcggcctgcgctccccggcgccggccggccgcgcgctctccgcggccgcgtcctgccgccagcgcgtcgtgcgcgccgccgccgtcgagacgctcgagggcaaggcggccgccggcgagctgctcgagaagtcggtcaacacgatccggttcctggccatcgacgccgtggagaaggccaactccggccacccggggctccccatgggatgcgcgcccattggacacatcctctacgacgaggtcatgcgctacaaccccaagaacccctactggttcaaccgcgaccgcttcgtcctctccgccggccacggatgcatgctccagtacgccctgctccacctcgccggatacgacagcgtcaaggaggaggacttgaagcaattcaggcaatggggaagcaagactcccggtcaccccgagaactttgagactccaggagttgaagttaccaccggaccccttggtcagggtattgccaatgctgttgggttggcacttgctgagaagcacctggctgctcgcttcaacaagcctgacagtgagattgttgaccactacacgtatgctattttgggagatggttgccaaatggagggtattgccaatgaagcttgctccttggctgggcattggggtcttggcaagctgattgctttctatgatgacaaccacatttccattgatggagatacagagatcgcgttcacagaggatgtgagcacccgttttgaggctcttgggtggcatacaatctgggttaagaacggaaacaatggctatgatgacatccgtgcagccattaaggaagcaaaggcagttactgacaagcctaccttaatcaaggtgactaccacaatcggttttggatctccaaacaaggccaactcatacagcgttcacggaagtgcattgggcaccaaagaggtcgaagcaaccaggcaaaaccttggatggccctatgagccattctttgtgccggaggatgtcaagagccactggagccgccacacggccgaaggtgctgcacttgaggctgaatggaatgctaagtttgcagaatacgagaagaagtatgcagaggatgcagcaaccttgaaaagtatcatctcaggggagttccctgctggctgggctgatgctcttcctaaatacactcctgagagcccaggagatgccaccaggaacctctcccagcagtgcttgaacgcacttgctaaagtggtgcctggtcttattggaggtagtgctgatcttgcgtcttccaacatgacactgcttaagatgtttagtgacttccagaaggatacgcctgaggagcgcaatgtccgctttggagtcagggagcacggaatgggcgccatttgcaatggcattgctctgcacagcccagggtttgttccatactgtgctactttctttgtcttcaccgattacatgagaggtgccatgaggatcgcagctttgtctgaagctggagttatctatgttatgacccatgactctattggtcttggagaagatggtccgacccatcagcccattgagcacttggtgagtttccgcgcaatgcccaacatattgatgctccgtcctgctgatggtaatgagactgccggagcatacaaagttgcagttctcaacagaaagaggccatctatccttgctctctccaggcaaaagcttcctcacctgcctggtacctcaattgagggtgttgagaaaggtggatatatcatctctgacaactcaacgggcaacaagcctgacctcattgtattgggtaccggctctgaactggagattgctgccaaggctgctgatgagttgaggaaggaggggaagactgtccgtgttgtgtcattcgtttcctgggagctttttgaggagcagtcagacgaatacaaggagagcgttctcccagcggctgtttccgcaagaatcagcattgaggcagggtctactcttggatggcagaagtacatcggagcccagggcaaggccatcggcatcgacaaattcggtgcaagtgctcctgctggaaagatctaccaggagtatggcatcactgtggagagcgtccttgcagcaaccaagagcttttaagagtcaacagtcttgagtttttgccaccattgatgccaaaggaacactataccttgaggtcttgtgcccatagcttggaataatggcgggagtggaaggatgcctgcatttagagcgtgagtggtattttaggcctgtaataaacattgccttttccatttacgttggttttgtttggcgaaaaaaaaaaaaaaaaaaaa

SEQ ID NO: 726 - protein, 739 aa, Panicum virgatum
  misc_feature: Ceres CLONE 1727581
  misc_feature (1)..(335): Pfam Name: Transketolase_N Pfam Description: Transketolase, thiamine diphosphate binding domain
  misc_feature (1)..(307): Pfam Name: Transketolase_N Pfam Description: Transketolase, thiamine diphosphate binding domain
  misc_feature (3)..(335): Pfam Name: Transketolase_N Pfam Description: Transketolase, thiamine diphosphate binding domain
  misc_feature (16)..(737): SWISSPROT Homolog: EC 2.2.1.1 Transketolase, chloroplast precursor
  misc_feature (66)..(739): SWISSPROT Homolog: EC 2.2.1.1 Transketolase, chloroplast
MAAHSVAAAHATIAARAGAAASAPAERLGFRRLSSLAGRGLRSPAPAGRALSAAASCRQRVVRAAAVETLEGKAAAGELLEKSVNTIRFLAIDAVEKANSGHPGLPMGCAPIGHILYDEVMRYNPKNPYWFNRDRFVLSAGHGCMLQYALLHLAGYDSVKEEDLKQFRQWGSKTPGHPENFETPGVEVTTGPLGQGIANAVGLALAEKHLAARFNKPDSEIVDHYTYAILGDGCQMEGIANEACSLAGHWGLGKLIAFYDDNHISIDGDTEIAFTEDVSTRFEALGWHTIWVKNGNNGYDDIRAAIKEAKAVTDKPTLIKVTTTIGFGSPNKANSYSVHGSALGTKEVEATRQNLGWPYEPFFVPEDVKSHWSRHTAEGAALEAEWNAKFAEYEKKYAEDAATLKSIISGEFPAGWADALPKYTPESPGDATRNLSQQCLNALAKVVPGLIGGSADLASSNMTLLKMFSDFQKDTPEERNVRFGVREHGMGAICNGIALHSPGFVPYCATFFVFTDYMRGAMRIAALSEAGVIYVMTHDSIGLGEDGPTHQPIEHLVSFRAMPNILMLRPADGNETAGAYKVAVLNRKRPSILALSRQKLPHLPGTSIEGVEKGGYIISDNSTGNKPDLIVLGTGSELEIAAKAADELRKEGKTVRVVSFVSWELFEEQSDEYKESVLPAAVSARISIEAGSTLGWQKYIGAQGKAIGIDKFGASAPAGKIYQEYGITVESVLAATKSF

SEQ ID NO: 727 - DNA, 1996 bp, Panicum virgatum
  misc_feature: Ceres CLONE 1727592
  misc_feature: Encodes the peptide sequence at SEQ ID NO. 728
agatccctttccagtgcgagcctacaaaaagactaattctctcccatgctgatcatccactacatgttgcagtatcatcaccatctgagctagcctcacttctcatggcctttgcctccgtctgctgttcgtcaattcacagcatgggcactgcttgctggcgaagccatggatgatcttcaactgcagggtggccgtgcctgaaagcttacaccgcagagggcaacctcgcatctttggcagagtcttgtatgtctccttgtatcggttatggattatgcatttatactacagcttctcctgagttcatctactgttctcaacttctatattggaaagtaatgaccacttgtttgaagactccttatattggctgctattgtttctttgctatgtgactccattgcagacttacaatgttgaatgcaaaaggcccatatataagctaaaaaaaaaacgaagaacagcggcagcagaggacacctccgccactctcgaatccttccccaccatggcgtcgcaggtagcctccgtcttcgccggcatcgcgcaggctccggaggaccccatcctgggggtgacggttgcgttcaacaaggatcccagccccgtgaaggtcaacctcggcgtcggcgcctaccggaccgaggaagggaagcccctcgtgctgaatgtggtccggtgcgccgagcagatgcttatcaatgacccgtctcgttataaggagtacctaccaatcactggtttggctgaattcaataagctgagcgctaagcttatctttggtgctgacagccctgctattcaggagaatagggttgttacagtgcagtgcctatcaggaactggttctttaagagtgggaggtgaatttcttgcaaagcactaccatgagcgcactatttacatcccaacaccaacctggggaaaccacccaaaagtcttcaccctagctggattgactgccaggacctaccgctactatgatcctgcaacccgtggtcttgatttcaacggactcgtagaagacctcagttctgctcctttaggatcaattgtactgctgcatgcttgcgcccataaccctactggggtagatcctaccgttgatcagtgggaaaagattaggcagctgatgagatcaaaatcattgcttccgttctttgacagtgcttatcaaggctttgccagtggaagtcttgacaaagatgcccagccagtgcgcatgtttgttgctgatggtggtgaattgctcatggctcagagctacgctaagaacatgggattgtatggagagcgtgttggtgctttgagcattgtatgtggaagtgctgatgtagctgttagggttgaaagtcaactcaagcttgtgattaggcctatgtattcaagccctcctcttcatggtccctctgtcgtggcaaccatactcagggacagtgagatgttcaacgaatggactgtggaactgaaggccatggctgatagaataattagcatgaggcaacagctatttgatgcgctaaaatccagagggactcctggagattggagccacatcattaagcaaattgggatgtttactttcactgggctcaatagcgagcaagtggccttcatgaggcaagaataccacatttacatgacatcggacgggaggatcagtatggctggtttgaacatgaagaatttgccccatcttgcagatgccatacacgctgcagttactaaactgaagtgaatgacagcatctcgcggtcttcctccatggataaaatccaaatcacctacagcagtgtcctgaggactcagctagtggtatttactggcagaactcctgtaatttgcctttttaaaaacatgtttgactctgttatcggagaagttttctactgacggattcaaacaccatggtgctttcagacaccaaatataaaagacacatgcatatgttttttgcaaaaaaaaaaaaaaataaaaaaaaaaaaaaaaaaaa

SEQ ID NO: 728 - protein, 409 aa, Panicum virgatum
  misc_feature: Ceres CLONE 1727592
  misc_feature: Great-hit functional homolog of the protein sequence encoded by LOCUS At5g19550
  misc_feature (1)..(367): Pfam Name: Aminotran_1_2 Pfam Description: Aminotransferase class I and II
  misc_feature (1)..(369): Pfam Name: Aminotran_1_2 Pfam Description: Aminotransferase class I and II
  misc_feature (2)..(332): Pfam Name: Aminotran_1_2 Pfam Description: Aminotransferase class I and II
  misc_feature (1)..(369): Pfam Name: Aminotran_1_2 Pfam Description: Aminotransferase class I and II
  misc_feature (1)..(409): SWISSPROT Homolog: EC 2.6.1.1 Aspartate aminotransferase, cytoplasmic
  misc_feature (5)..(406): SWISSPROT Homolog: EC 2.6.1.1 Aspartate aminotransferase, cytoplasmic
  misc_feature: Useful for making plants with modulated nitrogen use efficiency
MASQVASVFAGIAQAPEDPILGVTVAFNKDPSPVKVNLGVGAYRTEEGKPLVLNVVRCAEQMLINDPSRYKEYLPITGLAEFNKLSAKLIFGADSPAIQENRVVTVQCLSGTGSLRVGGEFLAKHYHERTIYIPTPTWGNHPKVFTLAGLTARTYRYYDPATRGLDFNGLVEDLSSAPLGSIVLLHACAHNPTGVDPTVDQWEKIRQLMRSKSLLPFFDSAYQGFASGSLDKDAQPVRMFVADGGELLMAQSYAKNMGLYGERVGALSIVCGSADVAVRVESQLKLVIRPMYSSPPLHGPSVVATILRDSEMFNEWTVELKAMADRIISMRQQLFDALKSRGTPGDWSHIIKQIGMFTFTGLNSEQVAFMRQEYHIYMTSDGRISMAGLNMKNLPHLADAIHAAVTKLK

SEQ ID NO: 729 - DNA, 1717 bp, Panicum virgatum
  misc_feature: Ceres CLONE 1727600
  misc_feature: Encodes the peptide sequence at SEQ ID NO. 730
aattaaaaaacccaccgcctcgtcctcgattcctccgccgcatcgccgccgtctcctccgcctccctgtctgtcccctccccacccccatcctgtaaaagcaccggccattgccgcaccgagcttccctcccctcaaatgcccgagaccccaccgcggcgacgcgccccaccgtcctccgatggctaacgggctcctcctccgcgccgcctccccgggcctccgccccgccgtcgcgggagcggccggctcctccgctgactccggccggggacacggcgtggtgacgatcggcgattcgaggccgcgcgttggtgctctgcgggtgggaggatctagccggagagaattctcatttatcacaacagccgccaaagatcattctgtcttgacccggcaacttctagattcgcgacatgatacagtagatgaagtaggtacagaacatgatccgttcattgagttgaaagcgaggttcatggacttcaaacagcgaaactatgtggaaaaaatttcaaattaccaaagtttggcgcaacagcaaacaccaaagttcatggtgattgcttgtgctgactccagggtctgccctaccagtattttggggtttcagcctggggaagcatttacagttcgtaatgtggcaaatttggtaccaccatatgagcatgggggttcagagactagtgcagcactagagtttgctgtcaatacactccaggtagaaaatgtattggtggtaggtcacagccgatgtggtggcatccaggcactaatgagtatgaaagatgattcgacctctggaagctttattaagaactgggtttcaattgggaagagcgcaaggttaagcacaaaagctgcagctggaaacttgagttttgaaatgcagtgcacacattgtgaaaaggaatcaataaatagctctcttttgaacttgttaacatacccatggatagagaaaagggtgaatgaaggtactctgaaccttcatggaggctactacaactttgtagattgcacatttgaaaaatggacattagtgtaccgtgaaggactcaaaggcggaagcaagtatgctataaagaacaggtcatcctggtcttgatcaatgaaggccttatttacttgggtaaatttcactctgccctctgctgttcagcatggttttgctttgccaccacgatgttcattttcattgcaccttgctccgttgtggtactgatgttctgcggaagggagtccctgtatcaaggaattgttacatggatggctgttgacgccgcccattgtcatgcatggcactgtgccactagcttgatacgcttgaactgtatgttgtatcgcagacgaacataaatgcatcgacattgtggcagttatttgatacagagactcgcaactgtagaaggacaaaatcacaatggagtgaggtgcaacacaatgaacaatatggtagcaaagtgaaagtctgtcgagctgccggggacacagtgaattttatccaactatttgtatgttgttttctgattgaaaccattaagtaattatgaataagctgcaagagtcggtcatagcacaaatgcatgtagtcatcgccacatttggcgtcaccgtgtgttattgtaacatttgtaccatttgttgtgtatcattgtaactgtgagacacaaatattataaaacatctgtatctgttaaaaaaaaaaaaaaaaaaaa

SEQ ID NO: 730 - protein, 308 aa, Panicum virgatum
  misc_feature: Ceres CLONE 1727600
  misc_feature (1)..(171): Pfam Name: Pro_CA Pfam Description: Carbonic anhydrase
MANGLLLRAASPGLRPAVAGAAGSSADSGRGHGVVTIGDSRPRVGALRVGGSSRREFSFITTAAKDHSVLTRQLLDSRHDTVDEVGTEHDPFIELKARFMDFKQRNYVEKISNYQSLAQQQTPKFMVIACADSRVCPTSILGFQPGEAFTVRNVANLVPPYEHGGSETSAALEFAVNTLQVENVLVVGHSRCGGIQALMSMKDDSTSGSFIKNWVSIGKSARLSTKAAAGNLSFEMQCTHCEKESINSSLLNLLTYPWIEKRVNEGTLNLHGGYYNFVDCTFEKWTLVYREGLKGGSKYAIKNRSSWS

SEQ ID NO: 731 - DNA, 1531 bp, Panicum virgatum
  misc_feature: Ceres CLONE 1727619
  misc_feature: Encodes the peptide sequence at SEQ ID NO. 732
acggattcgattcgattcgcttcggcttcgattgggcttttgtgtcctgatttgatcggtgccgcgcttggagctgcttggtttgggattccgctcggggatttctggggaacgagacaatggagaccgccgggaaggtgatcaagtgcaaagccgcggtggcatgggaggccgggaagccgctgtcgatcgaggaggtggaggtggcgccgccgcaggccatggaggtgcgcgtcaagatcctctacacctcgctctgccacacagacgtctacttctgggaggccaaggggcagactcccgtgttccctcggatcttcggtcatgaggctggaggtatcatagagagtgttggagagggtgtgactgacgtggcccctggtgaccatgtccttcctgtgttcactggggagtgcaaggagtgtccccactgcaagtcggcagagagcaacatgtgtgatctgctcaggatcaacactgacaggggtgtgatgattggtgatggcaagtcgcggttttcaatcaatgggaagcctatctaccactttgttgggacttccaccttcagcgagtacactgtcatgcatgttggttgtgttgcaaagatcaaccctgaggctccccttgataaagtttgtattcttagctgcggtatttctactggtcttggtgcaacaattaatgttgcaaaaccgccaaagggctcaacagttgctattttcggtctaggagctgttggtcttgctgctgcagaaggtgcaaggattgctggagcgtcgaggatcattggtgttgatctgaaccccagcagattcgaagaagctaggaagtttggttgcactgaatttgtgaacccaaaagaccacaacaagccagtgcagcaggtacttgctgagatgaccaatggaggtgttgaccgcagcgtggaatgcactggcaacatcaacgctatgatccaagcttttgagtgtgttcatgatggttggggtgtggctgtgctggtcggtgtgccacacaaggatgctgaattcaagactcacccaatgaacttcctaaacgagaggaccctgaagggaaccttcttcggcaactacaagccacgcactgacctgcccaatgtggttgagctgtacatgaagaaggagctggaggtggagaaattcatcacgcacagcgtcccgttcgcggagatcaacaaggccttcgacctgatggctaagggggagggcatccgctgcatcatccgcatggagaactagattctgtcggcctggtgggtgggtttgtctgaatcgggatgtgttaataaaggtagcagtgcttggtgagcctgccctgtcgatgggggaggcaggatgcacggtggtcgcgagccatgcttctgtgtcacgtccagtttggccctgtcaatcagtagggtgtagcttccagcgtctgtaattatctatccgcatgagagtctttccaactgtcttcggcttaatatatggtatggtatcactatgagtttcaaaaaaaaaaaaaaaaaaaa

SEQ ID NO: 732 - protein, 379 aa, Panicum virgatum
  misc_feature: Ceres CLONE 1727619
  misc_feature (1)..(130): Pfam Name: ADH_N Pfam Description: Alcohol dehydrogenase GroES-like domain
  misc_feature (1)..(379): SWISSPROT Homolog: EC 1.1.1.1 Alcohol dehydrogenase 1
METAGKVIKCKAAVAWEAGKPLSIEEVEVAPPQAMEVRVKILYTSLCHTDVYFWEAKGQTPVFPRIFGHEAGGIIESVGEGVTDVAPGDHVLPVFTGECKECPHCKSAESNMCDLLRINTDRGVMIGDGKSRFSINGKPIYHFVGTSTFSEYTVMHVGCVAKINPEAPLDKVCILSCGISTGLGATINVAKPPKGSTVAIFGLGAVGLAAAEGARIAGASRIIGVDLNPSRFEEARKFGCTEFVNPKDHNKPVQQVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKAFDLMAKGEGIRCIIRMEN

SEQ ID NO: 733 - DNA, 1636 bp, Panicum virgatum
  misc_feature: Ceres CLONE 1727641
  misc_feature: Encodes the peptide sequence at SEQ ID NO. 734
caccgccgagacacgggtcgcgcgcgcgaggagcacgcacggcctggcgctttaactctagctcccctgccctgccgcacacactactacgggtagcgtcgtcccggccgcggcacacgtagcgagaattccctggctgcagctggctagctagctaggtaggtagctaggtgacggctgacgacgagaggatcggagggccggggatggcgatcggcagggcggcggcgctggtgctgctggtggtgctgtgcgcgctccggcaggaggcggcggcgcagcggtacaacgccatctggagcttcggcgactccatctccgacaccggcaacctctgcgtcggcgggtgtccgtcgtggctcaccacggggcagccgccctacggggagaccttcttcggccgccccaccgggcggtgctccgacggccgcgtcatcatcgacttcctggccgagcactttgggctgccgctgctgccggcgtccaaggccggcggcgacttcaagaagggcgcgaacatggccatcatcggcgccaccaccatgagcttcgacttcttcaactccatcggcctcagcgacaagatttggaacaacggcccgctcgacacccaaatccagtggttccgacagctcctcccatccgtctgcggcaaagattgcaagaactacctgtccaagtccctgttcgtcgtcggcgagttcggcggcaacgactacaacgccgcgctcttctccgggcggaccatggccgaggtccggggctacgtgcccagggtcgtcagcaagctcatccgcggcctggagacgatcatcagggccggggccgtcgacgtggtggtgcccggggtgctgcccatcggctgcttccccatctacctcactctctacggcacctccaacggcgccgactacgacggcgacggctgcctcaagagctacaacggcctctcctactaccacaacgccctgctcaagcggagcctcgccagcctgcagaggacctacccacacgccaggatcatgtacgccgacttctactcccaggtcacccacatgatcagggcccctcagaacttcgggctcaagtacggcctgaaggtgtgctgcggcgccggcggtcagggcaagtacaactacaacaacaaggcgcggtgcggcatgtccggtgccagcgcctgcgccgaccccggcaactacctcatctgggacggcatccacctcacggaggcggcctaccgctccatcgccgacggctggctcaagggcccctactgcaaccctcccatccagcactgatgatgatccataagatcgagttgcatgcattggtcatcagtgtgtgtgtgtgtgttgtctgcttagtagggataatcaccatgtgcgtcatttataatatcctagattcatatatagctaagtgaccggtgtgtttaattcggttgttgattattcatggggcttaataggctgtttaattggggtgtgctgggggagaatgaataaaggtgttgtgcatcatttgcaattagctgcagtgagaacaatgagttcagttcaaggtggggagtggaaacgaaatgtgaaagtgcaggggaagtccggctgttcatttccaaaaaaaaaaaaaaaaaaaa

SEQ ID NO: 734 - protein, 363 aa, Panicum virgatum
  misc_feature: Ceres CLONE 1727641
  misc_feature (1)..(155): Pfam Name: Lipase_GDSL Pfam Description: GDSL-like Lipase/Acylhydrolase
  misc_feature (1)..(322): Pfam Name: Lipase_GDSL Pfam Description: GDSL-like Lipase/Acylhydrolase
MAIGRAAALVLLVVLCALRQEAAAQRYNAIWSFGDSISDTGNLCVGGCPSWLTTGQPPYGETFFGRPTGRCSDGRVIIDFLAEHFGLPLLPASKAGGDFKKGANMAIIGATTMSFDFFNSIGLSDKIWNNGPLDTQIQWFRQLLPSVCGKDCKNYLSKSLFVVGEFGGNDYNAALFSGRTMAEVRGYVPRVVSKLIRGLETIIRAGAVDVVVPGVLPIGCFPIYLTLYGTSNGADYDGDGCLKSYNGLSYYHNALLKRSLASLQRTYPHARIMYADFYSQVTHMIRAPQNFGLKYGLKVCCGAGGQGKYNYNNKARCGMSGASACADPGNYLIWDGIHLTEAAYRSIADGWLKGPYCNPPIQH

SEQ ID NO: 735 - DNA, 1333 bp, Panicum virgatum
  misc_feature: Ceres CLONE 1727645
  misc_feature: Encodes the peptide sequence at SEQ ID NO. 736
accaacaaccaaaggagagcacccgcgcatgtttagcttcgccgggcgcgcctccaccgcatcaagcatcgtcgccagcctcgccacccccgcgccgccgtccaagcccagcagccccgccttcgcctccgcccgccgccccaggctcatcatgagcgcgcccgtcttcgccgcccccagcgccgtcgcgtaaaccgtcgaacgcgaagctcgaaagtcagacgagagagaagccaagttagtagcatccgtctctccgcccggcgagtcggcgactaataaaaagaggcggtttcgaagatgagcgggtgcctttgcctcccctgctatcaaaagaaggaggccgtccccgcggcggcagcgaagccgtccatacattccccagcctcgtcactcctccagaacaagaagcccacccaccctccacctcccaagagcatggacgccgtggagcgcttgaagagcgggttcgagcagttcaagacccaggtctacgacaagaagccggagctgttcgagccgctcaaggccggccaatgccccaggtacatggtgttcgcctgcgccgactcccgctgctgcccgtcggtgaccctgggcctgcagcccggcgaggccttcaccatccgcaacatcgccgccatggtcccgccctacgacaagaacaagtacgccggcatcggggccgccatcgagtacgccgtctgcgccctcaaggtggaggtcctcaccgtcattggccacagccgctgcggtggcatcagggcgctcctctccctccaggacggcgcagccgacaccttccacttcgtcgaggactgggtcaggatcggctaccaggccaagaagaaggtgcagaaagagcaccccactgttccgttcgacgatcagtgctccatcttggagaaggaggctgtgaacgtgtccctctacaacctcttgacctacccctgggtcaaggaaggtgtggccaacgggaccctcaagttggtcggtgcccgctacgacttcgtgaacggtgtgttcgacacatgggagaaatgagccataaacttctactacgtcatatacatacatacatacctatatgcacctgatcgatgtgaatccgtggagtacttactgcctatttcgaccgctactacaagccggatcgtcatcctatatgcgaatgtaataagcaatagcattttctactgctttactttcaaatgtggagcttatatgtaatatatggtgcgtaatttgaccgcttttgtggtcaaaagacatcatctgtataagcctttttcataatattatctcaatttactaaaaaaaaaaaaaaaaaaaa

SEQ ID NO: 736 - protein, 247 aa, Panicum virgatum
  misc_feature: Ceres CLONE 1727645
  misc_feature (1)..(171): Pfam Name: Pro_CA Pfam Description: Carbonic anhydrase
  misc_feature (12)..(247): SWISSPROT Homolog: EC 4.2.1.1 Carbonic anhydrase, chloroplast precursor
MSGCLCLPCYQKKEAVPAAAAKPSIHSPASSLLQNKKPTHPPPPKSMDAVERLKSGFEQFKTQVYDKKPELFEPLKAGQCPRYMVFACADSRCCPSVTLGLQPGEAFTIRNIAAMVPPYDKNKYAGIGAAIEYAVCALKVEVLTVIGHSRCGGIRALLSLQDGAADTFHFVEDWVRIGYQAKKKVQKEHPTVPFDDQCSILEKEAVNVSLYNLLTYPWVKEGVANGTLKLVGARYDFVNGVFDTWEK

SEQ ID NO: 737 - DNA, 1473 bp, Panicum virgatum
  misc_feature: Ceres CLONE 1727669
  misc_feature: Encodes the peptide sequence at SEQ ID NO. 738
aggacgcaagcagcagcagcagctagagctagtagccacgccgccggtcgatcgagaagctagtagcctctcgctcgatctgcccgtcctccgcagcgtgatcgagcgagctgcctgctgctccccggcaggccgatcgagctgatcggctagctttcgtttggtagctaggtagctaggctgatcgatcgaccggccatggccgccgcctccaccgcgtcgagggccaactcgcgggtgaactactcgaacgagatccacgacctctccaccgtgcagagcggctccgccgtccccaccatgtactacccggagaagtccctcgccgacatcttcccgccccacctcctcaagaaggtgatctcggaggtggtggcgacgttcctgctggtgttcgtgacctgcggcgcggcgtccatctacggcgaggacctcaagcgcatctcgcagctggggcagtcggtggccggcgggctcatcgtcaccgtcatgatctacgccaccggccacatctccggcgcgcacatgaaccccgccgtcacgctctccttcgcctgcttccggcatttcccctggattcaggtgccgttctactgggcggcgcagttcacgggggcgatgtgcgcggcgttcgtgctcaaggcggtgctccaccccatcacggtgatcggcaccaccacgccgacggggccgcactggcacgcgctcgtcatcgagatcgtcgtcaccttcaacatgatgttcgtcacctgcgccgtcgccaccgactccagggcggtgggtgagttggccgggttagcagtcggttccgcggtttgcattacgtcaatcttcgcagggcctgtgtccggcggatcgatgaacccggcgaggacgctggcgccggcggtggccagcaacgtctacacgggcctctggatctacttcctcggccccgtcatcggcacgctctccggcgcctgggtctacacctacatccgcttcgaggagagccccgccaaggacgggccccagaggctctcctccttcaagctccgccgcatgcagagccagtccctcgccgccgacgagttcgacaccgtctaactcggcggcgcggcgcggcccgacccgggaccggccgccggcaggcaggtgtgcaccactagctcacacgcacatcagcatcaccatgcgtgagagccgtatgtgccacacgtgtgtgtactgtgtgctcgctcgctctgttcgagacctcaagtgggagacagagctagctagagctcctgcgtgtgtgtgtaccggtacatactcggtgtacgtacctacgtacgtgtttgtatttttctccgtcgcctatacgtacgcatacgtatgtgtgtacgtgtacgtatgcgtcgttgagagcagcggggatctcggagcagtgtatgctttatgttgtcttcggctttgtattacgtcagagagttgcaaaaaaaaaaaaaaaaaaaa

SEQ ID NO: 738 - protein, 295 aa, Panicum virgatum
  misc_feature: Ceres CLONE 1727669
  misc_feature: Great-hit functional homolog of the protein sequence given in SEQ ID NO 9649
  misc_feature: Useful for making plants with modulated silicon content
MAAASTASRANSRVNYSNEIHDLSTVQSGSAVPTMYYPEKSLADIFPPHLLKKVISEVVATFLLVFVTCGAASIYGEDLKRISQLGQSVAGGLIVTVMIYATGHISGAHMNPAVTLSFACFRHFPWIQVPFYWAAQFTGAMCAAFVLKAVLHPITVIGTTTPTGPHWHALVIEIVVTFNMMFVTCAVATDSRAVGELAGLAVGSAVCITSIFAGPVSGGSMNPARTLAPAVASNVYTGLWIYFLGPVIGTLSGAWVYTYIRFEESPAKDGPQRLSSFKLRRMQSQSLAADEFDTV

SEQ ID NO: 739 - DNA, 2371 bp, Panicum virgatum
  misc_feature: Ceres CLONE 1727670
  misc_feature: Encodes the peptide sequence at SEQ ID NO. 740
cggcggcagtggaggttcgggtgcgggaagtgagggatccgagattctttcctattctttgcgatcctctttcccgtgcgacggctgaagcggaggtggcggcgggggagagcagccgccggttcccggccttggaggggccccggcccgtctatggaacttgctgccctggcgccatgccccggcccggaaccgaagtgcgcagcaaggcgctgcttgcctgcacctctcacgctgctggttcctgctgtggcagtctgctgcttggttcttgctccacgctgaggaattgtgggactgcgacgatggtgccgcggatgttgctgcttctctgcttctgcctcctggcattcccgccacctggtccgctagcggttgaagcttttgtcgggggttacgggataaactacgggagaatagcaaacaacatcccttccccggataaagtggtggagctcctgaaaaagtcaaagataaggaatgtcaagatatatgactcggatcacaacattcttgatgcgttcaaagggtccgggctcaacctggtcattgcaatccccaatgagctcgtgaaggatatggctgcaaacgagagcaggtcgatggactggctgaatcagaatgtgaagccttatctccctcagacgcgaattgttgggatcactgtgggaaacgaggttctgggaggccaagatcagagcttgtaccagccgcttgttgatgctgtgaagaatgtgtataatggacttaagaggctccacttggagaaagaaattgagcttttcacacctcactcagaagctgtttttgctaattcctatccaccctctgcatgtgtcttcaaggaagaactcatgccatacatgaaacctctcctggacttgtttgcaatgattcactcgcctttctatgtcaactcttacccctttttggcttacataagtgatccagaacatatcgatatcaattatgctctctttaaacccaataatggaattgttgatccaaataccagcctgcactatgacaacatgtttgatgctcagatagatgcagcttatgctgctctacatgccgcaggctatgatgacatggaggttcgggtggcagagactggctgggcatctagtggagatcaaaatgaagcaggggcttcatctgagaatgcaaggacatataatttcaatctccgtaaaaggctcttccttaggaagggaactcctctgaagccaaaaagaccagtgaaagcttatatatttgctctgtttaatgagaatcagaagcctggacctagctccgagaggcactatgggctgttccttccagatggaaggatttcatatgacattggtgtctctggtctacttccttcatctgcatcctcatccatgctgtccgtgaagaaaattcgagctgggggttggattttacactatttggctatggttcttttatctattttcatttttgggccatagtgaattgaggaagggatagcaaatctgtagtaaaggtacaactgagcaagttaaaatgttgggaatgggaagttcacaatgaaaattcaaatactagtaccatgcccatgagttcttattcttgcaataactattatcctcatgctgatctgctttttgatgaaaaacatactcagtttatctaaaaaagaattcatacattggaatcctcgctccatagtttctctgtacatattttatttttagcaattgaaatgccttttgaaactgataaccccgtgaaatataattctctatctcaccaacttctagcctcctagtttttttctccatttttagcaatcaagttatagctcgagcttggatacctttaggtgattttatttatatgtgggatgtgcatcaagcagcctagcctgtcaagattaacaaatcattgttctttcttcccctgtaagcattgtatcttgacatatcagttaccattagacactcgaagcagatgctgaccgaaagatcagtatccattcttgtgggtatgatgaaggattgcacgtgcacctatcctgtgatctgttcaaagaaagtcttgagaagcactagttgcagaacctcacagattatatagtagatatcagacagtcgaaggatatgatatgtaattttttatgcctcttgttaagctttgctgagtggctccatccattgactgaacctctagcctatttgttaagctttggtgagtggacccatccactgatggaggctttacagagtgatacatatccttgctaataatcatgtattactttgcattgccatctttgtaaagaatggagtaggtgcagaacaagtatatatggtcattgttttaaaaaaaaaaaaaaaaaaaa

SEQ ID NO: 740 - protein, 433 aa, Panicum virgatum
  misc_feature: Ceres CLONE 1727670
  misc_feature: Great-hit functional homolog of the protein sequence encoded by LOCUS At2g26600
  misc_feature (1)..(319): Pfam Name: Glyco_hydro_17 Pfam Description: Glycosyl hydrolases family 17
  misc_feature: Useful for making plants with altered cell wall content and/or composition
MPRPGTEVRSKALLACTSHAAGSCCGSLLLGSCSTLRNCGTATMVPRMLLLLCFCLLAFPPPGPLAVEAFVGGYGINYGRIANNIPSPDKVVELLKKSKIRNVKIYDSDHNILDAFKGSGLNLVIAIPNELVKDMAANESRSMDWLNQNVKPYLPQTRIVGITVGNEVLGGQDQSLYQPLVDAVKNVYNGLKRLHLEKEIELFTPHSEAVFANSYPPSACVFKEELMPYMKPLLDLFAMIHSPFYVNSYPFLAYISDPEHIDINYALFKPNNGIVDPNTSLHYDNMFDAQIDAAYAALHAAGYDDMEVRVAETGWASSGDQNEAGASSENARTYNFNLRKRLFLRKGTPLKPKRPVKAYIFALFNENQKPGPSSERHYGLFLPDGRISYDIGVSGLLPSSASSSMLSVKKIRAGGWILHYLAMVLLSIFIFGP

SEQ ID NO: 741 - DNA, 2277 bp, Panicum virgatum
  misc_feature: Ceres CLONE 1727673
  misc_feature: Encodes the peptide sequence at SEQ ID NO. 742
aaccgctgcctcactcgctctactccctcgccatcctcacactgctctgctcgtcgtctcccaacagcctccaccggcgccgtctccgcttctccgaccccgagatggcggcctcggcactagcgtcccgcgcgctgcagcccccgcacggccaccatccggccgcgcctccgccgcgtgcgcgctcgtcaatcgccgccactcgccgtcgccgacgcgtggcggccgcatccgcacgctgccgagcagtggctgccgacgagcgccccgccgaccccgccttccccgagggccagaacggcgggttttccggggcggtggagaggccggaggcggacgtcgtcgtgatcagcagcggtctcggcgggctgtgctgcgcggggctcctggcgaggtacggccaagatgtgctggtgcttgagagccatgaccgcccgggaggcgccgcgcactcgttcgatatcaaggggttcaacttcgactcggggccatccttgttctccgggttccagtccagaggcccccaggcaaatccacttgctcaggtccttgatgccttaggtgaatcggtaccttgtgcgtcatatgactcttggatggtttatgtacctgaaggacaattcctctctcggattggtccaactgaattctacaaggaccttgaaacatttgtcggtgttgacgctgtccaggagtggaaaaggcttcttgatgcagttattcctatgtctgcagctgcaatggctttgcctccactttcaattcgaggtgatttaggtattctatctacagctgctggcagatatgctccttctctattgaaatcattcatacaaatgggaccccaaggagctctgggcgctactaaacttctacggccgttccaaaagattgttgattcgctggggctgaaaaatccctttattcgtaattggatcgacctcctgtgctttctacttgctggagtcaaatctgatggtgctctttctgcagaaatggtttatatgtttgcagaatggtataaaccaggatgcatacttgagtatcctctgggtggaactggagcaataatagatgcccttgtgagtggtattaaaaaatttggtggcagaatagctcttcgttctcatgttgaaaagatcttaatcgagaatggccgagcggttggtgtcaagctacaaagtggacaagtcatacgtgcaaagaaagcagttgttagcaatgcgtctatgtgggatactttggatctgctaccaccagatgttgtcccaaaatcatacgaagataaagtgaaagcaactccacaatgtgattcgtttatgcatctacacttgggtttcgatgtagagaatgctagagaggaccttggtatccatcacattgtggttgatgattggaacaaaggagttgatggtgaacaaaacgttatgttgatatctgttcctagtgttcatagtaaggacctggcgcctgcagggaaacatgttcttcatgcatatacaccagggacagaacctttcagtttgtgggagggactggaccggaaaagtgcagattatcgaagattgaaggaagaacgttctgaggtgatgtggaaagcagtggagcttgctcttggcccaaaatttagccgagaaaaatgtgacgtcaagttggtcgggacaccattgacgcataagagatttctcagaaggaataggggaacctacggtccagccataaaagccggggaaggcactttccctgggcaagcaacaccaatcccccagctcttctgttgtggtgactcgactttcccaggaatcggagtgccggcagtcgcggccagcggcgcaatcgtcgcgaacactctggtctcggtgtcgcaacattcagagctgcttgacgctgttggaatttgagtggcaggcatgtcctggaaggcagatcgttagatatgggtgctgggtacagggtacatacatacacagaaaggtaacctagattttgcaacggctgttgaaaagagcatctggatgatgaacaagattgttacaacgtgaacgtagttactttgtaacttaattgtagtaatttgcaaaagaaccatggttcattatgtgcagaaaagtgtttactagtcagaactgagactgaaaaaaacagggcatgacattgtttgtacagtgccgattcagatgagcttgtattgcccccacattggctgtgtttagatccgtaaaatagtggtaaaaaaagtcatatcggatactgtagcaaaaaaaaaaaaaaaaaaaa

SEQ ID NO: 742 - protein, 598 aa, Panicum virgatum
  misc_feature: Ceres CLONE 1727673
  misc_feature (1)..(43): Pfam Name: Amino_oxidase Pfam Description: Flavin containing amine oxidoreductase
  misc_feature (1)..(51): Pfam Name: DAO Pfam Description: FAD dependent oxidoreductase
MAASALASRALQPPHGHHPAAPPPRARSSIAATRRRRRVAAASARCRAVAADERPADPAFPEGQNGGFSGAVERPEADVVVISSGLGGLCCAGLLARYGQDVLVLESHDRPGGAAHSFDIKGFNFDSGPSLFSGFQSRGPQANPLAQVLDALGESVPCASYDSWMVYVPEGQFLSRIGPTEFYKDLETFVGVDAVQEWKRLLDAVIPMSAAAMALPPLSIRGDLGILSTAAGRYAPSLLKSFIQMGPQGALGATKLLRPFQKIVDSLGLKNPFIRNWIDLLCFLLAGVKSDGALSAEMVYMFAEWYKPGCILEYPLGGTGAIIDALVSGIKKFGGRIALRSHVEKILIENGRAVGVKLQSGQVIRAKKAVVSNASMWDTLDLLPPDVVPKSYEDKVKATPQCDSFMHLHLGFDVENAREDLGIHHIVVDDWNKGVDGEQNVMLISVPSVHSKDLAPAGKHVLHAYTPGTEPFSLWEGLDRKSADYRRLKEERSEVMWKAVELALGPKFSREKCDVKLVGTPLTHKRFLRRNRGTYGPAIKAGEGTFPGQATPIPQLFCCGDSTFPGIGVPAVAASGAIVANTLVSVSQHSELLDAVGI

SEQ ID NO: 743 - DNA, 902 bp, Panicum virgatum
  misc_feature: Ceres CLONE 1727703
  misc_feature: Encodes the peptide sequence at SEQ ID NO. 744
gaaagcattaccactaggcaatcagaaaagactctcgcgcctccactcgcctcgccgccggccgccgcccgccgccgaggggagcggagcaaagatgttcttccacatcgtgctggagcggaacatgcagctgcacccgcggcacttcggtccgcacctccgggacaagctcgtctccaagctcatcaaggacgtcgagggcacctgcagcgggcggcacgggttcgtggtggcgatcacgggggtggaggacatcggcaaggggctcatccgggagggcaccggctacgtcaccttccccgtcaagtaccagtgcgtcgtcttcaggcccttcaagggtgaaatcctcgaggccgtcgttaccatggtcaataagatgggcttcttcgcagaggctgggccagtgcagatttttgtgtcgaatcatttgattcctgatgatatggaattccaatctggtgatgtgccaaactacactacttctgatggatcggtaaaaattcagaaggagagcgaggtgcggctgaagattattggtactcgtgttgatgcaacagaaattttttgcattggcacaataaaagacgactttctgggtgttatcagcgatcctggtgcagcagtataaacggtttaagaaacaagatagcactccagtgtactgcgatgtacggagactcaaatgcagtgtagtgttaaaactgcaagggttgtacggatatttcaacctgtatcgagattgagatgttagggtttctcttaactgtagtaacctatcctcaccaccgaaacttttttccagctggctttgattaactagaaatcacgagttgtttgtcacaaaccacaacttcaccatttgtatcttcaagtatcttaccgaaaaaaaaaaaaaaaaaaaa

SEQ ID NO: 744 - protein, 177 aa, Panicum virgatum
  misc_feature: Ceres CLONE 1727703
  misc_feature (1)..(70): Pfam Name: RNA_pol_Rpb7_N Pfam Description: RNA polymerase Rpb7-like, N-terminal domain
  misc_feature (1)..(83): Pfam Name: S1 Pfam Description: S1 RNA binding domain
  misc_feature (1)..(173): SWISSPROT Homolog: EC 2.7.7.6 DNA-directed RNA polymerase II 19 kDa polypeptide
MFFHIVLERNMQLHPRHFGPHLRDKLVSKLIKDVEGTCSGRHGFVVAITGVEDIGKGLIREGTGYVTFPVKYQCVVFRPFKGEILEAVVTMVNKMGFFAEAGPVQIFVSNHLIPDDMEFQSGDVPNYTTSDGSVKIQKESEVRLKIIGTRVDATEIFCIGTIKDDFLGVISDPGAAV

SEQ ID NO: 745 - DNA, 1623 bp, Panicum virgatum
  misc_feature: Ceres CLONE 1727719
  misc_feature: Encodes the peptide sequence at SEQ ID NO. 746
agggcctctcctatccatccacccagcatccactcgctagctcctcaatcctcatgggcctctccacagcttactccccggccggatcgcgcctcgtgaccaccccgctcggcgccggcgccgcgcagctcctccgcccgcgccggaccccgctcgccaccgtccgatgctccgtcgacgccgccaagcaggtgcaggacggcgcggcgacggtcgcgccggagaagccggcgtcgcgcaagggcttcggggtcttcagcaccatctacgacctcaaggcggatagtgaacattgcaagagcaagtcatggaagaagttagtgagcattgctgtgtcaggcgcggctgggatgatatcaaatcatctgcttttcaaacttgcctctggtgaggtttttggacaagaccaaccaatagcacttaagttacttggctcagaaagatcattccaagcactagaaggtgtagctatggaactggaggactcactatatccattgctgagggaagtcagcattggtatggatccttacgaggtctttgaagatgtagattgggctcttcttattggtgctaagccccgaggccctggaatggagcgagctgcattactagacatcaatggccaaatctatgctgaccaggggaaagcacttaacgccgtggcatcgccgaacgtgaaagtcatagttgttggaaatccctgtaacactaatgcattgatttgcatgaaaaatgctccaaacatacctgcaaaaaatttccatgcgctcacgaggttggatgaaaatagagcaaagtgccagctagcactaaaagcaggcgtgttttatgacaaagtatcaaacatgactatttgggggaaccactcaacaactcaggttcctgatttcttgaatgccaaaattgatgggagaccagcgaaagaagtcattaaggatacaaagtggttagaagaagaattcacattgacagttcaaaatcgtggaggtgtgctcatccaaaaatggggcagatcttcagctgcatcaaccgctgtttcaatagtggatgctattagatcccttgtaactcctaccccagaaggcgattggttctcttcaggggtttatactactggaaatccttatggcatagcagagaacatcgtgttcagtatgccatgcagatcaaagggtgatggtgactatgaactagctactgatgtgttaatggacgattttctctggcaacgtattaaaaagactgaagccgagttgattgctgagaagaaatgcgtagcccatcttacaggagaggggattgcattttgtgatcttccagaagataccatgcttccaggagagatgtaagttagtaacagcagcacgaccgggcgaatgcgcacttgtgtatgttaatgcagtttcgggcgaaaacacagacgatagttgagagaagcagctgcttacagatgctatctatatgtatgttcagttaagtgtgccataggaatttgcctatgatgcgaagtttgtacactaataaagtaacaaaatgatgccgagctactaaacgtgcatcaagcatagctagaatcatcaagttgctttcagattgcaacaaaaaaaaaaaaaaaaaaaa

SEQ ID NO: 746 - protein, 432 aa, Panicum virgatum
  misc_feature: Ceres CLONE 1727719
  misc_feature (1)..(173): Pfam Name: Ldh_1_C Pfam Description: lactate/malate dehydrogenase, alpha/beta C-terminal domain
  misc_feature (1)..(432): SWISSPROT Homolog: EC 1.1.1.82 Malate dehydrogenase [NADP] 1, chloroplast precursor
  misc_feature (1)..(432): SWISSPROT Homolog: EC 1.1.1.82 Malate dehydrogenase [NADP], chloroplast precursor
MGLSTAYSPAGSRLVTTPLGAGAAQLLRPRRTPLATVRCSVDAAKQVQDGAATVAPEKPASRKGFGVFSTIYDLKADSEHCKSKSWKKLVSIAVSGAAGMISNHLLFKLASGEVFGQDQPIALKLLGSERSFQALEGVAMELEDSLYPLLREVSIGMDPYEVFEDVDWALLIGAKPRGPGMERAALLDINGQIYADQGKALNAVASPNVKVIVVGNPCNTNALICMKNAPNIPAKNFHALTRLDENRAKCQLALKAGVFYDKVSNMTIWGNHSTTQVPDFLNAKIDGRPAKEVIKDTKWLEEEFTLTVQNRGGVLIQKWGRSSAASTAVSIVDAIRSLVTPTPEGDWFSSGVYTTGNPYGIAENIVFSMPCRSKGDGDYELATDVLMDDFLWQRIKKTEAELIAEKKCVAHLTGEGIAFCDLPEDTMLPGEM

SEQ ID NO: 747 - DNA, 1830 bp, Panicum virgatum
  misc_feature: Ceres CLONE 1727726
  misc_feature: Encodes the peptide sequence at SEQ ID NO. 748
aatcgctagctttttgccaacgaccaagaggtagctcctgctcctcacgtttgtagcgtgagccatcctacggcagcaaccaagagccaaagctgcaaagctccaagcgagaagcctccgtcccttatcgacgacctgcaactactcgagctactcaactggctagctagctcagacagaagccgggtggcggcggtcggcgcgagcgatcggcggcgagcgcatgggcaacaccctggggtgcgccggcctcggcgagcggctggcggccgccgcgagggacggcgacgcggcggaggtgcggcggctgctggaggcgaacccggggctcgcgcggtgcgccgccttcggcagcctcaactcgccgctccacctcgccgcggccaaaggacaccacgagatcgctgtgttgctgctgcagaacggagctgacgtgaacgctcggaacatttacggacagacggcgttgatgcaagcgtgccggttcggccactgggaggtggttcagacgctgctggttttcagatgcaacgtgtcgaaggtggacagcctcagcagccggacggcgctgcacctggcggcggccggcgggcacgtcaagtgcgccaggctgctgctggccccggccgccggcaacggcggcaggttcgtgaacagggcggccagcggcggcgtcacggcgctgcacctcgccgcgctgcacggccacgtcgagtgcacgcacctgctcatcgacgagcacgccgacctcgccgcgcagaccctcccctgcgtcgcgtcgccgatggggtccatcggcgccggcagcaccccgctgcactatgccgccgcgggcggcgaggtcaagtgctgccagattctcgtgtcgcgaggcgccgacagaactgccgtcaactgcaacgggtggctcccggttgatgtcgccaggacgtggggctgccactggctggagcacgtgctgtccccgaagtcgcacctgccgatccccaagttcccgccgtcgggctacctgtcgtcgccgctcgccagcgtgctcagcctcgcaagggattgtagcctggttctgaacacgtcgtcggagttttcagacggcgtcgtcgacgacggcgacgcttgcgcagtctgcctggaaagaccctgcaacgttgctgccgaagtgtgcgggcacgagctgtgcgtcaagtgcgcgctggacctgtgctcggtgatcaagtcctacgacgtgccggggatcgccggcagcatcccgtgcccgctctgccggagcgcgatcgcctcgttcagaaaacgggcagcctcggaagcagaggacgggctcgagcctgagctgagccccgcctgctccggcggcggccactgcaagagctgcagcagcgccggtgaccaccaggcgtcgtccagcccggagaagaaacgaagcacggattcggatcagcccatcctccccctctactccccctctcctcccgccgtcctgtcctgagctcccgatcgatcaaggatctgcagctcgatgcgtgttagcagatgcagaggagctgcatcaccgttagaaaatgtgcagtattatgcaagtacagattggtagatgctcagagacagacagattgtttgattctcttgcgttcgttgtgctaatcgatggcatgcagatcattttatggtggtgtacatggtatgggtgtaacgtgtacgtctgattggtttgttgtagaaaggaactaaaaaaagaacattctttactgtaaaggttctggattttggctcatgatcctttgcttctgttcaagaatttgtggaattggaattcaaaaaaaaaaaaaaaaaaaa

SEQ ID NO: 748 - protein, 419 aa, Panicum virgatum
  misc_feature: Ceres CLONE 1727726
  misc_feature (1)..(50): Pfam Name: zf-C3HC4 Pfam Description: Zinc finger, C3HC4 type (RING finger)
MGNTLGCAGLGERLAAAARDGDAAEVRRLLEANPGLARCAAFGSLNSPLHLAAAKGHHEIAVLLLQNGADVNARNIYGQTALMQACRFGHWEVVQTLLVFRCNVSKVDSLSSRTALHLAAAGGHVKCARLLLAPAAGNGGRFVNRAASGGVTALHLAALHGHVECTHLLIDEHADLAAQTLPCVASPMGSIGAGSTPLHYAAAGGEVKCCQILVSRGADRTAVNCNGWLPVDVARTWGCHWLEHVLSPKSHLPIPKFPPSGYLSSPLASVLSLARDCSLVLNTSSEFSDGVVDDGDACAVCLERPCNVAAEVCGHELCVKCALDLCSVIKSYDVPGIAGSIPCPLCRSAIASFRKRAASEAEDGLEPELSPACSGGGHCKSCSSAGDHQASSSPEKKRSTDSDQPILPLYSPSPPAVLS

SEQ ID NO: 749 - DNA, 2044 bp, Panicum virgatum
  misc_feature: Ceres CLONE 1727738
  misc_feature: Encodes the peptide sequence at SEQ ID NO. 750
gttctctctccctcgtcactctcgccactgctcccagctgttgcgacctccgatcatccaaggctcctgcacccctgtcagtcctagctccagccaaaaatcgttggcttccgctgcctgctcctccgccttgcacctcccatgaccttccacgcgacatgattgcattgcaggcccctgcggagctcagtgtcctcccacgccgctgacgccttcttgttgcctccccgctgctgcgcacaaccgaaagggccttcctctcttcctttgcttccgcggaaagatttggcgatttgttcatctactaaagttgcatctctcttggtgattgtttcgaggagtgtggagtggagccatggggaagaagggcaagtggttcggcgcggtcaagaaagtgttcagccctgaatccaaggagaagaaggaggagaggcagaggaggaaatcagcagctagcaaccctactccacgagatctgaccccgtcgacctccttggaagtcaatgtttcggtgccaccccctccagctcctccggcccttcaccagattgaggaaatcagggcccctgaagctgagcaggagcagagcaagcacgtcaccgtagaggaggctcctgctgcccctgcacaggcgtcggtgctgccacctggtgtgccaagtgaagagcttgctgcaatcaagattcagactgccttccgaggttacctggcaaggagggcactgcgagcgctgcggggccttgttcgattgaaatcattggttgagggtgattcagttaggcgtcaatctgcaagcactcttcgctgtatgcagactctatcgcgggtgcagtcacaaatacgttctaggagagcaaagatgtctgaggagaaccaggcccttcagcgccagctcctactgaagcaggaactggagaatttcaggatgggtgagaactgggatgacagcactcaatccaaagagcaaatcgaggcaagcctaataagcaggcaagaggcagcgattagaagagaaagagcgcttgcatatgcattttcacatcagtggaagagcacttcgagatctgtcaacccaatgtttgtagacccaaacaacttgcagtggggctggagctggttggagcgctggatggctgcaaaaccttgggagggctgcaatggggctgataaggagagcaacattgaccgtggatctgttaagagcatgagcttgaaccttggagagggtgagatcacaaaagctttcaaccgccgggactcaaagccagaaaagccatcaccgccaactccaaaactaacccgtccagcctccaggcaatccccttcgacgccctctgctaaagtagcgccaatacctgctaggagaaaatccgccacgccagagaatgggctttcacatgtggatgacgatgcgagaagtgtgttcagcgtgcagtctgagcgaccaaggaggcacagtatagccacctcgactgtgcaggacaatgagagtctcgcaagctccccatcactcccaagttacatggttcccacagaatctgcaagggcgaagtctcgtctccagggatcagcattgactaatggtgcagagacaccagagaaaggaagctctgctggaccggtcaagaaaaggttgtcatttcaaggtggaacagcggctgcctcaccaatgcgacggcattctggtcctcccaaggtggacagtgcggtgaaggatattgttgccccaccacagccagaggccttggtgatcaatggtggaagcaagtgactcataccaggaggggaaagcggattatgaatatatattttatcgatgaagaaaggttaacgtgatatcagctcaatgagtgatttgaattgttttcttacgaccacattgtttgctctataagattcgcagtacctgccagttgattccattcgttgtttctgtaaaacaagtatcggttcgtcactagaatcaatgaagtttgtatgtaaacaggtcttctatttatgtgagccatatatttcttcttctgaaaaaaaaaaaaaaaaaaaa

SEQ ID NO: 750 - protein, 471 aa, Panicum virgatum
  misc_feature: Ceres CLONE 1727738
  misc_feature: Great-hit functional homolog of the protein sequence given in SEQ ID NO 9196
  misc_feature: Useful for making plants with modulated oxidative stress sensitivity
MGKKGKWFGAVKKVFSPESKEKKEERQRRKSAASNPTPRDLTPSTSLEVNVSVPPPPAPPALHQIEEIRAPEAEQEQSKHVTVEEAPAAPAQASVLPPGVPSEELAAIKIQTAFRGYLARRALRALRGLVRLKSLVEGDSVRRQSASTLRCMQTLSRVQSQIRSRRAKMSEENQALQRQLLLKQELENFRMGENWDDSTQSKEQIEASLISRQEAAIRRERALAYAFSHQWKSTSRSVNPMFVDPNNLQWGWSWLERWMAAKPWEGCNGADKESNIDRGSVKSMSLNLGEGEITKAFNRRDSKPEKPSPPTPKLTRPASRQSPSTPSAKVAPIPARRKSATPENGLSHVDDDARSVFSVQSERPRRHSIATSTVQDNESLASSPSLPSYMVPTESARAKSRLQGSALTNGAETPEKGSSAGPVKKRLSFQGGTAAASPMRRHSGPPKVDSAVKDIVAPPQPEALVINGGSK

SEQ ID NO: 751 - DNA, 1697 bp, Panicum virgatum
  misc_feature: Ceres CLONE 1727743
  misc_feature: Encodes the peptide sequence at SEQ ID NO. 752
gaatcgaagcagcccctctcgaaatccagcatcgccttctccgccgccgccgctcgatctaccccagaggttctcccccgaaacccgttcggcgatggcgacgatccagtccgtgaagacgcgccagatcttcgacagccgtggcaaccccaccgttgaggttgatgtgtgctgctcggacggaaccttcgcgcgtgctgctgttcccagtggtgcatcaactggtgtttatgaagctctggagttgcgggatggtggatctgactacctgggcaagggagtttccaaggctgttaacaatgtgaactctatcattggacctgctcttgttggcaaggaccctacgacacagactgagattgacaactttatggttcagcagcttgatggcactaagaatgagtggggatggtgcaagcaaaagcttagtgctaatgccatcttggctgtgtcactagctgtttgcaaagctggagctaacatcaagaaaattcctctttaccagcacattgccaatcttgctggcaacaagcaattagttttgcctgttcctgcatttaatgtcatcaatggtggttcccatgctggaaacaagcttgctatgcaggagttcatgatcttgcctactggagctgcctcattcaaggaggctatgaagatgggtgttgaagtttaccacaacctgaagtctgttatcaagaagaagtatgggcaggatgccaccaatgttggtgatgagggtggttttgctccgaacattcaggaaaacaaggaaggactagagctcctaaagactgcaattgagaaggcaggatacaccggaaaggttgtcattgggatggatgttgctgcctctgaattctacaatgacaaggacaagacatatgatctcaacttcaaggaggagaacaatgatggttcacagaagatatctggagacagcttgaagaacgtatacaagtcatttgtgagtgagtaccccattgtctcgattgaagacccatttgaccaggatgactgggttcactatgccaagatgactgaagaaattggaaagcaagtacagattgtcggtgatgaccttcttgtcaccaacccaactagggttacgaaggctatcaaggagaagtcatgcaatgctcttctgcttaaggttaaccaaattggatctgttactgagagtattgaggccgtgaagatgtcaaagcatgctggctggggggtgatgaccagtcacaggagcggtgagactgaggatacatttattgctgatttggcggttggtttggccacgggtcagatcaagactggagctccctgccggtctgagcgtcttgccaagtacaatcagctccttaggatcgaggaagagcttggtgctgccgctgtctatgctggtgccaagttccgcacacctgtcgagccctactaagctagagcgatgctggaggctgaacctcttgtttgagttttgtgaaaaaggttactgcaccctccgctatatatataacctctggtctggattgaacttgctaaagttgtgatcgagcaataagttcccacttatttttgggagatggacgtgtgacaagaaactcaaaggtttgttttggatcataatttaggcggctgtttgttttggattgaatgaagcggtatgcctaaccttttactcttaaaaaaaaaaaaaaaaaaaa

SEQ ID NO: 752 - protein, 445 aa, Panicum virgatum
  misc_feature: Ceres CLONE 1727743
  misc_feature (1)..(295): Pfam Name: Enolase_C Pfam Description: Enolase, C-terminal TIM barrel domain
  misc_feature (1)..(296): Pfam Name: Enolase_C Pfam Description: Enolase, C-terminal TIM barrel domain
  misc_feature (1)..(289): Pfam Name: Enolase_C Pfam Description: Enolase, C-terminal TIM barrel domain
  misc_feature (2)..(296): Pfam Name: Enolase_C Pfam Description: Enolase, C-terminal TIM barrel domain
  misc_feature (2)..(295): Pfam Name: Enolase_C Pfam Description: Enolase, C-terminal TIM barrel domain
  misc_feature (1)..(295): Pfam Name: Enolase_C Pfam Description: Enolase, C-terminal TIM barrel domain
  misc_feature (2)..(445): SWISSPROT Homolog: EC 4.2.1.11 Enolase
  misc_feature (2)..(445): SWISSPROT Homolog: EC 4.2.1.11 Enolase 2
MATIQSVKTRQIFDSRGNPTVEVDVCCSDGTFARAAVPSGASTGVYEALELRDGGSDYLGKGVSKAVNNVNSIIGPALVGKDPTTQTEIDNFMVQQLDGTKNEWGWCKQKLSANAILAVSLAVCKAGANIKKIPLYQHIANLAGNKQLVLPVPAFNVINGGSHAGNKLAMQEFMILPTGAASFKEAMKMGVEVYHNLKSVIKKKYGQDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWVHYAKMTEEIGKQVQIVGDDLLVTNPTRVTKAIKEKSCNALLLKVNQIGSVTESIEAVKMSKHAGWGVMTSHRSGETEDTFIADLAVGLATGQIKTGAPCRSERLAKYNQLLRIEEELGAAAVYAGAKFRTPVEPY

SEQ ID NO: 753 - DNA, 2222 bp, Panicum virgatum
  misc_feature: Ceres CLONE 1727752
  misc_feature: Encodes the peptide sequence at SEQ ID NO. 754
atccgaccgcgtcgcatctgttctcctcaagccgctccgccgcctcaccaggaaaccctagagtccggcgcacgacatggcggacggcgcgggctcggcttcgggcctggaggagaagctcgcggggctctctacgggcggctgcagcgacgacaagcaggaccctccgccggcgggtgagggcggagaggagcctcagctctcgaagaacgcgaagaagagagaggagaagaggaagaagatggaggaggagcggaggctcaaggaggaagagaagaagaacaaggtggctgctgctgctgctgccagtggaaagactcagaaggcatctgctgccgacgatgatgacatggatcccactcaatactatgagaataggctcaagacacttgattcgctcaaggccataggtgtaaacccctatccgcataagttcccagttggcatctccgtagccgaatacattgagaagtacaagagcttgagcgatggggagaagctagatgtgacagagtgtttagctgggaggatcatgaacaagagaacatcctcatctaagctattcttttatgatctttatggcggtggcctgaaggttcaagtgatggctgatgccaggacctcagagttggatgaagctgaattcactaaataccactcgggtgtgaagcgaggtgatattgttggcatatgtggctatccaggaaaaagcaagcgaggtgagcttagtgtattcccaaagaaatttgttgtgctctctccttgtcttcatatgatgcctcgacagaagggtgaaggaagtgcagtacctgcaccgtggactccaggaatgggcaggaacattgaaaactatgttttgagggatcaggaaactaggtatcgtcaacggtatcttgatctaatggtaaatcatgaagtgaggcatatcttcaagacacgatctaaagttgtctcttttatccggaagtttcttgatgaccgtgaatttttggaggtggagactccaatgatgaacatgattgctggtggagcagctgcaaggccttttgtcacacaccacaatgaattaaacatgaggctttttatgcgcattgctcccgagttatatctgaaggaattggttgttggtggattggaccgtgtttatgaaattggaaaacaattcaggaatgaagggattgatttaacacacaatcctgaatttacaacttgtgaattttatatggcttatgcagactacaatgatttgatggagcttactgagaccatgttgtcaggcatggttaaggagcttacaggtggttacaagataaaatatcatgcaaatggtgttacaaatcccccaatagaaattgatttcacgcctcccttcagaaggatagatatgattaaagatttggaggaaatggccaatctcaatataccaaaagatctgtcaagtgatgaagcgaatcgttacttgatagaagcatgtgtgaagtatgatgtgaaatgtccacctccccaaacaacatcacggttgcttgacaagttagttggccacttcttggaggagacatgcgtgaatccaacatttatcatcaatcatccagatataatgagtccgttagcaaaatggcataggtcccggcctggactgactgagaggttcgagctgtttgttaacaaacatgaggtgtgcaatgcatacacagagttgaacgatcctgttgtccagaggcaacggtttgaggaacaactaaaggatcgtcaatctggtgatgatgaagctatggccttggatgaaacgttctgtactgcccttgagtatggtttgccaccaacaggtggttggggtttgggaatcgatcgccttacgatgttgctaacagattcccagaatattaaggaagttcttctattcccggctatgaagcctcaagagtagttgtccagagccgaaatgcacaaaaggttaaattcagccggatgctttgcgccatgacagaaggatacaaggaagtttgtggatccgtagggatcttatacatctttttgccagttgtgtgtgagggttttttcaattttcattattttgatataccattgtgcattaccttggctgctggtttattgaccaaaattgtaacgtcagtgacgagaattctccaacttaaaatgtagcgccttaaggaggatttgcaaaatactctgggtcaatgcaaaaaaaaaaaaaaaaaaaa

SEQ ID NO: 754 - protein, 616 aa, Panicum virgatum
  misc_feature: Ceres CLONE 1727752
  misc_feature (1)..(616): SWISSPROT Homolog: EC 6.1.1.6 Lysyl-tRNA synthetase
  misc_feature (6)..(616): SWISSPROT Homolog: EC 6.1.1.6 Lysyl-tRNA synthetase
MADGAGSASGLEEKLAGLSTGGCSDDKQDPPPAGEGGEEPQLSKNAKKREEKRKKMEEERRLKEEEKKNKVAAAAAASGKTQKASAADDDDMDPTQYYENRLKTLDSLKAIGVNPYPHKFPVGISVAEYIEKYKSLSDGEKLDVTECLAGRIMNKRTSSSKLFFYDLYGGGLKVQVMADARTSELDEAEFTKYHSGVKRGDIVGICGYPGKSKRGELSVFPKKFVVLSPCLHMMPRQKGEGSAVPAPWTPGMGRNIENYVLRDQETRYRQRYLDLMVNHEVRHIFKTRSKVVSFIRKFLDDREFLEVETPMMNMIAGGAAARPFVTHHNELNMRLFMRIAPELYLKELVVGGLDRVYEIGKQFRNEGIDLTHNPEFTTCEFYMAYADYNDLMELTETMLSGMVKELTGGYKIKYHANGVTNPPIEIDFTPPFRRIDMIKDLEEMANLNIPKDLSSDEANRYLIEACVKYDVKCPPPQTTSRLLDKLVGHFLEETCVNPTFIINHPDIMSPLAKWHRSRPGLTERFELFVNKHEVCNAYTELNDPVVQRQRFEEQLKDRQSGDDEAMALDETFCTALEYGLPPTGGWGLGIDRLTMLLTDSQNIKEVLLFPAMKPQE

SEQ ID NO: 755 - DNA, 1435 bp, Panicum virgatum
  misc_feature: Ceres CLONE 1727770
  misc_feature: Encodes the peptide sequence at SEQ ID NO. 756
atctcttgctcggttgctcccactggtgactggtctcgccacagcgtgctgcaagaggaagaagggttgggcctggcgagatctcagcgaagatgggggagatcaccaatgtcatggagtaccaggccatcgccaagcagaagctccccaagatggcatacgactactacgcgtcgggcgccgaggacgagtggacgctccaggagaatagggaggccttctccaggatcctattccgcccacgcatactgatcgatgtgtccaagattgacatgaccacaactgtgctgggattcaagatctcgatgcccatcatgatcgctcccactgccatgcagaagatggctcacccagatggtgagtacgcgactgcacgcgccgcatctgcagcaaacactataatgacactgtcatcctgggctacttcaagcgtcgaggaggttgcttcaactggaccagggatccgcttcttccagctatatgtctacaaggacaggaaggtggtggagcagctggtgaggagagctgaaagggctgggttcaaggccatcgcgctcactgtcgacactccgcgccttggccgcagggaagctgacatcaagaacagatttgttctgccacccaatctgacgctcaagaacttcgagggcctggacctcggcaagatggaccaggctgctgattcagggctggcttcgtatgtcgccagccaaatcgaccgcaccctgagctggaaggacgtcaagtggctgcagaccatcaccacgctgccgatcctcgtcaagggagtgatcactgcagaagacacgaggctggcggtggagaacggcgcggcggggatcatcgtgtccaaccacggcgcgcgccagctggactacgtcccggcgaccatcagcgcgctggaggaggtcgtcaaggcggcccgcgggcagctccccgtgttcctcgacggcggcgtccgccgcggcaccgacgtcttcaaggcgctcgccctgggcgccgccggcgtcttcgtcggcaggccggtggtgttcgcgctggcggcggcgggcgaggccggggtgtccaacgtgatgaagatgctccgggacgagttcgagctcaccatggcgctcagcggctgcacctgcctcgccgacatcacccgcaaccacatcatcaccgagtccgacaggctccgcgtcatgccgtcgcgcttgtaaatagccgccgccctcgcgaggatcgccgtcgttcgtcctcgccgccggcgccgcgccggccgcaaccgggatcatgcatgcatggtcgctcgctcgatgatacactataatttcggaccgcatatatgtttgtgttccaagtgatcgatcgctagctgtaccgtaaaatcttacagattacatggatgatcactgtatttgatcacaaaatatatgttctgtgccatatcatc

SEQ ID NO: 756 - protein, 369 aa, Panicum virgatum
  misc_feature: Ceres CLONE 1727770
  misc_feature (24)..(333): Pfam Name: FMN_dh Pfam Description: FMN-dependent dehydrogenase
  misc_feature (1)..(344): Pfam Name: FMN_dh Pfam Description: FMN-dependent dehydrogenase
  misc_feature (1)..(342): Pfam Name: FMN_dh Pfam Description: FMN-dependent dehydrogenase
  misc_feature (3)..(360): SWISSPROT Homolog: EC 1.1.3.15 Peroxisomal (S)-2-hydroxy-acid oxidase
  misc_feature (7)..(344): SWISSPROT Homolog: EC 1.1.3.15 Hydroxyacid oxidase 1
MGEITNVMEYQAIAKQKLPKMAYDYYASGAEDEWTLQENREAFSRILFRPRILIDVSKIDMTTTVLGFKISMPIMIAPTAMQKMAHPDGEYATARAASAANTIMTLSSWATSSVEEVASTGPGIRFFQLYVYKDRKVVEQLVRRAERAGFKAIALTVDTPRLGRREADIKNRFVLPPNLTLKNFEGLDLGKMDQAADSGLASYVASQIDRTLSWKDVKWLQTITTLPILVKGVITAEDTRLAVENGAAGIIVSNHGARQLDYVPATISALEEVVKAARGQLPVFLDGGVRRGTDVFKALALGAAGVFVGRPVVFALAAAGEAGVSNVMKMLRDEFELTMALSGCTCLADITRNHIITESDRLRVMPSRL

SEQ ID NO: 757 - DNA, 1414 bp, Panicum virgatum
  misc_feature: Ceres CLONE 1727780
  misc_feature: Encodes the peptide sequence at SEQ ID NO. 758
aagacgcagtggcagtaggctaggaggagcagcgtgagctgcttgcccaagaattgctcccactcccggctgtccggactccggacagcgcagctctgctcggaaatttcagttcttggaggtcgatggccacgagggcgttgagggaggtggggaggagaaggggctgggcggcggaggtcgggcggaggtgcttctccggcgggagcgcgggggcgccggtggcggagccgaaggaggggggagcgggaggagggaaggcggtgaacctgttcacggccgtcaaccaggcgctccacatcgccctcgaaaccgacccgcgtgcttatgtcttcggagaggatgtgggtttcggcggcgtgtttcgctgcacaacagggctcgccgatcggtttggcaggaacagagtgttcaatacgccgctatgtgaacagggtattgctggatttgcgattggcctagcagcaatgggtaatcgggctattgcagaaatccagtttgcggactatatctttccagcctttgatcagattgtcaatgaagcagccaaattcaggtatcgaagtggaaatgaatttaactgtagaggcttaacaattcgaactccttatggtgctgttgggcatggtggtcactaccattcacagtcaccagaggctttcttctgccatgttcctggactcaaggttgtcataccacgaagtccacgcgaggctaagggattactgttggctagcattagagattcaaatccagttgtattttttgagccaaagtggctgtatcgtttggctgttgaagaagtacctgaggaggattatatgctacccttatctcaggcagaagtgattaggaaaggcatcgatataacacttattggctggggagctcaacttgcagtgcttaaagaagcttgtgaagatgcagcaaaggatggggtatcttgtgagctcattgatctgaaaactctgataccgtgggacaaggaaacggtagaggcctcagtaaagaagactggaaagctcctcgtcagccatgaggctccaatcactgggggattcggtgcggaaattgctgcatctattgctgagcgctgcttccaaaggctcgaagcgcctgtggcgagagtctgcggcctcgacactccttttcctctcgtctacgaaccgtttttcatgcccacaaagaacaaggtcctggacgccataaaagcaactgtaaattactgaagtgcacgaccaagctacttcccttcattttccatgatagcaatataaagcttccttcttcatatgtacatatgcactcttattacattgctggtcaccatatgcatgatctcaaacagcttattcagcaacattagcaataaagttgcaggatgcaaatgtaacaaaaaaaaaaaaaaaaaaaa

SEQ ID NO: 758 - protein, 367 aa, Panicum virgatum
  misc_feature: Ceres CLONE 1727780
  misc_feature (1)..(179): Pfam Name: Transket_pyr Pfam Description: Transketolase, pyrimidine binding domain
  misc_feature (32)..(367): SWISSPROT Homolog: EC 1.2.4.4 2-oxoisovalerate dehydrogenase subunit beta, mitochondrial precursor
MATRALREVGRRRGWAAEVGRRCFSGGSAGAPVAEPKEGGAGGGKAVNLFTAVNQALHIALETDPRAYVFGEDVGFGGVFRCTTGLADRFGRNRVFNTPLCEQGIAGFAIGLAAMGNRAIAEIQFADYIFPAFDQIVNEAAKFRYRSGNEFNCRGLTIRTPYGAVGHGGHYHSQSPEAFFCHVPGLKVVIPRSPREAKGLLLASIRDSNPVVFFEPKWLYRLAVEEVPEEDYMLPLSQAEVIRKGIDITLIGWGAQLAVLKEACEDAAKDGVSCELIDLKTLIPWDKETVEASVKKTGKLLVSHEAPITGGFGAEIAASIAERCFQRLEAPVARVCGLDTPFPLVYEPFFMPTKNKVLDAIKATVNY

SEQ ID NO: 759 - DNA, 1616 bp, Panicum virgatum
  misc_feature: Ceres CLONE 1727787
  misc_feature: Encodes the peptide sequence at SEQ ID NO. 760
agagcattggaatcaatagcaattgcgtgctccgcacccgcacgccaaccgccaccgccgccggctcgccgccgattcgagggttcgttccgggagaaggcagatcggttccgcgatggagtgcatcgccgagatgccgcccgcgccgctggaccgccgcccgcgcaagcggcagcgtctagggtgggacgtcggtcccgccgagatgcatcaggttcagcttggactttgtgggcaagaagttgtaaatgccataagtgctgtggcattgggtctctcttcaggtggtattgtctcctctcagctcaaccaagagcagcctcgtgagggttcccctccactgagagatgatgacaaggatgggcattatgtgtttgctgttggagataaccttacacctcgctataagatcaatgcaaaaatgggtgaaggtacctttggtcaggtgttggagtgttgggacaaggaaaggaaagaaatggtggctattaagatcatcagaggcattaagaagtacagggatgctgcaatgatagaaattggcatgctcgagcagcttggtaaatacgatgaaagtagatccagttgtgttcaaattcggaactggtttgactatcgtaaccatatctgtattgtctttgagaggcttggaccaagcttatatgattttctccggaaaaacaattaccgctcattcccaattgccctagttcgggaggttgccaaacaactgttggaatgtatagcatttatgcatgaattgcgcctcatacacactgatttgaagcctgagaacattcttcttgtttctccggagtacattaaagtgcctgattacaaagtttcatcccgatcaccaaaagatggatcctattacaagcggttgccaaagtctagtgctatcaaggtgattgattttggtagcactacctatgatcaacaggatcaaagttatgtggtatccaccaggcattatcgggctccagaagttatattgggacttggatggagttacccatgtgatatctggagtgttggttgtattcttgttgagctttgcacgggagaggcattgttccagactcatgaaaacttggaacatctggctatgatggagagggtttttggacctttgccataccatatgcttaagagggcagatcgccactctgagaaatacatcagaaaaggacgtctgaattggcctgagggttgtacttcgcgggagagcatgaaagctgtgatgaaactgcccagactccagaatctggtgatgcaaaatgtggatcagtcagctggggatttcatcgaccttttgcaagggctgctcaagtatgatccagcaaaccgcatgaccgcacaggaggcgctgaggcaccccttcgtcacagaaggatttgagcgaagaagatgatattccctgcaacttcatccttgtttgactaacttgctgttcgcaaatttgctgacagtttgccttttctgtttgtaacatagagcttctgtatatgtagataaatctgtatgtagttgaaatgtgaagttagttcaatcttgtttgaagctagtgtctcaactgatgtatcacaaaggaaatcaaatggatacatttgacg

SEQ ID NO: 760 - protein, 432 aa, Panicum virgatum
  misc_feature: Ceres CLONE 1727787
  misc_feature (1)..(432): SWISSPROT Homolog: EC 2.7.12.1 Serine/threonine-protein kinase AFC2
  misc_feature (6)..(430): SWISSPROT Homolog: EC 2.7.12.1 Serine/threonine-protein kinase AFC1
MECIAEMPPAPLDRRPRKRQRLGWDVGPAEMHQVQLGLCGQEVVNAISAVALGLSSGGIVSSQLNQEQPREGSPPLRDDDKDGHYVFAVGDNLTPRYKINAKMGEGTFGQVLECWDKERKEMVAIKIIRGIKKYRDAAMIEIGMLEQLGKYDESRSSCVQIRNWFDYRNHICIVFERLGPSLYDFLRKNNYRSFPIALVREVAKQLLECIAFMHELRLIHTDLKPENILLVSPEYIKVPDYKVSSRSPKDGSYYKRLPKSSAIKVIDFGSTTYDQQDQSYVVSTRHYRAPEVILGLGWSYPCDIWSVGCILVELCTGEALFQTHENLEHLAMMERVFGPLPYHMLKRADRHSEKYIRKGRLNWPEGCTSRESMKAVMKLPRLQNLVMQNVDQSAGDFIDLLQGLLKYDPANRMTAQEALRHPFVTEGFERRR

SEQ ID NO: 761 - DNA, 1762 bp, Panicum virgatum
  misc_feature: Ceres CLONE 1727793
  misc_feature: Encodes the peptide sequence at SEQ ID NO. 762
aaaggtcagaagccaaacgagtcaccgaaataattgtaaaaaaaaaaaaaagcatcgaagcgaggaacccgcgagatggcgatggcgagcctggctaggaggcgggcggcggatgcgctgctgcggcggccgcaggcggcggcctgggcgtcagcgctcagggcgtacgcggcatcaggggaggagagcgacgtggtggtgatcggcggcgggcccggcgggtatgtggcggcgatcaaggcggcgcagctagggctcaagaccacctgcatcgagaagaggggcaccctgggaggcacctgcctcaacgtcggctgcatcccctccaaggctcttcttcattcgtcacacatgtaccatgaggcgaagagttcttttgcacaccatggtgtgaagttttctaatctggagatagatctgcctgccatgatggcacagaaagacaaggctgtcactggtcttacaaaaggtattgaaggcctgttcaagaagaacaaagttgattatgtgaaaggatttgggaagtttgtctccccttctgaggtatctgtggacttgattgatggtgggagtactactgtcaaaggaaagaacataatcatcgctactggctcagatgtgaaatctctccctggagttactatagatgagaaaaagattgtatcatctaccggtgctcttgcgcttcaagaaataccaaagaagttggtcgttattggagctggatacataggtttagagatgggttctgtctggaacagactagggtctgaggttacagttgtggaatttgcttctgacattgtcccatcgatggatggagagattcggaagcagttccagcgtatgctggagaagcaaaaaatgaagttcatgctcaagacaaaggtagttggggttgatacttccgggagcggcgtcaagttaactgtggagcctgcagctggtggagagcagagtgtgcttgatgctgacattgtcctggtatctgctggcagaactccatacactgctggtcttgggctggacagcatcggtgtcgagatggacaagggtggaagaatccttgtcgacaatcgctttatgacaaatgttaacggcgtctatgcgatcggtgatgcgattcctggacccatgcttgcacacaaagcggaagaagatggggttgcatgcgtcgagttcattgctggaaaggagggccatgtagattatgatactgtaccaggcgttgtgtacacacaccctgaggtggcctccgttggcaaaactgaggaacaggtgaaggcatcaggaattgcttaccaggttgggaagttccctctcatggccaacagccgcgcaaaggcaattgatgatgctgaagggttggtgaaggtggtggctgagaaggaaaccgacagagtcctcggcgtgcacatcatggcccccaatgctggagagatcatccatgaggccgtacttgcacttcaatatggagcgtcaagcgaggacatcgcccgtacatgtcacgctcatcctacggtgagcgaggccctgaaggaagcttaccttcagacgtacacgaaggcaatccacatctgattccagatacgatttcaactgcgggctcaaaatacttgctaagattttggaataattttgtatgaatgtggtcctggaacatctacctttgccctttttgccatcgggaaactgtgaattgtctcccttgctgcagaatatagtatatgctgttaaattcgaaaaaaaaaaaaaaaaaaaa

SEQ ID NO: 762 - protein, 501 aa, Panicum virgatum
  misc_feature: Ceres CLONE 1727793
  misc_feature (1)..(315): Pfam Name: Pyr_redox_2 Pfam Description: Pyridine nucleotide-disulphide oxidoreductase
  misc_feature (1)..(501): SWISSPROT Homolog: EC 1.8.1.4 Dihydrolipoyl dehydrogenase 1, mitochondrial precursor
  misc_feature (1)..(501): SWISSPROT Homolog: EC 1.8.1.4 Dihydrolipoyl dehydrogenase, mitochondrial precursor
MAMASLARRRAADALLRRPQAAAWASALRAYAASGEESDVVVIGGGPGGYVAAIKAAQLGLKTTCIEKRGTLGGTCLNVGCIPSKALLHSSHMYHEAKSSFAHHGVKFSNLEIDLPAMMAQKDKAVTGLTKGIEGLFKKNKVDYVKGFGKFVSPSEVSVDLIDGGSTTVKGKNIIIATGSDVKSLPGVTIDEKKIVSSTGALALQEIPKKLVVIGAGYIGLEMGSVWNRLGSEVTVVEFASDIVPSMDGEIRKQFQRMLEKQKMKFMLKTKVVGVDTSGSGVKLTVEPAAGGEQSVLDADIVLVSAGRTPYTAGLGLDSIGVEMDKGGRILVDNRFMTNVNGVYAIGDAIPGPMLAHKAEEDGVACVEFIAGKEGHVDYDTVPGVVYTHPEVASVGKTEEQVKASGIAYQVGKFPLMANSRAKAIDDAEGLVKVVAEKETDRVLGVHIMAPNAGEIIHEAVLALQYGASSEDIARTCHAHPTVSEALKEAYLQTYTKAIHI

SEQ ID NO: 763 - DNA, 2268 bp, Panicum virgatum
  misc_feature: Ceres CLONE 1727795
  misc_feature: Encodes the peptide sequence at SEQ ID NO. 764
aggaagcgcgatacacacaccaacagaagccacggcggacatttaaaaaaaagtgaaggagagaggaaaaaaattagcgacgaggaatggttcatctccatccttcggtgcgctccctgccctcccccgctataatatcgccacgccctcgtcgccatcgccaccacaccaccactccctccctgccctctcactcccgatctctccaccaccaccgcccgctccgcgccaccacacccctcgcctcgcgcggcgaccggcggcgggacgtcggcggaccgaccatggggctcttcaccgtgacgaagaaggcaaccacgcccttcgagggccagaagcccggcacctccggcctccggaagaaggttactgtattccagcagcctcattatctacagaactttgtccaatcaacattcaatgcccttcctgctgaagaagtaaaaggtgcaaccattgttgtctctggtgatggtcgctatttctcaaaagatgctgttcagatcataacaaaaatggctgctgccaatggagcaagacgtgtttgggttggactaaacagtctcatgtctactcctgctgtgtctgctgtcatccgtgaaagagttggtgcagatggatcaaaggctacgggtgccttcatcttaacagcgagccacaacccaggtggtccgactgaggacttcgggatcaaatacaatatgggaaatggtgggcctgcccctgagtctgttactgacaagattttctctaatacaacaacaatctctgaatacctcatcgccgaagaccttccggatgttgatatttctgttgttggtgtcactagcttcagtggacctgaaggcccctttgatgtggatgtttttgactccagtatagattacataaagttaatgaagacaatttttgatttcgaggcaataaagaagttgctgacctctccaaaatttacattctgttatgatgccctccatggtgttgctggagcttatgccaaacacatctttgtggaagagcttggtgctgatgaaagctctctgttgaattgcgtcccgaaggaggactttggcggtggccatccggatcctaacctcacctatgcaaaagagttggttgaacggatgggtcttggaaagtcatcctcaaacgtcgaacctcctgaatttggtgcggctgctgatagagatgctgaccgaaatatgattctgggtaaacgattctttgtgacgccgtcggactctgttgccattattgcggccaatgctgttcagtcaattccttactttgcttctggcctgaagggagttgccaggagcatgccaacatctgctgcccttgatgttgttgcgaagaatttaaatctcaagttctttgaggtgcctactgggtggaaattttttggcaacttgatggatgctggaatgtgctcaatctgtggtgaagagagctttggcaccggttctgatcacattcgtgagaaggatggtatttgggctgtgcttgcatggctgtctattcttgcttttaagaacaaggacaaccttgaaggagataataagcttgtctccgttgaagatattgttcgtcagcactgggccacctatggtcaccactattacacacgctatgactacgagaacgttgatgcaggggctgctaaggagcttatggcaaacctagtcagcatgcaatcatcactttctgatgttaacaagttgatcaaggagatcagatctgatgtttccgaagtagttgcagctgatgagtttgagtacaaggatcctgttgatggctctgtgtccaagcaccagggtatccgatacctctttggagatggttcacgactggtgttccgtctctctggaaccggttctgttggtgccaccatccgtgtctacattgagcagtacgagaaggattcctccaagaccggcagggattcacaagatgcccttgctccactggtcgatgttgcacttaagctctccaagatgcaagagtacactggccgctctgcccccaccgtgatcacttaaatttttgaagagcctgtgttttagaatgagttgaggcacttacacaaaccttctttccggcctctcgtgtttgatagtttttttccctgttccatctcaccagtgaataaagtgtatgtttattgcccacactgcaaacttgccgctggcacagcatgcggtaataagtcttgtcacagtgctgtagttgggagcttgtttctcgtaataaaaaaaaaaaaaaaaaaaa

SEQ ID NO: 764 - protein, 650 aa, Panicum virgatum
  misc_feature: Ceres CLONE 1727795
  misc_feature (1)..(116): Pfam Name: PGM_PMM_II Pfam Description: Phosphoglucomutase/phosphomannomutase, alpha/beta/alpha domain II
  misc_feature (1)..(150): Pfam Name: PGM_PMM_I Pfam Description: Phosphoglucomutase/phosphomannomutase, alpha/beta/alpha domain I
  misc_feature (67)..(650): SWISSPROT Homolog: EC 5.4.2.2 Phosphoglucomutase, cytoplasmic 1
  misc_feature (67)..(650): SWISSPROT Homolog: EC 5.4.2.2 Phosphoglucomutase, cytoplasmic 2
MVHLHPSVRSLPSPAIISPRPRRHRHHTTTPSLPSHSRSLHHHRPLRATTPLASRGDRRRDVGGPTMGLFTVTKKATTPFEGQKPGTSGLRKKVTVFQQPHYLQNFVQSTFNALPAEEVKGATIVVSGDGRYFSKDAVQIITKMAAANGARRVWVGLNSLMSTPAVSAVIRERVGADGSKATGAFILTASHNPGGPTEDFGIKYNMGNGGPAPESVTDKIFSNTTTISEYLIAEDLPDVDISVVGVTSFSGPEGPFDVDVFDSSIDYIKLMKTIFDFEAIKKLLTSPKFTFCYDALHGVAGAYAKHIFVEELGADESSLLNCVPKEDFGGGHPDPNLTYAKELVERMGLGKSSSNVEPPEFGAAADRDADRNMILGKRFFVTPSDSVAIIAANAVQSIPYFASGLKGVARSMPTSAALDVVAKNLNLKFFEVPTGWKFFGNLMDAGMCSICGEESFGTGSDHIREKDGIWAVLAWLSILAFKNKDNLEGDNKLVSVEDIVRQHWATYGHHYYTRYDYENVDAGAAKELMANLVSMQSSLSDVNKLIKEIRSDVSEVVAADEFEYKDPVDGSVSKHQGIRYLFGDGSRLVFRLSGTGSVGATIRVYIEQYEKDSSKTGRDSQDALAPLVDVALKLSKMQEYTGRSAPTVIT

SEQ ID NO: 765 - DNA, 1666 bp, Panicum virgatum
  misc_feature: Ceres CLONE 1727818
  misc_feature: Encodes the peptide sequence at SEQ ID NO. 766
atcaggaacatgagcggttgatccggcatgcgttcgagccagctcgctctctgacggtacggtgccagcagcctgaatcgcgggcacctgactgttatcgccatggcagcttcttgctgccccagccatggacgattctgcctcatcctcctgcttgctggtgctgctgcggttgtatcatctgggtctggggccgccgctcttggtgatgggggcagctccgatgtgaagctccatgttgactcgtcttgcctcacaccacaagagcacaaacacggcgccgcgacgggcacgaggatgccgatcgtgcaccagcacggcccgtgctcgcctctgaccgacaagcacgggaagccgccttccgacgaggagatcctcgccgcggaccagcgccgcgtcgattacatccaccgccgcgtgtccgagaccaccggacaggcgaggccgaagcgcgcggcgccgccagtccagctccagcccgcgccgctggcgtcgtccgccgcgtcggcgaaccttccggcgtcgtccggggacgcgctgggcacgggcaactacgtggtgaccatcggcctcggcacgccggaggagcggctcacggtggtgttcgacaccggcagcgacacgacgtgggtgcagtgccagccgtgcgtgacctcctgttaccggcagaaggagccgctcttcaccccggccaactcgtccacgtacgccaacatctcgtgctcgtcgtcctactgctccgacctcgacgtccgcggctgctccggcggccactgcctctaccgcgtccggtacggcgatggctccgagaccgtcggcttctacgcccaggacaccctcacgctcgcctccgacgccgttaaggagttcaggttcgggtgcggcgagcagaaccgcgggctgttcgggcaggcggcggggctgatgggactcggccgcggcaagacgtcgctgacggcgcaggcgtacggcaagtacagcggcgtgttctcctactgcctcccggcgacgccgtccgggactgggttcctggacctcggcccaggcggtgcgccggcggcagcgaacgcgcgccgcacgccgatgctgaccgacaaggggccgaccttctactacgtggggctgacgggcatcaaggtggacgggcgcgcgctgtccatcccggactctgtcttctccgccgccggcgcgatcctggactccgggacggtgatcacgcgcctgccccccaaggcgtacgcgccgctgcggtccgcgttcgccaaggccatggcggatttgggctacaagaaggcagccgggacctcgttcctggacacctgctactacctcacgggggtccagggcaaggcgctccccgcggtgtcgctggcgttccagggcgacgcgaccctggatgtggacgcgtcggggatcctgtacatggtggacatgtcgcgggcgtgcctggggttcgcgcccaacaacgacgataccgacgtggccatcgtcgggaacatgcagcagaaaacgtacggggtggtgcacgatcttggcaagaagctcgttagcttcgcccccggagcttgctgatctgttgtcattccatactgatttgtagtatgtatttgttcaataactatctgaaatctcagattggcgtcatcaaaaaaaaaaaaaaaaaaaa

SEQ ID NO: 766 - protein, 489 aa, Panicum virgatum
  misc_feature: Ceres CLONE 1727818
  misc_feature (1)..(336): Pfam Name: Asp Pfam Description: Eukaryotic aspartyl protease
MAASCCPSHGRFCLILLLAGAAAVVSSGSGAAALGDGGSSDVKLHVDSSCLTPQEHKHGAATGTRMPIVHQHGPCSPLTDKHGKPPSDEEILAADQRRVDYIHRRVSETTGQARPKRAAPPVQLQPAPLASSAASANLPASSGDALGTGNYVVTIGLGTPEERLTVVFDTGSDTTWVQCQPCVTSCYRQKEPLFTPANSSTYANISCSSSYCSDLDVRGCSGGHCLYRVRYGDGSETVGFYAQDTLTLASDAVKEFRFGCGEQNRGLFGQAAGLMGLGRGKTSLTAQAYGKYSGVFSYCLPATPSGTGFLDLGPGGAPAAANARRTPMLTDKGPTFYYVGLTGIKVDGRALSIPDSVFSAAGAILDSGTVITRLPPKAYAPLRSAFAKAMADLGYKKAAGTSFLDTCYYLTGVQGKALPAVSLAFQGDATLDVDASGILYMVDMSRACLGFAPNNDDTDVAIVGNMQQKTYGVVHDLGKKLVSFAPGAC

SEQ ID NO: 767 - DNA, 1935 bp, Panicum virgatum
  misc_feature: Ceres CLONE 1727819
  misc_feature: Encodes the peptide sequence at SEQ ID NO. 768
aacgaacgcaaacgcgactcaacgaatcggatcaaatcaaattcgccatccacctcgccggcgccaccgcggcctcgagcgcctgcccgccgcccgatcggccaccggagatgcagcacgggagcggagactacgccgcatccggcggccccgccggccactactacccgcaccagtacgcgcccccggggtccaacccgtatccagccgctaccgatgcgccggcgccgggggcggggggctacgcctccgcgccgccctactccgttggcggaggctgcccagaccagccgccctactccgtcggcggaggctaccccgaccagccgccctccgctccggcctactcgcagccgccgcccacacagccccagtacggcgccgggtacccgccctacagcaccaaccccgcgccctacccgccggagccgtactacacctacacgccgccccccacccaggctgcggctccgccggctgcggagcccaaccctccgccgccgccctacgacgccccgtactacgggggcgggtaccagccgccggccgcggggtacgacaacgaggattacctgaacgagggcgcgtacgcgtacaacggcggcggcggcggcggcggctcggagccgtacggggcgcgcgttacggcccctgcgcggtcgggatccgcgctgtttgatgactatgggcggtcgatcagtgtcccatccggaggggaggagcaaccgtggagcggtggctatggaggtgggggtgggagctttggggcgatcgcgagggcccttccaaaggcggacacgcataaggattcgagtggcggtgcacgaaaatttcgggttaagatacttccagaaggcgctgggaatcctactgatgtgctttgccagattggtctagatggaattcgcatgcttgatccaaatacaagcaggaccctaagaatttatccccttgattcactgacgagatgggaggttttggattcaactatatttgcattctgggcgaagacatcagtggatattgaagcaaagcgaattaggctgaagtcaaacagttatacttccaatactatgcttgacactgtgacagcagcaacagtccagtttaaggagattggtggagatgctagaaacaaaggacctgtggatgctggcaaacatgtggtacaatcaaatgagaagaagaaaggttttgattggatgtttgcaaaacctgttgatgaagtgaaagatcattgggttccagatgaggttgccaagaaatgccactcatgtgccgctgattttagctcttttaatcgcaggcatcattgtcggaactgtggtgaaatcttctgtgacaaatgcagtcagggaagaattgctctgacagctgaggataatgctcctcttgtccgagtttgtgatagatgcatggctgaggtcactcaaaggcttagcatggctaaggaaactgccagcagatctgcaaccgtgcaaagtcatgaagatcttgcaagaaaacttaaggaggaaatggaaagaaaccgcaggtcttcaggtccggcatctggtggtgaggcatctggtaccagaatgagggaagtcgcatgccctacctgcacagtccatcttcaggttcagattccaacatctggctcagagacagtggagtatggagtgtgccagcacgccttccttgtcagcgccaattgataaaccgggaggcagtgcacacgtagaaattattctgttgattactcaacttctattttgttctacacatgataagagtgcgttctgtcagcctgtacatgtctaattgtgtttgtgatcacaataggataatgccatctttttcatgtacatgagcggattacaaactcaggattgctgctgaatttctagatttatggggagaatactgatggaataaaaaaaaaaaaaaaaaaaa

SEQ ID NO: 768 - protein, 528 aa, Panicum virgatum
  misc_feature: Ceres CLONE 1727819
  misc_feature (1)..(67): Pfam Name: FYVE Pfam Description: FYVE zinc finger
MQHGSGDYAASGGPAGHYYPHQYAPPGSNPYPAATDAPAPGAGGYASAPPYSVGGGCPDQPPYSVGGGYPDQPPSAPAYSQPPPTQPQYGAGYPPYSTNPAPYPPEPYYTYTPPPTQAAAPPAAEPNPPPPPYDAPYYGGGYQPPAAGYDNEDYLNEGAYAYNGGGGGGGSEPYGARVTAPARSGSALFDDYGRSISVPSGGEEQPWSGGYGGGGGSFGAIARALPKADTHKDSSGGARKFRVKILPEGAGNPTDVLCQIGLDGIRMLDPNTSRTLRIYPLDSLTRWEVLDSTIFAFWAKTSVDIEAKRIRLKSNSYTSNTMLDTVTAATVQFKEIGGDARNKGPVDAGKHVVQSNEKKKGFDWMFAKPVDEVKDHWVPDEVAKKCHSCAADFSSFNRRHHCRNCGEIFCDKCSQGRIALTAEDNAPLVRVCDRCMAEVTQRLSMAKETASRSATVQSHEDLARKLKEEMERNRRSSGPASGGEASGTRMREVACPTCTVHLQVQIPTSGSETVEYGVCQHAFLVSAN

SEQ ID NO: 769 - DNA, 1971 bp, Panicum virgatum
  misc_feature: Ceres CLONE 1727820
  misc_feature: Encodes the peptide sequence at SEQ ID NO. 770
cttcttctccggttctcccgtccccaaaatttctctggcttcctcgcccccacactccccaccggcgcatccccgaggagaaccccagagcttccccccagcgcggccgtcccatcctattccctccctccgccacccgcctagcgtgtgcgcacgtgcgatgctgcctccacggcggcggccacgcgcggcgcggtgactgagatggtgcgcttcttccgcagcgggaacctcgcctccagggtcttcgaccgccagcttctctccccgcgccccggcgctacggttaacactgttagacagttctatgagaatttggttccaagctacacgatatatgacatagattgcccagactattcgtttcgcaagttcactgatgatgggaaatatcttgtggcttttagccgaaaccaccaagatttgattgtataccgccccatctggttgacatattcatgcactgaagaatgtgattctcatgatcttccaccaaaagcaaagaagtttgatagcttctttaagcagctctactcaattccacttgcatccagcaatgaatacatttgcaaggactttttcctgtacatggattgccatcaatttggcttatttgcaacatcaaccgcacaaagtaatgattcaactgccactgagggtgcaatacatggcgtgccatcaattgagaaaataactttctatcttgtgaggctagaagatggcgtcatactggatgaaaaggctttctgcaatgattttatcaatctggcacatagtattagtgcttacttgtatgaggacctgctatgtattgtttctctgagatatcaaacaatacatatcctacagatccgagattctggcaaccttgttgacgtacgcagaattggcgctttctgccgggaagatgatgagctatttcttcactcacatgttcaggctggttttgggggttcttttcttccgggcatcaagcaacggttgttgtcgtatatttttcgcaaaacatggaacgaagttccagatcagactttgagggtccagcatctcaagaagaagttctattttcacttccaagactatgttgatcttatcatatggaaggtacagtttttggatcgccatcacctatttatcaagttcggtagtgtggatggaggggtttctcgaagcacagatcaaaacttagcattctttgccgtgtataacatggagacaactgatatcgtttcgctttaccagaattcatcggaggagctctattccttgtttgaacaattttatgaccattttcatgccaatccacaagattcatcgcatggaaaatttatctcgtcgcactccaatgatattcatgctcttgatcaacttcacacactaaaaaataaagcaagcagctcctcacagtttgtaaaaaagatgatggcatcgttgccttacacatgccaatcacagagtccttcaccatactttgatctatccctttttaggtatgatgagaagctgatttcagcaattgatcggcaccggcattgcacagagcatccaataaaatttatatcagtgaggtcaccaaatgttgtcaaatttaagatcaagccaggttcggattctggtgcttctgacagcagagcgaaaagaatctcatccttcttgtttcacccattttttccacttgcactttcaattcagcagacttatatgcagccaactgttgtcaatatccatttcaggagataggaaaagtataggtgttgccctaattgtatttgtaccatcagtgtgcttgcagcactgcttgctgcaaaattttggccatctgtaggatgatgtttagatggtggatgttataatgggggttgggtaacaagagatctgttgttgggaactgataatgacttatttggtttcccttccaaacaagaacaacatgtaaagaggctcgttattcaaaaaaaaaaaaaaaaaaaa

SEQ ID NO: 770 - protein, 511 aa, Panicum virgatum
  misc_feature: Ceres CLONE 1727820
  misc_feature: Great-hit functional homolog of the protein sequence given in SEQ ID NO 9471
  misc_feature: Useful for making plants with modulated low light sensitivity
MVRFFRSGNLASRVFDRQLLSPRPGATVNTVRQFYENLVPSYTIYDIDCPDYSFRKFTDDGKYLVAFSRNHQDLIVYRPIWLTYSCTEECDSHDLPPKAKKFDSFFKQLYSIPLASSNEYICKDFFLYMDCHQFGLFATSTAQSNDSTATEGAIHGVPSIEKITFYLVRLEDGVILDEKAFCNDFINLAHSISAYLYEDLLCIVSLRYQTIHILQIRDSGNLVDVRRIGAFCREDDELFLHSHVQAGFGGSFLPGIKQRLLSYIFRKTWNEVPDQTLRVQHLKKKFYFHFQDYVDLIIWKVQFLDRHHLFIKFGSVDGGVSRSTDQNLAFFAVYNMETTDIVSLYQNSSEELYSLFEQFYDHFHANPQDSSHGKFISSHSNDIHALDQLHTLKNKASSSSQFVKKMMASLPYTCQSQSPSPYFDLSLFRYDEKLISAIDRHRHCTEHPIKFISVRSPNVVKFKIKPGSDSGASDSRAKRISSFLFHPFFPLALSIQQTYMQPTVVNIHFRR

SEQ ID NO: 771 - DNA, 1705 bp, Panicum virgatum
  misc_feature: Ceres CLONE 1727838
  misc_feature: Encodes the peptide sequence at SEQ ID NO. 772
gggcagtcgagacatcaccacccctaccgaaatctcgccactctcctactcacccccacccgtctggtccatcacgagcgagcccagcggctgcagatatggcgtcgcctccggccgacgtggacctgggcaagctcagctacgagatcttctccctgctcgaaagcaagttcctgttcggcggcgcggccggcgtcggctccgtgccgggcacgccggcgcgggcggacgccggggaggacaggggccgggtgcgggtgctcgcgatcgacgggtgcgggccgggccccggcgacgcgctgctggcggcggtcgcgctcgcgaggctggaggcagcgctgcgggagcgcgccggggaccccgacgcgcgcgtcgccgacttcttcgacgccgcggcgggggccggcgccgggggcgtgctggcggcgatgctgttcctcaggggggaggacgggcgcgcgcggtacacggcggcggacgcgctggcgttcgtggcggcgagcctcgggaggcggcaggggggctggtggggcggcgacgacgcgcagcggagccggtgggcggccctgctgttccgccgcggggagcggtccccgctgcgccgggtgttcggggacgccacgctcagggacaccgtcgcgccgctgctcgtgccctgctacgacctcgccacggcggcgccgttcctcttctcccgcgccgacgccgtcgagagcgacagcttcgacttccgcctccgcgacgtctgcgcggccacctgcgccggcggggccgccgcagccgccgtccggtcggtggacgggcgcacggccatcgccgcggcgtcggggggtgtcgcggccatgggcaaccccgccgcggccgccatcacacacgtgctccacaacaagcaggagttcccgctcgccgtcggcgtcgacgacctcctcgtcgtgtccatcggctccgggtcctccgccgccgccgccgtagccgcaagcgccaccccttccgccggctggcggacgcccatcccgccgcgctcgccgtcgcccgccgagatggtccgcctcaccgccgagggcgtcgccgacatggtcgaccaagcagtggccatggcgttcgggcgcaactacgttcgtatccaggcggcgtcgccggcgtgctccgggaagaaggcgctgagctcgctggacgcgaggaaggcggtggcggccgccgacggcatgctgacgcagcggaacgtggaggcggagctgttccgcgggcggcgcctgtcggagaagtcgaaccgggagaagctggacgcgttcgcggcggagctggtgaaggagcaggagcggcgggcgcgcagcccgggcctgcccaacgtggtgatcaagcaggcggcggcgacaccgcggccgtcgtcggccaccaccgcctcctcggccaccgtcaccgcccgcaccacctccaccatgccgtccccggcgtcgcagggctcgtacggccactagccgccgccgcgcgccgccgtccgttctaagttttgtacatgccgtggacagaggaaagggggctcttcttccttcgttttttttccttcctttcttttcccgatctttcatttcttccacgccctcgggtcgccgacacgtgggccaggccggcaacgagcttgaactaagttatgcgatatgggcaagtaaaagtaacttatatgccaaaaaaaaaaaaaaaaaaa

SEQ ID NO: 772 - protein, 459 aa, Panicum virgatum
  misc_feature: Ceres CLONE 1727838
  misc_feature (1)..(207): Pfam Name: Patatin Pfam Description: Patatin-like phospholipase
MASPPADVDLGKLSYEIFSLLESKFLFGGAAGVGSVPGTPARADAGEDRGRVRVLAIDGCGPGPGDALLAAVALARLEAALRERAGDPDARVADFFDAAAGAGAGGVLAAMLFLRGEDGRARYTAADALAFVAASLGRRQGGWWGGDDAQRSRWAALLFRRGERSPLRRVFGDATLRDTVAPLLVPCYDLATAAPFLFSRADAVESDSFDFRLRDVCAATCAGGAAAAAVRSVDGRTAIAAASGGVAAMGNPAAAAITHVLHNKQEFPLAVGVDDLLVVSIGSGSSAAAAVAASATPSAGWRTPIPPRSPSPAEMVRLTAEGVADMVDQAVAMAFGRNYVRIQAASPACSGKKALSSLDARKAVAAADGMLTQRNVEAELFRGRRLSEKSNREKLDAFAAELVKEQERRARSPGLPNVVIKQAAATPRPSSATTASSATVTARTTSTMPSPASQGSYGH

SEQ ID NO: 773 - DNA, 1705 bp, Panicum virgatum
  misc_feature: Ceres CLONE 1727852
  misc_feature: Encodes the peptide sequence at SEQ ID NO. 774
gtcgctccatttccaccaaatctgtgccccgtcccgccgcctccgcgccgagcacctccgtccagaactccagatccagccatcctcgcctgctcccgctgcagcggcacctctctccattccttcccgcatcggcgggccggcgggcgtcctcttcccccgagcggggatcggcgtggaggcggtttcttcgtcttccgtgttatgtctttctccccagtggcacagctgttcaactgaagagcagatttttgtagagcaatggctgtggaaagagatgtctttggcatctccgggccgacatacctgaaatctgttgattggaactgcaagcataatcggagatctgtggctgcaagcttagttcaggctgtatatgtgttggagagagacagacaattaaatcgccaatctgttgaagcccttgctccttcttggtgggaattcttccattttgagctgattcgcaagctcgttgatgatgccgatatgtccatatttggtgcaatatttgaattcaaacctccttcaagtgaagaagcttctgctgtgaatgctccaagatttgtcgttgctttcagaggcaccataacagaaagggataccatctctagggatctttcccttgacctccaccttgtacaaaatggtctccataggacctcaagatttaccattgcaatgcaagctgttcaaaatgttgcctcggtttttcctggatccacaatttggctagcagggcactcattgggtgctggtatggctatccttactggaagaaacatggttaagaagggtgtgtttttggagagctttctcttcaatccaccctttgtcgctgctccaatcgaaaggatcagggatgaaagggtaaaacacggtttccgcattgctagaagtgtaattactgctggattaactattgcaatgaaaggtaaaactgaggggaacagtcagagatctgttgctgaagaatctttcagcattctgtcatcatggacgccgtatctatacgttaacccaggagaccacatctgttcagagtacatcgggtacttccaacaccggaagaacatggaggatctcggtgctggttttattgagaagcttgcaacccagaattccatcggagatctgttgttcaaggcattagggtgggaatccgaaccactgcaccttctcccatctgctgacttgatcgtcaatgtgagcccttcacctgatttcaaatatgctcatggcatcagccaatggtggcagccagagctgaacttgcagtgcagtaaatatcggtacgaatagtatacactgctggaaaaggaagatgttctcagaaacttagctatggtcttctattctttcagtttattcatgtggtccattccatttatatgataaactatttcagacactagactgcaaccttgacctgcgaaatctattgattatgtacagtaatcagattaactgcattctgtactgtactctgatgtgcttactggcgttaactagttcagctgtacaaatcacattatgatgtgctgtcttattcatgttttatctatctagagcacgtgagctttatttgaaggcaatgtaggaagttgaggtgtacgggaatataacttgtaccattttgaatgtcggttaagttttcttgctaatgtaaggtcatatcgaggagtaaaaaaaaaaaaaaaaaaaa

SEQ ID NO: 774 - protein, 346 aa, Panicum virgatum
  misc_feature: Ceres CLONE 1727852
  misc_feature (1)..(121): Pfam Name: Lipase_3 Pfam Description: Lipase (class 3)
MAVERDVFGISGPTYLKSVDWNCKHNRRSVAASLVQAVYVLERDRQLNRQSVEALAPSWWEFFHFELIRKLVDDADMSIFGAIFEFKPPSSEEASAVNAPRFVVAFRGTITERDTISRDLSLDLHLVQNGLHRTSRFTIAMQAVQNVASVFPGSTIWLAGHSLGAGMAILTGRNMVKKGVFLESFLFNPPFVAAPIERIRDERVKHGFRIARSVITAGLTIAMKGKTEGNSQRSVAEESFSILSSWTPYLYVNPGDHICSEYIGYFQHRKNMEDLGAGFIEKLATQNSIGDLLFKALGWESEPLHLLPSADLIVNVSPSPDFKYAHGISQWWQPELNLQCSKYRYE

SEQ ID NO: 775 - DNA, 1004 bp, Panicum virgatum
  misc_feature: Ceres CLONE 1727863
  misc_feature: Encodes the peptide sequence at SEQ ID NO. 776
agtcgcgtcggccacggccagtcgccgacgacttcacttctcggggacataaccccccgcgggcagcgcaggcgcgtccccgcccgacttcccgtgggggacagagaggcgaaggccggaaagggggaaggagagatgagctcctcgtcggcgtcggccgtgccgccggaggacgacgtctgctccgtctgccacgaccgcttccggatcccgtgccaggcaaactgctcccactggttctgtggagagtgcatcatccgtgtttggcatcatgggcctgcagtacaggcttgcaagtgtcccatttgccgccgccttatcaatctactggtacctgctcctttatcagaccaggaggatgatccacaacttcaccgtattttaggagagattcagcactataactgcatttttggtggagcaccacgcagcctgactcagaggttgcaagacctgcccttcttcatccgaagactgttcagagaactaatggatccccagaggactctcccacttgtgttcagggcgcggatggtgatgatggttgcattgagcgcaatttacgtgctgagccctgttgacattctccccgaaagtgtgctggggctctttggattcgttgatgacctgctgattctgttgatcgtgttcctccacctcgccgcggtctaccggtcgttgcttctgtaccgccatgggaggcagtagaaggtgttgtgcatagtcatttgcttagctgggttccctgggaagttttcgaggtggcagcagctttggatgagtgctaagcagatggcgagttggcgacgatatgaaggacggctagctactagcttgtgcttggtttgtactgttctggtacgcctgttttcttatgattctgacacgatgaacttgtgttgatggaggtggaactctgttctgttcagcttgcccgacggatctgcacagttcatggattatacaaattgtttgttgtgtcagaaaaaaaaaaaaaaaaaaaa

SEQ ID NO: 776 - protein, 190 aa, Panicum virgatum
  misc_feature: Ceres CLONE 1727863
  misc_feature (1)..(43): Pfam Name: zf-C3HC4 Pfam Description: Zinc finger, C3HC4 type (RING finger)
MSSSSASAVPPEDDVCSVCHDRFRIPCQANCSHWFCGECIIRVWHHGPAVQACKCPICRRLINLLVPAPLSDQEDDPQLHRILGEIQHYNCIFGGAPRSLTQRLQDLPFFIRRLFRELMDPQRTLPLVFRARMVMMVALSAIYVLSPVDILPESVLGLFGFVDDLLILLIVFLHLAAVYRSLLLYRHGRQ

SEQ ID NO: 777 - DNA, 1723 bp, Panicum virgatum
  misc_feature: Ceres CLONE 1727885
  misc_feature: Encodes the peptide sequence at SEQ ID NO. 778
gaagccgccatggccacgctctcgctctcctcccgccccctcaacttcctccgcccgaaccgcgccaagcctcccctccaccgcctcctccgccccaagcccctcgcctcgtcctccgcctccgcgctgacgccgccgacgccccgccccgaccccaccgacacccccgaccccgaccccaccccgctcttcctccgcccggcgtgccacccggccccggccgcggcactcgccgccttccgccgccgcgcggccgcgctcgtcccgccctccgcgctgcacctccaccgccacctccgctggctcctcgccgacgccgccgccgccgacccctcctccgacccggcgctcctccgcgcgccgctggacgacctcgaggccatgtgggcccaccacgtccggggccgccgcccgttccagtacgtggtcgggaacgagcactggcgggacctggtggtggccgtgagggagggcgtgctcatcccgcgccccgagacggaggccgtcgtcgacatggtaacaaaagtggaggggttcgcggacgggtggtgggcggacctcggcacgggcagcggcgccatcgccgtggccgtcgcgagggagctcggcgccgatgggagggtgttcgctgttgatgtcagcgaggtggccgtcgaggtcgccacgctcaatgtccagaggtacggggtgcagggtaaagttgaaataaggcatggttcgtggttcgaacctctgcaagatgtgaaaggaaaactcatgggggtgattagtaaccctccatatataccaaccgatgatctacctggacttcaacctgaggttggttggcatgaaccaaagttggcgcttgatggaggcaaggaaggccttgagcatcttctccatctttgtgaagggttatcttcagtcctgaagcctgggggtttctttgtttttgagactaatggcaataagcagtctgagttccttgttgatttgataagcacaaagtggagttcttcttttcataacgtggaggcagtattagactttgcagaaatcaagcgatttgtaacaggatatcgcagatgaacaccaaagcatggatgtcgatgtaatactttggagacaaataatttttccattaagactttggtccttgccatttaaaaatgggatcagtctggggtggcttctgcagaaagcaaacaactcataccattgccctctgcagagcttatcacttgcagtttaagtctggtggtcacaatgatatagtgcaaagtcaatcatcaatggtcacaatgataaatatacattctttaggtgtgcgaggtaacattttcaccaaagccaagctgaggaccgatcaattgtccaactgcccaaggaagctgtacaatagacaagaattggcagtttgcattcagaagacgtagcgtgtatttggtcgcttgttttgcggcgtgttgggcgatgattgtgatttaaagtggaggcttttgtggcctccaaaattattccgccgtccacacgccactttgtgtgcttaattattgatgccgtgggccgggtgattatttttgtaattttgtttcttttttggcccctcctttggatccatcttcaggtaaattctatggaagatgacgtctttattgttttcccttttcagtaatcccagaaaagttgaatgaataaagcagaagagatacctaaggatgaaaaaaaaaaaaaaaaaaaa

SEQ ID NO: 778 - protein, 353 aa, Panicum virgatum
  misc_feature: Ceres CLONE 1727885
  misc_feature (1)..(207): Pfam Name: MTS Pfam Description: Methyltransferase small domain
  misc_feature (1)..(56): Pfam Name: Methyltransf_11 Pfam Description: Methyltransferase domain
  misc_feature (2)..(121): Pfam Name: Methyltransf_12 Pfam Description: Methyltransferase domain
MATLSLSSRPLNFLRPNRAKPPLHRLLRPKPLASSSASALTPPTPRPDPTDTPDPDPTPLFLRPACHPAPAAALAAFRRRAAALVPPSALHLHRHLRWLLADAAAADPSSDPALLRAPLDDLEAMWAHHVRGRRPFQYVVGNEHWRDLVVAVREGVLIPRPETEAVVDMVTKVEGFADGWWADLGTGSGAIAVAVARELGADGRVFAVDVSEVAVEVATLNVQRYGVQGKVEIRHGSWFEPLQDVKGKLMGVISNPPYIPTDDLPGLQPEVGWHEPKLALDGGKEGLEHLLHLCEGLSSVLKPGGFFVFETNGNKQSEFLVDLISTKWSSSFHNVEAVLDFAEIKRFVTGYRR

SEQ ID NO: 779 - DNA, 1550 bp, Panicum virgatum
  misc_feature: Ceres CLONE 1727886
  misc_feature: Encodes the peptide sequence at SEQ ID NO. 780
aacaagttgcggctcgtgctcttgctcccccgaggcgtctcgaacccgttctgcccctgttcgtcgtctccccctcctcgggaggaggcggcgagatctgcccgctccggcgcctgtgagggtttttgtcccgggatggcgtcgtcggggaagatggaggggccatcggcgccggcggtccgccgggacccctacgaggtgctcagcgtgccccgggactcctccgatcaggagatcaagtccgcctaccgaaagctcgcactcaagtaccatcctgataagaatgcaagcaacccagaagcatcagaactcttcaaagaagttgcatattcttatagcatcttgtcagatcctgagaaaaggaggcaatatgatactgctggttttgagctgttagaaaatgaaggaatggatatggagattgatttgtccaatcttggaactgtcaacacgatgtttgcagcactttttagcaagcttggagttcctatcaagaccacaatatctcccaccgtgctggaagaggctatgaatggtacagttacagtgagaccactccctgttggaacatcagctaccggcaaggttgataagcaatgtgctcatttttttggtgtaacgataagtgaagaacaagctcattctggaatagtcgtcagagtcacttcacctgcacaaagtaaatttaagcttctttactttgagcaagaagttaatggaggttatggactcgctttgcaggaagatagtcagaagactggcaaggtgacatctgcaggcatgtatttcttgcatttccaggtgtaccgtatggactcaacagtgaatgcgttggcaatggccaaagatcctgaggccgccttctttaaaagattggaaggtctccaaccctgcgaagtgtcggctctcaaatctggaactcatatatttgctgtatatggtgataattttttcaagccagcaagctatatgattgaagcaatgtgtgctaaaagttatgaagagacaacagagaggctgaaggaaatagaatccaaaattctagcgaagagaaatgatctgcgtcaatttgaaactgagtacagaaaagctttggcacgatttcaagaagtcaccaacagatatacgcaagagagagaagcggttgatgatatgctgagagagagggataatatccattgctcattcacaactgaacgaactttggtaaaccctgttggcgctggtagtagcagcagtaggtataccacagagcatagcatccctgagagccctgagaatggtagcgtaaatggcagagacaaatctggcaaaaagaagtggtttaatctaaaccttgatagatctgacaagaaagcttgaagagtcttgctggaaatggcatgtgtttcactttgttgtacatttcagaaccctctattgtattcatgccttatgagctgtttggtagccaattctttgggttttgtagcatataggagttttggtacagcattttaatgacatgtattatcatctttaaattcctccaaaaaaaaaaaaaaaaaaaa

SEQ ID NO: 780 - protein, 408 aa, Panicum virgatum
  misc_feature: Ceres CLONE 1727886
  misc_feature (1)..(63): Pfam Name: DnaJ Pfam Description: DnaJ domain
MASSGKMEGPSAPAVRRDPYEVLSVPRDSSDQEIKSAYRKLALKYHPDKNASNPEASELFKEVAYSYSILSDPEKRRQYDTAGFELLENEGMDMEIDLSNLGTVNTMFAALFSKLGVPIKTTISPTVLEEAMNGTVTVRPLPVGTSATGKVDKQCAHFFGVTISEEQAHSGIVVRVTSPAQSKFKLLYFEQEVNGGYGLALQEDSQKTGKVTSAGMYFLHFQVYRMDSTVNALAMAKDPEAAFFKRLEGLQPCEVSALKSGTHIFAVYGDNFFKPASYMIEAMCAKSYEETTERLKEIESKILAKRNDLRQFETEYRKALARFQEVTNRYTQEREAVDDMLRERDNIHCSFTTERTLVNPVGAGSSSSRYTTEHSIPESPENGSVNGRDKSGKKKWFNLNLDRSDKKA

SEQ ID NO: 781 - DNA, 1732 bp, Panicum virgatum
  misc_feature: Ceres CLONE 1727887
  misc_feature: Encodes the peptide sequence at SEQ ID NO. 782
acaccaccatccccattccccaaccccaagcgaaccacccccgcagccgcatccgcagccgcagctgccccccaccggcctcggactcggcggcgagcgcggcggctccgcttcccaccccgacgcatggaggcgccgccggggccggagcccatggcgctggacgcgccccctgccgccaccgccgccgccgaggacgtggcggcggcggttccccccgccggcggcgagaagaaggaaggcgaggggggagagagggtcccgggccacatcatctccaccaccatcggcgggaagaacggcgaaccgaagaggactataagttacatggcggagcgtgttgtgggtacaggttcatttgggatagtcttccaggctaagtgtctggagactggggagacctttgccatcaagaaggtgttgcaagatagacgttacaagaaccgggagctgcaactgatgcgcgccatggaacaccccaatgtcatctgtctgaagcactgcttcttctcaacgacacccaaggatgagctgtttttgaacctcgtcatggaatatgttccggagacgctgtatcgtgtcctgaagcactacagcaatgcgaaccagagaatgcctcttatctacgtcaagctctacatgtatcagctttttagagggctagcttatattcatactgtaccaggagtctgccacagggatgtaaagccacaaaatgtcctggttgaccctctcacccaccaagtcaaactgtgtgactttggaagcgctaaagtcttgattcccggtgaaccaaatatatcttacatttgctctcgttattatcgtgctcctgagctcatattcggagcaactgagtatacaacttcgatagacatatggtcagctgggtgtgttcttgcggagttacttcttggtcagccactgtttccaggagagagtgcggtcgaccagctagtggagataatcaaggttcttggtactccaactcgtgaggaaataagatgcatgaaccccaactatactgagttcaggtttcctcagataaaggctcatccatggcacaagattttccacaagagaatgcctccggaagctatagaccttgcttctcgtctcctccaatactcaccaaatcttcgctgctctgctcttgatgcatgcgctcatcccttctttgatgagctacgggctccgaatgcacgcctgccaaatggccgtccattccctccgctcttcaacttcaagcatgaactagcaaatgcctctccggaactcgtcaacaggctgataccggaacatattagacggcaacatggcgtcaacttcgggcacaccggaagctaggagggcaggcacagcgatgttcaactttttggtcttggttccccatgagctgggccgatgcaagcgtaggcgacatggcaccatcaggagagatcgaccctgcagttcctgagagaagtaaaactatgtaaattatctgaccgtaaagaactaccgccagtgttaagtcggtaactggcgcatgttggtccggtagttaaggtaagaatgtaggaggtggtgactggttaatgcctagggctgtttttggttattatgttcgtcagtacttctcagtagtagtgtagctgcacctgttttgttcgtccgccatgatgtaaatgatcatctccccaatcgcaatgcatgttcaatcgttaatgcttaaaaaaaaaaaaaaaaaaaa

SEQ ID NO: 782 - protein, 406 aa, Panicum virgatum
  misc_feature: Ceres CLONE 1727887
  misc_feature: Great-hit functional homolog of the protein sequence given in SEQ ID NO 9591
  misc_feature (4)..(396): SWISSPROT Homolog: EC 2.7.11.1 Shaggy-related protein kinase iota
  misc_feature (40)..(401): SWISSPROT Homolog: EC 2.7.11.1 Shaggy-related protein kinase eta
  misc_feature: Useful for making plants with modulated biomass
MEAPPGPEPMALDAPPAATAAAEDVAAAVPPAGGEKKEGEGGERVPGHIISTTIGGKNGEPKRTISYMAERVVGTGSFGIVFQAKCLETGETFAIKKVLQDRRYKNRELQLMRAMEHPNVICLKHCFFSTTPKDELFLNLVMEYVPETLYRVLKHYSNANQRMPLIYVKLYMYQLFRGLAYIHTVPGVCHRDVKPQNVLVDPLTHQVKLCDFGSAKVLIPGEPNISYICSRYYRAPELIFGATEYTTSIDIWSAGCVLAELLLGQPLFPGESAVDQLVEIIKVLGTPTREEIRCMNPNYTEFRFPQIKAHPWHKIFHKRMPPEAIDLASRLLQYSPNLRCSALDACAHPFFDELRAPNARLPNGRPFPPLFNFKHELANASPELVNRLIPEHIRRQHGVNFGHTGS

SEQ ID NO: 783 - DNA, 1550 bp, Panicum virgatum
  misc_feature: Ceres CLONE 1727899
  misc_feature: Encodes the peptide sequence at SEQ ID NO. 784
agccgcgcgcgacgcgaagcctctcctgtcctctcttgcttcttccttggtcctccagcaccggcagccgccgccggcgtcgcgctcctctatctgtcacgcccggaaccgcgccggcacgagcacgacgacggccggcgacaatggtggcggcgtccgcggccgagcgggtctacacggcggcggcgcggtcggcgctggcggcgctggagcgcaacctcatcccggacgcggtcacccggcgcctcacgcggctcctgctcgcgcagcgcctccgccagggctaccgcccctccgcgccgctgcagctgctgcagctcctccacttcgtccactctctccaagagatgcccattgcgattgaaacggacaaagctaaagcccaacactacgagctgccaaccacatttttcaagctggttcttggaaggaatctcaaatacagttcctgctacttccctaacgagtccagcactctagaagatgctgaggttgcaatgatggaactgtactgtgagagggcaaaagtgcaggatggacagagcatccttgatgtcggatgtggatgggggtccctttcactacacattgcgaagaaatataagaactgcagcgtgacagggatatgcaactctaccacacaaaaaacatgtatagacgagcaatgtagggaaaatgagctgtcaaatgttgagataattgtggcagatatcagcaagtttgagatggagcgttcttttgacaggatcatatccatagagatgtttgagcacatgaaaaactacaagtcacttcttaaaaagatatccaagtggatgaaagaggacagcttattatttgttcaccacttctgccacaagacatttccatatcattttgaggataacaatgatgatgattggatcacaaggtatttcttcactggaggaacaatgccatcggcaaaccttctactctactttcaggaagatgtatctgtggtcaatcattggcttgtcagtggcatgcattatgctagaactagtgaggagtggctgaaacgtatggaccggagcatcacttccattaggcccatctttgagaaaacttacgggaaggaatcaactaccaaatggatggcttattggcgaacattcttcattgctgtcgctgaactttttgcatacaacaatggtgatgaatggatggttgcgcactacctgttccaaaagaagtaggagctaccgctcgccttttcctcaaacaaagtacaagccccgagaagcagctcattttcacagtgattcagtaatcttaccatttgtccccaagagcagaccattttcatgcattcaattgtatttaataaggtgcgtccacagtggtttcaccaacaacatcgcgaacaatggtgttctatatattattccttcgatgttctgtacagagcatacctttctgtcttctggatggcacgttcataagcacggaagtatgtaactacaaaactgtcattgatgtgcagtgattacattgcagtactggcatttcaaaaaaaaaaaaaaaaaaaa

SEQ ID NO: 784 - protein, 357 aa, Panicum virgatum
  misc_feature: Ceres CLONE 1727899
  misc_feature (1)..(98): Pfam Name: Methyltransf_11 Pfam Description: Methyltransferase domain
MVAASAAERVYTAAARSALAALERNLIPDAVTRRLTRLLLAQRLRQGYRPSAPLQLLQLLHFVHSLQEMPIAIETDKAKAQHYELPTTFFKLVLGRNLKYSSCYFPNESSTLEDAEVAMMELYCERAKVQDGQSILDVGCGWGSLSLHIAKKYKNCSVTGICNSTTQKTCIDEQCRENELSNVEIIVADISKFEMERSFDRIISIEMFEHMKNYKSLLKKISKWMKEDSLLFVHHFCHKTFPYHFEDNNDDDWITRYFFTGGTMPSANLLLYFQEDVSVVNHWLVSGMHYARTSEEWLKRMDRSITSIRPIFEKTYGKESTTKWMAYWRTFFIAVAELFAYNNGDEWMVAHYLFQKK

SEQ ID NO: 785 - DNA, 1976 bp, Panicum virgatum
  misc_feature: Ceres CLONE 1727905
  misc_feature: Encodes the peptide sequence at SEQ ID NO. 786
acacagctgccgccaccgccactcttcgctctcgcaaaagctagcgcgagtccatggcggcgtcggcggcgtctccgcgcaccgcagcgcctcctcctcggcgcctcctcgcgctctcgctgctgcttccgctgctcgtgctccccgccgccaccaatgcgcaccccgtgacgacgacgccggcgccggcggcgaaggcgaaggcacgggaggcgggcgtctcggcggggctggtctccacgctgcgcgagacgctggacgcgatcaggagcgtggcgggcatcatctcggcgttccccgtcggcggcatcctcggcggcggcgacatccgcctctcctccgccgttgccgactgcctcgacctcctcgacctctcctccgacgagctctcgtggtccatgtccgccacctcggcggcgaccaccggcgccgggggaggagcaggcggccgcctcggcaccggcgacgccagctccgacctccggtcctggctgagcggcgcgctcgggaaccaggacacctgcaaggagggcctggacgcgaccggctcggtcctcggctcgctcgtcgccacggggctccaggccgtcacgtcgctcctcgccgacggcctgggccaggtcgccgccgcgggcgaggacgccgccgccttgtacccgccgtcctcccgccgcggcctcctcggcggcgcccggcccccgcggtggctgcgcgcgagggagcggcggctgctgcagatgcccgtggggccggggggcctgccggtggacgccgtggtggcgcaggacgggagcggcaacttcacgaccgtgagcgcggccgtggaggcggcgcccgaggagagcgcggcgcggttcgtgatctacgtgaagaagggcgtgtacagggaggcggtggaggtgaggaagaagaagtggaacctgatgctggtcggcgacgggatgggcgtcacggtcatctccggtgaccgcaactacgtcgacggctacaccacctaccgcagcgccaccgtcgccgtgaacggcaggggcttcatcgcgcgggacctgacgttcgagaacacggcgggccccgccaagcaccaggcggtggcgctccggtgcgactcggacctctccgtcttctaccgctgcaccttcgagggctaccaggacacgctgtacgcgcactcgctccgccacttctaccgcgactgccgcgtcacgggcaccgtcgacttcgtcttcggcaacgccgccgccgtgttccagggctgcctcctcctcgcgcgcctcccgctgcccgcccagaagaactccgtcaccgcgcagggccggctcgacgccaacatgaccacgggcttcgccttccagttctgcaacgtctccgcccacgacgagctcctcgcggcctcctccggcgccggcaaccggaccgccgccgccgcgcagacgtacctcggccggccgtggaaggagtactcccgggtggtgttcatgcagtcgtacatcggcgccgcggttcgccccgaggggtggctcgcgtgggacggggagttcgcgctctacacgctctactacggggagtacatgaacacgggccccggcgccggcgtcggagcgcgggtccggtggccggggttccacgtcctgaccagccccgcggaggccggcaacttcaccgtcgcgcagttcatcgggggcaacatgtggctgccgcccaccggcgtcaagtacaccgccggcctcacctcttgatgattggtctgcttcggcggcggtgccagctcgatcagacctcatcagttgctgcctctgggtgtagagagttagtagtgttgtcatcttataccacatatgtactagcagagtagtcctacatgatgtccgtggaggggaatgtgtgaaagaaatggtggattaattggttgttgattcgggttgtctgaaatcagcagcgcatctctgttaccaggcgaaaaaaaaaaaaaaaaaaaa

SEQ ID NO: 786 - protein, 560 aa, Panicum virgatum
  misc_feature: Ceres CLONE 1727905
  misc_feature: Great-hit functional homolog of the protein sequence encoded by LOCUS At3g43270
  misc_feature (3)..(165): Pfam Name: PMEI Pfam Description: Plant invertase/pectin methylesterase inhibitor
  misc_feature (1)..(308): Pfam Name: Pectinesterase Pfam Description: Pectinesterase
  misc_feature (110)..(556): SWISSPROT Homolog: EC 3.1.1.11 Pectinesterase PPE8B precursor
  misc_feature: Useful for making plants with altered cell wall content and/or composition
MAASAASPRTAAPPPRRLLALSLLLPLLVLPAATNAHPVTTTPAPAAKAKAREAGVSAGLVSTLRETLDAIRSVAGIISAFPVGGILGGGDIRLSSAVADCLDLLDLSSDELSWSMSATSAATTGAGGGAGGRLGTGDASSDLRSWLSGALGNQDTCKEGLDATGSVLGSLVATGLQAVTSLLADGLGQVAAAGEDAAALYPPSSRRGLLGGARPPRWLRARERRLLQMPVGPGGLPVDAVVAQDGSGNFTTVSAAVEAAPEESAARFVIYVKKGVYREAVEVRKKKWNLMLVGDGMGVTVISGDRNYVDGYTTYRSATVAVNGRGFIARDLTFENTAGPAKHQAVALRCDSDLSVFYRCTFEGYQDTLYAHSLRHFYRDCRVTGTVDFVFGNAAAVFQGCLLLARLPLPAQKNSVTAQGRLDANMTTGFAFQFCNVSAHDELLAASSGAGNRTAAAAQTYLGRPWKEYSRVVFMQSYIGAAVRPEGWLAWDGEFALYTLYYGEYMNTGPGAGVGARVRWPGFHVLTSPAEAGNFTVAQFIGGNMWLPPTGVKYTAGLTS

SEQ ID NO: 787 - DNA, 2588 bp, Panicum virgatum
  misc_feature: Ceres CLONE 1727909
  misc_feature: Encodes the peptide sequence at SEQ ID NO. 788
gaaacaaactccaacagaagacggagcagcagtagagtcctccactcctcctcttggtcttcagcatcgcaatcctcgcctcgccggcctctccatctctatttatccgcccgccggatttccagatcgagcgaggcgacaaggacgagcagttgggggatcgccgcacccggaattcagccagagctcggatccgggcaggggcagagatggccatggaccacgcagcggcggagggggaccacctcgccgccgagagggccgcggcgcgcttcgacgtcgaggcgatgaaggtcgcgtgggccggctcgcggcacgccgtcgacgtcgccgaccgcatggcgcggctcgtcgcgtccgacccggtcttccgcaaggataacaggaccatgctctccaggaaggacttgttcaaggacactctaagaaaagctgcccatgcgtggaagcgcattgtcgagctacgtcttacagaggaggaagcaagtctgctgaggcaatacgtcgatcagcctggttatgttgatctgcattggggcatgtttgttcctgctataaaagagcaaggaactgaggagcaacagaagaagtggttacctctggcttacaagttccaaataattggatgctatgctcagactgaacttggtcacgggtcaaacgttcagggacttgaaacaactgctacatttgatccaaagactgatggatttgtcatccacagtccaactctgacctccagcaaatggtggcctggtggcttggggaaagcttccactcatgcagtcgtgtacgctcgattgataactgaaggaaaggactacggcatacatggtttcatcgtgcaactgcgaagcttggaggatcactccccgcttcctggtgttacccttggtgatattggtggaaaatttggtagtggtgcatataacagtatggataatggtgttctgcgatttgaccatgtgcgcatcccaagggatcaaatgttgatgagactttcacaagttacaagggaggggaaatatgttaattcagatgttccaaagcagctgctttatgggacaatggtttatgttcgtcaatcaattgtggcagatgcttctaaggctttgtcccgtgctgtttgcattgctgtacgatacagtgccattcgaaagcagtttggctctcaagatggtggccctgagactcaggttcttaattacaggactcaacaaagcagactctttccattgctggcttccgcatatgcattcagatttgtgggtgattggctcaattggctttacacggatgtcactcagaaactggaagctaaagattactcaacactgcaagaagctcatgcctgtactgctggtttgaaggctgtgactacatctgcaacagctgatgcaattgaagaatgcagaaagctctgtggtggtcatggttacttgaacagcagtgggcttcctgaattatttgccgtctatgttcctgcatgcacttatgaaggagacaatgttgttctgcttttgcaggttgcaaggattctaatgaagactgtttctcaattgacctctggaaaacagcctgttggtacaatggcctacatgggcaaagtacaacatctgatgcaatccaaatgtgcagtcaaaacagctgaagattggcttaaccctgctttcatacaagaggcatttgaagctagggctctcaggatggcggtaaactgtgcccagaacataggccaagcggcaaaccaagaagaaggtttctatgaacggtccccagatttgcttgagtctgcggtagctcacatccagttgatcattgtaaccaagtttatcgagaaggtacagcaggacattcctggacatggggtgaaggaacagctccagaacctctgcaatgtttatgccctctacattcttcacaagcacctgggtgatttcctggcaaccgggtgcatcacacccaagcagggagcgctggcaaacgagcagctgggcaagctctacgcacaggtgcgtccgaatgctgttgcgctggtggacgcgttcaactacaccgaccactacctgggatcagtgctggggaggtacgacgggaacgtgtacccggcactgtacgaggaggcgtggaaagaccctctgaacgagacggtggtgccggaggggtaccacgagtacctccaccccttgctcaagcagcagctcaagttatccaggctctgatctgacaggccacctctaggaattcaccatggtggtggtgttctcggagaatccagcaccccctcctctcaatggatgaattatggggtgaaataagcaaaattctgttatttgtcaaagccgcgaatgaggcatatataaatatacatgtataccttaagtgcggatcatatcagaggtacattctgttgacagccaaatttggcacctgccgaggccgactggtctgaccggtcggcccggtcggttagaccggtctggtatgtacagtctgagtagaattaggttttttataaaaagtcctcatgtaatcctactcgtgaaggggtatgtcttttccggcctacaaaaaaaaaaaaaaaaaaa

SEQ ID NO: 788 - protein, 670 aa, Panicum virgatum
  misc_feature: Ceres CLONE 1727909
  misc_feature (1)..(166): Pfam Name: Acyl-CoA_dh_1 Pfam Description: Acyl-CoA dehydrogenase, C-terminal domain
  misc_feature (1)..(183): Pfam Name: ACOX Pfam Description: Acyl-CoA oxidase
  misc_feature (1)..(61): Pfam Name: Acyl-CoA_dh_M Pfam Description: Acyl-CoA dehydrogenase, middle domain
  misc_feature (9)..(670): SWISSPROT Homolog: EC 1.3.3.6 Acyl-coenzyme A oxidase 1, peroxisomal
MAMDHAAAEGDHLAAERAAARFDVEAMKVAWAGSRHAVDVADRMARLVASDPVFRKDNRTMLSRKDLFKDTLRKAAHAWKRIVELRLTEEEASLLRQYVDQPGYVDLHWGMFVPAIKEQGTEEQQKKWLPLAYKFQIIGCYAQTELGHGSNVQGLETTATFDPKTDGFVIHSPTLTSSKWWPGGLGKASTHAVVYARLITEGKDYGIHGFIVQLRSLEDHSPLPGVTLGDIGGKFGSGAYNSMDNGVLRFDHVRIPRDQMLMRLSQVTREGKYVNSDVPKQLLYGTMVYVRQSIVADASKALSRAVCIAVRYSAIRKQFGSQDGGPETQVLNYRTQQSRLFPLLASAYAFRFVGDWLNWLYTDVTQKLEAKDYSTLQEAHACTAGLKAVTTSATADAIEECRKLCGGHGYLNSSGLPELFAVYVPACTYEGDNVVLLLQVARILMKTVSQLTSGKQPVGTMAYMGKVQHLMQSKCAVKTAEDWLNPAFIQEAFEARALRMAVNCAQNIGQAANQEEGFYERSPDLLESAVAHIQLIIVTKFIEKVQQDIPGHGVKEQLQNLCNVYALYILHKHLGDFLATGCITPKQGALANEQLGKLYAQVRPNAVALVDAFNYTDHYLGSVLGRYDGNVYPALYEEAWKDPLNETVVPEGYHEYLHPLLKQQLKLSRL

SEQ ID NO: 789 - DNA, 3102 bp, Panicum virgatum
  misc_feature: Ceres CLONE 1727919
  misc_feature: Encodes the peptide sequence at SEQ ID NO. 790
gctgatagagttagtcacacgcagcgcacaggaggccgggggatcggaggagagggattgtttgagagataaagagatttggggagacaaggagagagggacagagatggagaggagcagacggtctcggaggcaggccttgctttcacccccgcgcccggataacgatgtgcttgctaagctagttcctgctgcttcctcttaggttaaggtagctgcgggaggagttcgcgcccgggatcccgccgacgatgatggcagtggcgccgccggcatgggcatagcggcgccaccgtctcagccgggccagaccaccacgtacgtgaggagccaacccaacaagagcagcgcagcgatctccggccgcccggccaccgcgagttctatgtcccactcccagggattccaccagggcagcagcggcgtcttcggctactcctccgatggcttcgaccgcccggactccagccaggactacccgcagcagcacgtggcgcagcagagccgccgcgacaagctgagggtgcaggggttcgacccggcagccgccgccgccgccgggcgcggcctgctccccatcgagggcgacgagcacgccgagcccggggccatgtacgagcacgcggcggccgccggcgcttccaacatgctctccgagatgttcaacttccccgcgccgccatcggggccctccgccaccaagctgctggccagccagatgaacgccaactaccgcttcgggctgcggcaggggcccggaggggtggccggcttgtccggcgacggcggttggttcggtgctgctggcgcggcgggccgtgctggcttggtcctcggtggggccagcatggggtcgttaggtgaaacgtcctccccgaagcagcaaggcagcatggctggcctggccaccgacccggccgccgcgatgcagctcttcttgattaacccgcagcagcagtcgagatcgtcgccgacgtcgccgcagcagccgtcggacgtccagcagcaccacgaggcgttccaggcgttcggcggcggcgccgcggccgcgttcggctgcggcggggccggcggcgtcgtggaagggcagggcctgtccctgtcgctgtcaccgtcgctgcagcagctggagatggcgaagcaggccgaggagctgagggtccgggacggcgtgctctacttcaaccggcagcagcagcagcaggtgccgatggcattgcacggcggccaggtgggcgcgctggggcagcagctgcacgtggggtacggccccgccggcgtcgcgggcgtgctgcgcaactccaagtacacccgcgcggcgcaggagctcctggaggagttctgcagcgtggggcgcgggcagatcaagggcggcggcgggcgcggggcctcggcgtccaaccctagcgcgggcaagggcggcggcggcggcgcctccagctccggcgccgcgcagtccccgtcgtcggcgtccaaggagcccccccagctctcccccgccgaccggttcgagcaccagcgcaagaaggccaagctcatctccatgctcgacgaggtggaccgtcggtacaaccactactgcgaccagatgcagatggtggtgaacttcttcgactcggtgatggggttcggcgcggcgacgccgtacacggcgctggcgcagaaggccatgtcccggcacttccggtgcctcaaggacgcgatcgcgtcgcagctgcggcacacgtgcgaggtgctgggcgagaaggacgccggcaccagctcggggctgaccaagggcgagaccccgcggctgcgcgccatcgaccagagcctccgccagcagcgcaccttccaccacatgggcatgatggagcaggaggcctggcgcccccagcgcggcctccccgagcgctccgtcaacatcctccgatcctggctcttcgagcacttcctacacccgtacccgagcgacgccgataagcacctgctggcgaggcagacggggctgtccaggaaccaggtctccaactggttcatcaacgcccgtgtccggctatggaagcccatgatcgaggagatgtaccagcaggagtgccgggagctcgagggctcctcggccggcggcggggcccccgagtccggcaacgacccctcgggcgccgacgacacgcactccccgaccaccaccggcgccgtagcgcagcagctcccgcagcagcacggcacggcggcgcccggcatgatgatgccacacaagcccgacccgggcgccgcgggtccctcggcggcggacgcggccttcgtcgggatcgacccggtggagctcctcggcggcgacgcgcacgtgggcggcggcggcgccgacctgtacgggcggttcgagcccggggtgcgggtgcggtacgggcccggcgcgaccgccgccgctgccggcgacgtgtcgctgacgctgggcttgcagcacgccggcgccggcaacgccgggcctgacggcaccggccggttctccttgagagactacagcggctgttgatgcttattacacatcgctacatcacctttcatggctcatgcatgcgcgcatctatcgtgcattgggaacagtactgaggaaagatcaagagagagagagagagaacagtaaccagtagagagagagggggagggggaagggagctagacagagagagacgatgagcatctagaaagagaaaacttgcatggtgcctgctggagggtgatgcatgggatgggatatatgaatatgagatcattcacaaagacctcctcctccgatccttcttcgccttcttccgagatcgatgattcttaatttacttagctagcagattaattccttttgttaggcattattgttggggggttaaggataattaatttgtatacagaaaaggaagataggaagtgtataattgtttagtcacacttttttgttctctgttttgcatttgcccgtttttggttctggtgtaccaattttccccccttgtactcatttatttctttccttctctgtaactaaacataagagaaacacatacatgcatacgtaaatacatatattggtaaatattgggataaaaaaaaaaaaaaaaaaaa

SEQ ID NO: 790 - protein, 746 aa, Panicum virgatum
  misc_feature: Ceres CLONE 1727919
  misc_feature: Great-hit functional homolog of the protein sequence given in SEQ ID NO 9752
  misc_feature (1)..(59): Pfam Name: Homeobox Pfam Description: Homeobox domain
  misc_feature: The sequence is a functional homolog of  SEQ ID NO 2330 in the  10/374,780 US patent application
  misc_feature: The sequence is a functional homolog of  SEQ ID NO 236 in the  10/225,068 US patent application
  misc_feature: The sequence is a functional homolog of  SEQ ID NO 268 in the  10/412,699 US patent application
  misc_feature: The sequence is a functional homolog of  SEQ ID NO 588 in the  11/479,226 US patent application
  misc_feature: Useful for making plants with modulated biomass
  misc_feature: The plant is abnormally small.
  misc_feature: Useful for making plants with modulated growth and phenotype characteristics
MGIAAPPSQPGQTTTYVRSQPNKSSAAISGRPATASSMSHSQGFHQGSSGVFGYSSDGFDRPDSSQDYPQQHVAQQSRRDKLRVQGFDPAAAAAAGRGLLPIEGDEHAEPGAMYEHAAAAGASNMLSEMFNFPAPPSGPSATKLLASQMNANYRFGLRQGPGGVAGLSGDGGWFGAAGAAGRAGLVLGGASMGSLGETSSPKQQGSMAGLATDPAAAMQLFLINPQQQSRSSPTSPQQPSDVQQHHEAFQAFGGGAAAAFGCGGAGGVVEGQGLSLSLSPSLQQLEMAKQAEELRVRDGVLYFNRQQQQQVPMALHGGQVGALGQQLHVGYGPAGVAGVLRNSKYTRAAQELLEEFCSVGRGQIKGGGGRGASASNPSAGKGGGGGASSSGAAQSPSSASKEPPQLSPADRFEHQRKKAKLISMLDEVDRRYNHYCDQMQMVVNFFDSVMGFGAATPYTALAQKAMSRHFRCLKDAIASQLRHTCEVLGEKDAGTSSGLTKGETPRLRAIDQSLRQQRTFHHMGMMEQEAWRPQRGLPERSVNILRSWLFEHFLHPYPSDADKHLLARQTGLSRNQVSNWFINARVRLWKPMIEEMYQQECRELEGSSAGGGAPESGNDPSGADDTHSPTTTGAVAQQLPQQHGTAAPGMMMPHKPDPGAAGPSAADAAFVGIDPVELLGGDAHVGGGGADLYGRFEPGVRVRYGPGATAAAAGDVSLTLGLQHAGAGNAGPDGTGRFSLRDYSGC

SEQ ID NO: 791 - DNA, 1842 bp, Panicum virgatum
  misc_feature: Ceres CLONE 1727947
  misc_feature: Encodes the peptide sequence at SEQ ID NO. 792
gcagcagctcacactcaggcacgtcgagctcaaacgaaagatcccccccccccccccctctctccgaggcgcttggccaggccgaagccaagagtccccgcaacaatgacttccctctcctccgccgtggcattgccgtcctcgtgccgggcccgtccggcgggcggctgccggcgggcgcggctgctggtgacgcgggccgcggcgtcgagtcccaagctgccgaacgggcggcggctgcgggtggcggtggtggggggcggccccgcgggcggcgccgcggcggaggcgctggccaagggcggcgtggagacggtgctcatcgagcggaagatggacaactgcaagccctgcggcggggccatcccgctgtgcatggtgtcggagttcgacctgccgctggacctcgtggaccgcaaggtgaggaagatgaagatgatttcgccgtccaacgtcgccgtcgacatcggccgcacgctcgcgccgcacgagtacatcggcatggtcaggcgcgaggtgctcgacgcctaccttcgctcgcgggcccagtccgccggcgcggaagtcgtcaatggcctcttcctaaggtacgaggcgcccaaggaaccgaacggctcatacgtggtgcactacaaccactacgacagcagcaacggcaaggccggcggcgagaagcggtcgttggaggtggacgcgatcgtgggcgcggacggcgccaactcccgcgtggccaaggacatgggcgccggcgactacgagtacgccatcgcgttccaggagcgcgtcaagatccccgacgacaagatggcgtactacgaggagcgcgccgagatgtacgtcggcgacgacgtctcgcccgacttctacggctgggtgttccccaagtgcgaccacgtcgccgtcggcaccggtaccgtcacgcacaaggccgacatcaagaagttccaggccgccacgcgcctccgcgccaaggacaagatcgagggcggcaggatcatccgcgtcgaggcgcaccccatccccgagcacccaaggcccaagagggtggccgggcgtgtgacgctggtgggcgacgcggcggggtacgtgaccaagtgctccggcgagggcatctacttcgcggcgaagagcgggcggatgtgcgcggaggcgatcgtggccggctccgccaacgggacgcggatggtggaggagagcgacatgcgcaagtacctggcggagttcgaccggctctactggccgacctacaaggtgctcgacatcctgcagaaggtgttctaccgctccaacgcggcgcgggaggcgttcgtggagatgtgcgccgacgactacgtgcagaagatgaccttcgacagctacctctacaagcgcgtcgtgccgggcaacccgctcgacgacatcaagctcgccgtcaacaccatcggcagcctcgtcagggccaccgcgctgcgccgggagatggagaaggtcaccttgtgagccgccggatgcgacgtcgccgccgtcgagctgccattcacatgaggtgttcgagcgcagctgatcggtgtattagtagagattcgcggctgatcaagggcgcaaatttagactaacgggcgtaggcacggagaggaaaagacaggttgtgtaagttgagcaagtcaagtgctttctgcttctattggtctcgaccctgccctgttcttgtaaaacagagcatctggtgatgttgagaactcagagcagttcaattggatcactggagacgatgataaatttcgacgtgaatggatgtatcatacataaaactaaaactctgctttgattactgtatgctgtcaaaaaaaaaaaaaaaaaaaa

SEQ ID NO: 792 - protein, 457 aa, Panicum virgatum
  misc_feature: Ceres CLONE 1727947
  misc_feature (1)..(35): Pfam Name: Pyr_redox_2 Pfam Description: Pyridine nucleotide-disulphide oxidoreductase
MTSLSSAVALPSSCRARPAGGCRRARLLVTRAAASSPKLPNGRRLRVAVVGGGPAGGAAAEALAKGGVETVLIERKMDNCKPCGGAIPLCMVSEFDLPLDLVDRKVRKMKMISPSNVAVDIGRTLAPHEYIGMVRREVLDAYLRSRAQSAGAEVVNGLFLRYEAPKEPNGSYVVHYNHYDSSNGKAGGEKRSLEVDAIVGADGANSRVAKDMGAGDYEYAIAFQERVKIPDDKMAYYEERAEMYVGDDVSPDFYGWVFPKCDHVAVGTGTVTHKADIKKFQAATRLRAKDKIEGGRIIRVEAHPIPEHPRPKRVAGRVTLVGDAAGYVTKCSGEGIYFAAKSGRMCAEAIVAGSANGTRMVEESDMRKYLAEFDRLYWPTYKVLDILQKVFYRSNAAREAFVEMCADDYVQKMTFDSYLYKRVVPGNPLDDIKLAVNTIGSLVRATALRREMEKVTL

SEQ ID NO: 793 - DNA, 1516 bp, Panicum virgatum
  misc_feature: Ceres CLONE 1727950
  misc_feature: Encodes the peptide sequence at SEQ ID NO. 794
atttccctcctcgcttcctccatctacatctctcccctttccacctcgcacaccccagtccccgctgcccccacccaccccaccgcgaccatggcgagcgccgccgacgacctggacctcctgctctccctgtgggaggccgtcccggagacccctcccacctccccgcgcgccgccggtggccccgagtccgacggcgccttcacacctccaaggacggcgcggcccggcagcactgacatgtccgtcttccgcgatgccgtcaaggattacctcgaagcggcccccgaatccacctccccgctccccgagcgccccaagcggcccaaggccaccgaaaccctcgttgacaagtactccggcctccgcatcaggcacctgacgctctcacccctcgagatcagcaaccgcttcgctgacatccgattcgtgcgcatcacagcgataaagaactctgtggggagcgaaaggttctcgggctgttgggcaacggcgggggtgttgctagacaagggcgtgccgcgggtgagcgcgaaggggaccagctacagcatctggaagatgggcgccctggacgagactgaggtatcactgttcctctttggggatgcgcacgtccactactccggcgctgctgttggctcggtgttcgcgatattcaatggaaatgtccgcatggacaatgtgggcaaagggttctctgtgagtgttgcttcagtggggcagatgttgaagatgggagttgcagcagattttggtctctgcaaagggaagaggaaagacggggtggcttgcaccatggagataaataagagcaaaggagcatattgcaaatttcattcatcgaaaacatcacagaagtacactactggcagagtggagcttaagggtggaaacttccaatttgcttcaaaacttcgttctgaagggatttacatggtcaatccatcctcagaacgacccaacccaagaaagccaagccaaccagtgaaagtaatgtcaattgatgggctaaaaagggctttaagcaatgcagatagagtgactactaagaaccagtctcagggtataagattcctttctcatgttacagctaatttggacaatacgaaagcaactgtcaaaggcagtggatgtacgaaccaacagaaatcgaagtacagcttgaacaaaagttcggcatcatctggtgccaaagcaccacccaagcagggattagggaagccagaacaaggtttcaagagacggaaggtgaacaatccaccagggaatatcgttgagctcgatgcagtcagctcagacgatgatgagatcaatatagtactgcaacgctgattattgtattagaattttgaatgtactacaaacggataaacaatagtatttcaggaacgtttcaacgtttcacattgcttttaggaaagttttgtggccaaatatgtcacaatctgtacctgtagaaaaattatctgataaccatcattgaccattttctgaaaaaaaaaaaaaaaaaaaa

SEQ ID NO: 794 - protein, 414 aa, Panicum virgatum
  misc_feature: Ceres CLONE 1727950
  misc_feature (1)..(46): Pfam Name: zf-primase Pfam Description: Primase zinc finger
MASAADDLDLLLSLWEAVPETPPTSPRAAGGPESDGAFTPPRTARPGSTDMSVFRDAVKDYLEAAPESTSPLPERPKRPKATETLVDKYSGLRIRHLTLSPLEISNRFADIRFVRITAIKNSVGSERFSGCWATAGVLLDKGVPRVSAKGTSYSIWKMGALDETEVSLFLFGDAHVHYSGAAVGSVFAIFNGNVRMDNVGKGFSVSVASVGQMLKMGVAADFGLCKGKRKDGVACTMEINKSKGAYCKFHSSKTSQKYTTGRVELKGGNFQFASKLRSEGIYMVNPSSERPNPRKPSQPVKVMSIDGLKRALSNADRVTTKNQSQGIRFLSHVTANLDNTKATVKGSGCTNQQKSKYSLNKSSASSGAKAPPKQGLGKPEQGFKRRKVNNPPGNIVELDAVSSDDDEINIVLQR

SEQ ID NO: 795 - DNA, 1812 bp, Panicum virgatum
  misc_feature: Ceres CLONE 1727988
  misc_feature: Encodes the peptide sequence at SEQ ID NO. 796
aaaaatttgtctctccttatcctcttattcccccatcggccgcccccgctaccggcccgaggctcgcaccgccacccccgcctcaggcctccccggctccgcctcgggctcgcgccggcggccgctgcctcagcctcgggcctccgcctgcctggaggctcgagctcgcgtcggcagccttcgcctcaagctcgcgctggcggccaccgcctacgcctcgatctcgcgccggcggccgccgcctcctccgcctcgggctcgcgccggtggccgccgtctccgcattgggctcgtaccggcagcctctgctcgcgcagcgggcctaactgccgacgacgggacgcctagacatatcatcgagcgacggatccgacgcccgcgccatctctgccctatgctggcaccgggccggcgctggagaggagatatttggacctagctcacttggccggattgtgcttccggtttagttctggtgcctcgaatccaagtctcccgttttcttcgttccattactgcgcagtttatttcccaagaatttggtggttcgactgaacctctatgccccacgtgaagtccgccgctgcttcggacgggccgccgctacaggacgcatggcacgccgagtttcaacgcctcgtcccgctgtgggagtcgctgcgcaatacatccgaggtcattatcccaatttcaatatctagggtgaaccagtttgatgctgcaagactagatgttgagatgtctgccatgttgaaagagcaactagtcaaagtgttctctttaatgaagccaggattcttattccaatatgagcctgaactcgatgctttcctcgaattcctcatctggaggttctcgatttgggttgacaagccaaccccaggcaatgcactcatgaacctaaagtatagagatgagcgggcagcgcccatcactggaaaagaagtaagaacaggtttggaaggacctgggctttctgtttctcaaaagatattttactgtgttagctttgttggtggccaatatatatggtcaagattgcagtctttttctgctttccgtcgatggggtgattctgaacagagaccactagcacgctgcacctggggcttagtgcaaaatgctgaaggattgtacaaagccgcttcattctttaacctgttattgttcctttatggtggaaggtacaaaactatcgtagaaagaattctgaaagcaagacttgtttacgagagccccaacatgaatagagctgttagctttgagtacatgaatcggcagctagtttggaatgagttttcggaaatgctgcttttgcttcttccgctcttaaactcgtcctcagtaaagaagttccttctccctttctccaaagataactcggcaggttcttctggtgaggaagcagattgtcctatatgtcggtccagtcctagcattccttttgtagcccttccatgtcagcacaggtactgctattattgtctacgcacacggtgttcagctacgagttcttatagatgcccacgttgtaacgaggtggttgttggaattcgaagacaaggatcagtttagtttacttagtctggttcaagaattcttgcccatgtacacaagactagccccattgatcttcgtacctaaaagtttagatgcccccatcgaggatgtgcatcatgacatgtacatttaatggcccaagtatgaactgttttgatgccatgaatgctagttgtatatggaatgaatgtcacatttgtattttattgagtaaactctgcacattgtacacaaaaaaaaaaaaaaaaaaaa

SEQ ID NO: 796 - protein, 337 aa, Panicum virgatum
  misc_feature: Ceres CLONE 1727988
  misc_feature: Great-hit functional homolog of the protein sequence given in SEQ ID NO 9473
  misc_feature (1)..(41): Pfam Name: zf-C3HC4 Pfam Description: Zinc finger, C3HC4 type (RING finger)
  misc_feature: Useful for making plants with modulated low light sensitivity
MPHVKSAAASDGPPLQDAWHAEFQRLVPLWESLRNTSEVIIPISISRVNQFDAARLDVEMSAMLKEQLVKVFSLMKPGFLFQYEPELDAFLEFLIWRFSIWVDKPTPGNALMNLKYRDERAAPITGKEVRTGLEGPGLSVSQKIFYCVSFVGGQYIWSRLQSFSAFRRWGDSEQRPLARCTWGLVQNAEGLYKAASFFNLLLFLYGGRYKTIVERILKARLVYESPNMNRAVSFEYMNRQLVWNEFSEMLLLLLPLLNSSSVKKFLLPFSKDNSAGSSGEEADCPICRSSPSIPFVALPCQHRYCYYCLRTRCSATSSYRCPRCNEVVVGIRRQGSV

SEQ ID NO: 797 - DNA, 1786 bp, Panicum virgatum
  misc_feature: Ceres CLONE 1727993
  misc_feature: Encodes the peptide sequence at SEQ ID NO. 798
aagccagccaccactaggcactagctagtgtcactttactgtgaccgaccgaccgacccacccaccgtcgtcaccgtaccttcgttcccatccatggagctgctcgctctgctcacggtgctgctgctggcgcacgccgccgcgtacctggcgtggcaggccgtgtcgcgccgccgccgcgcgtgctgctacctgctggactacgcctgccacaagccctccgacgaccgcaaggtcaccaccgagacggccggcgccgtcatcgagcgcaaccagcgcctcggcctccccgagtaccgcttcctcctcaaggtgatcgtcaactccggcatcggcgagcgcacctactgcccgcgtaacgtcctcgagggccacgaggagcgccccaccctcggcgacgcgctcgaggagatggacgacctgttcgccgacgccgtcgccgccgtcctcgccaagactggcgtcgccgcgcgcgacgtcgacctggtcgtcctcaacgtcggctccttcgccccggcgccgtcgctggtgtccagggtcgtgcgccgcttcggcatgcgggaggacgtgatggcctacaacctctccgggatgggctgcagcgcggggctcatcgccgtcgacctcgcccggaacgtcatgctcacgcgcccgcgcaccatggcgctcctcgtcacctccgagtcgtgcgcgcccaactggtacgtcggcaccgacaagtccatgatgctcggcaactgcctcttccgctgcggcggcgccgccgcgctgctcaccaacgacccggcgttccgggcgcgcgccaagatggagctccgctgcctcgtgcgcgccaacatcgccgcgcacgacgacgcgcacgccgccgccgtgcaccgcgaggacgccgacggccgcctcggcgtcagcctcagcaaggcgctccccaaggccgccgtgcgcgccttcacggagaacctccagcgcctggcgccgcgcatcctcccggcccgcgagctcgcacggttcgcgtgccgcctcctcgcccgcaagctcctccggcgcaaggcggcggcggcggccaagggggagggccccaagatcgacttcaagagcggcgtggaccacttctgcctccaccccggcgggacggcggtgatcgaggcggtgcggaagagcctggtgctgagcgcccacgacgtggagccggcgaggatgacgctgcaccggtggggcaacacgtcggcgagcagcctctggtacgtgctctcctacatggaggccaagcggcggctgaagcgcggggacagggtgctcatgctcaccttcggctccggcttcaagtgcaacagctgctactgggaggtgagcagggacctcgccgacgccggcgcctgggaggactgcatcgccgagtacccgccggagaccctggtgaacccctacatggacaagttcggctgggtcaacgacgtccagggccagggagacggcttcgtcttttaataatggcatttgtttttttcttaatttgcgcgtgagttgttaaatatttattaaatttgtcactcggctatccttctgcgcggtggtgggcaaagcaaaattaaggttaataatttgttactgcattgtttaattaattggaaggtcaacaaggtgtacgtaggtatacggatacaaatgggttgggggctagctgttgtaattctttttctttctttctttcgttctttgtctcgtactatttctatattcacacctgtaaatgtttaggggtcgcatgcaaaaaaaaaaaaaaaaaaaa

SEQ ID NO: 798 - protein, 463 aa, Panicum virgatum
  misc_feature: Ceres CLONE 1727993
  misc_feature (1)..(292): Pfam Name: FAE1_CUT1_RppA Pfam Description: FAE1/Type III polyketide synthase-like protein
MELLALLTVLLLAHAAAYLAWQAVSRRRRACCYLLDYACHKPSDDRKVTTETAGAVIERNQRLGLPEYRFLLKVIVNSGIGERTYCPRNVLEGHEERPTLGDALEEMDDLFADAVAAVLAKTGVAARDVDLVVLNVGSFAPAPSLVSRVVRRFGMREDVMAYNLSGMGCSAGLIAVDLARNVMLTRPRTMALLVTSESCAPNWYVGTDKSMMLGNCLFRCGGAAALLTNDPAFRARAKMELRCLVRANIAAHDDAHAAAVHREDADGRLGVSLSKALPKAAVRAFTENLQRLAPRILPARELARFACRLLARKLLRRKAAAAAKGEGPKIDFKSGVDHFCLHPGGTAVIEAVRKSLVLSAHDVEPARMTLHRWGNTSASSLWYVLSYMEAKRRLKRGDRVLMLTFGSGFKCNSCYWEVSRDLADAGAWEDCIAEYPPETLVNPYMDKFGWVNDVQGQGDGFVF

SEQ ID NO: 799 - DNA, 2035 bp, Panicum virgatum
  misc_feature: Ceres CLONE 1728005
  misc_feature: Encodes the peptide sequence at SEQ ID NO. 800
atactcaaagttcacacagccgcgcagtgcgtgcctcgttgcgtccgcctcgaatccggcggcggcggcaggggagatggaggcagcggctgcgggcggagggggcgggaggtggtgcgtggtgactggcggccgcggcttcgcggccaggcacctggtgacgatgctgctccgctccggcgagtggcgggtgcgcgtggccgacctggcccccgccatcgcgctcgaccgcgacgaagaggaggagttcctgggcgccgcgctccgcgaaggccaggctgcctacgtctccgcggacctccgcgataaggcccaggtcgccagagcttttgaaggggcagaagtagttttccatatggctgctccagattcatccatcaacaacttccaccttcattattcagtcaatgttgagggaacgaaaaatgttattgatgcttgtatccgttgcaaggtgaagagactcatctacactagttcaccgagtgtcgtatttgatggagttcatggaatttttaatgcagatgaatcaatgccttacccagataagtttaatgattcatattcagaaacgaaggcagatggagaaaaactggtgatgagggctaatggtagggaagggcttcttacttgttgtatacgcccaagtagcatttttggccctggcgataaactactggttccatctctggttgctgctgcaagggcagggaaatccaaatacattattggtgatgggaacaactactatgatttcacctatgtggaaaatgtggcatatggtcatatttgtgcagagaaaactctatcatctgaagatggtgcaaagatagctgctggaaaagcctatttcataacaaatatggagcccatcaaattctgggagttcatgtcattgattttagaaggtcttggatatgaaaggccttcaataaaaatacctgtctctgttatgatgccagtggctcatgttgtagaatggacttacaagaaatttgccaagtacgggatgaaagttcctcagctgaccccttcaaggattaggctgctctcgtgtaacaggacattcagctgctcaagagcaaaggaccagcttggttatgagcccattgtgccccttaaggaaggactgaagagaacagtagaatcatacccccatctacgagctcagaatcagagaagcatatcaaaggcgtcagttttccttgggaatggaaatctggcaaaaacattactttgggaagatacgaagcaaacagtgacagtgctactgctattggctgttatctactaccacttgtttacatgtggttacaccttcatcacagctatggcaaagcttttgtcactgactgcattgtttttattcattcatggcatgctgccagcaaatgtatttggccacaaggttgagaaacttgaggcctcaaattttcacatcacagaggtggaggcccatcgtgtagctcattccatcagctcgtcttggaactctgtagtcggtgctctaagatctctttgcagaggaaatgattggccactgtttttcaaggttgcattatctctgttggttgtcagcattcttagttcaatgtcgtcgcaggctgccttcaaaataggtactgctctggttttcactggcttcaaagcatatgagaaatgggaggacaccatcgacagcatggttggcgacgtgtgctctattcttctgcacattggttctactaagaaatcttccagccaggaacaaatgtagatgtggatcttccaaacgatcagttgcttcatttagtgctattgtattgctgttcagctgtttcttgtttgtacgcctggaatttctctgtattcttttattgatgtaacagaattacctagcggctgataaggaacattccttaggtaattgtctagtagatgtatggtatgaaactgtatgcttagtatgagaggttctcttctaatttatattgcttgacagataaattcatcttgcaataagtttgctgaatggcaaaaaaaaaaaaaaaaaaaa

SEQ ID NO: 800 - protein, 559 aa, Panicum virgatum
  misc_feature: Ceres CLONE 1728005
  misc_feature (1)..(276): Pfam Name: 3Beta_HSD Pfam Description: 3-beta hydroxysteroid dehydrogenase/ isomerase family
MEAAAAGGGGGRWCVVTGGRGFAARHLVTMLLRSGEWRVRVADLAPAIALDRDEEEEFLGAALREGQAAYVSADLRDKAQVARAFEGAEVVFHMAAPDSSINNFHLHYSVNVEGTKNVIDACIRCKVKRLIYTSSPSVVFDGVHGIFNADESMPYPDKFNDSYSETKADGEKLVMRANGREGLLTCCIRPSSIFGPGDKLLVPSLVAAARAGKSKYIIGDGNNYYDFTYVENVAYGHICAEKTLSSEDGAKIAAGKAYFITNMEPIKFWEFMSLILEGLGYERPSIKIPVSVMMPVAHVVEWTYKKFAKYGMKVPQLTPSRIRLLSCNRTFSCSRAKDQLGYEPIVPLKEGLKRTVESYPHLRAQNQRSISKASVFLGNGNLAKTLLWEDTKQTVTVLLLLAVIYYHLFTCGYTFITAMAKLLSLTALFLFIHGMLPANVFGHKVEKLEASNFHITEVEAHRVAHSISSSWNSVVGALRSLCRGNDWPLFFKVALSLLVVSILSSMSSQAAFKIGTALVFTGFKAYEKWEDTIDSMVGDVCSILLHIGSTKKSSSQEQM

SEQ ID NO: 801 - DNA, 1419 bp, Panicum virgatum
  misc_feature: Ceres CLONE 1728010
  misc_feature: Encodes the peptide sequence at SEQ ID NO. 802
gtgcaagcgccctgctctgctctcactaaggctcgctctgttccgaagctccgagctgaggtgccggtgtttggattgcgtgggcagcatgaggatgagggtggcggcggcgctggcggcgctgctgtgcgcgtcgtgggcggcggcggcggcggcgcagaagtacaatgccttcttcaacttcggcgactccatcaccgacaccgggaacctctgcaccaacgggaagccgtcgcagatcaccttcacgcagccgccctacggcgagacctacttcggcacgcccacctgccgctgctgcgacggccgcgtcatcgtcgacttcctcagcaccaagttcgggctgccgttcctgccgccgtccaagtcgacgtcggcggacttcaagaagggcgccaacatggcgatcaccggcgccaccgccatggacgcgcccttcttccgctcgctggggctctccgacaagatctggaacaacgggcccatcagcttccagctccagtggttccagcagatcgcctcctccgtctgcggacaggactgcaagagctacctggccaactccctgttcgtgttcggcgagttcggcggcaacgactacaacgccatgctcttcggcaactacaacaccgaccaggcgagcacgtacacgccgcagatcgtgagcaccatcgccgccggcgtggagaagctggtggcgctgggggcgaaggacgtggtggtgcccggggtgctccccatcggctgcttccccatctacctcaccctctacggcacctccaacagcggcgactacgacggcctcggctgcctcaagaagttcaacgacctctccacgaaccacaacaaccagctcaaggcccagatcgccagcctccaggccaagtacccctccgcccgcatcatgtacgccgacttctactccggcgtctacgacatggtcaggagccccggcagctacggcttcagcacggcgttccaaacgtgctgcggcgccggcggcggcaagttcaactaccaaaacagcgcgcggtgcgggatgtcgggcgcggcggcgtgctccaacccggcgacgcacctcagctgggacggcatccacctcaccgaggccgcctacaagcagatcaccgacggctggctcagcggcgcctactgcagcccggccatcctccacagctaggaggggaccaccaagaccggcccaaccccattaaaaatactttatttttatcatcactattaaattatctgcgtctgcgttgccggagaggaaaaggcgtctcgatcggcaacggcggcagcatgtggcataacaatctttatacatgttcgtcgttcctcctttgctgtaacctgtcaccggttttcaatcacaaataaatcgaaatggtataggttcaaaaaaaaaaaaaaaaaaaa

SEQ ID NO: 802 - protein, 363 aa, Panicum virgatum
  misc_feature: Ceres CLONE 1728010
  misc_feature (4)..(295): Pfam Name: Lipase_GDSL Pfam Description: GDSL-like Lipase/Acylhydrolase
MRMRVAAALAALLCASWAAAAAAQKYNAFFNFGDSITDTGNLCTNGKPSQITFTQPPYGETYFGTPTCRCCDGRVIVDFLSTKFGLPFLPPSKSTSADFKKGANMAITGATAMDAPFFRSLGLSDKIWNNGPISFQLQWFQQIASSVCGQDCKSYLANSLFVFGEFGGNDYNAMLFGNYNTDQASTYTPQIVSTIAAGVEKLVALGAKDVVVPGVLPIGCFPIYLTLYGTSNSGDYDGLGCLKKFNDLSTNHNNQLKAQIASLQAKYPSARIMYADFYSGVYDMVRSPGSYGFSTAFQTCCGAGGGKFNYQNSARCGMSGAAACSNPATHLSWDGIHLTEAAYKQITDGWLSGAYCSPAILHS

SEQ ID NO: 803 - DNA, 1832 bp, Panicum virgatum
  misc_feature: Ceres CLONE 1728029
  misc_feature: Encodes the peptide sequence at SEQ ID NO. 804
gagctgctgactgtgagccgctaggcccagaagcctgccgtgccgtcctctgaatctctgatcccctgctgcacatgcgtctctccgctagctcttcctcctctcccagcctcacctcacatgctcgaatggcgacaatggcagcagcgcgtcttcttccccggtcgtcctcgtccaagctccagcagtgcagctttgctgtcctcctcctcttcttcttccagagctcgtgctgccacgcagcggctgtgggttacagccagcaggagggcgaccgggtgcggttcctccccgggcagccgccgcacccgccggtgtcgcagttcgcggggtacgtcacggtgaacgagcgcaacgggagggcgctcttctactggttcttcgaggcccaggcgtcgccggcgaaaaagcctctcctgctctggctcaatggaggacctggttgctcatcagttgggtatggagctgcttctgagttggggcctctcagggtcaccagccacggggcagggcttgagttcaacaagtttgcatggaacagagaggccaacttgctcttcctggagtctcctgttggggtcggcttctcctacaccaatacatcctctgacctgaccaaacttgatgacgccttcgtaggtcactatgttccacaacttgctgaacttgtctatgataggaacaaagataaggccagcacatatatcaaccttaaaggtttcatggttgataatccactaactgatgattactacgactcaaaggggctagctgaatatgcttggagccactcagtagtgtcagatgaaatttacgagcgcatcaagaaggtgtgtgacttcagaatttcaaactggtccgatgattgtgataaagccatgagcactgtgttcagccagtaccacgagatcgatatttacaacatctatgcacccaggtgcaatcttcctaagtcatcagcagcacttgctgttgatcaagcacttacagctaacgatcaggaacatttcaggcgtaggattaggatgttctcgggatatgacccatgcttttcttcatatgcggagaggtacttcaataaggaagatgtgcagagagcattccatgcaaatgtcagtggaactcgaaaatggcaagtttgcagtgactcaattttaaggtcatacaatttttcggtactttccatcttacccatctactctaagctcatcaaagccggattgagagtctggctttacagtggagatgctgatggtagggtcccagtgataggatcgcggtattgtgtggaagccctgggcctgcctatcaagacacagtggcaaccttggtacctgaacaaacaggttgcgggaagatttgtggagtaccacggtataacaatggttacaatcagaggagctggccatttggtgcccctcaacaaaccagaagaagggctcgcgcttattgacacattcctcctggggaaacagcttcccacacacagatgacaagaacgtttagggtcgcggtgcttgttgtggtcatacaccacttctgccagctgaggaacataatggcctgttgcatcaaagttggtcagtgtcttaatcataaatactgtatggtgttacacgtgtttcacacattatattagtgactagtgagtgtggctagccgcatagacctcatatttttgtgcatgaccagttggataaccaccatgcaatgcttgaatcttcatatttttctccctatattttctttgatcagacactttcctatcctttgaccctcaatattattaatttggtttcttagttttttggtaaaaaaaaaaaaaaaaaaaa

SEQ ID NO: 804 - protein, 472 aa, Panicum virgatum
  misc_feature: Ceres CLONE 1728029
  misc_feature (146)..(428): Pfam Name: Peptidase_S10 Pfam Description: Serine carboxypeptidase
  misc_feature (144)..(427): Pfam Name: Peptidase_S10 Pfam Description: Serine carboxypeptidase
  misc_feature (137)..(429): Pfam Name: Peptidase_S10 Pfam Description: Serine carboxypeptidase
MRLSASSSSSPSLTSHARMATMAAARLLPRSSSSKLQQCSFAVLLLFFFQSSCCHAAAVGYSQQEGDRVRFLPGQPPHPPVSQFAGYVTVNERNGRALFYWFFEAQASPAKKPLLLWLNGGPGCSSVGYGAASELGPLRVTSHGAGLEFNKFAWNREANLLFLESPVGVGFSYTNTSSDLTKLDDAFVGHYVPQLAELVYDRNKDKASTYINLKGFMVDNPLTDDYYDSKGLAEYAWSHSVVSDEIYERIKKVCDFRISNWSDDCDKAMSTVFSQYHEIDIYNIYAPRCNLPKSSAALAVDQALTANDQEHFRRRIRMFSGYDPCFSSYAERYFNKEDVQRAFHANVSGTRKWQVCSDSILRSYNFSVLSILPIYSKLIKAGLRVWLYSGDADGRVPVIGSRYCVEALGLPIKTQWQPWYLNKQVAGRFVEYHGITMVTIRGAGHLVPLNKPEEGLALIDTFLLGKQLPTHR

SEQ ID NO: 805 - DNA, 2073 bp, Panicum virgatum
  misc_feature: Ceres CLONE 1728040
  misc_feature: Encodes the peptide sequence at SEQ ID NO. 806
tcatcttgatttccttcttcaccccctcgcaattcgcaaagccgcgcactgcatcgtcgatcggcttccccacctgtcgcctccggctcactttccgccaccacctggctgctctgcatacaagaggttgcctccatctcttctctagtagtgacttccaaagatcttcctaaacttcttgagattggttgtgcagtaaactaagatggtgaagatctgctgcattggagctggctatgttggtggccctacaatggctgtcattgccctcaagtgcccagcaattgaagttgttgttgttgacatatccaagcctcgcattgaagcttggaacagcgaccagctcccaatctatgagcctggtcttgatgatgtcgtgaagcagtgcaggggcaggaacctcttcttcagcactgatgttgagaagcatgttgctgaggcagacatcatttttgtctcggttaacactcccaccaagacccgtgggcttggagcaggcaaggctgccgatctcacctactgggagagtgctgcccgtatgattgctgatgtctccaagtcagacaagatcgttgttgagaagtccactgtcccagtaaagacagcagaggctattgaaaagattttgactcacaatagcaagggcatcaactaccagattctctcaaacccagagttccttgcggagggcacagcgattgaggacctcttcaagcctgacagagttctcatcggtggccgggagactcctgagggcaggaaggccgttcaggctcttaaggatgtgtatgcccactgggttcctgaggacaggatcctcaccaccaacctgtggtctgccgagctctccaagcttgctgcgaatgcattcttggcccagaggatctcctctgtgaatgccatctcggcactctgtgaggccactggtgccaatgtatctgaggtggcttacgccgttgggaaggactcaaggattggccccaagttcttgaacgccagtgttggctttggtgggtcctgcttccagaaggacatcctgaacttggtctacatctgtgagtgcaatggccttcccgaggtgtccaactactggaaacaggtcatcaagatcaatgactaccagaagagccggtttgtgaaccgtgttgtttcctccatgttcaacactgttgctggcaagaagatcgccgttcttggttttgccttcaagaaggataccggtgacacgagggagaccccagccattgatgtgtgcaagggcttgctgggtgacaaggctcagatcagcatctatgacccccaagtcactgaggatcagatccagcgggacctcgccatgaacaagttcgattgggaccatccgatgcacctgcagcctacaagccccagtgctgtgaagcaggtgagcgtggtctgggatgcatacgaggccaccaagggcgcccatggcctctgcatcctcaccgagtgggacgagttcaagaccttggactaccagaagatctttgacaacatgcagaagccagcttttgtctttgatgggcgcaacattgttgacggtgagaagctcagggagattggcttcatcgtctactcaattggcaagccacttgatgcttggctgaaggatatgcctgctgttgcttaatttcccagatttccatcgcaagcgtgccacttgaactgcaggaagtctaccaagaagaggaattgtttgaccattctttatagtttgcttttgctggaggcacggcaattctctcaggcacaaaattggatgttagtatctccgtttatgtttgaatggtcgcagcagccatagcccggttgccagttgtattcatgttcatcgttctttgtttattcatttaccgtttggtttctgctccatcaccaaatataagctagttttaagttacatagtattttgcaaagatatggtcactcctagttatgccttcttatgtttatacatttgtctttgttcagtctatgcatgcttcctctgttcgaacactaatggatgtcaattaatggtgggtgcagttctaacaaaaaaaaaaaaaaaaaaaa

SEQ ID NO: 806 - protein, 480 aa, Panicum virgatum
  misc_feature: Ceres CLONE 1728040
  misc_feature: Great-hit functional homolog of the protein sequence encoded by LOCUS At1g26570
  misc_feature: Great-hit functional homolog of the protein sequence encoded by LOCUS At3g29360
  misc_feature: Great-hit functional homolog of the protein sequence encoded by LOCUS At5g15490
  misc_feature: Great-hit functional homolog of the protein sequence encoded by LOCUS At5g39320
  misc_feature (1)..(199): Pfam Name: UDPG_MGDP_dh_N Pfam Description: UDP-glucose/GDP-mannose dehydrogenase family, NAD binding domain
  misc_feature (1)..(480): SWISSPROT Homolog: EC 1.1.1.22 UDP-glucose 6-dehydrogenase
  misc_feature (2)..(467): SWISSPROT Homolog: EC 1.1.1.22 UDP-glucose 6-dehydrogenase
  misc_feature: Useful for making plants with altered cell wall content and/or composition
MVKICCIGAGYVGGPTMAVIALKCPAIEVVVVDISKPRIEAWNSDQLPIYEPGLDDVVKQCRGRNLFFSTDVEKHVAEADIIFVSVNTPTKTRGLGAGKAADLTYWESAARMIADVSKSDKIVVEKSTVPVKTAEAIEKILTHNSKGINYQILSNPEFLAEGTAIEDLFKPDRVLIGGRETPEGRKAVQALKDVYAHWVPEDRILTTNLWSAELSKLAANAFLAQRISSVNAISALCEATGANVSEVAYAVGKDSRIGPKFLNASVGFGGSCFQKDILNLVYICECNGLPEVSNYWKQVIKINDYQKSRFVNRVVSSMFNTVAGKKIAVLGFAFKKDTGDTRETPAIDVCKGLLGDKAQISIYDPQVTEDQIQRDLAMNKFDWDHPMHLQPTSPSAVKQVSVVWDAYEATKGAHGLCILTEWDEFKTLDYQKIFDNMQKPAFVFDGRNIVDGEKLREIGFIVYSIGKPLDAWLKDMPAVA

SEQ ID NO: 807 - DNA, 1094 bp, Panicum virgatum
  misc_feature: Ceres CLONE 1728043
  misc_feature: Encodes the peptide sequence at SEQ ID NO. 808
aggccagaaccttcttctcttcttctctctcttcccgcaggaggaggaggcggaggcggaggcggagccgaggaggaggaggaggcctgcctgtggctgccgtccctgagctcgccctacatcctgcgtccccccaaccccatgtcgtcgccgcctgcggacgacgacgaggaggaggccacagacgtgcagaccgaggaggaagaatggggcgacgaggctctccccggagctagggtttcggcggcggcggatgaagatcacagcggggagactaggaccacctgctgcgtgtgtatggagccatccacctgcagcggcgcgcatcgtctctgttgcattccctgtggacatgtgtatggcagatcgtgcctggagaattggctgattgcttgcggcaacacaagcgcaaagtgccctcagtgtggtaaagcatttgaacgcaagcatattatcaacctctacataccagggaatctctgggatggttgctgccgcatacaggaagtagaagcacattattctagggttgccaagtatttagcagagcttgcgcctttagcaagacggcatgcttctgaagccaagtcagaagcgcaatttgtgtctgaagttgctgacaagctagaagtgctagctcagtctgtcggtgccaagtcagaagcgcaatttgtgtctgaagttgctgacaagctagaagtgctagctccgtctgtcggtgccgaggaccaggccgtggataagaagttggttcaggatgtattggcgacggttatgactagctactcatcagtgaaggggcaggtggagatggcgcgtagacactatgaggacctaatcgagttcattgttcagagcttcgatggactgctgtaactccattattggaaatgatgagtggtggtgatcgtgccttttaattttgcaattgccatactgatcaggtgccttttttgtcgtacttgcatagcatctgattctgatgtgtgtgtatatatgtgaccagcgctgctgagacttggggatatatgtgtctacaagtgtgtaacttcattttattggaaatgatgagtggtgatcgtgccttttaattt

SEQ ID NO: 808 - protein, 244 aa, Panicum virgatum
  misc_feature: Ceres CLONE 1728043
  misc_feature (1)..(47): Pfam Name: zf-C3HC4 Pfam Description: Zinc finger, C3HC4 type (RING finger)
MSSPPADDDEEEATDVQTEEEEWGDEALPGARVSAAADEDHSGETRTTCCVCMEPSTCSGAHRLCCIPCGHVYGRSCLENWLIACGNTSAKCPQCGKAFERKHIINLYIPGNLWDGCCRIQEVEAHYSRVAKYLAELAPLARRHASEAKSEAQFVSEVADKLEVLAQSVGAKSEAQFVSEVADKLEVLAPSVGAEDQAVDKKLVQDVLATVMTSYSSVKGQVEMARRHYEDLIEFIVQSFDGLL

SEQ ID NO: 809 - DNA, 2024 bp, Panicum virgatum
  misc_feature: Ceres CLONE 1728049
  misc_feature: Encodes the peptide sequence at SEQ ID NO. 810
tcccctgattatcttacatcttaggaggaggaggaggagcaaagtagtggtcgggcgaaaggcctttggtggccgccaggagggaataatcaatcaatccatcgctgcacttggggttctccaacaaattcatcctccagaccatcaaccaatttgaccggaaagaagattggattggattcccacagagccaaagcaatggatgtcaacgctccctccccttcctcttcgtcatcgtcgtgcaccaccccggagacagaggacctgcaattcgacgacggccaccacgagagggcgccgctcctgctgcccaccaagatcatggacgccgccgacgagaagggcgagaggcccgacctctccgaggatacggcccaccagattagcgttgatccctggtatcaagttgggttcgtcctcataaccggggtcaacagcgcatatgtgcttggatactctggctctgtaatggtccctttaggctggattgccgggacatgtggcctcctcctagctgctgccatatccatgtatgctaatgcgcttcttgcacgactccatgaagttggtggcaaacgccatatcagatacagagatcttgctgggcacatatatggaagaaaaatttatggactcacatgggctctgcaatacgttaatcttttcatgatcaacacaggttttatcatcttagctgggcaagctctgaaggcaacatatgcactctttagggatgatggagctctaaagcttccttactgcattgcaatatcaggattcgtctgtgctctttttgcctttggaattccttatctatctgccctcagggtttggttggggttctccacacttttcagccttatctatattgtcatagcgtttgtgctatcactgagagatggaatggccgcgcctgcaagggattatagtattcccggatcacacggaattcgaatcttcactacaataggtgctgtagcagaccttgtgtttgcttacaacactggaatgctgcctgaaattcaagcaaccataaggcctcctgtggtcaagaacatggagaaagctttgtggttccagttcactgttggctcgttgcctctgtacgccgtaacctttatgggttactgggcttatggttcctcaacatcaagttatctactgaacaacgtcaagggcccggtctggataaaagccactgcaaatatgtcggcctttcttcagaccgtcatagcgttacacatatttgcgagcccaatgtatgagtttttggacacaaagtatggaagtgggcgtggcggtccttttgcattccacaacttggtgttcagagtagttgtcagaggaggctacctgacggtgaacacgttggtggcagcggtgctcccgttccttggtgacttcatgagcctgacgggcgccctcagcaccttccccctgacgttcgttcttgcaaatcacatgtacctgatggtgaagggccataagttgtctgccatccagaaatcctggcactggctgaatctaattgggttcagcggattggctgttgcagccgcggtcgcggcaataaggcttatcatgcttgattctaccacctaccacttcttcgctgatctttgaggccaggtttagtttctcggtctggtggcgatttggagcattggcttgataggtcagttgaaagatttaaaaaaaattttgtttcgttttgggtgggctggggaagatatggtaatagaaacggtgaattcaagcaataaaatgaagaccacagatgcgcatgcaagatttggttgttcagattcggtatgcagagaatatgtttggtgtgcattgcgcacggacaagtggagaactgaactatatatgttggtattggtatactgacgaactaagacactggaagaataatgtagtagtaggttcgtaataagtactagttgtaatttcaggccttattacagcccaggattattagttgaaatgaagggttatgatgtcaaaaaaaaaaaaaaaaaaaa

SEQ ID NO: 810 - protein, 474 aa, Panicum virgatum
  misc_feature: Ceres CLONE 1728049
  misc_feature: Great-hit functional homolog of the protein sequence encoded by LOCUS At2g36590
  misc_feature: Great-hit functional homolog of the protein sequence given in SEQ ID NO 9718
  misc_feature: Useful for making plants with altered carbon content
  misc_feature: Useful for making plants with altered nitrogen content
  misc_feature: Useful for making plants with modulated nitrogen use efficiency
  misc_feature: Useful for making plants with modulated oxidative stress sensitivity
MDVNAPSPSSSSSSCTTPETEDLQFDDGHHERAPLLLPTKIMDAADEKGERPDLSEDTAHQISVDPWYQVGFVLITGVNSAYVLGYSGSVMVPLGWIAGTCGLLLAAAISMYANALLARLHEVGGKRHIRYRDLAGHIYGRKIYGLTWALQYVNLFMINTGFIILAGQALKATYALFRDDGALKLPYCIAISGFVCALFAFGIPYLSALRVWLGFSTLFSLIYIVIAFVLSLRDGMAAPARDYSIPGSHGIRIFTTIGAVADLVFAYNTGMLPEIQATIRPPVVKNMEKALWFQFTVGSLPLYAVTFMGYWAYGSSTSSYLLNNVKGPVWIKATANMSAFLQTVIALHIFASPMYEFLDTKYGSGRGGPFAFHNLVFRVVVRGGYLTVNTLVAAVLPFLGDFMSLTGALSTFPLTFVLANHMYLMVKGHKLSAIQKSWHWLNLIGFSGLAVAAAVAAIRLIMLDSTTYHFFADL

SEQ ID NO: 811 - DNA, 1647 bp, Panicum virgatum
  misc_feature: Ceres CLONE 1728062
  misc_feature: Encodes the peptide sequence at SEQ ID NO. 812
gtccctccggccctcccctaccaaactcccctctctctcgccgcgcaacagcaccaccacgcgctgccgaatcgctgtgtcatggaggtcgccggcgcccgcgggtccggcggcggcggcggcggcggaccggcgccgttcctgctgaagacgtacgagatggtggacgacccgtccagcgacgcggtggtgtcgtggagcgacgcctctgacgggagcttcgtggtctggaacccgcccgagttcgcggcccggatgctgcccacctacttcaagcacagcaacttctccagcttcatccgccagctcaacacctacggatttcgcaaaattgacccggagcgctgggaatttgctaatgagtactttgtcaagggacagcagcacctgctgaagaatatccacaggcgaaagcccatccacagccacagccatcaacctggtgccctgcctgacaatgagcgtgcattatttgaggatgagattgaccggctttcacaggagaaagctgcccttcaggctgacctctggaagttcaatgagcagcagtcgggggccgtgagccagattgaatatcttgagcagcgggtgctcgacatggagcaacggcaggtcaagatgctcagcttcctgcagcaggctagcaagaaccctcagtttgtcagcaagctcgctaagatggcagagacctccccaatcttcgcagacgcatttcacaagaagcgaaggctacctgggttggaatgcagcgccgaggccgctgaaactaccagtagcttttatgatgaccacagcagcacctccaggcaagaaatgggcaacgctttgaaccagcacttctccgacaagctgaagctggggctctgtcctgcgatgaccgagagcaacctcacccaaagctcgcacgaagataacgggagtcctcacgggaagcatccaaattgcgagagaccgggcgtggagtgcctcccgctagttccacagatgatggagctctctgacactgggacatccatctgcccctcgaaagggcagagcgtgagcttcgccgcagccgcgaacaacgacgggctcctgccgtgccacctcaacctcaccctcgcgtcgtgctccatggacgtcaacagaagccaaacctccgacgcgaatgtgaacgctatggaagaggaggacagcccagcggaggcgaccactacagccaccatggaggaagacgacggcatcggcacacgccagggtgatacgcagcacaaggtttcaggcgactcagccactgcagtagtggacccgacggtgccgccacatggggacagccagcaagctccccctccacacgaagaagctgcagctccccctgttgtggcgaacgacaagttctgggagcagttcctgacggagaggccggggtgcacggaagccgaggaagcaagctccacgctgaggagggaagatccgtaccaggacacgaggagtgacaggagagagatgggtcagctgaagctctgaccttcaggttagcatgaccactatgcatacagcatacgtacagtgtttgttataagggaatatatctagtgcaaaccaatgacctcgtacaaattcgtgcaaatctactaaacaaagctttaaaaaaaaaaaaaaaaaaaa

SEQ ID NO: 812 - protein, 474 aa, Panicum virgatum
  misc_feature: Ceres CLONE 1728062
  misc_feature: The sequence is a functional homolog of  SEQ ID NO 1026 in the  10/225,066 US patent application
  misc_feature: The sequence is a functional homolog of  SEQ ID NO 110 in the  11/375,241 US patent application
  misc_feature: The sequence is a functional homolog of  SEQ ID NO 2280 in the  10/374,780 US patent application
  misc_feature: Useful for making plants with modulated growth and phenotype characteristics
MEVAGARGSGGGGGGGPAPFLLKTYEMVDDPSSDAVVSWSDASDGSFVVWNPPEFAARMLPTYFKHSNFSSFIRQLNTYGFRKIDPERWEFANEYFVKGQQHLLKNIHRRKPIHSHSHQPGALPDNERALFEDEIDRLSQEKAALQADLWKFNEQQSGAVSQIEYLEQRVLDMEQRQVKMLSFLQQASKNPQFVSKLAKMAETSPIFADAFHKKRRLPGLECSAEAAETTSSFYDDHSSTSRQEMGNALNQHFSDKLKLGLCPAMTESNLTQSSHEDNGSPHGKHPNCERPGVECLPLVPQMMELSDTGTSICPSKGQSVSFAAAANNDGLLPCHLNLTLASCSMDVNRSQTSDANVNAMEEEDSPAEATTTATMEEDDGIGTRQGDTQHKVSGDSATAVVDPTVPPHGDSQQAPPPHEEAAAPPVVANDKFWEQFLTERPGCTEAEEASSTLRREDPYQDTRSDRREMGQLKL

SEQ ID NO: 813 - DNA, 1415 bp, Panicum virgatum
  misc_feature: Ceres CLONE 1728077
  misc_feature: Encodes the peptide sequence at SEQ ID NO. 814
aaaccagtcgccgccgcctgcccgcctcctcgttcgagtccgatcttgctggaggtcgccgcattctgaatccggttaccaatggctcctcccctcctctcgccgccgctgctccccgactcgctcgcgacactgccgcggtctttcccttgctcccgccccacgcggcagctggccaccgtcgggttcgccggagccgttaggagcgaccaccaagggagttggagtgcgcggaggagggggaacctcaggattcgagccactgcggcggaagcggatcacgagaggccggaggaggatgtcgccgaggattactattccgttctgggtgtgatgccagatgcaacacctgaggaaatcaagaaggcatactacagttgcatgaaagcgtgccaccccgaccttagtggggacgaccctgacgtgaccaacttctgtatgttcatcaatgaggtttattcggtgctgagcgatccagcacaacgtgcagtgtatgatgagatccatgggtacacagctacagcaataaaccctttctttgatgacagtgcacccaaggatcaagtgttcgttgatgagtttacctgcattggatgtaaaaactgtgccaatatctgccctaacgtctttcaaattgaagaagattttgggaggtcaagggtctactcccagtcgggtagcaccgaacttatccaggatgccattgatagttgccctgtcgactgtatccactggacttctgcagcacaactgtcactcctcgagaatgagatgcgcagagtagagagggtgaatgttggtttgatgcttgctggtatgggagcttcagtcgatgttttccgaatggcaagtgttcgctgggaaaagaggcaagcaaaagtcttggaaaaagtcagaacacggatggtgaaccaagaaaattcagacacaggcaggtcttggagcgatgtctggggatccccaccacgagatcaaaacaatgaggaagaagcgtcagagagaaccaagagagcggcggcggctgccagaaggtggcgagaatactcaaggcgaggcgcagacaggcctccgacatacaagcttccagaagcagtgggcaacaaagattagtccactgaatagagaaaacatctgccattgtttggccaaatttggcaaacctgtactgtacagtgtcgttgtttgcagaggtgatccgaaggtttgctttgccttcccagtcgacacccatgctgctcctgtaaatctagacgtagcgatgttgataacctgtagaagacatgcaccaaatatattacgtgtatattcaagctgtaatataaacaaatgcacatgtatatcttgctggatgtggtactagatgaaaacatgagttattgtatgtgatgtcattttaaaaaaaaaaaaaaaaaaaa

SEQ ID NO: 814 - protein, 342 aa, Panicum virgatum
  misc_feature: Ceres CLONE 1728077
  misc_feature (1)..(63): Pfam Name: DnaJ Pfam Description: DnaJ domain
MAPPLLSPPLLPDSLATLPRSFPCSRPTRQLATVGFAGAVRSDHQGSWSARRRGNLRIRATAAEADHERPEEDVAEDYYSVLGVMPDATPEEIKKAYYSCMKACHPDLSGDDPDVTNFCMFINEVYSVLSDPAQRAVYDEIHGYTATAINPFFDDSAPKDQVFVDEFTCIGCKNCANICPNVFQIEEDFGRSRVYSQSGSTELIQDAIDSCPVDCIHWTSAAQLSLLENEMRRVERVNVGLMLAGMGASVDVFRMASVRWEKRQAKVLEKVRTRMVNQENSDTGRSWSDVWGSPPRDQNNEEEASERTKRAAAAARRWREYSRRGADRPPTYKLPEAVGNKD

SEQ ID NO: 815 - DNA, 1524 bp, Panicum virgatum
  misc_feature: Ceres CLONE 1728080
  misc_feature: Encodes the peptide sequence at SEQ ID NO. 816
attccctccccgcggccgtgctagctaggcgctcgctacctacctgaaagcacgcaccagctgaactgcgaaaccttggcgcacgcggacagtctaacaccttcagtcagagccccccagaccccccctgctcgcgagcgtccgggccgccaccaccacaccggcgagagcaatggagaccgtcgcggcggcgagctacgccggcacggccgccggcgccacgcgctccccggcgtgctgcgccgccatgtccttctcgcagtcgtccaggcccaaggcgtccaggccgccgacggcgttctacggcgagtcggtgcgggtgagcacggcgcggccgctcgcggcgaggcagaccaaggcggcgagccgggcggcgctcagcgcacggtgcgagatcggcgacagcctggaggagttcctgaccaaggcgacgccggacaagaacctcatcaggctgctcacctgcatgggggaggccatgaggacgatcgcgttcaaggtccggacggcgtcctgcggcggcacggcctgcgtcaactccttcggcgacgagcagctcgccgtcgacatgctcgccaacaagctcctcttcgatgctctggagtactcccatgtgtgcaagtacgcgtgctccgaggaagtccccgagctgcaagacatgggtggcccagttgacggtggtttcagcgttgcgttcgatccccttgacggttccagcattgtcgacaccaacttcaccgtcggaaccatcttcggtgtctggcccggcgacaagctgacgggagtcaccggcggcgaccaggtcgccgctgcgatgggcatctacggcccccgcacgacctacgtcatcgccctcaaggactgccctgggacacacgagttcctcctcctcgacgaaggcaaatggcagcatgtcaaggacaccacctccattggggaggggaagatgttctctcctggtaatttgagggcaacatttgacaaccctgactacagcaagctcatcgactactacgtcaaggagaagtacacattgcgttacactgggggaatggtaccagatgtcaaccagatcatagtgaaggagaagggcatcttcaccaacgtgacgtccccgtccgccaaggccaagctgcggctcctcttcgaggtggcgccgctggggctcctggtcgagaaggccggcgggcacagcagcgacggcaagcagtcggtgctggacaaggtgatcaacgagctcgacgagcgcacccaggtggcctacggctccaagaacgagatcatccggttcgaggagaccctctacggctcgtccaggctcgccgccggcgccaccgtcggcgcggccgcctgagtttttgctgcgatgtgtgcaacaccgtgtcgccattttgaatccatctggtgatgcctatacagatgagcttgtagaactctcctgcgaagtaatttttgcatacagtttatgtgcatgcattcatgcatggcaaccagcactagtgtcaaaaaaaaaaaaaaaaaaaa

SEQ ID NO: 816 - protein, 393 aa, Panicum virgatum
  misc_feature: Ceres CLONE 1728080
  misc_feature: Great-hit functional homolog of the protein sequence given in SEQ ID NO 9301
  misc_feature (1)..(313): Pfam Name: FBPase Pfam Description: Fructose-1-6-bisphosphatase
  misc_feature (5)..(313): Pfam Name: FBPase Pfam Description: Fructose-1-6-bisphosphatase
  misc_feature (1)..(314): Pfam Name: FBPase Pfam Description: Fructose-1-6-bisphosphatase
  misc_feature (1)..(393): SWISSPROT Homolog: EC 3.1.3.37 Sedoheptulose-1,7-bisphosphatase, chloroplast precursor
  misc_feature: Useful for making plants with modulated light quality response
METVAAASYAGTAAGATRSPACCAAMSFSQSSRPKASRPPTAFYGESVRVSTARPLAARQTKAASRAALSARCEIGDSLEEFLTKATPDKNLIRLLTCMGEAMRTIAFKVRTASCGGTACVNSFGDEQLAVDMLANKLLFDALEYSHVCKYACSEEVPELQDMGGPVDGGFSVAFDPLDGSSIVDTNFTVGTIFGVWPGDKLTGVTGGDQVAAAMGIYGPRTTYVIALKDCPGTHEFLLLDEGKWQHVKDTTSIGEGKMFSPGNLRATFDNPDYSKLIDYYVKEKYTLRYTGGMVPDVNQIIVKEKGIFTNVTSPSAKAKLRLLFEVAPLGLLVEKAGGHSSDGKQSVLDKVINELDERTQVAYGSKNEIIRFEETLYGSSRLAAGATVGAAA

SEQ ID NO: 817 - DNA, 1240 bp, Panicum virgatum
  misc_feature: Ceres CLONE 1728084
  misc_feature: Encodes the peptide sequence at SEQ ID NO. 818
aattccccaccccagctcacaaccctaatcacatttcgccgcctccacccccgtcaacctcttccccttctctcgccaaccctagcccacccccggcgagatcggcccagctcgagcagccatggcggatacgctcgacatgaccctcgacgacatcatcaagaacaacaagaagagcaacccctcctccggcgggggccgccgcagccgcggcggatccgcctctggcggcagcggcagcggcggcggcggtggcggtggggtcgggccgaccaggcgccccttcaagagggctggaaacaggcaggctccctaccagccgccgaaggcccccgacgcggcgtggcagcacgacatgtaccccgcggtcgccgccaccggtggaggcagcggcgagagggtctcggctatcgagacgggcaccaaactctacatctccaacctggactttggcgtctcgaacgacgacatcaaggagctattctctgagttaggtgatctgaagcgatcttccataaattatgatcgaagtgggaggtctaagggaacagctgaagttgtatttgcacggcgtgctgatgctgtagctgcggtgaagaaatataacaacgtgcaacttgatggtaagcccatgaagatagagatagttgggaccaatactccaacagcagcttctgctcttccactcactaacggaggccaggctaggaatgctgtgaagagcgcaccgaggggtggcccaacaggtatgccacagcgtagaccccatcaaaggggcggcagtggtcgtcgtggtggtggatctggtggtcgtcgtggcaaagagcgtagtatgccaaagtctgctgaagaacttgatgctgacttggagaaatatcatgccaatgcgatgcagaccaactaaataccttcaccaagttgacatttccatcaaatatgaagagcattagtcctttcattcctgctgtttgtgctgctatgttcaggggacaacagaactttatgtttgtggggggtcttgctttactgaatttatgggttatatgtgtttacatagaactagacagtgggtgatgctgaacactgctatggaaattacttggttgcctttagtttctgtacctaatgctgcggagtgaagaatcatccaagttactccacatgtgaacgttggagttgtatcaaggttcctctcatttgctttgaccctcacaatgcaacaatacaacatcttcaaggt

SEQ ID NO: 818 - protein, 260 aa, Panicum virgatum
  misc_feature: Ceres CLONE 1728084
  misc_feature: Great-hit functional homolog of the protein sequence given in SEQ ID NO 9424
  misc_feature: Useful for making plants with modulated biomass
  misc_feature: The plant is abnormally small.
MADTLDMTLDDIIKNNKKSNPSSGGGRRSRGGSASGGSGSGGGGGGGVGPTRRPFKRAGNRQAPYQPPKAPDAAWQHDMYPAVAATGGGSGERVSAIETGTKLYISNLDFGVSNDDIKELFSELGDLKRSSINYDRSGRSKGTAEVVFARRADAVAAVKKYNNVQLDGKPMKIEIVGTNTPTAASALPLTNGGQARNAVKSAPRGGPTGMPQRRPHQRGGSGRRGGGSGGRRGKERSMPKSAEELDADLEKYHANAMQTN

SEQ ID NO: 819 - DNA, 2056 bp, Panicum virgatum
  misc_feature: Ceres CLONE 1728085
  misc_feature: Encodes the peptide sequence at SEQ ID NO. 820
acttcatgtcttcatccgtctcatcttcccctcgtcctcctccctccctccctcccgtgctcacagctcgcagcacctcgtctccctgcactccaacctccaccaacaagctaaggccgagaagcgcgcggagcggaaggcgtagcgggatcgaccaagggccgagctggcggcaatggcgcggtgcctggtgtgcatgctgctcgtcctcatctcctccctcatctcgaccgtggggctgcccgtcgagccgcccgcggagctcctgcagctcggcgacgtcgcgggcggcggccgcctcagcgtcgacgcgtccgacgtcggcgaggcgtcgcgggacttcggggggctcggccgcgccgagccggcggcggtgttgcagccccgctgcgccggcgacgtggcggccctggtccgcgccgcgtacgagtcggcgcgcgggttccgcgtctcggcgcgcggccacggccactccatcagcgggcaggcgcaggcgcccggcggggtggtggtggacatgagccacggccccggcgccgcggcgcgggccggggcgcgggcattgcccgcctactcggcggcgctgggcgggcactacgtggacgtgtggggcggcgagctgtgggccgacgtgctcaactggacgctctcccacggcgggctcgcgccgcggtcctggacggactacctctacctctccgtgggcggcaccctctccaacgccggcatcagcgggcaggccttccaccacgggccccagatcggcaatgtctacgagctcgacgtcgtcacggggaagggtgaggtggtgacctgcacggaggcggagaacccggacctcttcttcggcgcgctcggcgggctcggccagttcggcatcatcacgcgcgcgcgcatcgccctcgagcgtgctccccaaagggttcggtggatccgggcgctctactccaacttcgccgagttcacggcggaccaggagcgcctcatctccctcggcgccggcggccgccggttcgactacgtggagggcttcgtcgtcgccgccgagggcctcatcaacaactggcgctcctccttcttctcgccgcagaacccggtgaagctcagctcgctcaagcaccactccggcgtgctctactgcctcgaggtcacaaagaactacgacgacgacgacgccgcgtccgtcgaccaggacgtggacgcgctactgggcgagctctacttcctgccgggcacggtgttcacgacggacctgccgtacgtggacttcctggaccgcgtgcactgggcggagctgaagctgcgcgccaagggcatgtgggaggtcccgcacccgtggctcaacctcttcgtgccggcgtcccgcatcgccgacttcgaccgcggcgtcttccgcggcatcctcggcggccgcaccgccgacgccggcgggcccatcctcatctaccccatgaacaagcacaagtgggacccgcggagctcggtggtgaccccggacgaggaggtgttctacctggttgccttcctgcggtcggcggtgccgggcgcgccggagagcctggaggcgctgtcccggcagaaccagcggatcctcgacttctgcgcggaggccggcatcggcgccaagcagtacctgcccaaccacaaggcacggcgcgagtgggcggagcacttcggcgccgcgcggtgggagcgcttcgcgcggctcaaggccgagttcgacccccgggccatcctggccgccgggcagggcatcttcccgccgcccggctcgccgccgctcgtctccgactcgtagtggggtcgagctgctactgatgattcatttgttaggcgcgtgtaggtagttacagtatacgaggaagattatttagttggttattgtagttattagctccccggttgattaatcgatgtacaaaagtggtgtggttcgtgtcacgtcgcggtggcatagcagttgcgattggttctctctctgtatagggcaggtgagtataaatgtcaatgtggcgaagtgaaatttttttggtggtaaaaaaaaaaaaaaaaaaaa

SEQ ID NO: 820 - protein, 540 aa, Panicum virgatum
  misc_feature: Ceres CLONE 1728085
  misc_feature (1)..(282): Pfam Name: Cytokin-bind Pfam Description: Cytokinin dehydrogenase 1, FAD and cytokinin binding
  misc_feature (22)..(528): SWISSPROT Homolog: EC 1.5.99.12 Cytokinin dehydrogenase 1 precursor
  misc_feature (8)..(540): SWISSPROT Homolog: EC 1.5.99.12 Cytokinin dehydrogenase 5 precursor
MARCLVCMLLVLISSLISTVGLPVEPPAELLQLGDVAGGGRLSVDASDVGEASRDFGGLGRAEPAAVLQPRCAGDVAALVRAAYESARGFRVSARGHGHSISGQAQAPGGVVVDMSHGPGAAARAGARALPAYSAALGGHYVDVWGGELWADVLNWTLSHGGLAPRSWTDYLYLSVGGTLSNAGISGQAFHHGPQIGNVYELDVVTGKGEVVTCTEAENPDLFFGALGGLGQFGIITRARIALERAPQRVRWIRALYSNFAEFTADQERLISLGAGGRRFDYVEGFVVAAEGLINNWRSSFFSPQNPVKLSSLKHHSGVLYCLEVTKNYDDDDAASVDQDVDALLGELYFLPGTVFTTDLPYVDFLDRVHWAELKLRAKGMWEVPHPWLNLFVPASRIADFDRGVFRGILGGRTADAGGPILIYPMNKHKWDPRSSVVTPDEEVFYLVAFLRSAVPGAPESLEALSRQNQRILDFCAEAGIGAKQYLPNHKARREWAEHFGAARWERFARLKAEFDPRAILAAGQGIFPPPGSPPLVSDS

SEQ ID NO: 821 - DNA, 1434 bp, Panicum virgatum
  misc_feature: Ceres CLONE 1728088
  misc_feature: Encodes the peptide sequence at SEQ ID NO. 822
gaagcactcgctgtaggatccgctcctccccggccgggcctcgctgccccgacccgctacccccacctccgccgcccgagaaccctcgccgccgcgcgctgccgcccactcgccgcggcccccatggaggccgacggaggcggtcgcccgagccccgccccggcccgctgcgccagcgccgagacggagtcggaggtggatgaggccgcgacgagctcgcccgccgcggaggccgcggcggcgggcgccacggagcaagggggcaacgggagccccgtaacctccatcgagggcgtcgacgggataaggatccggcggcggcccgtgacggggccggcggtgcactacgtgggcccgttccagttccgcctcgagaacgaggggaacacgccgcggaacatcctcgagaagatcgtctgggacaaggacgtcgaggtttcgcagatgaaagagaggcggcccctgtacatgctgaagggggcgctggaggctgctcctccggcgagggacttcgttggggcgctcaaggcgtcgtatgatcggactggcttgcctgctctgattgcggaggtcaagaaggcttcaccgagccggggtgttctcagggaggattttgatccggttcagatcgctcaggcatatgagaaaaatggagcagcatgtctaagtgttcttacagatgaaaaatattttcagggaagttttaactacttggaggctatacgcaatgctggagtccagtgccctcttctgtgcaaagagttcatagttgatgcttggcaactttactatgcacggtccaagggtgcagatgctgttcttctaattgctgctgtattacctgaccgtgatatcaactacatgttgaaaatttgcaaaatactagggatggctgctttagttgaggttcatgatgaaagggaaatggaccgtgttttaggaatcaatggtgtacagctcattggcatcaataaccgcaatcttgagacatttgaagttgatatttcaaacacaaaaaaacttctggaaggtgaacgaggacagctgatagctcagaaggatgtaattgttgtaggagaatctggtctgttcactcctgatcacgtttcattcgttcaaaacgccggggtcaaagcagttctcgttggggagtctctcatcaagcaggaggatccagggaaagcaatcgctgggcttttcggcaaagatatttcgcacgcggttgcttcctgaagatgcagaagggccggtcgagataattgagaaacacaatgctggaccgcatcgttttgtatatcttgaggaaagatgactccttcggagggtttttggtggtcttttggtgtacctgacctgatcagacgatttttccattatgcggtctttttgtgacctaacctaccggacagataaatacaagattaaagttcgcag

SEQ ID NO: 822 - protein, 369 aa, Panicum virgatum
  misc_feature: Ceres CLONE 1728088
  misc_feature (35)..(285): Pfam Name: IGPS Pfam Description: Indole-3-glycerol phosphate synthase
  misc_feature (60)..(365): SWISSPROT Homolog: EC 4.1.1.48 Indole-3-glycerol phosphate synthase, chloroplast precursor
  misc_feature (61)..(361): SWISSPROT Homolog: EC 4.1.1.48 Indole-3-glycerol phosphate synthase
MEADGGGRPSPAPARCASAETESEVDEAATSSPAAEAAAAGATEQGGNGSPVTSIEGVDGIRIRRRPVTGPAVHYVGPFQFRLENEGNTPRNILEKIVWDKDVEVSQMKERRPLYMLKGALEAAPPARDFVGALKASYDRTGLPALIAEVKKASPSRGVLREDFDPVQIAQAYEKNGAACLSVLTDEKYFQGSFNYLEAIRNAGVQCPLLCKEFIVDAWQLYYARSKGADAVLLIAAVLPDRDINYMLKICKILGMAALVEVHDEREMDRVLGINGVQLIGINNRNLETFEVDISNTKKLLEGERGQLIAQKDVIVVGESGLFTPDHVSFVQNAGVKAVLVGESLIKQEDPGKAIAGLFGKDISHAVAS

SEQ ID NO: 823 - DNA, 1524 bp, Panicum virgatum
  misc_feature: Ceres CLONE 1728102
  misc_feature: Encodes the peptide sequence at SEQ ID NO. 824
tgtacccgtcattttgcggagcagcgaacccccagacgaacagggagcgagcgagctcagagtcggaggccacgcgcgacgagatgccgggcctcacggcgccgtctgactacgcggaggagccgccgcgccacccggccctcaagatcaactccaaggagccgtttaatgctgagcctcaccggtcggcactagtcacatcttacattaccccggtggatttcttctacaagaggaatcatggacccattccaaaagtcgaggacctctcaagatacagtgtttgcatttctggtcttgtcaacaagcctattcagctatccatggctgacatttgggctcttccaaagtacaatgtcactgcaactttacagtgtgcgggaaacaggagaacagcaatgagtaaggtacggaaagtgagaggtgttggctgggacatatctgctcttggaaatgcaacttggggaggagcaaacctatctgatgtccttgagttagttggaatacctaaactcagttcggttacatctttaggagggaagcatgttgagtttgttagtgttgacaagtgtaaagaggaaaaaggtggtccttatactgcatctattccattaaagcaggcaacagatcctgatgctgatgtattacttgcatatgaaatgaatggagaggtcctcaatcgtgaccatggatacccactccgtgttgttgttcctggtgttattggtgcacgatctgtaaaatggctggacagtatcaaaataaccgaggaagaatgtcagggcttttttacgcaaaaagattacaaaatgtttccaccaaccgtagactgggacaatattaactggtcaactagaaggccacagatggattttcctgtacagtctgctatctgtacactggaagatgtagatgttattaaggaaggaaaggcgaggattgctggatatgcactttcaggtggtggccgtggtattgagagagtggatatatctgttgatgggggtaaaacctgggtcgaggctcacagatatcagaaagacggcgtgccatatgtatctgatggacctcagagtgataagtgggcttgggttcttttcgaggctacattagacataccagcaaatgctgagatagtagcaaaggcagtggacgcggctgcaaatgtccaacccgaaaacgtggaagacatatggaacctgagaggaatcctcaacacatcttggcatcggatcaagatacagaattcgtcatgcgctggaggatctaagctgtgaaataaacatgtctggaatcttggagcaatcatggtggtggtccttacgaagtgttaataacaatagtgtcatttcagctttcagtgtttcttgcatcggactgtaacatacgtgatggagctgtgtcgggtaattacagatgttggctatctgatttcaagaaaatgtcattgtattatgcattggaggatactccctctgaactgaaatataagtccattaaatccaaaaaaaaaaaaaaaaaaaa

SEQ ID NO: 824 - protein, 397 aa, Panicum virgatum
  misc_feature: Ceres CLONE 1728102
  misc_feature (1)..(387): SWISSPROT Homolog: EC 1.8.3.1 Sulfite oxidase
MPGLTAPSDYAEEPPRHPALKINSKEPFNAEPHRSALVTSYITPVDFFYKRNHGPIPKVEDLSRYSVCISGLVNKPIQLSMADIWALPKYNVTATLQCAGNRRTAMSKVRKVRGVGWDISALGNATWGGANLSDVLELVGIPKLSSVTSLGGKHVEFVSVDKCKEEKGGPYTASIPLKQATDPDADVLLAYEMNGEVLNRDHGYPLRVVVPGVIGARSVKWLDSIKITEEECQGFFTQKDYKMFPPTVDWDNINWSTRRPQMDFPVQSAICTLEDVDVIKEGKARIAGYALSGGGRGIERVDISVDGGKTWVEAHRYQKDGVPYVSDGPQSDKWAWVLFEATLDIPANAEIVAKAVDAAANVQPENVEDIWNLRGILNTSWHRIKIQNSSCAGGSKL

SEQ ID NO: 825 - DNA, 2265 bp, Panicum virgatum
  misc_feature: Ceres CLONE 1728117
  misc_feature: Encodes the peptide sequence at SEQ ID NO. 826
aaaccctaatccctccatggaagacggcgacggcggcctgagcttcgacttcgagggcggcctcgactccgccccggcggtcgggggccccgtgccgtcctccgcggaccctggcgcgggtggcggcggaggcggcgatggtccgggcatgcacggccgcggccgcggccgcgggagctaccgccagacggtgtgccggcactggctgcgtggcctctgcatgaagggtgacgcgtgcgggttcctgcaccagttcgacaaggcccgcatgcccgtctgccgcttcttccgggacttcggcgagtgccgcgagcccgactgcgcctataagcactcttacgacgacgtcaaggagtgcaacatgtacaagatggggttttgccccaatggccctaattgccggtacaaacatgtcaagctacctgggccgccacctcctgttgaggaagttctacagaagattttgcagatgcgctctttcaacagattcggtccgaatagaaacaataactataatcagcagggtgagagacctcaacatccacagggttctgggttgcctaaccaaaatgtggcagaaaatactactgctacgactccagcaactggtggacagcaagcacaaatggcgaatcaacagcctccacagcagcagcataagccgaatacaaatgaccaggtccaaggtgcttcaaacggccatcaaactactagaaccgcaacaccgcttccacaagggccatctaggtacttcattgttaaaagttgcaatcgggagaatctggaaatatcagttcagcagggaatttgggccacccagaggagtaatgaagctaaacttaatgaagcttttgaatccactgagaatgttattttaatattctcaatcaatagaactcgccatttccaggggtgtgcaaagatgacttctaggattggcggctacattggtggcggaaattggaaatctgctcatggaacagcacattatggtcggaacttctctatgcagtggcttaagctctgtgaactatcatttcagaaaactcatcatctccgcaatccatacaatgataatcttccggttaagatcagcagagattgccaggaactagaacctttcattggtgagcagttggcttccctgctttatctagagccagacagtgaacttacggctatgctaattgcagcagaggctaagagagaagaggaaaaggcaaagggagtcagtgctgacgaggcagctgataatcaagatatcgtgctgtttgatgacaatgaagaagaggaggaagaggaaagtgaggaggaggaagaaggcaatggccaagagtctcaagggaggggaagaggaagggggatgatgtggccacctcaaatgccaatgatgcgtgggccaatgatgggagggcgtttccctcccaacatgattggcgacggctttggttttggtggcggcttcggcatgcccgatcctttcggcatgccacgtggtttcccgccctttggtggcccaaggttccctgttgactttgctagaggccctatgcctggtatggccttcccgggcaggcctccgcagcctttccccctaggcctcgacatgatgatgggccccggccgtggcccgatgatgggaggcatgggaatgggcgggccgggacggcctaaccgccccattggtatggcgcccttcatgccccctccacctccgaacaaccgccccagcaagcgggagcagagaaggccgggcggcgaccgtggcgacaggttcgagacggcatcagatcaggggagcaggggccatgagaacactttgaactctggagctgagggagccagatcgcagcctggtgacaggtacggcagaaacgccctccgggacgacagcgagagcgaagaggaagcagccccgaggcggtcaaggaaacggtagagctatgctgaggggctgagctccatgctgttacctgataggagagcgctacctgtgatacagagccgagaaagtctaaagtagtatctcttataaggattacattagaaccaaagtagtgaaagagtggattgtgtgcaactgcatgctgtgatgtatttttgctccggcggcaaagacgtaagcctatattttggcagcctgagataatccctgtgttgtatcacagtatcagtcagaaatttgtacaataacaatgtcatagatcatctgccttaaattttttaatgaatctgtgcttatcataaaaaaaaaaaaaaaaaaaa

SEQ ID NO: 826 - protein, 640 aa, Panicum virgatum
  misc_feature: Ceres CLONE 1728117
  misc_feature: Great-hit functional homolog of the protein sequence given in SEQ ID NO 9617
  misc_feature (1)..(26): Pfam Name: zf-CCCH Pfam Description: Zinc finger C-x8-C-x5-C-x3-H type (and similar)
  misc_feature: Useful for making plants with altered alkaloid content
MEDGDGGLSFDFEGGLDSAPAVGGPVPSSADPGAGGGGGGDGPGMHGRGRGRGSYRQTVCRHWLRGLCMKGDACGFLHQFDKARMPVCRFFRDFGECREPDCAYKHSYDDVKECNMYKMGFCPNGPNCRYKHVKLPGPPPPVEEVLQKILQMRSFNRFGPNRNNNYNQQGERPQHPQGSGLPNQNVAENTTATTPATGGQQAQMANQQPPQQQHKPNTNDQVQGASNGHQTTRTATPLPQGPSRYFIVKSCNRENLEISVQQGIWATQRSNEAKLNEAFESTENVILIFSINRTRHFQGCAKMTSRIGGYIGGGNWKSAHGTAHYGRNFSMQWLKLCELSFQKTHHLRNPYNDNLPVKISRDCQELEPFIGEQLASLLYLEPDSELTAMLIAAEAKREEEKAKGVSADEAADNQDIVLFDDNEEEEEEESEEEEEGNGQESQGRGRGRGMMWPPQMPMMRGPMMGGRFPPNMIGDGFGFGGGFGMPDPFGMPRGFPPFGGPRFPVDFARGPMPGMAFPGRPPQPFPLGLDMMMGPGRGPMMGGMGMGGPGRPNRPIGMAPFMPPPPPNNRPSKREQRRPGGDRGDRFETASDQGSRGHENTLNSGAEGARSQPGDRYGRNALRDDSESEEEAAPRRSRKR

SEQ ID NO: 827 - DNA, 1484 bp, Panicum virgatum
  misc_feature: Ceres CLONE 1728128
  misc_feature: Encodes the peptide sequence at SEQ ID NO. 828
tagcttgctactaggcagcaacaaatccactgctcattcatcatggacgccaacagcaacaaagcagcagccgtcaaggaggagcccccggcgaccacacagctccgcgcccacctgctggcggcccatgaccacgagcgcctcgccggcgcgccgccgccgccgcccctcgttgacgcgccgccggttatcagtagtctcagccgctgcgccgcgcgccgctctctgctgctggtggtcacctacgcggcgctgttcggcgggtcgctgtcgtcgagcctcctgtcccggttctacttcgcgcacggcggcgccgaccggtggctcgccacgctggtccagtccgccggcttcccgctgctgctgctcctcctcctcctggcccggccgccgccggcgtcgtcgaggatgttcggcggcttcacgccgcggctcgtgctctactgcgtgctcctgggcctggtgatggggctcaacaacctgctctactcgtgcggcacttcctacctgcccgtgtccaccacctcgctgctcctctccatgcagctcgccttcactctggcgctcgctgcggcgctcgtccgcgtgccgctttccttcgcgaacgtcaacgccgtcgtgctcctcacgctgtcctcgctgctgctcgcgctccggcatggagtcggcggcggccgttcggactccgacgccgccggcggcgcggactacatggtcggggtggcgtccaccctcggcgcggcgctgcttttcgcgctctacctgccggcggccgagctcgtgtaccggcacggcggcgtgaggggcttcaggatggtggtggagtcgcaggtgatcatggaggcggtggcgaccgccgtgtccggagccggcatggctgcgtcctccggcggcaaggggccgtggagcggcgtggaggcgacgtgggacctgtcgccggcggcctactacgcggtggtcggggcggccgtcctcagctggcagatgtgcttcttcggcacggcgggcacggtgtacctgaccacgtcgctgcacggcggcatctgcatgacggcgctgctggcggtgaacgtcgccggcggcgtagtcgtgttcggggacgagttcggcgccgagaaaggcgtcgccatggtgctttgtctctgggccttctcgtcgtacatctatggggagtacaagaaaggtgggaataaattggtggagggggcaactcagatcgactatggagttctggatcaggtgtagtgtaggtgtagctttattttccattaggaggaatgtaaatcttcttagcatatttccgtcgtctgctgtgttacgaatcttgcacatattctgaaccctcgttgtaaaaagttagagaagcctagctagagcacaaatcaacaataatagtgtgggaagtcctactccgaccaatcacttatgtgacatccttcgatcgggacccaacattgacccatcaaaaaaaaaaaaaaaaaaaa

SEQ ID NO: 828 - protein, 400 aa, Panicum virgatum
  misc_feature: Ceres CLONE 1728128
  misc_feature (1)..(150): Pfam Name: TPT Pfam Description: Triose-phosphate Transporter family
MDANSNKAAAVKEEPPATTQLRAHLLAAHDHERLAGAPPPPPLVDAPPVISSLSRCAARRSLLLVVTYAALFGGSLSSSLLSRFYFAHGGADRWLATLVQSAGFPLLLLLLLLARPPPASSRMFGGFTPRLVLYCVLLGLVMGLNNLLYSCGTSYLPVSTTSLLLSMQLAFTLALAAALVRVPLSFANVNAVVLLTLSSLLLALRHGVGGGRSDSDAAGGADYMVGVASTLGAALLFALYLPAAELVYRHGGVRGFRMVVESQVIMEAVATAVSGAGMAASSGGKGPWSGVEATWDLSPAAYYAVVGAAVLSWQMCFFGTAGTVYLTTSLHGGICMTALLAVNVAGGVVVFGDEFGAEKGVAMVLCLWAFSSYIYGEYKKGGNKLVEGATQIDYGVLDQV

SEQ ID NO: 829 - DNA, 1283 bp, Panicum virgatum
  misc_feature: Ceres CLONE 1728131
  misc_feature: Encodes the peptide sequence at SEQ ID NO. 830
atcagccgagcgatcgcagagctcagagcactcgcctagacaccagcaatggcggcggctcggctcgtcgtcgcgttcctcgccgtctcctccgccttcctggccgtggccggccagaagttcaacgccatcttcagcttcgacgactccatgtccgacaccggcaacctctgcgtgaacggggcccccgccggcctgaccctcacccagccgccctacggcgagaccttcttcggccgcgccacctgccgctgctccgacggccgcctcgtcgtcgacttcctcgccgagaagtacgggctgccgctgctgaagccgtcgaagcagggcggcgccgacttcaagaagggcgcgaacatggcgatcatcggcgcgacgaccatggactcgggcttcttccagtcgctgggcatcgccgacaagatctggaacaacgggcccctcaacacccagatccagtggttcaagcagctcatgccctccatctgcggctccacacaggcctgcaagtcgtacctgtccaagtccctgttcgtgctcggcgagttcggcggcaacgactacaacgccatgaccttcggcgactactccccggagcaggcgagcgggcagagcggcaccatcgtggacgccatcggcaagggcgtggagcagctcatcgccctgggcgccgcgaacgtggtggtcccgggggtcctccccgtggggtgcttccccatctacctgacgctgtaccagacctccaacgccggcgactacgaccagtacggctgcctcaagcgcttcaacgcgctgtccgcccaacacaaccagctgctccagagcaaggtgacgagcctgcagggccggtaccccggcgcccggatcatgtacgccgacttctacagccacgtctacgacatggtccggagccccggcagctacggcttcagcaccaacctccaggcctgctgcggcgccggcggcggcaagtacaactaccagaacggcgcgcggtgcgggatggccggcgcgtcggcgtgcggcaacccggcggcgtcgctcagctgggacggcatccacctcacggaggcggcctacaagaagatcgccgacgggtgggtcagcggggcgtactgccacccggccatcggggcctagagggagctctgctttggtggatggccatggctcctcaagttgagggggatcgagggggtgattgattgtttggtttctctagctggaaaacaagaagatgatccgggagaataatcaattaagcatatttgcttgcgttcatc

SEQ ID NO: 830 - protein, 363 aa, Panicum virgatum
  misc_feature: Ceres CLONE 1728131
  misc_feature (1)..(322): Pfam Name: Lipase_GDSL Pfam Description: GDSL-like Lipase/Acylhydrolase
MAAARLVVAFLAVSSAFLAVAGQKFNAIFSFDDSMSDTGNLCVNGAPAGLTLTQPPYGETFFGRATCRCSDGRLVVDFLAEKYGLPLLKPSKQGGADFKKGANMAIIGATTMDSGFFQSLGIADKIWNNGPLNTQIQWFKQLMPSICGSTQACKSYLSKSLFVLGEFGGNDYNAMTFGDYSPEQASGQSGTIVDAIGKGVEQLIALGAANVVVPGVLPVGCFPIYLTLYQTSNAGDYDQYGCLKRFNALSAQHNQLLQSKVTSLQGRYPGARIMYADFYSHVYDMVRSPGSYGFSTNLQACCGAGGGKYNYQNGARCGMAGASACGNPAASLSWDGIHLTEAAYKKIADGWVSGAYCHPAIGA

SEQ ID NO: 831 - DNA, 1633 bp, Panicum virgatum
  misc_feature: Ceres CLONE 1728144
  misc_feature: Encodes the peptide sequence at SEQ ID NO. 832
agcggagaaagggaggtcgccccccaccaccaccaccacgcgcccgcccgcgccaccgaagccgccaaagcccaccacccccgccgcatccgccagactgccagaagcctctccgcccatcgctcgcccgtaccggcgccaatggccgcgtggtgagggcgcagcgaagcgagcggagtcagccgggcgcgagcgagcggccaccttccccactcggcccccgccgccgccgccccgcggaaggttgaggtcccgtgttcaggcaggcgccgctcgatttgatttggtggggaagtttctaggtcaatcttccctatggccgcctccatcgcggcctcggccttcttcccggggtcgccggcaccggcgccagccgtgcccaagaacggcctcggggagcgcccggaaagcctggacgtccgcggagtcgccgcgaagccaggatcctcgtcgaatgccttgagggcaggcaagacgcgcgcccacgcagccgtccccaaggtgaacggagggggcaagtcggcggtggcagatggggagcacgagaccgtgccctcctcggtgccgaggacgttctataaccagctccccgactggagtatgctcctcgcggccatcacgaccatcttcttggccgcagagaagcagtggccgctgctcgactggaagcccaaacggcctgacatgctttccgatacgtttggctttggccggatcatacatgacgggttcatgttcaggcagaacttctccattaggtcctatgaaattggggcggataggacagcatctatagagacgctgatgaaccatctgcaggaaactgctcttaatcatgtgaagaccgctggactgctaggtgatggattcggctccacaccagagatgagtaaaagaaacttgttctgggtggttagccaaatgcaggccatcgtcgagcgttatccttgctggggtgatactgttgaagtagatacatgggttagtgctaatggtaaaaatggaatgcgtcgggattggcatatacgtgattatataacaggccacacgatactgaaggcaacaagtaaatgggtgatgatgaacaagcttactaggaaacttgcaagaattccagatgaagtcaggactgaaatagagccttacttttttgagcgatctgctattgttgatgaagacaaccgaaaacttccaaaactaccagaggataaaagcactactgcagcaaattatgtccgaacaggattgactcctcggtgggctgatcttgatataaatcaacatgtcaataatgttaaatacatcgcatggattcttgagagtgcaccgatctctattcttgagaaccatgaattggcgagcattgtgctcgattacaaaagggagtgtggccgggatagtgtgctgcagtcacacaccaccgtgcacactgattgcaacagcgagtctggagaaacaaccttgcactgtgaacatgtgttgagcctcgaatcaggtccgaccatggtgaaagcccggaccatgtggaggccgaagggaaccaaggcccaagaaacagtggttccttcttcattgtgaagtgtgcaagatgtttgaaatggtgattttggcagaaaaaaaaaaaaaaaaaaaa

SEQ ID NO: 832 - protein, 420 aa, Panicum virgatum
  misc_feature: Ceres CLONE 1728144
  misc_feature (1)..(265): Pfam Name: Acyl-ACP_TE Pfam Description: Acyl-ACP thioesterase
MAASIAASAFFPGSPAPAPAVPKNGLGERPESLDVRGVAAKPGSSSNALRAGKTRAHAAVPKVNGGGKSAVADGEHETVPSSVPRTFYNQLPDWSMLLAAITTIFLAAEKQWPLLDWKPKRPDMLSDTFGFGRIIHDGFMFRQNFSIRSYEIGADRTASIETLMNHLQETALNHVKTAGLLGDGFGSTPEMSKRNLFWVVSQMQAIVERYPCWGDTVEVDTWVSANGKNGMRRDWHIRDYITGHTILKATSKWVMMNKLTRKLARIPDEVRTEIEPYFFERSAIVDEDNRKLPKLPEDKSTTAANYVRTGLTPRWADLDINQHVNNVKYIAWILESAPISILENHELASIVLDYKRECGRDSVLQSHTTVHTDCNSESGETTLHCEHVLSLESGPTMVKARTMWRPKGTKAQETVVPSSL

SEQ ID NO: 833 - DNA, 2302 bp, Panicum virgatum
  misc_feature: Ceres CLONE 1728148
  misc_feature: Encodes the peptide sequence at SEQ ID NO. 834
gcgctctgcatccctttccgacactcgcgtcttctaccccgcgacacctcggcagcagcccctcgcccgcagcgcacccccgccacgccctcggcgccggcgagatggagctcaagcccggcatgtcggcgctcgtcaccggcggcgcctccggcatcgggaaagcactgtgcagtgcttttgcacagaagggtttatttgtcactgtcgtcgatttctcagaagaaaatggaagagaagttgcggctttagttcaaaaagaaaatagcaaatttcatagagatcttagagttccatcttctgtatttgtcaaatgtgatgttagtaatgcagatagtcttgctgctgcttttgagaagcatgtacaaacatatggtggactagatatctgcatcaattgtgctggaattgccaatagaccactagtttatgatgatacatctgatggagctagaacatggaggcatgctgtaaatgtgaaccttgttgctgttattgatggtactcgcattgcaagtcaaataatgcggtcccaaaagaagcctggtgtcataataaatatcggttcagcggcaggcctttatcctatgatttttgatcccgtatatagtgcgacgaaagggggtgtagttatgtttacaagatcacttattccattgaaacgtcatggtgttcgtgtcaatgtgctgtgcccagagtttgttcaaactaatatggggaaacaaatgggccgcagaattgtagattctactggtggatatttgaagatggaggatattgtcaatggtgcatttgagcttatacaggatgagagcaaggctggtgcttgcctttggataacgaatcgccgagggatggaatactggccaacaccagaagaacaaagaaagtatatggtgaaccccagcaagtcgaaaaggacgctgacaaataacatatatcccagcatccaaatgcctgaatcttttgagaagataattgttcacacactcagccataatttccgcaatgctacaagacttgagcgtgtccgactgagattgcctgttgaaccacacagtgctctggttaaaataatatatgctggtgtaaatgctagtgatgtaaacttcagctcaggacgctattttagtggtaatcctaaagaaaccgcttcacgccttccatttgatgctggttttgagggtgtgggaattgttgccgctgtcggagattcagttaatcatatcaaagtaggcactcctgtggcccttatgacttttggaagctatgctgaattcacgcaggttccagccaaacatctccttccggtgccaagaccagacccagaggttgttgctatgttgacatcaggactgactgcttcaattggtcttgaaaaggcggggcaaatgacgtctgggaaagttgttttagttacagcggctgccggtggaacaggacaattcgccgttcagctggcgaaactagcaggcaacaaggttgttaccacatgtggaggtaaaagtaaggctgaatttctggcttccgtaggagctgatcgtgttatcaattacaggaacgaaagcatcaaagatgttctgaagaaagagtttccaagaggtgtagatatcatatatgaatctgtaggtggggaaatgtttgacttgtgcttgaatgcacttgcagtccatgggcatctcattgtaattggtatgatctcccagtatcaaggagagagtggatggaagccaaagaattacactggactatgtgagaagatactagctaaaagtcaaactgtggctggatttttccttgttcagtatgctcatctgtggcaagatcatcttgacaaactttttgacctgtatgcctctggaaagctaaaggtttccctagaccccaagaagttcctgggtgttgcttccgtgccagatgcagtagaataccttcattctggcaggagtgttggcaaggttgttgtgtgcattgatccatcatactgtcaggtcgctgctaagctataacttaaggacaatgacacgcattatggttcacagttgcaaaataggttaggctgttatgggtacacagagatcctgaggccatcttctttggttctctgtttcctgcctactcaacataagagcattttccaggtttgtttcaaaaaagatagcatttgccaagtgggtaagaaccgaataatttgcatatgttggtgtatggctaagttttgtgcattgtttataagatgcacgaccaaacatggacatggaaatcaaataactttataatccaaaaaaaaaaaaaaaaaaaa

SEQ ID NO: 834 - protein, 634 aa, Panicum virgatum
  misc_feature: Ceres CLONE 1728148
  misc_feature (1)..(87): Pfam Name: ADH_N Pfam Description: Alcohol dehydrogenase GroES-like domain
  misc_feature (1)..(176): Pfam Name: adh_short Pfam Description: short chain dehydrogenase
MELKPGMSALVTGGASGIGKALCSAFAQKGLFVTVVDFSEENGREVAALVQKENSKFHRDLRVPSSVFVKCDVSNADSLAAAFEKHVQTYGGLDICINCAGIANRPLVYDDTSDGARTWRHAVNVNLVAVIDGTRIASQIMRSQKKPGVIINIGSAAGLYPMIFDPVYSATKGGVVMFTRSLIPLKRHGVRVNVLCPEFVQTNMGKQMGRRIVDSTGGYLKMEDIVNGAFELIQDESKAGACLWITNRRGMEYWPTPEEQRKYMVNPSKSKRTLTNNIYPSIQMPESFEKIIVHTLSHNFRNATRLERVRLRLPVEPHSALVKIIYAGVNASDVNFSSGRYFSGNPKETASRLPFDAGFEGVGIVAAVGDSVNHIKVGTPVALMTFGSYAEFTQVPAKHLLPVPRPDPEVVAMLTSGLTASIGLEKAGQMTSGKVVLVTAAAGGTGQFAVQLAKLAGNKVVTTCGGKSKAEFLASVGADRVINYRNESIKDVLKKEFPRGVDIIYESVGGEMFDLCLNALAVHGHLIVIGMISQYQGESGWKPKNYTGLCEKILAKSQTVAGFFLVQYAHLWQDHLDKLFDLYASGKLKVSLDPKKFLGVASVPDAVEYLHSGRSVGKVVVCIDPSYCQVAAKL

SEQ ID NO: 835 - DNA, 3005 bp, Panicum virgatum
  misc_feature: Ceres CLONE 1744384
  misc_feature: Encodes the peptide sequence at SEQ ID NO. 836
agtcccacccacccgcgtctcctccttcctcggcacggctccccactccccccagtacactctcgcccccagtggtcaggtactcaggtcaccgtgcgcatgagcgatgagagctctcgcctcgcccgccgcctccatccttaaccccggcgcgagccccaaccctcgcgcgcctctccgctcggcggcggcgccgctcccgcggggcccgtgccctggccgctccgtcgccgccgcggccgccgccgccaccggggatcactggggcgccgaccaccaccacgtctgcggccgcgcgacctcgccggaggccggggcccgcgcggcgcacggcgtcaagtgcgacgtcgacgtggtgtcgtggcgggagcggcgggtgctcgcgtccgtgcccgtggccgccgacgtcgacaccctgtggcaggtcatcaccgactacgagcgcctcgccgacttcatccccaacctcgtccagagcgtgaggattccgtgcccgcacgaagggcggatatggctggagcagaggggactgcagcgggcactctactggcacatcgaggcgcgcgtcgtgttggatctccaggaagtccctgattccgttaatggacgagaactccatttctcgatggtagatggtgacttcaagaagtttgaaggaaaatggtccatcagattgggtccaaggtcctctagtgcagttttgctgtatgaagttaacgtgataccaagatttaacttcccggcaatatttcttgagaggattataaggtcggatcttcctgtaaatcttcgagccttggcatctagagctgaaaagatttatttagaaaatcaaagatgtggttcgagaaaattttctgccatggattcaaagccatcatctacttcttctcagcttaagttccatagtacagcaattgagactacttctagtaagttcaaagaagcacctcccactgctggtgttagtagtgtgcttccttcaccttcttctgagttgattagcaaatggggtgtatatggaaacgcttgcagaattgataggccttgtgtggtagatgagatccatcttcgaagatttgatggtctcttggaacatgagggggctcacaggtgtgtttttgctagtatcactgtgaaagcaccagttcgagaggtatggaatgttctcacggcatatgagaatttacctgaattcgtaccaaacctggctatcagtaggattgtccttcgtgataataacaaggtccgcctaatgcaggagggttgcaaaggcctactgtatatggtccttcatgcccgtgttgtcatgaatcttcgtgaaaaacttgagcaagagatcagctttgaacaagttgagggtgatttctactcattcaaagggaaatggcgcttcgaacaacttggagaccatcacaccctgttgaagtacatggttgagactaagatgcataaggacacctttctctctgagtccatccttgaagaggtcatatacgaggatcttccatcaaacttatgtgcaatacgtgattatattgaaaaggctggagctgaaggtagcaactccattactcattctgatgcaccaacacactcagatattgttcctgcgcaaagcaggcaattagagcaagaatctgcatcttgctccttcagttccacgaaacagagaccaaaagttcctggcttgcaaaaggacattgaagtcctcaaatctgagcttgagaatttcattgcaagctacggtcaggatggtttcatgcctaagagaaagcatcttcgttctcatggaagggtggatattgagaaggcaataacacgaatgggtgggttcaggaagattgccagcataatgaacctttccctttcctacaaaaatcgaaaaccaagaggttattgggataatctggagaacttgcaagaagagatcagccggttccagaagagttgggggatggatccttcttatatgccaagtaggaaatcttttgagagagcaggtcgatacgacattgctcgggcgttggaaaaatggggtggggtgcaggaggtttcgcgccttctttctcttgaactaagacgccctagaaggcgatctgactcagatgatgagaggcagtctgaatcacaagctggcagtggtaggacaaagaagcacggaatcaaacatgataaagccaacatgtccccagatgcacagaaatggctcctgaagctgaaggatttggatgtgaactgagtggaatactagattaataagcttcgaaaacgaaatgatgtggcactatcaactcaattcttttttggcgttggaggcgctctggaagcagtccgtcaaaggcgctgtaaattatgtacagaaaatttgcaatgctcaggccaaccctgaattaacccatgctgaagctaccaacgggcaacggttttcatttgtcatctgttatgactcttggtcctctactaatactaatactactactgcgtatctagaagtttgacaaaacagctttgttgcagtcaaattgaagcgtgaatttggccactaagcacaaatggggtgttgatttcgtatacctgttcaaagctgttttgagtaagctccgcctttcaaagaaggtggtcaaccattggattaaatcgtgttcgacaggttggtcgacttcttgttactgatcatgtcagttgacttgacccatttgttttgacactgaaagagaatgttactgcccactagtttcaatcagcgtggttacattagtctttcaggtgtaaagcattcggtgttccctgcttcatggcgagaaaggtaaggagctgatgaggacgttcgtcaacaaggggacatgatggtttgctttaatgtggcaaattatgcttagatgtttggctattcagtgaggctagattatttgaatttaaaagaatttattttttcttatgatcattgacttggatatagcctgaagaaagggaaattggatcaaaaaaaaaaaaaaaaaaaa

SEQ ID NO: 836 - protein, 711 aa, Panicum virgatum
  misc_feature: Ceres CLONE 1744384
  misc_feature (60)..(169): Pfam Name: Polyketide_cyc Pfam Description: Polyketide cyclase / dehydrase and lipid transport
MRALASPAASILNPGASPNPRAPLRSAAAPLPRGPCPGRSVAAAAAAATGDHWGADHHHVCGRATSPEAGARAAHGVKCDVDVVSWRERRVLASVPVAADVDTLWQVITDYERLADFIPNLVQSVRIPCPHEGRIWLEQRGLQRALYWHIEARVVLDLQEVPDSVNGRELHFSMVDGDFKKFEGKWSIRLGPRSSSAVLLYEVNVIPRFNFPAIFLERIIRSDLPVNLRALASRAEKIYLENQRCGSRKFSAMDSKPSSTSSQLKFHSTAIETTSSKFKEAPPTAGVSSVLPSPSSELISKWGVYGNACRIDRPCVVDEIHLRRFDGLLEHEGAHRCVFASITVKAPVREVWNVLTAYENLPEFVPNLAISRIVLRDNNKVRLMQEGCKGLLYMVLHARVVMNLREKLEQEISFEQVEGDFYSFKGKWRFEQLGDHHTLLKYMVETKMHKDTFLSESILEEVIYEDLPSNLCAIRDYIEKAGAEGSNSITHSDAPTHSDIVPAQSRQLEQESASCSFSSTKQRPKVPGLQKDIEVLKSELENFIASYGQDGFMPKRKHLRSHGRVDIEKAITRMGGFRKIASIMNLSLSYKNRKPRGYWDNLENLQEEISRFQKSWGMDPSYMPSRKSFERAGRYDIARALEKWGGVQEVSRLLSLELRRPRRRSDSDDERQSESQAGSGRTKKHGIKHDKANMSPDAQKWLLKLKDLDVN

SEQ ID NO: 837 - DNA, 1807 bp, Panicum virgatum
  misc_feature: Ceres CLONE 1744406
  misc_feature: Encodes the peptide sequence at SEQ ID NO. 838
ataacgggcaccgcaccactttccccttcgcgcgttttcctcgcattgcctccgcgacctcgtcgtcacaattcccccatttcccgattcctctaaaactttccccaatcccccctccccgattcggagcacgcgctaatggcgacgaaatgcgctgccgccgcggtcaatctggccaccggccgcccccgcaagcgcgcaaggcttggctgggacgtggctccggctgccgaggctcagataggaacattttgtgggcaagaagttggtgatgtgaccagactgctattgtcagcaaatccttccgaccatacttgttcgtctctgctcccgaagggtgtggctcgaaatgcttcccctccttggagagaagacgataaagatggccattacatatttgctgttggagagaatttgacctctcgctacaagatatacaaaaaaataggtgaaggtacttttggtcaggtactagagtgttgggaccgagaaagaaaagagatggtggctattaaaattgttcgttctgtaaagaagtacagcgatgcagcaatgatagagattgatgtcctgcagaagcttgcaagaaatgatgcagcaggcaaacattgtgtccaaatacggaactggtttgactatcgtagccatatttgtattgtctgcgagaagcttggcccaagcctatacgattttctacggaaaactggctatcgcccattcccaatcgatctagtacgccagattggagagcaacttttggaatctgttgcatttatgcatcgcttgcagctaattcatactgatctgaaaccagagaacattctccttgtttcttcggattatgtcaagttacctgatcccaaggatggatcattctcaaggaaactgccaaaatcaagtgccatcaagttgattgactttggaagcacggcataccatcaccaggatcgcagctatattgtatctactagacactatcgagcacctgaagttattttgggacatggatggagctacccatgtgatatctggagtattggttgtatactcattgagctttgctcgggtgagacgctgttccagacccatgagaacttggaacatctcgcaatgatggagagagttctaggtcctcttccgcagcacatgctggaaagagccgaccaacatgcagaaaagtacatcagaaggggaagattgaactggccagaaggagcaacaacaagggagagcattagagctgttctcaaattgcctcgcctgcagaacctggtgatgcagcatgtggatcactctgctggggatctcattgacctgctgaagcgccttctagcatatgagccctcagccaggttgactgctgaagaagcgttgagtcatggcttcttcacaagacatggcaataggcggtcgctatgacatccctgattctgaagaagcgcgagtcatgtggcttcttcaaaagatatggcagctatgccatctgcgattccactatgccatgttcatccgatcaaaaaggaagggcaatctatgaggattccaaggcaacagatacaaccgataattcagatgatatctgagctagtgctggtagaagtagaagcttgtatgttgtgattgactgagaaaacaaaattgtaaagctcccttaacaaaattgtaaagctcccttaacaaaattgtagcaaaatcatagagagatgccggattgatataccgtatacgtctactaggagcacatgttgtgtctgaatactgcagtgtggagttgcatacaaacccgagtttgttaatcagctgttac

SEQ ID NO: 838 - protein, 426 aa, Panicum virgatum
  misc_feature: Ceres CLONE 1744406
  misc_feature (16)..(419): SWISSPROT Homolog: EC 2.7.12.1 Serine/threonine-protein kinase AFC1
  misc_feature (16)..(419): SWISSPROT Homolog: EC 2.7.12.1 Serine/threonine-protein kinase AFC2
MATKCAAAAVNLATGRPRKRARLGWDVAPAAEAQIGTFCGQEVGDVTRLLLSANPSDHTCSSLLPKGVARNASPPWREDDKDGHYIFAVGENLTSRYKIYKKIGEGTFGQVLECWDRERKEMVAIKIVRSVKKYSDAAMIEIDVLQKLARNDAAGKHCVQIRNWFDYRSHICIVCEKLGPSLYDFLRKTGYRPFPIDLVRQIGEQLLESVAFMHRLQLIHTDLKPENILLVSSDYVKLPDPKDGSFSRKLPKSSAIKLIDFGSTAYHHQDRSYIVSTRHYRAPEVILGHGWSYPCDIWSIGCILIELCSGETLFQTHENLEHLAMMERVLGPLPQHMLERADQHAEKYIRRGRLNWPEGATTRESIRAVLKLPRLQNLVMQHVDHSAGDLIDLLKRLLAYEPSARLTAEEALSHGFFTRHGNRRSL

SEQ ID NO: 839 - DNA, 2944 bp, Panicum virgatum
  misc_feature: Ceres CLONE 1744705
  misc_feature: Encodes the peptide sequence at SEQ ID NO. 840
agccagccaacctacccgccccggacagcaaagcacaggcgcacgagcccccccagctccacgcctcctcctcctccctccccctctcccgccatcctcctccgccgcgcgccttcccgcccgccgagcctttaggagggggtttccggagtcgcggacgcgcgtgcgagaccccttcccctgccgccgagcgcaagtaagatctccggcctcccgccccgcgcgctccgggcgcctcctctctcccctgaattgcccgggctcgggggctctaacggctgccccggtggcgctgcgcgcgcagatctgccgagctcggcatggggtgaccagatcggggcgcggctcggggctctacggctgaattccgctcggtgaggagggagctggtctcggagaggccggggggatggcgaacgccggcgcggccgtcggtccagggggtgctagcgatgctttgttcagggaactctggcatgcttgtgctgggccgttggtcacggtgcctcgccaaggcgagctggtttactacttcccgcaaggtcatatggaacagcttgaagcatctacagatcagcaacttgaccagcacttacctttgtttaatctaccatccaagatcctgtgcaaagtggtaaatgtagaactcagagctgaaactgattccgatgaagtttatgctcaaattatgctgcaaccagaagcagatcaaaatgagcccactggcccagatcctgagccaccagagccagaaaggtgcaatgtccattccttctgcaagactttgactgcttcagacacgagcacccatggtggtttctctgtcctcaggagacatgctgaagaatgtttgccccaattggatatgactcagaatccaccatggcaagaactggtggctaaagatctccatggaaatgaatggcatttccgtcacatctttcgaggtcaaccaaggaggcatctacttacaacaggctggagtgtttttgttagctcaaaaagattggttgctggtgatgcatttatctttttgagaggtgataatggagagctacgagtcggggtaagaaggctcatgaggcaactaaataacatgccatcatcagttatctcaagccatagcatgcatcttggagtcctcgcaacagcatctcatgccatctccactggaactctcttttctgttttctacaaacccagaacaagtcgatcggagtttgttgtgagcgtaaacaagtaccttgaagctaagaatcacaagatgtctgtcggtatgaggtttaaaatgagatttgagggtaatgaatctcctgaaagaagatttagtgggacaattattggtctgggaagcatgccagctaactcaacatctccgtgggctgactctgattggagatctttgaaggtccaatgggatgagccttctgctgttgtccgtccagatagagtttcaccatgggaactagaaccccttaatgcaactaacacacaaccgcctcagcctcctttacggaataagcgtgcacggcctcctgcttcaccttctattgctccagaacttcctccagcttttggtttttggaaatccccagctgagcctacccatcctttctcattttcgggactgcagcgaactcaggaattataccattcaaaccccaattcaatcttttcatcatcgttgaatgtgggatttaattcaaagaatgaacattctactccaaccaacaatcatttgtactggccaattcgagacactagaacggaatcctactctgctagcattaacaaacttctacctgaaaggaagcaagaatccgctactgctggctgcagattgtttggtattgagataagtaatgcagtatcaccagtggttactgttgctagtgttggtcaagaccagccacctgttgagtcagtagatgttgagtctgatcagctgtcacagccatcccaagccaacaaaacagatgctccagcagcaagcagtgagcgctctcctcatgagactgagagccggcaagtcaggagctgcaccaaggtaatcatgcaaggaatggcggttggcagggcagtggacttgacgaggctagaaggatatgatgatcttctccacaagttggaggagatgtttgatatccagggggagctttctgctagcctcaagaaatggaaggttatttacacggatgatgaggatgatatgatgctggtcggggatgatccgtggcctgaattttgcagcatggtgaaaaggatatacatttactcctatgaggaggccaagtctttgactcccaaggcgaagctgccggtcattggtgataccactaaaccgaacccagacaagttgtcaccggaatctgacatgccgcagagtgactcaaacaacagcgctctggttgctgccgataaggactgatggatgctaacttggcgctctacctttaattcccgttttggatgtttgggaggcaatgcccatactccttgagactgctgagagttatctgtttgttgcgctgtgggcccgaaggacgttgccccacaatctgcctgactgccttggtttggaatggctgatgtaggaccagtggtggtcctctgccagcaaggtcgactggaatgtaatggcaagcaggccgcattgcgcgccgttccctgtgccaccaacctgtgttttgtttgccgtgtttggtaggaggcatggcgtatcgctggcctcacctccagagtaaataggactttatgtacaactattttggtagtagcagtagcggtttatgtatatcagcgtcatgttccttgctacctatataagcattatcatctgtagctgctgttcccacctgcattgtattctacccccggcttggtaccggatgctctggtgcaaaaatgtctctgcttgctgttccaaaaaaaaaaaaaaaaaaaa

SEQ ID NO: 840 - protein, 672 aa, Panicum virgatum
  misc_feature: Ceres CLONE 1744705
  misc_feature (1)..(106): Pfam Name: B3 Pfam Description: B3 DNA binding domain
  misc_feature (1)..(213): Pfam Name: AUX_IAA Pfam Description: AUX/IAA family
  misc_feature: The sequence is a functional homolog of  SEQ ID NO 298 in the  10/412,699 US patent application
  misc_feature: Useful for making plants with modulated growth and phenotype characteristics
MANAGAAVGPGGASDALFRELWHACAGPLVTVPRQGELVYYFPQGHMEQLEASTDQQLDQHLPLFNLPSKILCKVVNVELRAETDSDEVYAQIMLQPEADQNEPTGPDPEPPEPERCNVHSFCKTLTASDTSTHGGFSVLRRHAEECLPQLDMTQNPPWQELVAKDLHGNEWHFRHIFRGQPRRHLLTTGWSVFVSSKRLVAGDAFIFLRGDNGELRVGVRRLMRQLNNMPSSVISSHSMHLGVLATASHAISTGTLFSVFYKPRTSRSEFVVSVNKYLEAKNHKMSVGMRFKMRFEGNESPERRFSGTIIGLGSMPANSTSPWADSDWRSLKVQWDEPSAVVRPDRVSPWELEPLNATNTQPPQPPLRNKRARPPASPSIAPELPPAFGFWKSPAEPTHPFSFSGLQRTQELYHSNPNSIFSSSLNVGFNSKNEHSTPTNNHLYWPIRDTRTESYSASINKLLPERKQESATAGCRLFGIEISNAVSPVVTVASVGQDQPPVESVDVESDQLSQPSQANKTDAPAASSERSPHETESRQVRSCTKVIMQGMAVGRAVDLTRLEGYDDLLHKLEEMFDIQGELSASLKKWKVIYTDDEDDMMLVGDDPWPEFCSMVKRIYIYSYEEAKSLTPKAKLPVIGDTTKPNPDKLSPESDMPQSDSNNSALVAADKD

SEQ ID NO: 841 - DNA, 1769 bp, Panicum virgatum
  misc_feature: Ceres CLONE 1744767
  misc_feature: Encodes the peptide sequence at SEQ ID NO. 842
gacttgagtggcgagacagagcacgaacagatctagagagagagagagagcgagcgagagggcattttcctttttgagataaggaggagagagcttcgtcgcggcgggaggagatggcggtgacgatcgcgtccgtgaaggcgaggcagatcttcgacagccgcggcaaccccaccgtcgaggtggacgtggtcctcagcgacggcagcctcgcgaggggggccgtgcccagcggcgcatccactggaatatatgaggccttggagttgagggatggaggatctgactatcttggcaagggtgttcttaaggctgtggataatatgaatagcattattggaccagcaattattggaaaggaccccacggagcaggttgacattgacaacttcatggtccagcagcttgacggaacctccaacgaatggggctggtgtaaacaaaagcttggagcaaatgctattcttgccgtgtcactagctgtgtgtaaagctggagccatggtgaagaagattcctctttaccagcacattgcaaatctcgctggaaacaaaacactggtgctgcctgtacctgcttttaatgtgattaatggaggatcgcatgctggaaacaagcttgccatgcaggagttcatgatcctcccaactggtgcttcctcattcaaggaggccatgaagatgggagttgaggtgtatcataacctgaagagcataatcaagaaaaagtatggtcaagatgctacaaacgttggggatgaaggtggctttgcacctaacattcaggaaaacaaagagggccttgaactgttgaaggcagctatagaaaaggctggctacactggaaaggtggtcattggaatggatgttgctgcttctgaattctttagtgataaggataagacatatgatcttaatttcaaggaggataacaacgacggttcaaacaaaatttcaggtgacagtctgaaagatctgtacaagtccttcgtttctgagtaccctattgtctcgatcgaagacccgtttgatcaggatgactggtccacctatgccaaactcactgatgagattggagaacaagtgcagattgtaggagatgatcttcttgttactaatcccactagggttgccaaggccatcaatgagaagacctgcaatgctcttctgttgaaggtgaatcaaatcggctcggtgaccgagagtattgaggctgttagaatgtccaagcgtgctggatggggagtgatggcaagccacaggagtggtgagacagaggacaccttcattgctgacctctcggttgggctagctacgggtcaaatcaagacaggagctccctgccgttctgagcgcctggccaaatacaaccagctgctcaggatcgaggaagagcttggtactgcggctgtctatgccggagcaaagttcagggcaccagtggaaccctactgaacacccttcttagaacctaaagatgagcatgtgttctggtggtgtcactagttcgctgcagcattttagtacgagtctgtatcattacaataagatcttgtgtaccataaaagcttcctgtgtcatttgcatatgccatatcaccaatggctggacaattcatataagtggtgattttgtcgtgcaatttctggtagttttggtgggtgacgatctgcacccgcaaaggttttgtccaaacggatttctgaacagtttgggttgtgccataaagatgtattttgctttttgccggaaaaaaaaaaaaaaaaaaaa

SEQ ID NO: 842 - protein, 446 aa, Panicum virgatum
  misc_feature: Ceres CLONE 1744767
  misc_feature (2)..(296): Pfam Name: Enolase_C Pfam Description: Enolase, C-terminal TIM barrel domain
  misc_feature (2)..(295): Pfam Name: Enolase_C Pfam Description: Enolase, C-terminal TIM barrel domain
  misc_feature (1)..(446): SWISSPROT Homolog: EC 4.2.1.11 Enolase
  misc_feature (1)..(446): SWISSPROT Homolog: EC 4.2.1.11 Enolase 1
MAVTIASVKARQIFDSRGNPTVEVDVVLSDGSLARGAVPSGASTGIYEALELRDGGSDYLGKGVLKAVDNMNSIIGPAIIGKDPTEQVDIDNFMVQQLDGTSNEWGWCKQKLGANAILAVSLAVCKAGAMVKKIPLYQHIANLAGNKTLVLPVPAFNVINGGSHAGNKLAMQEFMILPTGASSFKEAMKMGVEVYHNLKSIIKKKYGQDATNVGDEGGFAPNIQENKEGLELLKAAIEKAGYTGKVVIGMDVAASEFFSDKDKTYDLNFKEDNNDGSNKISGDSLKDLYKSFVSEYPIVSIEDPFDQDDWSTYAKLTDEIGEQVQIVGDDLLVTNPTRVAKAINEKTCNALLLKVNQIGSVTESIEAVRMSKRAGWGVMASHRSGETEDTFIADLSVGLATGQIKTGAPCRSERLAKYNQLLRIEEELGTAAVYAGAKFRAPVEPY

SEQ ID NO: 843 - DNA, 1925 bp, Panicum virgatum
  misc_feature: Ceres CLONE 1744828
  misc_feature: Encodes the peptide sequence at SEQ ID NO. 844
tgtctgtcactgtggcagtgtggtaccgtgcgtgcgtaagacggggagaatggagccccgctcctcctcatccgctctcgccgccgccgccctcctcctcgcctcctcgctcctcctcgcggcgcgcgccgacgacccctacaggttctacacctggaacgtcaccttcggcgacatctacccgctcggcgtcaagcaggaggggatactgatcaacggccagttcccggggccgcagatcgacgccgtcaccaacgacaacatcatcgtcaatgtcttcaacaacctgcccgtccccttcctcctctcatggcaaggaattcagcagaggaggagctcatggcaagacggtgtgtacggtacaaactgcccgatccctccgggtggcaatttcacttacaacatgcaattcaaggaccaaattgggagctactactacttcccttcccttttattccacaaggcagccggtggttatggtggcatcagggttcttagcagaccaaggatcccggttccatttgacccccctgctggtgatttcaccatattggctggtgactggttcaaactcaatcacactgacttgaaaggcattttagacagtggaaatgacctgtcattccctgatgggcttcttattaatggacaaggctcgaatggcaatagatttacagtggaccaagggaaaacataccgttttcgggtatcgaatgtgggcattgcaacatcagtgaatattaggattcaaggccattccatgctcctggttgaggtggagggatctcacaccatgcagaccactttcacatccattgatatccatctaggccaatcctactcattccttgttactgctgatcaaccaccggcagactactccataattgtctcgacacgttttatcacccctgtgctcaccaccacagccatcctgcactacagcaatgcaaatggggctgcaacagtaccgcctcccccagcgcctacaaccgagatcgatttttctctcaaccaggctagatcaattcggtggaatctgacagcgagtggaccaaggccaaaccctcaaggttcataccactatggtcttgtcaacacgacacgaactatcagactcgccaactcacgggcaaccatcaatggcaagctgagatatgcagttaacagtatctccttcatcccggctgacactcctctcaaggttgccgatttttacaacatttcgggagtgttcacgctgggcagcatgcctgacaaccctaccagtggcggtgcctacctccagacatctgtcatggcagccaacatgcgggaatatgttgagatcatctttgagaacaccgagaactttgtgcagtcatggcacattgatggttatgcgttctgggttgtcgggatggatggagggcaatggacaccggctagtcgtcagggttacaacctcagagacgccattgctcggtacaccttgcaggtgtaccctcagtcatggaccgccatctacatgccactggacaacgtggggatgtggaacgtgaggtcggagagctgggcccggcaatacctcggccagcagttctacctccgggtgtactcgccggcgaactcgtggcgggacgagaacccgatcccgaagaacgcgctgctctgcggccgggcttctggacgccgaaccaggcctctctgaatcagaagctctgaactgaagggccctgtttcctgtcacgaaagggtgaccgaaacctgtgaggatcagttgaggacttgagggtagagatacatcgggaagctcagattgctgagcagagttccactgtggcgttgttccacttccacccatattttttttagcaattgtagttaaaacattttgcagtgaatttattgtatgggaagcattctcaaaaaaaaaaaaaaaaaaa

SEQ ID NO: 844 - protein, 546 aa, Panicum virgatum
  misc_feature: Ceres CLONE 1744828
  misc_feature (1)..(141): Pfam Name: Cu-oxidase_2 Pfam Description: Multicopper oxidase
  misc_feature (1)..(116): Pfam Name: Cu-oxidase_3 Pfam Description: Multicopper oxidase
  misc_feature (1)..(139): Pfam Name: Cu-oxidase Pfam Description: Multicopper oxidase
  misc_feature (10)..(536): SWISSPROT Homolog: EC 1.10.3.3 L-ascorbate oxidase homolog precursor
MEPRSSSSALAAAALLLASSLLLAARADDPYRFYTWNVTFGDIYPLGVKQEGILINGQFPGPQIDAVTNDNIIVNVFNNLPVPFLLSWQGIQQRRSSWQDGVYGTNCPIPPGGNFTYNMQFKDQIGSYYYFPSLLFHKAAGGYGGIRVLSRPRIPVPFDPPAGDFTILAGDWFKLNHTDLKGILDSGNDLSFPDGLLINGQGSNGNRFTVDQGKTYRFRVSNVGIATSVNIRIQGHSMLLVEVEGSHTMQTTFTSIDIHLGQSYSFLVTADQPPADYSIIVSTRFITPVLTTTAILHYSNANGAATVPPPPAPTTEIDFSLNQARSIRWNLTASGPRPNPQGSYHYGLVNTTRTIRLANSRATINGKLRYAVNSISFIPADTPLKVADFYNISGVFTLGSMPDNPTSGGAYLQTSVMAANMREYVEIIFENTENFVQSWHIDGYAFWVVGMDGGQWTPASRQGYNLRDAIARYTLQVYPQSWTAIYMPLDNVGMWNVRSESWARQYLGQQFYLRVYSPANSWRDENPIPKNALLCGRASGRRTRPL

SEQ ID NO: 845 - DNA, 1938 bp, Panicum virgatum
  misc_feature: Ceres CLONE 1745870
  misc_feature: Encodes the peptide sequence at SEQ ID NO. 846
ctcggcccaatttctcgcggcgtccattccaaaatatcgcccagcccacgatccccccacctctctctcttccctccccctccctcccctcgccggcgggcagcggagatccccccacccgggctgggatcgggttcgtcgttggctgatggtctcagccaacatatatcatcaacgttgacaatgcgccgctgaaacttgctgaagctgcaataagcatgatggttgtgcacataatgatgcttaatcattcatgctgcaataccctcgagtggaacttccttcttctgatgcaaccatgtataggtggacctagtggtgacgtggctgtgattagttgtgaagctgctgagggatctgtgctgcggagttctatttgttctcagtgattcttggcaaagctattggtgaagttaacaatcatggaaaggtacaaaataataagggagataggtgacggaacctgtgggaatgttttcatggcctataatgtagaaacaaatgaaattgttgctgttaaaaaaatgaagagaaaattcttccagtgggaagaatgcgttagtctgcgagaagtgaaggctcttcaaaaactaattcaccctaacattgtgaagctgaaggaggtgacaatggaaaaccatgagctgttcttcatctttgaacacatggaatgtaatttgtatgatgttataagagaaaggcaagttgctttctgtgaaggggatatacggaattttatggtccaaatactgcaaggtcttgcatatatgcataataatggatatttccaccgtgatttgaaacctgagaatttgttggtgacaaatggtatagtcaaaattgctgactttggtttggcaagagaagtatcttccagtcctccctatactgattatgtttccaccagatggtatcgggcaccagaggttctactccaatcgtcagcttacacacctgctattgacatgtgggctgttggtgcgattttggctgagctgttcacattgtccccactttttcctggtgaaagtgagacagaccagctttacaaaatatgcactgtgcttggaaccccagattgcactgtgtggccagagggaatgaacctgcctggttcaagtagctttaagttttttcagattcctccaagaaacttatgggagcttattcctaatgcttctttggaagcaattgacttgatccagcggctttgttcctgggatccacgaaggaggccaactgctgagcaaacattacagcatcccttctttaatgtatgcaactgggtaccaagacctgttcatgatacttcccatacaaaaacaaatgaacctaaagcgcatccaaagctggaactgaacctgtgggatttcagcacagaacctgatgactgtttccttgatttaacactcagtctaaagccaagttttcctggaacagaccttgctaaccatgttccacaacgtacagaagaggaaattttactatactcaggatttgagaatacgcctgtcaagcctggtttttggccactggtgccatcagatcgtcccattggtgatgttccagccattccatcctggcaacaggcatatatggttgacagccaggcgtcattgccaggattttctggttctccattcgggctgtcattacagccgagcctgcttgagaaccgttcactagcgcctatcaggcaggtgaatttcttctgaccgagacaaaattaatagattgagcattcgtacgattcttgcgttcttgacacactccagcatcttgctgtatacactaggctctaataagtggcggcagtagaggaaatgtatatatactactcgtagcttccttttttttggttactccacatttatgtaaataacaagatgaacatctcccgaaaaacagttttgtttgcaaaaaaaaaaaaaaaaaaaa

SEQ ID NO: 846 - protein, 430 aa, Panicum virgatum
  misc_feature: Ceres CLONE 1745870
  misc_feature (1)..(285): SWISSPROT Homolog: EC 2.7.11.22 Serine/threonine-protein kinase ICK
  misc_feature (1)..(429): SWISSPROT Homolog: EC 2.7.11.22 Serine/threonine-protein kinase MHK
MERYKIIREIGDGTCGNVFMAYNVETNEIVAVKKMKRKFFQWEECVSLREVKALQKLIHPNIVKLKEVTMENHELFFIFEHMECNLYDVIRERQVAFCEGDIRNFMVQILQGLAYMHNNGYFHRDLKPENLLVTNGIVKIADFGLAREVSSSPPYTDYVSTRWYRAPEVLLQSSAYTPAIDMWAVGAILAELFTLSPLFPGESETDQLYKICTVLGTPDCTVWPEGMNLPGSSSFKFFQIPPRNLWELIPNASLEAIDLIQRLCSWDPRRRPTAEQTLQHPFFNVCNWVPRPVHDTSHTKTNEPKAHPKLELNLWDFSTEPDDCFLDLTLSLKPSFPGTDLANHVPQRTEEEILLYSGFENTPVKPGFWPLVPSDRPIGDVPAIPSWQQAYMVDSQASLPGFSGSPFGLSLQPSLLENRSLAPIRQVNFF

SEQ ID NO: 847 - DNA, 1765 bp, Panicum virgatum
  misc_feature: Ceres CLONE 1745964
  misc_feature: Encodes the peptide sequence at SEQ ID NO. 848
gcatcgcatcctccagtaccgaggggatagtgccatggcggcggagctccacttcgtgctggtgccgctcttggcgcagggccacgttctccccatgctcgacctggcgcgcctcctggccggccacggcgcgcgcgccaccgtcgtgctcacgcccgtgaacgtcgcgcgcaacaggcccgccctggagcaagccgcgcgggcggggctcgccgtcgacttcgccgagcttgccttcccggggcccgcgctcggcctgcccgagggcctcgagaacctcgacatggtgaccgacgtatccctcgccgtccctttccacgacgccttgtggctgctcgccgagccgctcgaggcgtacctccggtcgctgccccggcgcccggactgcctcgtcgccgactcgtgcagcccgtgggcggcgggcgtcgcgcggcggctcggcatcccgccgctgctgttccacggcccgtccgccttcttcgtcctcgccgcgcacaacctggaaaggcacggcgcgtacgacagcgcgcccggcgacttcgagccgttggaggtgccggacttcccggtgcgagcggtcgtcagcaaggcgacgtcgcccgggctcttccactggccgggtctggagaggcagcggcgggatttgctcgaggccgaggccgccgccgacggcctgctcgtcaacacgtgcgcggccttggagggcgcgttcgtcgagcgctacgcggcggcgctcggccggaaggtgtgggcggtcgggccgctctgcctcctcaacaccggcgcggacacgatggcgggtcgaggcaaccgcgcggccatggacgccgagcgcatcgcgtcctggctcgacgcgcggccggcggcgtccgtgctctacgtcaacttcggcagcatcgcccgcctgttcccagctcaggtcgccgagctcgccgccggcctggaggcgtccggccggccgttcatctgggcgggtaaagacgccgccggcctggacgccgagttcgaggcccgtgtcaaggaccggggcctggtcgtccgcgggtgggcgccgcagatgaccatcctgtcgcacgggtccgtgggcggcttcctgacgcactgcgggtggaactcgacgctggaggccgtctcccacggcgtgccgctgctgacctggccgaacttcgccgaccagttcctgaacgaggcgctggccgtggacgtgctgggcgtcggcgtccgtgccggcgtgaaggtgccggccacgcacgtggggcacgtgaagcccggggagctgctggaggtgcaggtcgggagggacgacgtggggagggtggtggccgagctgatggacgacgcggcgcggcgggctagggcccaggagctcgccgataaggcgagggccgcgatggccgagggcgggtcgtcggacactgacgtcaggaacatggtcctgcacatcgccgagctcgctcggaaggaggcgggcgtggctcctgctcctggtgtgtcagaggccgcgagcaagagcgaggagaagaagatgggcgacgcagatggcacgctcccagtggcgtccaaagtcgcctgaatttcatgaatgcttgggttcgtactctgatggcaagtacaaacctccgaaacctgtacggctgtaccccctttgtcctttggtattactccatgctcttcttgatgtttgttggcttttatttgatccatgacttggaatccacgtatgcgaataaggccgtgtttagttcaaaaaaaaaaaaaaaaaaaa

SEQ ID NO: 848 - protein, 512 aa, Panicum virgatum
  misc_feature: Ceres CLONE 1745964
  misc_feature (1)..(127): Pfam Name: UDPGT Pfam Description: UDP-glucoronosyl and UDP-glucosyl transferase
MAAELHFVLVPLLAQGHVLPMLDLARLLAGHGARATVVLTPVNVARNRPALEQAARAGLAVDFAELAFPGPALGLPEGLENLDMVTDVSLAVPFHDALWLLAEPLEAYLRSLPRRPDCLVADSCSPWAAGVARRLGIPPLLFHGPSAFFVLAAHNLERHGAYDSAPGDFEPLEVPDFPVRAVVSKATSPGLFHWPGLERQRRDLLEAEAAADGLLVNTCAALEGAFVERYAAALGRKVWAVGPLCLLNTGADTMAGRGNRAAMDAERIASWLDARPAASVLYVNFGSIARLFPAQVAELAAGLEASGRPFIWAGKDAAGLDAEFEARVKDRGLVVRGWAPQMTILSHGSVGGFLTHCGWNSTLEAVSHGVPLLTWPNFADQFLNEALAVDVLGVGVRAGVKVPATHVGHVKPGELLEVQVGRDDVGRVVAELMDDAARRARAQELADKARAAMAEGGSSDTDVRNMVLHIAELARKEAGVAPAPGVSEAASKSEEKKMGDADGTLPVASKVA

SEQ ID NO: 849 - DNA, 1516 bp, Panicum virgatum
  misc_feature: Ceres CLONE 1745974
  misc_feature: Encodes the peptide sequence at SEQ ID NO. 850
aaaaacaagaagccaccagcccgaggcagccgcggcaatcaagagcagatcagcagagacgagggcgtacgtgccatcagcagcaatggccgccgccgccgccacctcctcctcccacctgctcttgctctcccgccagaaggcggcctccctccgatgccgcctctccttcctcggccaacccaggaggcccggcggcggcagagctgcggccgcccaggcccaggcgccgggtgccggcgtgcggtgcatggcggccgtggacacggtgcccgcggccacggagacgagcagcgcgaagagcagctacgagctcgtgacgctcacgacgtggctgctgaagcaggagcaggccggggtgatcgacaacgagatgaccatcgtgctggccagcatctccacggcgtgcaaacagatcgcggcgctcgtgctgcgcgcgcccatctccaacctcaccggcgtccagggcgccgtcaacgtgcagggcgaggaccagaaaaagctcgacgtcatctccaacgaggtgttctctaactgcctcaagtcaagcgggcgcaccggcgtgatcgcgtcggaggaggaggacgtgccggtggcggtggagcagagctactcgggcaactacatcgtcgtgttcgaccccctcgacggctcctccaacatcgacgccgccgtctccaccggctccatcttcggcatctacgcccccaacgacgagtgcctcgccgacattgaggacaatgggacccttgattccgtggagcagaggtgcgtcgtgagcgtgtgccagccggggagcaacctgctggccgccggctactgcatgtactcgagctcggtcatcttcgtgctcaccgtcggcacgggggtgtacgtgttcacgctagaccccatgtacggcgagttcgtgctgacgcaggagaaggtgcagatccccaaggccggcaagatctacgccttcaacgagggcaactacgcgctctgggacgacaagctcaagcagtacatggacagcctcaaggagcccggcgactccggcaagccctactccgcgcgctacatcggcagcctcgtcggcgacttccaccgcacgctgctctacggggggatctacgggtaccccagggacaagaagagcaagaacggcaagctcaggctgctctacgagtgcgcgcccatgagcttcatcgtggaacaggccggcggcaagggctccgacggccaccagaggattcttgacatcacgccgacagagatccaccaaagagtgcccctgtacatcggcagcgtggaggaagtggagaaggtggagaaattcctggaatgaataagaataatgtgcccgattagtggcagagccgtttcatcagatgggggggggggggggaatcccattttgaagaattccgttcttgagttgcataatctaaccagatcaagttagggaagggattcatatcaagtatggtttgaaatcttatatgctacggaactttaaaaaaaaaaaaaaaaaaaa

SEQ ID NO: 850 - protein, 413 aa, Panicum virgatum
  misc_feature: Ceres CLONE 1745974
  misc_feature (1)..(332): Pfam Name: FBPase Pfam Description: Fructose-1-6-bisphosphatase
  misc_feature (2)..(336): Pfam Name: FBPase Pfam Description: Fructose-1-6-bisphosphatase
  misc_feature (1)..(338): Pfam Name: FBPase Pfam Description: Fructose-1-6-bisphosphatase
  misc_feature (1)..(333): Pfam Name: FBPase Pfam Description: Fructose-1-6-bisphosphatase
  misc_feature (2)..(335): Pfam Name: FBPase Pfam Description: Fructose-1-6-bisphosphatase
  misc_feature (1)..(331): Pfam Name: FBPase Pfam Description: Fructose-1-6-bisphosphatase
  misc_feature (3)..(412): SWISSPROT Homolog: EC 3.1.3.11 Fructose-1,6-bisphosphatase, chloroplast precursor
MAAAAATSSSHLLLLSRQKAASLRCRLSFLGQPRRPGGGRAAAAQAQAPGAGVRCMAAVDTVPAATETSSAKSSYELVTLTTWLLKQEQAGVIDNEMTIVLASISTACKQIAALVLRAPISNLTGVQGAVNVQGEDQKKLDVISNEVFSNCLKSSGRTGVIASEEEDVPVAVEQSYSGNYIVVFDPLDGSSNIDAAVSTGSIFGIYAPNDECLADIEDNGTLDSVEQRCVVSVCQPGSNLLAAGYCMYSSSVIFVLTVGTGVYVFTLDPMYGEFVLTQEKVQIPKAGKIYAFNEGNYALWDDKLKQYMDSLKEPGDSGKPYSARYIGSLVGDFHRTLLYGGIYGYPRDKKSKNGKLRLLYECAPMSFIVEQAGGKGSDGHQRILDITPTEIHQRVPLYIGSVEEVEKVEKFLE

SEQ ID NO: 851 - DNA, 1812 bp, Panicum virgatum
  misc_feature: Ceres CLONE 1746007
  misc_feature: Encodes the peptide sequence at SEQ ID NO. 852
gttgccaccttcgtcttctccatgcccaaccgaccccaaaagcagagaaggcgcagggagggagcagaaatatccacccccactaccccgcagctccgctgcagcgagcaggcaccaccagcagatcgccccttccacgctgcgccgcctgtgctttcccttctcccccgaggatcatggagcacggggttgttggctccaggtgcgccgccggggccgggcaaatcttgacgaccaagtccagggccgcaacgtcatgtggcaaaagaacgtcaacaagtgttgccagttgtcccaaacatgatgttaagccattgcaattagcagcaaatggatcctcctgtttggctaacagaagtccagtacttaaaaagcagcggaatctttctgttaggtctagccctgcacatgcggttaccacttttgatgatgccaaaggtgtatcttcaagtgttgttgaagaaaaaattggagtcctcttgttaaatcttggtggaccggagaccctggatgatgttcaaccatttttgttcaacctatttgctgatccagatatcattcgactccctaggctgttcaggtttcttcaaagaccactggccaaacttatttctacttttagagctcccaagagtaaagaggggtatgcatccatagggggtggatcaccattgaggaaaattactgatgagcaggcaaatgctctgaagattgcactggaaaagaaaaacttgcacgcaaatatttatgttgggatgcgttattggtaccctttcacagaagaagccattgatcagattaagaaggataagattaccaagctagttgttctcccactttaccctcagtactccatatcaacaagtggatcaagcattcgtgttctccaaaacattgtcaaggaagatccatattttgctggcttgccagtttctatcattgaatcatggtaccagcgtgatggctatgtgaagtcaatggctgacttaattgagaaagagctatctgccttttccaatcctgaagaggttatgattttcttcagtgcacatggtgtgcctctgacctatgttgaggatgctggagatccttacagagatcagatggaggactgtattgctttgatcatgggggaattgagatccagaggaatcctaaacagtcacactctggcataccagagtcgggtggggccagttcaatggctaaagccatatactgatgaagttctagttgaactgggtcaaaagggtgtaaagagcctcctggctgttccagtaagctttgtgagcgagcacattgagacactggaagagatcgacatggagtacaaggagttggctctggaatctggaatcgaaaactggggcagggttcctgctcttggatgtacttcctcattcatctctgaccttgcagacgctattgtcgaagccctgcctactgcctcggcactcgtgaccagaaagcccgacgacactgactctgacctggacctgatgcattacctgactaagatgttcttcggctcaatcttggcattcatcctgctgttatcaccaggactgatttccgctgttcgtaacactatgctttaggttggctaggtaagtagaaaaaaggtgtgataggcacttatccaaagcttaaattttgagattgataagtgaagaagaaacaacttggtaatcacaactagagatcgcctttgactttaaggtggaagcttgcagttcgctgaatattgttcacatagctcgactgcagatcaaagttcattataattccttccaaaaaaaaaaaaaaaaaaaa

SEQ ID NO: 852 - protein, 473 aa, Panicum virgatum
  misc_feature: Ceres CLONE 1746007
  misc_feature (1)..(325): Pfam Name: Ferrochelatase Pfam Description: Ferrochelatase
  misc_feature (1)..(326): Pfam Name: Ferrochelatase Pfam Description: Ferrochelatase
  misc_feature (21)..(472): SWISSPROT Homolog: EC 4.99.1.1 Ferrochelatase-2, chloroplast precursor
  misc_feature (62)..(473): SWISSPROT Homolog: EC 4.99.1.1 Ferrochelatase-2, chloroplast precursor
MEHGVVGSRCAAGAGQILTTKSRAATSCGKRTSTSVASCPKHDVKPLQLAANGSSCLANRSPVLKKQRNLSVRSSPAHAVTTFDDAKGVSSSVVEEKIGVLLLNLGGPETLDDVQPFLFNLFADPDIIRLPRLFRFLQRPLAKLISTFRAPKSKEGYASIGGGSPLRKITDEQANALKIALEKKNLHANIYVGMRYWYPFTEEAIDQIKKDKITKLVVLPLYPQYSISTSGSSIRVLQNIVKEDPYFAGLPVSIIESWYQRDGYVKSMADLIEKELSAFSNPEEVMIFFSAHGVPLTYVEDAGDPYRDQMEDCIALIMGELRSRGILNSHTLAYQSRVGPVQWLKPYTDEVLVELGQKGVKSLLAVPVSFVSEHIETLEEIDMEYKELALESGIENWGRVPALGCTSSFISDLADAIVEALPTASALVTRKPDDTDSDLDLMHYLTKMFFGSILAFILLLSPGLISAVRNTML

SEQ ID NO: 853 - DNA, 1507 bp, Panicum virgatum
  misc_feature: Ceres CLONE 1746023
  misc_feature: Encodes the peptide sequence at SEQ ID NO. 854
aatcccctactttcctcccctctcaaaaccctagggaagcggaggaggaagacgatggatgcctccaaggcccgcgagctccgggagttcgtggaggcctgcaagaaggacccttctctcctcgccgaccccaacctcgccttcttcagggattacctccaaagtttgggtgccaagatccccgccgccgccaaagccgcctccttcgacaagcccaagagatcttccctggacgacattgatgatgatgacgacgatgaagatgaagatctggatatgagggatgccactcctgagccagatgagctcgatgaagagattgttgagtctgatcttgagcttgaagaagacacactaccatctgaccatgatgacccaccacagaagatgggagatccctcagttgaggtaactgaggaaaatcgtgatgcctctcaagaagccaaagggaaggctatggaggctatgtcagaaggaaaactcgacgaggctattgaacatcttaccaacgcaatagtgctgaatccgctctcagcaatcatgtatggcactagagcatccgtgtttataaagatgaagaaaccaactgctgcaattcgtgatgcaaatgctgctctggagattaacccagactctgcgaaaggctataaaacacgtggaatggcttatgccatgcttggcaaatgggaggaagctgctcgtgacttgcacacagcatctaacatggattacgatgaggagatcaatgctgtgctcaagaaggtggaacccaatgcacacaagatagtggagcatcgcaggaagtatgagaggctgagaaaagagagggaggaaaagagggctgagcgtgatcgacttcgtcgacgcgcagaggcacaggctgcttatgaaaaagccaagaggaaggaggaatcgtcaagccgctcatcaggaggcttccctggagcgatgcccggtggaggtttccctggaggaatgcctggaggagctttccctggagggatgcccgggggtttccctggaggtgccatgccggggggtttccctgggggtggtcctggtaatgtcgatatgagtaaaatcctgaatgaccctgaccttatggcggcattcagtgacccagaggtcatggctgctctacaagatgtgatgaacaatcctgccaactttgccaagcaccaagcgaatcccaaggtgggccctatcatagcaaagatgatggccaagttcagtgggtcccagtgaaagttgtgggccagtcaggttttgtgggcagcaagcaaaagttccttggacagtcaacaggtgttccctttttgtgcatctgggtgtgtttagcttgtgatgaagaacatgagtgggttttttttttctgtgcatctggaggtgcgctgagcttgtgatgaaatacactagtgggctcacttcggttagtgcctacgactagcagagatacaggaatgattgacagaggtggtattacagttaaaaaaaaaaaaaaaaaaaa

SEQ ID NO: 854 - protein, 396 aa, Panicum virgatum
  misc_feature: Ceres CLONE 1746023
  misc_feature: Great-hit functional homolog of the protein sequence given in SEQ ID NO 9513
  misc_feature: Useful for making plants with altered terpenoid content
MDASKARELREFVEACKKDPSLLADPNLAFFRDYLQSLGAKIPAAAKAASFDKPKRSSLDDIDDDDDDEDEDLDMRDATPEPDELDEEIVESDLELEEDTLPSDHDDPPQKMGDPSVEVTEENRDASQEAKGKAMEAMSEGKLDEAIEHLTNAIVLNPLSAIMYGTRASVFIKMKKPTAAIRDANAALEINPDSAKGYKTRGMAYAMLGKWEEAARDLHTASNMDYDEEINAVLKKVEPNAHKIVEHRRKYERLRKEREEKRAERDRLRRRAEAQAAYEKAKRKEESSSRSSGGFPGAMPGGGFPGGMPGGAFPGGMPGGFPGGAMPGGFPGGGPGNVDMSKILNDPDLMAAFSDPEVMAALQDVMNNPANFAKHQANPKVGPIIAKMMAKFSGSQ

SEQ ID NO: 855 - DNA, 1852 bp, Panicum virgatum
  misc_feature: Ceres CLONE 1746170
  misc_feature: Encodes the peptide sequence at SEQ ID NO. 856
actctccctgcctgccttggcatcaccaatggcgacgggtggctgaaaaaaacagagtggaagctccccaaacctccccgcatggcccccctcgcctcccctcctctcccatcccgcgcccctgccttcctcgccgccctcgccatccgcagcgggcggcctccacaactgctcagcccgtcgcggtccccactcctctcctccggccccgcaggctgcttcctccgcgcccctctcgcgccctgtaccaccgcccgcgaacgccgccgcgacgccgtgcggacattttcccaagctgatgctgctggacaaacacctttatcaaagactctgtcagacctcaaggattcctgctggagatttctgaggccacacacaattcgaggaactgctttgggatccatagctttggttgctagagccttgatagagaattcccacctgataaattggtggttgttattcaaagcattctatggacttgtagcgttaatatgtggcaatggttacatagttgggatcaatcagatctacgatgttgctattgacaaggtaaataagccatatctgcccattgctgccggtgatctctcagttgagtcagcatggttgctggtgatattattcgcaattgcaggcttttcaattgtagtgtcaaactttggacctttcattacctctctatactgccttggcttatttcttggcactatatattctgttcctccattcagactgaagaaatatccggttgctgcttttcttatcatcgcaacggttcggggttttcttctcaactttggtgtgtactatgctactagggctgcactaggtcttacattccaatggagctctcctgttgctttcattacatgcttcgtgacactatttgctttggtcattgctataaccaaagatctccctgatgttgaaggggatcgcaagtatcagatatcaactttggcaacaaaacttggtgtcagaaatattgctttccttgggtctggtctattggtagcaaattacattgctgctattgctgtagcttttctcatgcctcaggccttcaggcgctctgtcatggtccctgtgcatgttatccttgcagctggtttaattttccagacatgggttctggagcaagctaagtacactaaggatgctatttcgcagtactaccggttcgtttggaatctcttctatgctgaatatatcttcttcccgttgatatagagcctagagatctggtagttcagagtgggctacagcttaatgatgggagcaaatcaaaaagggaggagtcgataaagtgcaggggcgatcatagtcggcagatgcctcttttgtgcatataatataaagcgtacttgttgtgcatatgttgtacggaaactaaatgcggtgatgtttcaaggatcctggagttgtaggagcttcggatgcttttgtaatgctgagggtgagggctttgttggagctgctgtagctggcttcggcacaaattcagcagtgccccgttctgtagggtcttgcccgggaggcttgagctcaggtctcgcatcgatggaaactcaagttctggccccaaagggtggtggtggtggtggtggtggtggtggtgctcgtttcttgtcattcgaggttagtatgcgagacacattgacggcgtgccctctcagtgagtcacgaatactgaatacagaccacggactactagcatccccttggcttatactgtagatatatttcttgagcttcagctgtacctgttgtatagtagaaaccaccgtcttttcaaccgttctggaagggcagaaacttcctccatgtgcaaaaaaaaaaaaaaaaaaaa

SEQ ID NO: 856 - protein, 383 aa, Panicum virgatum
  misc_feature: Ceres CLONE 1746170
  misc_feature (1)..(281): Pfam Name: UbiA Pfam Description: UbiA prenyltransferase family
MAPLASPPLPSRAPAFLAALAIRSGRPPQLLSPSRSPLLSSGPAGCFLRAPLAPCTTARERRRDAVRTFSQADAAGQTPLSKTLSDLKDSCWRFLRPHTIRGTALGSIALVARALIENSHLINWWLLFKAFYGLVALICGNGYIVGINQIYDVAIDKVNKPYLPIAAGDLSVESAWLLVILFAIAGFSIVVSNFGPFITSLYCLGLFLGTIYSVPPFRLKKYPVAAFLIIATVRGFLLNFGVYYATRAALGLTFQWSSPVAFITCFVTLFALVIAITKDLPDVEGDRKYQISTLATKLGVRNIAFLGSGLLVANYIAAIAVAFLMPQAFRRSVMVPVHVILAAGLIFQTWVLEQAKYTKDAISQYYRFVWNLFYAEYIFFPLI

SEQ ID NO: 857 - DNA, 1580 bp, Panicum virgatum
  misc_feature: Ceres CLONE 1746250
  misc_feature: Encodes the peptide sequence at SEQ ID NO. 858
ggatcctttgccagcggcggcgccttcttctctttcctgttcgctccggcgaacgagaagagctagctcttcctccctcgcatgttagacggctgatgccaccggcctgcggcagcgtctaccggcttggccgccaccaccgccggcgcatggacggtgtgtttggcgccctgttcggcggccaccggcggccaggcgggagggcgccggccgcccagcaccggggcctggccccgcagccgtctgcggcctacgacggcggccgccggagggcggtgatcagcaagaagtactcgtacatacccgacaccttcacctcgctcgaccaggtggcggcggcgctgcggcagcagggcctagagtcatccaacctcatcctcggcatagacttcaccaagagcaatgagtggacagggaagcagtcgttcggcgggcagagcctgcacaggctgggcgacacgcccaacccctacgagcaggccatcagcatcatcggcaagacgctggcgccgttcgacgaggacaacctcatcccctgcttcggcttcggcgacgcaaccacccatgacggcaacgtgttcagcttccaccgcgacaactccccgtgccacggcttcgaggaggtcctggcttgctacaggaagatcgtgccgcacctcaggctatccgggccgacgtcgtttgcgccgatcgtggaggcggccgccgacatcgtggaccggagcggagggcagtaccatgttctcgtcatagttacagatggacaggtgactaggagtgttgacacgggtgacagcgatctgagcccacaggagaaaagaactgtggactccattgtcatggcaagctcctatccgttgtccatcatcctggttggggtcggggatgggccatgggaggacatgcagaagttcgacgacaagctccccgcccgcgacttcgacaacttccagttcgtgaacttcacctcgatcatggcgaggagcacgacggcgcagcagaaggagtcggcgttcgcgctcgccgcgctcatggagatccccattcagtacaaggccaccgtcgagctcggcatcctaggtcggtcgacggggaacgccaagagggttacgccggcgccgccgccactgccgcctgcgcagaggcagccgtcgttgaggaggggatccagcaacgttaacgccggatcggcacagcctgcagcaccgagagatgatcaggtgtgcccaatctgcctcaccaatgccaaggatctggcatttggctgtggacacatgtgttgcagggaatgtggggagagcctcaccagatgcccaatatgtcgacagccgatacggtcgaagctgaggctatattcgggatgaacaatatgttatgataaatcatacataacttaaatttctataagaaaacatagtttaggcgccataagaaaacatgccatgatcatgtacagattgtcaaatgtgtgtgaaaagggatcaaggtcaggtcctcgtggtctccaatttggataagcaaccaatggttcatttatgagcaaacgtttattagtttgtgaaaaaaaaaaaaaaaaaaaa

SEQ ID NO: 858 - protein, 422 aa, Panicum virgatum
  misc_feature: Ceres CLONE 1746250
  misc_feature (1)..(33): Pfam Name: zf-C3HC4 Pfam Description: Zinc finger, C3HC4 type (RING finger)
MPPACGSVYRLGRHHRRRMDGVFGALFGGHRRPGGRAPAAQHRGLAPQPSAAYDGGRRRAVISKKYSYIPDTFTSLDQVAAALRQQGLESSNLILGIDFTKSNEWTGKQSFGGQSLHRLGDTPNPYEQAISIIGKTLAPFDEDNLIPCFGFGDATTHDGNVFSFHRDNSPCHGFEEVLACYRKIVPHLRLSGPTSFAPIVEAAADIVDRSGGQYHVLVIVTDGQVTRSVDTGDSDLSPQEKRTVDSIVMASSYPLSIILVGVGDGPWEDMQKFDDKLPARDFDNFQFVNFTSIMARSTTAQQKESAFALAALMEIPIQYKATVELGILGRSTGNAKRVTPAPPPLPPAQRQPSLRRGSSNVNAGSAQPAAPRDDQVCPICLTNAKDLAFGCGHMCCRECGESLTRCPICRQPIRSKLRLYSG

SEQ ID NO: 859 - DNA, 1643 bp, Panicum virgatum
  misc_feature: Ceres CLONE 1746358
  misc_feature: Encodes the peptide sequence at SEQ ID NO. 860
aaaaagctaccggccggccagaccctaaagattgacctgagattgcataataagagaaatttcctgcaagatatggctgttggatcctagaggttctgttgtgtgctcaagccaaacaacatgatgggtggaggggaattcaagagctccttgctgcagcagatggtgtggagtggtggtggtacagacagcaagaatatgatgaatagcttgatgccttgtgccgaggagcaagaagcctccaacaacaagcagataccttcttccatgctcctctcccaacacctccttgaaatctcttccggtccggctcctgaggtgaacaccagtactgcaacttctctagcaagcagtgatctacatgatgggcgggagagcaacataccggagtcatggagccagctgcttcttgggggattagttggagatcatgagagatacagcgctgccacagctctgctgtcaaaaggactagaggagggacctaataatatgcctcatcaggctgcagcagcttacaatctctatggccatggtggtggtgaggagatcatccagacatcgtcggggaccaacaaatctcagcaggtgagccgggcgatgctcttggcgtcctctcctaggtcatgcatcaccacaagcctcggcagcaacatgctagacttctcatcaaacagtacagtactggcaccggaggtgaagaatcatcattctgataactcttctgagggcaacagcactgccagtggttcagctccaaagaaggctagggttcaaacctcttcttccgcacaatctactctaaaggtaagaaaggagaggcttggggataggataacagcgcttcaccagatagtgtccccatttggcaagactgacactgcctccgtactacaggagactattggctacattaggttcctcctgagtcatattgagattcaggaggaggtaaatggcggcggtgacgacaagggctccaataaggattatttgaggagcagagggctgtgcctggtgccggtgtcgtgcacgtcgcacctcgccggcgacgatagtggcacctccgacttgtgggcggtggccacggcgccaccacctccgccgccgctcggcggcatcatctggcgctagaggacgaccatgcatatatgcatccgcatcatcgatcattatcatatcatatcatatcatatcatatatatatatatatatatatatatatatatatatatatatatatatatatatttgctttctttctcctggtgattttggccgctgggccggccggttgctacttgctagcttcatctctagctaccatgagttgctattctcactatggaatacaataataatggagctagctagcgagcagctagctaccggctagctggctgtatgtatctatactatacgggtagtatatacatacgttgagatcgagatatatgatgatggagcatatatcatcatcaggagctgtcattctgtcgtcacagctagctttaagtgctagctgcagctagtaggctcattgctcttgatgcatatgcatttatatatctttaatttttgagcgagaaaattctattctgtatgtatacatataatgtttataaaaaaaaaaaaaaaaaaaa

SEQ ID NO: 860 - protein, 337 aa, Panicum virgatum
  misc_feature: Ceres CLONE 1746358
  misc_feature (5)..(49): Pfam Name: HLH Pfam Description: Helix-loop-helix DNA-binding domain
MMGGGEFKSSLLQQMVWSGGGTDSKNMMNSLMPCAEEQEASNNKQIPSSMLLSQHLLEISSGPAPEVNTSTATSLASSDLHDGRESNIPESWSQLLLGGLVGDHERYSAATALLSKGLEEGPNNMPHQAAAAYNLYGHGGGEEIIQTSSGTNKSQQVSRAMLLASSPRSCITTSLGSNMLDFSSNSTVLAPEVKNHHSDNSSEGNSTASGSAPKKARVQTSSSAQSTLKVRKERLGDRITALHQIVSPFGKTDTASVLQETIGYIRFLLSHIEIQEEVNGGGDDKGSNKDYLRSRGLCLVPVSCTSHLAGDDSGTSDLWAVATAPPPPPPLGGIIWR

SEQ ID NO: 861 - DNA, 1681 bp, Panicum virgatum
  misc_feature: Ceres CLONE 1746361
  misc_feature: Encodes the peptide sequence at SEQ ID NO. 862
acgcgcgctgacacgctcgcacccgtcattaattccagaggggaaacgcacgcggtatccagtggctggctgggcagcgggggcgcaggcgcaggcgggcgagcgagctcggccatggcgagcgcgatgaacggcggcggcggcggcggggcgctgaagcggatgggcccgctgcggctgcagtactacatcgtgatgggcgcggtggcggcagccgtggtgctggccacgctgcgctacatgccgggccccgccgccgcggccagcagcgtggtccggccgggcgcctccgccgcggcggcggcccccggcgccgaggcggaggcggaggatgcggagggggagagtgagaagaggaagaggaagggggacggcgtggtgctgttcaacttcggcgactccaacagcgacacgggcggcgtggcggcggtgatggggatccgcatcgcgccgccggaggggcgggcctacttccaccaccccacggggcggctctccgacggccgcgtcatcctcgacttcatctgtgagagcctgggcacgcaccatctgagcccgttcatgaagccgctgggctccaacttcaccaacggcgtgaacttcgccatcgcagggtccacagccacaccaggggtcaccacgttctcgctggacgtgcaggtggaccagttcatcttcttcaaggagagatgccttgatgccatcgagagaggtgagagtgccccggttgatgaaatggggttccaaactgctttatacaccatggacatcgggcacaatgatatcaatggcgttctccacatgccctatgatgaaatgcttgccagtcttccccctgtaattactgaaatcaagaaagccatcgagaggttgcataagaatggggccaggaagttctggatacacgggacgggcgcgcttggttgcatgcctcagaagcttgcaatgccgagggacgatgacagtggtctcgatgagcatggatgcatcgcaagcataaacaatgtttgcaagaagttcaattctttgctgagtgaagccttggatgagctacgcttgaccctgaaaaagtcggcaattgtctttgtcgatatgtttgctatcaagtatgatcttgttgccaaccacaagaaatacgggattgagaagccgttgatgacatgttgcggccatggaggccccccttacaactacgaccccaagaaaagctgtatgacttcggacgaatacctgtgcaagcttggtgaaaagttcataagctgggatggtgttcacttcaccgatgctgcaaatggcattgtggcttccaaggtgctcagcggcgagtactccattcccagggtcaagctggccagcctcgtcagcactgcaaaatctgacgattaatggtgatatggcattctaattggccctttggtttctcacaaggacgatgaagatggaaccactaacaaaactgaccccccaaatttaattatttcgaggttcttacattagagccatcgtcgacaaaggttttcttttctttttcttctcttttttttgtataattgggtcgaatgtatagcctaggggttaatacatggtcatgctggtgtctctgtaccatgtatgattttctttctgcattttggaacaataaatagagatgaatatttaacaaaaaaaaaaaaaaaaaaaa

SEQ ID NO: 862 - protein, 423 aa, Panicum virgatum
  misc_feature: Ceres CLONE 1746361
  misc_feature (1)..(311): Pfam Name: Lipase_GDSL Pfam Description: GDSL-like Lipase/Acylhydrolase
MASAMNGGGGGGALKRMGPLRLQYYIVMGAVAAAVVLATLRYMPGPAAAASSVVRPGASAAAAAPGAEAEAEDAEGESEKRKRKGDGVVLFNFGDSNSDTGGVAAVMGIRIAPPEGRAYFHHPTGRLSDGRVILDFICESLGTHHLSPFMKPLGSNFTNGVNFAIAGSTATPGVTTFSLDVQVDQFIFFKERCLDAIERGESAPVDEMGFQTALYTMDIGHNDINGVLHMPYDEMLASLPPVITEIKKAIERLHKNGARKFWIHGTGALGCMPQKLAMPRDDDSGLDEHGCIASINNVCKKFNSLLSEALDELRLTLKKSAIVFVDMFAIKYDLVANHKKYGIEKPLMTCCGHGGPPYNYDPKKSCMTSDEYLCKLGEKFISWDGVHFTDAANGIVASKVLSGEYSIPRVKLASLVSTAKSDD

SEQ ID NO: 863 - DNA, 1510 bp, Panicum virgatum
  misc_feature: Ceres CLONE 1746375
  misc_feature: Encodes the peptide sequence at SEQ ID NO. 864
aaaacgagcccgatcggcatctgacccgcgccgcacgcaccaccgcgtccgcgtgcgtgcgtgctgcgaggcctctttcggcacggcggcacgcgccccaacggcgccgggcccggtatatatccccgcccgcccggggccccagctggcaagcgccgccgccagagcaaagcgcagcaccgaaccgcacgccacgcgggcagcgccgccgccgggcgcggatcgaccgaccgatcgatccggccccatggcgatcggggcggaggccggcaacggcggcggaggagggagcgcggcgggggcccgggcgaggagcgtgctgatgacgggcggcgcggggttcatcggcacgcacacggcgctgcgtctcctggagcgcggctacggcgtcaccgtcgtcgacaacttccacaactccgtccccgaggcgctcgaccgcgtccgcctcatcgccggccccgcgctctccgcccgcctcaacttcgtcctcggggatctgaggagcatcgacgacctggagaaggtgttcgcggtcaagaggtacgacgccgtcatccacttcgccgggctgaaggccgtgggggagagcgtcgcgcacccggagctgtactacgacaacaacctcgtcggcaccatcaacctctacaagaccatgaagaagcacggctgcatgaagatggtgttctcgtcgtcggcgaccgtgtacggctggccggaggagatcccgtgcgtcgaggacgccaagctgcaggccgcgaacccctacggcaggaccaagcttatcctggaggatatggcgcgggactaccaccgcgcggacccggagtggagcatcgtcctgctgcgctacttcaaccccatcggcgcgcacagctccggcgagatcggcgaggaccccaaggggatcccgaacaacctgctgccctacatccagcaggtcgccgtcggcaggctgtccgagctcaacgtctacggccacgattaccccacccgggacggcaccgcgatcagggactacatacatgtcgtcgacctggccgacgggcacatcgctgcgctgaacaagctcttcgacactcctgacatcggttgtgtggcctacaatctgggcacggggcgcgggacatccgttctcgagatggtggcggcgttcaagaaggcatccggcaaggagattcccaccaagttctgccccaggaggccgggtgacgcgacggaggtttacgcgtccactgagaaggctgaaagggagcttggatggagagctcagtacgggatcgacgagatgtgcagggaccagtggaactgggccaagaagaacccgtatggctactgcggcagtgccgaaaagaagtagaatcagttcatcggaactccgggctgattgtccatagttgtctgaaacctatcagtggaagatgtaataagtaaagagacgactcaaatgtgtctacaaaagttccatacgatgcctctcttctttaagatccaaaaaaaaaaaaaaaaaaaa

SEQ ID NO: 864 - protein, 369 aa, Panicum virgatum
  misc_feature: Ceres CLONE 1746375
  misc_feature: Great-hit functional homolog of the protein sequence encoded by LOCUS At1g12780
  misc_feature: Great-hit functional homolog of the protein sequence encoded by LOCUS At1g63180
  misc_feature (1)..(265): Pfam Name: Epimerase Pfam Description: NAD dependent epimerase/dehydratase family
  misc_feature (19)..(364): SWISSPROT Homolog: EC 5.1.3.2 UDP-glucose 4-epimerase
  misc_feature (22)..(362): SWISSPROT Homolog: EC 5.1.3.2 UDP-glucose 4-epimerase
  misc_feature: Useful for making plants with altered cell wall content and/or composition
MAIGAEAGNGGGGGSAAGARARSVLMTGGAGFIGTHTALRLLERGYGVTVVDNFHNSVPEALDRVRLIAGPALSARLNFVLGDLRSIDDLEKVFAVKRYDAVIHFAGLKAVGESVAHPELYYDNNLVGTINLYKTMKKHGCMKMVFSSSATVYGWPEEIPCVEDAKLQAANPYGRTKLILEDMARDYHRADPEWSIVLLRYFNPIGAHSSGEIGEDPKGIPNNLLPYIQQVAVGRLSELNVYGHDYPTRDGTAIRDYIHVVDLADGHIAALNKLFDTPDIGCVAYNLGTGRGTSVLEMVAAFKKASGKEIPTKFCPRRPGDATEVYASTEKAERELGWRAQYGIDEMCRDQWNWAKKNPYGYCGSAEKK

SEQ ID NO: 865 - DNA, 1785 bp, Panicum virgatum
  misc_feature: Ceres CLONE 1746383
  misc_feature: Encodes the peptide sequence at SEQ ID NO. 866
attctgctcgggggtaggccgctgaagagctcatccgatcagttcgatctccaacgctcccatcctgcaaaactgaacatggcaatggaggcggtggccgctgcctccccgtcgcttggagcctccttgccctcctccaccgtcctcaaagcgttactgctcatggtgatgctggcgtacctcgtccaaaccctcgtgcggtggcgaaagagcatgtgcaccgcgccgctccctccagggcccatgccgtggcccctcgtcggcaacctgccggagatgcttttcagcggcaagcctgcgttccggtggatccacctcgttatggagaagacgggcaccgacatcgcctgcgtgaagctaggcggcgtccacgtcatccccgtcacctgccccaagatcgcacgggaggtgctcaaggagcaggacgccaacttcgcctcccggccgctgaccatggcctccaggacattcagcagaggctacacggacgccgtgatgtccccctacggcgagcagtggaggaagatgcgccgcgtgctcgcctccgagatcgtctgcccctcccgccacaagtggctccacggcaagcgcgccgacgaggccgacaacctcacccgctacgtctacaacctcgccggagcggggtccggcggcgccgtcgacgttaggcacgtcgcacgccactactgcggaaacgtcgtccgccgcctcgtcttcggcaggcgctacttcggcgagccgcggcgcgacggcggccctggcccgctggaggtgcagcacgtggacgcagtgttcgcctccctggggctcctctacgccttctgcgtctccgactacctgccatggctgctgggcctcgacctcgacggccacgagaggatggtcagggaggccaacgagaaggtgaccaggctgcacgacgcgttcatcgacgagcggtggaggcagtggaagagcggcgagaggcgggagctcgaggacctgctcgacgtgctcattagcctcggagatgccgagggcaaactcaccatcgaggaggtcaaagctcagtcgcaggacatcatgttggcggccatggacaacccgtcgaacgcggtggagtggactctggccgagatggtgaacggcccggagatgctgaggaaggcggtgggggagatcgacggcgtcgtcggccgggaccggctggtgcaggagtccgacatcccgcggctcagctacctcaaggcctgcatccgcgaggcattccgcctccaccccgtctcgccgttcaacgtgccccacgtcgcgctcgccgacgccaccgtggccggctaccacatccccaagggcagccacgtcatcgtcagccgcatcggcctcggccgcaaccctgccgtctgggacgacccgctccgcttcaaccctgaccgacacctcgcctgtgatccgacggcggatgtcacgctcgacgagaaagacctgaggttcatctctttcagcaccggccgccgcggctgcattgccgctccgcttggcacggccatgagcgtcatgctctttggcaggctcttgcaggggttctcctggagcaagccgtcagggatgacagccgtcgacctcagcgagtcgcggcacgacactttcatggccaagccgctggtgctgcacgccgagccacggctgccggcgcacctctactcggccgtctctatatgattcatccctaattgctatcaagcatgtagaagattccttagcctatattatattgtttatttctttcaaaaaaaaaaaaaaaaaaaa

SEQ ID NO: 866 - protein, 539 aa, Panicum virgatum
  misc_feature: Ceres CLONE 1746383
  misc_feature (50)..(539): SWISSPROT Homolog: EC 1.14.13.41 Cytochrome P450 79A1
MAMEAVAAASPSLGASLPSSTVLKALLLMVMLAYLVQTLVRWRKSMCTAPLPPGPMPWPLVGNLPEMLFSGKPAFRWIHLVMEKTGTDIACVKLGGVHVIPVTCPKIAREVLKEQDANFASRPLTMASRTFSRGYTDAVMSPYGEQWRKMRRVLASEIVCPSRHKWLHGKRADEADNLTRYVYNLAGAGSGGAVDVRHVARHYCGNVVRRLVFGRRYFGEPRRDGGPGPLEVQHVDAVFASLGLLYAFCVSDYLPWLLGLDLDGHERMVREANEKVTRLHDAFIDERWRQWKSGERRELEDLLDVLISLGDAEGKLTIEEVKAQSQDIMLAAMDNPSNAVEWTLAEMVNGPEMLRKAVGEIDGVVGRDRLVQESDIPRLSYLKACIREAFRLHPVSPFNVPHVALADATVAGYHIPKGSHVIVSRIGLGRNPAVWDDPLRFNPDRHLACDPTADVTLDEKDLRFISFSTGRRGCIAAPLGTAMSVMLFGRLLQGFSWSKPSGMTAVDLSESRHDTFMAKPLVLHAEPRLPAHLYSAVSI

SEQ ID NO: 867 - DNA, 1636 bp, Panicum virgatum
  misc_feature: Ceres CLONE 1746387
  misc_feature: Encodes the peptide sequence at SEQ ID NO. 868
cctgtgatctccttccgttcccaagctagctagcagacgcacaaggccgcggatccatgggcgtcttcacggtgaccaagctgtccgagggcccggtgcggccgtccgccgccacgccgtcggagacgctgcccatggcctgggtggaccggtacccgacgcaccgcggcctcgtcgagtccgcgcacatctaccgcaacgtcgccggcgacatctccccggcgccggcagggctagaggcggctggtggtggcgcgggcgccgatgccaccgcccccagactcgccctggaggtgccggacaaggaggcgatggtgaacggcaagtccccggccgcggtggtgcgcggcgctctggcggacgcgctggtgcactactacccgttcgcggggcggatcgaagaggacgtccccggccgccccgccgtgcggtgctccggcgagggcgtctacttcgtggaggccgccgccaactgcaccctcgccgacgtcaacttcctcgagcgcccgctgctgctcgccaaggagcagctcgtgccgtgcccgacgccggagctctggcccgtcgagccacacaacaccctcgccatgatacaggtcacgaccttcacctgcggcggcttcgtggtcggcctgcgcaccaaccacgcggtggcggacggcacgggcgcggcgcagttcctgaacgccgtcggcgacctcgcccgcgggctgccggagccccgcgtgaagcccgtctgggcccgggaccgcttccccgacccggacatcaagcccggcccgctcccggggctgccggcgctggccctcgagtacctcgcgttcgacttcccggccgcctacatcgccgagctcaagtcgcagtacgccgcgtccacgggcggcaagatctgctccgccttcgacatcgtcgtcgccaagctctggcagtgccggacgcgcgccatcggcgccgcgcccagcgccgacgtccggctctgcttcttcgccagcgcccgccacgtgctcaagctggagccgggctactacggcaacgccatcttccccgtgaaggtgtcggcgccggcggggaaggtggccgagtcgccggtggtcgagctcgtctgcgcggtgcgcgacgcgaagcggcggatggccgaggagtacctgcgctgggcggagggccgcaccggcgggcgcgacccgttccagatgaccttcagctacgagtccgtgtacgtgtcggactggagcaagctcgggttcaacgacgtcgactacggctacggcacgccggtgtccgccggcccgctggtgaactgcgacctcatcgcgtcggccatcgtcatgagggcgccggcgccgctcgccggcacgcggctgctggccagctgcgtcaccaaggagcacgccggcgacttcgcccgcaggatgcgggaggatctcgtgtgatgatgatatgcgcgcttgcatatgtgcatgcgtgaaggaactcgatcggccgccgtaccgtatcacatctaccgatctactacagtagatgctccgtctcgaattattaatcgttttgttttttttaattcatagattttactacgcacctatatatattatatattatatattatatattatattatattatattatattatatt

SEQ ID NO: 868 - protein, 457 aa, Panicum virgatum
  misc_feature: Ceres CLONE 1746387
  misc_feature (1)..(316): Pfam Name: Transferase Pfam Description: Transferase family
  misc_feature (9)..(411): Pfam Name: Transferase Pfam Description: Transferase family
MGVFTVTKLSEGPVRPSAATPSETLPMAWVDRYPTHRGLVESAHIYRNVAGDISPAPAGLEAAGGGAGADATAPRLALEVPDKEAMVNGKSPAAVVRGALADALVHYYPFAGRIEEDVPGRPAVRCSGEGVYFVEAAANCTLADVNFLERPLLLAKEQLVPCPTPELWPVEPHNTLAMIQVTTFTCGGFVVGLRTNHAVADGTGAAQFLNAVGDLARGLPEPRVKPVWARDRFPDPDIKPGPLPGLPALALEYLAFDFPAAYIAELKSQYAASTGGKICSAFDIVVAKLWQCRTRAIGAAPSADVRLCFFASARHVLKLEPGYYGNAIFPVKVSAPAGKVAESPVVELVCAVRDAKRRMAEEYLRWAEGRTGGRDPFQMTFSYESVYVSDWSKLGFNDVDYGYGTPVSAGPLVNCDLIASAIVMRAPAPLAGTRLLASCVTKEHAGDFARRMREDLV

SEQ ID NO: 869 - DNA, 1752 bp, Panicum virgatum
  misc_feature: Ceres CLONE 1746402
  misc_feature: Encodes the peptide sequence at SEQ ID NO. 870
aagtcgcaccaggttcccgaaccactccgttggcagccaggcggacccacagctcagggaccgaccccaaacccacgccatcatccatggcgccgccggagccggaggtcttcgacgtcgtcatcttcggggcctcgggcttcaccggcaagtacgtcatccgcgaggccctcaagttcctctccccctcctccccgctccgctccctcgcggtcgccggtcgcagccgcgaccgcgtggccgcggcgctccgctgggcggcggcccctgccccgccgccagatgatgtggaaatcctcgtcgcggacgcctccgacccggcatccctcgcagcgctcgcttcccgcgcccggatcgtgctctcctgcgcggggcccttccgcctccacggccacgccgtcgcggcggcctgcgcggccgcgggcgccgactgcctcgacatctccggggagcccgagttcatggagcgcgtagaggccgagctccacgagcccgcagcaaagagtgggtcgctcatcgtctccgcctgcgggttcgactccgtccccgcggagctggggtttctgttccactccaggcagtgggagccgccgtccgcgccggtgaccgtggaggcgtacgtcagcctgcagtctacaaagaggatcgtcgggaacatcggcacctacgagtcggccgtgctcggtgtggccaacgccggccagctacaggcgctgcgccggtcgaggcccaggcggccgaggcccaatattctaggccctccccctcccaaagggttgctgattgagggtcataatcctctggggatgtgggctatgaagttgccttcggccgacactgtggtcgtgaagagaactctgtcaacagttaccgagcatcctgagggccttcctggggcagaagaaaccccagagtacgccgagcacaggaagaagttctggtcctctgttaaacctgcacatttcggtgtgaagattgcctccagatccctgatgatcatcgtgcggttcctgatcactggactgttcattggcctgcttgccaacttctccttcggcaggtctctcctgctgaagtaccctgagttcttctccgctgggatgttcagcagggctggcccgactgaggaaggggtgaagagtgcctccttcaaaatgtggttcgtggggcatggctacagcgacgcaactcgggcatcggagcgtgggagcaagccggacaaggaggtgatcaccaaggtctcaggccctgaggtcgggtacatcacgaccccgatcgtgctggtgcagtgcgccctggtcctgctgagccagcgtggcaacctgcccaagggaggggtgtacacgccgggtgttgtctttggccctaccgatctccagcggcgcctccaggagaacgggatgtcgttcgatgttcaggtgacaagggccatgcactgaggttggaagtggaaaagagttggcaaaggacgtggcctggggaataagaagcgatcggtggcgcctcaatcttgtgtgtgagtggtagactccaaaggtatgcctactacgttctgaagtatacctagtctctgtttgtgatgctgtgtgtttgtgagccgagaaagtaggaagatggtctggccgtgtactgtgagaggatcatatgggttgggttgcagtgtgtgtaatgccaggcttggcttgctgagaaaagctgctttctaatgcggtaatgcatactggagtattccaaaaaaaaaaaaaaaaaaaa

SEQ ID NO: 870 - protein, 450 aa, Panicum virgatum
  misc_feature: Ceres CLONE 1746402
  misc_feature (1)..(433): Pfam Name: Saccharop_dh Pfam Description: Saccharopine dehydrogenase
MAPPEPEVFDVVIFGASGFTGKYVIREALKFLSPSSPLRSLAVAGRSRDRVAAALRWAAAPAPPPDDVEILVADASDPASLAALASRARIVLSCAGPFRLHGHAVAAACAAAGADCLDISGEPEFMERVEAELHEPAAKSGSLIVSACGFDSVPAELGFLFHSRQWEPPSAPVTVEAYVSLQSTKRIVGNIGTYESAVLGVANAGQLQALRRSRPRRPRPNILGPPPPKGLLIEGHNPLGMWAMKLPSADTVVVKRTLSTVTEHPEGLPGAEETPEYAEHRKKFWSSVKPAHFGVKIASRSLMIIVRFLITGLFIGLLANFSFGRSLLLKYPEFFSAGMFSRAGPTEEGVKSASFKMWFVGHGYSDATRASERGSKPDKEVITKVSGPEVGYITTPIVLVQCALVLLSQRGNLPKGGVYTPGVVFGPTDLQRRLQENGMSFDVQVTRAMH

SEQ ID NO: 871 - DNA, 1836 bp, Panicum virgatum
  misc_feature: Ceres CLONE 1746440
  misc_feature: Encodes the peptide sequence at SEQ ID NO. 872
agcagccgagcactgatcaacccaccgccatcacctcactcgccgccgcgcgcaccacccgccgccgcgccttttaaagtaaaaccgcaccccgagcccgtgctccgagctgccgagcccgtcgcctccgcccgccgccgcgcgcctcccacccctcccctccccccatgggcccccgcgcccgagccgggaccgccccacccaccggccggtgcgcgcgccgcggatagatcccacgccccgtcgccaccggatccgatgctggagacggcggccgcctcctccccccgcgccgctgcggcggctgcctccgccggcgcggcggcggcggcttctgccgtttcctccccgcggcggggtggggccaccgcgcaccaccaccggcgctgggcgccggccccgttccgggcgtgcctcgtcgcgctctggctggtgggattcgggctcgtcttcctgtggcagagcacctccgtgggccgcgtgcggctctacacgcgcccgcccatgcccaggcgcgcgccggcgtccatggggcagtgggtggcctccccgcccgtctacgatctgagggagttcggggcggtcggggacgggaggacggtgaacacggcctcgttcgaggcggcggtcgcggcgatcgccgagaggggcggcgggaggctcaccgtgcccgccgggcggtggctcaccgcgccgttcaacctcactagccgcatgacgctattcctcgctgccggcgctgagatcctgggaatccaggatgaaagatattggccattaatgtctccattaccatcatatgggtatggaagagagcacaagggacctcgatacggaagccttattcacggtcaagacctgaaggatgtgactataacaggtcataatggtaccataaatggacaaggtcaaagttggtgggtaaagtttcggagaaaactccttaatcacacaaggggccctctagtgcaactcatgcgatcaagtaacattatcatttcgaatatcactcttcgtgattctcccttttggactcttcacatgtacgactgcaagaatgttactattgtagaaacgaccatcttggctccaattgctggagctccaaatactgatgggataaatccagattcttgtgaaaatgtggtgataaagaattgctatatttctgttggtgatgatgggatagctataaagagtggttgggatcaatatggaattgcatatgggcgcccatctgctaacattattattcagaatgtcataatccgctccatggtcagtgccggtgtatcgatcggaagcgagatgtctggtggtgtctctaatgttttggtagagaatgttcatgtatgggattcacggcgaggtgtgaggataaagactgcccctggaagaggggcctatgtaagcaacattgtgtatcggaacataagcttagagaatgtccgtgttggtattgtcataaagacagactacaatgagcacccagatgaaggcttcgacccgaaggccgtgcccataatcgagaacatttcttacacgtcaatccacgggcagggtgtgcgcgtacctgtcaggatacagggaagcgcagagatccccgtaaagaatgttaccttccatgacatgtcagtgggtatagcagacaggaagcaccatgttttccagtgctcctttgtccaggggcaggtcattggctatgttttccccatgccttgcaagaacctggacatgtataacgagcggcgtgagttggtcaaacaatcgacattccagaacatttctgatatcgactacagtttttgacaagggcaaaaaaaaaaaaaaaaaaaa

SEQ ID NO: 872 - protein, 516 aa, Panicum virgatum
  misc_feature: Ceres CLONE 1746440
  misc_feature (1)..(361): Pfam Name: Glyco_hydro_28 Pfam Description: Glycosyl hydrolases family 28
  misc_feature (1)..(359): Pfam Name: Glyco_hydro_28 Pfam Description: Glycosyl hydrolases family 28
MLETAAASSPRAAAAAASAGAAAAASAVSSPRRGGATAHHHRRWAPAPFRACLVALWLVGFGLVFLWQSTSVGRVRLYTRPPMPRRAPASMGQWVASPPVYDLREFGAVGDGRTVNTASFEAAVAAIAERGGGRLTVPAGRWLTAPFNLTSRMTLFLAAGAEILGIQDERYWPLMSPLPSYGYGREHKGPRYGSLIHGQDLKDVTITGHNGTINGQGQSWWVKFRRKLLNHTRGPLVQLMRSSNIIISNITLRDSPFWTLHMYDCKNVTIVETTILAPIAGAPNTDGINPDSCENVVIKNCYISVGDDGIAIKSGWDQYGIAYGRPSANIIIQNVIIRSMVSAGVSIGSEMSGGVSNVLVENVHVWDSRRGVRIKTAPGRGAYVSNIVYRNISLENVRVGIVIKTDYNEHPDEGFDPKAVPIIENISYTSIHGQGVRVPVRIQGSAEIPVKNVTFHDMSVGIADRKHHVFQCSFVQGQVIGYVFPMPCKNLDMYNERRELVKQSTFQNISDIDYSF

SEQ ID NO: 873 - DNA, 1762 bp, Panicum virgatum
  misc_feature: Ceres CLONE 1746457
  misc_feature: Encodes the peptide sequence at SEQ ID NO. 874
gtggtgggtcagcagcacgtcagccgtcagggtctgtacactgtctcctgtttccctcccagccgccgccgccgccgccgctcctccccggttgctctcgccatggccgacgccgccgacgccctctcagctcggagcaaggtgcaaactttcctagaggctgcgcgcgccggcgacctcgattccctcaagagcctcgtcgcggcgctcgacgaggagggcacgggcgccgccgccgtcgccgccgccgtgcgggacgccaacaagcgcaccgcgctccacttcgccgcgcgcgagggccgcaccgacgtctgccagttcctcatcgaccagctcggcctccccgtcgaccccaaggacgatgatggcgaaactccactcatccatgctgcgcgccaaggccatctgcacactgtcaagtatctacttgaccatggagccgatccttcggtagcctccagcctaggagccacagcgctacatcatgctgcaggaataggaaacacggagctcatgaagcttctactctccaagggagttgatatcgaatcagaaagtgatgccggtactccccttatatgggctgctggtcatggacaggaagatgcagtcaaacttctgcttcaacataatgctaagccaaatattgaaaatgctgatggtgccacagcattattatctgctgttgccgcaggttccctcccatgcttggaggtcctacttgaggcaggtgcaaacccaaatatcagggcttgtggagcaaccccattgcatattgctgcagatagtggaaatatagaattaatcaaatgcttacttaaggctggaggtgacccaaatacctgcgatgatgatggactaaagccaatacaggtcgccgcttggagaaataaccgtgaagttgtggaacttcttttaccattaacatccccaattccaggtgtttcaaactggagtgtagatggaattatagaatacatgctggctaaggagactgaggaaaagtcccaattgaaggaaggaacatctctgaaatcaggcagaccacagcctgttgaggtgtcatctgaagcaaaaaagagatccttggaagctaaatcgagaggtgatgatgccttcagaagaaaggattaccttgtagcagtggatgcttacacgcaggctacagagctggacccaaatgatgcaacagtgctctcaaacagaagcctctgctggctacgggcagggcaagctgagcgtgctctggaggatgcgaaagcatgccgagcattgaggccggattgggcgaaagcatgctacagggaaggtgcagcccatcgcctgttacagaggtttgaggaagctgcaaatgccttctatgagggcgtgcaactagagccggagaacaaagaactagtcagcgcattcagggaggccatcgaagctgggaggaagttccatggggtgaacaatccaaatccagcacaatgattagagagatgttgatgaggaaccaatctagttggattggcaggaatgtttagctgaaatttaatgggatggtgctgaggaactcaagttggagcgttggacgaccaggaagttcgaatgtatgcaaagttttttgagttgtgtaatgatttttttgccgtgtttaggtttgtacgggtgtcgagatgctttgtttggtagcttgagatgatggatggaaaagccacatgacatattgcaacgagacgatacaatccgatcctttggccaaaaaaaaaaaaaaaaaaaa

SEQ ID NO: 874 - protein, 456 aa, Panicum virgatum
  misc_feature: Ceres CLONE 1746457
  misc_feature: The sequence is a functional homolog of  SEQ ID NO 1843 in the  10/374,780 US patent application
  misc_feature: The sequence is a functional homolog of  SEQ ID NO 1844 in the  10/374,780 US patent application
  misc_feature: The sequence is a functional homolog of  SEQ ID NO 1845 in the  10/374,780 US patent application
  misc_feature: Useful for making plants with modulated growth and phenotype characteristics
MADAADALSARSKVQTFLEAARAGDLDSLKSLVAALDEEGTGAAAVAAAVRDANKRTALHFAAREGRTDVCQFLIDQLGLPVDPKDDDGETPLIHAARQGHLHTVKYLLDHGADPSVASSLGATALHHAAGIGNTELMKLLLSKGVDIESESDAGTPLIWAAGHGQEDAVKLLLQHNAKPNIENADGATALLSAVAAGSLPCLEVLLEAGANPNIRACGATPLHIAADSGNIELIKCLLKAGGDPNTCDDDGLKPIQVAAWRNNREVVELLLPLTSPIPGVSNWSVDGIIEYMLAKETEEKSQLKEGTSLKSGRPQPVEVSSEAKKRSLEAKSRGDDAFRRKDYLVAVDAYTQATELDPNDATVLSNRSLCWLRAGQAERALEDAKACRALRPDWAKACYREGAAHRLLQRFEEAANAFYEGVQLEPENKELVSAFREAIEAGRKFHGVNNPNPAQ

SEQ ID NO: 875 - DNA, 1000 bp, Panicum virgatum
  misc_feature: Ceres CLONE 1746459
  misc_feature: Encodes the peptide sequence at SEQ ID NO. 876
acagctagctcttccagaggagaccgggagtcgcaggaggccaggaccaggagcagcagcgagccatggcgtccaccacctgcttcctccaccagtcctccgcccgcttcggcgccgccgcgtcggcgcgcccccagcaggcgccgcgggcccagcagctcgcgtgcagggcgcagaagctggacgccgccgagggcgacgccgcggtcacccgccgcgccgcgctcacgctcctcgcgggcgccgccgccgtcggcgccaaggtgaaccccgccgccgctgcctacggagaagcagccaacgtgttcgggaagcccaagacgaacacggacttcatggcctacagcggcgacggcttcaagctgttgatcccgtctaagtggaaccccagcaaggagcgcgagttccccggccaggtgctccgctacgaggacaacttcgacgccaacagcaacgtctccgtcatcgtccagcccaccaccaagaagaccatcaccgactacggctcgcccgaggagttcctcgcccaggtcgactacctcctcggcaagcaggcctacgccggcaagacggactccgagggcgggttcgagaccgacgcggtggccacggccaacatcctcgagagctcggcgccggtggtggacgggaagcagtactacagcgtgtccgtgctgaccaggacggccgacggcgacgagggcggcaagcaccagctcatcacggccaccgtctcggacggcaagctctacatctgcaaggcgcaggccggcgacaagaggtggttcaagggcgccaggaagggcgtcgagaaggcagccagctccttcagcgtcgcatgagcacgcaccatccgtgcgtcggccggaatttgtttcttttggttcattcaggaatatgcttacgtagatacagaggctgggcatgcctctgattgtacatgagaacaaagaccaaggagagctccatttcgtccctgcaaaaaaaaaaaaaaaaaaaa

SEQ ID NO: 876 - protein, 258 aa, Panicum virgatum
  misc_feature: Ceres CLONE 1746459
  misc_feature: Great-hit functional homolog of the protein sequence given in SEQ ID NO 9494
  misc_feature: Useful for making plants with altered Lignin content
  misc_feature: Useful for making plants with modulated nitrogen use efficiency
MASTTCFLHQSSARFGAAASARPQQAPRAQQLACRAQKLDAAEGDAAVTRRAALTLLAGAAAVGAKVNPAAAAYGEAANVFGKPKTNTDFMAYSGDGFKLLIPSKWNPSKEREFPGQVLRYEDNFDANSNVSVIVQPTTKKTITDYGSPEEFLAQVDYLLGKQAYAGKTDSEGGFETDAVATANILESSAPVVDGKQYYSVSVLTRTADGDEGGKHQLITATVSDGKLYICKAQAGDKRWFKGARKGVEKAASSFSVA

SEQ ID NO: 877 - DNA, 1750 bp, Panicum virgatum
  misc_feature: Ceres CLONE 1746590
  misc_feature: Encodes the peptide sequence at SEQ ID NO. 878
ctgcgacccaggagcccacagaccagagcgctttttcctctctctcctttgccgccgccgcagcctctggccatcgcagctgctcacgaggctcccgagcgcccccacccgccccaacgcgcgcgaggcgagccagggagaggagccttcaaaagcatcacccccggccagccgaggagagcgcgccgagacatggcatcaactgttaccttcagctcagttagtgctcaggcggggctgatccaaaagccaaggaacaatggtgtcacaagctactctggtttaaagacatcatcatcaactgttagctttggattggagtcgtcattcctgggcaggaatgcatccctccgggcatctgttgctccaaggattgtgccgaaagcagtgtctgggtctcagatttctccccaggcatcttacaaagtggccgtacttggtgctgccggtggaatcggacaacccctaggccttttgatcaagatgtcccctctcgtgtcagagctgcatctgtatgatattgcaaatgtcaagggtattgccgcggatctcagccattgcaacacacctgctcaggttctggacttcactggcccctcggaattggcaaactgcttgaaaggtgtggatgttgttgtcatccctgccggagtaccaaggaagccgggcatgactcgtgatgacctctttaacatcaatgcaagcatagtcaagtcacttgttgaggctgttgcagacaattgcccagacgcgttcatccatatcatcagcaacccagtgaactccacagtgccaattgctgctgaggttctgaagcagaagggtgtctacaaccccaagaagctttttggcgttaccaccctggatgttatcagggccaacacatttgtggcacagaagaagaatctcaagctcattgatgttgatgtcccagttgtcggtggccatgctggaatcacaattcttccgttattgtcgaagaccaggccatctgtcaccttcacggacgaggaaactgaggagctgacaaagaggatacagaatgctgggacagaggtggtggaggccaaggctggtgcagggtctgctaccctgtccatggcctacgctgctgccagatttgtcgagtcatctctccgtgcattggctggtgatccagatgtctatgagtgcacattcatccagtctgaggttactgatctgccattctttgcatcaagagttaagctcgggaagaatggtgttgaatctgttgtttctgctgacctcgagggagtgactgagtatgaggccaaggcacttgaggcgctgaaggctgaactgaagggaagcattgagaagggcattgcgttcgcgaacaaacagcaggaagctgttgcgtctgtttgaagtgggtgaaataaaaatccacaagaagagaataaagggacaatgatccagaatccacaatggcttttagttttgcagcctagaattttttgtgttgacaataggaagatgctccagaagagctacaattgtggctgttgttagcttctacggagtaacgattacgtatttacgtaggtgggggctggatgccccccaagttatctatttctgaaccagtccctgttttaacacaacccataaattttgctgcttttctattgtggttgtgtctgtagcttgttgtagtttgcaaactaccaggccgctaataaagtatttttacgaaagcgatttgcatcaaaaaaaaaaaaaaaaaaaa

SEQ ID NO: 878 - protein, 398 aa, Panicum virgatum
  misc_feature: Ceres CLONE 1746590
  misc_feature (1)..(166): Pfam Name: Ldh_1_C Pfam Description: lactate/malate dehydrogenase, alpha/beta C-terminal domain
  misc_feature (3)..(397): SWISSPROT Homolog: EC 1.1.1.37 Malate dehydrogenase, chloroplast precursor
  misc_feature (49)..(389): SWISSPROT Homolog: EC 1.1.1.37 Malate dehydrogenase, mitochondrial precursor
MASTVTFSSVSAQAGLIQKPRNNGVTSYSGLKTSSSTVSFGLESSFLGRNASLRASVAPRIVPKAVSGSQISPQASYKVAVLGAAGGIGQPLGLLIKMSPLVSELHLYDIANVKGIAADLSHCNTPAQVLDFTGPSELANCLKGVDVVVIPAGVPRKPGMTRDDLFNINASIVKSLVEAVADNCPDAFIHIISNPVNSTVPIAAEVLKQKGVYNPKKLFGVTTLDVIRANTFVAQKKNLKLIDVDVPVVGGHAGITILPLLSKTRPSVTFTDEETEELTKRIQNAGTEVVEAKAGAGSATLSMAYAAARFVESSLRALAGDPDVYECTFIQSEVTDLPFFASRVKLGKNGVESVVSADLEGVTEYEAKALEALKAELKGSIEKGIAFANKQQEAVASV

SEQ ID NO: 879 - DNA, 1835 bp, Panicum virgatum
  misc_feature: Ceres CLONE 1746622
  misc_feature: Encodes the peptide sequence at SEQ ID NO. 880
aaccagatcagcagacagcaccgaaggaaggcaccagcgcaatcgaatccagggggaggaggatggcggcggccgtggcctcgctgtaccggcgggtcctcccgtcgccgccggcggtggacttcgcctcgccggagggcaagcgcctcttcgcggaggccctggcggcgggcaccatggagggcttcttccccctggtctcctgcttccagacgcagtcggagccggccttctgcggcctcgcctccctcgccgtcgtcctcaacgcgctcgccatcgaccccggccgccgctggaaggggccctggcggtggttcgacgagtccatgctcgactgctgcgagcccctcgacaaggtcaaggccgagggcatcaccttcgccaaggtggcctgcctcgcgcgctgctccggcgccgacgttcagtccttccgcgccaaccgggtcaccatcgacgacctacgacggcatctcctccgatgcgtcgcctcccaggactgccatctcatcgcctcctaccacaggcagactttcaaacagactggaactgggcatttctccccaatcggtggctaccatgctggagaggatatggctctcatcttggatgtcgctcgcttcaaataccctccccattgggttcccgtggaacttctttgggatgccatgaatactactgatgactcaaccggatttcttagggggttcatgcttgtatcaagaaagacagctgccccttcatcgttgtacacagtgagttgcagggatgagaactggaaaagtatagcaaagtactgtgctgaagatttaccaaatcttttgaagggagagaatctagataatgttcaaacacttttctcccgtttaattgagtctcttccagctgatgctgaagctttgatcaaatgggttgttgaagttaggagaaaggaggaagggggaccaagcttaagcaaagaggagaaagaaaggcttttcttgaaggaaaatgttctacaacaagttcgtgataccagactatttgccatagtctacgaccagcaatatgctaataactcatgttgtaattgctcatcatcgagcgaagaagattcccttactaggattgcagctgccgtatgctgtcagggagctgcggtgctatcaggaaaccttgcatcaagaaatggtttctgctgcaaagaaacatgtttaaaatgtgtccaagcgaatggtgacggccttaagactgttatctcagcctctgtggtatctgaaggcaatgaacagggtgttgatattcttttaccaatgtcttcgcctggttccagtttgtgcaattcaaacttgaagaagaatgccgtgaaatatccttcaagtgcagatgttctgactgttcttctgctggcattacatcccaacacatggttgggcatcaaagatgagaagcttaaagctgaacttcagattcttgtttcaatagacaatctacctgatgatcttaaacgagagataatgcatctaaggcggcaactttattatctgaaggcttgtaaagaaaaggaggaagatgatggtgatgatccaccatcacctaagtatcaatgctaaagagggaatgtgcccacggcataaatttattttccagaaattcatgtcaagagaaaagttgtgcgagagtggttcttgactatagtgaacagaattatggtaggaatgatgatgtatatcttattgatgagatccgatgtaactccccgcttgcacgaagtggctatgcgcagacttaattactttacttactggaaatagaaaagttaaaagagtggtttttgacaaaaaaaaaaaaaaaaaaaa

SEQ ID NO: 880 - protein, 508 aa, Panicum virgatum
  misc_feature: Ceres CLONE 1746622
  misc_feature (1)..(133): Pfam Name: Phytochelatin Pfam Description: Phytochelatin synthase
MAAAVASLYRRVLPSPPAVDFASPEGKRLFAEALAAGTMEGFFPLVSCFQTQSEPAFCGLASLAVVLNALAIDPGRRWKGPWRWFDESMLDCCEPLDKVKAEGITFAKVACLARCSGADVQSFRANRVTIDDLRRHLLRCVASQDCHLIASYHRQTFKQTGTGHFSPIGGYHAGEDMALILDVARFKYPPHWVPVELLWDAMNTTDDSTGFLRGFMLVSRKTAAPSSLYTVSCRDENWKSIAKYCAEDLPNLLKGENLDNVQTLFSRLIESLPADAEALIKWVVEVRRKEEGGPSLSKEEKERLFLKENVLQQVRDTRLFAIVYDQQYANNSCCNCSSSSEEDSLTRIAAAVCCQGAAVLSGNLASRNGFCCKETCLKCVQANGDGLKTVISASVVSEGNEQGVDILLPMSSPGSSLCNSNLKKNAVKYPSSADVLTVLLLALHPNTWLGIKDEKLKAELQILVSIDNLPDDLKREIMHLRRQLYYLKACKEKEEDDGDDPPSPKYQC

SEQ ID NO: 881 - DNA, 1633 bp, Panicum virgatum
  misc_feature: Ceres CLONE 1746793
  misc_feature: Encodes the peptide sequence at SEQ ID NO. 882
ccacaagcaccgcaccgcgctcccctgtcgtctcgccctcgccccccgcggccgtttcacccgcttcccccgcctgcgcgcgctccccgtccgtctccggcggcgacgacgacgaagaaccgcggggacagagaaacagagagatgaggactaggagcggttccctgtattccaacaacggaggcgaggccgccgtggggcagaagaggaagaggacggcgtcgccgatggggcagtcggccgtcgccggcgagtgcgccggcggcgggcggaggaagaggctcgcgagagggccggactacctggacgtgctccccgacgacctcgtcctctccatcctgtccaagctcgccgcctccgcctcggcgccctccgaccttgtctccgtgcacctcacatgcaagaagctcaacgagctcggcgggcatgacatggtgttcgccaaggcctcgccggcgtcgctggccgtgaaggcggcagcgtggtcggagccggcgcagaggttcctcaagcgctgtgccgacgccggcaacctcgaggcctgctacattctcggcatgattcgattctactgcctcgggagccggagcagcggcgccgcgctgctggcgagggcggcggtcggcgcgcacgccgcggcgctctactcactggcggtcatccagttcaacggcagcggcggcgccaagtccgaccgggacctccgcgcgggcgcggcgctgtgcgcgcgcgcggccgcgctgggccacgtcgacgcgctccgcgagctcgggcactgcctccaggacggctacggcgtgcggcgcgaccccgccgagggacgccgactcctggtggccgccaacgcccgcgagctcaccctcgcgctcgccgcggccgccgcctcgcgccaccccttcgccgcggcgctcccgctcggcgcggcggtcgagggctccggcgggtgcccgctcctctcggacttcgggtggagcctccccgaggcggacccccacgcggcgaaccagttcatggtggactggtgggcctcccgcggcgcccaggcggcggccgcgaagaagcccgctacaggcggcgacggcgacggcgcggagctccggctgtgctcccacgtccggtgcgggcggcgcgagacccggcggcacgagttccggcggtgctccgtgtgcggcgccgccaactactgctcccgcgcgtgccaggcgctggactggaagcgcgcccacagggcgcaatgcgttcccatggaccggtggctcgccgccaacgccggcgaggcggccccgcagtgacgctgcggcgcgcctccccaacggctgacctgacgtaccagtactactactagagtactagcccctcggcccaccgtagacccggtgtagcaaaggaaggaaaggcgcagcagatggaaatgcacctcggcccttttttttcctctcttttggtccctatcctttctcttttgcgcctctgctgtctgggcgtcgccttgtcagatgtacgtattctactagggaagaggagccgagggatacccgcgcccgtttctgtttttttgagctcttgttttgtctcggttaaagttaccgctagaactcaaatccttattttctaaaaaaaaaaaaaaaaaaaa

SEQ ID NO: 882 - protein, 382 aa, Panicum virgatum
  misc_feature: Ceres CLONE 1746793
  misc_feature: Great-hit functional homolog of the protein sequence given in SEQ ID NO 9608
  misc_feature (1)..(42): Pfam Name: zf-MYND Pfam Description: MYND finger
  misc_feature: Useful for making plants with altered Lignin content
MRTRSGSLYSNNGGEAAVGQKRKRTASPMGQSAVAGECAGGGRRKRLARGPDYLDVLPDDLVLSILSKLAASASAPSDLVSVHLTCKKLNELGGHDMVFAKASPASLAVKAAAWSEPAQRFLKRCADAGNLEACYILGMIRFYCLGSRSSGAALLARAAVGAHAAALYSLAVIQFNGSGGAKSDRDLRAGAALCARAAALGHVDALRELGHCLQDGYGVRRDPAEGRRLLVAANARELTLALAAAAASRHPFAAALPLGAAVEGSGGCPLLSDFGWSLPEADPHAANQFMVDWWASRGAQAAAAKKPATGGDGDGAELRLCSHVRCGRRETRRHEFRRCSVCGAANYCSRACQALDWKRAHRAQCVPMDRWLAANAGEAAPQ

SEQ ID NO: 883 - DNA, 1720 bp, Panicum virgatum
  misc_feature: Ceres CLONE 1746800
  misc_feature: Encodes the peptide sequence at SEQ ID NO. 884
atcgtctcacattccacaatcgatcagctgcaaaccagtttgaccatctagcctcacatcctgtgtgctctccggcaggcggcgtttccggtgatcgatgatgccgtacagcaccgtccgcttcttctgctcggtcgtcgccgccttcgcgcgcctcgtgcgcgagcttcgcaaggccgtcgccatggccgcgtcatcttcgtcggcggcggcggtgtctcctcccgtgggcctgatagccgccgcgccgctgccgctgcgcaggaagaagctcctggccgcgctcgcgccgccgcagccgcagccgcccgtggttgctcgtccggcggaggtgtgcgacgccgccgccggcgtcagtgtggccggggtggtggatcagcagccgcagcaggccgagagcaagaggaagaagacgtccgcgtggtcggcgagggggcggccctcgaggctcgtcataccggtggcggatgacgccggcgagctggccgccggctggggcgcggccgcggcggcggccacggaggccgacgtggtggtggagggcgaggggttctgggtggccagtcgggctgggccgaggcattccatggaggacgcctactcggtggtcactcacaaaaatggtggtgattcccagctggcattctacggtgtcttcgacgggcatggtggccgcggggccgtggacttcgtctcccagcgcctcggcgagaacgtcgtctccgcggtgctcgccgcgggttcggaggcccgcgacgaagcaccgtcggcggcggaggaggatgacgacgccgtctcggccgcgatcagagccgcctacttggccaccgacagcgagctcctcgcacaacatcagggtgcgagcgccggcggcgcgtgcgcggcgacggcgctggtgaggggcagcgacctgtacgtggcgcacctgggcgactgccgcgcggtgctgagccgcggcggcggcgtggcggccgcgctgacggcggaccacacgtgcgcggcggagggcgagagggcgcgcatcgagcgcggcggcggcttcgtgagccgcagcggcagcggcgtgtggcgggtgcagggcagcctggccgtgtcgcgggcgttcggcgactccggcctgaagcggtgggtgctcgccgagccggcggtcgccagggtgcccctgcgcgccggctgcgagttcctcgtcgtcgcgtccgacggactctgggacaaggtgagcaaccaggaggccgtcgacgtcgtctcgaggagccgcaacgcggcggcgacgtcgtccgtggcgcgctcctgcgtggagctcgtggacatggcgcggcgcagggggagcagggacgacgtcaccgtcatggtcatcgacctcgagaggttcgtgagatagaagaagttacggagctgagggaggcactgactgacagatcgagcttagttcacaaatttaagctgatggaggttaaacggagcaccttattgatcgattgtaaatatgcggcatccagagcaaatgtaatttttttttctgtccctcaatgtaagtatagtatacacgtaggcctggtaggagctaggaatgcatgcagtgtttggagggtacagaaaattaggaagacaggttcctattcaaggaatggttgttggtgtacagataactcatttgaatttaagctctcagacggcaggaaaatgttttatttgtgcggaaaaaaaaaaaaaaaaaaaa

SEQ ID NO: 884 - protein, 427 aa, Panicum virgatum
  misc_feature: Ceres CLONE 1746800
  misc_feature (1)..(253): Pfam Name: PP2C Pfam Description: Protein phosphatase 2C
MMPYSTVRFFCSVVAAFARLVRELRKAVAMAASSSSAAAVSPPVGLIAAAPLPLRRKKLLAALAPPQPQPPVVARPAEVCDAAAGVSVAGVVDQQPQQAESKRKKTSAWSARGRPSRLVIPVADDAGELAAGWGAAAAAATEADVVVEGEGFWVASRAGPRHSMEDAYSVVTHKNGGDSQLAFYGVFDGHGGRGAVDFVSQRLGENVVSAVLAAGSEARDEAPSAAEEDDDAVSAAIRAAYLATDSELLAQHQGASAGGACAATALVRGSDLYVAHLGDCRAVLSRGGGVAAALTADHTCAAEGERARIERGGGFVSRSGSGVWRVQGSLAVSRAFGDSGLKRWVLAEPAVARVPLRAGCEFLVVASDGLWDKVSNQEAVDVVSRSRNAAATSSVARSCVELVDMARRRGSRDDVTVMVIDLERFVR

SEQ ID NO: 885 - DNA, 1182 bp, Panicum virgatum
  misc_feature: Ceres CLONE 1747102
  misc_feature: Encodes the peptide sequence at SEQ ID NO. 886
agaccaccacggccgggtagctagctgagtaccaaaaccacctgcaaagtgcaaacccatcgaaacactctgctctgcttgtagctagctagcagccatggcttctactacttgttgccttagcctgttagtgctggtagcgctggcctcggtggcgtcggcgcagctgtcgtcgacattctacgacacgtcgtgccccagggccctggccaccatcaagagcgccgtcaacgcggcggtggccaaggaggctcgcatgggggcgtccctgctcaggctgcacttccacgactgctttgtccaaggctgtgatgcgtccattctgctggcggggaacgagcagaacgatcctccgaatttaactctgagaggcttcgacgtcatcgccaacatcaaggcgcaggtggaggccatctgcaagcagaccgtctcctgcgccgacatcctcgccgtcgccgcccgcgactccgtcgtagcgctgggagggccgtcatggagtgttccgctggggagacgggactcgcccaaagctgcaagcacgagcacggtaaatcagtttctgatcccccctacagctagcctcgccgaactgattaaagggtacggcgacttgggcctcaacccaaccgacatggttgccctctcaggtgctcacacgatcgggcaggcgcattgcccgagctaccaagaccacatctacaacgacaccaacatcaaccaggcgttcgcgacctcgctccgggccagctgccccatgaccggcggcagcaacgtcatggcgccgctggacacggcaacgcccaccgcgttcgacaacgcctacttcaagaacctgctgtcccagaaggggctcctgcactcggaccaggagctcttcaacggcggcagcaccgacaacattgtgcgaaacttcgcctccagcccgtcggcgttcagcagcgccttcgtgacggccatggtgaagatgggcaacctcagcccgctgacggggacgcaggggcagatcaggacaacatgctccgccgccaactcctaggaagacgacgacgacgatattaattacatatgtgaaaaatacgaggaccacacgaacgaataataagctgatcgatcctgctcactacagccaatatcaaatagcgcatgcctgcatgctttgtataaaaaaaaaaaaaaaaaaaa

SEQ ID NO: 886 - protein, 312 aa, Panicum virgatum
  misc_feature: Ceres CLONE 1747102
  misc_feature (1)..(238): Pfam Name: peroxidase Pfam Description: Peroxidase
  misc_feature (1)..(311): SWISSPROT Homolog: EC 1.11.1.7 Peroxidase 2 precursor
  misc_feature (1)..(312): SWISSPROT Homolog: EC 1.11.1.7 Peroxidase precursor
MASTTCCLSLLVLVALASVASAQLSSTFYDTSCPRALATIKSAVNAAVAKEARMGASLLRLHFHDCFVQGCDASILLAGNEQNDPPNLTLRGFDVIANIKAQVEAICKQTVSCADILAVAARDSVVALGGPSWSVPLGRRDSPKAASTSTVNQFLIPPTASLAELIKGYGDLGLNPTDMVALSGAHTIGQAHCPSYQDHIYNDTNINQAFATSLRASCPMTGGSNVMAPLDTATPTAFDNAYFKNLLSQKGLLHSDQELFNGGSTDNIVRNFASSPSAFSSAFVTAMVKMGNLSPLTGTQGQIRTTCSAANS

SEQ ID NO: 887 - DNA, 1351 bp, Panicum virgatum
  misc_feature: Ceres CLONE 1747254
  misc_feature: Encodes the peptide sequence at SEQ ID NO. 888
gtttggattttgttcctgctcccttcccttgaccctcctcacccaaagcctctgctacagttctacctgacagggccaccatgtctgcttttgtggggaaatacgcagatgagctgatcaagacggccaagttcctcgcgacgccgggcaagggcatcctggcctccgacgagtcgacgggcaccatcggcaagcgcctctccagcatcaacctcgagaacgtcgagtccaaccggcaggcgctccgcgagctgctcttcacggcgcccggcgtgttcgactacctctccggggtcatcctcttcgaggagaccctgtaccagaagacctccgacgggacgccgttcgtggacctgctcgtcgccggcggcgtggtcccggggatcaaggtggacaagggcaccgtcgagatcgcgggaaccaacggcgagaccaccacccaggggcacgactccctgggcgcgcgctgcgccaagtactacgcggccggcgcgcgcttcgccaagtggcgcgccgtgctcaaggtcggcgctgccggggagccgtccgagctcgccgttcggcagaacgccgaggggctcgcgcggtacgcgctgctctgccaggagaacggcctcgtccccatcgtcgagcccgagatcctcaccgacggcggccacgacatcaagacctgcgccgccgccaccgagcgcgtcctcgccgccgtctacaagtcgctcaacgaccacaaggtcctcctcgagggcaccctcctcaagaccaacatggtcacccctggctccaacagccccaaggttggcgtggaggtgatcgcggagtacacggtggcaacgctgcggcgcacggtgccgccggcggtggccggggtggtgttcctgtcgggcgggcagagcgaggaggaggcgacgcagaacctgaacgccatgaacaagctggaggtgctcaggccctggacgctctccttctccttcggccgcgcgctgcagcagagcaccctcaagaagtggctcggcaagaaggagaacgtcgccgccgcgcaggccgccttcgtcgcccggtgcaaggccaactccgaggccacgcttggcaagtacgccggctccggcgccggggacgccgccgcatccgagagcttgtacgtcaaggggtacaagtactaagccgctgccacgccggtggcctcggcctgggacccaatccttgtggtccacgtggcagcattcggaccatgtcaagattcgtgcggatatatgtgcttcacctgtgtagttgtgttgtggactaaattgtctcttccctccggcacctagttaaccaaaaaacatgttatcaaaaaaaaaaaaaaaaaaaa

SEQ ID NO: 888 - protein, 359 aa, Panicum virgatum
  misc_feature: Ceres CLONE 1747254
  misc_feature (1)..(347): Pfam Name: Glycolytic Pfam Description: Fructose-bisphosphate aldolase class-I
  misc_feature (1)..(348): Pfam Name: Glycolytic Pfam Description: Fructose-bisphosphate aldolase class-I
  misc_feature (1)..(349): Pfam Name: Glycolytic Pfam Description: Fructose-bisphosphate aldolase class-I
  misc_feature (1)..(345): Pfam Name: Glycolytic Pfam Description: Fructose-bisphosphate aldolase class-I
  misc_feature (1)..(359): SWISSPROT Homolog: EC 4.1.2.13 Fructose-bisphosphate aldolase, cytoplasmic isozyme
  misc_feature (1)..(359): SWISSPROT Homolog: EC 4.1.2.13 Fructose-bisphosphate aldolase, cytoplasmic isozyme 1
MSAFVGKYADELIKTAKFLATPGKGILASDESTGTIGKRLSSINLENVESNRQALRELLFTAPGVFDYLSGVILFEETLYQKTSDGTPFVDLLVAGGVVPGIKVDKGTVEIAGTNGETTTQGHDSLGARCAKYYAAGARFAKWRAVLKVGAAGEPSELAVRQNAEGLARYALLCQENGLVPIVEPEILTDGGHDIKTCAAATERVLAAVYKSLNDHKVLLEGTLLKTNMVTPGSNSPKVGVEVIAEYTVATLRRTVPPAVAGVVFLSGGQSEEEATQNLNAMNKLEVLRPWTLSFSFGRALQQSTLKKWLGKKENVAAAQAAFVARCKANSEATLGKYAGSGAGDAAASESLYVKGYKY

SEQ ID NO: 889 - DNA, 1834 bp, Panicum virgatum
  misc_feature: Ceres CLONE 1747286
  misc_feature: Encodes the peptide sequence at SEQ ID NO. 890
gtcgaaaaccctagcatccaaatctcccgatccagcagctagcagcagatttccgccatggccgccgccgccgccgcccctgcgccgtcccgcaagacggagacctacaccgacaccaagcgccgcgacgacgtccgcggcgccaacatcgccgctgcgcgcgccgtcgccgacgccgtgcgcacctcgctgggcccccgtggcatggacaagatgatctcttcgggggaccaggaggtcatcatcaccaacgacggcgccaccatcgtctcccgcatggcgctcgtccagcccgccgcccgcatgctcgccgagctctcccgctcccaggacgctgccgccggggacggaaccaccaccgtcgtcgtcctcgccggatccctcctccgccgcgcccagtcgctcctctccgccggcgcccaccccaccgcagccgccgacgccctccaccgcctctccacgcgcgccgtcgacatcctccaatccatggccatccccatcgagctctccgaccgggaatcgctcgtcaaatccgcctccactgcccttaactccaaggttgtttcccagtactccactctcctctcacccctcgccgtcgatgccgcactctctgtcgtcgatcccgctcacccggacctcctcgacctccgtgacatccgcatcgtcaacaaacttgatggaactatagacgacactgagctcgtccatggcctcatcttcgacaaaaaggctagccacgctgccgggggaccaactcggatggagaatgcaaaaatcgctgtcatccagttccaaatctcgccaccaaagactgacattgagcagagcgtcattgtgtcggactattcacagatggaccgcatccttcgtgaggagcgcaattatatcctcgggatggtcaagaagatcagggctgctggatgcaatgtcttgctcattcagaagagcatcttgcgtgatgcggtcaccgacttgtctctgcactatcttgctaaggcaaagattctggtggtcaaggatgtggatagggatgagattgagtttatcaccaagaccttgaactgccttcccattgccaacattgagcacttccgcaccgataagcttgggtatgctgatcttgttgaggaagtctctgttggggagggcaaggtcgtgaagatcactggtatcaaggacatggggaggaccgcaactgtacttgtcagggggtcaaaccagttggtcattgatgaagctgaacgcagtctccatgatgccctctgcgtcatcaggtgcttggtgaacaagaggtttatgattgccggtggtggtgctccagaaatagagatgtcaatgcaactggctgcttgggcaaaggagcttcaagggatggagagttactgcatcaaggagtttgctgaggcactagaggtcatcccttacacgctggctgagaatgcagggcttaacccaatctccattgtcactgagctcaggaaccgccatgctagaggtgagaagaacacaggcatcaatgtgaggaaagggcagatcacaaacatcctggaggagaacgttgtgcagcccttgctggtgagcacaagcgccattacgctatcttgcgagtgcgttagaatgatcttgaagattgatgatattgtcaccgtaagataagggcgtagagttgatcatcacgtcagcctgccctgctgtctggattgatagtgtactacttaatttagaacttggttcgtgggctttggtgttgtcaatctggatgttttgaactcgtggtttggatgatgtcagtagaggaggggagtttgtttaaaaaaaaaaaaaaaaaaaa

SEQ ID NO: 890 - protein, 533 aa, Panicum virgatum
  misc_feature: Ceres CLONE 1747286
  misc_feature (1)..(497): Pfam Name: Cpn60_TCP1 Pfam Description: TCP-1/cpn60 chaperonin family
  misc_feature (1)..(483): Pfam Name: Cpn60_TCP1 Pfam Description: TCP-1/cpn60 chaperonin family
  misc_feature (1)..(504): Pfam Name: Cpn60_TCP1 Pfam Description: TCP-1/cpn60 chaperonin family
  misc_feature (1)..(508): Pfam Name: Cpn60_TCP1 Pfam Description: TCP-1/cpn60 chaperonin family
  misc_feature (1)..(492): Pfam Name: Cpn60_TCP1 Pfam Description: TCP-1/cpn60 chaperonin family
  misc_feature (1)..(496): Pfam Name: Cpn60_TCP1 Pfam Description: TCP-1/cpn60 chaperonin family
MAAAAAAPAPSRKTETYTDTKRRDDVRGANIAAARAVADAVRTSLGPRGMDKMISSGDQEVIITNDGATIVSRMALVQPAARMLAELSRSQDAAAGDGTTTVVVLAGSLLRRAQSLLSAGAHPTAAADALHRLSTRAVDILQSMAIPIELSDRESLVKSASTALNSKVVSQYSTLLSPLAVDAALSVVDPAHPDLLDLRDIRIVNKLDGTIDDTELVHGLIFDKKASHAAGGPTRMENAKIAVIQFQISPPKTDIEQSVIVSDYSQMDRILREERNYILGMVKKIRAAGCNVLLIQKSILRDAVTDLSLHYLAKAKILVVKDVDRDEIEFITKTLNCLPIANIEHFRTDKLGYADLVEEVSVGEGKVVKITGIKDMGRTATVLVRGSNQLVIDEAERSLHDALCVIRCLVNKRFMIAGGGAPEIEMSMQLAAWAKELQGMESYCIKEFAEALEVIPYTLAENAGLNPISIVTELRNRHARGEKNTGINVRKGQITNILEENVVQPLLVSTSAITLSCECVRMILKIDDIVTVR

SEQ ID NO: 891 - DNA, 1689 bp, Panicum virgatum
  misc_feature: Ceres CLONE 1747353
  misc_feature: Encodes the peptide sequence at SEQ ID NO. 892
acatccaaaagctcacctcgcctcaccaccaccgatctcctcgtcgcgttcgcctccgactcgatccggttcttccaatccaatccgcggtgagccgccccctccgatcgcgagcctgccccccggatccgccgccgtcgggctccgggctcgggtctgatccccgcggcgtcgggttttctcttggcgcgtgcgtgcagggagtgatggcgaccaagaggagcgtcggcaccctcggggaggcggatctgaaggggaagaaggtgtttgtgcgcgccgacctcaacgtgccgctcgacgacgcccagaagatcaccgacgacacccgcatccgcgcgtccgtccccaccatcaagttcctcctcgagaagggcgccaaggtcgtcctcgcaagccacctgggccgtccgaaaggtgtcaccccgaagtacagcttgaagcctcttgttccacgcttatctgagctccttggtgttgatgtggtaatggccaatgattgcattggtgaggaggttgagaaattggctgctgctttgccggaaggtggagttctgctccttgagaacgtcagattctacaaggaggaagaaaagaatgaccccgattttgctaagaagctagcatctgttgctgacctttatgtaaatgatgcttttggcacggctcacagagcccatgcttcaacagaaggagttaccaagtttttgaagcctgctgttgctggtttcctcatgcagaaggaacttgactatctcgtcggagctgttgccaacccaaagaagccatttgctgccattgttggtggatccaaggtctcaaccaagattggggtcattgagtctctgctggcaaaggttgatatcctcattcttggtggtggtatgatctacacattctacaaggcacagggatatgctgttggaaaatctcttgtggaggaagacaaacttgagcttgcaacctcacttattgaaaaggcgaaggcaaagggtgtttctcttttgcttcccactgatattgtagtcgctgacaagtttgcacctgatgctgagagcaagattgttcctgccactgctatccctgatgtttggatgggtcttgatgttggccctgatgccatcaaaaccttcaatgatgcattggacaccacccagactattatttggaacggtccgatgggagtgtttgagttcgagaagtttgccgcaggcactgatgccattgcgaagaagttggctgagcttacaacctcaaagggtgtcactaccatcattggtggtggtgactctgttgctgctgttgagaaggctgggctggctgacaagatgagccacatttcgaccggtggtggtgcgagcttggagctgttggaaggcaagccgctcccaggcgtccttgctctcgacgatgcgtaagctacggagctacttcagaacttcaactgcccctgtcagcctacgtgtcattttgttttggaccattgtgtaacattgcaaagttatgaatcgatggaactgagatagaggcttggcatcatgttttgctagatgagtcttgaataagtttagacttccttgctggtgcgagtgaagtgattggaattcggaaaattggaactaacaaactcccatggatgtgtatgatattttgttttgcagtttgcagctccaaaaaaaaaaaaaaaaaaaa

SEQ ID NO: 892 - protein, 402 aa, Panicum virgatum
  misc_feature: Ceres CLONE 1747353
  misc_feature (1)..(298): Pfam Name: PGK Pfam Description: Phosphoglycerate kinase
  misc_feature (2)..(397): Pfam Name: PGK Pfam Description: Phosphoglycerate kinase
  misc_feature (1)..(396): Pfam Name: PGK Pfam Description: Phosphoglycerate kinase
  misc_feature (2)..(396): Pfam Name: PGK Pfam Description: Phosphoglycerate kinase
  misc_feature (3)..(396): Pfam Name: PGK Pfam Description: Phosphoglycerate kinase
  misc_feature (1)..(402): SWISSPROT Homolog: EC 2.7.2.3 Phosphoglycerate kinase, cytosolic
MATKRSVGTLGEADLKGKKVFVRADLNVPLDDAQKITDDTRIRASVPTIKFLLEKGAKVVLASHLGRPKGVTPKYSLKPLVPRLSELLGVDVVMANDCIGEEVEKLAAALPEGGVLLLENVRFYKEEEKNDPDFAKKLASVADLYVNDAFGTAHRAHASTEGVTKFLKPAVAGFLMQKELDYLVGAVANPKKPFAAIVGGSKVSTKIGVIESLLAKVDILILGGGMIYTFYKAQGYAVGKSLVEEDKLELATSLIEKAKAKGVSLLLPTDIVVADKFAPDAESKIVPATAIPDVWMGLDVGPDAIKTFNDALDTTQTIIWNGPMGVFEFEKFAAGTDAIAKKLAELTTSKGVTTIIGGGDSVAAVEKAGLADKMSHISTGGGASLELLEGKPLPGVLALDDA

SEQ ID NO: 893 - DNA, 1555 bp, Panicum virgatum
  misc_feature: Ceres CLONE 1747406
  misc_feature: Encodes the peptide sequence at SEQ ID NO. 894
accagcgaggctccatggctcatggcggagctgagctgaagaaagctgagcaagctagcacacaagcacacgctgccagaacagcaaagttcgctgcagatcgcgatcaggtcagaaaagggcatcacgagatttggtcgattatatatttagggcccccagcgcagcagagagaggcgactcgagcaggctctcagtctccactgctcctccgccgggcgtgctcgacgctgctcgcgggaggggacatgttggcctccgcgtcgacgccggccgccgaggagaagcaggagctggcgcccgtggtgcagtgcaagggcgtcaacgacctcgacaaggtcgtcctccgcgaggtccggggcagctccgccgaggtgtacctgtatggtgggcatgtgacatcatggaaagatgagcatggagatgagttactttttgttagcaataaggctattttcaagcctccaaaagctatacgtggaggaataccaatctgctttccacagttttccaactttggaaatctggaacaacatggatttgcaaggaatagagtctggaccattgatactgatccgccaccatttcctgtaccaaccaccaatacagcttatattgatttaatccttaaacctacggaagaggatttgaagatctggcctcatagttttgaataccgtctgagggttgcacttagtcctggtggtgatttgatgctaacttcacgtataagaaacactaatgcagatggaaagccattctctttcacctttgcataccacacatacttcaagatttctgatatcagtgaggtgcgagtagaaggtctggaaactctggattacctagacaacttacaagacagagcccgtttcactgaacaaggagatgcaattgtttttgaatctgaactggacagaatatatctgggcacaccatcaaaaattgccattattgatcatgagaagaaaagaacatttgttgtgaggaaaggaggacttcctgatgctgttgtttggaatccttgggacaaaaaggcaaaggctatgtcagattttggcgatgatgaatataaacgcatggtttgtgtggaggcagctgctatagagaagccggttactctaaagcctggtgaggaatggactggaaagttggaactttctgctgtgccatctagttattacagtggtcagctagaccctgatcgtgtgattcaggattcaagtgtcccagaggattcaatcagctagtccttactgtaattctgtgcaggtagagcttatatcatgtataagggacactggcagcaaggattatcacaacgtttcttctattctattcaaatctttgttgttttatgttcgggggtgcatattgaaccaatggatgtgaaattggtttccttttttggatctacgtggcataaaggacaagtcagttttcgtagttcgtaccctgtatatggacgtttgaggcgagaaacatcttccatgggttgtaaaataaagaaaaaaaatcctctctaccgttaatccaaaaaaaaaaaaaaaaaaaa

SEQ ID NO: 894 - protein, 411 aa, Panicum virgatum
  misc_feature: Ceres CLONE 1747406
  misc_feature (1)..(277): Pfam Name: Aldose_epim Pfam Description: Aldose 1-epimerase
MAHGGAELKKAEQASTQAHAARTAKFAADRDQVRKGHHEIWSIIYLGPPAQQREATRAGSQSPLLLRRACSTLLAGGDMLASASTPAAEEKQELAPVVQCKGVNDLDKVVLREVRGSSAEVYLYGGHVTSWKDEHGDELLFVSNKAIFKPPKAIRGGIPICFPQFSNFGNLEQHGFARNRVWTIDTDPPPFPVPTTNTAYIDLILKPTEEDLKIWPHSFEYRLRVALSPGGDLMLTSRIRNTNADGKPFSFTFAYHTYFKISDISEVRVEGLETLDYLDNLQDRARFTEQGDAIVFESELDRIYLGTPSKIAIIDHEKKRTFVVRKGGLPDAVVWNPWDKKAKAMSDFGDDEYKRMVCVEAAAIEKPVTLKPGEEWTGKLELSAVPSSYYSGQLDPDRVIQDSSVPEDSIS

SEQ ID NO: 895 - DNA, 1812 bp, Panicum virgatum
  misc_feature: Ceres CLONE 1747444
  misc_feature: Encodes the peptide sequence at SEQ ID NO. 896
agaggtccgtgcggtgggcggtggcttaccagagttaggtccttggcgccttcagtcgggtgaggaaggcttgcagccgagacattgaagacacagtaatagaacacaaaagaatgggtaagaagggaaagtggtttagtgctgtgaagaaagtcttcggctcctccgatcctgatggaaagcaagcaaaggctgagaaggcggacaagtcaaaatccagtaggagatggccatttggaaagtcgaggcactctgatccttctgcctcaacggtgtcagggactgctccagtagctcctttgccgccgccgccaccaatacaacttactcagccacactctcaggagattaaagatgtcaagccagttgaaacagacagtgagcagaacaagcatgcatactctgttgcccttgcatctgctgttgctgctgaagctgcagcagttgctgcccaggccgctgctgaggttgtccgcctcacagcagttactacggcagcaccaaaaatgcctgttacttcaagggaagaacttgcggccatcaagattcagaccgccttcagaggttatctggcaaggagagcattgcgcgcactaagagggctagttagattgaagtcacttgttgatggacatgccgtcaagcgccaaactgctcatactttgcattgcacacaaacgatgacaagagttcaagctcaaatctactctagaagggtgaaattggaggaggaaaaacaggctcttcaaaggcagctccaattgaaacatcaaagggaacttaagaaaatgaagattgatgaagactgggatcacagccatcaatccaaagaacaaattgaggccagcctagttatgaaacaagaagctgcgctaagacgagaaagagcactcgcatatgctttttctcatcagtggagaaattctggtcgaactataaccccaactttcacagaacctggtaatcctaactggggctggagctggatggaacgctggatgacagcaagaccttgggagagccgattggcagcatcagacaaggatcctaaagagcgttctctgacaaagaattccagcaccagtgctgttcgaatgtctgtaccccgtgccatctcaatccagaggccagcaacaccaaacaagtcaagccgtccaccaagccggcaatcaccttcaacaccgccatcgaaggcaccatctacctcaggaaagaccaggccggcaagtccaaggagcagctggctgtacaaggaagatgacctgaggagcatcacaagcatacgctctgaacgcccaaggaggcaaagcataggtggaggctcggtccgggatgatgcaagcctgactagcacaccacctctccccagttatatgcagtcgacagagtctgcgagagcaaagtctcgataccgcagcttattgactgagaaacttgagctttcagagagggcacctctggcccattcagttgttaagaagcgcctctccttcccagtcattgacaaaccgagcggtccaccggcagataagccaaaggaaagggtgagacgccattcagaccctccgaaagtcgatccggcaacactgaaggatgctcctgttgcctgatcaggcccttgtgattgttaggtttcatgctgttttaactccatgatgaaatttctaagattgttttctctgtgtaatgtatgatctgtccgggttgatttgagaattgagacaattctaactgtgtttgcagacatggttttctccctgtagattgacacgtgtgatgctaacagtgtgtgctgttggctttcaatgtacc

SEQ ID NO: 896 - protein, 498 aa, Panicum virgatum
  misc_feature: Ceres CLONE 1747444
  misc_feature: Great-hit functional homolog of the protein sequence given in SEQ ID NO 9200
  misc_feature: Useful for making plants with modulated oxidative stress sensitivity
  misc_feature: Useful for making plants with modulated salt sensitivity
  misc_feature: Useful for making plants with modulated salt sensitivity
MGKKGKWFSAVKKVFGSSDPDGKQAKAEKADKSKSSRRWPFGKSRHSDPSASTVSGTAPVAPLPPPPPIQLTQPHSQEIKDVKPVETDSEQNKHAYSVALASAVAAEAAAVAAQAAAEVVRLTAVTTAAPKMPVTSREELAAIKIQTAFRGYLARRALRALRGLVRLKSLVDGHAVKRQTAHTLHCTQTMTRVQAQIYSRRVKLEEEKQALQRQLQLKHQRELKKMKIDEDWDHSHQSKEQIEASLVMKQEAALRRERALAYAFSHQWRNSGRTITPTFTEPGNPNWGWSWMERWMTARPWESRLAASDKDPKERSLTKNSSTSAVRMSVPRAISIQRPATPNKSSRPPSRQSPSTPPSKAPSTSGKTRPASPRSSWLYKEDDLRSITSIRSERPRRQSIGGGSVRDDASLTSTPPLPSYMQSTESARAKSRYRSLLTEKLELSERAPLAHSVVKKRLSFPVIDKPSGPPADKPKERVRRHSDPPKVDPATLKDAPVA

SEQ ID NO: 897 - DNA, 1690 bp, Panicum virgatum
  misc_feature: Ceres CLONE 1747460
  misc_feature: Encodes the peptide sequence at SEQ ID NO. 898
aagtaacaccattgacccagaccagggccggcgctccaccatctcggctcctcttttattcgcagccatgtcgggcagcgcaaatggtgcctccgccggcgctgctcacgtcgtgatgctcccgtggctcgccttcgggcacatcaccccgttcgcgcagctggcacgcaaactggtctccgccgacggcggtggcgtccgcgtgacgttcctgacggccgccgggaacgtgccgcgcgtcgaggccatgctggcgccgtcggccgcgggcgcggtggtggttgtgccgctccacctgccccacgtcccggggctggacgcgggggcctccagcacggcggagctctccgccgacggcgccgagcttctcaaggtcgccctggacggcacccggccgcaggtcgcggcgctgctcgccgagctccgcccggtcgccgtgatcatggacttcgccacgccgtgggtctacgacatcgccgcgccgctcggcctcaaggcgctccacctcagcgtcttctccgccactgcgggcgcttttaactgcgtccccgcgcgccgcctccacgggccgcacccgtccgcgcacgatctgcggtcggccccggccggcttcccggagggctcttcggtggcgaccatcccggcgtaccaggccgccgacctcacctacttgttcaccagcttcgacggcaagccgtgcgtctacgaccgtgtactggccagcatcgaggcgtgccatggcatcgtgatgaagacatgcgcggagatggagggcagctacatcgactacctctccggccagttcggcaagcctgtgctcctcgccgggcccgtcgtgccggagccaccgcaaggtgagctcgaggatcagtgggagaactggctctccgcgtttcccgacaaggccgtcgtcctcgcctcgttcggcagcgagacgttcctgccggtagccgcggcgacagagcttctcctcggcctcgaggccaccggccggccgttcctcgccgtgttcaacttccccaggggtgcggacacggaggcggagctccaggcgcgcgtcccgctgggattcatggagcgcgtcaaagggcgaggccgcgtgcacgtggggtgggtgcagcagcagcacatcctgcgccaccggagcgtcgggtgcttcttgaaccacggcgggttcagctccgtagtggaggggctcgtcgccggctgccgcctggtgctgctgccgatgaagggcgaccagtacctcaacgcggcgctgttcgcgcgggacctgcgtgtcggcgtggaggtggcgcgccgcgacgaggacggctggttcgggcgcggggacgtggccgacgcggtcgctgcagcgatggcggatggaggggatggtgacgtgcggaagtggagggagttcttgacggacgatgccgtgcagatgaggttcacagacgagttcgtccggcagctcaaggaacacgtaatggagacctgagctgatattttcgctcccaagttctaagtatgttcactcattaggaacttctttgttatttttattattgatcttgttgtaagaccttgagcctatggctttctttgtgtttgatgctcagctgtgtcggatggcagaggctggaacttaatttgttccattatccaaaaaaaaaaagctatgttcacttaaaaaaaaaaaaaaaaaaaa

SEQ ID NO: 898 - protein, 470 aa, Panicum virgatum
  misc_feature: Ceres CLONE 1747460
  misc_feature (1)..(85): Pfam Name: UDPGT Pfam Description: UDP-glucoronosyl and UDP-glucosyl transferase
MSGSANGASAGAAHVVMLPWLAFGHITPFAQLARKLVSADGGGVRVTFLTAAGNVPRVEAMLAPSAAGAVVVVPLHLPHVPGLDAGASSTAELSADGAELLKVALDGTRPQVAALLAELRPVAVIMDFATPWVYDIAAPLGLKALHLSVFSATAGAFNCVPARRLHGPHPSAHDLRSAPAGFPEGSSVATIPAYQAADLTYLFTSFDGKPCVYDRVLASIEACHGIVMKTCAEMEGSYIDYLSGQFGKPVLLAGPVVPEPPQGELEDQWENWLSAFPDKAVVLASFGSETFLPVAAATELLLGLEATGRPFLAVFNFPRGADTEAELQARVPLGFMERVKGRGRVHVGWVQQQHILRHRSVGCFLNHGGFSSVVEGLVAGCRLVLLPMKGDQYLNAALFARDLRVGVEVARRDEDGWFGRGDVADAVAAAMADGGDGDVRKWREFLTDDAVQMRFTDEFVRQLKEHVMET

SEQ ID NO: 899 - DNA, 1799 bp, Panicum virgatum
  misc_feature: Ceres CLONE 1747471
  misc_feature: Encodes the peptide sequence at SEQ ID NO. 900
gtccctcgactccctccccccacacggccactgccaccagtccaccaccacgtccccgccgtcgtcgccgtctccgtctccgtctcaccccacgcgcgtcccgtcgcgtcccgctgctgctgggaggcgcgcccgctcgctcgcgcgcgtcgccgtgacgctgcttccgcgcgccgccgccggcacctccccagcgcgtgggttccaagtcaaggcggcaggggggtccggggagagcggacggcgcgggaggaggggggataaaggcggccgcggcgcgggcgtgagctgcagaagcggagcagaggcggcgttcgactcgggcggtgcgctgagctcggggatcggccgcgcgggcccgaggaggatggcgcaggccgaggaggcgcaggcgccgctgctgcagaccgaggaggcggacgccgagtggagctccaggccgcgccgcattgctctcttcgtcgagccttcgcccttcgcctacatctcggggtacaagaaccggttccagaacttcatcaagcatctacgagagatgggtgatgaggtgttggtagtaactacacacaagggagctcccgaggaattctatggagcaaaggtcattggctcgtggagctttccatgcccattgtaccaaaatgttccactttcgctggcactgagtcctagaatattttctaaggtgaataagttcaagccggatataattcatgctacctcacctggaattatggttattggtgctcttgctatagcgaagatggtatcagttccaatggtgatgtcttatcacacacatcttccagcgtacataccgagatacaatttaaattggttacttgagcccacgtggagttttataagatgcctgcacagagctgcagatctcactctagttccttcagtagctattgccgaagactttgaaactgctaaagtagtaccagcaaacagaatacggctgtggaacaagggcgttgattctgaaagctttcatactaaatatcggaggcatgaaatgcgcgtcagattgagtggtggtgagccagagaaaccattaataatacacgtgggccgttttggacgagagaaaaatctggattttctgaaaagggttatggagaggttccctggagcaagaattgcctttgttggagatggaccatacagggctgagctggaaaaaatgttcacaggcatgccagcagttttcactggaatgctccaaggtgaggagctctcacaagcatacgccagtggagatgtatttgcaatgccttcagagtctgagactcttgggcaagtagttctggagtccatggcttctggagtcccagttgttgctgctcgtgctggaggaatacccgatataatacccaaggacaaggagggcaagactagcttcttgtttacacctggagatctcgatgaatgtgtgaggaagatagagcagctccttaagtcaaaagatctcagagaatctgttggaaaggctgccagggaagagatggagaagtgtgactggagagcagcctcgaggaaaatccgcaacgagcactacagctctgcaatgtcatactggcggaaaaagatgggcaaaacttgactaggttccatcgtttcagtcaggaatcattctgatgctgccctctccgactagttgctgtcaataactaaaagaatttgtacattgtacccaaacagcttgcaagtttgtgtggctagctgcattcatatctccacagttatgatgattgaccgactactacttgtacgaaaaaaaaaaaaaaaaaaaa

SEQ ID NO: 900 - protein, 413 aa, Panicum virgatum
  misc_feature: Ceres CLONE 1747471
  misc_feature (1)..(165): Pfam Name: Glycos_transf_1 Pfam Description: Glycosyl transferases group 1
MAQAEEAQAPLLQTEEADAEWSSRPRRIALFVEPSPFAYISGYKNRFQNFIKHLREMGDEVLVVTTHKGAPEEFYGAKVIGSWSFPCPLYQNVPLSLALSPRIFSKVNKFKPDIIHATSPGIMVIGALAIAKMVSVPMVMSYHTHLPAYIPRYNLNWLLEPTWSFIRCLHRAADLTLVPSVAIAEDFETAKVVPANRIRLWNKGVDSESFHTKYRRHEMRVRLSGGEPEKPLIIHVGRFGREKNLDFLKRVMERFPGARIAFVGDGPYRAELEKMFTGMPAVFTGMLQGEELSQAYASGDVFAMPSESETLGQVVLESMASGVPVVAARAGGIPDIIPKDKEGKTSFLFTPGDLDECVRKIEQLLKSKDLRESVGKAAREEMEKCDWRAASRKIRNEHYSSAMSYWRKKMGKT

SEQ ID NO: 901 - DNA, 1191 bp, Panicum virgatum
  misc_feature: Ceres CLONE 1747527
  misc_feature: Encodes the peptide sequence at SEQ ID NO. 902
gtttccgcccgtcttgtagagttggcctcggcttgggccggaagaaagaaggcaagaaagaaaaggggggcgacgcactgactcaggcccttctcgtcccctcttcttccccatcgatctcgtccttccccaaacccatcccaagccgccgagctcagaacaccccgccgctccaccccagctccgccgggctccgcctcgctcgccgccggtccagatccaggagtgatctccataatagcagcttagaggtgacgcaaacaagtcgacgatgagcagcataggcacgggttacgatctgtcggttaccaccttctctccggatggccgtgtcttccaggtcgagtacgccaccaaggctgtcgacaacagcgggactgttgtcgggatcaagtgcaaagatggcattgtcctgggtgttgagaagctggtaacttcaaagatgatgctggaggggtccaaccggaggatccattcagtgcaccgccactctggcttggctgttgctggcttagcggcagatggcaggcaaattgtttcaagggccaaatcagaagctgctagttatgaaaaggtctacggggaagccatttctgtgaaggaattggcagatcgtgtggcaagttatgttcatctttgcacgttgtactggtggctcaggccgtttggttgtggcgttattcttggaggttatgatacggatgggccacaactctacatgattgagccctcaggagtctcctacaaatactttggtgctgcattggggaagggaagacaggctgcaaaaactgagatagagaagctgaagctttcggagcttacctgccgggaaggcattgttgaagttgcaaagataatttatggagtgcatgacgaagctaaggacaaagctttcgagttggagttgagctgggtctgtgatgaatcaaaccgccagcatcagaaggtaccaaatgatctgttggaacaggccaaggctgctgctcaggcggctctggaggaaatggatgccgactaagaaacaccgacaatacgttcgaaattcgtcttctggtgctgtttaaatctttgatccctttggggtgacatactggacatggccaatttgtcggtttgtttcagtgtaatgtgaacttcatatgtacttaatggaactagtctttcatggaaaaaaaaaaaaaaaaaaaa

SEQ ID NO: 902 - protein, 249 aa, Panicum virgatum
  misc_feature: Ceres CLONE 1747527
  misc_feature (1)..(249): SWISSPROT Homolog: EC 3.4.25.1 Proteasome subunit alpha type 3
MSSIGTGYDLSVTTFSPDGRVFQVEYATKAVDNSGTVVGIKCKDGIVLGVEKLVTSKMMLEGSNRRIHSVHRHSGLAVAGLAADGRQIVSRAKSEAASYEKVYGEAISVKELADRVASYVHLCTLYWWLRPFGCGVILGGYDTDGPQLYMIEPSGVSYKYFGAALGKGRQAAKTEIEKLKLSELTCREGIVEVAKIIYGVHDEAKDKAFELELSWVCDESNRQHQKVPNDLLEQAKAAAQAALEEMDAD

SEQ ID NO: 903 - DNA, 1874 bp, Panicum virgatum
  misc_feature: Ceres CLONE 1747545
  misc_feature: Encodes the peptide sequence at SEQ ID NO. 904
agtacctctccaacacgcctctctccctacatacagcaatggcggcaggagctcatcaagtggattcgatcgagcaaattaacaaagcggccactcccggcaccttctagccactacctacccagcagctagctagccagccatggggtcgctgccgccagcggagcagccgccgccgcacgcggtgatgatcccgtacccggcgcagggccacgtgacgcccatgctgcagctggccaagctcctccacgcgcggggcttccacgtcaccttcgtcaacaacgagttcaaccaccgccgccacctccgcgcgcgggggcccgccgcgctcgacggcgcccccgggttccgcttcgccgccatcgacgacggcctcccgcgctgcgacgccgacgccacccaggacgtcccggcgctctgctactccaccatgaccacctgcctgccccgcttcaaggacctcgtcgccaggctcgacgccgaggccgaccgcccgcgcgtcacctgcgtcgtcgccgacagcaccatgacgttcgcgctccgcgccgcgcgggagctcggcctccgcgccgccacgctctggaccgccagcgcgtgcggcttcatcacctactaccactaccgccacctcgtcgaccgcggcctcgtcccgctcagggacgaggcgcagctcgctgacggctacctcgacaccgtcgtcgactgggtccccggcgcgcccgcggacctgcgcctccgcgacttccccagcttcgtgcgcaccacggaccccgacgacgtcatgctcaacttcttcatccacgagacggccggcatgtcgcaggcgtcggcggtcgtgatcaacaccttcgacgagctcgacgccacgctgctcgacgccatggccaatatcctaccgcccctctacaccgtgggcccgctcccgctgacggtgcggaacaacgtgccggcggggagccccgtcgccgccatcgcgtccaacctgtggaaggagcaggacgcgccgctccggtggctggacggccgcccgccgcgctccgtcgtgtacgtcaacttcgggagcatcacggtgatgtcgagcgagcagctggccgagttcgcgtggggcctcgccaacaccggctacgcctttctctggaacgtgcgcccggacctcgtcaagggcgactccgccgggctgccgccggagttcgcggcggccacggagggccggagcatgctgtcgacgtggtgcccgcaggcggcggtgctggagcacgaggccgtgggggtgttcctcacgcactccggctggaactcaacgctggagagcatctgcggcggcgtgcccatggtgtgctggcccttcttcgccgagcagcagaccaactgccgctacaagtgcaccgagtggggcatcgggatggagatcggcggcgacgtggagcgcgccgaggtggaggcgctcatccgggaggccatggagggggacaaggggagggagatgcgccgccgcgcggccgagctcagggagagcgccgtggcggcggcgagccccggcggacggtccatgcgcaacgtcgaccggctcatcgacgaggtgctcctagcttgaacacacgttgccctgtgttcgttggcctcttgttggttggcggctgccacagcttgaaatcctatctttgttatctgaatgcgatagccttctgatatcagtttgagatgatatatagtgatgcaaaataacttcagttattaagttcgggttctttttggggaaagctatcacgttttagctcgatcgaatttatacggaattttatgtgatttccgctccacttcatacaaatatatctagtttcttgtataattattaaaaaaaaaaaaaaaaaaaa

SEQ ID NO: 904 - protein, 483 aa, Panicum virgatum
  misc_feature: Ceres CLONE 1747545
  misc_feature (1)..(121): Pfam Name: UDPGT Pfam Description: UDP-glucoronosyl and UDP-glucosyl transferase
MGSLPPAEQPPPHAVMIPYPAQGHVTPMLQLAKLLHARGFHVTFVNNEFNHRRHLRARGPAALDGAPGFRFAAIDDGLPRCDADATQDVPALCYSTMTTCLPRFKDLVARLDAEADRPRVTCVVADSTMTFALRAARELGLRAATLWTASACGFITYYHYRHLVDRGLVPLRDEAQLADGYLDTVVDWVPGAPADLRLRDFPSFVRTTDPDDVMLNFFIHETAGMSQASAVVINTFDELDATLLDAMANILPPLYTVGPLPLTVRNNVPAGSPVAAIASNLWKEQDAPLRWLDGRPPRSVVYVNFGSITVMSSEQLAEFAWGLANTGYAFLWNVRPDLVKGDSAGLPPEFAAATEGRSMLSTWCPQAAVLEHEAVGVFLTHSGWNSTLESICGGVPMVCWPFFAEQQTNCRYKCTEWGIGMEIGGDVERAEVEALIREAMEGDKGREMRRRAAELRESAVAAASPGGRSMRNVDRLIDEVLLA

SEQ ID NO: 905 - DNA, 1712 bp, Panicum virgatum
  misc_feature: Ceres CLONE 1747717
  misc_feature: Encodes the peptide sequence at SEQ ID NO. 906
gttcctcctctctctttctcgcgctcggctcgtctcgtctcgtctcggctagggttaggacctctcgccaagtcgccatgatgcagcagcccccgccgccgcagcagcagccgggtatggcgccgccaccacccgcgggcgggcagccgcagcactggggtgggatcccgccgccgatggcgcagcagtacggcgcgccgccaccgcagcagacgccggcgatgtggggccagcagccgccgcaggcgcactacgggcaggcgccgccccctcagccgtactacgccgcgcctcccgcaccggcgccggcggcacccgcggcggcggacgaggtcaggacgctctggatcggggacctgcagtactggatggacgagaactacatctacggatgcttcgccacaaccggggaggttcaatctgtaaagctcatccgtgacaagaattcagggcagctccagggttatggctttgttgaatttacaagccgtgcagctgcagagcgagttcttcaaacatacaatgggcaaatgatgcccaatgttgagttgacattccggctgaactgggccagtgctggtgaaaagcgtgatgatacccctgactatactattttcgttggggatttggcagcagatgttacagattacttattacaagagacattcagggttcattacccttcggtgaagggtgcaaaagttgtgactgataaattgacaatgcgttcgaagggttatgggtttgtgaaatttggtgatcctactgagcaagctcgtgcaatgacggaaatgaatggaatgccttgttcatccaggcctatgcgtattggccctgcagcaagtaggaaaacaacaggagttcaagaaagagtaccaaattctcaaggagctcagtccgagaatgatcctaacaataccactatattcgttggtggccttgatcccaacgttactgaagatgtcctgaaacaagtttttgctccttacggagaagtggtccatgttaagatccctgttgggaaaagatgtggttttgttcagttcgctaccagaccttctgccgagcaagcgttgctgatgctgcaagggaccttaattggggggcagaatgttcggctttcatggggtcgaagcctgtccaacaagcagcctcagcaggattccaaccaatggggtggagctgctgcttctgctggtggtggtggttactatggtggctatggacaaggttatgaggcttatggcggtggttatgcccaacctcaggatcctaacatgtatggttatggtgcttatgctggttatcccaattaccaacagcaaccagctgcacagcagccacagcaacagcagtgaagcctgttttgctcaggcaaatcattgggttgtgagatgttctaaagttatttcgaggcgctggtatattgcattctagctcttgtcgatagagagatggtttcggaaggctcctgattttgattgcctgtgcctcatggcatggtttcatctattttatattattgttattattcattgtgttatggctatgaacaagtggtgctctactgtgattgctattctcagacatgctttcttagcttctctcaatgttctctatctagtggtatcgtattattgtgtatttctatctgcagttacgctatacatgtacactgtaccgtttgcttccaaaaaaaaaaaaaaaaaaaa

SEQ ID NO: 906 - protein, 426 aa, Panicum virgatum
  misc_feature: Ceres CLONE 1747717
  misc_feature: The sequence is a functional homolog of  SEQ ID NO 536 in the  10/666,642 US patent application
  misc_feature: Useful for making plants with modulated growth and phenotype characteristics
MMQQPPPPQQQPGMAPPPPAGGQPQHWGGIPPPMAQQYGAPPPQQTPAMWGQQPPQAHYGQAPPPQPYYAAPPAPAPAAPAAADEVRTLWIGDLQYWMDENYIYGCFATTGEVQSVKLIRDKNSGQLQGYGFVEFTSRAAAERVLQTYNGQMMPNVELTFRLNWASAGEKRDDTPDYTIFVGDLAADVTDYLLQETFRVHYPSVKGAKVVTDKLTMRSKGYGFVKFGDPTEQARAMTEMNGMPCSSRPMRIGPAASRKTTGVQERVPNSQGAQSENDPNNTTIFVGGLDPNVTEDVLKQVFAPYGEVVHVKIPVGKRCGFVQFATRPSAEQALLMLQGTLIGGQNVRLSWGRSLSNKQPQQDSNQWGGAAASAGGGGYYGGYGQGYEAYGGGYAQPQDPNMYGYGAYAGYPNYQQQPAAQQPQQQQ

SEQ ID NO: 907 - DNA, 1834 bp, Panicum virgatum
  misc_feature: Ceres CLONE 1747852
  misc_feature: Encodes the peptide sequence at SEQ ID NO. 908
ggctcaggattgcccggctccaccgcgcccgaattccccacctcccaccgccccatggccgccgccgccctcctcctccgcacccaccaccacccctgcaagccgccgccgcccgcggcgcgcgcgcccgccctctgccgcgccgcggcggggacgtcggccgggccggcgtcggccgcggcgctgcggtcgctggccccgcccacgcggccggagctgctgtccctcgacctgccccgctacgacccgtcgcgcgcccgccccgtggacctcgccgtggtgggcggcgggcccgcgggcctcgccgtggcgcagcgcgtggcggaggccggcctgtcggtgtgcgccgtcgacccgtccccggcgctcgtgtggcccaacaactacggcgtgtgggtggacgagttcgaggccatgggcctctcccactgcctcgacaccgtctggccgtcggcctccgtcttcatcgacgacggccgcgccaagtcgctcgaccgcccctacgcccgcgtcgcgcgccgcgagctcaagtccgccatgatggaccgctgcgtcgccaacggcgtcctcttccaccaggccaaggtcgccaaggccgtccactacgacgcctcctccatcctcatctgcgacgacggcgtctccatcccggccaccatcgtgctcgacgccacggggttctcgcgctgcctcgtgcagtacgacaagccctacaaccccgggtaccaggtcgcctacggcatcctcgccgaggtggacggccacccgttcgacatcgacaagatgctcttcatggactggcgcgactcgcacctcgccgagggctcggagatcaaggagcgcaaccgccgcatccccacgttcctctacgccatgcccttctcgcccacgaggatcttcctcgaggagacgtcgctcgtcgcgcgcccgggcctcgccatggacgacatccaggagcgcatggcggcgcggctcaggcacctgcggatacgcgtccggagcgtcgaggaggacgagcgctgcgtcatccccatgggcgggccgctgcccgtgctgccgcagagggtggtcggcatcggcggcacggccgggatggtgcacccgtccacggggtacatggtggcgcgcacgctggcgaccgcgcccatcgtggcggacgccatcgtgcggttcctcgacaccggcgacggcacggccggcctcgccggggacgcgctctccgccgaggtgtggaagcagctgtggccggccaacaggcggcggcagagggagttcttctgcttcggcatggacgtcctgctcaagctggacctcgagggaacgcggcgcttcttcgacgccttcttcaacctcgagccgcactactggcacggcttcctgtcgtccaggctgttcctgccggagctcttgatgttcgggctagcgctgttcgggaacgcctccaacacgtcgaggctggagatcatggccaagggcaccttgcctctgggcaagatgattggcaacttgatacaggacagagatgggtgagggtatgtatgcctgcatttctcacctgaagatctccattggatctctgattttggcattgctgatgctcagtgtatttgagatttgcaaagaaagattcacgaaacaccagtctaggagcttctgtcagatataggaattgctgctgcaacgttattttaatattggtgagcacaatttacagtcacaattcgatgacgagagctgtatagttgcaaactgagggatgttacgacaatccacgtatcagatatcatggtcttcaaatagaagaccgatttcccaaaaaaaaaaaaaaaaaaaa

SEQ ID NO: 908 - protein, 491 aa, Panicum virgatum
  misc_feature: Ceres CLONE 1747852
  misc_feature (1)..(393): Pfam Name: Lycopene_cycl Pfam Description: Lycopene cyclase protein
  misc_feature (1)..(394): Pfam Name: Lycopene_cycl Pfam Description: Lycopene cyclase protein
  misc_feature (1)..(398): Pfam Name: Lycopene_cycl Pfam Description: Lycopene cyclase protein
  misc_feature (47)..(485): SWISSPROT Homolog: EC 5.3.99.8 Capsanthin/capsorubin synthase, chromoplast precursor
MAAAALLLRTHHHPCKPPPPAARAPALCRAAAGTSAGPASAAALRSLAPPTRPELLSLDLPRYDPSRARPVDLAVVGGGPAGLAVAQRVAEAGLSVCAVDPSPALVWPNNYGVWVDEFEAMGLSHCLDTVWPSASVFIDDGRAKSLDRPYARVARRELKSAMMDRCVANGVLFHQAKVAKAVHYDASSILICDDGVSIPATIVLDATGFSRCLVQYDKPYNPGYQVAYGILAEVDGHPFDIDKMLFMDWRDSHLAEGSEIKERNRRIPTFLYAMPFSPTRIFLEETSLVARPGLAMDDIQERMAARLRHLRIRVRSVEEDERCVIPMGGPLPVLPQRVVGIGGTAGMVHPSTGYMVARTLATAPIVADAIVRFLDTGDGTAGLAGDALSAEVWKQLWPANRRRQREFFCFGMDVLLKLDLEGTRRFFDAFFNLEPHYWHGFLSSRLFLPELLMFGLALFGNASNTSRLEIMAKGTLPLGKMIGNLIQDRDG

SEQ ID NO: 909 - DNA, 1781 bp, Panicum virgatum
  misc_feature: Ceres CLONE 1747967
  misc_feature: Encodes the peptide sequence at SEQ ID NO. 910
atcgcaccaaatggtcagtgttagctccctcaaccgcaggagcgcaaaggaaacattacaacaaccaaccctaacgggcctttccttccactgctgcactgcatttgcgagctagctgataaatcaagtgtacctatagtggctacaggttggacacttgcagtgagatgcgtgtagttgcggtgtcgtcgccggtgaggtgtgccgatgtggaggagtgccgtggaagcgccggcatggagatggaggagattgggccggtgtcggacgacctggatttcgacttcacggtcgatgagatagacttcggggacttcttcctcagactagaagatggagatgcgctgccggaccttgaagtcgatcctggcgagatcttcaccgacttcgaggcaatcaccaccggcagcgatggtgtcatggaccaggaggtgcccagcgtccagcccttagcagatgcggtgcagttagatgctgtagatccatgcagtagtgttcttggcgaagagaatacgaccctcgtcgatgtggaagaagagaaaggagagtactactgcaaccatgctgaggatgtggtagccgggactaatggtaactttgggggaggcggtggaaccgtgttggctgaggagaagtcgccgtcttctacgacatcgtcatcgcgagaggctgagagccggcacaagtctaccaccaagcactcgcaagggaagaagaaagcaaaggtggattggacgccagaactccaccggagatttgttcaagcggtagagcagctgggcattgacaaggcagtgccgtcgaggatactcgagatcatggggatcgactccctcacgcggcataatatagcgagtcatttgcagaagtaccggtctcacaggaagcacatgctagcaagggaggcggaggcagcgagctggacccagcgacggcagatgtacgctgccgggggagcccctgccgccgcgaaaagacccgattattccaacgcatggactgtgccaaccatcggcttccctcctcctcctctgccacctcctcctcatccgatgcagcacttcggaagaccgttgcacgtctggggccacccaacccctggggtggagtcgccccgcgtgccaatgtggccacggcacctcgtcccgcgtgcctcgacgccgccgtgggctcctccaccgtctgacccggcgttctggcaccacccttacatgagggggcctgcacatatgccgggccaggtggctccctgcgtggcagtgccaatgccagccgcgcgatttcctgctccaccggtgaggggtgttttgccatgtccacctccaatgtacagacctctcgttcccccagcactaggaagcaagagtcagcaagatacgcagctccagctacagatacaaccatcaagtgagagcatagatgcagcgatcggtgatgttttatcgaaaccatggctgccactgccccttggcctgaagccaccttcagtagacagtgtcatgggcgagttgcagaggcaaggtgtagcagatgttcctccagcttgtggatgatctctgcgagatggatgatcgagtcctccatcatagctgctcgtcccctcagtccaacaaaaagaatttgtcgacatcctttttttttcattttcacgaaccatctatatggagtatggacaattctcctaacttgtgcatggttaggaaaaaagactacagccttcaacctttgtgagaaattaattaacctgaggacatccatgtcaaaaaaaaaaaaaaaaaaaa

SEQ ID NO: 910 - protein, 461 aa, Panicum virgatum
  misc_feature: Ceres CLONE 1747967
  misc_feature (1)..(51): Pfam Name: Myb_DNA-binding Pfam Description: Myb-like DNA-binding domain
MRVVAVSSPVRCADVEECRGSAGMEMEEIGPVSDDLDFDFTVDEIDFGDFFLRLEDGDALPDLEVDPGEIFTDFEAITTGSDGVMDQEVPSVQPLADAVQLDAVDPCSSVLGEENTTLVDVEEEKGEYYCNHAEDVVAGTNGNFGGGGGTVLAEEKSPSSTTSSSREAESRHKSTTKHSQGKKKAKVDWTPELHRRFVQAVEQLGIDKAVPSRILEIMGIDSLTRHNIASHLQKYRSHRKHMLAREAEAASWTQRRQMYAAGGAPAAAKRPDYSNAWTVPTIGFPPPPLPPPPHPMQHFGRPLHVWGHPTPGVESPRVPMWPRHLVPRASTPPWAPPPSDPAFWHHPYMRGPAHMPGQVAPCVAVPMPAARFPAPPVRGVLPCPPPMYRPLVPPALGSKSQQDTQLQLQIQPSSESIDAAIGDVLSKPWLPLPLGLKPPSVDSVMGELQRQGVADVPPACG

SEQ ID NO: 911 - DNA, 1827 bp, Panicum virgatum
  misc_feature: Ceres CLONE 1747986
  misc_feature: Encodes the peptide sequence at SEQ ID NO. 912
gatccccctccgcaacacgacaccgccacacacgccccacaccacaccaatccgatcgaatccggggcgacgacggcggccatggaggcggcggcggagctggcgctgcgcctgcgggcggccgccaacggccgcctcgcgcgctgcgagccgctggcgctcgtcgccgcgccgctcctcgcgctcctcgtcgcgcgcctcgtccacgccgccaccagcgccgtcgccgaccggggcctcgtcgccatcgccatcgccgccgtcaagttgctgccgggagtctccggctacatcgcggcggagaagaagaaggttgttgacaagatgcaatctggtgggacctcgtccaagaacaaccggcgagctgagttgccaaccattggccttggtgaggaagtgataaaggatcttgaaacattgaaggccaaagatgtagactggcagggaaagtgctctggcacagtatatatcgctggaagtgagtctgagggccattttgaattgataaacaaagcttactctatgttttcacacactaatccgctgcatcaagatgtattcaatagtgtggcacacatggaagctgaagtagtcgcaatgacagctgctttgcttggcagcaaagaaaaatcatccggtggacaaatttgcggcaacatgacatctggtggaactgaaagcatattattagcagtcaaaacatcgcgtgactatatgcgatcaaagaaaagaattacaaagcctgaaatgataattgctgaatcagcacattctgcatatgacaaggctgctgaatatttcaatattaaagtgcgtcgtgtgcctgtgaacaaagagtttcttgcagatgtgaaaggattcaagcgatgcataaatggaaacaccataatgatggttggatctgcaccaggatttccgcatggtttaattgatcctattgaggaactgggggagctggcttcacgctatgacatttgcttgcatgttgatttatgccttggtggcttcgtattgccttttgcccgtaagcttgggtaccctattcctccttttgatttttctgtcaagggtgttacatcaatctcatcagatgttcataagtatggattagccccaaagggcacaagtgttgtcctgtacagaaatcatgaaattagaaagcatcaatttgttgctgttaccgagtggaccggtgggctttatatttctcccaccattgctggaagcaggccaggtggattaattgcaggagcatgggctgctatgatgtctcttggactgaatggctacttggacagtacaagtcgtatcatggaagtttcaaagaaaatacaaagagggattgatgagatcccaggactgtttgtgattgggaaaccagacatgaccgttgtggcattcggctcagatgttgtcgacatatttgaggtgaatgacataatgtcatcgaaaggctggcaccttaatgctctgcagagacctaacagtttacacatttgcgtgaccctccaacacacaactgtttatggggagttcctgaaggacctgcaagattctgtgaacactgtgaaagcaaacccgggcccaatcagcggggggatggctcctatctacggtgccgcagggaagatgccagacagaggcacggtgaaggagcttcttgtggagttcatggacagctcttgctgaaactgattatggcttgtgaataacagtcgaattgttgtgatttgtttgttgtctcaacaacacaaagttacttaccattggaaagggtagtgttaataacacaaaattacttaataacaaaaaaaaaaaaaaaaaaaa

SEQ ID NO: 912 - protein, 535 aa, Panicum virgatum
  misc_feature: Ceres CLONE 1747986
  misc_feature (1)..(307): Pfam Name: Pyridoxal_deC Pfam Description: Pyridoxal- dependent decarboxylase conserved domain
  misc_feature (1)..(82): Pfam Name: Aminotran_1_2 Pfam Description: Aminotransferase class I and II
  misc_feature (1)..(230): Pfam Name: Pyridoxal_deC Pfam Description: Pyridoxal- dependent decarboxylase conserved domain
  misc_feature (1)..(535): SWISSPROT Homolog: EC 4.1.2.27 Sphingosine-1-phosphate lyase precursor
  misc_feature (7)..(533): SWISSPROT Homolog: EC 4.1.2.27 Sphingosine-1-phosphate lyase
MEAAAELALRLRAAANGRLARCEPLALVAAPLLALLVARLVHAATSAVADRGLVAIAIAAVKLLPGVSGYIAAEKKKVVDKMQSGGTSSKNNRRAELPTIGLGEEVIKDLETLKAKDVDWQGKCSGTVYIAGSESEGHFELINKAYSMFSHTNPLHQDVFNSVAHMEAEVVAMTAALLGSKEKSSGGQICGNMTSGGTESILLAVKTSRDYMRSKKRITKPEMIIAESAHSAYDKAAEYFNIKVRRVPVNKEFLADVKGFKRCINGNTIMMVGSAPGFPHGLIDPIEELGELASRYDICLHVDLCLGGFVLPFARKLGYPIPPFDFSVKGVTSISSDVHKYGLAPKGTSVVLYRNHEIRKHQFVAVTEWTGGLYISPTIAGSRPGGLIAGAWAAMMSLGLNGYLDSTSRIMEVSKKIQRGIDEIPGLFVIGKPDMTVVAFGSDVVDIFEVNDIMSSKGWHLNALQRPNSLHICVTLQHTTVYGEFLKDLQDSVNTVKANPGPISGGMAPIYGAAGKMPDRGTVKELLVEFMDSSC

SEQ ID NO: 913 - DNA, 1214 bp, Panicum virgatum
  misc_feature: Ceres CLONE 1748222
  misc_feature: Encodes the peptide sequence at SEQ ID NO. 914
attagccatcaggattcaggacgtcgcttccactcgtcgtaacgcaacggcacgagcaaagcaggcagaaaagcggggagccggcctttgcgcgagtgcgctctcttttcttagctctagctagctagctagcggtgggatgccgacgaggcggcgcggtgggttccggctcggccggaagctgctgagcgtctggcgctgggcgctctgccaccgccggcgccggcgcggccgcgggtacctccgcctgcggccgtgccggggaggaggcgggggcagcgacggcggcaggtcgcccctgctggcggcgcccgcggcgtgcgccaccaagaagcaccagcagcagttcgtggcaggggcgcgcgacgacgagtacgcctcctcgccgcgggtgctgacgtgggggcggtcgctggcgcggcggatgaggctcctgcgccggcgcggcggcggggcggagcggctgctggagggcgcggcggaggccaccacgcccaaggggcaggtggcggtgtacgtgggcggcgccgagcccggcggggagtcgatgcggtacgtggtccccgtggtgtacttcaaccacccgctgttcggggagctgctgcgcgaggccgaggaggagttcggcttcgagcaccccggcgggatcaccatcccgtgcgcggcctcgcggttcgagcgcgccgccgcggccgccgcgggcggcggcgggaagaaggttccctgctgatggtagcagtagcagcagcacgtggccgccccagtggccggtgtacatacacacatgcccctccggagaggaggatcccgatccagcccatggggatcatggatcggatccttctgctattttttcttcttcttcttctcaaattagttttgactttttttttttggttccttgcgccccgagcgacgccccgtttccttgtgtggattgagcatgtgcatgggatgcgaggaggcatagccagggtttacgttaccgaccagtccggtcaaaccggtgcggtccggtagcggtttaccggaccgatttgaccggaaatcggtagaaatcggtcaaattcaaaatcacatgttcaaccggtttcgaccggcttaccggtcggtttgactggtaatcggccaaattcaaattttaaaaaaaaaaaaaaaaaaaaaaaaaaaaaaaaaaaaaaaaaaaaaaaaaaaaaaaaaaaaaaaaaaaaaaa

SEQ ID NO: 914 - protein, 196 aa, Panicum virgatum
  misc_feature: Ceres CLONE 1748222
  misc_feature: Great-hit functional homolog of the protein sequence given in SEQ ID NO 9332
  misc_feature (1)..(94): Pfam Name: Auxin_inducible Pfam Description: Auxin responsive protein
  misc_feature: Useful for making plants with altered protein content
  misc_feature: Useful for making plants with modulated cold sensitivity
MPTRRRGGFRLGRKLLSVWRWALCHRRRRRGRGYLRLRPCRGGGGGSDGGRSPLLAAPAACATKKHQQQFVAGARDDEYASSPRVLTWGRSLARRMRLLRRRGGGAERLLEGAAEATTPKGQVAVYVGGAEPGGESMRYVVPVVYFNHPLFGELLREAEEEFGFEHPGGITIPCAASRFERAAAAAAGGGGKKVPC

SEQ ID NO: 915 - DNA, 2056 bp, Panicum virgatum
  misc_feature: Ceres CLONE 1748470
  misc_feature: Encodes the peptide sequence at SEQ ID NO. 916
aaaaagctcggaagatcccgcggcgctgcaccctcctctcctctcctcgtcgccgccgtcgcgagaccgccatggcgctgcacgcccccgtcctcgtgatgaaggactcgatgaagcggaagtcgggcgccaaggtgcaccgggccaatatccaggctgccaaggctgtggcagacatcatacgcactacactgggtcccagatccatgttgaagatgcttcttgatgctggcggaggtattgtggttactaatgacgggaatgctatattgagggaaatagacattgcacatcctgcagctaagtctatgattgaactaagccgtacacaggatgaggaagtgggcgatggcacaacctctgtgattgttctagctggtgagatgctccatgttgctcaagcattcattgacaagagctatcatccaaccgtcatttgccgagcatacaccaaagcgcttgatgacgctatagctgttcttgacaagattgcaatgcctgttgatgtgaatgatcgcgcggcaatgctaggtcttgtgaagagctccatcggtacaaaattcactggtcagtttggtgaccttattgctgaccttgctatcgatgctactacaacagcaggtgttgacctaggtcagggtatgcgggaagttgatatcaagaagtatattaaagtagaaaaggttcctggtggccagttagaggattctacggtcctcaaaggagttatgatcaataaggatgttgtggctcctggcaaaatgagaaggaagatagttaacccacgtataatcctgctggacagccctattgagtataagaagggagaaaatcagaccaatgctgagttgatgaaggaagaagattggcaggttctgctagagatggaggaagagtacataaagaacctatgtgcacaaattctaaaatttaagcctgatttggtcatcacagagaaagggcttagtgatcttgctatccattatttgagcaaggctggtgttagtgcaattcgtagacttcgaaaaactgacaacaacagaattgctaaggcttgtggagcagttatagtgaacaggcctgaggagctccaggaatctgatgtgggcacaggagctggcctatttgaggtcaagaagataggtgatgaattcttttccttcgttgttgattgtaaagatcctaaggcttgcactgttctgttgaggggagcaagcaaggatgtcttgaatgaagttgagaggaacctgcaggatgctatgtctgttgcgaggaacattttgaaaaacccaaaactcctacctggaggtggtgctactgaattgactgtatcggcaacactgaagcaaaagagttcttcagttgaaggtgttgaaaagtggccctatgaagctgctgctttggcatttgaagcaattccgagaacattggcccaaaattgtggtttgaatgttattaggacaatgactcaactccagggaaagcatgctaatggcgaaaatgcctgggttggccttgatggaagaagtggtgacattgttgatatgaaagagcgaaagatctgggactcctacagtgtcaaagcgcagacgttcaagacagctatcgaggctgcttgcatgcttttgagaatcgacgacattgtcagcggtatcaagaagaagcaggctcctggagcctcagctcccaagcagccccagattgaaacggaaggtgatgcggacaatgagcagatgatcccagagtagatgtagcgagtcatttcttaagccagaatagcacgatgagccgaattcattatttcagtgtttgtttgtggctggtcctggcttgaaaatgtacctgaattcttatggttgagtggttcgagggttttggggtccaggttttgaagtatggctgctgttcatcttgttttggacttgtgctgaacgacagtcagcagttagactagtagtttttgtggctaactgtctgttgtatgacacatgctatgtgtttggtaatgctatcgttcccatgcttgtaactgtgctaaaaaaaaaaaaaaaaaaaa

SEQ ID NO: 916 - protein, 558 aa, Panicum virgatum
  misc_feature: Ceres CLONE 1748470
  misc_feature (1)..(493): Pfam Name: Cpn60_TCP1 Pfam Description: TCP-1/cpn60 chaperonin family
  misc_feature (1)..(520): Pfam Name: Cpn60_TCP1 Pfam Description: TCP-1/cpn60 chaperonin family
  misc_feature (1)..(494): Pfam Name: Cpn60_TCP1 Pfam Description: TCP-1/cpn60 chaperonin family
  misc_feature (1)..(497): Pfam Name: Cpn60_TCP1 Pfam Description: TCP-1/cpn60 chaperonin family
  misc_feature (1)..(501): Pfam Name: Cpn60_TCP1 Pfam Description: TCP-1/cpn60 chaperonin family
  misc_feature (1)..(495): Pfam Name: Cpn60_TCP1 Pfam Description: TCP-1/cpn60 chaperonin family
  misc_feature (1)..(500): Pfam Name: Cpn60_TCP1 Pfam Description: TCP-1/cpn60 chaperonin family
MALHAPVLVMKDSMKRKSGAKVHRANIQAAKAVADIIRTTLGPRSMLKMLLDAGGGIVVTNDGNAILREIDIAHPAAKSMIELSRTQDEEVGDGTTSVIVLAGEMLHVAQAFIDKSYHPTVICRAYTKALDDAIAVLDKIAMPVDVNDRAAMLGLVKSSIGTKFTGQFGDLIADLAIDATTTAGVDLGQGMREVDIKKYIKVEKVPGGQLEDSTVLKGVMINKDVVAPGKMRRKIVNPRIILLDSPIEYKKGENQTNAELMKEEDWQVLLEMEEEYIKNLCAQILKFKPDLVITEKGLSDLAIHYLSKAGVSAIRRLRKTDNNRIAKACGAVIVNRPEELQESDVGTGAGLFEVKKIGDEFFSFVVDCKDPKACTVLLRGASKDVLNEVERNLQDAMSVARNILKNPKLLPGGGATELTVSATLKQKSSSVEGVEKWPYEAAALAFEAIPRTLAQNCGLNVIRTMTQLQGKHANGENAWVGLDGRSGDIVDMKERKIWDSYSVKAQTFKTAIEAACMLLRIDDIVSGIKKKQAPGASAPKQPQIETEGDADNEQMIPE

SEQ ID NO: 917 - DNA, 1820 bp, Panicum virgatum
  misc_feature: Ceres CLONE 1748570
  misc_feature: Encodes the peptide sequence at SEQ ID NO. 918
aagtcgagcataaacggaacccgtggaatcccgcaaggccacatacgcgagcgccgcgaagctccgggaacgaaggcgagaagggaagctcacgattctgctgccatctgttcagaacttgagatccatccagtccaatcgcgtcgcagggttttattccgcggcgttgagaacccatggcgaggaagatgctcgccgacggggaggcgcctgtcgccgacggcgagcagtacgactacgatctcttcgtcatcggggcgggcagcggcggcgtacgcggttctcgcaccgccgcctctttcggagctaaggttgcgatttgtgagctcccgtttcaccccatcagctcggattggcaaggaggacatggtgggacgtgtgtgatacgtggttgtgttcctaaaaagatattggtgtatggcgcatctttccgcggagaatttgaggattcgaagaattttgggtgggagattaatggagatattaacttcaattggaaaaagctattggaaaataagactaacgaaattgttagattaaatggagtataccagaggatccttggcaattctggtgtgacaatgattgaaggggcaggcagtttagttgatgctcataccgttgaagttagtcagcctgatggttcaaagcaaaggtatacagcaaagcacatcttgattgcgactggtagccgagctcaacgtgtcaacatacctggaaaggagctggctattacttcagatgaggccttgagtttggaggagctaccaaagcgtgctgtaatccttggtggaggatatattgctgttgaatttgcttctatctggagagggatgggtgcagaagtagatttgttttatcgaagggaacttcctctaagaggttttgatgatgagatgagagaagttgttgcaaggaaccttgagggaaggggaatcaaattgcatcctgggacaaatctgtctgagttgagcaaaacggctgatggcataaaagttgtaactgataaaggagaggagcctgataaaggagaggagcttattgcagatgttgttctatttgctacagggcgcacacccaactccgataggctgaacttgcaagctgcaggtgtcgaggttgaccagattggagccatcaaggttgacgaatattctcatacatctgctcctagtgtatgggctgtaggtgatgtaacaaaccggatcaatctaacacctgtcgcattgatggaggctacttgcttttccaaaactgtgtttggtggccagcaagttaagcctgattacagagatgttccttgtgctgttttctccattccaccgctctctgtagtgggcctcagcgaacagcaggccttggaggaagccaagggtgatattcttgttttcacttcatcattcaacccaatgaagaacagcatatccaagcggcaggagaagactgtgatgaaactggtagttgatgctgaaactgatagagtacttggtgcgtccatgtgtggatcagatgcacctgaaattatccagggcattgctgttgcacttaaatgtggagccaccaaagcaagcttcgacagcacggtcggaattcacccttcggctgccgaagagtttgtgaccatgcggaccttgaccaggcgcgtgagcccgtccaagccaaagacgaatttgtaagcaacatcggtgttttggggactacacatgttgtttgtacgcagactgtttccatttttgtgattttacatcattcgaactggagcactatattataaaggaataagatttttgcgtaacagccaaaaaaaaaaaaaaaaaaaa

SEQ ID NO: 918 - protein, 499 aa, Panicum virgatum
  misc_feature: Ceres CLONE 1748570
  misc_feature (1)..(317): Pfam Name: Pyr_redox_2 Pfam Description: Pyridine nucleotide-disulphide oxidoreductase
  misc_feature (1)..(111): Pfam Name: Pyr_redox_dim Pfam Description: Pyridine nucleotide-disulphide oxidoreductase, dimerisation domain
  misc_feature (1)..(499): SWISSPROT Homolog: EC 1.8.1.7 Glutathione reductase, cytosolic
MARKMLADGEAPVADGEQYDYDLFVIGAGSGGVRGSRTAASFGAKVAICELPFHPISSDWQGGHGGTCVIRGCVPKKILVYGASFRGEFEDSKNFGWEINGDINFNWKKLLENKTNEIVRLNGVYQRILGNSGVTMIEGAGSLVDAHTVEVSQPDGSKQRYTAKHILIATGSRAQRVNIPGKELAITSDEALSLEELPKRAVILGGGYIAVEFASIWRGMGAEVDLFYRRELPLRGFDDEMREVVARNLEGRGIKLHPGTNLSELSKTADGIKVVTDKGEEPDKGEELIADVVLFATGRTPNSDRLNLQAAGVEVDQIGAIKVDEYSHTSAPSVWAVGDVTNRINLTPVALMEATCFSKTVFGGQQVKPDYRDVPCAVFSIPPLSVVGLSEQQALEEAKGDILVFTSSFNPMKNSISKRQEKTVMKLVVDAETDRVLGASMCGSDAPEIIQGIAVALKCGATKASFDSTVGIHPSAAEEFVTMRTLTRRVSPSKPKTNL

SEQ ID NO: 919 - DNA, 2165 bp, Panicum virgatum
  misc_feature: Ceres CLONE 1748584
  misc_feature: Encodes the peptide sequence at SEQ ID NO. 920
aacccacccacctcccaccccaccaccgcgtggtccgtctcgctcgcttggagtcattgatccaaggaccatatcgcccgatccatcctgcggtgcctcgcctctgaacgagaacgcgtcttgctgcctctgattacttattcactatgtgctccggacctcgcaagccgtcgaccccgccgctgccggcggcgacgcccgaggactcggcggtgatggcggccctgctcctggagctggcggcggcggacgacgtcgtggcgttccggcgcgccgtcgaggaggacaaagtctcggccttggacgccgcgtgccagtggtacggcccctccgcggcgggggcccggctgcgcctcgagctgcgcacgccggccatggtcgccgcgctctacggcagcacggcggtgctggcgtacgtgctgtccaccgcgccggccgaggcggcgcgcgcctcgcccacggatggcgccacgccgctccacctcgccgcggccggcggcgccgcgggcgccgtcgcggccgcgcacctcctcctcgcctcggacgcgtccgcggacgcgctcgccttctcgggcctccgcgccggcgacctcctcccgcgcgccaacgccgccgccgagagggacagggctctccgcgtgctgctcaagtcccccgcggtgtcgccctcttcctcccccaagaagtcggcctcgccgccgcctgccccggagccgaggaaggagtaccctcccgacctcacgctcccggacctcaagagcggcctcttcagcaccgacgagttccgcatgtacagcttcaaggtgaagccctgctcccgcgcctactcccacgactggaccgagtgccccttcgtgcaccccggcgagaacgcgcgccgccgcgacccgcgccgctactcctacagctgcgtgccctgccccgagttccgcaagggcggcgcctgccgcaagggggacagctgcgagtacgcgcacggcgtgttcgagtgctggctccacccggcgcagtaccggacgcgcctctgcaaggacgaggtcggctgcgcgcggcgcatctgcttcttcgcgcacaagcccgaggagctccgcgccgtcaacccctccgcggtctccgtcggcatgcagcccgccgtgtcgtcgccgcgctcctcgccgcccaacgggctcgacatgggcatgctcaaccccgcgtggccctcctccccggcgagcaggctcaagaccgcgctcgccggccgggagctcgacttcgacctcgagctgctcgcgctggaccagtaccagcagcacaagctgttcgacaaggtgtcctcgccgagggccagctggggctcggccggcgggatcgggtcgccgctgcccgccgccgcgcccgccagaaccgtgccggactacacggacctgctcggctccgtcgacccggccatgctgtcccagctccacgcgctgtcgctgaagcaggccggcgacatgccggcgtacagctccatggcagacaaccagctgcacatgccgacctctcccatggtgagcgccaacaccgccttcgggctcgaccactccatggcgaaggccatcatgagctcccgcgcctcggcgttcgccaagcgcagccagagcttcatcgaccgcggcggccgcgcgccggccacccgctcgctcatgtcgcaggccaccaccggcgccccgtccatgctctccgactggggatcgccggacggcaggctggactggggcgtccagggcgacgagctgcacaagttccgcaagtccgcgtccttcgctttccgcgggcaatccccggcgccggtggcagcccccaccgagccagacgtctcatgggtgaactctcttgtcaaggacggccacgccggcgacatatttgcgcagtggccggagcaggagcagatggtggcctaattcatcgatcatcgttggctcatagcatcttgctgaccaaagttctttccttcaattatttttcccctttgtttgctcaatttgattcgtacgagatattttttagtacatatatataggctgttcacaataattatatttgttcgtcgacaagaagcatggatgcccaaagggagctttatactgatgaagaacagccagtgtttactcgtttctttcttttaaaaaaaaaaaaaaaaaaaa

SEQ ID NO: 920 - protein, 591 aa, Panicum virgatum
  misc_feature: Ceres CLONE 1748584
  misc_feature (1)..(27): Pfam Name: zf-CCCH Pfam Description: Zinc finger C-x8-C-x5-C-x3-H type (and similar)
MCSGPRKPSTPPLPAATPEDSAVMAALLLELAAADDVVAFRRAVEEDKVSALDAACQWYGPSAAGARLRLELRTPAMVAALYGSTAVLAYVLSTAPAEAARASPTDGATPLHLAAAGGAAGAVAAAHLLLASDASADALAFSGLRAGDLLPRANAAAERDRALRVLLKSPAVSPSSSPKKSASPPPAPEPRKEYPPDLTLPDLKSGLFSTDEFRMYSFKVKPCSRAYSHDWTECPFVHPGENARRRDPRRYSYSCVPCPEFRKGGACRKGDSCEYAHGVFECWLHPAQYRTRLCKDEVGCARRICFFAHKPEELRAVNPSAVSVGMQPAVSSPRSSPPNGLDMGMLNPAWPSSPASRLKTALAGRELDFDLELLALDQYQQHKLFDKVSSPRASWGSAGGIGSPLPAAAPARTVPDYTDLLGSVDPAMLSQLHALSLKQAGDMPAYSSMADNQLHMPTSPMVSANTAFGLDHSMAKAIMSSRASAFAKRSQSFIDRGGRAPATRSLMSQATTGAPSMLSDWGSPDGRLDWGVQGDELHKFRKSASFAFRGQSPAPVAAPTEPDVSWVNSLVKDGHAGDIFAQWPEQEQMVA

SEQ ID NO: 921 - DNA, 747 bp, Panicum virgatum
  misc_feature: Ceres CLONE 1748590
  misc_feature: Encodes the peptide sequence at SEQ ID NO. 922
aacgcatcagttgagcttccgatccaatcgacggctccactgctctcgtcttctcgcttccgtctccggcgtcgagccgcctccggccccctgggcaaactctactcctttgcaaggaagagcgccacctggaaggaattcttcaggattagaggtgccgccggtgtccgcgcctctgctgggccggcgtcaagcggagatcgaatcgggaaccgaactgacctcgtctttcgtcgaacttccatcaggagaagcaatgtcaggagtgatcacaaagttcgcggttacatccatggtgatgtggatggccccagtcgccatcatgtatgggttctactaccaggtgtttccaggtgtgagtcagatgtcatcctcagcgcagacactggccagtgggttccttgccgtcatatcagttaatctggtgatcggcttctacatatgcatggcgatgaaggagactccacaccaggagccacagcctgatcccaccttcttggcaaatgctaaagcgagtgtcaaccagccaacatcctctcgagtgaatgatgattccaagggaaaggggaaggttgagtaagctgtagcattttgacttgggtcttgtgtatgctatacgcatgttggccatcacacaatgccgtaaccttttaaatttcttaatttgctgtaaatcttgatggttatggttatggaaccatatgaagatgaatcttctgtatcctttaaaaaaaaaaaaaaaaaaaa

SEQ ID NO: 922 - protein, 107 aa, Panicum virgatum
  misc_feature: Ceres CLONE 1748590
  misc_feature: Great-hit functional homolog of the protein sequence given in SEQ ID NO 9673
  misc_feature: Useful for biocontainment applications
  misc_feature: The plant produces a reduced number of seeds.
MSGVITKFAVTSMVMWMAPVAIMYGFYYQVFPGVSQMSSSAQTLASGFLAVISVNLVIGFYICMAMKETPHQEPQPDPTFLANAKASVNQPTSSRVNDDSKGKGKVE

SEQ ID NO: 923 - DNA, 2115 bp, Panicum virgatum
  misc_feature: Ceres CLONE 1748729
  misc_feature: Encodes the peptide sequence at SEQ ID NO. 924
atcaccctcttccccaccccgtcgtcgagtcgcgtccccccgatccccaaatccactcctcgccccccatggaccaccaccaccacttcacgccgccgccgccgtcgccgatggagaacacggcggcgggggcgtcctccaagccgccgacgccggcgtccacgcccaactcaaggctcgcctcgggcgcgccctcctcccggcactccgccacgccgtcgcacgcctccgccaccgcgtccgcgcccacgccggcctcgcggaccgtctacagcgaccgcttcatccccagccgcaccggatccaacctcgcgctcttcgacctagccccctcgccctcgccctcccacgacgccgcggccagcggcccggcctcctcgtccggatctgctccagccacgtcgccgtactgcgcgctcctccgcgccgcgctcttcggccccgacacgccggaccgggtcgcgtcctcggccaccgcgtgctcctcctcctcgtccgcgggggcgtcggcggtgggcacccccgccacggggaatatcttcagattcaaggcggaggtgccccggaacgccaagagggcgctattttccggcgaggacgaggaggacgcgctgtttcccggcattttcaccacgaggggcgccgggccaaggaagatcccaaggtcgccctacaaggtgctagatgcgcccgccctgcaagacgacttctacctcaacctcgtcgattggtcttcacataatgtccttgctgtcgggttgggcaattgcgtttacttgtggaatgcatgcagtagcaaggtcaccaagctatgtgatttgggggtgaatgacaatgtttgctctgtggggtgggcacagcgtggcactcaccttgctgttgggacaaatcaaggcaaagttcagatatgggatgcaactcgctgtaaaagaataagaacgatggaaagccatcgcctgcgtgtaggtgctcttgcatggagttcttcattgctttcttctggaagtcgcgacaagagcatcctccaccatgacatccgtgctcaagaagattatgttagcaagcttaccgggcataaatctgaggtttgtgggctcaagtggtcatatgacaatcgtcagcttgcatctggtggcaatgacaacagactttttgtttggaatccacattcagtacaaccagtactgaaatatacggagcacacggcagctgtcaaagctattgcctggtcacctcatctccatggtccgcttgcatctggtggaggaaccgcagatagatgcatacgattttggaatacgaccacaaatacacacttgagctgtgtggacaccggcagtcaggtctgcaatcttgtgtggtcaaagaacgtaaatgagcttgttagtacccacggatactctcaaaaccaaataattgtttggagatatccaacaatgtctaagcttgccactttgacaggccatacatacagagtgttgtttctagctatttcccctgatggacagaccatagttactggtgctggtgatgaaacactccggttttggaacgtgttcccctctccgaagtcccagagttctgacagtttaaattgcattggaggaacatcatttgttagaagctacatccggtgacacttaaatgtagtttccttgggctcataagattattgcaggcttgccgcatatgttgatgatcatcgacatcattccatttgccacacccatgccaccaggtcatcaaccatcaaagctagccggatttttgagatagcacgatgcattgtgatgaactggcttgcgaatctgggcatggctcttttgctgagagagtgtgcatatttatcagagcagtgatgctgtaggaggaacattgctgaaggcttcgagtatcagcattgttccaattgataagaatacgcccttttgtttttgctcccttttgcgagtcaaacctcgacctggagctgtttctgtaatctgctagaagctaaccaattcaaaacatttactaactcaataactcatgacgtccatttcatctatgttggtatggtgtaaaatgagaatacatctgttccagattcattgttaaaaaaaaaaaaaaaaaaaa

SEQ ID NO: 924 - protein, 522 aa, Panicum virgatum
  misc_feature: Ceres CLONE 1748729
  misc_feature: Great-hit functional homolog of the protein sequence given in SEQ ID NO 9729
  misc_feature: Useful for making plants with modulated biomass
  misc_feature: The plant is abnormally small.
MDHHHHFTPPPPSPMENTAAGASSKPPTPASTPNSRLASGAPSSRHSATPSHASATASAPTPASRTVYSDRFIPSRTGSNLALFDLAPSPSPSHDAAASGPASSSGSAPATSPYCALLRAALFGPDTPDRVASSATACSSSSSAGASAVGTPATGNIFRFKAEVPRNAKRALFSGEDEEDALFPGIFTTRGAGPRKIPRSPYKVLDAPALQDDFYLNLVDWSSHNVLAVGLGNCVYLWNACSSKVTKLCDLGVNDNVCSVGWAQRGTHLAVGTNQGKVQIWDATRCKRIRTMESHRLRVGALAWSSSLLSSGSRDKSILHHDIRAQEDYVSKLTGHKSEVCGLKWSYDNRQLASGGNDNRLFVWNPHSVQPVLKYTEHTAAVKAIAWSPHLHGPLASGGGTADRCIRFWNTTTNTHLSCVDTGSQVCNLVWSKNVNELVSTHGYSQNQIIVWRYPTMSKLATLTGHTYRVLFLAISPDGQTIVTGAGDETLRFWNVFPSPKSQSSDSLNCIGGTSFVRSYIR

SEQ ID NO: 925 - DNA, 1918 bp, Panicum virgatum
  misc_feature: Ceres CLONE 1748768
  misc_feature: Encodes the peptide sequence at SEQ ID NO. 926
gtcctcgtccttcttcctccacgcgactgctgttcgtgctagctactgctccgagcaagcctctcggctccctatcctcttgctccgctcgcccgcggggaggcgcgccccagtagcatcagcgcgtgctccgtcgtcctgctccacctgtcgccgccctcggtgtgcgcacggcgggcgcctcggatgaccgggccgggcgacgagctggccgagctgctgtgggacaacgggccggcgctgaggagggcgccgccgccgttccagcccttcacctgcagcgccgctggcagcagcagggcccacgagctcaagcgccacgccgccgctggcggcatggcccccgtcccgctcgggcttcacggcgccggcggcctccccgacgaggacgccgtgccgtggctgcattgccccgtcgccgtcgacgtcagcgacgccgacacggcgccgctgccgccggagtactgcgccggcctgctgtccgagtactcggggctccagcccgcgccgcccgcggccgtcccggcctcgcgcgctgcgccgcgggaggccgcggccaagcaggccacgctgccgggcaccgccagcggtgcaggcgagggcgtcatgaacttcaccttcttctcgcggcccctgcagcggccgcaggcgtccgccgccgcggcggcgagcaaccccgtcgagtccacggtcgtgcaggctgcgacgaaccggctgcgggccaccccgctcttctccgagcagaggatggcgtggctgcagccgcccaaggggccgcgcgccgcggcgccaggggccgctcccgctcccgctccccaggcgccgctgcccacagagcaccgcctccacggagaagccgccacggtgactcagtgcaggttgcaaccggaggcaagagctcccgatgcggccgcggcgacggcggtggtgaccacctcgtcggtctgctccggcaacggtgaccgaagccagcagcccaagagaagcagcagccaccaggtcgcggactgttcggtcagcccggacgaggacctcgacgacgagggcggcgcgatgagaaggtcggcggcgcggagcaacaagcgcagccgcaccgccgaggtgcacaacctatccgagaggaggagacgggaccggatcaacgagaagatgcgcgccctgcaggaactcatccccaactgcaacaagatcgacaaagcgtcgatgctggaggaggccatcgagtacctcaagaccctgcagctgcaggtgcagatgatgtccatggggacggggctgtgcgtgccgccgatgctgctgccggcgatgcaggtgcccgtgccccaccccatggcgcacttcccgcacctcggcatggggctggggttcggcatgggcgccgcggccgccgccgccttcgacatggcccgcgccgccggcgcgcacttcccctgcccgccgatgccaatgccgccgggaccgatgttcggcgtgcccgggcaggcgatgccgtctccggccgcggcggcgtgggcccacatggccggcagtggcaccacgccggccgagcacatagaagcagcagccgctcctcctgcacgggaagaagcagagcccttgccaccgccagttcccgtcgtcacacagggcgaccagattcagaagctgcagcatccgaagcagacgtgaaggcgatgaggcgctccgcgtgctgtcgctgtgttgctctgaagtcagaacctggctgcggctccgacgatccctgtctgaagaagcgcgtgcacgcagcaggcccgggttccctctgaagaaacatttttacctagcctgctagtgctagaacgccgcgtctcggctgtaatctgcttgtagattgtaagagaatccagaaggggtaatcgtggagcgtttcagtgagcaaaaaaaaaaaaaaaaaaaa

SEQ ID NO: 926 - protein, 493 aa, Panicum virgatum
  misc_feature: Ceres CLONE 1748768
  misc_feature (1)..(50): Pfam Name: HLH Pfam Description: Helix-loop-helix DNA-binding domain
MTGPGDELAELLWDNGPALRRAPPPFQPFTCSAAGSSRAHELKRHAAAGGMAPVPLGLHGAGGLPDEDAVPWLHCPVAVDVSDADTAPLPPEYCAGLLSEYSGLQPAPPAAVPASRAAPREAAAKQATLPGTASGAGEGVMNFTFFSRPLQRPQASAAAAASNPVESTVVQAATNRLRATPLFSEQRMAWLQPPKGPRAAAPGAAPAPAPQAPLPTEHRLHGEAATVTQCRLQPEARAPDAAAATAVVTTSSVCSGNGDRSQQPKRSSSHQVADCSVSPDEDLDDEGGAMRRSAARSNKRSRTAEVHNLSERRRRDRINEKMRALQELIPNCNKIDKASMLEEAIEYLKTLQLQVQMMSMGTGLCVPPMLLPAMQVPVPHPMAHFPHLGMGLGFGMGAAAAAAFDMARAAGAHFPCPPMPMPPGPMFGVPGQAMPSPAAAAWAHMAGSGTTPAEHIEAAAAPPAREEAEPLPPPVPVVTQGDQIQKLQHPKQT

SEQ ID NO: 927 - DNA, 1502 bp, Panicum virgatum
  misc_feature: Ceres CLONE 1748826
  misc_feature: Encodes the peptide sequence at SEQ ID NO. 928
gcggagctggtaaccgctgccaccacactcccgttgcggcgacgagggctcgctgctcggcagccaaacccaagcgcgcagctttgttctccttcgccgccaggtcggcgggtgcgctctcgccggacccttccctcgccgtgaccgtttgctgcgctcggcgcgccatggagctgctggtacgcgcggcggcggccgccgccgcgtcctcctccccgcacccatcgctccagctcccccgccgcgcctgcgtcgctggctcctgccgcccccgtccccgccgccccgggttcccttctctccgcgcagcggcggcggcggccgccaccgtcgtggagccggaaacaaaagaacagcagaataacacttcagaaaccgaggtgtttgcgtgccctgtttgctacgaaccattgataagaaaagggccaccgggcataaacttgtcagcaatttataggtcaggattcaagtgttcaaagtgcaacaagtcatttaccagcaaaaacatcttcttggacctcactgtaacttctgggacaaaagaatatacggaacagaagcctgctagaaccgagctgttcaggagtccacttgtctcctttctttatgagagagggtggcgtcaaaacttcaatcagagcggcttccctggtcttgatgaagagtttcaaatgactcaagactatttccaacctgttgctggaggtatccttcttgatgtcagctgcggaagtggcttgtttactaggaaatttgcaaactctgggacatactcagctgtaattgctttggacttctccgagaatatgcttcgccaatgctatgaatttattaagcaagatgatactctcctcaacgtgaatctagcacttgtgagggcagatatttcaaggctcccttttgcttcttgttctgtagatgccattcatgctggagctgctatccattgttggccctcaccctctaatgcggtagctgaaataagccgtgtcctcaaacctggcggtgtgtttgtgggcacaactttcttatcctctcccaggaacaacccattctctgttgaagcattaaggccactgagacagattgttggaccagtaaacacaagctacaattacttcaccgaaggagagctagaagacttatgcaaatcgtgtggctttgttaactatagcagtaaggttcagaggtcattcatcatgttctccgggcaaaagccattctgaagaaatctcaatctctactgtttctttaggattacgtgtaaaatgaatctacttgaatttcatacgtttacatatcaaatagagaatagtgtgcctagggttcctcattttctgtatagatgtgtgtccctgaatgttttcagaacaagatggacaaaaatgtatgctgcagattcttgaaagaatcactaccagtgcaaaagaaacactactatactagctctcattaataaaggagactatccacattttctttaaaaaaaaaaaaaaaaaaaa

SEQ ID NO: 928 - protein, 352 aa, Panicum virgatum
  misc_feature: Ceres CLONE 1748826
  misc_feature (1)..(101): Pfam Name: Methyltransf_11 Pfam Description: Methyltransferase domain
MELLVRAAAAAAASSSPHPSLQLPRRACVAGSCRPRPRRPGFPSLRAAAAAAATVVEPETKEQQNNTSETEVFACPVCYEPLIRKGPPGINLSAIYRSGFKCSKCNKSFTSKNIFLDLTVTSGTKEYTEQKPARTELFRSPLVSFLYERGWRQNFNQSGFPGLDEEFQMTQDYFQPVAGGILLDVSCGSGLFTRKFANSGTYSAVIALDFSENMLRQCYEFIKQDDTLLNVNLALVRADISRLPFASCSVDAIHAGAAIHCWPSPSNAVAEISRVLKPGGVFVGTTFLSSPRNNPFSVEALRPLRQIVGPVNTSYNYFTEGELEDLCKSCGFVNYSSKVQRSFIMFSGQKPF

SEQ ID NO: 929 - DNA, 1626 bp, Panicum virgatum
  misc_feature: Ceres CLONE 1749822
  misc_feature: Encodes the peptide sequence at SEQ ID NO. 930
agtgatccaaccagcccgtgtatttatacggccggccacggtctcaactcccaacgagagcgaggtgtcagctccacgagcgcacaccagcgacagcagccagacgcgagcggagcggagcaatggcgggggcggggcagctgcggtcgttcgtggaggtgccggcgggctcgcacttccccatccagaacctgcccttcggggtcttccgccggcgggggtcgcgggcgccgccgcgccccgcggtggcaatcggggacctggcgctcgacctcgccgccgtcgccgacgccgggctcttcgacgggcccgcgctcgccggctccccgtgcttccaccaggagacgctcaacatgttcttggggatgggccggccggcgtggaaggaggcgcgcgccacgctccagaaaatcttatcagctgatgagccagtcttgcgtgacaatgaggcgctcaggagcaagtgtcttgttccaatgagtgacattgagatggttctgccaatcactgttggaggctacacggacttcttttgttccgtgcaccatgccaggaattgcgggtttatcttccgtgggccgcagactccggtcaatccaaattggtttcatcttcccataggttacaacggaagggcatcatctgtagttgtgtctggaacagatgtcattcgacccagaggacaaggacatccaacaagaaactccggtccttatttcggtccatctcagaagcttgattttgaacttgagatggctgccattgtcggcccagggaatgaattgggaaaacctatcgatattaataatgctgaagaccatatttttggcctagctttgatgaatgattggagtgccagagatatccaggcttgggagactatacctcttggacctttccttggaaaaagcttcagtaccataatatcgccatggattgtcactctggatgctttaaagcctttcacctgtgaggcgcctaagcaggaacctgggcctttgccttacttggctgaaaagaatcacgtgaactatgatattcctcttgaagtttggattaagcccaaagatcaaagtgatgcctcaattgtcgcaaagactaatttcaaacatttgtattggacagtgacgcagcagctagcacaccacactatcaatggatgcaacatgagaccaggggatatatttgcaacaggcacactcagtggacctgaacccgagtctctggggtgtcttctggagctaacatggaacgggcagaaggagataccagttggaaattcgacccgcaagtttctagaagatggggatgaagtcatcttgaccggctgttgcaagggtgaaggctacaacattggatttggaacctgcatagggaaggttctgcctgcgcttccttgagccaacatatcttcacttcagttcatggagtctcgatgatcccaaaggagttcatgcgctgaaatctaccaagctccgatccttagtctgtttaaagcctactagttatggtaactggatattaggtattgtttttcttgaatgcggaaaaggaaactggtccctctctagtgcaataaaactgatgctaagtcatctttttatacaaaaaaaaaaaaaaaaaaaa

SEQ ID NO: 930 - protein, 425 aa, Panicum virgatum
  misc_feature: Ceres CLONE 1749822
  misc_feature (1)..(212): Pfam Name: FAA_hydrolase Pfam Description: Fumarylacetoacetate (FAA) hydrolase family
  misc_feature (9)..(424): SWISSPROT Homolog: EC 3.7.1.2 Fumarylacetoacetase
MAGAGQLRSFVEVPAGSHFPIQNLPFGVFRRRGSRAPPRPAVAIGDLALDLAAVADAGLFDGPALAGSPCFHQETLNMFLGMGRPAWKEARATLQKILSADEPVLRDNEALRSKCLVPMSDIEMVLPITVGGYTDFFCSVHHARNCGFIFRGPQTPVNPNWFHLPIGYNGRASSVVVSGTDVIRPRGQGHPTRNSGPYFGPSQKLDFELEMAAIVGPGNELGKPIDINNAEDHIFGLALMNDWSARDIQAWETIPLGPFLGKSFSTIISPWIVTLDALKPFTCEAPKQEPGPLPYLAEKNHVNYDIPLEVWIKPKDQSDASIVAKTNFKHLYWTVTQQLAHHTINGCNMRPGDIFATGTLSGPEPESLGCLLELTWNGQKEIPVGNSTRKFLEDGDEVILTGCCKGEGYNIGFGTCIGKVLPALP

SEQ ID NO: 931 - DNA, 1462 bp, Panicum virgatum
  misc_feature: Ceres CLONE 1749963
  misc_feature: Encodes the peptide sequence at SEQ ID NO. 932
aatttttatactactcggtccagtaccacccagcccggcgtccagtccgacccctcgcgatccccatcgagttcctggcgcgcgataggatggtttcaacgcttcttgcgctgctgcttccgtgagtcctaagcgacgccggcggcggctcgattcgatcgccgatggcattgaagctccagctgctggcggtggtggtggccgtcgcggcgagctgccggccgggcctcgcggaccccgcggtgagcgcgctgccggggctcccggtcgccgggctcgccgccgggttctacaacgagtcgtgcccggaggtggaggatctggtgctcgccgagatgcgcgccatcgtcgagaaggaccggaccctcgggccggcgatgctgcggttcatgttccacgactgcctcgtcaggggctgcgacgcgtccatcatgctcaaatcgcggagcaacaagggggagcaggacgccatcgcgagctacagcctccgcggctacgacgtggtcgagcagatcaaggccacggtagaggcggcgtgcccgctcaccgtgtcgtgcgcggacatcatcgccttggccgcccgggatgccgtgtacctgagcaacgggccgcgctacgccgtcgagaccggccgccgggacggcaaggtttcggccaagttcgacgccgacaacgacctcccgccccccttctccaacatcgtcgacctcaagacctacttcagcgtcaagggcttgggctggaaggacctcgtcgtcctatcagggagccacacgatcggcagcgcggagtgctcgacgttcgcgtcggaccggctctacaacttcagcgggaagggggtgcaggacccgtcgctggacaaggcgtacgcggcgttcctgcgggaggcgtgcgagcccggcctccagaacgacacgaccacggtggcgatggacccgtccaccccctacgagttcgacctgagctactaccgccacgtgctcggcgacacggggctcctcctctccgaccaggcgctcatggacgaccggtggaccagggagtacgtggagcggatggccgccgcggcgtcgcccgacgagttcttcgccgactacgcggtcgccatgaccaacatgggccggctcgaggtgctcaccggcgacagcggggagatcagggagacctgcgccgcgtacgttgactagaagcgaagcgaaggggataggctagctaaggctagagcggccggcgattgtggttggttggtggatccgatcgccacgtggcggcggcagcgtgggagccaaccaggatgcacttgccgtatcctatttgggggcggttggaggattgacttcgccgtgaggctggattggatgcattattctttgctgccgaaaaagaagttcaattgtactagctaggatgtaaggaaaaaagccacctgttttgttcttcagaaaaaaaaaaaaaaaaaaaa

SEQ ID NO: 932 - protein, 340 aa, Panicum virgatum
  misc_feature: Ceres CLONE 1749963
  misc_feature (1)..(248): Pfam Name: peroxidase Pfam Description: Peroxidase
MALKLQLLAVVVAVAASCRPGLADPAVSALPGLPVAGLAAGFYNESCPEVEDLVLAEMRAIVEKDRTLGPAMLRFMFHDCLVRGCDASIMLKSRSNKGEQDAIASYSLRGYDVVEQIKATVEAACPLTVSCADIIALAARDAVYLSNGPRYAVETGRRDGKVSAKFDADNDLPPPFSNIVDLKTYFSVKGLGWKDLVVLSGSHTIGSAECSTFASDRLYNFSGKGVQDPSLDKAYAAFLREACEPGLQNDTTTVAMDPSTPYEFDLSYYRHVLGDTGLLLSDQALMDDRWTREYVERMAAAASPDEFFADYAVAMTNMGRLEVLTGDSGEIRETCAAYVD

SEQ ID NO: 933 - DNA, 1773 bp, Panicum virgatum
  misc_feature: Ceres CLONE 1749989
  misc_feature: Encodes the peptide sequence at SEQ ID NO. 934
acccttctcagttctcatctcaagttctcaactcgtctcgtctcttccctggtaggggagaggaggcgctactagaagtactaccacgcggctgggcgcgccgcatcgagtcggcatctctctgggatccggctgcccggtcgtccggtcgttggctggatcggcggcgatgggggcgctgtcgcggccggaggaggtggtggcgctggtcaagctgcgggtggcggcggggcagatcaagcgccagatcccgcccgaggagcactggggcttcgcctactccatgctccagaaggtctcccgaagcttcgcgctcgtcatccagcagctcggccccgatctccgcaatgccgtgtgcatcttctacctcgtactccgtgccctggacaccgttgaggatgacactagcatcccaaccgaggtgaaggtgcccatcctccaggaattttatcgccacatctacaaccgcgactggcactactcatgtggaacaaataactacaaagtgctgatggataagtttcaccatgtatccaccgccttcctggagcttggtgaaggttatcaaaaggcaattgaagaaatcactaggcgaatgggagcaggaatggcaaaatttatatgcaaggaggttgaaactgttggtgactatgaagaatactgtcactatgtagccgggctggttgggtatggactttccagactcttttatgctgctgggactgaagatctggctccagactcgctgtcaaattcaatgggtctatttttgcagaaaactaatataattagggactatttggaagacataaatgagataccaaagtcccgcatgttctggcctcgagagatatggagtaaatatgcgaataaacttgaggatttcaaatatgaggaaaattcagaaaaggcagtacagtgcttgaacgatctagtgactaatgcattgattcacgctgaagactgcctccagtacatgtcagccttgaaggatcatgccattttccgtttttgtgcaatacctcagataatggcaattggaacatgtgctctttgctacaataatgtgaatgtctttagaggagttgtaaagatgagacgtgggctcacggcacgagtgattgatgagacaaactcaatgtcagacgtctatactgctttctatgagttttcttcattgctggagtcaaagattgacgacaatgatccaaatgctacgctaacacgaaaacgcgtggattcaataaagcaaacttgcaggtcatcaggtttcctaaagagcagggggtaccatttggacaagtcaccttacaagcctattctgctcatgattgttcttctgctggtggctattatatttggggtactttatactaagtgaagccctgctagttagcctttttcttcatgtggagacttaagagagcaactacgccaatatgattttgttttgtactctgtagtctacgaaggctgagaaaaaaatccagaagtagggagggactgtagatggaatgatggatatggctgcatgctactgcttcctcatttcttttgttccttttctttcctcgcgtgttgcaccgtttgaagctgtttctagggaaaagaaacttgcaacatgtatcctgtaaacttatgttagcagtgggcacactagtttgctgacatttttttcctttcgaaaaacccgtataagagtattgtttttccggaatcgtgtagtggaagaacatcaaccgtgttgagcagtaaaaaaaaaaaaaaaaaaaa

SEQ ID NO: 934 - protein, 403 aa, Panicum virgatum
  misc_feature: Ceres CLONE 1749989
  misc_feature: Great-hit functional homolog of the protein sequence given in SEQ ID NO 9178
  misc_feature (1)..(288): Pfam Name: SQS_PSY Pfam Description: Squalene/phytoene synthase
  misc_feature (1)..(400): SWISSPROT Homolog: EC 2.5.1.21 Squalene synthetase
  misc_feature (4)..(400): SWISSPROT Homolog: EC 2.5.1.21 Squalene synthetase
  misc_feature: Useful for making plants with altered sterol content
MGALSRPEEVVALVKLRVAAGQIKRQIPPEEHWGFAYSMLQKVSRSFALVIQQLGPDLRNAVCIFYLVLRALDTVEDDTSIPTEVKVPILQEFYRHIYNRDWHYSCGTNNYKVLMDKFHHVSTAFLELGEGYQKAIEEITRRMGAGMAKFICKEVETVGDYEEYCHYVAGLVGYGLSRLFYAAGTEDLAPDSLSNSMGLFLQKTNIIRDYLEDINEIPKSRMFWPREIWSKYANKLEDFKYEENSEKAVQCLNDLVTNALIHAEDCLQYMSALKDHAIFRFCAIPQIMAIGTCALCYNNVNVFRGVVKMRRGLTARVIDETNSMSDVYTAFYEFSSLLESKIDDNDPNATLTRKRVDSIKQTCRSSGFLKSRGYHLDKSPYKPILLMIVLLLVAIIFGVLYTK

SEQ ID NO: 935 - DNA, 2271 bp, Panicum virgatum
  misc_feature: Ceres CLONE 1750014
  misc_feature: Encodes the peptide sequence at SEQ ID NO. 936
tccctcgcgcgcggctcctcatcacttctcgcctcgcccgaaaaagctatggccctgcgctctccccgccgccaagcgtaacgaggccgccgtcgtcggcagcgcgaggagagccccagcgcgtacgtgcagctctgcgccgcgggagctagctagccagctagctgtagaggatggcgcacgatccgagcctggcgtacgcggactacttcgcggcggcgggcggcgtggccacgctcgtcccggaggtggacgccgcgggggaggacgacggccacctgtacggcggcgcgcacgcgcaccaccaccaccacgggctcgacgtgttcggcggggccaggggtggcctcgtgccggccgcggcgcaccacggcaagggcgccgcagccgcgctaggggacttcggcctcggcggcgccgagcaccaccgcctgctgctgggccacggccagcaggcgccgctgacgtccctgtcgctgcacgggtccgccgaggccgcgtcgctggcgctgcaccaccaccagcttggcggcggcgcgctcaggcagcaccagccggcggcgtggccgccgccgccgcagcagcagcagggcggcgccgcgtggcacctgcgcggctccaggttcctgcgcccgacgcagcaactgctgcaggaattctgcggcctccccgtggaggccgccagcgcggcggcttccaagccgccgacgaagccggggagcgaggacggcgccggggaggggtcgtcgtcgtcctcggccccgtcggcgcagatccaggccatggacgccgccgagctgcagaggctcaaggccaagctctacgccatgctccaagaggtggagaggaggtaccggaggtaccgcgagcagatgagggcggtggcggggtccttcgaggcggtggccggggagcgggcggcggcggcgtacacgaggctggcgtcgcggacgatatccaagcacttccggagcctgcgggacggggtggcggcgcagctgcaggcggtgcgccgggcgctcggcgagaaggacgccgacggcggcggcgccccgggggcggccgggatggccaacaagggggagacgacgcccaggctgcgggtgctcgaccagtgcctgaggcagcacagggcgtaccaggccggcgttctcgagagccagccgtggaggccgcagcgagggctgccggagcgcgccgtctccatcctccgggcctggctgttcgaacacttcctgcatccgtatccaagcgacgtggataagcacatcctggcgcggcagacgggcctatcacgcagccaagtctccaactggttcatcaacgcgagggtgaggctgtggaagcccatggtggaggagatgtacgcggaggagatgaagggcccgcaggagggcggcgcctgcagcaacgccgccgcgaacaacagcagcagcaacgcgaaccctagcggcgtctacggcggcggcgcctccgagcggctagggcaggggcgcggcggcggcgacgacggcggcggcgagcggaagccgacgcgggcgcagctgcaggtccacgacgccgggtccctggcctccgtcgtgagcatcggcagcggcaggggcccgcagaacatcgacttcggcatgatggacggccacctcgacttcgacgcgtacagcgacgcccacgccacggggcccggcgggcaccacggcttcggcggcggcgtgtccctcacgctggggctgcagcagcacgccggcggcgacccgcacggcggcgtgaacgtcgcgttcgcggccgcgcaatcgtccgcggcggcgcacgagttcctgttcatggcgggcggcggcgagcagcatcagcagcagatggtcgctgaccagggccagttcaccgccggaatggacggcgacggcgtggccgcctcgcactaccaccaccaccggggcatcagcgccgccactgggttccagctcctccacgacctggccggctgacggcatgattaattagcacgtagcaggggacggagggaccgtgatgatcagagcggagtgcgtgctttaatttgctttttggattgtggaggaggttcacgcggtggttgacggggatgcgccaacggcagcgagcagcagctagcggacggcattgggcttgggcatggggtgcatggcgcgagcgcagcttgtgcggctcttgtgtgtaagggcgctttggatttttgtaggggtttagattcctctcccttcaattcttggcagggtgtccctgtctgtcctgtcc

SEQ ID NO: 936 - protein, 602 aa, Panicum virgatum
  misc_feature: Ceres CLONE 1750014
  misc_feature (1)..(59): Pfam Name: Homeobox Pfam Description: Homeobox domain
MAHDPSLAYADYFAAAGGVATLVPEVDAAGEDDGHLYGGAHAHHHHHGLDVFGGARGGLVPAAAHHGKGAAAALGDFGLGGAEHHRLLLGHGQQAPLTSLSLHGSAEAASLALHHHQLGGGALRQHQPAAWPPPPQQQQGGAAWHLRGSRFLRPTQQLLQEFCGLPVEAASAAASKPPTKPGSEDGAGEGSSSSSAPSAQIQAMDAAELQRLKAKLYAMLQEVERRYRRYREQMRAVAGSFEAVAGERAAAAYTRLASRTISKHFRSLRDGVAAQLQAVRRALGEKDADGGGAPGAAGMANKGETTPRLRVLDQCLRQHRAYQAGVLESQPWRPQRGLPERAVSILRAWLFEHFLHPYPSDVDKHILARQTGLSRSQVSNWFINARVRLWKPMVEEMYAEEMKGPQEGGACSNAAANNSSSNANPSGVYGGGASERLGQGRGGGDDGGGERKPTRAQLQVHDAGSLASVVSIGSGRGPQNIDFGMMDGHLDFDAYSDAHATGPGGHHGFGGGVSLTLGLQQHAGGDPHGGVNVAFAAAQSSAAAHEFLFMAGGGEQHQQQMVADQGQFTAGMDGDGVAASHYHHHRGISAATGFQLLHDLAG

SEQ ID NO: 937 - DNA, 1701 bp, Panicum virgatum
  misc_feature: Ceres CLONE 1752787
  misc_feature: Encodes the peptide sequence at SEQ ID NO. 938
aaaagccagatgctgttcgcggcgactggatcccaaaaatttataccgcccgcccccataattccgaggcgccactcttcccctttctctcccgtctctcgcatcgcgtcgtctcgcccgcgctcgtcccaggtcttcgagtgggaagggagggcagccggtccgttccggaatagcgcaggcggtggtgccggcgatgcagtgccaggtcggggcgaaggcggccgtccgggcgaggccggcggcgagcgccgggggtagggtgtggggcgtcaggaggagcggacgcggcacctcggggttcaaggccatggctctcagcaccgcgagcaccggggtggtgccgcgcctcgagcagctgctcaacatggacaccaagccctacaccgacaagatcatcgccgagtacatctggatcggaggatctggaatcgatatcagaagcaaatcaaggacaattgaaaaaccggtggaggacccctcggaactaccaaaatggaactacgatggatcaagcacagggcaagctccaggagaagacagtgaagtcattctatatccccaggctattttcaaggacccattccgaggtggcaacaacattttggttatgtgtgatacctacacgccagctggggaacccattcctactaacaaacgccacagggctgcacaaattttcagcgacccaaaggtcgttgaacaagtgccatggtttggcattgaacaagagtacactttgatgcagagagatgtgaattggcctcttggctggcctgttggaggctaccctggtccccagggtccgtactactgtgccgtaggagcggaaaaatcattcggccgtgacatatcagatgctcactacaaggcatgcctttatgctggaatcaacattagtggaacaaacggggaggtcatgcctggtcagtgggagtaccaagttggacctagtgttggtattgaagcaggagaccacatatggatttcaagataccttctcgagagaatcacagagcaagctggagttgtgcttacacttgatccaaaaccaattccgggtgactggaatggagctggctgccacacaaattacagcacgaagagcatgcgtgaagatggaggatttgaagtgatcaagaaagcaatccttaacctttctctgcgccatgatttgcatattagtgcatatggagaaggaaatgagagaagattgacagggttacacgagacagctagcatcgacaccttctcatggggtgtggcgaaccgtggatgctctattcgtgttgggagagataccgaggccaaaggaaaagggtacctggaagaccgtcgcccagcatcgaacatggacccatacattgtgacagggctactggcagagaccacaattctctgggagccaacccttgaagccgaggctcttgctgctaagaaattggcgctgaatgtatgaaagacatgaagcatggctcaggcaaataaaccggtccgcaacaaaattgattgttgcccaccggtggatcttgtgattctgttcggcgccatcctgtacaaaatttacagtttctggatccacattctctttgattcgtcggttacagtaaccttttgcttggataccacgtttgtactcggtctgtacttgtctccacttgggactcgataatgaacagtgaaaaaaaaaaaaaaaaaaaa

SEQ ID NO: 938 - protein, 420 aa, Panicum virgatum
  misc_feature: Ceres CLONE 1752787
  misc_feature (1)..(253): Pfam Name: Gln-synt_C Pfam Description: Glutamine synthetase, catalytic domain
  misc_feature (1)..(420): SWISSPROT Homolog: EC 6.3.1.2 Glutamine synthetase, chloroplast precursor
MQCQVGAKAAVRARPAASAGGRVWGVRRSGRGTSGFKAMALSTASTGVVPRLEQLLNMDTKPYTDKIIAEYIWIGGSGIDIRSKSRTIEKPVEDPSELPKWNYDGSSTGQAPGEDSEVILYPQAIFKDPFRGGNNILVMCDTYTPAGEPIPTNKRHRAAQIFSDPKVVEQVPWFGIEQEYTLMQRDVNWPLGWPVGGYPGPQGPYYCAVGAEKSFGRDISDAHYKACLYAGINISGTNGEVMPGQWEYQVGPSVGIEAGDHIWISRYLLERITEQAGVVLTLDPKPIPGDWNGAGCHTNYSTKSMREDGGFEVIKKAILNLSLRHDLHISAYGEGNERRLTGLHETASIDTFSWGVANRGCSIRVGRDTEAKGKGYLEDRRPASNMDPYIVTGLLAETTILWEPTLEAEALAAKKLALNV

SEQ ID NO: 939 - DNA, 2290 bp, Panicum virgatum
  misc_feature: Ceres CLONE 1752800
  misc_feature: Encodes the peptide sequence at SEQ ID NO. 940
gtcgtgttcgtgtaaaggaaaggaaggaaagggggcagaggagggagggcgggcgggcgggccggagccaggcagcgccgccgtccggtaccgtcgcggcctcctgctcctcctctgccgccgcctcctaacgcgcagagaaggaggcgggaggtcgtccgtggggagattctggagtgcgggtggagaggggcggagccggcgtggtctcgactccgtcgccgcagcttctcacgaggaggaacacagggatcgagggagagttagcccgagacgcttcgccatccagttctgtcgccatcgttccaggatggtgcactgggttagcgacagcgaggatagcgataaattcgagtgggacactgatggggaggatgcggggagcttcaacgctgccgcttctggttcttcagctctcgcgtcaaggaactttgatgctcctggcccctcaacaaaggttgctaatgctaatgggacggcctggccatctgcctcttcagttcagaagtatgtggatatgggttttccagaggagatggttctcaaggccatgaaggataatggggataacagtgcagattcattaattgaacttcttcttacctaccaggccataggcaatgatccctctgtggacatgggctctgcttctcgctgtgtcccccaagctgcaaaggatagtgacgatgatgacgatctagaaaactgggacgataatgacgatctaaaaggtcctaccttcgatgaatccagtgatgaggatttcttgcatgagatgtcacaggtcgatgagaaagttgattatttggtgaaagttttgggatttccagaaggtgaggtcaccatggctgttactagatgcgggcaggatgcatctatttctgttttggctgattcggtctatgcctcacaaacagcaggtggttgctgtggcaattcttctgaccacgaggataattcctatggagggagaaagaaaggaaggcccatggaagggaacaacagaaagagaaagaggtttggaggtcaagcacaaggaagtagaggggccctagatggtaatgatgagtcaatgaatctcccaaatccaatggttggttttaacttgccaaatgggttaaggtcagtgaacagatcgctacctgcacaagctattgggccaccatacttctattatgagaacgtggcacttgccccaaaaggtgtttgggctacaatatcaagattcctatttgatattcagccagaatttgtagactcaaagttcttctgtgccgccgccagaaagagaggttacatacataacctgcctctcgtgaacaggtcacctctacttcccttacccccaaagacaatatttgaggccttccctcgtaccaagaagtggtggccctcatgggatccaagacggcaatttaactgtcttcagacttgtgtggctagtgctaagaatttagagagaattcgcctagccctaacaaatagtgaagatccgccacctctaggagttcaaaagtatgtgcttgaacaatgcagaaaatggaatttggcatgggttggtctcaacaaggttgctcctctagagccggatgagatggagttcctactcggcttcccaaaggatcataccagaggaatcagcaggacagaaaggtaccggtccttgggcaactcgttccaagtggacactgttgcgtaccacctctcggtactcaaggatatgtttccacacggcctgaatgtgctgtcgttgttctctggtattggaggtggggaggtggctctccacagacttggcattcgaatgaactatgtaatttctgtagagaaatctgaagtgaacaggacaattctaaagagttggtgggatcagacgcaaacaggcacgctgattgagattagcgatgtgcaaacactgacttcggagaagcttgaggcatttattagaagaattggtggttttgatctggttattggaggcagtccgtgcaacaacctggctgggagcaaccgtcaccacagagatggcttggagggcgaacattcttcactgttcttccattattttagaattttggactctgtgaaggccatcatggcccaactgtagtttatgtgtacctttgttgtcttgttccagaattttagaattttcttttcgtcgaactagtgaattatttgaaggttggctggtgtaattcggttgttactctaatttaggcttctttatttgcctttggtgatcaatgaaaaattgtcatattggcaccaaaaaaaaaaaaaaaaaaaa

SEQ ID NO: 940 - protein, 599 aa, Panicum virgatum
  misc_feature: Ceres CLONE 1752800
  misc_feature (1)..(115): Pfam Name: DNA_methylase Pfam Description: C-5 cytosine-specific DNA methylase
MVHWVSDSEDSDKFEWDTDGEDAGSFNAAASGSSALASRNFDAPGPSTKVANANGTAWPSASSVQKYVDMGFPEEMVLKAMKDNGDNSADSLIELLLTYQAIGNDPSVDMGSASRCVPQAAKDSDDDDDLENWDDNDDLKGPTFDESSDEDFLHEMSQVDEKVDYLVKVLGFPEGEVTMAVTRCGQDASISVLADSVYASQTAGGCCGNSSDHEDNSYGGRKKGRPMEGNNRKRKRFGGQAQGSRGALDGNDESMNLPNPMVGFNLPNGLRSVNRSLPAQAIGPPYFYYENVALAPKGVWATISRFLFDIQPEFVDSKFFCAAARKRGYIHNLPLVNRSPLLPLPPKTIFEAFPRTKKWWPSWDPRRQFNCLQTCVASAKNLERIRLALTNSEDPPPLGVQKYVLEQCRKWNLAWVGLNKVAPLEPDEMEFLLGFPKDHTRGISRTERYRSLGNSFQVDTVAYHLSVLKDMFPHGLNVLSLFSGIGGGEVALHRLGIRMNYVISVEKSEVNRTILKSWWDQTQTGTLIEISDVQTLTSEKLEAFIRRIGGFDLVIGGSPCNNLAGSNRHHRDGLEGEHSSLFFHYFRILDSVKAIMAQL

SEQ ID NO: 941 - DNA, 1905 bp, Panicum virgatum
  misc_feature: Ceres CLONE 1752819
  misc_feature: Encodes the peptide sequence at SEQ ID NO. 942
gattcaacgcgcgctagctataaattcgaggagaaatcgctccccgctccaatccccccacgaactgcaagctcctcctcgtcctccgccccaatggcgacctcccgcctcctggttttcctctgcctcgccgccgccgtcgcggtggcgtccgccggaaaagacgccctccgtctgccccgcggcgccagcttcccggcggcgcaggccgagcggctcatccgcgcgctcaacctcctgccaaaggaggcagggccggccgtctccggcgatggccccgctgtggcgcctggggagctcctggagcggcgggtgaggctgcccggtgcgcccgacggggtccaggacctcggccaccacgccggttacttccgcctgccacacacgcacgacgccaggatgttctacttcttcttcgaatcgaggggcaagaaggaggacccagtagtgatctggctaacgggagggcctggctgcagcagtgagttggccgtcttctatgagaacgggcccttcaccattgcaaacaacatgtcgcttgtttggaacaaatttggttgggatacgatctcaaatatcatatttgttgatcaacctactggaactggctttagctacagctctgatgatcgtgatactcgtcatgatgagactggtgtcagcaatgatctatatgactttctccaggtattctttaagaagcacccggaatttgcaaagaatgacttctatataactggagaatcttatgctgggcactacattccagcatttgcaagcagagttcaccaaggaaacaaagcaaatgagggcattcatataaacttaaagggttttgctatcggtaatggtctcacagatccagaaatccaatacagagcctacacagactatgcattggaaatgaaccttattgagaaatctgactatgaaaggatcaacaggttcatcccaccatgtgaatttgcaattaagatgtgtggtaccgatgggaaagcatcatgcatggcagcttatatggtctgcaataatattttcaactctatcatgaagcttgttgggacaaagaattactatgatgttaggaaggaatgtgaagggaaactttgctatgacttctcaaacttggagaagttctttggtgataaaacggtcaaagaggcacttggagttggtaacattgaattcgtctcttgcagtattacagtttatgaagcaatgctcacagactggatgcggaatttggaagttggtatcccagctctactagaggatgggatcaatgtccttatatatgctggggagtatgaccttatatgcaattggctcggaaactcgaggtgggtacactcaatggaatggtctgaccagaaagactttgtatcctctagtgagtcatcatttgtagtagatggtgccgaagctggagttttgaagagccacggaccactcagcttcctcaaggttcacaatgctggccacatggttccaatggatcagcccaaagcttctctagaaatgctgaggagatttacccaaggaaaactgaaggaattgcttcccgagtcgatggtttttaaggcagtgatgtgattgacctgaacagaattgcttgctaggtagtatgagttgtcattccaaggagtgtgttgcctaagcttcttgtttacattaatttttatccacggtgcgagctgaaatataaccctgataataactttgggaggcctgaaatgtaattacagttccagtcatgtatgctgatgatgagaaacccagtacacgaaggggacagtgttggaagccttgtctgctgctcttgtaaagcatctcatgtatacgcgctctgatcccaaagaaaaataataaaaagaaaggtttcttgaaaaaaaaaaaaaaaaaaaa

SEQ ID NO: 942 - protein, 499 aa, Panicum virgatum
  misc_feature: Ceres CLONE 1752819
  misc_feature (9)..(410): Pfam Name: Peptidase_S10 Pfam Description: Serine carboxypeptidase
  misc_feature (1)..(407): Pfam Name: Peptidase_S10 Pfam Description: Serine carboxypeptidase
  misc_feature (1)..(335): Pfam Name: Peptidase_S10 Pfam Description: Serine carboxypeptidase
  misc_feature (3)..(403): Pfam Name: Peptidase_S10 Pfam Description: Serine carboxypeptidase
  misc_feature (1)..(406): Pfam Name: Peptidase_S10 Pfam Description: Serine carboxypeptidase
  misc_feature (3)..(405): Pfam Name: Peptidase_S10 Pfam Description: Serine carboxypeptidase
  misc_feature (1)..(491): SWISSPROT Homolog: EC 3.4.16.5 Serine carboxypeptidase 3 precursor
  misc_feature (1)..(498): SWISSPROT Homolog: EC 3.4.16.5 Serine carboxypeptidase 3 precursor
MATSRLLVFLCLAAAVAVASAGKDALRLPRGASFPAAQAERLIRALNLLPKEAGPAVSGDGPAVAPGELLERRVRLPGAPDGVQDLGHHAGYFRLPHTHDARMFYFFFESRGKKEDPVVIWLTGGPGCSSELAVFYENGPFTIANNMSLVWNKFGWDTISNIIFVDQPTGTGFSYSSDDRDTRHDETGVSNDLYDFLQVFFKKHPEFAKNDFYITGESYAGHYIPAFASRVHQGNKANEGIHINLKGFAIGNGLTDPEIQYRAYTDYALEMNLIEKSDYERINRFIPPCEFAIKMCGTDGKASCMAAYMVCNNIFNSIMKLVGTKNYYDVRKECEGKLCYDFSNLEKFFGDKTVKEALGVGNIEFVSCSITVYEAMLTDWMRNLEVGIPALLEDGINVLIYAGEYDLICNWLGNSRWVHSMEWSDQKDFVSSSESSFVVDGAEAGVLKSHGPLSFLKVHNAGHMVPMDQPKASLEMLRRFTQGKLKELLPESMVFKAVM

SEQ ID NO: 943 - DNA, 1648 bp, Panicum virgatum
  misc_feature: Ceres CLONE 1752831
  misc_feature: Encodes the peptide sequence at SEQ ID NO. 944
gatggcagccgcggcgtggctgtgcgggctcgtctcgctcctggcggtagccgccgccgcggcggcggatggggagtgggagccgctgatacggatgccgacggaggaggggggcgacgctgctgctgctgctccggcggccgaggatgaagtggggacgaggtgggccgtgctcgtggcgggatcctccggctacggcaactaccggcaccagaagggaggagtgaaggaggagaatattgtggtgttcatgtacgatgatattgcccataacattctgaacccaaggcctgggattatcattaaccatcctaaaggtgaaaatgtatataccggtgttccaaaggactatacaggtgatcaggtcactactgaaaatttctttgctgtgctcttgggcaataaaagtgcaattactggagggagtaagaaggttatagacagtaaaccaaatgaccacatatttatctattactcagatcatggtggtcctggagttcttggtatgccaaacttgccatatctctatgctggcgacttcatcaaggttttaaaaaagaagcatgcttccaatagctactcgaaaatggttatatatgttgaagcatgtgaaagtggcagtatctttgagggattaatgccacaagacctaaatatttatgtcacaactgctgcaaatccagttgaaaatagttggggaacatactgccctgggatggacccaccaccccctcctgagtacattacctgtttaggtgatctgtacagtgtttcttggatggaagatagtcaaacccacaatctaatgaaggaaaccatcaaggatcagtacgaagtggtgaaaacaagaacctctaactcgaataagtacaaggagggttctcatgtcatagagtatggtgacaagaccttcaaggatgagaagcttttcctttatcaaggttttgatcctgctaatgccaacgttgcaaatacgctgctttggccaggcccaaagggtgcagtcaatcagagagatgctgatcttctcttcgtgtggaagaggtatgagcagttaaatgggggatctgaagagaaactgagggctctcagagagattaaagaaactgttcaacacaggaagcatctcgacagcagcatcgatttcattgggagacttatctttggatttgagaatgggcctaaaatgcttgagaccgttagagcatatggtgaaccattagttgatgactgggattgtttgaagaggatggtgaggattttcgaatcccagtgcgggtcgctcactcaatacggcatgaagtacatgagggcatttgcgaacatttgcaacagcggtatatccgagacaaagatgagggagtcgagcatcagtgcttgcggcggttacaacctggcgaggtggagccctttggctcagggacacagcgcctgatgaggtgcagcctgtagcaaaggtccccgaggtctatcctgcgtagggacgctgcgaactcgtgtagcctggggactgtaaagcgtaaaccgctcagaatgtgcgttggttaatcagctgtatatattgtgtaccgtgcgttcgtgcctgtgtgaactgataccatgcaagtctgatctgcagccaactgccgaaaaaaaaaaaaaaaaaaaa

SEQ ID NO: 944 - protein, 477 aa, Panicum virgatum
  misc_feature: Ceres CLONE 1752831
  misc_feature (1)..(426): Pfam Name: Peptidase_C13 Pfam Description: Peptidase C13 family
  misc_feature (1)..(424): Pfam Name: Peptidase_C13 Pfam Description: Peptidase C13 family
  misc_feature (4)..(423): Pfam Name: Peptidase_C13 Pfam Description: Peptidase C13 family
  misc_feature (10)..(477): SWISSPROT Homolog: EC 3.4.22.34 Legumain precursor
MAAAAWLCGLVSLLAVAAAAAADGEWEPLIRMPTEEGGDAAAAAPAAEDEVGTRWAVLVAGSSGYGNYRHQKGGVKEENIVVFMYDDIAHNILNPRPGIIINHPKGENVYTGVPKDYTGDQVTTENFFAVLLGNKSAITGGSKKVIDSKPNDHIFIYYSDHGGPGVLGMPNLPYLYAGDFIKVLKKKHASNSYSKMVIYVEACESGSIFEGLMPQDLNIYVTTAANPVENSWGTYCPGMDPPPPPEYITCLGDLYSVSWMEDSQTHNLMKETIKDQYEVVKTRTSNSNKYKEGSHVIEYGDKTFKDEKLFLYQGFDPANANVANTLLWPGPKGAVNQRDADLLFVWKRYEQLNGGSEEKLRALREIKETVQHRKHLDSSIDFIGRLIFGFENGPKMLETVRAYGEPLVDDWDCLKRMVRIFESQCGSLTQYGMKYMRAFANICNSGISETKMRESSISACGGYNLARWSPLAQGHSA

SEQ ID NO: 945 - DNA, 1315 bp, Panicum virgatum
  misc_feature: Ceres CLONE 1752837
  misc_feature: Encodes the peptide sequence at SEQ ID NO. 946
agcgccttatcccttctcctccgtctccgtggcacgcgtgctcgcacgcacgcaagacccatgtcgtccgccgcagcgcgcgccgtctcgccggcggccgcggcgccgcctcccctccctcgccgcctgaggcccgcgaggtgcacggccggcgccgcggcgacggagacggccaccgcggggccggcgagggtggcgaccgtcagcaacagcggggactccctggcgatatgccgggtgctcaacggcatgtggcagaccagcggagggtgggggcgcatcgaccgcgacgccgctgtcgaatccatgctcacgtacgccgacgccggactcaccaccttcgacatggccgaccactatgggccagcagaggatttgtatggcatgttcatcaatagagtcaggcgggagcgcccacctgagttgcttgaagaaatcaaggggcttacaaagtgggtgccgcctcccgttaagatgacaagaagttacgttgaggataatatcaatagatctaggaagaggatggatgttgctgcattggacatgttgcagttccactggtgggattacgcaaatcctggatatttggatgcactaaagcacatcacagacctgaaggaggaaggcaagataaagaccgtagctctgacaaacttcgatacagacagactgcaaataattctagaaaacggaatcccagttgttagcaaccaggttcaacattccatcgttgatatgcgccctcagcaaagaatggcagagctttgccagttaactggagttaaacttataacgtatggcacagtgatgggtggtcttttgtctgaaaagtttcttgacaccaacgtatcaataccttttgctgggcctcctctaaataccccatctttgcagaagtataagaggatggtcgatgcttggggtggctggagcttgttccagactttgctgcaaactttaaagaaggtatcattgaaacatggtgttcctatcgcaactgttgctgtgcgatacatactgaaccagacatctgttgcgggttccatggtaggtgtgagattgggactctccgagcacatcaaagacaccaacgccatattctcacttgaattggatgaagaggacatgaacagcatcaccgaggtatcgaagaagggaagaaatttgatggatattatcggggattgtggcgatgagtacagagcttagttcatgctgctgcttggttgatatacttgttgtgacggaaccgccaaattaaaactctaattaagcgtaatggccgtcatttgaacaaaaaaaaaaaaaaaaaaaa

SEQ ID NO: 946 - protein, 382 aa, Panicum virgatum
  misc_feature: Ceres CLONE 1752837
  misc_feature (8)..(300): Pfam Name: Aldo_ket_red Pfam Description: Aldo/keto reductase family
  misc_feature (1)..(317): Pfam Name: Aldo_ket_red Pfam Description: Aldo/keto reductase family
  misc_feature (1)..(312): Pfam Name: Aldo_ket_red Pfam Description: Aldo/keto reductase family
MSSAAARAVSPAAAAPPPLPRRLRPARCTAGAAATETATAGPARVATVSNSGDSLAICRVLNGMWQTSGGWGRIDRDAAVESMLTYADAGLTTFDMADHYGPAEDLYGMFINRVRRERPPELLEEIKGLTKWVPPPVKMTRSYVEDNINRSRKRMDVAALDMLQFHWWDYANPGYLDALKHITDLKEEGKIKTVALTNFDTDRLQIILENGIPVVSNQVQHSIVDMRPQQRMAELCQLTGVKLITYGTVMGGLLSEKFLDTNVSIPFAGPPLNTPSLQKYKRMVDAWGGWSLFQTLLQTLKKVSLKHGVPIATVAVRYILNQTSVAGSMVGVRLGLSEHIKDTNAIFSLELDEEDMNSITEVSKKGRNLMDIIGDCGDEYRA

SEQ ID NO: 947 - DNA, 1578 bp, Panicum virgatum
  misc_feature: Ceres CLONE 1752915
  misc_feature: Encodes the peptide sequence at SEQ ID NO. 948
cccaagaaccccccactcccctccaccccaccccgcacccaccgcaagcgagaggcgagagccagcagccaagaagcagcagcagcagcagcagcagcagctatggtggcgcagcgccgggacgccgaggcggagctgaacctgcccccggggttccgcttccaccccaccgacgaggagctggtggcgcactacctctgcgcgcgcgccgccgggcgcggcccgccggtgcccatcatcgccgaggtcgacctctaccgcttcgacccctgggacctccccgagcgcgccctcttcggccgccgcgagtggtacttcttcacgcccagggaccgcaagtaccccaacggctcccgccccaaccgcgccgccgggacgggctactggaaagccaccggcgccgacaagcccgtccaccacgccggccgcaccctcgggatcaagaaggcgctcgtcttctaccacggcaagccgccgcgcggggtcaagaccgagtggatcatgcacgagtaccgcctcgccgacgccggcaccaagaagcccggcaacggctcgctcaggctggacgactgggtgctgtgccgcctgtacaacaagaagaacgagtgggagaagatgcagcagcagaaggggaaggcgatggagtcggaggcgtcgctctcccactcccactcccactccgacacgcgcacgccggagtcggagatcgacgacgacacgttcccggtgctgggcttgctgccggagttcgacgacatgggccccgctcccgctctcgcccccgcccccgccggcgccgtcctgcccaaggaggaggtgcaggacttcgtcaacctcggcggcgacgactggctcgcggggatcaacctcgactacctgcagatgcccggggacgccgacttcttcaacaacatgctcgggtcgccgatgggtcctcccaagccggagcaggacggcggcttcctgctattctgaacctgatgggctctgctccgattagctctgctctgctctgctccgaccccgaagagggatgcagctgcaactgtgaatagttcagatttgctttccatttagagaaacaaaaaattcctgctaatgcctggttggttgtagtgccgtagaccgtagtggtgtagtgcagaagtagtggtggtatgcaggtcagccaaggattggagtccagtgtaggactgaagctcatcattggagcttgtgatcagtgacaaaattctttcgtttctggttcagtaatttatcatcatttagatttgtttcttcagaattcagatgggcaaatgacattcagccgttttgtgttccttgtctctgaatattggatggtcatcccatttctgtttggccttttcgtttgtgatgatgatttttcagtgtgctactctttgcattcaggaattgttcttactcgatgagcaccgcgttcctttgcttccgtacaggccatgtgttctgtttgttcaaatgtagcagtggatgtttggtttctgttcagcgggtagcacagagaagaggcgatgggcagtacaaaaaaaaaaaaaaaaaaaaaaaaaaaaaaaa

SEQ ID NO: 948 - protein, 290 aa, Panicum virgatum
  misc_feature: Ceres CLONE 1752915
  misc_feature: The sequence is a functional homolog of  SEQ ID NO 891 in the  10/374,780 US patent application
  misc_feature: Useful for making plants with modulated growth and phenotype characteristics
MVAQRRDAEAELNLPPGFRFHPTDEELVAHYLCARAAGRGPPVPIIAEVDLYRFDPWDLPERALFGRREWYFFTPRDRKYPNGSRPNRAAGTGYWKATGADKPVHHAGRTLGIKKALVFYHGKPPRGVKTEWIMHEYRLADAGTKKPGNGSLRLDDWVLCRLYNKKNEWEKMQQQKGKAMESEASLSHSHSHSDTRTPESEIDDDTFPVLGLLPEFDDMGPAPALAPAPAGAVLPKEEVQDFVNLGGDDWLAGINLDYLQMPGDADFFNNMLGSPMGPPKPEQDGGFLLF

SEQ ID NO: 949 - DNA, 2215 bp, Panicum virgatum
  misc_feature: Ceres CLONE 1752929
  misc_feature: Encodes the peptide sequence at SEQ ID NO. 950
aaaagattaggcataacatctttattttttgtttttctttttctctctcttcgacctgctcaatcgcggcggcggcggcggcgttgtccatctccatgaacacggtggcttctctgtctttgatgccgcacttgctcattaagccttccttcacgtgcttctccagaaagggcgttggtcgctatggcggaatcaaggtgtatgcggtgctcagggaagatggagctgaattcgcaaagaacaacaacctggaggccctgttccatgtcgatgaccccgggccgagggtcccaatcaagaagggcaagttcttggatgtgaatgaggctctggaggtggtcagattcgacatccagtactgcgattggagggcgcggcaggatctcctcaccatcatggttctccacaacaaggtggtagaggttctcaatcctttaacaagagaattcaagtcgattggaaccttgaggaaagagcttgacgagttacaggaggaactagaaaaggctcacaatcaggttcatttgtcagaagcaagagtatcatctgcgctcgacaagttagcacatatggagaccctggtaaatgataggctattgccggatggagtctctagtacatccacagccgagtccacttccctagttccaagtacatcatccaccacccatgtccgaactaagaaacagccgcgtaggactctgaacgtgtctggtccagtgaagccctacaatcccagcttgaagaacttctggtacccaattgccttctccagtgatctgaaagatgacacgatggtaccaatagattgtttcgaggagcagtgggtgatattccgtggaaaagatggaaggcccggatgtgttcagaacacgtgtgctcacagagcttgcccccttcatcttggttcagtgaatgagggtagaatccagtgcccttaccatggttgggagtactcgaccgatggaaaatgcgagaaaatgccatcaacaaggatgctcaatgtgcgcatccagtcattgccatgctttgagcaggaaggaatggtttggatctggcctggtgatgacccaccaaaggccaccatcccttctcttctgcctccttctggattcacagttcacgcagagatagtgatggagctacctgttgagcatggccttctcctggacaatctgttggaccttgcccatgctccttttacacatacatccacctttgccaagggttggagtgttccaagcttggtgaagttcttaacacctgcatctgggctccaagggtactgggatccttaccccattgacatggagttccgaccaccatgcatggtcttgtcaaccatcggcatctcgaagccaggaaagctagaagggcagagcacccaacaatgttcgacacatcttcaccagcttcatgtttgcttgccctcatctaggaataaaactaggctgctgtatcggatgtcgctggacttcgctccttggctcaagcacataccgctcatgcacctactgtggtcacatttcgccgagaaggtcttgaatgaggacctacggcttgttcttgggcagcaagagcgaatgatcaatggcgccaacgtctggaactggccggtatcgtatgacaagctcgggatccggtaccggttgtggagggatgcagttgagagggactccgaccggctaccattcagtaaccaagttgagagtagatcatagccggtttatttcttcatctgtagtctctttctcgtcgcattgcttagccagacgatggccagacttagctgttggatatatacccacaattattacctaggcgcgcgtctctgcgctgcgcagttgataatttgccggaggatgctatgcgatggaacattctgggaaggaaggcggattcagagaatgatgggcaacgtcattgtctgatgtcaacagtgttacactagtgacggcatcatgggatgcaactgtaatctgagattggtctgtttttcctcctcttctttctcaccctttcatgtaaagattcagcggatgtcactctgtcaaagcatgtataatcatactaccagatacggagacatgttcatatgagaaatggcagttattcctacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 950 - protein, 541 aa, Panicum virgatum
  misc_feature: Ceres CLONE 1752929
  misc_feature (1)..(541): SWISSPROT Homolog: EC 1.13.12.14 Chlorophyllide a oxygenase, chloroplast precursor
  misc_feature (5)..(534): SWISSPROT Homolog: EC 1.13.12.14 Chlorophyllide a oxygenase, chloroplast precursor
MNTVASLSLMPHLLIKPSFTCFSRKGVGRYGGIKVYAVLREDGAEFAKNNNLEALFHVDDPGPRVPIKKGKFLDVNEALEVVRFDIQYCDWRARQDLLTIMVLHNKVVEVLNPLTREFKSIGTLRKELDELQEELEKAHNQVHLSEARVSSALDKLAHMETLVNDRLLPDGVSSTSTAESTSLVPSTSSTTHVRTKKQPRRTLNVSGPVKPYNPSLKNFWYPIAFSSDLKDDTMVPIDCFEEQWVIFRGKDGRPGCVQNTCAHRACPLHLGSVNEGRIQCPYHGWEYSTDGKCEKMPSTRMLNVRIQSLPCFEQEGMVWIWPGDDPPKATIPSLLPPSGFTVHAEIVMELPVEHGLLLDNLLDLAHAPFTHTSTFAKGWSVPSLVKFLTPASGLQGYWDPYPIDMEFRPPCMVLSTIGISKPGKLEGQSTQQCSTHLHQLHVCLPSSRNKTRLLYRMSLDFAPWLKHIPLMHLLWSHFAEKVLNEDLRLVLGQQERMINGANVWNWPVSYDKLGIRYRLWRDAVERDSDRLPFSNQVESRS

SEQ ID NO: 951 - DNA, 1873 bp, Panicum virgatum
  misc_feature: Ceres CLONE 1753042
  misc_feature: Encodes the peptide sequence at SEQ ID NO. 952
actcacaaccagccaaaagcttccgcttctcacctcacgcgctagctagctagctgcacacccaagcatcacacgccggacgccgcccgccggcaggcatggagaacaagcgggtggtcatcgttggagccggcgtcagcggcctcacggtgtgcaagcacctggtggagctcggctgccggcctaccgtcttcgaggcggacaccgtgctgggcggcgtgtgggcgcgcgcgccggcgtgcaccgagctccagacgccgcggcccctgtaccagtactccgacttcccatggccggagaacgtgacggaggtgttcccgaaccaccgccaggtggtggcgtacctcgacgcgtacgcgcgccacttcggcgtgctcggctgcatccgcttcggccaccgggtggtcggcatggagtaccacggcgtcggcgaaaaggatatcgccgcgtgggaggagtgggctgagaacggacaggcgttcggctccggcgccggcgagtggcgcctgtcggtggccgacgccgacggacacgttcagacacacaaagcagactttgtcgttctttgcatggggaggttcagtggtgtgcccaacatacccacattcccagaaggcaaaggtccagaagcatttgatgggcaggtcatccactccatggactatgccaaaatgggcacaagtaaagctaaggagatgatcaggggcaagcgtgtgactgtcgttggctacttgaaatcagcacttgatattgccgctgaatgtgccgaagtaaatggcactgctcacccatgtacaatgctggtcagaacaaagcactggatcttaccggactacttcgcctggggcttccacgtctcaaagctctatctcaaccgtttcgctgaactcctcatccacaagcctggcgaaggccttctccagtcaatcttggccacccttctgactcccttgaggtgggccttctccaagttcggggagagctactactccatcccgatgaagaagcacggcatggtgcctgaccacagcctgttcgaggcgctggctgcggccaccatcgccatcacgcccaaggaccactacaagcggctcgaagaaggcagcatcgtgctcaagaagtccaagacgttcagcttcagcaaggaaggcgtgctcgtggagggcgagccgtcgccggtcaagagcgacatcgtcatcttcgggaccgggttcaagggcgacgacaagatcacggacatgttcacttcagactacttccagagtgttgcggttgggtcagaatccactactgtgcctctctacagggagtgcatacatcctaagatccctcagcttgctgtgatcggatattccgagagcattgcgaacatgtacacgtcggacattcgggccaagtggttggcgcgcttcttggacggcggcttcagactaccgaacgttgctgcaatgcagaaggatgttctggaatgggagaagtacatgaagagatactctggaagatactttcgccggtccagcatcctgctcgtgcacacttggtacaacgaccagctctgccgcgacatggggtgcaatccgaggaggaaaaaagggttcttctctgaactgtttgaggtctatggccctggtgattatgctaacctactctccaactccaagcccaaggaacagtagaacttgtgtttaaattcctttggcacctacggatcacttctctgagatatatattcttgttacagcgaatgtacaatgtgtgtgtattgtcacatgtgtgatgaccatctttgcacttatctaaatgatgtaaagctttcctggcatataataaatttggactaatgttactccctcaaaaaaaaaaaaaaaaaaaa

SEQ ID NO: 952 - protein, 525 aa, Panicum virgatum
  misc_feature: Ceres CLONE 1753042
  misc_feature (1)..(36): Pfam Name: DAO Pfam Description: FAD dependent oxidoreductase
  misc_feature (2)..(505): Pfam Name: FMO-like Pfam Description: Flavin-binding monooxygenase-like
MENKRVVIVGAGVSGLTVCKHLVELGCRPTVFEADTVLGGVWARAPACTELQTPRPLYQYSDFPWPENVTEVFPNHRQVVAYLDAYARHFGVLGCIRFGHRVVGMEYHGVGEKDIAAWEEWAENGQAFGSGAGEWRLSVADADGHVQTHKADFVVLCMGRFSGVPNIPTFPEGKGPEAFDGQVIHSMDYAKMGTSKAKEMIRGKRVTVVGYLKSALDIAAECAEVNGTAHPCTMLVRTKHWILPDYFAWGFHVSKLYLNRFAELLIHKPGEGLLQSILATLLTPLRWAFSKFGESYYSIPMKKHGMVPDHSLFEALAAATIAITPKDHYKRLEEGSIVLKKSKTFSFSKEGVLVEGEPSPVKSDIVIFGTGFKGDDKITDMFTSDYFQSVAVGSESTTVPLYRECIHPKIPQLAVIGYSESIANMYTSDIRAKWLARFLDGGFRLPNVAAMQKDVLEWEKYMKRYSGRYFRRSSILLVHTWYNDQLCRDMGCNPRRKKGFFSELFEVYGPGDYANLLSNSKPKEQ

SEQ ID NO: 953 - DNA, 1762 bp, Panicum virgatum
  misc_feature: Ceres CLONE 1753053
  misc_feature: Encodes the peptide sequence at SEQ ID NO. 954
gccacttcactgtgtaccgaagagttagtcggagatgactccctacacggtgattgctctcgtggttgcattgagcctggcacagtatgccttcctcgccgccgccgccggccctagggtcatcatcgtcggcgccggcatgtcggggatctcggcggggaagagcctgtcggatgccgggataaccgacctgctgattctggaggcgacggaccacgtcggcgggaggatgcacaagcagaacttcgccggcatcaacgtcgaagtcggcgccaactgggtggagggcatcaacggcggcaagatgaaccccatctggcccatcgtcaactccaccctcaagctcaggaacttccgctccgacttcgactacctcgcacaaaacgtctacaaggaggatggtggcctttatgatgaagattacgttcagaaggggattgacctggcggatagtgtggaagagagtggggaaaaactctccggcacgttgcacactagtggccgcgacgacatgtctatccttgccatgcagcggctctacgatcaccagcctaacggcccggcgacgccggtggacatggccgtggactactacaagtacgactacgagttcgcggagccgccgcgcgtgaccagcctgcagaacactgtccctctcccgacgttcaacgactttggagacgacgtctacttcgtcgccgaccagcggggctacgagtccgttgtctactacctcgccggccagtatctcaagaccgacaagtccggcaaaatcgtcgatccccggttaaagctcaacaaggtggttcgtgagatctcctactccccgagtggagtcaccgtgaagacggaggacaactcggtttacggagcagactacgtgatggtttctgcaagcttgggggtcctgcagagcgatctcattcagttcaagccccacctgccttcatggaaggtcgtagcgatctaccagttcgacatggccgtgtacaccaagatattcgtcaagttccccaagaggttctggcctgaaggtaaagggagggagttcttcctctacgccagcagcaggagaggttactacgcagtgtggcaggagtttgagaagcagtaccctggtgccaacgtcctccttgtcaccgtgaccgacgaggaatctaggcgcattgagcagcagtcggacaaccagaccaaggcagagatcatggaggtgctgaggaagatgttccctggcaaggacgtcccggacgcgaccgacatccttgtcccgagatggtggtccgacaggttctacaggggcaccttctccaactggccaattggtgtgaaccgctacgagtatgatcagctcagggcgccagttgggagggtttacttcactggtgagcacacaagcgagcactacaatggctatgtccatggcgcttatattgcaggcattgactctgcagaaattcttatcaactgcgcccagaagaagatgtgcaagtacaatatcccgggcaagtatgacgactgagttcatcccaaccaaaacacgttcgatcatcatattattacggcgaccaactatgctgcatgttaattgtgtttctctatcagtttacgtttgagcgcgattaaataaatgaccatggcttggcttatagagaccgctcgcttgttcgggattgtaatgctttgtcatcagtgaaacaaaaactttcctttgagtcatgttgaataagatcttgtgccgcgttaaaaaaaaaaaaaaaaaaaa

SEQ ID NO: 954 - protein, 494 aa, Panicum virgatum
  misc_feature: Ceres CLONE 1753053
  misc_feature (1)..(433): Pfam Name: Amino_oxidase Pfam Description: Flavin containing amine oxidoreductase
  misc_feature (1)..(440): Pfam Name: Amino_oxidase Pfam Description: Flavin containing amine oxidoreductase
  misc_feature (1)..(442): Pfam Name: Amino_oxidase Pfam Description: Flavin containing amine oxidoreductase
  misc_feature (6)..(493): SWISSPROT Homolog: EC 1.5.3.11 Polyamine oxidase precursor
MTPYTVIALVVALSLAQYAFLAAAAGPRVIIVGAGMSGISAGKSLSDAGITDLLILEATDHVGGRMHKQNFAGINVEVGANWVEGINGGKMNPIWPIVNSTLKLRNFRSDFDYLAQNVYKEDGGLYDEDYVQKGIDLADSVEESGEKLSGTLHTSGRDDMSILAMQRLYDHQPNGPATPVDMAVDYYKYDYEFAEPPRVTSLQNTVPLPTFNDFGDDVYFVADQRGYESVVYYLAGQYLKTDKSGKIVDPRLKLNKVVREISYSPSGVTVKTEDNSVYGADYVMVSASLGVLQSDLIQFKPHLPSWKVVAIYQFDMAVYTKIFVKFPKRFWPEGKGREFFLYASSRRGYYAVWQEFEKQYPGANVLLVTVTDEESRRIEQQSDNQTKAEIMEVLRKMFPGKDVPDATDILVPRWWSDRFYRGTFSNWPIGVNRYEYDQLRAPVGRVYFTGEHTSEHYNGYVHGAYIAGIDSAEILINCAQKKMCKYNIPGKYDD

SEQ ID NO: 955 - DNA, 1607 bp, Panicum virgatum
  misc_feature: Ceres CLONE 1753169
  misc_feature: Encodes the peptide sequence at SEQ ID NO. 956
accaccgccacctcgtctcctctcccctccagtcccccccccccctccttcctcaccccaccacatggcggcggcgctcgcctcctcccgctgctgctgcagccgcccgtcgctgccgccgctcccggcccgcggccgccgcgccgtcgcccggtgcgcgctcggcggaggagagaaaagaaactccttcagctggaaagagtgtgcgatttctgttgccttgtcagttggattgatcagtggtgcaccaacattaggatcgtcggcctatgcttctcctctcgaacctgttcttccagatgtctctgttctgatctctggacctcccgttaaagatccaggtgctttactaagatatgctttgccaataaataacaaagctattcgtgaggttcaaaagccactggaggatatcactgacagtctcaaggttgctggtgttagagccttggattcagttgaaagaaatgtcagacaagcatcgagagcactggacaatgggagaggtgtaattcttgatggtcttgctgagtccaaaagagcaaatggagaagagttattggataaattggctgttggacttgatgagcttcaaagaattgttgaagacagaaatagggatgctgtagctccaaagcaaaaagagcttctccagtatgttggaactgtagaagaagacatggttgatggctttccctatgaaataccagaagagtacagcaacatgcctcttctcaaaggaagagctactgtggatatgaaggttaaaattaaggacaatcccaacatagaagattgtgtatttcgaatagttctggatggatataatgctcctgtgactgctgggaacttcgtagatttggtggaacggaaattctatgatggcatggaaatccagagagctgacggctttgttgttcaaaccggagatccagagggaccagctgaggggttcatcgatcccagcactggcaaaattcgcacaatacctcttgaaataatggttgatgttgataaggctcctgtatatggtgaaacacttgaagaacttggccgctacaaggctcaaacgaaacttccttttaatgcatttggaacgatggcaatggctagagaagaatttgatgataattcagcttctagtcaaatcttttggctcttaaaagagagtgagctaactccaagcaatgccaatatattggatggacggtatgcagtatttggatatgtaaccgagaatgaggatttcttggcggatgtcaaagttggggatgtcatcgaatcaatccaagtcgtctcaggcttggacaaccttgtgaacccaagctacaagatagtaggataacgtgttttgtatcagagttccttggccgcaattgtgtcttgaaattgatgtaaagcatataatatctaactcttataaccttgtctcttgttaatgaggctgtgtcatgtggaattccttggcggcaattgtgtcttgaaattgatgtaaagcactgtataatatctaactcgtataacaggctgtgtcatgggggattcaatattaattgaaagttcagaataattgatcggttgtccaccaaaaaaaaaaaaaaaaaaaa

SEQ ID NO: 956 - protein, 426 aa, Panicum virgatum
  misc_feature: Ceres CLONE 1753169
  misc_feature (2)..(187): Pfam Name: Pro_isomerase Pfam Description: Cyclophilin type peptidyl- prolyl cis-trans isomerase/CLD
  misc_feature (37)..(426): SWISSPROT Homolog: EC 5.2.1.8 Peptidyl-prolyl cis-trans isomerase, chloroplast precursor
MAAALASSRCCCSRPSLPPLPARGRRAVARCALGGGEKRNSFSWKECAISVALSVGLISGAPTLGSSAYASPLEPVLPDVSVLISGPPVKDPGALLRYALPINNKAIREVQKPLEDITDSLKVAGVRALDSVERNVRQASRALDNGRGVILDGLAESKRANGEELLDKLAVGLDELQRIVEDRNRDAVAPKQKELLQYVGTVEEDMVDGFPYEIPEEYSNMPLLKGRATVDMKVKIKDNPNIEDCVFRIVLDGYNAPVTAGNFVDLVERKFYDGMEIQRADGFVVQTGDPEGPAEGFIDPSTGKIRTIPLEIMVDVDKAPVYGETLEELGRYKAQTKLPFNAFGTMAMAREEFDDNSASSQIFWLLKESELTPSNANILDGRYAVFGYVTENEDFLADVKVGDVIESIQVVSGLDNLVNPSYKIVG

SEQ ID NO: 957 - DNA, 2678 bp, Panicum virgatum
  misc_feature: Ceres CLONE 1753240
  misc_feature: Encodes the peptide sequence at SEQ ID NO. 958
gcaggaagggggaggggaaagggcagcaggcagcagcgcagcgccggcgagcgagcgggcgccttcgaggatcaaaatgtgagggcgagcccggtgggctccgatcgctgattcccgagccgcccgcgctccgcccgtgcgctgatcccgaacactcaagatgctggatcctaggtggagtgccgtttcggcctacgtgtcggagtactggtctgtgataatcgccactgccgtgttcgcgtgtgtgggcgcggtgaccatctactacgtggtgaatcagctgaacaagaacatcagcctgagcctggtgaaggctatcagggtcagggcgaagcagtacaagaaatggaaggacaaggtccccgccgcgtcccacgtctggaggaaagaagttatcccccgcagtaaaggcctgaaatgctgcgtgtgcctcaagtccgtttcgccgcctcagtactctggggccaccatccatcagtgcgatatctgcggcgccgccgcgcatccgagctgctcagggaatgcgcacaaggattgcaagtgtgtttccatggctggtttgaaccatgtccttcaccagtgggctgtgcagtggattgagacagcggatcactccgaggaagactcgttctgttgctactgcgatgaatcttgcaatggagctttccttgcagggtctccgatttggtactgtatgtggtgtcaacggctcgtgcatgttgactgccacagcagcttagccaaggaaactggtgatatctgtgacttgggaccattgaagcggctgatattgtcacctctttgtgttaaggagcttcattggacaggtgcagggattttgagttctatcacaagtggggctaatgaattggcttccactgtccgagaaacgattatgattcgtagaaaaaggtacaaaaatggtactgcatctgctgactcagatagctctggggctattgagctaccatctgatgctgaaggagactcgcaagaagcaaatagcgcagcaaagaggagggatgatcagaccaacggcaaactcgatgaggtacaccaaaactccgaatcagagaaagaaaaacaagttgtatcagataacacagctgcaactggtaggtcaaatgggcaacgtgagaattctcatgtacagaacaatcagaagtatgaaattgtcaacgtgccttctgattccaggcccctccttgtttttgttaacaagagaagtggtgctcagagtggtgattcattgagacagcgtctgcagatccttcttaaccctgtgcaggtttttgagttgagcaagcagcaaggtccagaagttggtttagctttgtttcggaaggtaacccacttcagagttcttgtatgtggtggagatggcactgctggttgggttttagatgccattgagaaacagaagttcgaagctccgcctcctgtagccatccttccagctggtactggtaatgatcttgcgagggttctgtgttggggtggtggccttggtgttattgagaagcggggaggtctcttctcagttttgcaagatgttgagcacgcagcagtcactgttctagacagatggaagatcgcaattaaggacaaacaagggaagcttatggcaccaccaaaatttatgaacaactactttggggttggttgcgatgcaaaggttgccttagatatccataacttgagggaagaaaaccctgagcggttttatagccagtttatgaacaaggtgctttatgcaagagagggagcaaagaacatcatggacaacacgtttgattattttccttgggatgtcaaacttgtgatagacggatccaaaattgatattcctcaggactctgaaggtatccttgttgccaatatccgaagctacatgggaggggttgacctatggaagaatgaggatgatgtctctgacacttacctccctcaatccatgcatgacaagaagctggaagtagttagcttcaccggaatgctgcatctgggaaggctgcaggtagggctttctcgtgcgaaaagattagctcaaggtcatcatataaagattgagatcagtacgacaatgccaatccaagtggatggagagccatggtctcaggagccatgcaccatagaagtttctcatcgtaaccaggccttcatgctgaagagagtttccgaagaacctctcggtcatgctgcttccgtcatggctgacatcctggaaaatgctgagaacagcggcatcatttcggccatgcagaagaggactctgcttcaagagatagcatctaggcttttgtaggacagttctaacactcgcgcttgtagttgtgtagcgctcaccctataacttgttctcttgttttcagctggcagatgcttccttccaggctggaagggaactatgcctggacgtttgtacatacagtcgtggtattttacgcctgatttgggttgtggctgtgtaaaattttgtgtaaaattttgaacgccctattgggttgggcatagttggttagggccctgccagagcattgtgtgtactttgttgcccttggtgaggctagaaaacgtgatatcatttcttggttgttgaaacttgaaagaatgaattttcaacgttgttgatctggattccaattttcattctggcacaaaaaaaaaaaaaaaaaaaa

SEQ ID NO: 958 - protein, 714 aa, Panicum virgatum
  misc_feature: Ceres CLONE 1753240
  misc_feature (1)..(158): Pfam Name: DAGK_acc Pfam Description: Diacylglycerol kinase accessory domain
  misc_feature (1)..(130): Pfam Name: DAGK_cat Pfam Description: Diacylglycerol kinase catalytic domain ( presumed)
  misc_feature (1)..(713): SWISSPROT Homolog: EC 2.7.1.107 Diacylglycerol kinase 1
MLDPRWSAVSAYVSEYWSVIIATAVFACVGAVTIYYVVNQLNKNISLSLVKAIRVRAKQYKKWKDKVPAASHVWRKEVIPRSKGLKCCVCLKSVSPPQYSGATIHQCDICGAAAHPSCSGNAHKDCKCVSMAGLNHVLHQWAVQWIETADHSEEDSFCCYCDESCNGAFLAGSPIWYCMWCQRLVHVDCHSSLAKETGDICDLGPLKRLILSPLCVKELHWTGAGILSSITSGANELASTVRETIMIRRKRYKNGTASADSDSSGAIELPSDAEGDSQEANSAAKRRDDQTNGKLDEVHQNSESEKEKQVVSDNTAATGRSNGQRENSHVQNNQKYEIVNVPSDSRPLLVFVNKRSGAQSGDSLRQRLQILLNPVQVFELSKQQGPEVGLALFRKVTHFRVLVCGGDGTAGWVLDAIEKQKFEAPPPVAILPAGTGNDLARVLCWGGGLGVIEKRGGLFSVLQDVEHAAVTVLDRWKIAIKDKQGKLMAPPKFMNNYFGVGCDAKVALDIHNLREENPERFYSQFMNKVLYAREGAKNIMDNTFDYFPWDVKLVIDGSKIDIPQDSEGILVANIRSYMGGVDLWKNEDDVSDTYLPQSMHDKKLEVVSFTGMLHLGRLQVGLSRAKRLAQGHHIKIEISTTMPIQVDGEPWSQEPCTIEVSHRNQAFMLKRVSEEPLGHAASVMADILENAENSGIISAMQKRTLLQEIASRLL

SEQ ID NO: 959 - DNA, 1700 bp, Panicum virgatum
  misc_feature: Ceres CLONE 1753269
  misc_feature: Encodes the peptide sequence at SEQ ID NO. 960
caccgcagctcgcactcgcactcgcactcgccctcgccctcgccctcgccctcgccctcgccctcgcatttgatccatcgctaataacaatggcgtcgttgctgccggcgttcacggtgcggcggggggagccggtgctggtggcgccggcggagcccacgccgcgggaggtcaagccgctgtcggacatcgacgacggggagggcatgcggttctacagctcggggatccacctgtaccgcagcaacccggccaaggcggggcaggacccggccagggtcatccgggaggcgctcgccagggcgctcgtcccgtactacccgctcgcgggccgcctccgcgaggagcaagggaggaagctcgtcgtcgactgcgccggccagggcgtcatgttcgccgaggccgacgccgacctcaccgccgacgacttcggggacgtgcagagcccgccgttcccgtgcttcgagcgcttcatcctggagagcaccaccatcgccggcgtcgagcccgtcgtcgaccgccctctgctctacatccaggtgacgcggctcaggtgcgggggcttcatcttcggccagcgcttctgccactgcatcgtggacgccccgggcggcatgcagttcgagaaggccatctgcgagctcgcgtgcggcgccggcgcgccgtcggtggcgccggcgtggggcagggagatgttcatggcgcggcggcccccgcggccgtcgtacccgcacctcgagtaccgcgagccggcgggcggacacgacaggatgctgtcgacgcccccggccgacatggcgcgcgtccccttcttcttcgggccccgggagatcgccgggctgcgccagcgcgcgccgccgggcatgcgctgctcccgcttcgagctcgtggccgcctgcatctggcgcagccgcgcggcggcgctcgggtacgcgcccggcgaggaggtgcgcctgtccttcatcgtgaacgcgcgcggccgccccgagatcccgctccccgagggcttctacgggaacgcgttcgcctactccgtggcggcgaccaccgccggggagctctgcggcaaggacctcgggtacgcgctggagctggtgaagaaggccaagtcggcggtgacgtacgactacctgctgtcggtggcggacctgatggtgctccaggggcggccgctgttcgcgctgtcgcggacgtacatcgtgtcggacgtgagccacgccgggttcaagagtgtggacttcgggtggggggaggccgtctacggcgggccggccaagggcggcgaggggccgctcctcggcgtcaccaactacttctcgagggccaagaacggccagggggaggagggcaccgtggtgcccatctgcctgcccaaggacgccatggagaagttccagctcgaggtccaaggactcaccgcggagctctaggcggcgcgcgcgccggttggccggccagtgagtgcatggtcataccagtagccttgacgcaggcacaaccgcacaactagctggtcatatattattattacacggcccgtccggtgtgtgtgtgtgtgtgtatatatatatatatatatatatatatatatatttgtattactatacacaggaaatgtgatatcgatggtggtgtgttcttgtttgttgtgtgagatctattaacttattatttagccaacaaaaaaaaaaaaaaaaaaa

SEQ ID NO: 960 - protein, 446 aa, Panicum virgatum
  misc_feature: Ceres CLONE 1753269
  misc_feature (1)..(437): Pfam Name: Transferase Pfam Description: Transferase family
MASLLPAFTVRRGEPVLVAPAEPTPREVKPLSDIDDGEGMRFYSSGIHLYRSNPAKAGQDPARVIREALARALVPYYPLAGRLREEQGRKLVVDCAGQGVMFAEADADLTADDFGDVQSPPFPCFERFILESTTIAGVEPVVDRPLLYIQVTRLRCGGFIFGQRFCHCIVDAPGGMQFEKAICELACGAGAPSVAPAWGREMFMARRPPRPSYPHLEYREPAGGHDRMLSTPPADMARVPFFFGPREIAGLRQRAPPGMRCSRFELVAACIWRSRAAALGYAPGEEVRLSFIVNARGRPEIPLPEGFYGNAFAYSVAATTAGELCGKDLGYALELVKKAKSAVTYDYLLSVADLMVLQGRPLFALSRTYIVSDVSHAGFKSVDFGWGEAVYGGPAKGGEGPLLGVTNYFSRAKNGQGEEGTVVPICLPKDAMEKFQLEVQGLTAEL

SEQ ID NO: 961 - DNA, 1371 bp, Panicum virgatum
  misc_feature: Ceres CLONE 1753293
  misc_feature: Encodes the peptide sequence at SEQ ID NO. 962
cccaactccaagtcccaacaagagtactccccaccaatggaggcgctcgtggtgcggcggcttggtgaccccacggtggcccccgacgaggagacctctccgttcgccgctgtcttcggggaccacccggtgccggagctctcgtcgccgacggccgtccgggtgcgagtcgcggcgaccagcctcaacttcgccacgttcctccaagtgcagggcaagtaccaggagcggccctcgctgccgttcgtgcccggctccgactacgccggcgtcgtcgacgctgtcgggcccggggtccgagggctacaccccggcgaccgcgtctgctccttcgcaggcctcgggtccttcgccgacttcatcgtcgccgaggagaagcagctatttttagtgcctgatggatgcgatctggtcgctgctggggctttacctgttgcatttggcacatcacatttggcccttgttcacagagctaagctgaaggctggccaggtgctacttgttcttggtgctgctggtggtgtcggggtatctgctgtgcaaataggaaaagtttgtggtgctgtcgttattgctgttgctagggggattgagaaattgcaatatctcaagtccataggagctgatcatgtaattgactcaagcaaggataatgttataggaagtgccaagtccttcttaaaggctagaggcctgacaggtgctgatgttttatatgatcctgttggggggaaacttactcaagatagcctgaagcttctcaattgggctgcgcaaattctggtcattggatttgccagtggtgatgtaccaattattcgagcgaatattgctcttgttaagaactggacaattcatggtctgtactggggaagctacttaactcatcagccatgggtgcttattgactccctcaatgaactcttgttatggctctcaaagggtctgataactgttcaaatttcagaccgctacaggcttgctgaggcccatctcgcttttgctgccctaagagataggaaggcagttggcaaagtcatgattataatgggctcgtcagcaaaatcaaggctctgatatccttccgaaatgcttctgtactagatcatcagacatctattgtgcatctcttatattgtaggacaggactgagactggtagtttccctgcccgaaatgtttgtgtacaatatcgacgaaagcaatcctagaaataaacagtttatctgcagacacatctgatgggaaatacctatatgatgccagtgttgtgggtagtggcaggtaaaccgaatacaatctgaataatcagcatctaggttacagctacagaggaaagtacacattttaccaaaaaaaaaaaaaaaaaaaa

SEQ ID NO: 962 - protein, 346 aa, Panicum virgatum
  misc_feature: Ceres CLONE 1753293
  misc_feature (1)..(82): Pfam Name: ADH_N Pfam Description: Alcohol dehydrogenase GroES-like domain
MEALVVRRLGDPTVAPDEETSPFAAVFGDHPVPELSSPTAVRVRVAATSLNFATFLQVQGKYQERPSLPFVPGSDYAGVVDAVGPGVRGLHPGDRVCSFAGLGSFADFIVAEEKQLFLVPDGCDLVAAGALPVAFGTSHLALVHRAKLKAGQVLLVLGAAGGVGVSAVQIGKVCGAVVIAVARGIEKLQYLKSIGADHVIDSSKDNVIGSAKSFLKARGLTGADVLYDPVGGKLTQDSLKLLNWAAQILVIGFASGDVPIIRANIALVKNWTIHGLYWGSYLTHQPWVLIDSLNELLLWLSKGLITVQISDRYRLAEAHLAFAALRDRKAVGKVMIIMGSSAKSRL

SEQ ID NO: 963 - DNA, 1454 bp, Panicum virgatum
  misc_feature: Ceres CLONE 1753352
  misc_feature: Encodes the peptide sequence at SEQ ID NO. 964
acacctccgatcctcacaaagcaagcaagcaaccactgctccattgccagctagccacacagtcacacacacgcagcctcgaccaagcagtcgctactggtagtgctgagccagcaggcagcaggagctgcagcagcgatggcgagagcgctggtgccggcggccatggcggccgcgacgatggtgctgctgctgctggccgcggcgccggcgccggcggccgcgatcgacttcggcgcggaggacctggcgtcggaggaggcgctgtgggcgctgtacgagcggtggcgcggcgtgcacgcggtggcgcgcgacctgggcgacaaggcccgccgcttcaacgtcttcaaggagaacgtgcgcctcatccacgacttcaaccagcgggacgagccctacaagctccgcctcaaccgcttcggcgacatgaccgccgacgagttccgccgccactacgccggctcccgggtcgcgcaccaccgcatgttccgcggcgaccgggccgccggcgccgggtcgtcgtccttcaggtacgccgccgcgcgcgacctcccggcctccgtcgactggcgccagaagggcgccgtcaccgacgtcaaggaccagggccagtgcgggagctgctgggcgttctcgacgatcgccgccgtggaaggcatcaacgcgatcgtgaccaagaacctgacgtcgctgtcggagcagcagctggtggactgcgacaccaaggccaacgccggctgcaacggcgggctcatggactacgcgttccagtacatcgccaagcacggcggggtcgccgccgaggacgcgtacccgtaccgggcccggcaggccgcgtgcaagaaggccgccggcgccccggccgtgagcatcgacgggtacgaggacgtgccggccaacgacgaggcggcgctgcgcagggcggtggcgcaccagccggtggcggtgggcatcgaggccagcgggtcgcacttccagttctactcggagggcgtgttcgcggggcggtgcgggacggagctggaccacggcgtggcggcggtcgggtacggggtcaccgccgacgggaccaagtactgggtggtcaagaactcgtggggccccgagtggggggagaaggggtacatccgcatggcccgagacgtggccgccaaggaggggctctgcggcatcgccatggaggcgtcctaccccgtcaagacctcgcccaaccccgtcaagccccgcgccgccgcctctgacgaggaccacctccacgacgagctctgaagtctgaatccccgtcctcatctgatcgatcgatctacgatatcgatccatcatcgactgaataattaagcactacttaacttgcattgcctactctatctatctagttatatgcaaggactggatcgtgctgacttgcactatgtatgtaagacttacattattaagactttgagacatctatc

SEQ ID NO: 964 - protein, 376 aa, Panicum virgatum
  misc_feature: Ceres CLONE 1753352
  misc_feature (1)..(218): Pfam Name: Peptidase_C1 Pfam Description: Papain family cysteine protease
MARALVPAAMAAATMVLLLLAAAPAPAAAIDFGAEDLASEEALWALYERWRGVHAVARDLGDKARRFNVFKENVRLIHDFNQRDEPYKLRLNRFGDMTADEFRRHYAGSRVAHHRMFRGDRAAGAGSSSFRYAAARDLPASVDWRQKGAVTDVKDQGQCGSCWAFSTIAAVEGINAIVTKNLTSLSEQQLVDCDTKANAGCNGGLMDYAFQYIAKHGGVAAEDAYPYRARQAACKKAAGAPAVSIDGYEDVPANDEAALRRAVAHQPVAVGIEASGSHFQFYSEGVFAGRCGTELDHGVAAVGYGVTADGTKYWVVKNSWGPEWGEKGYIRMARDVAAKEGLCGIAMEASYPVKTSPNPVKPRAAASDEDHLHDEL

SEQ ID NO: 965 - DNA, 1642 bp, Panicum virgatum
  misc_feature: Ceres CLONE 1753374
  misc_feature: Encodes the peptide sequence at SEQ ID NO. 966
aagagagggaagcgaaacggggcccgtctctccccgcggaccgcatctcaccctcctgctcagtcgcgcgatccagtgaggcggcgcctgccatcgcaattcgcaggtccagctaccaacgggatgggtgaggaggaggaccagcggaagcgcatggtgggttccgagcgagaccaggagctggagccgcggccaggagaggaggaggaggtgaaggaggagggggcgaagaaacccgcgcctggcgaggcggaggccggcgacggcgccgccgcggaggcggcgagctgcgactactgcggcgccgcggcggcggcggtctactgccgcgccgacgccgccaggctctgcctgccgtgcgaccgccacgtgcacggcgccaacggggtctgctcccgccacgcccgcgccccgctctgcgccgactgccgcgccgccggggccgtcctccgccgcgcctcctccgcggccttcctctgctccaactgcgacctcgggaggcaccgggacggcgccggcggcggcgagccggcgctccacgaccgctgcgcggtgcagccttactccgggtgccccccggcgaccgagctcgccgcgctcctcggggtgcccctcttcgacaagccggccgccgaagacggtggttggtggaacatctggaaggagccgcaggtgctcagcttggaggatctgatcgtgcccaccactccctgccatggcttccagcctctcctcacgccatcatctcccaagaatcggagcatctcggcggacgaaaagatgaacgaggagatcctccggcagctgggtgagcttgcagagtcagatggaggggtgcaggcagcagcaggtcacgaggaggcagagcaagctggagatcagttcccttcgtgggcaccggcaccgcagtataccactggacatggcaattttggagcagagaacagccatgaggtcgcgaccatgcctactcctggctatgagaatggcagttggaacaacaatgattatcatgtcctaaatgatgcctgcaaggtcgagctcacatatgatcaggctccggtcagctcatctgaagcatgcttgtcatcatttgttccgatgtcggaaatctgccccaacatgagcaattttagcagtatggaggagaaccaccagactaatcctggccttggcacacctacgcaagctttccccaaaagaaccggctttgatgttgtgccctgccctgatcggggttcggtcatcttgcgctataaggagaagaggaagacaagaagattcgacaggcaggttcggtatgaatcacgcaaagttcgtgctgatggcaggctcaggatcaaggggcgttttgcgaaggcaaaccagacataaaacttaaggagaaaactgattaggagtgaagataatacaaaatgtgccataattttgtttgccttcagttccatagctgatagctcatagcctcatatacagtttgaatgttgtatgtatattgccgtcatgtggatacacttatttgaaaaagagatccagtccctgtaaatagccctacacccacgaattctaagattttgtcatgctggagatatcatgcacacgaaagaatagcatacattgttaaaaaaaaaaaaaaaaaaaa

SEQ ID NO: 966 - protein, 416 aa, Panicum virgatum
  misc_feature: Ceres CLONE 1753374
  misc_feature (3)..(48): Pfam Name: zf-B_box Pfam Description: B-box zinc finger
  misc_feature: The sequence is a functional homolog of  SEQ ID NO 1628 in the  11/479,226 US patent application
  misc_feature: The sequence is a functional homolog of  SEQ ID NO 798 in the  10/412,699 US patent application
  misc_feature: Useful for making plants with modulated growth and phenotype characteristics
MGEEEDQRKRMVGSERDQELEPRPGEEEEVKEEGAKKPAPGEAEAGDGAAAEAASCDYCGAAAAAVYCRADAARLCLPCDRHVHGANGVCSRHARAPLCADCRAAGAVLRRASSAAFLCSNCDLGRHRDGAGGGEPALHDRCAVQPYSGCPPATELAALLGVPLFDKPAAEDGGWWNIWKEPQVLSLEDLIVPTTPCHGFQPLLTPSSPKNRSISADEKMNEEILRQLGELAESDGGVQAAAGHEEAEQAGDQFPSWAPAPQYTTGHGNFGAENSHEVATMPTPGYENGSWNNNDYHVLNDACKVELTYDQAPVSSSEACLSSFVPMSEICPNMSNFSSMEENHQTNPGLGTPTQAFPKRTGFDVVPCPDRGSVILRYKEKRKTRRFDRQVRYESRKVRADGRLRIKGRFAKANQT

SEQ ID NO: 967 - DNA, 2356 bp, Panicum virgatum
  misc_feature: Ceres CLONE 1753389
  misc_feature: Encodes the peptide sequence at SEQ ID NO. 968
aatccacaatccgtcgcgcatcggcccggacattgacagtacatgcacttggtctcgctcctttcctcctcccccttcacgggtcgcggccggccgggccggcagccgccgcagcgccatggcggcctagcagagtttcagatgccgaagaactcgattaaggcagtgagtagtcttgctagagtttggataaggtgaagcaaggcctgggtgtcctctcagatttgcattcgtgcaagtctacatgaccagcatgtctgtcgaggctgcagagcagaatgtgcctggacaccaggtcaaaccaggggctgatccagttcctgcaaaggagaagaagaaagatgtggacggcacgcccgagcttactgctaaggagattttggaggagcaaaagccctcccatcagcggcaagagtcttctgcatctatgatggacaagggtccttccagcgtttgctcagactctggtgtccttgacgagccgctaaccccacaaggcgattctggggagctgaaggatattcagagcttggattgcaatggtaaccgggagaagaatatatcgcagaagagcagcataagcgagagctttgtttcagcaaaagccagcgatgggacaaacagcctgaggaagaccagtggcagtgctaagatcagcgaccgagctgatttcccagagagtgggaagaacagcatgtgccgcccgagtgcaagcagcaacattagtgatgagagctcgtgcagtagcatgagcagcagcatgacaaagccacataaggggagtgattctaggtgggaagccatccgagtgatcagatcaagggatggcattcttggtttgagccattttaggctgctgaagaagctgggttgtggtgatattggcagcgtttacctctctgaactgaatgggacaaagagctactttgccatgaaggtcatggacaaagggtctttggcgagtcgcaagaagcttcttcgagcacagacggagcgggagatactacagtcactggaccatccgtttcttccaacactatatacccactttgagacagataaattctcatgtttggtgatggagttctgccccggaggggacctgcacactcttcgacaaaggcagcctggaaagtattttgctgagcaagcagccaagttctatgtagcggaagttctactcgcactggaatacctgcatatgcttgggattatataccgtgatttgaagccagagaacgtccttgttcgggaagatgggcacatcatgctgtctgattttgacctctcccttcgttgcgatgtaagccctactgttgtcaagtcttccaaccctgggccagatgcactgcagaggaacaaccaagcatactgtgttcagcctgcttgtattgagccgtcctgcatccagccggcatgtgtcgctccaactacttgctttggtccccgatttttctcctccaaatccaagtccaagaaggagaagaaaccaaagccgaagcctgagattgtcaaccaagttagcccactgcctgagctcattgcggagccaactgatgctcgttccatgtcatttgttggcacccatgagtacctggcgccagaaataatcaagggcgaaggtcatggcagtgctgtggactggtggacctttggtatattcctgtatgaactcctatttggtaagacccctttcaagggatcaggaaaccgggctactctcttcaacgttgttggtcagcccctgcgattcccagagtccccaattgtgagtttctctgctagggacctgataagaggattgctggtcaaggacccacagcatcgtcttggctacaagcgagggactactgagattaagcagcacccattctttgagggtgtcaactgggcgctgatacggtgtgcgagccctccagatgtaccaaagcctgttgagctggaacgcccaccgaagccggccccagctaatgataaggcgactccagctgccaatcagaagggcacagataactttctggagtttgaattcttctagcattgttttccttcaggtttttgagcgtgggctcatgcatgcaagctggtgtataaaaggaggaagatcagttcggaggcgtatcctgtgatgaccagtgatgatccgttgtagactgtagctctgttttgagtaggtcttgttctttcttctgttgaactgcttatgatccaatttatacgggtcagtgttgcaatttttgagaatcttgtggtgcttaaaggacgcagggaaatactttcaccctggcattgtaaatcctgttcgatttggcataaattgcaactgaattttcttcaaaaaaaaaaaaaaaaaaaa

SEQ ID NO: 968 - protein, 597 aa, Panicum virgatum
  misc_feature: Ceres CLONE 1753389
  misc_feature (35)..(597): SWISSPROT Homolog: EC 2.7.11.1 Protein kinase G11A
  misc_feature (49)..(597): SWISSPROT Homolog: EC 2.7.11.1 Protein kinase PVPK-1
MTSMSVEAAEQNVPGHQVKPGADPVPAKEKKKDVDGTPELTAKEILEEQKPSHQRQESSASMMDKGPSSVCSDSGVLDEPLTPQGDSGELKDIQSLDCNGNREKNISQKSSISESFVSAKASDGTNSLRKTSGSAKISDRADFPESGKNSMCRPSASSNISDESSCSSMSSSMTKPHKGSDSRWEAIRVIRSRDGILGLSHFRLLKKLGCGDIGSVYLSELNGTKSYFAMKVMDKGSLASRKKLLRAQTEREILQSLDHPFLPTLYTHFETDKFSCLVMEFCPGGDLHTLRQRQPGKYFAEQAAKFYVAEVLLALEYLHMLGIIYRDLKPENVLVREDGHIMLSDFDLSLRCDVSPTVVKSSNPGPDALQRNNQAYCVQPACIEPSCIQPACVAPTTCFGPRFFSSKSKSKKEKKPKPKPEIVNQVSPLPELIAEPTDARSMSFVGTHEYLAPEIIKGEGHGSAVDWWTFGIFLYELLFGKTPFKGSGNRATLFNVVGQPLRFPESPIVSFSARDLIRGLLVKDPQHRLGYKRGTTEIKQHPFFEGVNWALIRCASPPDVPKPVELERPPKPAPANDKATPAANQKGTDNFLEFEFF

SEQ ID NO: 969 - DNA, 1626 bp, Panicum virgatum
  misc_feature: Ceres CLONE 1753581
  misc_feature: Encodes the peptide sequence at SEQ ID NO. 970
acagaacagaagcaagcacacacgccaaagcgaggaaagcagccagcaaagaccagacaccaggggagcaccgaagctgtagctcagcaatcatcatggggatggtggagagcatcagccccacggcggcggaggcctcctccgcttccgccgcctcctcctcgcgctccaccggcgcgtccacggccaccacggagtccggcgccgcgcagcagccgcttgccgcggcgccgggaggcgcggccgccggggaggtctcagtctcgccggcggacgagcaggccgtcacgtcgcagccgtcggcggcggcggcggtggcgcaggggtcatcgcggtacaagggcgtggtgccgcagcccaacgggcgctggggagcgcagatctacgagcgccacgcccgggtgtggctcggcacgttccccgacgaggaggccgccgcgcgcgcctacgacgtcgccgcgctccgctaccgcggccgcgaagccgccaccaacttcccgggggccggggcgtcggcgcccgagctcgccttcctgcttgcgcactccaaggcggagatcgtcgacatgctccggaagcacacctacgccgacgagctccgccagggcctgcgccgcggccgcggcatgggcgcccgcgcgcagcccacgccggcctgggcgcgcgcgctgctcttcgagaaggccgtcacgcctagcgacgtcggcaagctcaaccgcctcgtcgtgcccaagcagcacgccgagaagcacttcccgctgaagcgctcgccggagaccgccaccgggaagggcgtgctcctcaacttcgaggacggcgacggcaaggtgtggcggttccggtactcgtactggaacagcagccagagctacgtgctcaccaagggctggagccgcttcgtccgggagaagggcctccgagccggggacaccatcgtcttctcccactccacatacggcccggagaagcagctcttcatcgactgcaagaagaccaaggcggccgccaccgacgcggccggaccagcggagaagccaaaggaagccgcccgtgtagtcaggctgttcggcgtggacatcgccggagacgggtgccagaagagagcacggccggtggagatggcgttcgagcaaggccaggagttcttgaagaagcaatgcgtggttcatcaccgctctcctgctctaggtgccttcttgttgtagcagcgatcatatgcatcgttttctagttcttcccctttgttcttcctcctcctagtagcctgtttgatatcgaatccgaatctagtgtgtgttcttcgtcttttgcaaataactacttgctatgtcagactgcggcaagacgagttgtatgtacaccattaggaagtcttgtctttgagagggtagtacatagtagtgatcatcctacaagatcatgcaagttcgtgccatcatctagtacagtaaaataagttgattattcgatatgctagatgtagaaggtgtaatttcttccagttttaatttgctcatagatacactcttggcaacatatctagcatggttagcttcgtcgctgtagcagttcgtcatgaataataataatcagttgatgttgttgcaaaaaaaaaaaaaaaaaaaa

SEQ ID NO: 970 - protein, 369 aa, Panicum virgatum
  misc_feature: Ceres CLONE 1753581
  misc_feature (1)..(63): Pfam Name: AP2 Pfam Description: AP2 domain
  misc_feature (1)..(113): Pfam Name: B3 Pfam Description: B3 DNA binding domain
  misc_feature: The sequence is a functional homolog of  SEQ ID NO 1176 in the  10/374,780 US patent application
  misc_feature: The sequence is a functional homolog of  SEQ ID NO 1177 in the  10/374,780 US patent application
  misc_feature: The sequence is a functional homolog of  SEQ ID NO 1372 in the  10/412,699 US patent application
  misc_feature: The sequence is a functional homolog of  SEQ ID NO 1373 in the  10/412,699 US patent application
  misc_feature: The sequence is a functional homolog of  SEQ ID NO 20 in the  10/838,616 US patent application
  misc_feature: The sequence is a functional homolog of  SEQ ID NO 30 in the  10/838,616 US patent application
  misc_feature: The sequence is a functional homolog of  SEQ ID NO 32 in the  10/838,616 US patent application
  misc_feature: The sequence is a functional homolog of  SEQ ID NO 732 in the  11/435,388 US patent application
  misc_feature: The sequence is a functional homolog of  SEQ ID NO 734 in the  11/435,388 US patent application
  misc_feature: Useful for making plants with modulated growth and phenotype characteristics
MGMVESISPTAAEASSASAASSSRSTGASTATTESGAAQQPLAAAPGGAAAGEVSVSPADEQAVTSQPSAAAAVAQGSSRYKGVVPQPNGRWGAQIYERHARVWLGTFPDEEAAARAYDVAALRYRGREAATNFPGAGASAPELAFLLAHSKAEIVDMLRKHTYADELRQGLRRGRGMGARAQPTPAWARALLFEKAVTPSDVGKLNRLVVPKQHAEKHFPLKRSPETATGKGVLLNFEDGDGKVWRFRYSYWNSSQSYVLTKGWSRFVREKGLRAGDTIVFSHSTYGPEKQLFIDCKKTKAAATDAAGPAEKPKEAARVVRLFGVDIAGDGCQKRARPVEMAFEQGQEFLKKQCVVHHRSPALGAFLL

SEQ ID NO: 971 - DNA, 2278 bp, Panicum virgatum
  misc_feature: Ceres CLONE 1753603
  misc_feature: Encodes the peptide sequence at SEQ ID NO. 972
gtgtcctgcactcgctcgcctcttccgtcgggaggggaggtcttggatgctgcccgcatgacacacgggttcaattagagtttacaagtggaagcgtatgggtaccaaggaagcatcccctcctactgtcctctgcctcttctttctgttctgcttaggcggcaaatgcctagcgtcagaattccaagctacccagacagcaaccctcacggttgatgcctcaccgcagcttgctcggaagattcctgacacactatttgggatcttttttgaggagatcaaccatgcaggagctggtggaatatgggctgaactcgttagtaacagaggttttgaagctggaggcccccatactccatcgaacattggcccatggtccatcattggagatgactcttccatatttgtggcgactgatcgtacatcatgtttcagtcgaaacattgttgctctaaggatggaggtcctctgcgataactgtccagctgggggtgttggcatttacaacccaggattctggggcatgaacatagaagatggaaagacatacaacctagttatgtatgctaagtcgccagaaacaacagacttgacagtttcgctaacgagtgctgatgggtcacaaagtctggcttcagctacggtcacagtctctggcacattaaattggacaaaactggagcagaaattggttgccaaaggaaccaatagaacctcaaggcttcaaataacgactaacaagaaaggagttgtctggtttgatcaagtatcactcatgcctgaagacacatacaagggacacggttttcgcacagaacttatatccatgcttttggatttgaaaccacaattcttgagatttcctggaggctgctttgtagaaggtgattggttaaggaatgccttcaggtggagagaatctattggtccatgggaggagagacctggacacttcggggatgtttggcactactggactgatgatggccttggatattatgaatttcttcagcttgcggaggacctgggtgctgccccaatctgggtgttcaacaacggagtcagccacaatgatgaagttgatactgttgctattgctccttttgtaaaggatgtattggacagtctagagtttgcaagggggagtgcaaactcaacatggggctctgttagggcttcaatgggtcaccctgaacccttcccagtgaaatatgttgcaattggaaatgaagactgcgggaaaaagttttaccgtggtaactacctcaagttctacaatgctataagacaggcctatcctgacattcaaatgatctcaaactgtgatggttcatctaaaccacttgatcatcctgctgatttatacgacttccatgtctacactgactcgaagactttgtttaacatgaggagcacatttgacagaacatctcgtagtggacccaaggcttttgtgagtgagtacgctgtttggagaagtgacgcaggtagaggaagtcttcttgcttcgttggcagaagctgctttccttactgggctggagaagaatagtgacattgttcagatggcaagttatgctccactgttcgtgaacgacaatgatcaaacgtggaacccagatgctattgtctttaactcgtggcagcattatggaactccgagttactggatgcaaacccttttccgtgagtccagtggtgccatgattcatccaatcaaaatcagttccaactactctggttctctggcggcatctgcaattacttggcaagattcagagaatagtttcctaagagtaaaggttgtaaactttggatcagatgctggtagccttacaatctccacaagcggacttcaagctagtgttaatgctctgggatcaacagccactgttctcacatccgggaatgtgatggatgaaaattctttcagtaacccaaacaaggttgcgccagttaagagcgagctgagcaatgccgcagagcagatgcaggtcacgctggctcctcactccttcagttcattcgatctcgcgctggctcagtccaaacttattgcggagatgtgaagtggcatgacccatagtaggctggtgacagatacacgagcaatacacactacagatggtgtgatacgcgaataccagcaaccagggagttgctgctgttagcatcttgataaaagctttgtatagtgtaacacgatgcagatacacagtactaaataaaaatcacatcaggttggtttggtgttgactcaaaaaaaaaaaaaaaaaaaa

SEQ ID NO: 972 - protein, 656 aa, Panicum virgatum
  misc_feature: Ceres CLONE 1753603
  misc_feature: Great-hit functional homolog of the protein sequence encoded by LOCUS At3g10740
  misc_feature (1)..(186): Pfam Name: Alpha-L-AF_C Pfam Description: Alpha-L-arabinofuranosidase C-terminus
  misc_feature: Useful for making plants with altered cell wall content and/or composition
MGTKEASPPTVLCLFFLFCLGGKCLASEFQATQTATLTVDASPQLARKIPDTLFGIFFEEINHAGAGGIWAELVSNRGFEAGGPHTPSNIGPWSIIGDDSSIFVATDRTSCFSRNIVALRMEVLCDNCPAGGVGIYNPGFWGMNIEDGKTYNLVMYAKSPETTDLTVSLTSADGSQSLASATVTVSGTLNWTKLEQKLVAKGTNRTSRLQITTNKKGVVWFDQVSLMPEDTYKGHGFRTELISMLLDLKPQFLRFPGGCFVEGDWLRNAFRWRESIGPWEERPGHFGDVWHYWTDDGLGYYEFLQLAEDLGAAPIWVFNNGVSHNDEVDTVAIAPFVKDVLDSLEFARGSANSTWGSVRASMGHPEPFPVKYVAIGNEDCGKKFYRGNYLKFYNAIRQAYPDIQMISNCDGSSKPLDHPADLYDFHVYTDSKTLFNMRSTFDRTSRSGPKAFVSEYAVWRSDAGRGSLLASLAEAAFLTGLEKNSDIVQMASYAPLFVNDNDQTWNPDAIVFNSWQHYGTPSYWMQTLFRESSGAMIHPIKISSNYSGSLAASAITWQDSENSFLRVKVVNFGSDAGSLTISTSGLQASVNALGSTATVLTSGNVMDENSFSNPNKVAPVKSELSNAAEQMQVTLAPHSFSSFDLALAQSKLIAEM

SEQ ID NO: 973 - DNA, 1852 bp, Panicum virgatum
  misc_feature: Ceres CLONE 1753662
  misc_feature: Encodes the peptide sequence at SEQ ID NO. 974
gaagaaaaaggaaggcctccacctcctctctccctctcactccgcagctccccgtccacctgctccctcctcttcttcctcagctagtcgcctcctcggagctgcggagaaaatgggtacctccaccgcggcgtcgctcgcggcggcggcgctgctgctgctggtctccctggccgcggcggcggacatgtcgatcgtgtcctacggcgagcgcagcgaggaggagacgcggcggatgtacgccgagtggatggccacgcacggccgggcctacaacgccatcggcgaggaggagcgccggtaccaggtgttcagggacaacctccgctacatcgacgcccacaacgccgccgccgacgcgggcgtccactccttccgcctcggcctcaaccgcttcgccgacctcaccaacgacgagtaccgcgccacctacctcggcgtcaggcccaaaccgcagagggagaggaagctcagcgccaggtaccaagccgacgacaacgaggagctcccggaatccgtcgactggagggccaagggcgccgtcgcggagatcaaggaccagggcagctgcgggagttgctgggctttctcaacaatagcagctgtggaaggcatcaaccagattgtgacgggcgacctgatctctttatctgagcaggagcttgttgactgcgacacctcatacaacgaggggtgcaatggaggtctgatggactacgcgtttgagttcatcatcaacaacggtggaattgacacggaggaggattacccttacaagggcactgacaaccggtgtgatgtcaacaggaaaaatgcaaaggttgttaccattgacagctatgaagatgtaccggtgaacagcgagaagagtctgcaaaaggccgttgcgaaccagcccgtcagtgttgcaattgaggctagtggcagagcatttcagctctacagctcgggtatcttcaccggaagatgcggaacagcgctagaccacggtgtcacggccgtcggttacggcacagagaacggcaaggactactggatcgtgaagaactcgtgggggtccagctggggcgaggccggctacatccggatggagcgcaacgtgaaggcgtccagcggcaagtgcggtatcgccgtcgagccatcgtaccctctgaagaagggctcgaaccccccgaaccccggcccgacgccgccatcccccaccccgccgcccgccgtctgcgacaactactactcctgcccggacagcaccacctgctgctgcatctacgagtacggcaagtactgcttctcctggggctgctgcccgctggagggcgccacctgctgcgacgatcactacagctgctgcccccatgactaccccatctgcaacgtcaaggagggaacctgcctcatggccaaggacagcccgctgtcagtgaaggctctgaagcgcaccctggccaagccgcactgggctttctctggcaacgcagctgatggcatgaagagcagcgcttgaacaatctccagtaagatatcaggccgccaacagccacggtgatcagagctcctgcaaacgatcacccggtgcttaatcgaccaagacattcgtggtgcggcggccgctgttttaagtgtatctgtataataggtgctcctgtacataagcctgaaaaaatgggtttgtgttgttcacggaactgctgccaaatttgcttttacatactatatatgtaagattcagctagctctgcttagcgccttgccgcgcagttcggccgaactacgattgatgtttatggaaattgatattggaacaataatcaatgattatgctatattcattcaaaaaaaaaaaaaaaaaaaa

SEQ ID NO: 974 - protein, 463 aa, Panicum virgatum
  misc_feature: Ceres CLONE 1753662
  misc_feature (1)..(216): Pfam Name: Peptidase_C1 Pfam Description: Papain family cysteine protease
  misc_feature (8)..(366): SWISSPROT Homolog: EC 3.4.22.14 Actinidain precursor
MGTSTAASLAAAALLLLVSLAAAADMSIVSYGERSEEETRRMYAEWMATHGRAYNAIGEEERRYQVFRDNLRYIDAHNAAADAGVHSFRLGLNRFADLTNDEYRATYLGVRPKPQRERKLSARYQADDNEELPESVDWRAKGAVAEIKDQGSCGSCWAFSTIAAVEGINQIVTGDLISLSEQELVDCDTSYNEGCNGGLMDYAFEFIINNGGIDTEEDYPYKGTDNRCDVNRKNAKVVTIDSYEDVPVNSEKSLQKAVANQPVSVAIEASGRAFQLYSSGIFTGRCGTALDHGVTAVGYGTENGKDYWIVKNSWGSSWGEAGYIRMERNVKASSGKCGIAVEPSYPLKKGSNPPNPGPTPPSPTPPPAVCDNYYSCPDSTTCCCIYEYGKYCFSWGCCPLEGATCCDDHYSCCPHDYPICNVKEGTCLMAKDSPLSVKALKRTLAKPHWAFSGNAADGMKSSA

SEQ ID NO: 975 - DNA, 1783 bp, Panicum virgatum
  misc_feature: Ceres CLONE 1753664
  misc_feature: Encodes the peptide sequence at SEQ ID NO. 976
acacaccccctccctcctcgccatcctcccacctccgctctcccagtctccggccgcgttccaggcttccagcaccagcgctgaagccgctagctagccgttgctcggctcccccgacaccaccaaggctttcccttcgatcgatcgaccagcaactagccggatgacgaagcagggcgtggtggtgccggcgcccgcggaggcggccgtcgcggtgccgcccagctcggcgccgctcctcccgtacccgccgccgcgggccgccatgcgcaagaagtgcctgcagatgggacctggcgtcggcggctgggtcgagtccatgcgcgcctcctcgcccacgcacgccagggccgccgccgcgctcgccgccggcgccgacgaggaccgccgcgccgcctggatggtggagcacccgtcggcgctgagcaagttcgaccaggtggtggcggcgtccaagggcaagcagatcgtcgtcttcctcgactacgacggcacgctctcgcccatcgtcgacgaccccgacgccgcctacatgtccgacacgatgcggcgggcggtgcacagcgtcgccaagcacttccccacggcgatcgtcagcggccggtgccgcgacaaggtgttcgagttcgtgaagctggcggagctctactacgccggcagccacggcatggacatcaagggccccgccaaaggttcccagcacaccagggccgccaagggcgtcctcttccagccggccagccagttcctgcccatgatcgagcaggtgcacgagtctctggtggagaagaccaggagcatccctggagccaaggtggagaacaacaagttctgcgtgtctgtccacttcagatgcgtcgatgagaagagctggagcgcgttggcggagacggtgaagtcggtgctcaaggagtacccgaagctgaagctgacgcaggggcggatggtgttcgaggtgcggcccagcatcaagtgggacaagggcaaggccctcgagttcctgctcgagtcgctgggcttcgccgactgcgccgacgtgctccccgtctacatcggcgacgaccgcaccgacgaggacgccttcaaggtgctccgccgccgcggccagggcgtcggcatcctcgtctccaagcaccccaagaacacctccgcgtcctactcgctgcaggagcccgccgaggtgatggagttcctgctgcggctcgtcgagtgggagcgcctctccaaggcccgccccaagtggtgaccggccggccgccgccgccgccgccgccgattgcgaggagatcgattaccagacggattagcagtatatattatatatatcatatatattatctttacatcttcgatcatcaggggggattaaattagaagggagcgcgtatcctggcgtgtcagcggcgcgccgctcagctccccgcgtgtggtgtcgtacgttaaccctgccgagctcaccgcgccatgtgcgtccgcgacggggggccctcccccttctttttacgggggagggcgccccctggggttgccgggggggggtagaagaaggcctcggaagcttgagctttccggagccccctggcttgctagagacgatgccatctggctgctgcgcagcaaggcaaaaaaaaaaaaaagaaccaaaaaaaaacaagaagaagaagaacgtgttgctgctttagtttgtgtaattagtgctgctattattactgtggccgcctgaattctgattgtgtaaaagatgtatgaaatggagatccagctacgggaatatatatatact

SEQ ID NO: 976 - protein, 360 aa, Panicum virgatum
  misc_feature: Ceres CLONE 1753664
  misc_feature (1)..(235): Pfam Name: Trehalose_PPase Pfam Description: Trehalose-phosphatase
MTKQGVVVPAPAEAAVAVPPSSAPLLPYPPPRAAMRKKCLQMGPGVGGWVESMRASSPTHARAAAALAAGADEDRRAAWMVEHPSALSKFDQVVAASKGKQIVVFLDYDGTLSPIVDDPDAAYMSDTMRRAVHSVAKHFPTAIVSGRCRDKVFEFVKLAELYYAGSHGMDIKGPAKGSQHTRAAKGVLFQPASQFLPMIEQVHESLVEKTRSIPGAKVENNKFCVSVHFRCVDEKSWSALAETVKSVLKEYPKLKLTQGRMVFEVRPSIKWDKGKALEFLLESLGFADCADVLPVYIGDDRTDEDAFKVLRRRGQGVGILVSKHPKNTSASYSLQEPAEVMEFLLRLVEWERLSKARPKW

SEQ ID NO: 977 - DNA, 1878 bp, Panicum virgatum
  misc_feature: Ceres CLONE 1753811
  misc_feature: Encodes the peptide sequence at SEQ ID NO. 978
cactcgcgcacccatcacgcccccaaccacccgcctccctcccgtcccgagccctcagagccaccaccgcagcagctcgagctgcccctgcgtgccccactgtgccctgcatctccgccacaagtcagctcgatcgctcgctccgccggtgttggttgtgctggtggtaggtaggcaggcgcggcggcggccatggcgctggcggggacgggggcgttcgcggagatcctcgacggcggcgaggtgtacaagtactacgccgacggggagtggcgcgcctccggctccagcaagtccgtccccatcgtcaaccccaccacccgcaagacgcagtacagggtgcaagcatgcacccaggaggaggtgaacaaggtgatggaggcggccaaggttgcacagaaggcgtgggcccggacgccgctatggaagcgcgccgagctcctccacaaggccgccgcgatcctgaaggagcacaaggcaccgatcgccgagtgccttgtcaaggagatcgccaagccggccaaggacgctatttctgaggttgtgcggtctggggatttgatatcgtacacagctgaggagggtgtccgcatactgggggagggcaagctgctggtttctgatagcttccccggtaatgagcggaacaagtactgcctgagctccaagataccccttggagtagttttggcaatcccgccatttaactatcctgtcaacctagcagtttctaagattggcccagcactaatagctggcaattctcttgtgctcaagcctccaactcagggtgcagtggctgcacttcatatggtacactgcttccacctggctggtttcccgaaaggcttgattagttgtgtgactgggaagggttctgaaataggtgattttcttacaatgcatcctggagtcaactgcataagttttactggaggtgatactggtatagccatttcaaagaaggctggaatggtccctcttcaaatggagcttggagggaaagatgcttgtatcgtgctagaggatgcagatctcgacttagttgctgcaaatatagtaaagggtggcttctcgtacagtggacagaggtgcactgctgtgaaagtagtgctgatcatggaatcaatagctgatgccgtggtagagaaggttaacgccaagttggcaaaactgaaagttgggccacctgaggacgactctgatatcaccccagttgtaacagaatcctcagccaacttcattgaaggcctggtgatggatgcaaaggagaaaggagcaaccttctgtcaggaatacagaagagagggcaacctcatctggccgttgctgctggatcatgtccgtcctgacatgaggatcgcttgggaagaaccttttggccccgtattgcctgtaatcaggatcaactcagttgaggagggcatccaccattgcaacgccagcaactttggcctgcagggatgtgttttcacaagagatatcaacaaggcaatcctgatcagtgatgcaatggagactggaaccgttcagatcaactctgcaccggctcgtggacctgaccatttccccttccagggtctgaaggacagtggcattggctcccaggggataactaacagcataaacatgatgaccaaggtgaagagcactgtcataaacctgccatcaccatcctacaccatgggctgagatgttcatgtagaggggagttgtatgttttatagccgcaagagcaccatgtagagaattcaaatgttccataggcacgtgaaatttgtatgctatttgcacttcagttctgcgtgtaccagatcttttgcatgaagaataaagtgcgtcaaaagtattttatcctaaaaaaaaaaaaaaaaaaaa

SEQ ID NO: 978 - protein, 499 aa, Panicum virgatum
  misc_feature: Ceres CLONE 1753811
  misc_feature (1)..(469): Pfam Name: Aldedh Pfam Description: Aldehyde dehydrogenase family
  misc_feature (1)..(461): Pfam Name: Aldedh Pfam Description: Aldehyde dehydrogenase family
  misc_feature (1)..(499): SWISSPROT Homolog: EC 1.2.1.9 NADP-dependent glyceraldehyde-3-phosphate dehydrogenase
  misc_feature (3)..(499): SWISSPROT Homolog: EC 1.2.1.9 NADP-dependent glyceraldehyde-3-phosphate dehydrogenase
MALAGTGAFAEILDGGEVYKYYADGEWRASGSSKSVPIVNPTTRKTQYRVQACTQEEVNKVMEAAKVAQKAWARTPLWKRAELLHKAAAILKEHKAPIAECLVKEIAKPAKDAISEVVRSGDLISYTAEEGVRILGEGKLLVSDSFPGNERNKYCLSSKIPLGVVLAIPPFNYPVNLAVSKIGPALIAGNSLVLKPPTQGAVAALHMVHCFHLAGFPKGLISCVTGKGSEIGDFLTMHPGVNCISFTGGDTGIAISKKAGMVPLQMELGGKDACIVLEDADLDLVAANIVKGGFSYSGQRCTAVKVVLIMESIADAVVEKVNAKLAKLKVGPPEDDSDITPVVTESSANFIEGLVMDAKEKGATFCQEYRREGNLIWPLLLDHVRPDMRIAWEEPFGPVLPVIRINSVEEGIHHCNASNFGLQGCVFTRDINKAILISDAMETGTVQINSAPARGPDHFPFQGLKDSGIGSQGITNSINMMTKVKSTVINLPSPSYTMG

SEQ ID NO: 979 - DNA, 1740 bp, Panicum virgatum
  misc_feature: Ceres CLONE 1753926
  misc_feature: Encodes the peptide sequence at SEQ ID NO. 980
gcgcatgtgctccctccactgctcgcccagccggccggctgccccactccgcacagccacttgacggcgtccccatggctgcctcttggcgccacggccatggaagcttctgcctcctcctcctgctgctggttgctgtcgatgccgccgccgctgttggtgctggtgcggcagggagcttctcccatgtccagctgagcgcggagtccctgcaccgtgccgcgggctcgtcttgccccgcaccaaaagaggaacagcatggcgccgccacgggcacgcggatgcctgtcgtgcaccagcacggcccgtgctcgccgctggccggcaagcgcgagaaggcgccgtcccatgcggagatcctcgccgcggaccagcgccgcgtcgagtacatccaccgccgcgtgtccgagaccaccggccgggcgaggccgccgaagcgcggcgcggcaccggcggtctacctccagcccggcgcgccgtcgacggcggcaactccggcgtcggcctcgccgtcctacgcgaagtcggcggcgaacctcccggcgtcgtccgggcgcgcgctgggcacgggcaactacgtggtgaccatcgggctcggaacgccgtcggagcggttcacggtggtgttcgacaccggcagcgacacgacgtgggtgcagtgccagccgtgcgtggcctactgctaccggcagaaggagccgctcttcaggccggccaagtcctccacctacgccaacatctcgtgctcctcgtcctactgcgacgacctcgacgtcagcggctgcgacggcggccactgcctctacggcgtcgagtacggcgacggctcccagaccatcggcttctatgcccaggacaccctcaagctcgcctacgacgtcatcaaggagttccggttcgggtgcggcgagaataaccgcgggctgttcgggcggtcggcggggctgatgggtctcggccgcggcaagacgtccctgacggtgcaggcgtacggcaagtacggcggcgtgttcgcgtactgcctcccggcgacgccgtcggggacgacggggttcctggacctgggcccgggcgcgccggcggcgaacgcgcggctgacgccgatgctgaccgacaacgggccgacgttctactacgtggcgctgacgggcatcaaggtgggcgggcacctgcttcccatcccagagtccgtcttctccggcgccggcgcgctcgtggactccggcacggtgatcacgcgcctgccgccctcggcgtacgagccgctgcggtcggcgttcgccggggccatggacgcgctggggtacaggaaggcccccgcgctctcgatcctggacacctgctacgacctgacggggcagcaggggccgagcgtcgcgctgccggcggtgtcgctggtgttcaggggcggcgcgtgcctggacgtggacgcgtcggggatcctctacgtcgccgacgcgtcgcaggcgtgcctggcgttcgccgccaacgacgccgacgacgacgtcgccatcgtcgggaacacgcagcagaagacgtacggcgtgctctacgacctcgccaggaaggtcgtcggcttcgcccccggagcttgctaatccgccggctcgccggcacggtggagctgcacgcgcgtgattcctgaataaccaaccaattaatcgcctgaatccgctaagcggtcggtgatcagcgttgaagatcgaagattaccatgtccaaaaaaaaaaaaaaaaaaaa

SEQ ID NO: 980 - protein, 507 aa, Panicum virgatum
  misc_feature: Ceres CLONE 1753926
  misc_feature (1)..(336): Pfam Name: Asp Pfam Description: Eukaryotic aspartyl protease
MAASWRHGHGSFCLLLLLLVAVDAAAAVGAGAAGSFSHVQLSAESLHRAAGSSCPAPKEEQHGAATGTRMPVVHQHGPCSPLAGKREKAPSHAEILAADQRRVEYIHRRVSETTGRARPPKRGAAPAVYLQPGAPSTAATPASASPSYAKSAANLPASSGRALGTGNYVVTIGLGTPSERFTVVFDTGSDTTWVQCQPCVAYCYRQKEPLFRPAKSSTYANISCSSSYCDDLDVSGCDGGHCLYGVEYGDGSQTIGFYAQDTLKLAYDVIKEFRFGCGENNRGLFGRSAGLMGLGRGKTSLTVQAYGKYGGVFAYCLPATPSGTTGFLDLGPGAPAANARLTPMLTDNGPTFYYVALTGIKVGGHLLPIPESVFSGAGALVDSGTVITRLPPSAYEPLRSAFAGAMDALGYRKAPALSILDTCYDLTGQQGPSVALPAVSLVFRGGACLDVDASGILYVADASQACLAFAANDADDDVAIVGNTQQKTYGVLYDLARKVVGFAPGAC

SEQ ID NO: 981 - DNA, 1432 bp, Panicum virgatum
  misc_feature: Ceres CLONE 1754166
  misc_feature: Encodes the peptide sequence at SEQ ID NO. 982
gtgtcctcgtccccgctccagcctgccttggttggccgccccgctcgctaatcccaccggtcattgggcggttactggctgattaagttggcggcgaggtcggggggcgcgatggcgtcggagccggtggcgcgggcggtggcggaggaggtggtgcggtgggggagcatgaagccgacgggggtcagcctgcgctacatgatggagttcggctcgagccccacccagcgcaacctgctcctctccgcgcagttcctgcacaaggagctccccatccgcatcgcgcgccgcgcgctcgagctcgactcgctgcccttcgggctctccaacaagcccgccatcctcaaggtgagggattggtacttggactcgttccgcgacatcagatacttccctgaagtgaggaatcagagcgacgagcttgcttttacacagatgattaaaatggtcaaggtgcggcacaataatgtggttccaacaatggctttgggagtgcagcagctgaaaaaccaactgtgccgcacaaggaaggttccctctggattcgacgagatccacgagttccttgatcgattctacttgtcaaggatcggcatccgcatgctgatagggcagcatgtggctttgcatgatcctgaaccagagcctggtgtcataggcctcattaatacaagattgtcccccatacaggtggctcaagctgctagcgaagatgcccgtgctatttgtttaaggacatatggatcagctcctgatattaacatttatggtgatccgacttttacatttccatatgtcgcatcacacctctatctgatgttatttgaattggtgaagaactcgcttcgtgcagtgcaagaacgatatatgaattctgataaagatgtccccccagttagaattatagttgctgatggagaagaggatgttactatcaaggttagtgatgaggggggtgggataccaagaagtggcctcccaaaaattttcacacatctgtatagcactgcaaagaatccacctgatctagatggacctaatgaaggagcaactatggccggatatggtttcgggatcccaatcagccgcctttatgctcggtattttggtggcgacttgcaaattatttctatggaaggatatggtaccgatgcttacctccacttgtcacgtctgggagattcagaggagcccctgccttgatgacttgatttgatgtgctgacacgaccctcttcctgtaattagtctgcccttcttgtaatagaatccagtgctggtctgcaaatattggcctaatgggccagccacctatagctatagttggttgctactccgtatcttctagctctgctgcattgcgagcacaagcactcctacttcctctgatccctcttccaggtttcagaaaaatagtatgattataatctctc

SEQ ID NO: 982 - protein, 363 aa, Panicum virgatum
  misc_feature: Ceres CLONE 1754166
  misc_feature (1)..(128): Pfam Name: HATPase_c Pfam Description: Histidine kinase-, DNA gyrase B-, and HSP90-like ATPase
MASEPVARAVAEEVVRWGSMKPTGVSLRYMMEFGSSPTQRNLLLSAQFLHKELPIRIARRALELDSLPFGLSNKPAILKVRDWYLDSFRDIRYFPEVRNQSDELAFTQMIKMVKVRHNNVVPTMALGVQQLKNQLCRTRKVPSGFDEIHEFLDRFYLSRIGIRMLIGQHVALHDPEPEPGVIGLINTRLSPIQVAQAASEDARAICLRTYGSAPDINIYGDPTFTFPYVASHLYLMLFELVKNSLRAVQERYMNSDKDVPPVRIIVADGEEDVTIKVSDEGGGIPRSGLPKIFTHLYSTAKNPPDLDGPNEGATMAGYGFGIPISRLYARYFGGDLQIISMEGYGTDAYLHLSRLGDSEEPLP

SEQ ID NO: 983 - DNA, 1931 bp, Panicum virgatum
  misc_feature: Ceres CLONE 1754222
  misc_feature: Encodes the peptide sequence at SEQ ID NO. 984
agcacctcgctccgctctcaccatatgttctgcatgtgaagagagaaataagagggtgagagcaagaaacatagactgctagctagagtgacaagacacaagctaaacgagagaccttcttgtcactctcgcacggagattattgtcaacacgaaccagcattatatttagttcgtcgatctttaaagattcgcgagagcgaaggcgcagcagcaagcaatggctcgcgtagtctcgctggtgttgttactggccacgctcgcgagcatcctgccgccgtccgcgagccaggcggcggcgaccaggtgcgagtacccgaggcacgccgggcacgggtacaagcacccggtgggcgtgcggaaggtggtcgtggacgccggcggcgccggcgacttcacctccatccagcaggccgtcgactccgtgccggtgaacaacaccgtgcgcgtcatcatgcagatcaacgccggcacctacagggagaaggtgctggtgccggcgtcgaagccgtacatcacgttccagggcgccgggcgcggcgtgacggtggtggagtggcacgaccgggccagcgaccgcggccccgacgggcagccgctccgcacctacaacaccgcctccgtaaccgtcctctcttactatttcaccgctaagaacatcagcttcaaggtgagcgccccgttcggtttgcccggtggtccatgaatgatgagagcgtcgccgtcgtacgcgaggtcacaagacgcacagggatgcgtggcctggtgcatcatatcatgcagcctcgcagggacagcacggtgcaggagcaggcaaagtgacaacgcttcagatcagtcacaagtctgaccttgcaaacgctgccgtctccgtgaacccttgctatcatgcctcttttgttcctttcgaaattttgaattcgtgtgttttcaccacaagatgttagagttcttgtatttgctggagttctgcttggagcaggctgcacgcaggtcatgagaggatggcttcagcttcgatcggctgcaataataatctgcctggacgagaccaacacaattttgcgttggtagattattccttcctgttaactagctagttacatgcatgccactaactgggtccgtgttgcgttcttcgtttttgtcatggcagaacacagctccggcaccaatgcccggcacgcaggggggccaggcggtggcgttccgcatctccggcgacaaggccttcttcttcgggtgcgggttccacggcgcgcaggacacgctgtgcgacgacgccggccggcactacttccgcgactgctacatcgagggctccatcgacttcgtcttcggcgacgcccgctccctctacaaggactgcgagctgcgctccacggcggagcgctacggctcggtggcggcgcacggccggcgcgacccctgcgagcgcaccggcttcgccttcgtcaactgccgggtcaccggcaccggcaggctctacgtcggccgcgccatgggccagtattcgcgcatcgtctacgcctacacctacttcgacagcgtcatcgcgcccggcggatgggacgactgggaccacaccagcaacaagagcatgacggcgttcttcgggatgtacaggaactgggggcccggcgtcgacgccgtgcacggcgtgccgtgggcgcgggagctcgactacttcgccgcccgccccttcctcggcaagagcttcgtcaacggataccactggctcacgcctgacgtctgaacagacgcccgccccttcctcggcaagagccgccacagatctgtctgtctgatacaacaaaccagatttattcattcgtacagcacaaacacagaatatatattgtacaacaccattttttttgcaagctacttcatatatatagagagaaaagctaaaaaaaaaaaaaaaaaaaa

SEQ ID NO: 984 - protein, 215 aa, Panicum virgatum
  misc_feature: Ceres CLONE 1754222
  misc_feature: Great-hit functional homolog of the protein sequence encoded by LOCUS At5g47500
  misc_feature (100)..(293): Pfam Name: Pectinesterase Pfam Description: Pectinesterase
  misc_feature: Useful for making plants with altered cell wall content and/or composition
MPLTGSVLRSSFLSWQNTAPAPMPGTQGGQAVAFRISGDKAFFFGCGFHGAQDTLCDDAGRHYFRDCYIEGSIDFVFGDARSLYKDCELRSTAERYGSVAAHGRRDPCERTGFAFVNCRVTGTGRLYVGRAMGQYSRIVYAYTYFDSVIAPGGWDDWDHTSNKSMTAFFGMYRNWGPGVDAVHGVPWARELDYFAARPFLGKSFVNGYHWLTPDV

SEQ ID NO: 985 - DNA, 1642 bp, Panicum virgatum
  misc_feature: Ceres CLONE 1754266
  misc_feature: Encodes the peptide sequence at SEQ ID NO. 986
ctcgttcccctccccacccacactctctctctctctccctcccgcatgtcaacggccctccccgcggactccgtccccgcccccagttcccgggcttagttacgagccgccctcggctccggatcggcgcggcccgccgctctcgtcatggcatttccgtcgcgggtggctctgctcgtcgcgggggtgttggtgatgctggggctctccgcggcggcggcggaagggcgagggagcgtgtgcttccgccgggtgttcagcttcggggactcgctcactgacaccggcaacttcctgctctccgtgccagaggacttcccggaccccgcgcggaacctcccctacggccagaccttcttcggtcgcccatccggacgctactccgacggccgcaacctgctcgacttcttcgcggaagcatttgggcttccattcgtgccgccgtaccttggcggtggggacttccaatatggtgcaaactttgcggtcggcggggctactgccctcaaaggttcgttcttccgggaacgtggtgtggagcctacatggacgccacactgccttgatgagcagatgcagtggttcaagaagcttctcccatcaattgcgccatcagagacagaacaaagtgatataatgtccaattcgcttttctttgtgggagaggtcggcggaaatgattacaaccatctaattgtgaggggcaaatctcttgatgagctacatgagcttgttcctaatgttgttggtgccataagctcagccatcacggagcttataagtcttggagcaaagaaattagttgttccagggaactttccaatagggtgtgtcccattatatcttgcgatcttcccaagccaaaaggaggattactatgatgaacaaacaggctgcattaagtggctcaatgaatttgccgagtaccataataggatgcttcaggaggagttggagaggctcaggaatcttcaccctgatgtgaccatcatttatgctgattattatggtgcttcattgaacatattccgcgccccactccagtttggcttcacagtcccactgaacgcatgctgtggaagtgatgctccttataattgttccccatctatattgtgtggacgtcctggatctacagtgtgctctgacccttcaaagtacatctcatgggatggtctacacttcaccgaggcgagttacaaagttgtcattcaaggagtattagggggttatgccattcctcctctttcagaaacttgcaagggtggagaattcaaagtctcccaacttcaccaatgtacagataatccaacaaacactgtaacatacaatgccttgagctcttttatttgatctgctgagctcaagtgcatttagagttctggtaaagaaagaagatgggcatttagagttataatgagcagtatagatgttgcaggtccctgcatcctggacacttcccaaagctgagaagaagtcctgtgatccggaatgtagtacgtcgattcatgttgctgctgtaagaagggtaaaaagaaaggagattttgtagtgcagaacttcacaatcgttgactgcattgctttgctctactacctttttttagcagcttactgtgacagaaaaaaaaaaaaaaaaaaaa

SEQ ID NO: 986 - protein, 401 aa, Panicum virgatum
  misc_feature: Ceres CLONE 1754266
  misc_feature (1)..(322): Pfam Name: Lipase_GDSL Pfam Description: GDSL-like Lipase/Acylhydrolase
MAFPSRVALLVAGVLVMLGLSAAAAEGRGSVCFRRVFSFGDSLTDTGNFLLSVPEDFPDPARNLPYGQTFFGRPSGRYSDGRNLLDFFAEAFGLPFVPPYLGGGDFQYGANFAVGGATALKGSFFRERGVEPTWTPHCLDEQMQWFKKLLPSIAPSETEQSDIMSNSLFFVGEVGGNDYNHLIVRGKSLDELHELVPNVVGAISSAITELISLGAKKLVVPGNFPIGCVPLYLAIFPSQKEDYYDEQTGCIKWLNEFAEYHNRMLQEELERLRNLHPDVTIIYADYYGASLNIFRAPLQFGFTVPLNACCGSDAPYNCSPSILCGRPGSTVCSDPSKYISWDGLHFTEASYKVVIQGVLGGYAIPPLSETCKGGEFKVSQLHQCTDNPTNTVTYNALSSFI

SEQ ID NO: 987 - DNA, 1395 bp, Panicum virgatum
  misc_feature: Ceres CLONE 1754411
  misc_feature: Encodes the peptide sequence at SEQ ID NO. 988
acgcctcccaacccctctctcctcctctgctcccaagatctcctcatctcccggcccggcagcagcgcgcgggggggcagagagatcgagatccggaggaggcgcggcaccagcaatggcgggcacggtgacggtcccgggggcgaacgtcccctccaccccgctgctcaaggacgagctcgacatcgtgatcccgacgatccgcaacctcgacttcctgaagatgtggcggcccttcttccagccgtaccacctcatcatcgtgcaggacggcgatccgaccaagaccatcaaggtgccggagagcttcgactacgagctctacaaccgcaacgacatcaaccgcatcctcggccccaaggcctcctgcatctccttcaaggactccgcctgccgctgcttcggctacatggtctccaaaaagaagtacatctacaccatcgacgacgactgcttcgttgccaaggatccatctggcaaggacatcaatgctcttgagcagcacatcaagaacctcctcagcccatccaccccgttcttcttcaacacgctgtatgacccctaccgcgatgatgctgactttgtgcgtgggtaccccttcagcctcagggagggcgcccacactgctgtctcccacggcctgtggctgaacatccctgactatgatgctcccacacaactggtcaagcctaaggagaggaatgaaaggtatgttgatgctgtcatgacaatccccaagggaaccttgttccccatgtgcggcatgaaccttgccttcgacagggatctcattggccctgctatgtactttggtctcatgggtgatggccagcctattggtcgctatgacgacatgtgggctgggtggtgtgtgaaggtcatctgcgaccacttgagcctgggtgtcaagactggcctgccatacatctggcacagcaaggctagcaaccccttcgttaacttgaagaaggaatacaagggcatcttctggcaggaggacatcatccccttcttccagaacgtgaccatccccaaggagtgcgacacggtccagaagtgctacatctacctttctgggcaggtgaaggagaagctgggcaagatcgacccctacttcgtcaagcttgccgacgccatggtcacctggatcgaggcctgggatgagctgaacccaaccgccgccgccgctgcgaacggcaaggccaagtagagggagtccctggtcttcacttccccttcgaagtgatgaaagtatgattggggcctgcctaggccccatagatatagctctttttgagagggaagagagattaattcagcagcagcttttataattctttgttgttatgataccgtggttcttttgtagttgacgaaaaaaaaaaaaaaaaaaaa

SEQ ID NO: 988 - protein, 364 aa, Panicum virgatum
  misc_feature: Ceres CLONE 1754411
  misc_feature (1)..(364): SWISSPROT Homolog: EC 2.4.1.112 Alpha-1,4-glucan-protein synthase [UDP-forming]
  misc_feature (9)..(359): SWISSPROT Homolog: EC 2.4.1.112 Alpha-1,4-glucan-protein synthase [UDP-forming] 2
MAGTVTVPGANVPSTPLLKDELDIVIPTIRNLDFLKMWRPFFQPYHLIIVQDGDPTKTIKVPESFDYELYNRNDINRILGPKASCISFKDSACRCFGYMVSKKKYIYTIDDDCFVAKDPSGKDINALEQHIKNLLSPSTPFFFNTLYDPYRDDADFVRGYPFSLREGAHTAVSHGLWLNIPDYDAPTQLVKPKERNERYVDAVMTIPKGTLFPMCGMNLAFDRDLIGPAMYFGLMGDGQPIGRYDDMWAGWCVKVICDHLSLGVKTGLPYIWHSKASNPFVNLKKEYKGIFWQEDIIPFFQNVTIPKECDTVQKCYIYLSGQVKEKLGKIDPYFVKLADAMVTWIEAWDELNPTAAAAANGKAK

SEQ ID NO: 989 - DNA, 2543 bp, Panicum virgatum
  misc_feature: Ceres CLONE 1754466
  misc_feature: Encodes the peptide sequence at SEQ ID NO. 990
atcactcgccccacctcgtcgtcctccgccgccgccgccgccgacgatgccgcggaaggcctcgtcgagatcagattcgcgcttcaaatggcgcaagcggaagcgcaaccccaacgcgtccccgtccaggccctccacctccgcggcggcggccgaccactccgacgagtccgactccgccgctgcgaacgacgacgatgatgccgccgcccacgccgccgcggggggcggggccgacgacgacgaggacgccgcggcgtccgaggaccccgtgctcgacctccgcgaggcggaggtcctgccctcggccgaggtcatctccgccttccccgccgccaagcgccgcgtggtcaaccggccgcacccgtccgtcgtcgccctgatcgcggcggaacgatcttcttatcccggcgacacctctgctgcagcgccgccgccggcgctagagaacatttcgcacgggcagctgcaggtgctctctggggtacttccggaccacccctcccttgccacagaccctgacaaaccgtccttgtatgtgtgcacaccgcctcccctcatggaggggcggggtgtgcccaaacagttccatggtcgcctccatgtcgtgccaaagcactcagattggttctccccggggacagtgcataggctggaaagacaggtggttccacacttctttacagggaagtctccagggcacaccccggagaagtacgtcatgctaaggaataaagttattgccaaatacttagagaacccgggcaagaggcttgcttttgctgagtgccaggggcttgttgggagcacaggcgaactttatgatctgagtaggattgttaggttcttggacacttgggggatcattaattaccttgcggctggatcagtgcactgcggcctgaggatggcagcatctcttctaagggaggaaccatcaggggaattgcaattgcttacagcgccattgaaatcaatcgatggtctggttttgtttgaccggccaaaatgtagcatccaagtggaggacatttcttcgatggcatcatcttcttcgaattcggtggtggattttgatgctgcatttgcagaattggatgggaagattagggagtgtttgtctgaaagctcttgcagttactgcttacagcctttgccaagtttgcactaccgatcgcagaaggaggcagatattgctctgtgctctgattgcttccatgacgcgagatatattactgggcattctagcttagatttccagaaagtggatggggataatgatggattggaaaatgatagtgataaatggactcatgaagaaacattgttgctgttggagggcattgaaaagtacaatgacaactgggatgacattgcagggcatgttggaacaaaatcaaaggcacaatgtatttaccattttattcggcttccagtggaagatggtttgctagagaatgttaaggtaccaaatggatctgtaccacaaagcaatggttatccacattcagattccaatggcagcacttcagggataccagttcaaagctttcgacatggaaacgagcttccgttcattaattcttctaatccggtcatgtcactggttgcatttttggcctctgcaataggaccaagagttgcagcatcatgcgcgcatgcagcactgtccttttttactagagatgatgatcccaggctcagttcagaaggaatgcatgctgatggcaggggcaatggtgcaaatcctaattttcccaaccataacggtgcttcaccagctgtttctccagaaaatgtgaaacatgccgccgtgtatggtctatcagcagcagcaatgaagtctaaactctttgcagaccaagaggaacgtgaagtccaaagactagcagctactgtaataaatcatcagttaaagaggttggagttgaaattgaagcagtttgccgaagttgagactttgctcttgaaggaatgtgagcaagtggagagggtgagacagcggatttcagctgatcgtgcccggatgaggtcggccctgttaggttccactggaatgcctggaagcagtagcaccatgccatccaatccagcaagcattagccccagaccagtgggtgtgccaggctccatgcctcagaccagcatgccagccgtatatgccaataacatgcagggacatggtcatccccagatgcctcagatgccgttcatgcatcagcagccgcagatgctttcgttcggccctcgccttccactctcagcaatccagactcaaccatcgccgcaggcatcaaacatcatgttcaactctgggatgcccagttcggttgctcctaaccaccatcagttgctgagatcatcttctggaaacaattttagtgcaggataggggaatacttcataagaatttttactcagcttagttttgtcagatgtagcattatatgatttataaacacatcattgtaatccattcagacggtgtcctgtgttggtcatacaatatattaagtcctagtcaaaaaaaaaaaaaaaaaaaa

SEQ ID NO: 990 - protein, 781 aa, Panicum virgatum
  misc_feature: Ceres CLONE 1754466
  misc_feature (2)..(46): Pfam Name: Myb_DNA-binding Pfam Description: Myb-like DNA-binding domain
MPRKASSRSDSRFKWRKRKRNPNASPSRPSTSAAAADHSDESDSAAANDDDDAAAHAAAGGGADDDEDAAASEDPVLDLREAEVLPSAEVISAFPAAKRRVVNRPHPSVVALIAAERSSYPGDTSAAAPPPALENISHGQLQVLSGVLPDHPSLATDPDKPSLYVCTPPPLMEGRGVPKQFHGRLHVVPKHSDWFSPGTVHRLERQVVPHFFTGKSPGHTPEKYVMLRNKVIAKYLENPGKRLAFAECQGLVGSTGELYDLSRIVRFLDTWGIINYLAAGSVHCGLRMAASLLREEPSGELQLLTAPLKSIDGLVLFDRPKCSIQVEDISSMASSSSNSVVDFDAAFAELDGKIRECLSESSCSYCLQPLPSLHYRSQKEADIALCSDCFHDARYITGHSSLDFQKVDGDNDGLENDSDKWTHEETLLLLEGIEKYNDNWDDIAGHVGTKSKAQCIYHFIRLPVEDGLLENVKVPNGSVPQSNGYPHSDSNGSTSGIPVQSFRHGNELPFINSSNPVMSLVAFLASAIGPRVAASCAHAALSFFTRDDDPRLSSEGMHADGRGNGANPNFPNHNGASPAVSPENVKHAAVYGLSAAAMKSKLFADQEEREVQRLAATVINHQLKRLELKLKQFAEVETLLLKECEQVERVRQRISADRARMRSALLGSTGMPGSSSTMPSNPASISPRPVGVPGSMPQTSMPAVYANNMQGHGHPQMPQMPFMHQQPQMLSFGPRLPLSAIQTQPSPQASNIMFNSGMPSSVAPNHHQLLRSSSGNNFSAG

SEQ ID NO: 991 - DNA, 1870 bp, Panicum virgatum
  misc_feature: Ceres CLONE 1754483
  misc_feature: Encodes the peptide sequence at SEQ ID NO. 992
attcgaccccacgcggcgactccaccccgtcctcatggcgaccgcctgccgcgcgtcgcgcctccccttcgccgccgcaaccttccttcttgtgctacttctcgcgggcggcggcgcggcggacgacgcctccagcgacgacgacgcggggaccccgcggacgcccggctgctccaacaagttccagctggttaaggtgaaaaattgggtgaatgggactgaaggtgcaactgttgttggcttaagtgcaagatttggagcccgcttgcctagagatatgcaagaagctcaaaaatcatttgctatcctcgcaaatccatttgcctgttgctccaacttgacatcaaagttaacaaattctgttgctttagcaacacgtggggagtgtgctttcactgctaaagcaaagactgctcaggcaggtggtgcagttggtttactagttatcaatgacgatgaagagctttacaagatggtttgcagcgagaatgacacttctattaacgtgacaatacctgttgtcatgataccacagtcagcagggaagaagttgaaggacttcctagatcatggagcaagtgtggaagttcagttatattcaccaaatcgaccaattgtggacctttcagcatgcttcctgtggataatggctttaggaaccatagtctgtgcttcactctggtctgaacttgttgcatgcgagcaggttgatgagcgttataatcagctgacccgaaaggatggaccaaacacaggaacaaactatagagaagataaagagatctttgagatcagcgccaggggtgctattgtttttattataatagcttcagttttcctcctcctgttctacttcatgtcatcttggttcgtttgggtcctagttgtattattctgcattggtggtattgagggtatgcatgtttgcttggtcacacttctagctaggattttcaaggattgtgggcaaaagactgtacaacttccctttcttggggaggtcttaaccatatctgttggaattgtaccattttgtgtggtgtttgcaattctctgggctgtgtatcggcatgcttcatttgcttggataggccaagatatcctcggtatatgtttgatgataactgtacttcagatggcacgcttaccaaatatcagggttgcatcagcacttcttagtgctgcatttgtgtacgacattttttgggttttcatttcacctcttttattccatgaaagcgtcatgattgcagttgcccgtggtgataacacaggggaatcaattccgatgctcctaaggatacctcgcttctttgatccatggggtggttacgatatgataggctttggtgatattatttttcctggattgcttgttgcattcagctatagatttgacagggtaagcaaaaagggtatcttaaatggatactttctgtggctgactgtgggatatgctgttggccttttccttacctatcttgcgcttttcctaatggacgggcacggccaacctgcgttgctgtacctggttccatgtacattagggcttattgttatccttggttgggtaagaggtgacctacatgacttgtggaactacggaaaaggtcgaactgaaaacgtggtcgatgaaccttgagaagtgaaattctgactaatgataccggattgcttgtgacttccattattcaatcgacagatcttctggggcagtatcagagatgcatagaattaccttaattgaaaagtttttacgtgtcttttcttctttgttataatagcgtagtgctcatgtattattacgggtaatataatagatttatataatattaacaacaaagtaataccatcaagtttgtgctcgttc

SEQ ID NO: 992 - protein, 535 aa, Panicum virgatum
  misc_feature: Ceres CLONE 1754483
  misc_feature (1)..(282): Pfam Name: Peptidase_A22B Pfam Description: Signal peptide peptidase
MATACRASRLPFAAATFLLVLLLAGGGAADDASSDDDAGTPRTPGCSNKFQLVKVKNWVNGTEGATVVGLSARFGARLPRDMQEAQKSFAILANPFACCSNLTSKLTNSVALATRGECAFTAKAKTAQAGGAVGLLVINDDEELYKMVCSENDTSINVTIPVVMIPQSAGKKLKDFLDHGASVEVQLYSPNRPIVDLSACFLWIMALGTIVCASLWSELVACEQVDERYNQLTRKDGPNTGTNYREDKEIFEISARGAIVFIIIASVFLLLFYFMSSWFVWVLVVLFCIGGIEGMHVCLVTLLARIFKDCGQKTVQLPFLGEVLTISVGIVPFCVVFAILWAVYRHASFAWIGQDILGICLMITVLQMARLPNIRVASALLSAAFVYDIFWVFISPLLFHESVMIAVARGDNTGESIPMLLRIPRFFDPWGGYDMIGFGDIIFPGLLVAFSYRFDRVSKKGILNGYFLWLTVGYAVGLFLTYLALFLMDGHGQPALLYLVPCTLGLIVILGWVRGDLHDLWNYGKGRTENVVDEP

SEQ ID NO: 993 - DNA, 1732 bp, Panicum virgatum
  misc_feature: Ceres CLONE 1754564
  misc_feature: Encodes the peptide sequence at SEQ ID NO. 994
cccgttggggttttccgccccgacgaaaccctaataaccggcggggggcgatcgccggcggcatgcaccagcagcggatcaagcaggcggcggcggcggccgccgtggcggcgcagcagcagcagcagctgatgcagcaggcgctgctcctgcagcagcagcagcaggcgcagccgcccttgttcccggggcaccacccgcaccccggcctcctcgacgcgccgcagatagaacccatagttagcggaaaccttcctcctgggtttgattcaagtacatgccgcagcgtgtatgttggcaatatccatcttcaagtgacggacacgttactgcaggaagtcttccaaagtattggtccagtagaaggttgcaagctcatcagaaaagaaaagtcatcttttggtttcatcgactactatgaccgccgatctgctgcactagcaattttatctctcaacggcaaacaactgtatggtcagccaataaaagtcaattgggcatatacaagtactcagagggaggacacatcaggccattttaatatttttgttggggatctttgcccagaaatcactgatgctgctctatttgcctttttctctggatactctacctgctcagatgctagggttatgtgggaccagaaaacaggacgatccagagggttcggttttgtttctttcaggaatcagcaggatgctcaaaatgcaataaatgacttaaatgggaagtggcttggcaaccgtcaaattcgttgcaattgggcgacaaaaggtgctaatgctggtgaagagaaacaaagtgtggacaccaaggtggaccagacaaatggttcatcagaagctggaaaggagaatttaaatgaagatggtcctgaaaataacccactttttaccactgtttatgttggtggtcttcctcatgaggccaccaacaatgatgtgcacctgttttttcattcacttggggttggctcaattgaggaggtccgtgtaacacgtgacaaaggctttggctttgtgaggtacagcacccatgaggaagctgcattggcaattcagatgggcaatggccaactgattggcgggagacccataaggtgctcctggggaaacaaaccaactccaccggggacagcatcttcgccgctcccccctcctgcaccatctgcattccccaccggcgtgtcggcaactgacttcctggcctaccagcgcctggccctgagcaagattgccgcgaacccagccttaatgggccagcacgccctgaagcaggctgcgctggggatggacgctggggccagccaggctatctacaatggcggcttcccaggtgtcaatgctgctgccactgccgctgcccagcagcagcagcagcagcagcagctcatgtacttctagagtgacgactggcgcatgataagccagctacctgtctctgcaagaggaaggcgaggatgatccccagttacagccccccatatacatatactagagtatcatagtagatgacgccttaccaggatctttttttatttacctaatcttttgttacaccatctaagtaacttgccctgtatgtcagctatatatattttcaccaccgtagaacatatgtatttgagagacatggaaaccaagtctgggtgggtgtcaccccggcattctagtataattttctgtgtttagatcatcgtattttctgtgtttaaaaaaaaaaaaaaaaaaaa

SEQ ID NO: 994 - protein, 446 aa, Panicum virgatum
  misc_feature: Ceres CLONE 1754564
  misc_feature: Great-hit functional homolog of the protein sequence given in SEQ ID NO 9221
  misc_feature: Useful for making plants with altered Lignin content
MHQQRIKQAAAAAAVAAQQQQQLMQQALLLQQQQQAQPPLFPGHHPHPGLLDAPQIEPIVSGNLPPGFDSSTCRSVYVGNIHLQVTDTLLQEVFQSIGPVEGCKLIRKEKSSFGFIDYYDRRSAALAILSLNGKQLYGQPIKVNWAYTSTQREDTSGHFNIFVGDLCPEITDAALFAFFSGYSTCSDARVMWDQKTGRSRGFGFVSFRNQQDAQNAINDLNGKWLGNRQIRCNWATKGANAGEEKQSVDTKVDQTNGSSEAGKENLNEDGPENNPLFTTVYVGGLPHEATNNDVHLFFHSLGVGSIEEVRVTRDKGFGFVRYSTHEEAALAIQMGNGQLIGGRPIRCSWGNKPTPPGTASSPLPPPAPSAFPTGVSATDFLAYQRLALSKIAANPALMGQHALKQAALGMDAGASQAIYNGGFPGVNAAATAAAQQQQQQQQLMYF

SEQ ID NO: 995 - DNA, 1128 bp, Panicum virgatum
  misc_feature: Ceres CLONE 1754635
  misc_feature: Encodes the peptide sequence at SEQ ID NO. 996
accacacggctaccggtagccttcgccttagctagctagcagcaccatggccggaaggatgctcctcggcgtctgtgccgtgctgatggcgatagccgtcgctaacgcagcggagcgccagcaggtggcgtcggtcgtcgtcggcctggccaggtgcgccgactgcaccaggaagaacatgaaggccgagacggctttcaaaggtcttcaggtggccatcgagtgcaagaacagcaacggcgaatacgagaccagggccgtcagtgagctccaaagctccggagccttcagcgttcccctcgctgccgacctccacggcgccgactgccacgctcagctccacagcgccgccaacgcgccctgccccggccaggagccgtccaagatcgcgccgatgtcatgcggcaccttcgtcgccatccccgccaagacgcattacccgtccgcggactgcgcgtctgcgttcctatgcgtcccgttcaagaagcacttcctcgaccatttccacaagaagcccgtgccggagtaccaccccgtgccagagcacaagccagcgccggagtaccaccccgtgcctgagcacaagccggcgccggagtaccaccccacaccggaataccaccctcccacgccagaataccatccacccacaccggagtaccacccaccaacgcccgaataccactctcccactcctccggcgtacgggaagccataagccaactcagtggccgagccaggatttgatcattggaggggctaagcagtgattagggaggggggcaaaagtcttgccacaggctaccattggggtaagttccacctttgataatagtactataatggtgctacgggatcattaggaggggccaggccactgcccccctgtctccgcccctgagccaactccgatctaccatcctctcgctgcgcactgcataaattactcctaccatgagttcagcatattctaccactgcttgtgctgtgttagttaataattcggtatgtgcaagtactaatgaacgcatggagaataattgtcgagaattagttgtgaggttgtacttggggatcgttgtttagctttgattaaagtggactgcgtaaaaaaaaaaaaaaaaaaaa

SEQ ID NO: 996 - protein, 223 aa, Panicum virgatum
  misc_feature: Ceres CLONE 1754635
  misc_feature (60)..(124): Pfam Name: Trypan_PARP Pfam Description: Procyclic acidic repetitive protein (PARP)
MAGRMLLGVCAVLMAIAVANAAERQQVASVVVGLARCADCTRKNMKAETAFKGLQVAIECKNSNGEYETRAVSELQSSGAFSVPLAADLHGADCHAQLHSAANAPCPGQEPSKIAPMSCGTFVAIPAKTHYPSADCASAFLCVPFKKHFLDHFHKKPVPEYHPVPEHKPAPEYHPVPEHKPAPEYHPTPEYHPPTPEYHPPTPEYHPPTPEYHSPTPPAYGKP

SEQ ID NO: 997 - DNA, 1618 bp, Panicum virgatum
  misc_feature: Ceres CLONE 1754655
  misc_feature: Encodes the peptide sequence at SEQ ID NO. 998
acccattcctcggcgatcccatccaattccggcgccggagtatcgccgcccgccggctcagatcgacctctgctcgggatgctatccaactccagcttcagttggcgggctcgccggagctcggctcattgacagctcagggctcagggcctcggcctcatctctgtttccttcccccttccccttgtctccgactctctcctcccttgctcttccttccctggcggcgacgactggcccattcgtcccgtcttcgcccagccctctgccggcgacgagcctccaccagcgaagcgctccgctcccacggacaacttgggctcaagcggatgagcatgtgtgagaaagatcagaatttgccctggggatacgatctttttcgcgatccttttgctcctcctgccgggtactatggtcctcctcccggttactgcgatagtaactgttgtgacctccattatgcacatccaaatgagactcagttgcattcctctctactcacgtatgatttgtacaacccatcagtaggcatctaccatcccggtagtgccgatgatcatgagcacgatacagtatacatagaaccgtctagttcctctccaggccccggcagtgacggttattttgagatggaggaggaagtagggaagaggttttaccccatggtcccagtcccccatgtccctaaaattaatggagaaattccatcagtcgatgaagccactatggaccatgaaaggctgacagagaggttgaagttgtatgagctggttgaacgcaaggtgaaaggagatggcaactgtcagttccgagcactatccgatcaactgtaccaaactccagatcaccatgagtttgtgagagagcagataattagccagcttaaaactaaccgtgatgcctatgatggatatgttcccatgacatatgatgattacttggagaaagttgcacgaaacggtgaatggggtgaccacgtgacattacaggctgctgctgacaagtatggagtaaaaatttttgtgatgacatcgttcaaggatacctgctacatcgagatccagcctaaggttcagaagtccaacaaagtggtactgttgagcttctgggccgaggtgcactacaactccatatacccccggaatgatgcgccgaggtcgcagacaacaaagaggaggagatggtggcctttctctcagcaccaccaccattgatggcggatggcagaaggatcagccccatcatcttcatctctctgggactgggacggatgccggcacggtggagctcatcatcattgaggatcaggtggtggtcctgggagagctatggaggggccgtcatccaaatgatacaaggagcggcgttatgattaaattcatatacagagcagagcaggccagagcagacccgatatagatacatgggatgggatgggatgaaatgaaataagcatgagatgaggactgtcctctggtacatagttggagctgaggccagtgcatgccaactaaactcttgtattattgtttgtatctacaaattttgccgcaataaggctagaattactgggaaacgattatggtgataataaaatgggcaagaattgagatgaccc

SEQ ID NO: 998 - protein, 294 aa, Panicum virgatum
  misc_feature: Ceres CLONE 1754655
  misc_feature (1)..(113): Pfam Name: OTU Pfam Description: OTU-like cysteine protease
MSMCEKDQNLPWGYDLFRDPFAPPAGYYGPPPGYCDSNCCDLHYAHPNETQLHSSLLTYDLYNPSVGIYHPGSADDHEHDTVYIEPSSSSPGPGSDGYFEMEEEVGKRFYPMVPVPHVPKINGEIPSVDEATMDHERLTERLKLYELVERKVKGDGNCQFRALSDQLYQTPDHHEFVREQIISQLKTNRDAYDGYVPMTYDDYLEKVARNGEWGDHVTLQAAADKYGVKIFVMTSFKDTCYIEIQPKVQKSNKVVLLSFWAEVHYNSIYPRNDAPRSQTTKRRRWWPFSQHHHH

SEQ ID NO: 999 - DNA, 1542 bp, Panicum virgatum
  misc_feature: Ceres CLONE 1754657
  misc_feature: Encodes the peptide sequence at SEQ ID NO. 1000
acggctgccgacacacagatcactgaccgaaaggggcagcgtcgccagtcgatcgccgcccatggggatcctccggctcctgctgccactcctcctgctcctgctgccccccggcctccgggagtacttctcgccggcgatcaaccccgtgccggagcaggatggtagtagcagtgctgctgctcctgctcccggcggcggcgtcgtcctccacccgatggtgctggtgcccgggttgacctgcagcgagctggaggtgcgcctcacggacgcctaccgcccgaccctgccgcactgcggcgccatgaagggcaagggctggttcgggctctgggccaactgctccgacatccccgcccaccactacgtcccgtgcttcatggagcagatgagcctcgtctacgaccctgccgccggcgactaccggaacctgcccggcgtcgagacgcgcgtccgtaacttcggctcctcgcggggcttccagaggaacccaaagcacacggtctggtgcttcgagatcctcaggaaggagctggagaggatcgggtaccgcgacggtgacaccctcttcggggcgccctacgacctccgccatgccccgccggtgcccggccagtcatccgaggtcttcacccgctacttccggcagctgacgcagctcatcgaggacgcgagcaggaggaaccagggcaggaaggccatcctcttcggccacagcttcggtggaacggtggcgctggagttcgtgcggagcaccccgatggcgtggcgggaccggcacatcaagcacctcgtcctcgtcgcgccgctcccagcgggaggattcgtcaacacggttcaattattcgcgtccgggtcggatctcctctttgtcccgggagtcgacccgctgaccctcaccctgcgtcccatgtggcggaccttcgagtccgccatcgtcaacttcccggcgccggcggtgttcgggcgcaagccgctcgtgatcaccaaggaccggaactactccgcccacgacatggaggacttcctcgccgccaccggttacggcgccgccgtggagccattcaggaggcgggtagtccccaagatgggctattttcaggcgcccatggtgccaacgacgtgcctcaatggggtggggatcgagacgccggagcagcttgtgtactgggatggcgacttcgacgcggacccggagacggtgaacggcgacggggacgaggacatcaatctggccagcatgctggcattcgatgagcagatgcgccagcagccggagcagaacaagctgttcaagacgatcaagcttcatggagctaagcacggtacgattgtgacggaggactgggcgctgaagagggtcatgcaggaaatccttgaagccaatcgtatctagggctctaggcgatcataaaagaagaatctatatagtgggctagctagatgattggatctttattatcatccaattatctgcagtgtttggacttgcacgcatagtaaatttctttttgctcgttcgaaaaaaaaaaaaaaaaaaaa

SEQ ID NO: 1000 - protein, 444 aa, Panicum virgatum
  misc_feature: Ceres CLONE 1754657
  misc_feature (1)..(344): Pfam Name: LACT Pfam Description: Lecithin:cholesterol acyltransferase
MGILRLLLPLLLLLLPPGLREYFSPAINPVPEQDGSSSAAAPAPGGGVVLHPMVLVPGLTCSELEVRLTDAYRPTLPHCGAMKGKGWFGLWANCSDIPAHHYVPCFMEQMSLVYDPAAGDYRNLPGVETRVRNFGSSRGFQRNPKHTVWCFEILRKELERIGYRDGDTLFGAPYDLRHAPPVPGQSSEVFTRYFRQLTQLIEDASRRNQGRKAILFGHSFGGTVALEFVRSTPMAWRDRHIKHLVLVAPLPAGGFVNTVQLFASGSDLLFVPGVDPLTLTLRPMWRTFESAIVNFPAPAVFGRKPLVITKDRNYSAHDMEDFLAATGYGAAVEPFRRRVVPKMGYFQAPMVPTTCLNGVGIETPEQLVYWDGDFDADPETVNGDGDEDINLASMLAFDEQMRQQPEQNKLFKTIKLHGAKHGTIVTEDWALKRVMQEILEANRI

SEQ ID NO: 1001 - DNA, 2096 bp, Panicum virgatum
  misc_feature: Ceres CLONE 1754761
  misc_feature: Encodes the peptide sequence at SEQ ID NO. 1002
gccggagggcgaccacgcgcgcgaggtagagcgtcgcggcgtcgggcggcggcggccggaggcgacagacgagacaggcaggatgtcgtcggtgtacgtgcttgagcccccgacgaagggcaaggtggtggtgcagacgacggctggcccgctcgacatcgagctgtggcccaaggaggcccccaaggcggcgcgcaacttcgtgcagctctgcctcgagggctactacgacggcaccctcttccaccgcgtcatcaagaacttcctcgtccagagcggagaccccactggctccggcaccgggggtgagagcatctatggcgcgccgtttgcagatgagttccactcgcggctgaggtttaaccacaggggtttagtcgcgtgcgccaatgctggcacgcctcattcaaacgggagccagttctttatcacccttgaccgctgcgattggcttgacaagaagaacaccatctttgggaaggttactggtgattctattttcaaccttcttgccttggctgatgttgagacagataaggatgatcgacctgtgtatccacagaaaattctttcagtagaggttctctgggacccatttgaggatattgttccaaggcagctcaagaaggctgagtttgttgccaaggctgatgctgaggtgaaacctaagaagaaggcagttaagcaacttaatgtgctctcttttggagatgaagtagaagaggaggagaatgaggcagcttcctctgttccggccaaaataaaaagtattcatgatgtgctagacgatccccgtttccttaaaggggaaccagaggatgtacagctgtccaaggagcaagaggagaagaaaaaagacactgttttatctgtcagggatgctttgatctcaaagaaagttgactcaagagagccagagcatgctccagaatctgatgattatcctgaagacgagaatgaagaggattttgacaatagaatgcgttcacaaatcctaaaaaaacgtagagaacttggtgatgtcccccctcgtgaaacttctaaagcagataaaccacatcggaaggataaggaattaccagaccgcagggccgaaattaaacataggagggacaatgatgaagatgacaatcaggagcatgaactacaaaagtctaaaaaactatcattgaagaaaaaaggtattggctcagaagccagtgctgagaggatgtccagaacagatgcaaatttgcagcttctaaatccagctgaacaagagagacatttgcaaaaacagaaaaaacgccggcttcaaggccgtgaagacgagactctagcaaagctacagaagttcaaggcttctttcctcagtaagaatcctgctacagatcacatcaaagaaaagaatcctgctactgataaggcggaaaaggaagctgaagaggactacacggggtggcatacaaaccggctgtctttcttacccgattcttccaaggatggaatggctaggaaagatgatccagatgactatgtggtggtagatcctcttctggagaaaggaaaagaaaaattcaacaagatgcaagcgaagcttaagcggagagagcgtgaatgggcaggcagatctctcacctgaccagcaagctgcttgaattgcattggtgctcctttcttacccttgatgttttggcgtggtcttgggaccgcaatcagtggatatcgcacgcagatcacagaactgatggtagcgcgcccatctgcagactgttcttaattttcctttttggtatctgtatcatgattgttgaagctgtaattgccgaatgctgcagttttggcgtggtcttgggaccatgaactgcggatattgcacacaagagcacggaactgatggtagagcgcccatctgtagactattgttttcctttttggtatttgtatgtatcatgattgtcaaagctgtaaatgcaattgtacaatagattgttttggttttatagggtccatgaggaagcaactctgtatcgctagctatatggtatccgtcttacagagttcacaaaaggatctaacacaaaagtgttcgaaatcaaaaaaaaaaaaaaaaaaaa

SEQ ID NO: 1002 - protein, 512 aa, Panicum virgatum
  misc_feature: Ceres CLONE 1754761
  misc_feature (1)..(155): Pfam Name: Pro_isomerase Pfam Description: Cyclophilin type peptidyl- prolyl cis-trans isomerase/CLD
MSSVYVLEPPTKGKVVVQTTAGPLDIELWPKEAPKAARNFVQLCLEGYYDGTLFHRVIKNFLVQSGDPTGSGTGGESIYGAPFADEFHSRLRFNHRGLVACANAGTPHSNGSQFFITLDRCDWLDKKNTIFGKVTGDSIFNLLALADVETDKDDRPVYPQKILSVEVLWDPFEDIVPRQLKKAEFVAKADAEVKPKKKAVKQLNVLSFGDEVEEEENEAASSVPAKIKSIHDVLDDPRFLKGEPEDVQLSKEQEEKKKDTVLSVRDALISKKVDSREPEHAPESDDYPEDENEEDFDNRMRSQILKKRRELGDVPPRETSKADKPHRKDKELPDRRAEIKHRRDNDEDDNQEHELQKSKKLSLKKKGIGSEASAERMSRTDANLQLLNPAEQERHLQKQKKRRLQGREDETLAKLQKFKASFLSKNPATDHIKEKNPATDKAEKEAEEDYTGWHTNRLSFLPDSSKDGMARKDDPDDYVVVDPLLEKGKEKFNKMQAKLKRREREWAGRSLT

SEQ ID NO: 1003 - DNA, 1591 bp, Panicum virgatum
  misc_feature: Ceres CLONE 1754816
  misc_feature: Encodes the peptide sequence at SEQ ID NO. 1004
acgggccacggccgggccctgctgctgcctgtgcctcgcaatcgtggtcgtgcgcgccgccgccggcggcggctaacaaaagcagtgcgaaccgaagcacctcggaacgatcagattcccgctagtattttagatcggccccatccatcgaacaagggcgacgggcgagcgctaatccggtcgggttcgctcggccttgggattccgtcgccatgggcagcctccgcctcgccggctgggcggccgcgccggagtggggcgtgcgccgccgctgccacggggtgccgctgccgcgcccccgctgcgccccgtcgccggctccggcggtggcgtcctctctcggcgtcggctccgcgggccacctccgggccggggcggagcgcgactggctgtgggactgccgcggcggcgccgggggcggggcgagggattacgccagggagatggaggtggcggtgcgggtcgtgcaggtggcctgcaccctgtgccagcgcgtccaggactcgctcctccaccccagcgccgacgccggcggccgcgtccactccaagctcgaccgctcccccgtcacagtcgctgattggggtgttcaagcgacagtaagctggttgctttccaattcctttcatgatgacaacatatcgattgtcgctgaagaagatgatgagacattatctagtagcaacggtgcggctttgcttgaatccgttgttgtggctgtcaatggttgtctggttgaagctccaaagtatgggctgagatccccggagaaagagctcggcgctcatgatgttattcaagccatacggaaatgcagctctgccggaggtccgaaaggaagattttgggtgcttgatcctgtcgatggcacccttggttttgttcgaggggatcaatatgctatcgctctagccttgattgaagatggagaagttatacttggtgttctcgggtgcccaaattatccaatgaaaaaggagtggctcaattatcaccaaaagtactacagattgatgtctaaggttgctcctccaccattggggtcctggcataagggttgtgtaatgtatgctcagaaaggatgtggccaagcttggatgcagccactggttcatgactttggtaagcttgattggcgtcacctgagggagattcaagtatcgtccatcagtgatccaatgtcagcaacattttgtgaacctgttgagaaagccaactcaagccattcctttacagcaggacttgctcatagcgtaggattaaggactcaacctctgcgtgtgtacagcatggtgaagtatgctgcaatagcacgaggtgatgcagagatatttatgaaatttgcaagaactggatataaggagaagatatgggatcatgctgcaggggtggttatcattcaagaggctggtggagtggtcacagatgctggaggccgccagttggacttctcaaggggtatttacttggaaggtttggatagaggcataatagcatgttggggagcattgcttcatcagagaattttagatgctgttgatgcaagctggaactcatcaacactatgatccaaaaaaaaaaaaaaaaaaaa

SEQ ID NO: 1004 - protein, 451 aa, Panicum virgatum
  misc_feature: Ceres CLONE 1754816
  misc_feature (1)..(368): Pfam Name: Inositol_P Pfam Description: Inositol monophosphatase family
  misc_feature (77)..(451): SWISSPROT Homolog: EC 3.1.3.7 PAP-specific phosphatase HAL2-like (3(2),5-bisphosphate nucleotidase)
MGSLRLAGWAAAPEWGVRRRCHGVPLPRPRCAPSPAPAVASSLGVGSAGHLRAGAERDWLWDCRGGAGGGARDYAREMEVAVRVVQVACTLCQRVQDSLLHPSADAGGRVHSKLDRSPVTVADWGVQATVSWLLSNSFHDDNISIVAEEDDETLSSSNGAALLESVVVAVNGCLVEAPKYGLRSPEKELGAHDVIQAIRKCSSAGGPKGRFWVLDPVDGTLGFVRGDQYAIALALIEDGEVILGVLGCPNYPMKKEWLNYHQKYYRLMSKVAPPPLGSWHKGCVMYAQKGCGQAWMQPLVHDFGKLDWRHLREIQVSSISDPMSATFCEPVEKANSSHSFTAGLAHSVGLRTQPLRVYSMVKYAAIARGDAEIFMKFARTGYKEKIWDHAAGVVIIQEAGGVVTDAGGRQLDFSRGIYLEGLDRGIIACWGALLHQRILDAVDASWNSSTL

SEQ ID NO: 1005 - DNA, 2004 bp, Panicum virgatum
  misc_feature: Ceres CLONE 1754854
  misc_feature: Encodes the peptide sequence at SEQ ID NO. 1006
aaacctctcctgcacgggagcacgtacaagcggagcggaagcgatcggcgccgcggcggcgagatgtcggcggcgtcgacgttgatgtggcacgaggacctggccaccctcgtgggggacacgggcgcccatctccacggcgccggaggggaggcgccggcggcggcggcgaatgttgcggcggccggggccgggtggtacggcgaggaggaagaggggagggcggaggaggggtgggcgcagcaggcgaagggattcgcggagtcgacggcggagatgctgcgggagctgggccgcgggctgtgggacgtcgccgcgcagagcctcgccggcgccgaggacagcgagctcgcgcggcggctcaggaagcgggcggcggccacgggggagcgcctcagcttcatgaacgagtacctccccgaggagcgcgaccccgtgaggtgttggctcatcgtcgccgcagttgcattcgtcacgctcctagttttaggtgttgggagtggtgatgaaattccggttgagcttccaaagaaacttatcatcagccccccaagtgcgaatagaatccaacttcctgatggacgccatctagcttatgaagaacaaggagtctcagctgatagggcaagattttcactgattgctcctcattcttttctttcatcaaggctggcaggaatccctggaatcagtgcatcccttctggaagaatttggggcacgacttgtgacctatgatcttcctggttttggtgaaagtgatctgcacccaggccgaaatctgaattcttctgccctggacatgctccatctggctgatgctcttggtattccggacaagttctgggttgtgggctattctggtggtggcatgcatgcttggagtgctcttcgttacattcctgatagagttgctggtgcagcaatgtttgcacctatggcaaatccatatgactccaagatgaccaaagatgagaggcataaaacatgggatagatggtcaacaaaacggaaacttatgcacattttagctcggaggtttccatcactactgcccctcttctatcgccgaagctttctttctggcaagcaaggacagccagagagttggttgtcactgtcattggggaagaaggacaaaactttactggaaggtcctgagttcaatgcattctgggaaaggaatgttgcagagtctgtgcgccagggagatgcgcgaccatttgtagaggaagctgtgttgcaagtatccgactggggtttcagcttgtccgacattcaaatgcagaagaaagaggatcgaagcttttttgaactcatcaagtctctgttcaatcaagttgaacgagagtgggttggatttctgggcccaatacatatctggcagggaatggatgaccgagtggtctcaccgtcagtggctgaatttatccgtcaggtggttccaggagctacggtgcacaagcttcttgatgaaggccacttctcgtatttctgcttctgcgacgagtgccacaggcagatattctccacactcttcggcatcccccagggccctatcaaccctgcgccactacccagcaatgtggcttcagagcttgccgaagaaacaacagaagaaacaacagcaccggacaatcttacagaggaggaacaaggaaaatcaagcctggcctgatcaagatcagttttcaggatcagaagtatagatacaagaccttactactactactactactacttgacacaatacatcacagatagacatgcttttcttcgctgccatgggacaaggcctacatcaggtggacagtggactgagcttgtcctcttgcattggatgggaggtgcagcgccggattatgtggtttcacctcgatgtacaaatgctcatcccgaatgtgcgcggcaactgcttggtgcgcacttagtatagtcggtgttaaaattcggttaacctgtcataatgagagaccgttatacagaaaaaaaaaaaaaaaaaaaa

SEQ ID NO: 1006 - protein, 537 aa, Panicum virgatum
  misc_feature: Ceres CLONE 1754854
  misc_feature (3)..(270): Pfam Name: Abhydrolase_1 Pfam Description: alpha/beta hydrolase fold
MSAASTLMWHEDLATLVGDTGAHLHGAGGEAPAAAANVAAAGAGWYGEEEEGRAEEGWAQQAKGFAESTAEMLRELGRGLWDVAAQSLAGAEDSELARRLRKRAAATGERLSFMNEYLPEERDPVRCWLIVAAVAFVTLLVLGVGSGDEIPVELPKKLIISPPSANRIQLPDGRHLAYEEQGVSADRARFSLIAPHSFLSSRLAGIPGISASLLEEFGARLVTYDLPGFGESDLHPGRNLNSSALDMLHLADALGIPDKFWVVGYSGGGMHAWSALRYIPDRVAGAAMFAPMANPYDSKMTKDERHKTWDRWSTKRKLMHILARRFPSLLPLFYRRSFLSGKQGQPESWLSLSLGKKDKTLLEGPEFNAFWERNVAESVRQGDARPFVEEAVLQVSDWGFSLSDIQMQKKEDRSFFELIKSLFNQVEREWVGFLGPIHIWQGMDDRVVSPSVAEFIRQVVPGATVHKLLDEGHFSYFCFCDECHRQIFSTLFGIPQGPINPAPLPSNVASELAEETTEETTAPDNLTEEEQGKSSLA

SEQ ID NO: 1007 - DNA, 1644 bp, Panicum virgatum
  misc_feature: Ceres CLONE 1754897
  misc_feature: Encodes the peptide sequence at SEQ ID NO. 1008
gagaaagagagacaaaggccaaagggagagagagaccaagcgccagagacacagagaggggcggaggagagagaggggggaatcgcgggagggaggcggggttttggcgagatttgagtttttcccacgctcccgccatggtgtccgaccaggagatcgccagctgcgtcgagtccgtcctccgcggctccgccggcgggcccggggaggcctcgctcgccgccgtgctgcagcaggcggaggccaagctcggcacggacctctcccacaaggcgcagttcatccgcgaccagatggacctcttctttggtccgagcctccagccgcagccgcagtccaaatcccaggcggcccttcctccgccgcaggctattcccaccgcggcctccgtgccgcagcccgacgctcaggtcctgcagcaggcgcaggccccgcctcttgcccagcagattcggacacagccgcagcagcaccagcagctcgcggcgctccagccgcagctcatcttccaggccatgcctcagctccccgccacaatccctgcggtgtcctcaccgccggccgtaccagccatggccttctaccccccgccgccgcttgccttccgctacaccaccggcctgggcggggccgccacgggtgggaccgtctccttccaacagccggcccctgcagtcgggggcactgctctccccgccgcggcagcgcaggtcgccagcgacaacaaggaaagtgcttctaagcggaaaagaggtggacctggtggtttaaataaagtttgtgcaatttcacctgaacttcagaccattgttggcgagactgctatgtcaagaactcagattgtgaagcagctgtgggcatatatcaggcagaataatcttcaagatcctgatgacaaaagaaagatcatttgcaatgatgaacttcgtgtggtttttggaactgacaccaccgacatgtttaagatgaacaaattgttggctaagcacataaccccacttgacccaaaagatcaaattcacaacacgaaaagaatgaaggctcccaccgagactcctcaacctggaccactcattaatcaaccctctgtggttatttctgatgcactagcaaagtttattggagttgatggaacatttcctcaagaagatgctctgaaatacctctgggattacataaaggcaaaccaactcgaggatgtcatcaatggatcaatattatgtgattcaaaacttcaagagctatttggctgcgagagcattcctatgtcaggattatcagaaatgcttggtcaccacttcatcaagaagacatagcaaatcctcattaactgatctaggattgcagtgtggcagatatcataggcctaacattaccatatggtgttcttgacagaatggacagcatagcttatgtatttcttcaatgttatggattatgaattgtcaggcaaagatcagattattgtggtagcctgtagtttgttattcattcaggccaccgctgtggtgtctggtgtaacctttactgaattcgtagtgttagttcctaaatgtcaaaaatgtcaagctgattatgtaaagttaagctttcgattgagtgccaggttgaactcttaaaatccaaaaaaaaaaaaaaaaaaaa

SEQ ID NO: 1008 - protein, 392 aa, Panicum virgatum
  misc_feature: Ceres CLONE 1754897
  misc_feature: Great-hit functional homolog of the protein sequence given in SEQ ID NO 9246
  misc_feature: Useful for making plants with modulated biomass
  misc_feature: Useful for making plants with modulated flowering time
  misc_feature: Useful for making plants with modulated drought sensitivity
  misc_feature: The plant flowers significantly late compared to wild-type.
  misc_feature: The plant is abnormally large.
MVSDQEIASCVESVLRGSAGGPGEASLAAVLQQAEAKLGTDLSHKAQFIRDQMDLFFGPSLQPQPQSKSQAALPPPQAIPTAASVPQPDAQVLQQAQAPPLAQQIRTQPQQHQQLAALQPQLIFQAMPQLPATIPAVSSPPAVPAMAFYPPPPLAFRYTTGLGGAATGGTVSFQQPAPAVGGTALPAAAAQVASDNKESASKRKRGGPGGLNKVCAISPELQTIVGETAMSRTQIVKQLWAYIRQNNLQDPDDKRKIICNDELRVVFGTDTTDMFKMNKLLAKHITPLDPKDQIHNTKRMKAPTETPQPGPLINQPSVVISDALAKFIGVDGTFPQEDALKYLWDYIKANQLEDVINGSILCDSKLQELFGCESIPMSGLSEMLGHHFIKKT

SEQ ID NO: 1009 - DNA, 3578 bp, Panicum virgatum
  misc_feature: Ceres CLONE 1754916
  misc_feature: Encodes the peptide sequence at SEQ ID NO. 1010
catcgcaaccgcagctagctagcacggcgtcccccgctcctgcggcagagccatccagctagcctcgctcgcttgcctccccggccgccatggcgtccgccgagcgccaccactccatcgacgcgcaggtccggcagctggcccccggcaaggtctccgaggatgacaagctcgtcgagtacgatgtcctcctcatggaccgcttcctcgacatcctcgagaacctccacggccccgccatccgcgaattcgtccaggagtgctacgagctggcggcggagtacgagggcaagcgcgacgccgcgaagctcaaggagctcgggtccaggctcgcggcgctggcccccgccgacgccatcctcgtcgcgggctccatccagcacatgctcaacctcgccaaccttgccgaggagttgcagatcgccaaccgccgccggaacaagctcaagagcggggacttctccgacgagggctccgccaccaccgagtccaacatcgacgagaccatcaagcgcctcgtcgacctcggcaagtccaaggaggaggtgttcgaggcgctcaagaaccagtccgtcgacctcgtcctcaccgcgcaccccacgcagtccgtccggaggtcgctcctccagaagcacgccaggatccggaactgcctcaaccagctgaatgccaaggacgtcacggacgacgaaaagaaggagatcgacgaggctcttcacagggagatccaagcagccttcagaacagatgagatccggagagcccagccgaccccgcaggacgaaatgcgttacgggatgagctacatccacgagaccatatggaagggcgtccccaagtttctgcgtcgtgtggacactgctctgaagaacatcgggatcgacgagcgtctcccctacaatgtccctctcatccagttttgttcttggatgggtggcgaccgtgatggaaacccaagagttacgccggaggtgacaaggaatgtgtgcttgctgtcacggatgatggctgcaaacttgtacttctctgggctagaagaactcatgtttgagctctctatgtggcgctgcaacgatgaactccgtgctcgtgctcaagaaatacacagcgctccaaagaaagctgccaagcactacatagagttctggaagcaaattcctctaagtgagccgtatcgcgtggtgcttggtaacgtgagggacaaactgtacaacacacgcgagcgtgcgcgccaactgctggccaatgaatttactgacattccggaggaattggtctttaaaaacgttcaggagttcgtggagcccctcgagctttgctacaaatcgctgtgcgagtgcggcgacaagaccatcgccgacgggagcctgctggacttcctccggcaggtctccgccttcgggctgtccctggtgaagctggacatccggcaggagtcggagaggcacaccgacgtgatcgacgccatcaccacgcacatcggcatcggctcctaccgctcctggcccgaggagaagcgccaggagtggctgctgtcggagctccgcggtaagcggccgctgctcgcgccggacatgccccagaccgaggagatcgccgacgtgctcggctgcttccgcgtgctctccgagctgccccgcgacagcttcggcccctacatcatctccatggccaccgcgccgtcggacgtgctcgccgtcgagctcctgcagcgcgagtgccacatacgcgagccgctgcccgtggtgccgctcttcgagcggctcgccgacctgcagaacgcgccggcgtccatggagcgcctcttctcggtggactggtacctgcagcggatcaacggcaagcagcaggtcatgatcggctactccgactccggcaaggacgccgggcgcctgtcggcggcgtggcagctgtaccgggcgcaggaggagctcgcgcaggtggccaagcgctacggcgtgaagctgaccatgttccacggccgcggcggcaccgtcggcaggggcggcgggccgtcgcacctggccatcctgtcgcagccgccggacaccatcaacgggtccatccgggtgacgatccagggcgaggtcatcgagcactcgttcggcgaggagcacctctgcttccggacgctggagcggttcacgtcggcgacgctggagcacggcatgcacccgccggtgtcccccaagcccgagtggcgcaagctcatggacgagatggccgtcgtggccacggaggagtaccgctccgtcgtcatgaaagagccgcgcttcgtcgagtacttccgatcggctacgcctgagacggagtacggcaagatgaacatcggcagccggccggcgaagaggaagccccagggcggcatcacgtcgctccgcgcgatcccctggatcttctcgtggacgcagacgaggttccacctccccgtgtggctcggcgtcggcgccgcgttccagtccgccattaagaaggacagcaagaacatccagaagctcaaggagatgtacaaggagtggcccttcttcagggtcaccattgacctgctggagatggtcttcgccaagggggaccccagcatcgccggcttgtacgacgagctgctcgtcgccgacgagctcaagcccttcggggagcagctgaggaacaagtacctggagacgcagcagcttctcctgcagatcgctgggcacaaggaaatcctggaaggcgatccctacctgaagcaggggctccggctgcgcaacccctacatcacaacgctcaacgtgttccaggcctacaccctgaagctgatgagggacccgagcttccaggtgaagaagcagccgccgctgtccaaggagttcgccgacgagaagaagcccgccgggctggtggagctcaacccggccagcgagtacgcgccgggcctcgaggacacgctcatcctcaccatgaagggtatcgccgccggcatgcagaacaccggctaggtcgacgccggccggccgccgtcaggtgctccgctcctcaactgcagactgctgctcatcgaggcaccaccgtgtcgatgcgcatgtatccttttttcaattccgcactccaccactttttatccttttgatttgaatttcacgcttgatgtacgtgtcggctctgttgttattactacaaactcgtgtctgtttgagctggagctcgctcggcttgtttgttcaccgagcccagcgcgtcgtgtatggtcgagccagaggcgtgcggagtccacgccgtggcgcgtcggcgcgcggcatgatccgggcgtgcgggatggcgcacgcggagagcgggtcatggcgtgcgcgtgtgcagggactacggcgagaccggggctctgccttttccttttcatcacactctgtcgggtcatggcgcgcgcgtgtgcagggactacggcgagaccggggctctgccttttccttttcatcacactctgtttgtaataatcgatatatatatatatatatatatatatatatatataataaataaagggatcctatgcagaaaaaaaacgccgcacgttacgcgcggcacaaaaaaaaaaaaaaaaaaaa

SEQ ID NO: 1010 - protein, 961 aa, Panicum virgatum
  misc_feature: Ceres CLONE 1754916
  misc_feature (1)..(750): Pfam Name: PEPcase Pfam Description: Phosphoenolpyruvate carboxylase
  misc_feature (1)..(961): SWISSPROT Homolog: EC 4.1.1.31 Phosphoenolpyruvate carboxylase 3
  misc_feature (5)..(961): SWISSPROT Homolog: EC 4.1.1.31 Phosphoenolpyruvate carboxylase 1
MASAERHHSIDAQVRQLAPGKVSEDDKLVEYDVLLMDRFLDILENLHGPAIREFVQECYELAAEYEGKRDAAKLKELGSRLAALAPADAILVAGSIQHMLNLANLAEELQIANRRRNKLKSGDFSDEGSATTESNIDETIKRLVDLGKSKEEVFEALKNQSVDLVLTAHPTQSVRRSLLQKHARIRNCLNQLNAKDVTDDEKKEIDEALHREIQAAFRTDEIRRAQPTPQDEMRYGMSYIHETIWKGVPKFLRRVDTALKNIGIDERLPYNVPLIQFCSWMGGDRDGNPRVTPEVTRNVCLLSRMMAANLYFSGLEELMFELSMWRCNDELRARAQEIHSAPKKAAKHYIEFWKQIPLSEPYRVVLGNVRDKLYNTRERARQLLANEFTDIPEELVFKNVQEFVEPLELCYKSLCECGDKTIADGSLLDFLRQVSAFGLSLVKLDIRQESERHTDVIDAITTHIGIGSYRSWPEEKRQEWLLSELRGKRPLLAPDMPQTEEIADVLGCFRVLSELPRDSFGPYIISMATAPSDVLAVELLQRECHIREPLPVVPLFERLADLQNAPASMERLFSVDWYLQRINGKQQVMIGYSDSGKDAGRLSAAWQLYRAQEELAQVAKRYGVKLTMFHGRGGTVGRGGGPSHLAILSQPPDTINGSIRVTIQGEVIEHSFGEEHLCFRTLERFTSATLEHGMHPPVSPKPEWRKLMDEMAVVATEEYRSVVMKEPRFVEYFRSATPETEYGKMNIGSRPAKRKPQGGITSLRAIPWIFSWTQTRFHLPVWLGVGAAFQSAIKKDSKNIQKLKEMYKEWPFFRVTIDLLEMVFAKGDPSIAGLYDELLVADELKPFGEQLRNKYLETQQLLLQIAGHKEILEGDPYLKQGLRLRNPYITTLNVFQAYTLKLMRDPSFQVKKQPPLSKEFADEKKPAGLVELNPASEYAPGLEDTLILTMKGIAAGMQNTG

SEQ ID NO: 1011 - DNA, 2023 bp, Panicum virgatum
  misc_feature: Ceres CLONE 1754932
  misc_feature: Encodes the peptide sequence at SEQ ID NO. 1012
actccggcactcccacaccacacgcttgactcgcactgtgtccacggccatggcggccgcggtctcgccgccgctcctcctcgcagtcctcctcctgaccaccgccggcacaacccaatgccacgggcacaagcgccaccaccaccagactgacggaaccaggaggcccagcaaggctgccgccgagaaatccaggccaccggccgccaccgctcaccacaccatctgccagaagaccccgcactcggcctcctgcctcgcggccgtggcctcgcatctcgacgccgtcgccggcgcgagcgggaaggcggccgaggcgtccgctgtttccgtacagctcctcccgccggacgtgctctccgtcgtgctcgcctccctccgcggcgcggcatccgcgctgtcgtcgctctcccccgccatctccacgctctccgtgcgggccgccttccccacgggcgccccgctccgccgcggcgccgcgcaggactgccaggagctccacgccgcgtcgctgtcctcgctctcgcgcgccgcctcgctgctcgcggcgcccggcgacggcgggggcctccccgccgcgcgcgcgcacctcgcggccgcgctcgccaacaaggccacctgcctcgacgggctcgccggcgcgtcgtcgggaccgggggtggccggcctcctcgcgtccttcgacgacgcctacgagcacgtgtccaactcgctcgccctcgtcgcccggggcggcgtgccgtcggccgctggcttcgcgaacgccgtggccaaggccatccacaaccggcggctgctccaggacgacgacaacggcgacggggaagatgacagcggcaacaacggcgacggcgacagtgggaacgccgaccagcggacggcgaaggtgatcacggtggcgcaggacggaacgggggacttccggacggtgggggaggcggtggcggcggcgccgaacaacagccgcgcgaggacggagatccgggtgaaggccgggacgtacagtgagaacgtggaggtgccgccgtacaagaccaacatcgccctcgtcggcgagggccgcgagaagacgatcatcaccggcagccgcagcgccgccggcggctggaccaccttccgcacggccaccttcggcgtctccggcgagggcttcctggcgcgcgacgtcacgttccgcaacacggcgggcgcggccgcggggcaggcggtggcgctgcgagtgaacgcggaccttgccgccgcctaccgctgcggcgtggaggcgcaccaggacgcgctgtacgcgcactcgttccgccagttctaccgcgagtgcgccgtcgccggcaccgtcgacgtcgtcttcggcgacgccgccgccgtgctgcagggctgcgcgctcctcgccagggcgccgctgcccggccaggacgtcgtgctcacggcgcagggccggggcgaccccaacgaggacacgggcatcgccgtgctcaactgcacggtcgacgccgccgccgcgcccctgcccgccggcacgcgcacgttcctgggccggccgtggggcgcgtacgcgcgcgccgcggtgatggactcctacctgggcccgatcgtggaccgggaaggctgggccgagtggcccggcgccgagcccggccgcggggacaccgtgttcttcggcgagtacgggaacggcggcccgggcgcgggcacggaggggcgcgtgcgctgggccggcgtgcgccagatggactacgacgaggcggcccagtttgccgtcgagaacttcatctacggcaacgagtggctcggcgccacctccttcccctacgacgacgacgtctgaattctgattaacctttgccctgtaaaatctcaagtacgcaacagttaattgcaagttacttactctgtaccttatgcttacccgtcaggcgtaattaagttttgcttgtgttgtgttccagtgtagtggaattcgaatggcttcctgctctgatctggaatgttttgttctgttggagagcaaaaaaaaaaaaaaaaaaaa

SEQ ID NO: 1012 - protein, 590 aa, Panicum virgatum
  misc_feature: Ceres CLONE 1754932
  misc_feature: Great-hit functional homolog of the protein sequence encoded by LOCUS At2g26440
  misc_feature (1)..(299): Pfam Name: Pectinesterase Pfam Description: Pectinesterase
  misc_feature (2)..(167): Pfam Name: PMEI Pfam Description: Plant invertase/pectin methylesterase inhibitor
  misc_feature: Useful for making plants with altered cell wall content and/or composition
MAAAVSPPLLLAVLLLTTAGTTQCHGHKRHHHQTDGTRRPSKAAAEKSRPPAATAHHTICQKTPHSASCLAAVASHLDAVAGASGKAAEASAVSVQLLPPDVLSVVLASLRGAASALSSLSPAISTLSVRAAFPTGAPLRRGAAQDCQELHAASLSSLSRAASLLAAPGDGGGLPAARAHLAAALANKATCLDGLAGASSGPGVAGLLASFDDAYEHVSNSLALVARGGVPSAAGFANAVAKAIHNRRLLQDDDNGDGEDDSGNNGDGDSGNADQRTAKVITVAQDGTGDFRTVGEAVAAAPNNSRARTEIRVKAGTYSENVEVPPYKTNIALVGEGREKTIITGSRSAAGGWTTFRTATFGVSGEGFLARDVTFRNTAGAAAGQAVALRVNADLAAAYRCGVEAHQDALYAHSFRQFYRECAVAGTVDVVFGDAAAVLQGCALLARAPLPGQDVVLTAQGRGDPNEDTGIAVLNCTVDAAAAPLPAGTRTFLGRPWGAYARAAVMDSYLGPIVDREGWAEWPGAEPGRGDTVFFGEYGNGGPGAGTEGRVRWAGVRQMDYDEAAQFAVENFIYGNEWLGATSFPYDDDV

SEQ ID NO: 1013 - DNA, 1288 bp, Panicum virgatum
  misc_feature: Ceres CLONE 1754989
  misc_feature: Encodes the peptide sequence at SEQ ID NO. 1014
attgcaaagaatcaccactccctccggcttctattggatcttaggcgcaaagaggtgcgagctatggaactcaccaaggtcgacctccgcggcgtcgagccgggcgggccggggtgggaggccgcccgcgccgcggtgacagcgtcaatggtggcgcacggcttcgtcgttgtcgcgcacgacgcgctcggccccgacctccaccaggcgctgttcacccgcgccctgccggagctcttcgcgctccccatcgaagctaagaagcgcaacttgaacaacagggggcagttcagaggctacatcggaccgagcgacggtatgaactgggagagcctcgtcgtcgaggagtccgccgacgccgccagagtccgcggcttcaccgacctcatgtggccggacggcaacccggagttctgtgagaccatggtgtcgttcgccaagaacatactgaagctggaagagatggtggagacgctggtcctggaaggcctcggcgtccggggagagagcatcggcgcccaattggacatgctcatcgacgtcattcggatctggcactacggcgcgccagcggacacggagaccgccgtgaccttgccgccgcactacgacgacatcatggtcaacgcgatcgtccagcacgaggtggaagacctggaggtgcacgtcggggacgggcgctgggtcgccgtccctgccgagcccggcaccatcgccttcgtcgccggcgaccagctcagggtcgccacgaacgggcgcgtgccggcgtgctaccaccgcgtgcggacgccgagcaaccgcgaccggttctcggtgctgttcggccgccggcagaaggacggcgtcccggtgcgcccgctggacgacctcgtcgacgcggagcacccgctgctgtacaaccccctgaggcacgaggagtactccaagtggcgtttctccgaggaagcgcgcaaactcgaggatccactcaaggagttctgcggtgtggagaaagtcggagtctgttagccaagcctcgtacgtgggcttggttcttttacatgcatctgtgttgagtcaggcatgctgagcacgcgtcctgtgcggccccgcatgccatagttggattgctctcacgatcgagtccagcgctccgagggttgctctcgcctcacgcgtcgtggggatggacgcgacgatgccgcggcgtgaggagcactcggacaccgctttcctttccgttttcgttgtactgaataaaaggagagtctttttatttatgtaccattaaaaaaaaaaaaaaaaaaaa

SEQ ID NO: 1014 - protein, 314 aa, Panicum virgatum
  misc_feature: Ceres CLONE 1754989
  misc_feature (5)..(95): Pfam Name: 2OG-FeII_Oxy Pfam Description: 2OG-Fe(II) oxygenase superfamily
MELTKVDLRGVEPGGPGWEAARAAVTASMVAHGFVVVAHDALGPDLHQALFTRALPELFALPIEAKKRNLNNRGQFRGYIGPSDGMNWESLVVEESADAARVRGFTDLMWPDGNPEFCETMVSFAKNILKLEEMVETLVLEGLGVRGESIGAQLDMLIDVIRIWHYGAPADTETAVTLPPHYDDIMVNAIVQHEVEDLEVHVGDGRWVAVPAEPGTIAFVAGDQLRVATNGRVPACYHRVRTPSNRDRFSVLFGRRQKDGVPVRPLDDLVDAEHPLLYNPLRHEEYSKWRFSEEARKLEDPLKEFCGVEKVGVC

SEQ ID NO: 1015 - DNA, 1036 bp, Panicum virgatum
  misc_feature: Ceres CLONE 1755048
  misc_feature: Encodes the peptide sequence at SEQ ID NO. 1016
agatgctcccgctgtggcgacggctgcggccacagctcgatggcttgccgcgtcgccgccaccgcaggccagagaagaggtgaggccgccaccatgcgctgcggcggaggcgccgccgctgggctgaggctcttcggggtgcagctcggtgccgcggcaggtggcgccgcttcgccggcgctgcagctgcacaagagctacaacgtggactgcctgaacctgcagggttctgctcctgcctatgctgctcgcgtcacggctcctctgcttctgtcgccgtcgccgtcgacggctttgctcctgtcgatcgacgagtgctcgacggagagggccaccgacggcggcggctacctctccgacgacggcgctcgcggcggcacggcgttgcgggagaggaagaagggcgttccgtggagcgaggaggagcacaggctgttcttggaggggctggagaagctcggcaggggcgactggcgaggcatctcccggggcttcgtcaccacgcggacgcccacgcaggtcgccagccacgcgcagaagttcttcctcaggcagaacagcgcggggaagaacagcaacgcaaagcgccggtccagcctcttcgacctggttcagaattgtgagggtggactcgtctccgatccttcggacggcaaggccgccgcaacctcggaatctctgtatccgaaggcattgtgcgatgtgtaccggaaggagtcgacggccatccatgctaggatgacaaggccttcgtcagagagcgcaccagtttcagagaaagttacagtggcgacagagcaagctcacgggtaccactgctctccgttaaacctggagctcggcatgtccctgacgacgccgtccatcggaacctagcagtctcatgaacaagacaagttcagcgaaaagctgaagctcgtagctgccccccacagccatgaagatggttgtaaacgaagcttgtaatccagccgccttatccagataattacaggaatcagagtattgtttccccgaaaaaaaaaaaaaaaaaaaa

SEQ ID NO: 1016 - protein, 278 aa, Panicum virgatum
  misc_feature: Ceres CLONE 1755048
  misc_feature (1)..(48): Pfam Name: Myb_DNA-binding Pfam Description: Myb-like DNA-binding domain
MACRVAATAGQRRGEAATMRCGGGAAAGLRLFGVQLGAAAGGAASPALQLHKSYNVDCLNLQGSAPAYAARVTAPLLLSPSPSTALLLSIDECSTERATDGGGYLSDDGARGGTALRERKKGVPWSEEEHRLFLEGLEKLGRGDWRGISRGFVTTRTPTQVASHAQKFFLRQNSAGKNSNAKRRSSLFDLVQNCEGGLVSDPSDGKAAATSESLYPKALCDVYRKESTAIHARMTRPSSESAPVSEKVTVATEQAHGYHCSPLNLELGMSLTTPSIGT

SEQ ID NO: 1017 - DNA, 1350 bp, Panicum virgatum
  misc_feature: Ceres CLONE 1755065
  misc_feature: Encodes the peptide sequence at SEQ ID NO. 1018
aaccatttccgacgcagaacccccgggggccggaatccgtgacacccacccggaggagagcagagcagaggcatcaggcatggccgccgcggtggagctggagcagaagccggcggtggggtactggggcgtggccggcgcgcggccctgcgacgcgtgcgccgcggagccggcgcggctgcactgccgcgcggacggcgcgttcctgtgccccgggtgcgacgcccgcgcgcacggcgccgggtcgcgccacgcgcgcgtctggctctgcgaggtctgtgagcacgctcccgccgccgtcacgtgccgcgccgacgccgccgcgctctgcgcggcctgcgacgccgacatccactcggccaacccgctcgcgcgccgccacgagcggctccccgtcgcgcccttcttcggcgcgctcgccgacgcgccgcagccgttcccgtccgcggccttcgccaccgcggggggccagtcccagggggacgcggcggcggcggcggcggcggacgacgacgggagcaacgaggccgaggccgcctcatggctcctccccgagcccgacaccagccacgaggacagcgcagccgccaccgacgccttcttcgcggactccgacaagtacctcggcgtcgacctcgacttcgcccggtccatggacggcatcaaggccatcggcgtcccggtcgcgccgccggagctggacatcgccgctggcgctttctactaccccgaacactccatgaaccatagcgtgtcgtcatcagaggtggcggtcgtgccggacgtgctggcgggcggcgtcccggcggtgccggtggcgagccgggggaaggagcgggaagcgcggctgatgcggtaccgcgagaagcgcaagaaccggcggttcgacaagaccatccggtacgcgtcccgcaaggcgtacgccgagacgcggccgcgcatcaagggccgcttcgccaagcgctgctccgccgaggccgaggacgaggacgaggcgctgctggagcacgaggaaggggcgtgcttctcgcccgcggtgtcggcccccgcggcctcggacggcgtcgtcccgtccttctgctaagggggacgacgggtggcggccgcgcctcctcctcctccccggctcccaggcggcaaccccttaattttgccgactctgaatcgacccccaacgcatgccaacatgcgaatgcgatgcgcgcgctccgtgtagcataataattgtacagcagctcgtccgacgcaacgagctcaatcgcggtcgcacggaacgcctgtaatcctcctcaccatccgtgtaatccagccttgtacattaccatctagaggtgtttgtgcttctcttgc

SEQ ID NO: 1018 - protein, 334 aa, Panicum virgatum
  misc_feature: Ceres CLONE 1755065
  misc_feature: Great-hit functional homolog of the protein sequence given in SEQ ID NO 9333
  misc_feature (1)..(43): Pfam Name: zf-B_box Pfam Description: B-box zinc finger
  misc_feature: Useful for making plants with altered Lignin content
  misc_feature: Useful for making plants with modulated cold sensitivity
MAAAVELEQKPAVGYWGVAGARPCDACAAEPARLHCRADGAFLCPGCDARAHGAGSRHARVWLCEVCEHAPAAVTCRADAAALCAACDADIHSANPLARRHERLPVAPFFGALADAPQPFPSAAFATAGGQSQGDAAAAAAADDDGSNEAEAASWLLPEPDTSHEDSAAATDAFFADSDKYLGVDLDFARSMDGIKAIGVPVAPPELDIAAGAFYYPEHSMNHSVSSSEVAVVPDVLAGGVPAVPVASRGKEREARLMRYREKRKNRRFDKTIRYASRKAYAETRPRIKGRFAKRCSAEAEDEDEALLEHEEGACFSPAVSAPAASDGVVPSFC

SEQ ID NO: 1019 - DNA, 1423 bp, Panicum virgatum
  misc_feature: Ceres CLONE 1755159
  misc_feature: Encodes the peptide sequence at SEQ ID NO. 1020
gcgcgctccctcccctcccctcctcccaccagcccaccaccaccacaagcaccgcgtcgtccacaccacctgccattgccgcgccgagctcagcctctagctgcgccaggagggcgcccgcctccctccctgccgacgccggtgtgatggagctgcacaagtactggggcgtggggggccgccggtgcggcggctgcgaggcggccccggcggcggtgcactgccgctcgtgccccgccgggggcgcgttcctctgcacggcgtgcgacgcgcgcccggggcacgcgcatctgggccacgagcgcgtgtggatgtgcgaggtctgcgagctggcgcccgccgccgtcacgtgcaaggccgacgccgccgtgctctgcgccgcctgcgacgccgacatccacgacgccaacccgctggcgcgccgccacgcacgcgtccccgtcgcgcccatcggctcggaggccgcggccgccgccgtggaggccatgctgttcgggaccggcgagccggccgcgtccgaggccgaggagccgcagaacgcggcggccaggcacaaccaccagcacgcgctgaacctcaacgtggaggccaaggacatgaagctggactacctcttttccgacctggacccctacctcagcgtcgatatcccgcgcttccagcacgccgacagcgtcgtccccagcggcgtcggcgccggagcagccggcgccgtcgagctggacttcacgtgcggcatcggcgtcgagccctcctcatacagctcctacacggcaacatccctcgcccacagcggctcctcttctgaggtcggcgtggtgccagaggccttctgcggcggcggcgggagcttcgagctcgacttcacaaggcccaagcctcaagcctacatgccgtacaccgcgactcctcaaagtcacagcgtgtcgtcggtggacgtggaggtggtgccggagcggggggacatgatggcggcggcgaggccggtgccgctggtgggggagagccgggaggcgcggctgatgcgctaccgggagaagcggaagaaccggcggttcgagaagaccatccggtacgcgtcccggaaggcctacgccgagatgcggccgcggatcaagggccggttcgccaagcgcgccgaccacgacgccgacgccgacgacaccgaggccgaggccgaggccgccgtgccgtcgccggcgtcgtacgtgctcgacttcggctacggcgtcgtgcccagcttctgatcgacgacgatcgtctcgctcgttccacgcgcggcgcgcttgacccggcccggcgcgcgcgccttgtacttgtatcgatgcatgtataggggaggaatagtaatcccatgtactctcgtcttggagctgcgctagccctgcgtacgtacgctagtgatgtataatttgtacaaccc

SEQ ID NO: 1020 - protein, 366 aa, Panicum virgatum
  misc_feature: Ceres CLONE 1755159
  misc_feature (1)..(48): Pfam Name: zf-B_box Pfam Description: B-box zinc finger
MELHKYWGVGGRRCGGCEAAPAAVHCRSCPAGGAFLCTACDARPGHAHLGHERVWMCEVCELAPAAVTCKADAAVLCAACDADIHDANPLARRHARVPVAPIGSEAAAAAVEAMLFGTGEPAASEAEEPQNAAARHNHQHALNLNVEAKDMKLDYLFSDLDPYLSVDIPRFQHADSVVPSGVGAGAAGAVELDFTCGIGVEPSSYSSYTATSLAHSGSSSEVGVVPEAFCGGGGSFELDFTRPKPQAYMPYTATPQSHSVSSVDVEVVPERGDMMAAARPVPLVGESREARLMRYREKRKNRRFEKTIRYASRKAYAEMRPRIKGRFAKRADHDADADDTEAEAEAAVPSPASYVLDFGYGVVPSF

SEQ ID NO: 1021 - DNA, 1622 bp, Panicum virgatum
  misc_feature: Ceres CLONE 1755309
  misc_feature: Encodes the peptide sequence at SEQ ID NO. 1022
gccgacgtgccacgcccggatctcacaagctgctgccgcggcaacgagtccctcctaaataactcttcttccaccgcatccgcgccgcgccgcgaccgcgacaccatctcccggatctcatctgcgacgacctcccctcccgtcccgatccggccttcgcccgcggcgcgccaccgccaccgccgcccgcaccccacaccgagttcctcacgtctgcggcggcggcgaagatgtacgggtgggagatgctgtcgttcaacatccacgacgggttcctggaggccatcgtgagggggaaccgctcgggcctcctcaccgccgccgactacaacaacctctgccagtgcgagaccctcgacgacatcaagatgcacctcaccgccaccgagtacgggccctacctccagaacgagccttctcccttgcacacaacaacaattgtggaaaaatgcactcttaaactggttgatgagtacaagcacatgctatgccaggctactgaaccactatctacattcttgcagtatataacgtacgggcatatgattgataatgttgtccttattgtaaccgggacattgcatgagagagatgttaatgaactgttggagaaatgccacccattgggcatgtttgacagtattgcatcacttgctgttgctcaaaatatgcgtgagctttatagattggttctggtcgatacacccttggccccatacttctcggagtgcattacatctgaggatctggatgacatgaatattgagattatgaggaacactctgtacaaagcatatcttgaggatttttacaaattttgccagaaactgggtggtgctacagctgagattatgtgtgatctcctttcatttgaagccgacagaagagcggttaacattacaataaacagtattgggaccgagttgacaagagatgaccgcaggaagctgtactccaactttggtctattgtatccatatggtcacgaggaactggctgtctgtgaagatgttgaccaggtgcgtggtgcaatggagaagtacccaccataccagtcaattttttccaggatttcatatggagaaagccagatgttggataaggccttttatgaggaggaagtacggaggctatgcttgtcctttgagcagcagttccactatgctgttttcttcgcttacatcaggctacgcgagcaggagataaggaacctgatgtggatctctgaatgtgtcgctcagaaccagaagtccagggtccacgacagcgtcgtgttcatcttctgagcactcccacggcacaatatatgttgtacaaaatgaccgctttgatgatggcacaatcaattgcacccattataaacctgggacttaatattatgcctattccccctcgttcgatgcggcagaaagaggccagacctggagtcaatgtgttatttgttttgtagtaaaaaatataaaggcgtggttatctggtacaccgaataaaatcttgtctattcgttagaataagcgaaatcttgtgtattttgggacagtttttttttttgagccgaatgtattttgggacagttacacaggcaatgtgcagtttgctttcaaaaaaaaaaaaaaaaaaaa

SEQ ID NO: 1022 - protein, 351 aa, Panicum virgatum
  misc_feature: Ceres CLONE 1755309
  misc_feature (1)..(334): Pfam Name: vATP-synt_AC39 Pfam Description: ATP synthase (C/AC39) subunit
  misc_feature (1)..(336): Pfam Name: vATP-synt_AC39 Pfam Description: ATP synthase (C/AC39) subunit
  misc_feature (6)..(347): SWISSPROT Homolog: EC 3.6.3.14 Vacuolar ATP synthase subunit d
  misc_feature (9)..(351): SWISSPROT Homolog: EC 3.6.3.14 Vacuolar ATP synthase subunit d 1
MYGWEMLSFNIHDGFLEAIVRGNRSGLLTAADYNNLCQCETLDDIKMHLTATEYGPYLQNEPSPLHTTTIVEKCTLKLVDEYKHMLCQATEPLSTFLQYITYGHMIDNVVLIVTGTLHERDVNELLEKCHPLGMFDSIASLAVAQNMRELYRLVLVDTPLAPYFSECITSEDLDDMNIEIMRNTLYKAYLEDFYKFCQKLGGATAEIMCDLLSFEADRRAVNITINSIGTELTRDDRRKLYSNFGLLYPYGHEELAVCEDVDQVRGAMEKYPPYQSIFSRISYGESQMLDKAFYEEEVRRLCLSFEQQFHYAVFFAYIRLREQEIRNLMWISECVAQNQKSRVHDSVVFIF

SEQ ID NO: 1023 - DNA, 1999 bp, Panicum virgatum
  misc_feature: Ceres CLONE 1755375
  misc_feature: Encodes the peptide sequence at SEQ ID NO. 1024
agaggtggggagcagagggttgagggagggcggcaggtcgagcagctggcctgttgctggtgaagagctcttccttggctttcttggtggaggcttctcaaggttcagtccaatggcgttgagcaggggagcggtgctcttcttcaagctcctggcgtgcctcctctggctcttcgagctgtcccatggcaagaagcagttccccttgaagaacctccctcctctccggaaggccagcagctaccccacggggtgcccggcgacgctgtccctcaagtacaaggtgctgctgctggagagaggaggctccccatatggcaaccgcaacgtctcctacatggagaacttccacatcgggctgctgaatatggcgccggactcggcggcgcaggccttcatctccaccgatggcgtcatcaatgcccgggcgagggtgttgggcggtggcacctgtatcaatgctggcttctacagccgggccagctcaagcttcatccagcaggtcggctgggatgaagaactggtgaacaagtccttcccttgggttgaggagaagattgtccagtggcctaagattgcgccttggcaggctgcattacgggatgggctgctacaagcaggtgtagcccctttcaatgggtatacctacgatcatgtttctgggacaaaagtggggggcaccatttttgacgagaccgggtaccgccacacggctgctgacttacttgcagctggagatcctaacaacctgagggtgctgctccatgctagtgtgcacaggatagtgttcgactcacgacaaggatgcctgaagccaagggccattggagtccaattcactgatgaaaatggcaggcaccaccaagcatttctgaacaacaaaaaagatagcgaaataattgtatctgctggtgcaatcgggaccccccagttgcttctgctcagcggaattggaccgaagaaccacctcaaaagccataacattcctgtggttctccataataaatatgtgggtaaagggatggctgacaaccccatgaactccatcttcatacccacaagaagccctccacggcagtccctcattgaaactgttggaataactgaagaaggtgtgtttattgaggctagcagcggttttggccagtcatcagagagtgtccactgccaccatggaatcatgtccgccgagattgggcagctatctacaattcctccaaagcaaagaaccctggaagcagcccagaaatacactcagaacaaacttaacctacccaaagaggtattccatggcggttttatactcgagaagatcgatggtcctctgtccacaggtcatctggtcctcacagacactgatgtccggaacaacccagcagttaccttcaactacttcagtcatccacaggatctcaatcgttgcgtctatggtatcaagaccattgaaaggatactcaagacaaaccgtttctctgaactttctgctgatggcaccagattttcaatggaaagggtgctcaatatgagtgtgcaggctaatgtgaacctgatacccaagcatacaaatgacacagaatccctggagcaattttgcaaggacacagtgatcaccatctggcattaccatggtggatgccatgtagggaaggtggttgaccagcattaccgggtgcttggagtctcaggtctccgtgtagttgatggctcaatattttctagatcaccaggaacaaaccctcaagctactgtcatgatgatgggcagatacatgggagtaaagatcctaagggaaaggctgggacgtgcagctggagtgtagtcgattccaggacattagctttttattatgtgtggcctaggacagagattactaattttttgtgggatccagaatgaatcaccgaagaaaaacaagctacgagtttcatctgtacccagtagtcatttgtctaatatgatattgtagactgaatggttgattgaccccttcttttttctt

SEQ ID NO: 1024 - protein, 568 aa, Panicum virgatum
  misc_feature: Ceres CLONE 1755375
  misc_feature (1)..(156): Pfam Name: GMC_oxred_C Pfam Description: GMC oxidoreductase
  misc_feature (12)..(287): Pfam Name: GMC_oxred_N Pfam Description: GMC oxidoreductase
MALSRGAVLFFKLLACLLWLFELSHGKKQFPLKNLPPLRKASSYPTGCPATLSLKYKVLLLERGGSPYGNRNVSYMENFHIGLLNMAPDSAAQAFISTDGVINARARVLGGGTCINAGFYSRASSSFIQQVGWDEELVNKSFPWVEEKIVQWPKIAPWQAALRDGLLQAGVAPFNGYTYDHVSGTKVGGTIFDETGYRHTAADLLAAGDPNNLRVLLHASVHRIVFDSRQGCLKPRAIGVQFTDENGRHHQAFLNNKKDSEIIVSAGAIGTPQLLLLSGIGPKNHLKSHNIPVVLHNKYVGKGMADNPMNSIFIPTRSPPRQSLIETVGITEEGVFIEASSGFGQSSESVHCHHGIMSAEIGQLSTIPPKQRTLEAAQKYTQNKLNLPKEVFHGGFILEKIDGPLSTGHLVLTDTDVRNNPAVTFNYFSHPQDLNRCVYGIKTIERILKTNRFSELSADGTRFSMERVLNMSVQANVNLIPKHTNDTESLEQFCKDTVITIWHYHGGCHVGKVVDQHYRVLGVSGLRVVDGSIFSRSPGTNPQATVMMMGRYMGVKILRERLGRAAGV

SEQ ID NO: 1025 - DNA, 934 bp, Panicum virgatum
  misc_feature: Ceres CLONE 1755652
  misc_feature: Encodes the peptide sequence at SEQ ID NO. 1026
acgcgtcgattcttccacccaccgtcccacgagctcgcagccgccgccgggcttccagaagctccttcagcgcagggcgccaccatggctgcggaaggcaaggctccgtcgctcgcggaggagtattcactcccaccccaggaggtccaattgcaaaatccatctgaagagaaatctgctgctagcactgtggctgaagttgttcccgagaaaagtgctgaaaccccaccagctaatgaggctactgttgttgttgaagaaacaagtgaaactccagaggtgaaggaagcctctgaggagccagaagctgaggcaagccctgctgctgaagaaagtagtgaggctgctgaagaaagcagtgatgccgctgacgaaacagctgatgaaaaaccagaaattaagatcgagacagctccagcagattttcgtttcccaacaacaaatcaaacaagacattgcttcacgcgctatgttgaatatcataggtgtgtagctgcaaaaggggagggtgctcctgagtgtgaaaagtttgctaagtactacagatcactctgcccaagtgaatgggttgagcgttggaatgagcaacgtgaaaatggcacattccctggacccttgtaaagccgctcagcgccgagaaagcatgcttgatctcgcatcctaccttcgttgataacaacaggagacttcatttccttttgggagacttttgacaaaataaagtgttggcttatgtgcaaggattcacttttgaattccttcctgaacgttcattggatcgttcaaggattcatggtccccaattttgatgtacgtgttacaaccaagagctctttctggattatattatcttgtcactcgcttgctgcggagggacaggatatggaataaacgagagcttgttcctgcagtgcaaaaaaaaaaaaaaaaaaaa

SEQ ID NO: 1026 - protein, 178 aa, Panicum virgatum
  misc_feature: Ceres CLONE 1755652
  misc_feature (1)..(74): Pfam Name: COX6B Pfam Description: Cytochrome oxidase c subunit VIb
  misc_feature (114)..(178): SWISSPROT Homolog: EC 1.9.3.1 Cytochrome c oxidase polypeptide VIb
MAAEGKAPSLAEEYSLPPQEVQLQNPSEEKSAASTVAEVVPEKSAETPPANEATVVVEETSETPEVKEASEEPEAEASPAAEESSEAAEESSDAADETADEKPEIKIETAPADFRFPTTNQTRHCFTRYVEYHRCVAAKGEGAPECEKFAKYYRSLCPSEWVERWNEQRENGTFPGPL

SEQ ID NO: 1027 - DNA, 1148 bp, Panicum virgatum
  misc_feature: Ceres CLONE 1755688
  misc_feature: Encodes the peptide sequence at SEQ ID NO. 1028
aaagcttctggagacatcttctcgtctccctcccgccgtcgcgttcgcgtcctcttcgaatcgagtcgagaagcgccgcgatcgaaccaacgcatggcggacaaggagcccgtcgccgtgcgccccgaggcggccgaggaggaggacgacgcctccgccgccaccgccgccgccgccgcgggggaggaggaggacacgggcgcccaggtggcccccatcgtgcggctcgaggaggtcgccgtcaccaccggcgaggaggacgaggatgtactcctcgatatgaaagcaaagctctacaggttcgacaaagacgggaaccagtggaaggagcgtggcacgggcactgtcaagctcctaaagcataaggagaccggcaaggtccgcctcgtcatgcgccaggccaagacgctaaagatctgcgccaaccaccttgtggtctcgaccacgaagatgcaggagcacgccggcagcgacaagtcgtgcgtctggcacgctgcggatttcgctgatggtgagcttaaggaggagatgttcgctatccggttcggttctatagagaactgcaagaagttcaaggacttggtcgaggagattgctgagtctcttgcaaaggatgaaagcaaggtcaatgaagatggttcgtccacagcaggattgctggagaagctcaccgtaagtgagaacaaatctgaggaaggtgtgaagggggaatccacagaatctggcaaggaggcagaaaccaaatccgaggctaccccatctgagtagtggtactgcacactgcaaagaagattgcccagtggcgagtcagtttgtctgtccttctcgcaagtgaaagtttggtactcggtacccatgaaatatgctgctatcctttggggtgagtcggagcagagtcattgagtcatcttctaaagcgcgctcctgtctgggtagcctccattgttttaaaaggttaccgttcctgagttcaaggttggcgtttggatttggtctggtctgggcttggttttgttaaaaacttgaagttcattggtatgagttggaatgtttggtatgtgagtttgcaggtatttcgctgcatggatcgttatggactgcgttatattatgatacatgtgttataccaaaaaaaaaaaaaaaaaaaa

SEQ ID NO: 1028 - protein, 224 aa, Panicum virgatum
  misc_feature: Ceres CLONE 1755688
  misc_feature: Great-hit functional homolog of the protein sequence given in SEQ ID NO 9741
  misc_feature: Useful for biocontainment applications
  misc_feature: Useful for making plants with modulated flowering time
  misc_feature: The plant flowers significantly late compared to wild-type.
  misc_feature: The plant produces a reduced number of seeds.
MADKEPVAVRPEAAEEEDDASAATAAAAAGEEEDTGAQVAPIVRLEEVAVTTGEEDEDVLLDMKAKLYRFDKDGNQWKERGTGTVKLLKHKETGKVRLVMRQAKTLKICANHLVVSTTKMQEHAGSDKSCVWHAADFADGELKEEMFAIRFGSIENCKKFKDLVEEIAESLAKDESKVNEDGSSTAGLLEKLTVSENKSEEGVKGESTESGKEAETKSEATPSE

SEQ ID NO: 1029 - DNA, 1082 bp, Panicum virgatum
  misc_feature: Ceres CLONE 1755694
  misc_feature: Encodes the peptide sequence at SEQ ID NO. 1030
tgagttgagagcatctctggaggggatcatggaggaggagcggaaggtggatgcagcggcctttggtttcccggggccacacgtgtcgggtggatcggcatcggcgtcatgggcggcgccatggctaagcacctcctcgcggctgggttcgcagtcacggtgtacgctcgcacgccggccaaggcggagagccttgtcgccgctggcgcgagcctcgcggactcgccggcggccgtggctgctgcatccgatgtggtgttcactatggtcggaaaccccggcgacgtccgcgcggtggttctggaccccaccatcggcgccctcgccggcctccgccccggcggcgtgctggtggactgcacgagctcctccccttccctcgcgcgcgagatcgccgcggctgcaagcgcggcaggctgctacgccgtcaacgcgccagtctcgggggcgacgtcggcgcccgcgacgggacgctggccatcttcgccggcggccggcgaagaggccgtggtcgcctggctcgccccgctcttcgcccacctcggcacggcgacccacatgggcgcgcccggcagcggccacagcagcaagatcgccaaccagatcgcggtggccggcgcggtggtgggcctgggcgagtccgtggccttcgccaacgccgcggggctcgatgcgccgctgttcctcgacgcggtgtccaagggcgcggcgggctcgcgcatcatggacatcttcggcgaccgcgtgctgcgccgcgagttcgggtacgggggcagcgtgcgctacatcgtcaaggacctcagcatggcgctggaggtcggggacggtcaggaggagtcgaatgtgctgcccggagccacgctgtaccgccagatgttcactgctatggtggccaatggcgacggcgacctgagcttgcagggactgatcaccgtcgttgagcgcttgaacggcattggcaagtaaggcaggctgcaggcaagatgttcgccggaatgccgcattgcatttgaaaactttttgtattttgtctgtctgaataaagtttgggaccatgggtttaaaaaaaaaaaaaaaaaaaa

SEQ ID NO: 1030 - protein, 285 aa, Panicum virgatum
  misc_feature: Ceres CLONE 1755694
  misc_feature (12)..(164): Pfam Name: NAD_binding_2 Pfam Description: NAD binding domain of 6- phosphogluconate dehydrogenase
MGGAMAKHLLAAGFAVTVYARTPAKAESLVAAGASLADSPAAVAAASDVVFTMVGNPGDVRAVVLDPTIGALAGLRPGGVLVDCTSSSPSLAREIAAAASAAGCYAVNAPVSGATSAPATGRWPSSPAAGEEAVVAWLAPLFAHLGTATHMGAPGSGHSSKIANQIAVAGAVVGLGESVAFANAAGLDAPLFLDAVSKGAAGSRIMDIFGDRVLRREFGYGGSVRYIVKDLSMALEVGDGQEESNVLPGATLYRQMFTAMVANGDGDLSLQGLITVVERLNGIGK

SEQ ID NO: 1031 - DNA, 1242 bp, Panicum virgatum
  misc_feature: Ceres CLONE 1755739
  misc_feature: Encodes the peptide sequence at SEQ ID NO. 1032
agccatctatcgatcagatccatcgcaaacaccaagcaagcgtcgtagccagccaagccgcctctcgcctcgagaaaaccagcgagcctaaacctcgcgcaatggccgccgccggtaatggcatcgtggtggtgttcgacttcgacaagaccatcatcgacgtcgacagcgacaactgggtggtggacagcctgggcctcacggaggagttcgagcgccttctccccaccatgccgtggaacaccctcatggacaccatgatgggggagctccacgcgcgcggggcgaccctggccgacgtcgccgcggcgctgcgcgcggcgcccatcgacccgcgcgtgccggccgccatccgcgcggccgccgcgctcgggtgcgacctgcgcgtcctcagcgacgccaacgccttcttcatcgaaaccgtcctcgagcaccacggcctccgcggctgcttcaccgaggtcaacaccaacccgagccgcgtcgacgccggcggccccctccgcatcgagccctaccacgacttcctccgcggggcgccgcacgggtgcggcgtcggcacctgcccgcccaacatgtgcaagggccaggtgctggaccgcatcctccgcgaggccgccgccgcggcgcccgcggggaggaagccgcgcgtcatctacctgggcgacggccgcggcgactactgcccggcgctgcggctggcgcgggaggacttcgtgatgccgcgtcgcgggtaccccgtgtgggacctcattcgcgaggaccccgcgcgggtgcaggccgaggtgcacccctgggccgacggcaccgagatggaggccacgctgctggggctcgtcaggagggcgctcgtcgaggacgccgccgcgctgctgccgctcgactgcaagctcgagtccaccatgcccgccgccgcgcaggacggcggcatgcccatcatgccgctcggcgtcaagaactgatcgaccattgtattcgaagaccggccggaaaagattgccggttcgggttcgttcgtggcgatcgcgagctcgatcgaacaactgcgaggcacggccgattacttactagtgtttaactggagtacttattattgactaatttttgtgcgtggcgtgtggcgttgcgtatccctgattgagcctgtcaccgctgaattggcgacggctcactgtatcttaccgaccaacaaaagataaattaatggatgagaaattccgcgaaaaaaaaaaaaaaaaaaaa

SEQ ID NO: 1032 - protein, 286 aa, Panicum virgatum
  misc_feature: Ceres CLONE 1755739
  misc_feature (1)..(234): Pfam Name: Put_Phosphatase Pfam Description: Putative Phosphatase
MAAAGNGIVVVFDFDKTIIDVDSDNWVVDSLGLTEEFERLLPTMPWNTLMDTMMGELHARGATLADVAAALRAAPIDPRVPAAIRAAAALGCDLRVLSDANAFFIETVLEHHGLRGCFTEVNTNPSRVDAGGPLRIEPYHDFLRGAPHGCGVGTCPPNMCKGQVLDRILREAAAAAPAGRKPRVIYLGDGRGDYCPALRLAREDFVMPRRGYPVWDLIREDPARVQAEVHPWADGTEMEATLLGLVRRALVEDAAALLPLDCKLESTMPAAAQDGGMPIMPLGVKN

SEQ ID NO: 1033 - DNA, 1039 bp, Panicum virgatum
  misc_feature: Ceres CLONE 1755794
  misc_feature: Encodes the peptide sequence at SEQ ID NO. 1034
gcacttttcctgtacaaatcgaaacaaatttccacccctgctcggggcagctacagtacaagcagcagcgaaggggataaacgagcgacctcgaagctcggccggcgcggcgatggaggtcaagtgccggcgcctggaggggaaggtggccgtcgtgacggcgtccacgcaggggatcggcctcgccatcgccgagcgtctcggcctggagggcgccgccgtcgtcatctcctcgcggaagcagaagaacgtggacgacgcggtgaaggggctcaaggcaaaggggatcaccgcggtcggcgccgtctgccacgtctccgacgcccagcagcgcaagagcctcatcgacacggcagtcaagaactttggacacattgatattcttgtctcgaatgccgctgcaaatcctactgtagatggcattcttgaaatgaaagaggctgttcttgataaactatgggatattaacgtcaaggcttctattcttcttcttcaggatgctgctccccacctacgtcagggatcatctgtgattattatttcttcaattgctgggtacaatccagaaaaagagttgacaatgtatggtgttacaaagactgctctcttaggtctcacaaaggctcttgctggtgagatgggacccaatactcgtgttaactgtatagcccctggtttcgttcctacacggtttgctagtttcctcacaacaaatgaggccattaggaaagagcttattgacaggtccacgcttaagagattgggttctgtggaagacatggctgcggttgctgcattcctggcttctgacgatgcgtccttcatcacagctgaaaccattgttgttgctggagggacacagtctagattgtaaatctggctaaagtttaattggcatgctcgaataatctgtactagcaccacatatgactataccagtgcatttagagggtgtagcaactatactgtaataattggctgtgaagctccgttgtgctaagttgtactgtttgttttttaaaaaaaaaaaaaaaaaaaa

SEQ ID NO: 1034 - protein, 253 aa, Panicum virgatum
  misc_feature: Ceres CLONE 1755794
  misc_feature (1)..(167): Pfam Name: adh_short Pfam Description: short chain dehydrogenase
  misc_feature (8)..(253): SWISSPROT Homolog: EC 1.1.1.184 Dehydrogenase/reductase SDR family member 4
MEVKCRRLEGKVAVVTASTQGIGLAIAERLGLEGAAVVISSRKQKNVDDAVKGLKAKGITAVGAVCHVSDAQQRKSLIDTAVKNFGHIDILVSNAAANPTVDGILEMKEAVLDKLWDINVKASILLLQDAAPHLRQGSSVIIISSIAGYNPEKELTMYGVTKTALLGLTKALAGEMGPNTRVNCIAPGFVPTRFASFLTTNEAIRKELIDRSTLKRLGSVEDMAAVAAFLASDDASFITAETIVVAGGTQSRL

SEQ ID NO: 1035 - DNA, 1271 bp, Panicum virgatum
  misc_feature: Ceres CLONE 1755821
  misc_feature: Encodes the peptide sequence at SEQ ID NO. 1036
cttgtacccggggctacactgtgctgttgtcagcgacggaagcagtgtccaagatggtggccttgttagctgcagatcatcaggcgccatggctagcgtcatcgtcctcgtcgccggcggtcccggtttggttcgccctgctggtggccctcggcctggtcgccgtggtccggtccgcggccgccttcctcgcgtggctgcaccgcgcgttcctccgcccgggccgcgacctggccggccggtacggggcgtgggcggtggtgaccggcgccacggacggcatcggccgcgcggtggcgctggagctcgcgcgccggggcctgcacctcgtcctcgtgggtcggagccccgccaagctggcgcgcgtggggaaggaggtccgcgccgccgcgccgtcgtgcgaggtgcggggcgtggcgttcgacctcgccgccgcgggggaggacgccgcgcggcgcggcgtggcgcgggtggcggccgccgtggagggccgggacgtgggcgtcctcgtcaacaacgccggcgcgacgtacccgtgcgcggcctacttccacgaggtcgagggccccgtgtgggaggccgtggtgcgggtcaacgtggaggccgcgacgcggatcacgcgcgccgtcctgccgctcatggcggcgaggggaagggacgccgtcgtcaacgtcggctctggctcctccgtcgtggtgccggcgttcccgctctacgccgtctacgcggcgaccaaagcgtacgttgataaattttctcgaagcttgagcgttgaatacaaacaatatggagtagacgtgcaatgccagatccctctgtatgtcgctaccaagatgtccccggtcaagggtgattctccattcataccatcgccagaggagtacgccaagtttgctcttcgttgcattggctatgaggcaaggtgcctcccgtattggcgccactcagtccaggggttcttggcatcgttagtgccagatgctgctctcaaccagtggcgcctccgaattggcatccggaaaagaaacgagatgaaggctctgcttgaagagaaagtcttcagttaaattgttgtacatattgtatcgtgatgatgggtttcaatatctgtgctctgtttggacttctgagaaacttaattgagtagtctcgcaaccagcactgtcttagtcaattggagaatgactggaaataatcggttgtgtataactcgtgatgttttatgagatgtaaaatgttgctgttttcatgaaaaaaaaaaaaaaaaaaaa

SEQ ID NO: 1036 - protein, 337 aa, Panicum virgatum
  misc_feature: Ceres CLONE 1755821
  misc_feature (1)..(179): Pfam Name: adh_short Pfam Description: short chain dehydrogenase
MVALLAADHQAPWLASSSSSPAVPVWFALLVALGLVAVVRSAAAFLAWLHRAFLRPGRDLAGRYGAWAVVTGATDGIGRAVALELARRGLHLVLVGRSPAKLARVGKEVRAAAPSCEVRGVAFDLAAAGEDAARRGVARVAAAVEGRDVGVLVNNAGATYPCAAYFHEVEGPVWEAVVRVNVEAATRITRAVLPLMAARGRDAVVNVGSGSSVVVPAFPLYAVYAATKAYVDKFSRSLSVEYKQYGVDVQCQIPLYVATKMSPVKGDSPFIPSPEEYAKFALRCIGYEARCLPYWRHSVQGFLASLVPDAALNQWRLRIGIRKRNEMKALLEEKVFS

SEQ ID NO: 1037 - DNA, 1297 bp, Panicum virgatum
  misc_feature: Ceres CLONE 1755954
  misc_feature: Encodes the peptide sequence at SEQ ID NO. 1038
gaagatgcaacgcgaagccagacaatagcatcctgacaggaacccatggatccggactctgacgaggtggtgttcgacctcccggagcacttccgcatctacaagagcggccgcatagatcgtttccaccgaccagtgctcgttgccgcgggtgtcgacggcgaagccagcggcgtcgcaaccaaggacgtcgtcctcgacgccgccaccggcctcaccgtgcgcctcttcctgcccaaacgccaagaacgaccttccggtaagaagctccccgtcctcgtcttcttccacggcggcgggttcatcatcgagtccgccaagtccgccatgtaccacaactacctcacctccctcgccgccgcggccggtgtcctcggggtgtccgtcgactaccgcctcgcccccgagcaccggctccccgcggcctacgacgactgctggaccgcgctccagtgggcggcgtccgcgcgggacgactggctcgccgagcacggcgacgcgtcccgcgtcttcgtcgccggcgacagcgccggcggcaacaccgtgcacaacgtgctggtgagggcgtcgtcggcggaaaacgcggcgaggatcgagggcgcggtcctgctccacccgtggttcggcgggagcacggccatcgagggggagccggagcgcgcggtcgtgaacaccgccaagtggtgggcctccgcgtgcccggacgcggccgacggcgcggacgacccgaggatcaacccgaccgcgccgggcgcgccggcgctggagcgcctcgggtgcgagcggatgctggtgtgcgcggcggagaaggactgggtggcggcggcgagggaccgcgcgtactacgacgccgtggcggcgagcgcgtggcccgggagcgcggcgtggctggagacggaaggggaggagcatgtgttcttcctgctgaagcccgagtgcgaccgggccaaggcgctcatggaccgcgtcgtggcgttcatcgccggagcatgagctacaccgcgttcatggagcaggagcaattgtgtcttgatggaacgacgactgctcagaatagcgacggaacaagctgggtatcaggatatcagcagtggccatggttccccatgcattcataaatcataagaaaggctacaataagaaggtttttctattaaaaactctgttaagatttgttgtggccatttagatatgctttgtgctgctatgttggaattttcttttgttaactgaacgacatgccgagagatcccgtcaatttccattcttttagatccaaaaaaaaaaaaaaaaaaaa

SEQ ID NO: 1038 - protein, 315 aa, Panicum virgatum
  misc_feature: Ceres CLONE 1755954
  misc_feature (1)..(215): Pfam Name: Abhydrolase_3 Pfam Description: alpha/beta hydrolase fold
MDPDSDEVVFDLPEHFRIYKSGRIDRFHRPVLVAAGVDGEASGVATKDVVLDAATGLTVRLFLPKRQERPSGKKLPVLVFFHGGGFIIESAKSAMYHNYLTSLAAAAGVLGVSVDYRLAPEHRLPAAYDDCWTALQWAASARDDWLAEHGDASRVFVAGDSAGGNTVHNVLVRASSAENAARIEGAVLLHPWFGGSTAIEGEPERAVVNTAKWWASACPDAADGADDPRINPTAPGAPALERLGCERMLVCAAEKDWVAAARDRAYYDAVAASAWPGSAAWLETEGEEHVFFLLKPECDRAKALMDRVVAFIAGA

SEQ ID NO: 1039 - DNA, 1725 bp, Panicum virgatum
  misc_feature: Ceres CLONE 1756141
  misc_feature: Encodes the peptide sequence at SEQ ID NO. 1040
aaaccccctgttcaagcgcgagtgcggagtgcggacagagaggtggcacagcagccacgagcccccaagatcccggcctccccggcggcaccctccgcgtcgtgagatctttgcagagagagagagagagagagagagagagagagagagagagagatcggccatggcgctgagggcgtcgtcccccgtgtcgcacgtggcggcgccgctgccgccgtgcgggccgaggaggagggcgagcggggtggtggtggccatggcgtccaccatcaacagggtcaaaactgtcaaagaaccctatactccaccacgagaggtgcgtcgccaagttacccattcactaccagcccaaaagaaggaaatttttgattcacttcaaccttgggccaaggataacttgttgaaccttctgaagccggttgagaagtcatggcagccacaagacttcctaccagagccttcttctgatgggttttacgatgaagttaaagaactgagggagcaggcaaaggaaatacctgatgagtattttgtttgtttagttggtgacatggttactgaggaagcactacctacctatcaaacaatgctcaacacccttgatggagttcgggatgaaactggtgcaagtccaaccacttgggctgtttggacgagggcgtggacagctgaagagaacaggcatggtgatctccttaataagtacatgtaccttactggacgggttgacatgaaacaaattgagaagaccatacagtatctgattgggtctggaatggatccaggtactgagaacaatccctatttgggtttcctttacacatcattccaagagagagcaacatttatatctcatggcaataccgcaaggcatgccaaggagtatggtgatctcaagctggctcagatatgtggcacaatagcagctgatgaaaagcgccatgagacagcctacaccaagatagtcgagaagctctttgagatcgatcctgactacacggtgatggcgtttgccgacatgatgaggaagaagatcacaatgcctgctcatctcatgtacgatgggaatgacaaccacctgtttgagcacttcagcgcggtggcgcagaggctgggcgtctacaccgctaaagactacgccgacatccttgagttcttggtccagaggtggaaagttgctgatctaacagggttatctggagaagggaggagggcgcaggactttgtctgtaccttagcaccgagaatcaggaggttggatgagagagctcaagcaagggcaaagcagggactggttattcctttcagttggatatatgaccgcaaggtgcaactttaattgattgtggtaggcaatgggagcacattctatatccgttttgagtcctggagttctatataagaaagcagcctttaggttatctagctgggtagaattcaactgcttatcaatctcacttacgcaaagtatgcatgctatcagttgtcttgtgtgttgcaagtttggatctggtgtaagactcatgtgagttgcctttctggcagccacggacggttccattgcaactgagaaaacttgtgtcgtattgaatatctagtgtgagatttacaggacttataagttccaaagtaataatatggagattgtatatggacaagcttgccatggtgcatgttgcgaatctaagattaagtactttccgttaaaaaaaaaaaaaaaaaaaa

SEQ ID NO: 1040 - protein, 391 aa, Panicum virgatum
  misc_feature: Ceres CLONE 1756141
  misc_feature (1)..(329): Pfam Name: FA_desaturase_2 Pfam Description: Fatty acid desaturase
  misc_feature (10)..(391): SWISSPROT Homolog: EC 1.14.19.2 Acyl-[acyl-carrier-protein] desaturase, chloroplast precursor
  misc_feature (5)..(391): SWISSPROT Homolog: EC 1.14.19.2 Acyl-[acyl-carrier-protein] desaturase, chloroplast precursor
MALRASSPVSHVAAPLPPCGPRRRASGVVVAMASTINRVKTVKEPYTPPREVRRQVTHSLPAQKKEIFDSLQPWAKDNLLNLLKPVEKSWQPQDFLPEPSSDGFYDEVKELREQAKEIPDEYFVCLVGDMVTEEALPTYQTMLNTLDGVRDETGASPTTWAVWTRAWTAEENRHGDLLNKYMYLTGRVDMKQIEKTIQYLIGSGMDPGTENNPYLGFLYTSFQERATFISHGNTARHAKEYGDLKLAQICGTIAADEKRHETAYTKIVEKLFEIDPDYTVMAFADMMRKKITMPAHLMYDGNDNHLFEHFSAVAQRLGVYTAKDYADILEFLVQRWKVADLTGLSGEGRRAQDFVCTLAPRIRRLDERAQARAKQGLVIPFSWIYDRKVQL

SEQ ID NO: 1041 - DNA, 1572 bp, Panicum virgatum
  misc_feature: Ceres CLONE 1756221
  misc_feature: Encodes the peptide sequence at SEQ ID NO. 1042
cagcccatcaaacgactagacgctggtcaagcagcaccaaccctaggcccctccccctcctcctctcccttcgcgagcggcggcgaggaaggcgacgaggaagccatggattcctccggcggcggcggcggcggcggtggcgcgccgatcagggggatggcgacgcacggcgggcggtacgtgctgtacaacgtgtacggaaacctcttcgaggtctcctccaagtacgcgccgcccatccgccccatcggccgcggcgcctacggcattgtctgtgcggctatgaactcggagacaagcgaggaggttgcgatcaagaaggttggcaatgccttcgacaaccacatcgacgccaagcggacactgagggaaatcaagctgctccgccacatggaccacgagaacatccttgccttaaaggatgtaatacgcccaccaagtagagagaactttaatgatgtctacattgttactgagttaatggataccgatctccatcagattatacgctcaaatcagccattgactgatgatcattgccagtacttcttgtatcagttgctacgagggctaaaatatgtgcactcagcaaatatattgcaccgtgatctaaagccaagcaatttgttcctaaatgcaaattgtgacctcaagatcgcagactttgggcttgcaaggaccacttcggaaacagatctcatgacagagtatgtggtcactcgttggtaccgggcaccagagttgctgttgaactgttcacagtatactgctgcgattgatgtctggtcagttggatgcatactaggtgaaattgttactcgccaacccctgtttcctggacgggactacatccagcaattaaaactgatcactgagctcataggctcaccagatgatgcaagcttgggatttcttcgaagtgataacgcaaaaagatacatgaaacaactaccacagtttccaaggcaggacttccgcttgcgtttccgcaacatgtctgctggtgcagttgatttgttggagagaatgctcgtgtttgatccaagcagacggatcacagttgatgaggctctgcatcacccatacttggcttctcttcatgatatcaatgaagaacctacctgccctgcacctttcagctttgattttgagcaaccatcgtttacagaagcacatataaaagaactcatctggagggaatctttggctttcaacccggatcctccctactaagaacaaaggataagttatctgctcaaggcatctgaagatctctagctccagcggatgctaaaacttatgtctgtgtgcatagattattttcacgctgcttgctggaagaacgggcatgggttgctgctgcaatagcaattcccttaaaggcttgtgagaacaaacactgtttgtttgttccctttcagatgcctgaacccaggcttgtattataccggttgatttcacaaactattcttatgtatctaagattgtaattttgtagacgattacttgaacgacccctgtatatctaatatctgagttgacatcgcttcccaaaaaaaaaaaaaaaaaaaa

SEQ ID NO: 1042 - protein, 375 aa, Panicum virgatum
  misc_feature: Ceres CLONE 1756221
  misc_feature (1)..(375): SWISSPROT Homolog: EC 2.7.11.24 Mitogen-activated protein kinase 6
  misc_feature (6)..(373): SWISSPROT Homolog: EC 2.7.11.24 Mitogen-activated protein kinase 2
MDSSGGGGGGGGAPIRGMATHGGRYVLYNVYGNLFEVSSKYAPPIRPIGRGAYGIVCAAMNSETSEEVAIKKVGNAFDNHIDAKRTLREIKLLRHMDHENILALKDVIRPPSRENFNDVYIVTELMDTDLHQIIRSNQPLTDDHCQYFLYQLLRGLKYVHSANILHRDLKPSNLFLNANCDLKIADFGLARTTSETDLMTEYVVTRWYRAPELLLNCSQYTAAIDVWSVGCILGEIVTRQPLFPGRDYIQQLKLITELIGSPDDASLGFLRSDNAKRYMKQLPQFPRQDFRLRFRNMSAGAVDLLERMLVFDPSRRITVDEALHHPYLASLHDINEEPTCPAPFSFDFEQPSFTEAHIKELIWRESLAFNPDPPY

SEQ ID NO: 1043 - DNA, 1023 bp, Panicum virgatum
  misc_feature: Ceres CLONE 1756231
  misc_feature: Encodes the peptide sequence at SEQ ID NO. 1044
aagcaaagcgaagcagctagccagtcaatcgtgagttcgtgactgaaaatggcggaggaggtggaagcgacggcggggcggccgaggctgtactcgtactggcgcagctcgtgctcccaccgcgcccgcatcgccctcaatctcaaaggcgtggactacgagtacaaggcggtgaacctcctcaagggcgagcagtctgatccagaattcctgaagctgaatcctatgaagtttgtccctgcgctggttgatggtgatgcagtaattggtgactcttatgcaatagcattgtatttggaggacaagtaccccgaccctcctcttttgcctcaagaccctaaaaagaaggctttgaatcaccaaattgcgaacattgtaagctctggtattcaacctctccataatctctcagtgttgaggttcattgagcaaaaagttggtgccggagagagtgtcttgtggacccaacaacaaatcgagagaggtttcacagcaattgaaaacctgatacaactaaaagactgtgctgggaagtatgcaacaggagatgaagtccaactggcagatgtattcctcgctccccagatttatgcagccatcgagcgcactaaaatcgacatgtcgaattaccccacccttgcgaggctccacgcagagtacatggcgcaccctgcattccaagcagcgctccctggtcagcaaccggacgcccctccctccacataggaactgcggtgttgttgcctcgtcagccttgtatattgctcatcttgctgaatatagatttggagttgttacttgctcgctgaacgctgattttactctgtaataggaataagcacagaatttcctgtgcacggggcaaataattttctggttttaaaaaactaccggaatagagtggtctctggccttgttcaggacttgaggtaggcatctcatgtagggtttgttcagctgtaaaattttccatggatacacaaattgagtccagtgattagtgaaaaaaaaaaaaaaaaaaaa

SEQ ID NO: 1044 - protein, 225 aa, Panicum virgatum
  misc_feature: Ceres CLONE 1756231
  misc_feature: Great-hit functional homolog of the protein sequence given in SEQ ID NO 9330
  misc_feature (1)..(95): Pfam Name: GST_C Pfam Description: Glutathione S-transferase, C-terminal domain
  misc_feature (1)..(72): Pfam Name: GST_N Pfam Description: Glutathione S-transferase, N-terminal domain
  misc_feature (1)..(225): SWISSPROT Homolog: EC 2.5.1.18 Glutathione S-transferase zeta class
  misc_feature (13)..(225): SWISSPROT Homolog: EC 2.5.1.18 Glutathione S-transferase zeta-class 1
  misc_feature: Useful for biocontainment applications
  misc_feature: The plant produces a reduced number of seeds.
MAEEVEATAGRPRLYSYWRSSCSHRARIALNLKGVDYEYKAVNLLKGEQSDPEFLKLNPMKFVPALVDGDAVIGDSYAIALYLEDKYPDPPLLPQDPKKKALNHQIANIVSSGIQPLHNLSVLRFIEQKVGAGESVLWTQQQIERGFTAIENLIQLKDCAGKYATGDEVQLADVFLAPQIYAAIERTKIDMSNYPTLARLHAEYMAHPAFQAALPGQQPDAPPST

SEQ ID NO: 1045 - DNA, 1077 bp, Panicum virgatum
  misc_feature: Ceres CLONE 1756255
  misc_feature: Encodes the peptide sequence at SEQ ID NO. 1046
gcagaggggagccgcgccgcgcagaccaaactccctcccaaaagcccctcgccggccgcgactgaatcaggcgcccaggatggcccgctacgaccgcgcgatcaccgtcttctcccccgacggccacctcttccaggtcgagtacgccctcgaggccgtccgcaagggcaacgccgccgtcggcgtccgcggcgtcgacaccgtcgtcctcggcgtcgagaagaagtccacccccaagctgcaggactccaggtccgtgcgcaagatcgcgagcctggacacccacatcgcgctggcctgcgcggggctcaaggccgacgcgcgcgtcctcatcaaccgcgcccgcatcgagtgccagagccaccgcctcaccgtcgaggaccccgtcaccgtcgagtacatcacgcgcttcatcgccggcctgcagcagaagtacacgcagagcggaggggtccgccccttcggcctctccaccctcatcgtcgggttcgacccctacaccaacaagcccgccctgtaccagaccgacccgtcggggaccttctccgcctggaaggccaacgccaccggccgcaactccaactccatgcgcgagttcctcgagaagaactacaaggagacgtcaggcaaggagaccatcaagctcgccatcagagcactccttgaggttgttgagagtggtggcaagaacattgaggttgcagtgatgacacacaaggatggccttcgcgaacttgaagaggcagagattgatgaatatgttgctgagatcgaggcagagaaggccgccgctgaagctgcaaagaagggcgcgccgaaggaaacatgatccagcacagcaactctagacaactcttgttccacagcgtgccttaggattcacatcttttagacggaggcctggtttgggtgaagggatttttatttctgttgaagttgcttcggtgaaactcctcatgctatattgctacgcggatgcacactgttgcatccgccatgctggtgaactagtaattgttgtcgcagtgttggtcttacagtatatctgagttctgataaaaaaaaaaaaaaaaaaaa

SEQ ID NO: 1046 - protein, 249 aa, Panicum virgatum
  misc_feature: Ceres CLONE 1756255
  misc_feature (1)..(249): SWISSPROT Homolog: EC 3.4.25.1 Proteasome subunit alpha type 7
MARYDRAITVFSPDGHLFQVEYALEAVRKGNAAVGVRGVDTVVLGVEKKSTPKLQDSRSVRKIASLDTHIALACAGLKADARVLINRARIECQSHRLTVEDPVTVEYITRFIAGLQQKYTQSGGVRPFGLSTLIVGFDPYTNKPALYQTDPSGTFSAWKANATGRNSNSMREFLEKNYKETSGKETIKLAIRALLEVVESGGKNIEVAVMTHKDGLRELEEAEIDEYVAEIEAEKAAAEAAKKGAPKET

SEQ ID NO: 1047 - DNA, 1234 bp, Panicum virgatum
  misc_feature: Ceres CLONE 1756297
  misc_feature: Encodes the peptide sequence at SEQ ID NO. 1048
cccgctcttgctcgatccctagcttctccactgcctccgatcctccctctccccgtccttctgtaaagaaagttcagggtccgatattcgctttcgtttcgcagagagtggtgtgggggctccggccggcggcgaagccaccatgggggagatcaccaacgtcatggagtaccaggccatcgcggagcagaagcttcccaagatggcctacgactactacgcctccggcgccgaggacgagtggacgctcaaggagaaccgggaggccttctccaggatcctattccgccctcgcatactgatcgatgtgtccaagattgacatgaccacaagtgttctgggcttcaatatttcaatgcccattatgattgctcccactgcctttcagaaaatggctcacccagatggggagtatgcaactgcacgggcagcatcagcagcagggactatcatgacactgtcgtcatgggctacttcaagcgtcgaggaggtcgcctcgaccggaccaggaatccgtttcttccagctatatgtacaaggacaggaaggtggtggagcagctgtgagaagggccgagagggccgggttcaaggcgatcgcgctcaccgtggacaccccacgcctcggccttcgcgaagccgacatcaagaacaggttcgttctgccgccacacctgacgctgaagaactttgagggcctggacctcggcaagatggaccagtcgaaccacggcgcgcgccagctggactacgtgccggccaccatcagcgccctcgaggaggtcgtgacggcggcccaggggcgcatcccggtgtacctcgacggcggcgtccgccgcggcaccgacgtcttcaaggcgctcgccctcggcgcctccggcatcttcgtcgggaggccggtggtgttcgcgctggcggcggagggcgaggcgggcgtccggaacgtgctgcggatgctgcgggaggagttcgagctgaccatggcgctcagcggatgcacgacgctggccgacatcaaccgcagccacatcctgaccgagggcgaccgcctccgccccacgcccagattgtgagacttctagagtaagacgaatttgaccatgaaattttatatatagatgatgtaatttgagaagcacattcatgatttttttcagaattttttgaaactttgtttagtaggtttgcacgggtttgcacgaggttcttggtttgcaaaaaaaaaaaaaaaaaaa

SEQ ID NO: 1048 - protein, 309 aa, Panicum virgatum
  misc_feature: Ceres CLONE 1756297
  misc_feature (1)..(239): Pfam Name: FMN_dh Pfam Description: FMN-dependent dehydrogenase
  misc_feature (3)..(249): SWISSPROT Homolog: EC 1.1.3.15 Peroxisomal (S)-2-hydroxy-acid oxidase
MGEITNVMEYQAIAEQKLPKMAYDYYASGAEDEWTLKENREAFSRILFRPRILIDVSKIDMTTSVLGFNISMPIMIAPTAFQKMAHPDGEYATARAASAAGTIMTLSSWATSSVEEVASTGPGIRFFQLYVQGQEGGGAAVRRAERAGFKAIALTVDTPRLGLREADIKNRFVLPPHLTLKNFEGLDLGKMDQSNHGARQLDYVPATISALEEVVTAAQGRIPVYLDGGVRRGTDVFKALALGASGIFVGRPVVFALAAEGEAGVRNVLRMLREEFELTMALSGCTTLADINRSHILTEGDRLRPTPRL

SEQ ID NO: 1049 - DNA, 1186 bp, Panicum virgatum
  misc_feature: Ceres CLONE 1756306
  misc_feature: Encodes the peptide sequence at SEQ ID NO. 1050
gaaccatccaaaagagaagaagaaacaagcaagtagcaatactctctttcttgtaacatagcgcagcaaaggttactcacttacatggcaacttccattggttgcctcgtcttgctctgccttgtttctcccctccttgccagtgccgtccacggccacccatggggcggcttgttccctaggttctacgaccattcatgccccaaggcgaaggagattgtgcagtccattgtagcacaggctgtggccaaggagaccaggatggcggcatccttggtcagactgcatttccatgactgctttgtcaaaggctgcgatgcatccgtgctgttggacaacagcagcagcatagtcagtgagaaagggtctaaccccaacaggaactccctcagagggtttgaggtggtcgaccagatcaaggccgctctcgaggctgcctgcccaggcactgtctcctgcgccgacatcctcgccctcgcagcccgtgattcaactgtcctggttggtggcccatactgggacgtgcctctcggccggagggattcgctcggtgcaagcatccagggctccaacaacgatatcccagcccccaacaacaccctcccaaccatcatcaccaagttcaagcgccaaggcctcaacgttgtggacgtcgtcgccctctccggtggccacaccataggtatgtctcggtgcaccagcttccgtcagaggctgtacaaccaaacgggcaatggcatggctggcagcacactggatgtatcgtacgcggcacagctgaggcaggggtgcccccgctctggcggcgacaataacctcttccccttggacttcgtcaccccagccaagtttgacaatttttactacaagaacctcctggctggcaagggcctcctcagctctgatgaggttctgttgaccaagagcgccgagacagcagccctcgtgaaggcatatgctgctgatgtcaatctcttcttccagcactttgcgcagtctatggtgaacatgggcaacatctcaccactaaccgggtcacagggcgagatccggaagaactgcagaaggctcaacaacgaccactgaggctgctttatgtactgaaattgtatctgatgttggtgatataatttgttcaaataagcaagcatggctatgattttatcaaaaaaaaaaaaaaaaaaaa

SEQ ID NO: 1050 - protein, 333 aa, Panicum virgatum
  misc_feature: Ceres CLONE 1756306
  misc_feature: Great-hit functional homolog of the protein sequence encoded by LOCUS At5g66390
  misc_feature (1)..(249): Pfam Name: peroxidase Pfam Description: Peroxidase
  misc_feature (1)..(331): SWISSPROT Homolog: EC 1.11.1.7 Peroxidase 72 precursor
  misc_feature (23)..(331): SWISSPROT Homolog: EC 1.11.1.7 Peroxidase 15 precursor
  misc_feature: Useful for making plants with altered cell wall content and/or composition
MATSIGCLVLLCLVSPLLASAVHGHPWGGLFPRFYDHSCPKAKEIVQSIVAQAVAKETRMAASLVRLHFHDCFVKGCDASVLLDNSSSIVSEKGSNPNRNSLRGFEVVDQIKAALEAACPGTVSCADILALAARDSTVLVGGPYWDVPLGRRDSLGASIQGSNNDIPAPNNTLPTIITKFKRQGLNVVDVVALSGGHTIGMSRCTSFRQRLYNQTGNGMAGSTLDVSYAAQLRQGCPRSGGDNNLFPLDFVTPAKFDNFYYKNLLAGKGLLSSDEVLLTKSAETAALVKAYAADVNLFFQHFAQSMVNMGNISPLTGSQGEIRKNCRRLNNDH

SEQ ID NO: 1051 - DNA, 1433 bp, Panicum virgatum
  misc_feature: Ceres CLONE 1756459
  misc_feature: Encodes the peptide sequence at SEQ ID NO. 1052
attggctgttgggaagcatgagctggtggtgggcaggcgccatcggcgcggcctggaagcgccaggacgaccgcgccgccgtgtcgccgtcccagcaggccttcaagagcgtggcgctcgtcgtcggctccaccggcatagtgggcgcctcgctcgtcgacatcctcccgcagccggacactcccggcgggccatggaaggtatacgcgctctcccgccgccctcccccgccttggtccccgccgtcgtcctccgtgactccaatacatgttgatctcaccgactacaccgccgccgccgcggccctcgcgccactcaccgacatcacccacgtcttctacgtcgcctggacctggcgggccacggaggaggagaactgtgaggccaacgccgccatgctccgcaacgtgctctccatcgtcgtccccaactgcccggcgctcgtccatgtcaccctccagacaggtactagacactacttcggccgtttttccgagacacccgtccacgacccgccctacacggaggacatgcccaggctggacatgcctatcttctactacgaccaagaggacgttctgttccaatccatcgcgcgccggagcggcgccgtcagctggtccgtgcaccgccccaacatcatactcggcttctccccacgcggcgcaatcaacctcgtctgctgcctatgtgtctacgccgccgtctgccgcaaggagggcgccccgctgcggtggccggggacccgcgggggctgggaggggttcatcacgccctccgacgcggacctcgtcgccgagcaccacatctgggcgggcgtggaccccatggccaagaacgaggcgttcaactgcagcaacggggatgtctgcacgtggaagaagctgtggccgatactcgctgggcgtttcggattggagtgggcggggtacgagggcgaggagaagcggttcaagctgacggaggccatggccgggaaggaagcgttgtgggaggagattgtcgaggagaacgagcttgtggcgacacacgtctccgaggtcgccaattggtgggtcatcgacataacggttgatcagcacggccttaattcaccgatcctggacagcatgaacaagagcaaggagcatgggttccttggcttccggaacacgttcaagtccttcaacacatgcatcgacaggttgaagtttcacaggattgttccttgatgccttgatgtatctgtttatcatactgtggttttggtcatgctacatcgctgctcatgcgcgcgcctagtgaattaccttagctacccgtacccagcagttcatcatgaattggctgacgctgtcttttttttctttgctatgtgtagtactatgctttatttgagaataaaatgaactcaaagattattcagtgatatgtaaaaaaaaaaaaaaaaaaaa

SEQ ID NO: 1052 - protein, 397 aa, Panicum virgatum
  misc_feature: Ceres CLONE 1756459
  misc_feature (1)..(252): Pfam Name: Epimerase Pfam Description: NAD dependent epimerase/dehydratase family
MSWWWAGAIGAAWKRQDDRAAVSPSQQAFKSVALVVGSTGIVGASLVDILPQPDTPGGPWKVYALSRRPPPPWSPPSSSVTPIHVDLTDYTAAAAALAPLTDITHVFYVAWTWRATEEENCEANAAMLRNVLSIVVPNCPALVHVTLQTGTRHYFGRFSETPVHDPPYTEDMPRLDMPIFYYDQEDVLFQSIARRSGAVSWSVHRPNIILGFSPRGAINLVCCLCVYAAVCRKEGAPLRWPGTRGGWEGFITPSDADLVAEHHIWAGVDPMAKNEAFNCSNGDVCTWKKLWPILAGRFGLEWAGYEGEEKRFKLTEAMAGKEALWEEIVEENELVATHVSEVANWWVIDITVDQHGLNSPILDSMNKSKEHGFLGFRNTFKSFNTCIDRLKFHRIVP

SEQ ID NO: 1053 - DNA, 1314 bp, Panicum virgatum
  misc_feature: Ceres CLONE 1756587
  misc_feature: Encodes the peptide sequence at SEQ ID NO. 1054
ctcttccaaggagaagcaccgcctcctgttgttggagcctgctggagaagacgaaggaacagggagcggaggggaacaagttgcggcgacggctggactctgaaagaaataccaggtggtcaagatgtcagctggtttccagctcggtgtgatcgggtcacttgcactctctgttgcatcttcagttgccattgtcatctgcaacaaagctctcatcagcacacttggttttccattcgctacaacattaacaagctggcatctgatggtgaccttctgcaccctccatgtggcacagcgcttacatttatttgagcccaaggcaattgatggacagacagtgatactctttgggttgctgaatggcacctcaattggccttctcaaccttagtttaggattcaactccattggattctatcaaatgacaaaattggcgatcatacctttcactgtgctattggagacaatcttcctgaagaaaagattcagtgagagtatcaagctttctcttctggtcttacttcttggagtaggcatcgcttcagttactgatctcaagctaaatctgctcgggtccatcctttctggcctcgccattgccaccacttgtgttggccaaattctcacaaatacaatacagaagaggttgaaggtctcgtcaacacagctattgtaccaatctgcgccttaccaggcagcaattctgtttgcaactggcccttttgtggatcaactccttactaaccgcagtgtcttcgcacacaaatactctgctccagttttgggttttattgtcctatcttgcttgattgcggtgtctgtgaacttcagtacatttcttgtgattggaacaacatccccagtgacataccaggtgcttggccaccttaagacatgtctggttctatcatttggctacactctattgcatgatcctttcactctaaggaatatattgggcattctggtagccatatttgggatggcactgtactcctacttctcagtaagagaaagcaagaagaagtcaacaaatgatgctctgccagtttcacagatgccagataaggaggctgaaccacttttggcaacgaaagacagcaacgacaccaaaaaagcaaatggtctatctcacgactgctaagacttttcttgtagtttaggtctagtatgaacaactgcccttcgaatttaaaggacctggggaaagccattctttccattcttgatttcctttttaggaacggagatttttatgtgtagagaatgtatatttgacattacaattattatttgagtgtattttttcac

SEQ ID NO: 1054 - protein, 340 aa, Panicum virgatum
  misc_feature: Ceres CLONE 1756587
  misc_feature (1)..(143): Pfam Name: TPT Pfam Description: Triose-phosphate Transporter family
MSAGFQLGVIGSLALSVASSVAIVICNKALISTLGFPFATTLTSWHLMVTFCTLHVAQRLHLFEPKAIDGQTVILFGLLNGTSIGLLNLSLGFNSIGFYQMTKLAIIPFTVLLETIFLKKRFSESIKLSLLVLLLGVGIASVTDLKLNLLGSILSGLAIATTCVGQILTNTIQKRLKVSSTQLLYQSAPYQAAILFATGPFVDQLLTNRSVFAHKYSAPVLGFIVLSCLIAVSVNFSTFLVIGTTSPVTYQVLGHLKTCLVLSFGYTLLHDPFTLRNILGILVAIFGMALYSYFSVRESKKKSTNDALPVSQMPDKEAEPLLATKDSNDTKKANGLSHDC

SEQ ID NO: 1055 - DNA, 1083 bp, Panicum virgatum
  misc_feature: Ceres CLONE 1756603
  misc_feature: Encodes the peptide sequence at SEQ ID NO. 1056
agccaacccgaggtcaatccagccacagcccacccagctcgtacccagatctcccggacccgttcagcgcctgctgtagcgtcggcgatggccagcacggcggccgaggcggcgaaggcggcggagcagccggccaacggcaacagcgagcagaagacgcgccactccgaggtcggccacaagagcctgctcaagagcgacgacctctaccagtacatcctggacacgagcgtgtacccgcgggagcccgagagcatgaaggagctccgcgagatcaccgccaagcacccgtggaacctgatgacgacgtcggcggacgaggggcagttcctcaacatgctcatcaagctcatcggcgccaagaagaccatggagatcggcgtctacaccggctactccctcctcgccaccgccctcgcgctccccgaggacggcacgatcttggccatggacatcaaccgcgagaactacgagctcggcctgccctgcatcgagaaggccggcgtcgcccacaagatcgacttccgcgagggccccgcgctccccgtcctcgacgacctcatcgccgacgagaagaaccacggcaccttcgacttcgccttcgtggacgccgacaaggacaactacctcaactaccacgagcggctgctcaagctcgtgaagctcggcggcctcatcggctacgacaacacgctgtggaacggctccgtcgtgctccccgacgacgcgcccatgcgcaagtacatccgctactaccgcgacttcgtgctcgtgctcaacaaggcgctcgccgccgacgagcgcgtcgagatctgccagctccccgtcggcgacggcgtcaccctctgccgccgcgtcaagtgagcgtggcccggcccggctgccaaccccaccgtaccgacgacggccgccgccgccgcccaactccaatcatagacgacgcgcagcattaattattcaccatcttttttttggctctttcttggctttgtaatcttggaaattgtaaccattttcgtgcgtaaatgtcgagaccataatactataaattcacagtaccacgaaaaaaaaaaaaaaaaaaaa

SEQ ID NO: 1056 - protein, 258 aa, Panicum virgatum
  misc_feature: Ceres CLONE 1756603
  misc_feature: Great-hit functional homolog of the protein sequence given in SEQ ID NO 9679
  misc_feature (1)..(213): Pfam Name: Methyltransf_3 Pfam Description: O-methyltransferase
  misc_feature (1)..(258): SWISSPROT Homolog: EC 2.1.1.104 Caffeoyl-CoA O-methyltransferase 1
  misc_feature (1)..(258): SWISSPROT Homolog: EC 2.1.1.104 Caffeoyl-CoA O-methyltransferase 2
  misc_feature: Useful for making plants with altered Lignin content
  misc_feature: Useful for making plants with altered cell wall content and/or composition
MASTAAEAAKAAEQPANGNSEQKTRHSEVGHKSLLKSDDLYQYILDTSVYPREPESMKELREITAKHPWNLMTTSADEGQFLNMLIKLIGAKKTMEIGVYTGYSLLATALALPEDGTILAMDINRENYELGLPCIEKAGVAHKIDFREGPALPVLDDLIADEKNHGTFDFAFVDADKDNYLNYHERLLKLVKLGGLIGYDNTLWNGSVVLPDDAPMRKYIRYYRDFVLVLNKALAADERVEICQLPVGDGVTLCRRVK

SEQ ID NO: 1057 - DNA, 1511 bp, Panicum virgatum
  misc_feature: Ceres CLONE 1756652
  misc_feature: Encodes the peptide sequence at SEQ ID NO. 1058
gaatcctccgtgagcccccaaccccaagggcggcagaggaggcgtgaggggctagagtcccgtccgtacgatcgccgcccgccgccggttcgccaccccgttcgctggcttctcgcgtccggagcgcggttcctcctgtgagggctagaggaaggaaaaagaacagcaatggatacgaaccaggagctggaagaggtggtcccaaatgactcagaccctcttctcggaagggagggcaaggaggcagagtcatcatcagtggagctgtctgcgccacaaccagcaaccgtgaccccgctggagatcgaagatgaggagaccaatggttcttctgctgcatgctgccgcatttgccttgaggcagagtctgagataggtgatgaactgatatcaccttgcatgtgcaaaggaactcagcagtttgttcaccgttcatgccttgatcactggcgttctgttaaggaaggatttgcattttcccactgcacaacgtgcaaagctcaatttcatcttagggtggagacttgggaggacaactcatggcgtaaaatgaagttccggatatttgttgcaagagatgtgctcctcgtatttcttgccgtacagcttactattgctattattggtgcaattgcatactttctagacagggatggaagtttccggaacagtttcagtgatggttgggatcgcttcttgtcaaagcacccaataccattctactattgcataggtgttgttgttttctttgtgctgcttggattctttgggttgatagtgcactgctcatccttcaacgaccaccaggatccatgcctagctgggtgccggaactgctgctatggttggggcatccttgactgcctgcctgcttccttggaggcttgttttgccctggtgttggtgttcattgttgtgttcgctatcctcggcatcgcctacggcttcctggccaccaccatggctgtccagaggatctggcagaggcactatcacattctgacaaaaagggagctaacgaaggaatacgtggtggaagaccttcacggcaactacacggctccaaagcttgatccggaacacgaggagcagctgaagatgctcaagctcctctagggagaggtgcctgcctgaattctgaagatgcttcatggcaacctcatcaacatgacaacatggcccatcctctttcgttccagatcatagaaagaaaaaggcaccttgagttctaggctactgtacagatgaaaatcctgcttcaacctgtaccgaacaccatcagctgaaacaatccagagattctgctgggcttcacgttttgccctcgggctaattccatcgactacgtgtagtgcctgtaatgtttgatgtgcattgttcctggatgtgaacgcctgtacgattgaagattctgttgtctgaattgatcccctgtgatctctttgcgttttggcatctgaataagatctgctctcgatgcatctgatgttcaaaaaaaaaaaaaaaaaaaa

SEQ ID NO: 1058 - protein, 315 aa, Panicum virgatum
  misc_feature: Ceres CLONE 1756652
  misc_feature (1)..(51): Pfam Name: zf-C3HC4 Pfam Description: Zinc finger, C3HC4 type (RING finger)
MDTNQELEEVVPNDSDPLLGREGKEAESSSVELSAPQPATVTPLEIEDEETNGSSAACCRICLEAESEIGDELISPCMCKGTQQFVHRSCLDHWRSVKEGFAFSHCTTCKAQFHLRVETWEDNSWRKMKFRIFVARDVLLVFLAVQLTIAIIGAIAYFLDRDGSFRNSFSDGWDRFLSKHPIPFYYCIGVVVFFVLLGFFGLIVHCSSFNDHQDPCLAGCRNCCYGWGILDCLPASLEACFALVLVFIVVFAILGIAYGFLATTMAVQRIWQRHYHILTKRELTKEYVVEDLHGNYTAPKLDPEHEEQLKMLKLL

SEQ ID NO: 1059 - DNA, 1303 bp, Panicum virgatum
  misc_feature: Ceres CLONE 1756710
  misc_feature: Encodes the peptide sequence at SEQ ID NO. 1060
agcagccactacaagctgccgtgccgagtgagctagtgagcgagcgagctcccggcgcgcgatggagggtgacaagaagtcggcgggcggggccccggcctactggggcctgggcgcgcggccctgcgacgagtgcggcgccgaggcggcgcggctctactgccgcgcggacgcggcgttcctctgcgccgggtgcgacgcgcgcgcgcacggcgccgggtcgcgccacgcccgcgtctggctgtgcgaggtctgcgagcacgcgccggccgccgtcacgtgccgcgcggacgccgccgcgctctgcgcctcctgcgacgccgacatccactccgccaacccgctcgcgcgccgccacgagcgccagaccgtggcgcccttctacggcgcgctcgccgacgcgcccaagcccttcgcctcgtcggtggccgtgcccaaagcggccgacgacgacggaagcaacgaggccgaggcggcgtcgtggctcctccccgagcccgaccacgggcacaaggaaggcgccacgacggaggtgttcttcgcggactccgacccgtacctcgacctcgacttcgcgcgcaccatggacgacatcaaggccatcggcgcccagaacggccccgccggcgccgagctcgacctcaccggcgccaagctcttctactccgaccactccatgaactacagcgtgtcgtcgtcggaggcagcggtggtgcccgacgcggcggcgggcgcggcgcccgtcgtgcctgtggtgagcaggggcctggagcgggaggcccggctgatgcggtaccgggagaagcgcaagagccggcggttcgagaagacgatccggtacgcgtcccgcaaggcgtacgcggagacgcggccgcgcatcaagggccggttcgccaagcgcaccccggggcccggcgcggacggggaggacccgctggaggagcacgaggaggagatgtactcctccgccgcggccgccgtggccgcgctcatggcccccggcggcgccgacgccgactacggcgtcgtgcccacgtattgatcggcgccggcctgctgtacactagctagcctcgacctctcggggctgtaatttttgctgcatgccttgcatgcaaaaagctgccgtgtagcattgattacctgtaatatgattccacggaagccatgaggctggacttccaagctcttcttcctccctaatgattccgtcatgtacggatgtatattattattatttatcacgaactgctgctaatctgcaactgtaatttctaattagcaaaaaaaaaaaaaaaaaaaa

SEQ ID NO: 1060 - protein, 326 aa, Panicum virgatum
  misc_feature: Ceres CLONE 1756710
  misc_feature (1)..(45): Pfam Name: zf-B_box Pfam Description: B-box zinc finger
  misc_feature: The sequence is a functional homolog of  SEQ ID NO 1293 in the  11/479,226 US patent application
  misc_feature: The sequence is a functional homolog of  SEQ ID NO 598 in the  10/412,699 US patent application
  misc_feature: Useful for making plants with modulated growth and phenotype characteristics
MEGDKKSAGGAPAYWGLGARPCDECGAEAARLYCRADAAFLCAGCDARAHGAGSRHARVWLCEVCEHAPAAVTCRADAAALCASCDADIHSANPLARRHERQTVAPFYGALADAPKPFASSVAVPKAADDDGSNEAEAASWLLPEPDHGHKEGATTEVFFADSDPYLDLDFARTMDDIKAIGAQNGPAGAELDLTGAKLFYSDHSMNYSVSSSEAAVVPDAAAGAAPVVPVVSRGLEREARLMRYREKRKSRRFEKTIRYASRKAYAETRPRIKGRFAKRTPGPGADGEDPLEEHEEEMYSSAAAAVAALMAPGGADADYGVVPTY

SEQ ID NO: 1061 - DNA, 1442 bp, Panicum virgatum
  misc_feature: Ceres CLONE 1756716
  misc_feature: Encodes the peptide sequence at SEQ ID NO. 1062
aaaccaagtcctcgcctaacagcgcagatgtagaccccgcatcgcctttcaagaatggcaatgagctcttgcgtgaccaataagtccttgcctttcctcgtcgccccatcggaggcgacgccggccggcaccctccggctgacctccatggaccgcgctctggcgtccctgcccatgacagcgctgttcgtcttcgagcaccccatcgatcagccggccgagaccctaaggcgagctctttcccgagcgctggttccctactaccctgtcgccgggcgcctcactgccggggcacatggccagagcatcgcgtgcacgggtgagggcgtgctgttcgtgggcgcgtccgcgagatgcaccctgcgcgacgccaggctctccgatcagcgtccggcgatccccgtggaggacctcaccgtcacctacgccgggctgtacaacaaagacccgccgctgctgcttacgcaggtgaccgagttctcctgcggcggcttcgtcgtgggggtgacgtggaaccacgtcgtcgccgacggcgtcgggatggcgcagttcttgcaggccgtcggcgagttcgcccgtgggttctcgtcgccgtccgtcgtccaaccggtgagggtggacaacttcctcccagaacttccgccgccgatcaccaccatgacgaagtcgatggtcagcagcaagcacaccgacttcccgagctcctacatcaccatccccatgagcttcgtcaaccgcatcaaggacgagttccgtcgcagtggcccgcagggtgaccagaagaaggcggcagcggcgacatgcacggcgttcgacgtattcaccgccgccatatggaggtcccgtgcccgcgcgacaatagccggcgccgccagccaggacgcccccacggcgctcgccttcacggtgaacctgaggaagcaggccggggccaaggacggctactacggcaacgtcttcgccttcggcctcgcagcggcaacgctgcgcgaggttgccgacggggacatccttgacctcgtgaggctgatcagggacgccaaggcgcgggtcccgtacaccttcacggacggagctgcgtacatcggcgacgagatgggcggccggctgcagtgcctggacgggtacgacaccctgtacgtgaccagctggtggaatctcggcttcgatgacgtcgactttggcggtggcgggcctgcgcgcgtcatgggggacatggagcgcaaggtggtgcccggatgcatcctgtgcggaaggaaggacaaggccgatggtgtcgccgccatggcgttctgcgtcaagcaggagcacgcggaggccttccatgaagagttaggcaggctcaaaatgtgacatgcgtatgagaatgaatgtgtgtgttcctgttacgagcatgacaccaacacgtaaacttattagaccaaaaaaaaaaaaaaaaaaaa

SEQ ID NO: 1062 - protein, 432 aa, Panicum virgatum
  misc_feature: Ceres CLONE 1756716
  misc_feature (2)..(191): Pfam Name: Transferase Pfam Description: Transferase family
MAMSSCVTNKSLPFLVAPSEATPAGTLRLTSMDRALASLPMTALFVFEHPIDQPAETLRRALSRALVPYYPVAGRLTAGAHGQSIACTGEGVLFVGASARCTLRDARLSDQRPAIPVEDLTVTYAGLYNKDPPLLLTQVTEFSCGGFVVGVTWNHVVADGVGMAQFLQAVGEFARGFSSPSVVQPVRVDNFLPELPPPITTMTKSMVSSKHTDFPSSYITIPMSFVNRIKDEFRRSGPQGDQKKAAAATCTAFDVFTAAIWRSRARATIAGAASQDAPTALAFTVNLRKQAGAKDGYYGNVFAFGLAAATLREVADGDILDLVRLIRDAKARVPYTFTDGAAYIGDEMGGRLQCLDGYDTLYVTSWWNLGFDDVDFGGGGPARVMGDMERKVVPGCILCGRKDKADGVAAMAFCVKQEHAEAFHEELGRLKM

SEQ ID NO: 1063 - DNA, 1097 bp, Panicum virgatum
  misc_feature: Ceres CLONE 1756765
  misc_feature: Encodes the peptide sequence at SEQ ID NO. 1064
gagaacgaagaagaatggatgccggcggcgcgccggtggcgcagacttcggaggaggcggcgaccccgccgtacggctctgtggtcctcggcggcaccttcgaccgcctccacgacggccaccgttgccttctcaaggcgtcggcggatttggcgagggaccgaatcgtggtgggcgtctgcacgggccctatgctcacaaaaaaggagtatgccgagctgattgagcccgtcgagaagcggatcaaggccgtggaggattacatcaagtctataaaaccagaactgacagtacaagtggagcctattgaggatccttatggcccttccattactgacgataagttggatgccatcattgtcagtaaggagacattaaatggtggacttgctgtaaatagaaaaagagaagagaaagggttgccactgttgaaggttgaggttgttgatctactttctggaggtgtggagggggagaaactgagttcatctgctttaaggaagctcgaggcagagcaagctgaacaaagtgaagcaaagaccgctagccattaagcttcttaagcaatacttgaatttgaacagatgaatgcacaaatgcagggtaagctgctccaagatcgccgtcaacaaaatattagtaggagttcacagtttggttacattcagaaagcaatgcccacgacactgtaacactattactctttaactttacaaaatcaacctggcaacatggactctctctactaacctaatttacagattttgtatgagcattgccttctgaatgtaaagaaaaaggaaatacccttggtggttttgccaatagtggcaaaagtacaaatgaatattgttagtgtgtgtagttaatgggccggcctactggcctgggttatagctgtgccggcctccttggccgtgcgccttcccctggggatctagatggttttggattaggcaaggaactcttgattggtattacttctataaaccaaaccctaggacttccttgcctttatatgtacacgagctttgcctctccataatcaatctattattcccgagccatatttgctttcaaaaaaaaaaaaaaaaaaa

SEQ ID NO: 1064 - protein, 179 aa, Panicum virgatum
  misc_feature: Ceres CLONE 1756765
  misc_feature (1)..(141): Pfam Name: CTP_transf_2 Pfam Description: Cytidylyltransferase
MDAGGAPVAQTSEEAATPPYGSVVLGGTFDRLHDGHRCLLKASADLARDRIVVGVCTGPMLTKKEYAELIEPVEKRIKAVEDYIKSIKPELTVQVEPIEDPYGPSITDDKLDAIIVSKETLNGGLAVNRKREEKGLPLLKVEVVDLLSGGVEGEKLSSSALRKLEAEQAEQSEAKTASH

SEQ ID NO: 1065 - DNA, 896 bp, Panicum virgatum
  misc_feature: Ceres CLONE 1756799
  misc_feature: Encodes the peptide sequence at SEQ ID NO. 1066
gcagcggggtcgacgcggagaggaagagaatcccacacaaaaggaagaaccgagggggagggtattggaagcgccggagagggaaggttcgatctcggaagggagagagatcatggctccgatgaagctgtacggcgcgacgatgtcgtggaacgtgacgaggtgcgtggtggcgctggaggaggccggcgccgactacgagatcgtgcccatcaacttcgccaccgccgagcacaagagccccgagcacctcgcccgcaacccatttggtcaggttccagctttgcaagatggtgacttgtacgtctgggaatcgcgtgcaatttgtaagtatgcagcccgtaaaaacaagccggagctgttgaagcaaggcaatcttgaggagtcagcaatggtggatgtctggatggaggtggaggccaaccagtacacctctgtgctgaaccccatcctcttccagtgcctcatcagtcctatgcttgggggatccactgacctgaaggttgtcgaggagaaccttgagaagctgaagaaggtgctggaggtgtatgaggcgcgcctgaccaagtacaagtacctggctggagacttcctcagccttgctgaccttaaccatgtctctgccaccctgtgcttgtttgcaacgccccatgcgtcggtgtttgatgggtaccctcatgtgaaggcctggtggtctagcctgatggagaggccatctgttcagaaggtcgcagcgctgatgaagccatctgcttgaagtggttggccttgcgcaggcggtacttggaataagctgtgttctgtttcagtgtttgcttgttcaggttctgtgctgttatgatgtgccttctatgttgaatgttcatgctttgtgctaaaaaaaaaaaaaaaaaaaa

SEQ ID NO: 1066 - protein, 214 aa, Panicum virgatum
  misc_feature: Ceres CLONE 1756799
  misc_feature (1)..(96): Pfam Name: GST_C Pfam Description: Glutathione S-transferase, C-terminal domain
  misc_feature (1)..(76): Pfam Name: GST_N Pfam Description: Glutathione S-transferase, N-terminal domain
  misc_feature (1)..(214): SWISSPROT Homolog: EC 2.5.1.18 Glutathione S-transferase I
  misc_feature (4)..(214): SWISSPROT Homolog: EC 2.5.1.18 Glutathione S-transferase IV
MAPMKLYGATMSWNVTRCVVALEEAGADYEIVPINFATAEHKSPEHLARNPFGQVPALQDGDLYVWESRAICKYAARKNKPELLKQGNLEESAMVDVWMEVEANQYTSVLNPILFQCLISPMLGGSTDLKVVEENLEKLKKVLEVYEARLTKYKYLAGDFLSLADLNHVSATLCLFATPHASVFDGYPHVKAWWSSLMERPSVQKVAALMKPSA

SEQ ID NO: 1067 - DNA, 1286 bp, Panicum virgatum
  misc_feature: Ceres CLONE 1756885
  misc_feature: Encodes the peptide sequence at SEQ ID NO. 1068
aaccatggccgccaccgccgccctggtgccggcggctctctcctcgccaccgtccccgtctcctccgcacgcctcgcgaccgagagcccttcgcagcgacgctctcctctcactccgcgcaaagccgcgcgaccgcgtcgtctgtgccgccgccgccgccgccgccgccgccgcctccggcttctccaacttcgggaatcaggcatcactgttgcctccgttcaactttacacttgatgaaggttcctctaggtccaaaaagccatatagatggcaacgggtattgcttaaagtaagtggggaagctcttgctggagatcacacagaaaacattgacccaaagattacaatggcaattgcaagagaggtcgcttctgtcaccaagctaggtgtagaggttgctattgttgttggtgggggcaatattttccgtggggcctcttgggctggatgtagtgggcttgatcgctcatctgcggattacatcggcatgttggccactgtgatgaatgctatatttcttcaagcaacaatggagagcattggaataccaacccgtgtccaaactgccttccgtatgtcagaggttgcagagccatacatacgcagaagagctgtcaggcatttagagaaaggaagggttgttatatttgctgccgggacagggaacccattctttacaactgatacagctgctgctctccgttgtgcagaaatcaatgcagaggtagtgcttaaagcaacaaatgttgatggagtgtacgatgcagacccaaggcagaacccaaatgcccgccttcttgaaacagtgagctataatgaagtgactacaagagatctctcagtaatggacatgactgccattacactatgccaagaaaacaacattcccgttgtcgtgtttaacttgcaaaagcctggaaacattgcaaaggctattgttggtgagaaggttggtacctttattggatgcacaggaaatcaggaacaaaatggaaacgcactgcatgaagaaagaagattggttaacgaggcgtgagctcaacagctgctcgatctgtgcttccccctcttttcttatttagtttatgcgtaggaggtttttggaggttgggtttggggctcgtgctagaattagactagattagctacaaaagttcttaaaccttgaaagaagacaattagaccaaaattttccagccaagtgctgctaccctatgtacaatagactcatggagattacctaataaaataaaatctttttgcaaaaaaaaaaaaaaaaaaaa

SEQ ID NO: 1068 - protein, 344 aa, Panicum virgatum
  misc_feature: Ceres CLONE 1756885
  misc_feature: Great-hit functional homolog of the protein sequence given in SEQ ID NO 9263
  misc_feature (1)..(211): Pfam Name: AA_kinase Pfam Description: Amino acid kinase family
  misc_feature: Useful for biocontainment applications
  misc_feature: Useful for making plants with modulated biomass
  misc_feature: The plant is abnormally small.
  misc_feature: The plant produces a reduced number of seeds.
MAATAALVPAALSSPPSPSPPHASRPRALRSDALLSLRAKPRDRVVCAAAAAAAAAASGFSNFGNQASLLPPFNFTLDEGSSRSKKPYRWQRVLLKVSGEALAGDHTENIDPKITMAIAREVASVTKLGVEVAIVVGGGNIFRGASWAGCSGLDRSSADYIGMLATVMNAIFLQATMESIGIPTRVQTAFRMSEVAEPYIRRRAVRHLEKGRVVIFAAGTGNPFFTTDTAAALRCAEINAEVVLKATNVDGVYDADPRQNPNARLLETVSYNEVTTRDLSVMDMTAITLCQENNIPVVVFNLQKPGNIAKAIVGEKVGTFIGCTGNQEQNGNALHEERRLVNEA

SEQ ID NO: 1069 - DNA, 926 bp, Panicum virgatum
  misc_feature: Ceres CLONE 1756916
  misc_feature: Encodes the peptide sequence at SEQ ID NO. 1070
aaccaccagtccaccacgcgcgcgatcgggctggcttgctgcgtgcggagggaaggtggagggccggccaccgtgccgtgacgacgccgcgccatggaggtgccgccgctgccagcggcggcggaggaggagcggcgcggcgcggcgacggggtcgtgcctccacaagctggtctccggcgtcctctcgggggccctcaccggcctcttcgccgtcgctggaggcctgacgggggcgttcaccggcgcattggcggggagggcctccgacagcggcgtcctccggggagccgggctgggggcgtttgcgggggcggtgctttccatcgaggttctggaggcttcgcgcgcgtactggagcacggaccgatcgagcccgcagagcacatcctccatgggcgatttcatagagcagctccttcatgctcgatttgtgcaagaccagtatgagccatcggcatatatggcgtatcgttggcaggttggtattgcagacaatgatgatctgttcgacgtccttgaagaggttttatctgatgggctctcacaagataccctaaagaagttaccacatcatgtggtgactgatcagaagcaagaatcgattggtgaaaacttgtcttgtgctatttgcctccaggatattgttgctggcgagacagtgaggaagttgccgaagtgttctcacactttccaccagccttgcgtggacagatggttcattgaccacggttcatgccctgtatgtaggcaagatgtgtaggtagattctgttcggctccgtgttctcatgcctttgtaaagtgcctactggcttcatgtagaaagaattatacgtagcggtgtaaactaagcctacaacttattggtatcgtgaaattggttgtatacataatacatacgtcagaaaaaaaaaaaaaaaaaaaa

SEQ ID NO: 1070 - protein, 222 aa, Panicum virgatum
  misc_feature: Ceres CLONE 1756916
  misc_feature (1)..(42): Pfam Name: zf-C3HC4 Pfam Description: Zinc finger, C3HC4 type (RING finger)
MEVPPLPAAAEEERRGAATGSCLHKLVSGVLSGALTGLFAVAGGLTGAFTGALAGRASDSGVLRGAGLGAFAGAVLSIEVLEASRAYWSTDRSSPQSTSSMGDFIEQLLHARFVQDQYEPSAYMAYRWQVGIADNDDLFDVLEEVLSDGLSQDTLKKLPHHVVTDQKQESIGENLSCAICLQDIVAGETVRKLPKCSHTFHQPCVDRWFIDHGSCPVCRQDV

SEQ ID NO: 1071 - DNA, 1050 bp, Panicum virgatum
  misc_feature: Ceres CLONE 1756994
  misc_feature: Encodes the peptide sequence at SEQ ID NO. 1072
acaccaaccccgcgagagggcgtgttccccccaatctgccggcagcgatgtgcaccctggagcagcgcggccgcgtgttcgtcctcaccctcacaggcgacggcgagcaccgcctgggccacgccctcatctcctccctccgctccgccgtcgcctccgccgcggaggccgcggcccgggcggggccgggggccgcgctcgtcaccgtcggcgagggccgcttcttctccaacgggctcgacatcgggtgggcgggcacctcccgcgcgcgcctcggggagctcgtcgacgcgctccgcccgctcgccgccgacctcctcgcgctccgcatgcccaccgtctccgccgtcacgggccacgcctccgccggcgggttcctcctcgcgctctgccacgactaccgcctcatgcgcgccgaccgcggcgtgctctacatgagcgaggtcgacatcggcctgcccctcccgccctacttcatggccgtgctccgcgccaagatcaccgccgccaacgcgctccacgacgtcgtgctccggggcaggaagctcagggccgcggagggcagggagatgggcgtcgtcgacgccgtctacccctccgcggccgagacggcggccgaggccttcaagtttgccgagcagctcgcggcgaggaagtgggacggtgccgtgtacgcgtccataagaatgtccatgtaccctgaggcctgcaggtcagttggaattgtagaggagagtgacgaggtgaagaggaagcacttcgcttccaagctctgaagccgtgattgtgattcgagtgagggtttctgtggtggagatcccttcacgttctgtattggtacgtcggctcagccagccattgacactatcgatgaatcagacaatatgtacatgtgcaaaccttgtgattgtgagttgcttgcttgaaggtggggactaaattcatgtttctctccccaccttgctggtaaatttttaatgtgcctgctagactctatagaattccaataagatcaccgataggtgttcataaaaaaaaaaaaaaaaaaaa

SEQ ID NO: 1072 - protein, 242 aa, Panicum virgatum
  misc_feature: Ceres CLONE 1756994
  misc_feature (1)..(136): Pfam Name: ECH Pfam Description: Enoyl-CoA hydratase/isomerase family
MCTLEQRGRVFVLTLTGDGEHRLGHALISSLRSAVASAAEAAARAGPGAALVTVGEGRFFSNGLDIGWAGTSRARLGELVDALRPLAADLLALRMPTVSAVTGHASAGGFLLALCHDYRLMRADRGVLYMSEVDIGLPLPPYFMAVLRAKITAANALHDVVLRGRKLRAAEGREMGVVDAVYPSAAETAAEAFKFAEQLAARKWDGAVYASIRMSMYPEACRSVGIVEESDEVKRKHFASKL

SEQ ID NO: 1073 - DNA, 1303 bp, Panicum virgatum
  misc_feature: Ceres CLONE 1757025
  misc_feature: Encodes the peptide sequence at SEQ ID NO. 1074
atcaccagtcagtcgccgtcgcgctccaatgcatatgcaatccatggcaccggctgccgcgcctcccgcggcgcctctcctccgcccgcgccgccccgcctccgccagtgccgccgccgcgcgcgccagggccacctccctcgtcgccgtcagggcccagccggacaccgccgccacctccgcacccgacccgccgccggagttcaagccgccgcaggggttccagccgcccgagcccaagaggttcgcggtcaaggagggccagcagggcagcgtcctcggcgcctcgctcgccatccccctccgccttggcaccggcgtcttcgtcctggggtactcgccgtcacttgtttctccgtcagagataccatcagaccagtacgctctcgaattcggagcttggaaggtgaaggaggaatcaaagataggacagtgcaaacgaccagaaaagcctatcgagatttatgaattcgaaggctgtccgttttgtcgaaaggtcagggagatggtgtccgtcttggacctagatgtattgttttatccttgtcctcaaaaaggcccaacattccgaccaaaagtcctcgagatgggtggaaagaaacaatttccttacatggtggatccaaacacaggggtagccatgtatgaatcagatgacatcataaaatacctggctgacacatatggtgatggaacggttccaatcatgctgtcacttggtctgctaacagcaatcacggcagggcttgctacacttgatcgtattggaaagggaaattcctatactgcttcaaaagttccacctcagccgatagagatatgggcatatgagggatcgcccttctgcagattagtacgagagaccctcgttgagttggaattgccacatttgctacacagctgtgcgcgtggcagccccaagcgccaggaatttttcaagaagatgggaactttccaggcgccttacatcgaagatccaaacaccggagtcaagatgttcgagagcgctgaaatcataaactacctgaaggcaacatatgccctttatccaagctcatagtgctagtacctgccatatctcaagtgctcatatgtaatcttgtatagaccgtctaaattttgttctttacgagaatatttagggaagaaacagtgagcctcaaattatgtatgatgcacagccgattttatgtatgcagagtttggactctgaagtgatactggaaattatatgttctttctgtcgataaaagagaagatatagcgagtgatgttgctttccgaaaaaaaaaaaaaaaaaaaa

SEQ ID NO: 1074 - protein, 343 aa, Panicum virgatum
  misc_feature: Ceres CLONE 1757025
  misc_feature (1)..(77): Pfam Name: GST_N Pfam Description: Glutathione S-transferase, N-terminal domain
MHMQSMAPAAAPPAAPLLRPRRPASASAAAARARATSLVAVRAQPDTAATSAPDPPPEFKPPQGFQPPEPKRFAVKEGQQGSVLGASLAIPLRLGTGVFVLGYSPSLVSPSEIPSDQYALEFGAWKVKEESKIGQCKRPEKPIEIYEFEGCPFCRKVREMVSVLDLDVLFYPCPQKGPTFRPKVLEMGGKKQFPYMVDPNTGVAMYESDDIIKYLADTYGDGTVPIMLSLGLLTAITAGLATLDRIGKGNSYTASKVPPQPIEIWAYEGSPFCRLVRETLVELELPHLLHSCARGSPKRQEFFKKMGTFQAPYIEDPNTGVKMFESAEIINYLKATYALYPSS

SEQ ID NO: 1075 - DNA, 1333 bp, Panicum virgatum
  misc_feature: Ceres CLONE 1757049
  misc_feature: Encodes the peptide sequence at SEQ ID NO. 1076
atcaaaggatcagggagcttccaagggaggcagcaggcagctaggttgtctccctccttcccacctgcaccaccctaccctaccccagtcctatcgatgggaaggtctccttgctgtgatgagaatggcctcaagaaggggccatggacctctgaagaagaccagaagctcatggagtacatccagaagcacggccatggaagctggagagcactgccgaagcttgcagggctcaacaggtgtggcaagagctgcaggctgagatggaccaactacctgaggccagacatcaagagagggaagttcaccgaagaggaagaacaaaccatcctccggttccactccgtccttggcaacaagtggtcagccatcgcgaagcacctcccggggcggacggacaacgagatcaagaatttctggaacactcacctgaagaagaagctgatccagatgggcttcgacccgatgacgcacaggccaagaacagacttctttgctgcgctgcctcaactcattgcgctggccaacctccgccagcttgtggagcagcggccatgggacgaccacgccgccaggctgcaggttgaggcggtccaggctgcaaagttccagtgcctccagaacctgatccagtctgcagcatctattgcaattagtcccagttccagcagcatcaacaccatccccgacctggagcaaattggcctcctgagtcctccgcagatgtcttccctgtcttcgttgccttctccaagtttcctcgagagtatcagtggccaggacatcgtagctggacaactgcctgacatccaaattcctagcactttctttgagcagcccaccagcaatgatacaaaccagaactcggacttcactccaaagagtagtgttgagggagagaatggaacccctaaaacgctgctgctgtcagaaaactcccttccgccactcaccgacttccccatttccaacctcggcgatgcttgcagcgcctcaagctgtgacggtagcagcattcaattcccaagttggcctgagttctttgatgaacagttcttgagcgagttcgaatgaatcctgatctggtgtgtgtttgtgttactctacggtttgccttttagttttctttgtttcttacctctgttttttgtgccatattctgatgtgagtatcagttcagaggtgtagttaccgcgtgctgttatttttttcccgttttgagtgcaaatgcatgctcctatgcataaacactatacaccaaacacttgtaaatatatacaacttctatataaattttgcagggttggattctcaaaaaaaaaaaaaaaaaaaa

SEQ ID NO: 1076 - protein, 325 aa, Panicum virgatum
  misc_feature: Ceres CLONE 1757049
  misc_feature (1)..(48): Pfam Name: Myb_DNA-binding Pfam Description: Myb-like DNA-binding domain
  misc_feature: The sequence is a functional homolog of  SEQ ID NO 1052 in the  11/479,226 US patent application
  misc_feature: The sequence is a functional homolog of  SEQ ID NO 456 in the  10/412,699 US patent application
  misc_feature: Useful for making plants with modulated growth and phenotype characteristics
MGRSPCCDENGLKKGPWTSEEDQKLMEYIQKHGHGSWRALPKLAGLNRCGKSCRLRWTNYLRPDIKRGKFTEEEEQTILRFHSVLGNKWSAIAKHLPGRTDNEIKNFWNTHLKKKLIQMGFDPMTHRPRTDFFAALPQLIALANLRQLVEQRPWDDHAARLQVEAVQAAKFQCLQNLIQSAASIAISPSSSSINTIPDLEQIGLLSPPQMSSLSSLPSPSFLESISGQDIVAGQLPDIQIPSTFFEQPTSNDTNQNSDFTPKSSVEGENGTPKTLLLSENSLPPLTDFPISNLGDACSASSCDGSSIQFPSWPEFFDEQFLSEFE

SEQ ID NO: 1077 - DNA, 1086 bp, Panicum virgatum
  misc_feature: Ceres CLONE 1757139
  misc_feature: Encodes the peptide sequence at SEQ ID NO. 1078
gtcccaccccgaccccgtttcgccgttctcttccttctctttttcctcagccgcctcgccctcgctccccctgtgtgcagcaaaaccttgccgcgaatcgccgacgcgaagccccaacccagaggagccgacgagctgggcgctaggcggccatgggtgacagccagtactccttctccctcaccaccttcagcccttcaggaaagttggtgcagatcgagcacgcgctcacggcggtcggatccggccagacctcgctcgggatcaaagctgccaatggtgtagtcatcgccactgagaagaaactgccttctatcctagtggatgaaacatctgtgcaaaagattcagtcactgacaccaaatattggagttgtttacagtggtatgggtccagatttccgtgttctggtgagaaaaagccgaaagcaggcgcaacagtattatcggttgtacaaggaacatatacctgttactcagcttgtacgtgagactgctgctgttatgcaggagtccacgcaatcaggtggtgttagaccatttggagtatccctgttgatcgctgggtatgatgacaatggcccgcagctgtatcaggttgacccctcaggatcatacttctcctggaaagcatcagctatggggaaaaatgtttccaatgcaaagacatttcttgaaaagagatacacagaagatatggagcttgatgatgccatccacactgctattttgactctgaaagaaggatatgaggggcaaatttctgccaacaatattgaaattggaattattcgcgctgaccgtgaattcaaagttctaagcccatcagagatcagggatttcttggaagaggtggagtaagcttggtcatgatttactgtgtcaaacaatgaaggcatcactcatgagcagcccgcctgaagcttttcttttggtttatttgccacttctgtaaactgatttgctctggtgaatgtgatgcttacgtttgaaccccgtggatgcatattgtagacaagataaccaggtggatgttcatgttgtacttggccgattcctgcgggattaaaaaaaaaaaaaaaaaaaa

SEQ ID NO: 1078 - protein, 235 aa, Panicum virgatum
  misc_feature: Ceres CLONE 1757139
  misc_feature (1)..(235): SWISSPROT Homolog: EC 3.4.25.1 Proteasome subunit alpha type 2
  misc_feature (1)..(235): SWISSPROT Homolog: EC 3.4.25.1 Proteasome subunit alpha type 2-A
MGDSQYSFSLTTFSPSGKLVQIEHALTAVGSGQTSLGIKAANGVVIATEKKLPSILVDETSVQKIQSLTPNIGVVYSGMGPDFRVLVRKSRKQAQQYYRLYKEHIPVTQLVRETAAVMQESTQSGGVRPFGVSLLIAGYDDNGPQLYQVDPSGSYFSWKASAMGKNVSNAKTFLEKRYTEDMELDDAIHTAILTLKEGYEGQISANNIEIGIIRADREFKVLSPSEIRDFLEEVE

SEQ ID NO: 1079 - DNA, 1327 bp, Panicum virgatum
  misc_feature: Ceres CLONE 1757248
  misc_feature: Encodes the peptide sequence at SEQ ID NO. 1080
acttgctctcgctgccaatggccgagatctgctgcgaggaagccaagtccacgccggctaccgccgtggccgtcgcctcctcggcgctagagaggaggcgacgcaggttggagatgaggcggttccgcgtcgcgaccgatctcgaggcgccggccgaggaggacgtccgcgccggcaagcggctgcggctggcgcgcacggcgtccggctcgtgcgccgacgccgtcccggattgcaagaggccggccccgccggagcggttgccgaggtacggggtcagctccgtctgcggccggcgccgcgagatggaagacgccgtctgcattaggccggacttcctgccgggcgccagcaagcaccacttcttcggcgtcttcgacggccacggctgctcccacgtggccgcgttgtgccaggacaggatgcatgaggttgtcgctgacgagcaccacaacgccgggtccggtgaagtggcggcgtggaagggggtgatggagaggagcttcgcgcgattggacgagcaggccacgagctgggctagcagccgcagcggcgacgagcccgcctgcagatgcgagcagcagatgccctcgcggtgcgatcacgttgggtccaccgccgtggtcgccgtagttagccccacccacgtcgtcgtcggtaacgccggcgactcccgtgccgtcctctcacgcgctggcgcgcccgtcgagctttccgtcgaccacaagcctgaccggcctgacgagctggcgcgcatcgaggcggcgggcggtcgcgtcatctactgggatggcgcccgtgttctcggcgtcctcgccatgtctcgagccataggcgatgggtacctaaagccattcgtgtcgtcggagccggaggtgacggtgacggagcgcaccggcgaggacgagtgcctgatcctggccagcgacggcctgtgggacgtcgtgaccaacgagatggcgtgcgaggtcgtccgcgcgtgcttccgtagcaacggtccgccggcgccggccgctcggccggacggcgcggcgccgcccgcggccgacgcggacgccgagaacggatccgcggtggtcaagggcgtgagcaaggcggattccgacaaggcgtgctccgacgcggccatgctgctggcgaagctggcgctggcccggcggagcgccgacaatgtcagcgtggtcgtcgtggatctccgacgggggatatgattcttggagcagagcagaaatcatatgctccatgatttgcttgctttagaccccccccccccccttttttcaaaatccacaagctaatacttccccaaaaaaaaaaaaaaaaaaaa

SEQ ID NO: 1080 - protein, 397 aa, Panicum virgatum
  misc_feature: Ceres CLONE 1757248
  misc_feature (1)..(306): Pfam Name: PP2C Pfam Description: Protein phosphatase 2C
  misc_feature (11)..(327): SWISSPROT Homolog: EC 3.1.3.16 Protein phosphatase 2C
MAEICCEEAKSTPATAVAVASSALERRRRRLEMRRFRVATDLEAPAEEDVRAGKRLRLARTASGSCADAVPDCKRPAPPERLPRYGVSSVCGRRREMEDAVCIRPDFLPGASKHHFFGVFDGHGCSHVAALCQDRMHEVVADEHHNAGSGEVAAWKGVMERSFARLDEQATSWASSRSGDEPACRCEQQMPSRCDHVGSTAVVAVVSPTHVVVGNAGDSRAVLSRAGAPVELSVDHKPDRPDELARIEAAGGRVIYWDGARVLGVLAMSRAIGDGYLKPFVSSEPEVTVTERTGEDECLILASDGLWDVVTNEMACEVVRACFRSNGPPAPAARPDGAAPPAADADAENGSAVVKGVSKADSDKACSDAAMLLAKLALARRSADNVSVVVVDLRRGI

SEQ ID NO: 1081 - DNA, 1147 bp, Panicum virgatum
  misc_feature: Ceres CLONE 1757292
  misc_feature: Encodes the peptide sequence at SEQ ID NO. 1082
ttcacaacaaaagtcacacatacacaacacactttcaattctccacaccacacgaccaccagctcagctctcagtaaaccccgtccactcctttatcatcgtctccctctcatatcccttccctccattcccatctcagtcctcctgccatcaatggcgaatgcttctctccaatcctttcttcttccccaacaccattctttcgtcaacgctggcggcagccatgacagctccccatctgctctactgaagctctctaacaacaacagcggcagcatttccttcaggctctactccaacacctccccttcggtgaccacaacttcgactgccaactcatcagctccgactccagtcacccctgccgcagcagcagactcgccaccctccccctccatagacctgcttggtcgccagctcgcagcaagggactaccgccaagccgatgacaccacccgggcgctcctcatcgagctcgcgggggagtctgcagggcggcgagggtacgtcttcttctctgaggtccagttcatctccaccgaggacctccgcaccattgacaagctctggaaggagcacagcaatggcaagtttgggtacagcgttcagcggcggctttgggagaagtcacggcgtgacttcacccgcttcttcatcaaggttggctggatgaagaagctagacaccgagatagagcagtacaactacagggcatttcctgatgagttcatttgggagatgaaggatgacacacctgaaggtcacctgccgctcaccaatgccctcagggggacacagctgctagggaacatcctcacccacccggccttcgaggaagagagccaggaaaatgaagccgcagcagaggagagtgctacagctgctggtcagagcaaagatgataacaaagggagggacagaccaaagtttatgaaagatttcaagcctaactactccttttgaggctggaaaaaaaggcatgggagtttgtgatgcagagatgctggcatgatgtaattgatttaaaagaacatgtatctgtagttttatttgtcttattttcttcaacatgcatgagaacttgtgcaatatattatgaatataattggttcaggtgtttgttctgcaaaaaaaaaaaaaaaaaaaa

SEQ ID NO: 1082 - protein, 269 aa, Panicum virgatum
  misc_feature: Ceres CLONE 1757292
  misc_feature: Great-hit functional homolog of the protein sequence given in SEQ ID NO 9727
  misc_feature: Useful for biocontainment applications
  misc_feature: The leaves start out wild- type green and gradually turn yellow-green in color, while the cotyledons stay wild-type green.
MANASLQSFLLPQHHSFVNAGGSHDSSPSALLKLSNNNSGSISFRLYSNTSPSVTTTSTANSSAPTPVTPAAAADSPPSPSIDLLGRQLAARDYRQADDTTRALLIELAGESAGRRGYVFFSEVQFISTEDLRTIDKLWKEHSNGKFGYSVQRRLWEKSRRDFTRFFIKVGWMKKLDTEIEQYNYRAFPDEFIWEMKDDTPEGHLPLTNALRGTQLLGNILTHPAFEEESQENEAAAEESATAAGQSKDDNKGRDRPKFMKDFKPNYSF

SEQ ID NO: 1083 - DNA, 1342 bp, Panicum virgatum
  misc_feature: Ceres CLONE 1757321
  misc_feature: Encodes the peptide sequence at SEQ ID NO. 1084
gagcacgcgtaggcggtaggccacacctgggcatccctctctagctaacttcgcagctgacgagacttgttacacgaacaatgggctacgctggtctcgcgcctctgctcgcgctcgcctccgtcctctgcctgctgcccgcggcgtccgcggcgcgggccttcttcgtgttcggcgactccctcgtggacaacggcaacaacaactacctgctcaccacggcacgcgccgacgcgccgccctacggcatcgacttccccacgcaccgcgccacgggccgcttctccaacgggctcaacatccccgacatcatcagcgagcacctcggggccgaaccagcgctgccgtacctgagcccggagctccggggggcgaagctgctcgtcggcgccaacttcgcgtcggccggcgtcgggatcctcaacgacacggggatccaatttgtgaacatcatccggatcggcgaccagctgcagtacttccgggagtaccagcggaagctgagggccctcgtcggcgaggagcaggcgacgcagctcgtgaaccaggccctcgtgctcatcaccctcggcggcaacgacttcgtcaacaactactacctggtgcccatgtccgtgcgctcgcgccagtacgcgctcccggactacatccgcttcctcgtcgccgagtaccgcaagatcctatcgaggctgtacgagctgggcgcgcggaaggtgatcgtgacggggacggggccgctggggtgcgtgcccgcggagctggcgatgcacagccagaacggcgagtgcgcggcggagctgatgcgcgccaccaacctcttcaacccgcagctggtggacatggtgcgcggcctcaaccgagccatcggcgccgacgtcttcgtcacggccaacaccatgcgcatgaacttcgactacatcaacgacccgcagagattcgggttcacgaacgtgcaggtggcgtgctgcgggcagggcccgtacaacgggatcgggctgtgcacgccggcgtccaacgtgtgcgccaaccgggacgtgttcgccttctgggacgcgttccaccccacggagcgggccaaccgcatcatcgtcggccagttcatgcacggcgacacggactacatgcaccccatgaacctcagcaccatcctcgccatggaccgggaggggcggctctagacccatcttctagcgtgaccatcagtcgatctgcctggattagtgtgtcatgtcgtggcccgatcgagtgcgagtgtgtgtgtgacaatgccttactgatatatctgtcataaatttaacagaattagtaattggttgggattgaaaaaaaaaaaaaaaaaaaa

SEQ ID NO: 1084 - protein, 365 aa, Panicum virgatum
  misc_feature: Ceres CLONE 1757321
  misc_feature (1)..(313): Pfam Name: Lipase_GDSL Pfam Description: GDSL-like Lipase/Acylhydrolase
MGYAGLAPLLALASVLCLLPAASAARAFFVFGDSLVDNGNNNYLLTTARADAPPYGIDFPTHRATGRFSNGLNIPDIISEHLGAEPALPYLSPELRGAKLLVGANFASAGVGILNDTGIQFVNIIRIGDQLQYFREYQRKLRALVGEEQATQLVNQALVLITLGGNDFVNNYYLVPMSVRSRQYALPDYIRFLVAEYRKILSRLYELGARKVIVTGTGPLGCVPAELAMHSQNGECAAELMRATNLFNPQLVDMVRGLNRAIGADVFVTANTMRMNFDYINDPQRFGFTNVQVACCGQGPYNGIGLCTPASNVCANRDVFAFWDAFHPTERANRIIVGQFMHGDTDYMHPMNLSTILAMDREGRL

SEQ ID NO: 1085 - DNA, 1363 bp, Panicum virgatum
  misc_feature: Ceres CLONE 1757400
  misc_feature: Encodes the peptide sequence at SEQ ID NO. 1086
aaaaaaaacacctcgcttttgtactcttccgtctttgccctcgcgctctcgcctcgcccccgttcgctcggccggcgcgtgtacgtgcgtacagcgagcggagaagggaaaagagagagagagagagagagagaaaagaaaagagtcttgcggcccttgccttgccttgggttgagctcattcgctgttcgttcatggagagctcctcccacaagcgggcgcgggaggcggccgacctcgccgccgccggcgacggcgcgctgccggagaagaggctgcggcccgaggacctgctcgacctgctcgacgatgacgccgacgcggccgccgccggcgacctggcgtccgtcatgcggagcctcgaggaggagttagggagcttcgacgaggccggggcccccgacgccgccgccgcgccgccggcgcaccagccggagctggggttcctgctcgaggcctcggacgacgagctggggctgccgcctgcgggcgcctcctcgtcggaggaggaggccgtggccgccggggcgccggacgtggccgccgggctcgacggccagatctgggggttcgaggacgagatcgacggcggcttcggcggctactcgccggaggcggccgccgccgccgcggcggcggcggcgtgggacgacgacggcttcgacgctgggctgttcgcgttcggggacgacgcctgcggggcctcggatctcgcggccctgcgccacgagaccatgccggccgtctgatgacgggccccggccggctagccagtggattagcgttccttttctttttcttgcttttttttacctttggctaaccttagctggaactaccctctttttttaaccttggtgtaaagtttttagaagggtaaaaacagaggcgtggaaacctggggaaggttccgaccggggaaaagaatctgaaaatggtttccctttttgcccttgggaattattttctcgcttattataaatgaaaaacggaagaagaaataagctagcataagctagcgagtagtaaaaaaacagcagtgaagtcaattgaaagatgccgacacgttagtggcttgggtggaggggatcaacatgacatgtggctgctggaaggacgctgaccaactgatgtgacagactccaaatctcagaaaagatctgtgattaattgtggacggagaaaatggacggcaaattatttcaagaaaatggacgggaatgcttggaactgtctgtccttcattcaagttggataatccatgaattttataatttttctctatagaatatagatatattgtactgcaaataactttattctgatggagtcattgagaggataaaaaaaaaaaaaaaaaaaa

SEQ ID NO: 1086 - protein, 184 aa, Panicum virgatum
  misc_feature: Ceres CLONE 1757400
  misc_feature: Great-hit functional homolog of the protein sequence given in SEQ ID NO 9355
  misc_feature: Useful for making plants with modulated low light sensitivity
MESSSHKRAREAADLAAAGDGALPEKRLRPEDLLDLLDDDADAAAAGDLASVMRSLEEELGSFDEAGAPDAAAAPPAHQPELGFLLEASDDELGLPPAGASSSEEEAVAAGAPDVAAGLDGQIWGFEDEIDGGFGGYSPEAAAAAAAAAAWDDDGFDAGLFAFGDDACGASDLAALRHETMPAV

SEQ ID NO: 1087 - DNA, 1299 bp, Panicum virgatum
  misc_feature: Ceres CLONE 1757409
  misc_feature: Encodes the peptide sequence at SEQ ID NO. 1088
ctattcattccccgcgcaccactcgagtcgagagccacctgatccttcgttccccgtcttcctctcccccggcacgtcgctgtcgccattgccgcgccgctcgagagcggaagggggtaggtggggaagcggcggggatggggcgcgggccggtgcagctgcggcggatcgagaacaagatcaaccgccaggtgaccttctccaagcgccggaacgggctgctgaagaaggcgcacgagatctccgtgctctgcgacgccgaggtcgcgctcatcgtcttctccaccaaggggaggctctacgagtactccagcaatgacagcatggaaggcattcttgagcgttaccaacgatactcgtttgaagaaagagcagtacttgatccaaatattggagaccaggcaaactggggagatgaatatggctggttaaagaccaaacttgatgcacttcagaagagtcagaggcaactgttaggagaacaactggattcacttaccgtaaaagaactccagcaactggagcaacaactggacagctctctgaagcatataagatcaagaaagaatcagctcatgtttgattcaatttctgagcttcagaaaaaggagaaatcacttacagatcaaaatggtgtcctgcaaaagctcatggaggcagagaaagagaaaaacaatgcattaatgaatgcacacctccgggagcagcaaaatggagcatcaacaagcttgccatcaccaccgccatcaacagttccagattccatgccaactctaaatattaggccgcgtcaacctagagaaggaacagtaggggagtctgaacctgaatcgtctcctgctcaagtgaacagcggcaagctgcctccatggatgctacgcagtgtcagtaacagatgagctgttcctgatacggttctgcggctgaactcggatggcaaacacaccgtcaccaacacccttcggtgacccaggcatccataccggctcgatccagtagatgccagcatagtcactaataataagatcaggtatcaagtgctttacagggtgaataaagtctgaagctcctctgcaccatcatattgcgttttgttctcgcgtctgctgtctacctttttttttttctccgatcgacaagctcgtggttggagatgtatgctgtatcatgtttttcgtgtttacacttttacgaaaacagaaggctcttctcctggtaagggttgagtcccgatcaaagtgtcaaatgcgtaattcggtatcttagcagtattaacagcaaaaaaaaaaaaaaaaaaaa

SEQ ID NO: 1088 - protein, 253 aa, Panicum virgatum
  misc_feature: Ceres CLONE 1757409
  misc_feature: Great-hit functional homolog of the protein sequence given in SEQ ID NO 9300
  misc_feature: Great-hit functional homolog of the protein sequence given in SEQ ID NO 9694
  misc_feature: The sequence is a functional homolog of  SEQ ID NO 730 in the  10/666,642 US patent application
  misc_feature: Useful for making plants with altered alkaloid content
  misc_feature: Useful for making plants with modulated biomass
  misc_feature: Useful for making plants with modulated flowering time
  misc_feature: The plant flowers significantly earllier than wild-type.
  misc_feature: The rosette leaves do not appear in the normal fashion, i.e., their phyllotaxy may be abnormal or too many leaves may be emerging in comparison to the control.
  misc_feature: Useful for making plants with modulated growth and phenotype characteristics
MGRGPVQLRRIENKINRQVTFSKRRNGLLKKAHEISVLCDAEVALIVFSTKGRLYEYSSNDSMEGILERYQRYSFEERAVLDPNIGDQANWGDEYGWLKTKLDALQKSQRQLLGEQLDSLTVKELQQLEQQLDSSLKHIRSRKNQLMFDSISELQKKEKSLTDQNGVLQKLMEAEKEKNNALMNAHLREQQNGASTSLPSPPPSTVPDSMPTLNIRPRQPREGTVGESEPESSPAQVNSGKLPPWMLRSVSNR

SEQ ID NO: 1089 - DNA, 1251 bp, Panicum virgatum
  misc_feature: Ceres CLONE 1757868
  misc_feature: Encodes the peptide sequence at SEQ ID NO. 1090
aaaaaagttgtgctgcaaattagtatcaagaatgaagatgcggggtttgaggagctcaagcagcctactagtggcggcagcagcactgctgctcttctcctgcttcttggccactggggacgccgccaataatggcggcggccttaggctgggttactactcggcgagctgcccgcgcgcggaggacatcgtgagggagcaggtggcgcagctgtacgacaagcacggcaacacggcggtgtcgtggctgcgcgccctgttccacgactgcatggtcgggtcctgcgacgcgtcgctgctgctggacacgagcgccgccgcgggcatctccgagaagtccgccccgcggagcttcggcatgcgcaacttcaagtatgtcgacgccatcaaggcggcgctggagcgggagtgccctggcaccgtctcctgcgccgacgtgctcgtcctcgccgcgcgcgacggcgccgccgcgctgggcgggccccgcgtcgccatgcgcacgggccgccgggacagccgggcgagccgctacgccgaggtggggcgcgacatccccaaccacaacgacagcgtgtcggcggtgctctcccggttcgcggccttgggcgtcgacgccgagggcgcggtggcgctgctgggcgcgcactccgtcggccgcgtgcactgcttcaacctggtggggcggctgtacccgtcggtggacgccggcatggacccggcgtacggcgcctacctccgtgggcggtgcccgacggcggacgccaaggaggacacacgcgacgtcgcgtacgcgcgcaacgaccgcgccacgcccatggtgctcgacaacatgtaccacaagaacctgctggcgcgcaggggcctcctcctcgtcgaccagcggctcgccgacgacccccgcaccgcgcccttcgtcgccaggatggccgccgacaacgcctacttccacgaccgcttcgccgccgctctgcttaccatgtcggagaacaacccgctcgccgccgacgagggggaggtcaggcgcgactgcaggttcgtcaactcggcatgatgatcgaagacgactacaggcccccgctagctagctattcgatcaggacttgccgtgctcgatccatatgcggtgtatggtcaggacgaaaatgctagcttatactattcagcacgaaaaatcaaggcacgtccatcttaacttatctgtgcaatacataaaaaaatgcaattccacaataaaaaaaaaaaaaaaaaaaa

SEQ ID NO: 1090 - protein, 339 aa, Panicum virgatum
  misc_feature: Ceres CLONE 1757868
  misc_feature: Great-hit functional homolog of the protein sequence encoded by LOCUS At2g37130
  misc_feature (1)..(248): Pfam Name: peroxidase Pfam Description: Peroxidase
  misc_feature (14)..(337): SWISSPROT Homolog: EC 1.11.1.7 Peroxidase 42 precursor
  misc_feature (19)..(337): SWISSPROT Homolog: EC 1.11.1.7 Peroxidase 21 precursor
  misc_feature: Useful for making plants with altered cell wall content and/or composition
MKMRGLRSSSSLLVAAAALLLFSCFLATGDAANNGGGLRLGYYSASCPRAEDIVREQVAQLYDKHGNTAVSWLRALFHDCMVGSCDASLLLDTSAAAGISEKSAPRSFGMRNFKYVDAIKAALERECPGTVSCADVLVLAARDGAAALGGPRVAMRTGRRDSRASRYAEVGRDIPNHNDSVSAVLSRFAALGVDAEGAVALLGAHSVGRVHCFNLVGRLYPSVDAGMDPAYGAYLRGRCPTADAKEDTRDVAYARNDRATPMVLDNMYHKNLLARRGLLLVDQRLADDPRTAPFVARMAADNAYFHDRFAAALLTMSENNPLAADEGEVRRDCRFVNSA

SEQ ID NO: 1091 - DNA, 1238 bp, Panicum virgatum
  misc_feature: Ceres CLONE 1757994
  misc_feature: Encodes the peptide sequence at SEQ ID NO. 1092
gaggaggaagaagccaaaatacttgaggttgagagctcactgttgcgcgcctgtgcgtggttcttgatcgaatcgagccgaggccggtcggagttcagcccgagggatggcaactgggagcgaagccacaaagccagctgaggctgtgcttgaatggaacaaacaggacaacaagaggatgcttcatgctgtttaccgtgttggggatttggaccgcacaatcaagtactacacggaatgctttgggatgaagctgctgaggaaaagagacgttcctgatgagaagtacaccaatgccttccttggttttggaccagagaccaccaactttgcgcttgaattgacatacaactatggcgtcgacaagtatgacatcggagagggctttgggcatttcgctatcgctaatgaggatgtgtacaagttggctgagaatattaaatccaagggtggcaagattactcgtgaacctggtcctgtcaagggaggatccactgttattgcctttgcacaagaccctgatggttacttgtttgagcttattcagagggctgagacacctgagcctctttgccaagtcatgcttcgtgttggtgaccttgagcgttctatcaagttctatgagaaggcccttgggatgaagcttctaagaaagaaggatgtgcctgattataagtataccattgccatgttgggctatgctgatgaggacaagacaacagttctggagctgacatacaactatggtcgcacagaatatagcaagggcaatgcatatgctcaggttgctattggcaccaatgatgtgtacaagagtgccgaggctgttgatcttgcgaccaaagaactaggtggaaagattttgcggcagccagggccgctacctgggatcaacacaaagatcgcctcttttgttgacccagatggctggaaagtggttctggttgaccacaccgacttcctcaaggagctccagtgaagcccagagcccctgacacccaggtgccctgctggatgtagtaatgcttgtccgtgatgtaataaatggcgattggtgtttgggtttgttcctgccatgatgaactgaaaataaaactgctgcagagttgtgcttttgctagtgaggattggggttgactgtgtggttctgcctgttactagtttgcaattgctacctgtagcaatctgtctattacactggatcagttcgcgtggttgaaaaaaaaaaaaaaaaaaaa

SEQ ID NO: 1092 - protein, 290 aa, Panicum virgatum
  misc_feature: Ceres CLONE 1757994
  misc_feature: Great-hit functional homolog of the protein sequence given in SEQ ID NO 9549
  misc_feature (1)..(126): Pfam Name: Glyoxalase Pfam Description: Glyoxalase/Bleomycin resistance protein/ Dioxygenase superfamily
  misc_feature (1)..(290): SWISSPROT Homolog: EC 4.4.1.5 Lactoylglutathione lyase
  misc_feature: Useful for making plants with modulated nitrogen use efficiency
MATGSEATKPAEAVLEWNKQDNKRMLHAVYRVGDLDRTIKYYTECFGMKLLRKRDVPDEKYTNAFLGFGPETTNFALELTYNYGVDKYDIGEGFGHFAIANEDVYKLAENIKSKGGKITREPGPVKGGSTVIAFAQDPDGYLFELIQRAETPEPLCQVMLRVGDLERSIKFYEKALGMKLLRKKDVPDYKYTIAMLGYADEDKTTVLELTYNYGRTEYSKGNAYAQVAIGTNDVYKSAEAVDLATKELGGKILRQPGPLPGINTKIASFVDPDGWKVVLVDHTDFLKELQ

SEQ ID NO: 1093 - DNA, 1120 bp, Panicum virgatum
  misc_feature: Ceres CLONE 1758012
  misc_feature: Encodes the peptide sequence at SEQ ID NO. 1094
agtccaacaaacattaatacagtgtcgtccgaaactgctgcttgatgtggtggttctaccgcaaggggccctcgggcttctccagcgcctccacggccgaggaggtcaccgccggcgtcgacggccgcggcctggtcgccgtcatcacaggtgcgtcgagtggaatcgggctggagacggcgcgcgtcctggcgctgcgaggtgtgcacgtcgtcatgcccgtccgcaacgtcgccgctgggctcgcagtcaaggagtccatcgtggccaagatccccgtcgcaagaattgacgtgctggagctggacctcagctccatggcatcggtaaggagattcgcctccgagttcgaatctctgaacctgcccctgaacattctcatcaacaacgctggagttctgacaaggaaccgcacgtgttcctgcgacggcctggaactgcatttcgcaacaaatcacattggtcactttcttctaacaaacctcctattggagaacatgaagagcacatgtagggacagcggcaccgagggacggattgtcaatgtgacgtcagtagggcatgccatgatgacttatcctgaagggatatgctttgacaaaattcatgatccttccggtttgaatgactttattgcttactgccaatccaagcttgccaatattcttcactccaatgaattatcacgaattttcaaggaggaaggagtgaatatttcagccaatgccgttcatcctggtgtcatcatgactaacatttttagggacaagactattgtcggtgcgttttttaacaccattggaagaatcatatgtagaagagttgaacaaggtgccgcaacgacatgctatgtggcgatgcatcctcaagtgaaggggataagtggaaagtacttcgccgattgtaacatatccagcccaagcttacaagcctcagatgctgagctggccaagaagctatggcagttcagcttgcagacagtgtcttcttgatcaagctatgcttgcctgaacgagtgatgcacgtattgttgtacttaatgcttacatagctcttccggatgtttgttatcggtgtatttagttactgcgctatgaatcaaaaaaaaaaaaaaaaaaaa

SEQ ID NO: 1094 - protein, 315 aa, Panicum virgatum
  misc_feature: Ceres CLONE 1758012
  misc_feature (1)..(141): Pfam Name: adh_short Pfam Description: short chain dehydrogenase
MWWFYRKGPSGFSSASTAEEVTAGVDGRGLVAVITGASSGIGLETARVLALRGVHVVMPVRNVAAGLAVKESIVAKIPVARIDVLELDLSSMASVRRFASEFESLNLPLNILINNAGVLTRNRTCSCDGLELHFATNHIGHFLLTNLLLENMKSTCRDSGTEGRIVNVTSVGHAMMTYPEGICFDKIHDPSGLNDFIAYCQSKLANILHSNELSRIFKEEGVNISANAVHPGVIMTNIFRDKTIVGAFFNTIGRIICRRVEQGAATTCYVAMHPQVKGISGKYFADCNISSPSLQASDAELAKKLWQFSLQTVSS

SEQ ID NO: 1095 - DNA, 1256 bp, Panicum virgatum
  misc_feature: Ceres CLONE 1758143
  misc_feature: Encodes the peptide sequence at SEQ ID NO. 1096
aaaccgtgtgcgccaccagcagctagcgacccgacgagcaaaaaccacacccgcctccggcccgccgccatggccttctgcgcggacgctcagtcccagcccgcgtgggcgctggcgctggcggcgctggggctcctcgcgtccgcgcgcgccgcggcgcgcctcgcgctgtggctgtacgccgcgttcctccgccccgcgcggccgctgcgccgccgctacggcgcgtgggccgtcgtcacgggcgccacggacggcatcggccgcgcgctcgccttccgcctcgccgcggccggcctcggggtcgtcctcgtcggccggagcccggacaagctcaccgccgtcgcggccgagctcgaggccaagcgcccgggggccggggtccgcaccttcgtcgtcgacttcgctgccgacgacctcgcctcgagggtgggcgcgctcggggagttcctccggggcctcgacgtcggcgtgctcgtcaacaacgtcggcgcgtcctacccgtacgcgcgctacttccacgaggtggacgaggcgctggcgcagaggctgatccgtctcaacgtcgaggccgtcacgcgggtcacgcacgccgtgctccccggcatgctggagcgcgggcggggagccatcatgaacatgggctccggcgcctccgccatcatgccgtccgacccgctgtacaccgtctacgtcgccaccaaggcctatgtcgatcaattctcgagatgcctgtatgtcgagtacaagagcaaaggcatcgacgtgcaatgccaggtgcccattcaggtggcgatgaagctggcgtccatccggaagcccaccctcctggcgccgtcgccggaggcgtacgcccgcgccgccgtccgcagcatcgggtacgagccgcagtgcacgccgtactgggtgcacgcggtggtggggttcctcatctccctcgtgccggagcccatcgccgacaggatgttcctcaacaggtccctcggcatccgcgccaggggccgcgccaaggaggccaagaagaaggcgcagtgatcggcgagggtccgggcctccgccgttggtcgtcgctggatttggatttgcagacggtttaaagtccctagcgatggccgttttaaaccgtatttgcatctaataacacacgggctgatgactgctacatacgagttgtgtcatggaacaaattaaagttgagtttagtttgatgagctacaagactacggactatttggtaaaaaaaaaaaaaaaaaaaa

SEQ ID NO: 1096 - protein, 321 aa, Panicum virgatum
  misc_feature: Ceres CLONE 1758143
  misc_feature (2)..(175): Pfam Name: adh_short Pfam Description: short chain dehydrogenase
MAFCADAQSQPAWALALAALGLLASARAAARLALWLYAAFLRPARPLRRRYGAWAVVTGATDGIGRALAFRLAAAGLGVVLVGRSPDKLTAVAAELEAKRPGAGVRTFVVDFAADDLASRVGALGEFLRGLDVGVLVNNVGASYPYARYFHEVDEALAQRLIRLNVEAVTRVTHAVLPGMLERGRGAIMNMGSGASAIMPSDPLYTVYVATKAYVDQFSRCLYVEYKSKGIDVQCQVPIQVAMKLASIRKPTLLAPSPEAYARAAVRSIGYEPQCTPYWVHAVVGFLISLVPEPIADRMFLNRSLGIRARGRAKEAKKKAQ

SEQ ID NO: 1097 - DNA, 1310 bp, Panicum virgatum
  misc_feature: Ceres CLONE 1758161
  misc_feature: Encodes the peptide sequence at SEQ ID NO. 1098
gcgagctccctccgcaagtcccctctcggattctccaaacaccagcagctcctctccgccagcgtcgctcacgctgcctgcccctccgctcccaggaagacgcgcgagcgccccgcgcccgggagcactcgctaaagatggcgcccgccttcgccgccgcaccttcctcctccgtatgcgtcgttcgcatcccaacagcgtgccgtttcgaagcgcagagcacggttcccacggccaggtttctgcgtaatcgggtggcagctaaaacacggtcttctgctgcatggtccttgaaggctggcttgtgggattctctcagatccggctttttgaaaaataataacagtaccgagacagtagagccaccaccagcaccacttgaagtcgaagaacctttgcctgaggaattagtacttctggaaaggacactacctgatggtagcacagaacagattttattttcttcagctggagatgttgatgtatatgacctccaagccttatgtgataaggtaggatggccacgcagacctctatcaaaaatagcagcatccttaagaaacagctacttggttgctacgctacattcaataattaagtcttcagaaacagagggagaagagaagaaacagctgattgggatggcacgagcaacttcagaccatgccttcaatgctacaatttgggatgtcctggttgatccttcatatcagggtcaaggtcttggtaaagcacttatggagaaagtaattcgtactttgctccagagagacatcaacaacattacattgtttgcagataataaagttgtagatttctacaagaacttgggatttgaagctgatcctcaaggcatcaagggcatgttctggtatcccagattttagcgccagcagccagatagattgtacctgaagtttctcccattccgaaagggtaatgccaggtcagagttgacatgcctcagggctccaagcccggatggatcgtccttaacatttcatcctggtgacaaacaacaattttctccaatgctaaaatgatcaggctgtcggctcaaggtcaactcaccacttgtaaccataactgcagcaaaacacgctatctgtagcaaccaggtttcatacactgcactctgggctctgtccatctgtatgtagcattctctacactcggaacgaaatactgtatccatccatcagttgtccatgtgcacaccatcatgctgtactgtacgcgggaaagaaattgctttctatcaactatcaagtatcaacatcgaattgctgtaaaaaaaaaaaaaaaaaaaa

SEQ ID NO: 1098 - protein, 249 aa, Panicum virgatum
  misc_feature: Ceres CLONE 1758161
  misc_feature (2)..(77): Pfam Name: Acetyltransf_1 Pfam Description: Acetyltransferase (GNAT) family
MAPAFAAAPSSSVCVVRIPTACRFEAQSTVPTARFLRNRVAAKTRSSAAWSLKAGLWDSLRSGFLKNNNSTETVEPPPAPLEVEEPLPEELVLLERTLPDGSTEQILFSSAGDVDVYDLQALCDKVGWPRRPLSKIAASLRNSYLVATLHSIIKSSETEGEEKKQLIGMARATSDHAFNATIWDVLVDPSYQGQGLGKALMEKVIRTLLQRDINNITLFADNKVVDFYKNLGFEADPQGIKGMFWYPRF

SEQ ID NO: 1099 - DNA, 1012 bp, Panicum virgatum
  misc_feature: Ceres CLONE 1758187
  misc_feature: Encodes the peptide sequence at SEQ ID NO. 1100
aatcgtcttcccccagtgcgaactaatcgtcttcccccagtgcgctccctctccccaccccaaccccaactactaccatcgagcgccaccaactaatcgtaggaggaagcgacccggcgggaagcgatcggtcatggcggcggcgaagatagcaccgtcgatgctctcatctgacttcgccaatctcgccacggaggccgagcgcatgctccgcctcggcgccgactggctccacatggacatcatggatgggcactttgttcctaatctgactattggggctccagtgatccagagcttgaggaaacataccaaagcatatttggactgccatcttatggtcacaaacccttcagattatgtagaaccattgggaaaggctggtgcctcaggattcacattccatatagaagtaaccagagacaactggcaagagctcatccaaagcattaaatcgaagggtatgcggcctggtgtatcattgaggccaggtactccggtggaggaagtttttcccctggtggaagcggaaaatccggtagaattagttcttgtgatgacagttgagcctggtttcggtggtcagaaattcatgccagaaatgatggataaggtgcgtacactgagaaataagtatccttcccttgacatagaggtcgatgggggtctaggtccttcaaccatcgatgtggccgcatctgctggcgctaattgcattgtggctggaagctccatatttggcgctgctgaccctggagaggttatatcggtgcttaggaagagtgtcgagggctctcagaacaaaaactgatctgtaatccacttctgggctgtaagctagatccacgctgcacgtcaatcatataaaaggatcctcacgattgcaccgagaattgttaagcgtgaataaaagttgatgttggccctgatgccattgtcatgtaaccacacgttctttttgaaaaaacccccgcaaagctgagcttttgtgtaaaaaaaaaaaaaaaaaaaa

SEQ ID NO: 1100 - protein, 225 aa, Panicum virgatum
  misc_feature: Ceres CLONE 1758187
  misc_feature (1)..(201): Pfam Name: Ribul_P_3_epim Pfam Description: Ribulose-phosphate 3 epimerase family
  misc_feature (1)..(222): SWISSPROT Homolog: EC 5.1.3.1 Ribulose-phosphate 3-epimerase
  misc_feature (2)..(225): SWISSPROT Homolog: EC 5.1.3.1 Ribulose-phosphate 3-epimerase, cytoplasmic isoform
MAAAKIAPSMLSSDFANLATEAERMLRLGADWLHMDIMDGHFVPNLTIGAPVIQSLRKHTKAYLDCHLMVTNPSDYVEPLGKAGASGFTFHIEVTRDNWQELIQSIKSKGMRPGVSLRPGTPVEEVFPLVEAENPVELVLVMTVEPGFGGQKFMPEMMDKVRTLRNKYPSLDIEVDGGLGPSTIDVAASAGANCIVAGSSIFGAADPGEVISVLRKSVEGSQNKN

SEQ ID NO: 1101 - DNA, 1314 bp, Panicum virgatum
  misc_feature: Ceres CLONE 1758231
  misc_feature: Encodes the peptide sequence at SEQ ID NO. 1102
acaaaacggtattcctctgcagcttgccgtcttcgctgactgcccgcaagaggacctccattccattccgcgtcgtagaagcacgagagtggaagcagcatccatggcgggagaggaggctggaaggagaggtattccctccttgctgaacccgtcctcgtcatccagcgaaggggagcacgaacacatcgcctctgatgtcacacagctcatcggatggacgcctctgatcgagctcaagcgaatcacaggcacggacggggtagatgcccggatcgtcggcaaggtcgaggcgtaccagcccctctgctccgtcaaggatcgcagcgctttgagaatgatagaagatgcagaggagaggggattgatttcacctggtgtcacaacactcgtcgagccaacaagcggcaacttggggttaggaattgtcctcattgctcttcgcaaaggctacaggttcgttgcagttatgccgggtcaatattcacttgataagcagatcctgttgagatacatgggtgctgagttgtatttgactgatccagcccttgaatttccgggcataaatgagaaggttgaacagctgaaaaaagaattgcccaacgtacatgttcttgatcaattctcgaacaaagcaaaccctgaagcacatattaggtggactggacctgagatttggaaggacactgctggcaaggtggacatatttgtagctggttctggctcaggaggtacggtgtctggtgttggaaagtatctgaagatgcaaaacccaggtatcaagatcatctgtgttgagcccacggagagtccagttgtttcaggtggagaaccaggcaaacataaaatccagggcatagggccaggatttatacctgaagtactggacacctcggttattgatgaggctgtcacggtgaccactgaggaggcgatggcgaatgcgaggaggctggccaaggaagagggcctccttgtgggcatatcttctggagcaaacttggcagcttgcttgaaggtcgcatcaagggaagaaaacaaggggaagatgattgtcaccatgtttccaagcgggggcgagagatacatgaactccgacctatttgcagatgtgagggaggagtgtattgcaatgacattttgatctcgtcacttattcagaagaggtttgtttgtcttccaaagttccacatagcatccgacaactgcccaattggcatctgctatatgtagtagctcatatgcggtgataccacaatgaattgtgtaatcttgcaatgaaatttatattcagaaaaaaaaaaaaaaaaaaaa

SEQ ID NO: 1102 - protein, 346 aa, Panicum virgatum
  misc_feature: Ceres CLONE 1758231
  misc_feature: Great-hit functional homolog of the protein sequence given in SEQ ID NO 9420
  misc_feature (15)..(341): SWISSPROT Homolog: EC 2.5.1.47 Cysteine synthase, chloroplast/chromoplast precursor
  misc_feature: Useful for making plants with modulated cold sensitivity
MAGEEAGRRGIPSLLNPSSSSSEGEHEHIASDVTQLIGWTPLIELKRITGTDGVDARIVGKVEAYQPLCSVKDRSALRMIEDAEERGLISPGVTTLVEPTSGNLGLGIVLIALRKGYRFVAVMPGQYSLDKQILLRYMGAELYLTDPALEFPGINEKVEQLKKELPNVHVLDQFSNKANPEAHIRWTGPEIWKDTAGKVDIFVAGSGSGGTVSGVGKYLKMQNPGIKIICVEPTESPVVSGGEPGKHKIQGIGPGFIPEVLDTSVIDEAVTVTTEEAMANARRLAKEEGLLVGISSGANLAACLKVASREENKGKMIVTMFPSGGERYMNSDLFADVREECIAMTF

SEQ ID NO: 1103 - DNA, 1289 bp, Panicum virgatum
  misc_feature: Ceres CLONE 1758299
  misc_feature: Encodes the peptide sequence at SEQ ID NO. 1104
acaagggactcgccaataatggcatctctgactacctgtctcgggggccgttcctcgtggcgccggccggtactggtgcaccgcctcgtggtggtggcgatggcagcagcggcgtttcggccgcaggtagtccatggagcagcatcggctgggcaacagaaaatctcggcgatcttcatgttcggcgactccatcgtagatcccggcaacaacaacaaccggttcacggaggcaaaggctaacttcccgccatatgggcaggacttccctggcggcgttgccaccgggagattctccaatgggttggtacccggggacctcttagcttcgaagttgggtgttaagcagctattgcctcctttccttagtgatgatcttgaactaaaagacctactcactggtgtggcattcgcatgtggaggcagtggttatgatccactcacatcaaaactcgcgacaaccttatccagtaaggatcaacttgacctatttcgtgactacaaggaaaaggtaagagccttggttggagaggaggaaatgacacgtgttatttccgaggccgtctactttgtagtaatgggggcaaatgacattctaaataattatttcgctgttccgttgagacgccacgaatatgatcttccatcgtatgtggattttcttgtctcttcggcaatcagcttcaccaagactctcaatgatatgggtgctaagaggattgggattgttggtgtcccaccactgggatgttgtccttcacaaataacacttggaggaagcccctcacgtcaatgcgaaccactaaggaatcaagcatcaagattatttaattctagaatttcacaggaaatagagatactaaatgcagagcgaagtgcttctggatcaacaattgcttattttgacatatactacaacctacttgatcttattcagaatccagctttgtatggtttcaaggacgtgagcgaaggatgctgtggtagcacagtgttaaatgctgccatattcattgcatatcatagtgcatgtccaaacgccaatgattatattttctgggacggcttccatcctaccgagaaggcatataacattgtagtggacaagcttattcagcaaaatatgaagtatctaatgtgaagaattgatgttgtacgtacaccctcaaaattttaattaatgtccattaccgtacgtccataccgaacaatctgaccatgaatgtaacttttcaatgccatttgccaagtggaccaaacatattgtgtcaaaaaaaaaaaaaaaaaaaa

SEQ ID NO: 1104 - protein, 373 aa, Panicum virgatum
  misc_feature: Ceres CLONE 1758299
  misc_feature (1)..(309): Pfam Name: Lipase_GDSL Pfam Description: GDSL-like Lipase/Acylhydrolase
MASLTTCLGGRSSWRRPVLVHRLVVVAMAAAAFRPQVVHGAASAGQQKISAIFMFGDSIVDPGNNNNRFTEAKANFPPYGQDFPGGVATGRFSNGLVPGDLLASKLGVKQLLPPFLSDDLELKDLLTGVAFACGGSGYDPLTSKLATTLSSKDQLDLFRDYKEKVRALVGEEEMTRVISEAVYFVVMGANDILNNYFAVPLRRHEYDLPSYVDFLVSSAISFTKTLNDMGAKRIGIVGVPPLGCCPSQITLGGSPSRQCEPLRNQASRLFNSRISQEIEILNAERSASGSTIAYFDIYYNLLDLIQNPALYGFKDVSEGCCGSTVLNAAIFIAYHSACPNANDYIFWDGFHPTEKAYNIVVDKLIQQNMKYLM

SEQ ID NO: 1105 - DNA, 1205 bp, Panicum virgatum
  misc_feature: Ceres CLONE 1758343
  misc_feature: Encodes the peptide sequence at SEQ ID NO. 1106
agtcagccagtactccagtatccacgaccacgcagcacctgcgagcacacagcttcgaccccttcttctcagcgcgcgagcgttgccctgtgtgtgttcgttagcagcaggctcggcggcacggatggcgcagtccatgctcatgtcgacgagcgtcagcggcggccgcgcgctgccgtcgctgcagtccggccggccggcgccgtacccgcggctcgcgctgccgtcggcgtgcaggcactctaggtccgtctccgtgaagaccctggccatcttcaacaagtccaaggccaagaccgcgccggcgaagaaggctcctgcgcccaagccgaaggttgaggacaggatcttcggcacgtccggcgggatcggtttcaccaaggagaacgaactgttcgtcggccgtgttgccatgcttggttttgccgcatccctactgggagaggccatcaccgggaagggcatccttgcccagctgaacctggagacgggtatccccatctacgaggcggagcccctcctcctcttcttcatcctcttcaccctcctcggcgccatcggcgctctcggagaccgcggcaccttcgtcgacgacgtcaccggccttgacaaggccgtcatcccacccggcaagggcttccgtggagccctcggcctcagcgagggagggccgctgttcgggttcaccaagtcaaacgagctgttcgtggggcgactggcgcagctgggcgtggccttctccatcatcggcgagatcatcacggggaagggcgcgctggcgcagctcaacatcgagacgggcgtgcccatcaacgagatcgagccgctcgtgctcttcaacgtcctcttcttcttcatcgccgccatcaaccccggcaccggcaagttcatcatcggcgaggacgaagagtagagtgtagagagaccgacgagggatcggaaatggtgcgcctggttgtttgtggttgatcgatcagtgcgtctctgcgcgtgtgcgtgcaatttgctgtgtattgcacgcgaggccttggggattagggtgttgcgttgggattgtctggtaaaaacaagagcttagctttcaaaaggattgaagacgaagagacctgttcaaagcaccgttccagcatgggcgaattgaacatttgaacataataatatctagcatcggtacagatcagattgaaaaaaaaaaaaaaaaaaaa

SEQ ID NO: 1106 - protein, 262 aa, Panicum virgatum
  misc_feature: Ceres CLONE 1758343
  misc_feature: Great-hit functional homolog of the protein sequence given in SEQ ID NO 9477
  misc_feature: Useful for making plants with modulated light quality response
MAQSMLMSTSVSGGRALPSLQSGRPAPYPRLALPSACRHSRSVSVKTLAIFNKSKAKTAPAKKAPAPKPKVEDRIFGTSGGIGFTKENELFVGRVAMLGFAASLLGEAITGKGILAQLNLETGIPIYEAEPLLLFFILFTLLGAIGALGDRGTFVDDVTGLDKAVIPPGKGFRGALGLSEGGPLFGFTKSNELFVGRLAQLGVAFSIIGEIITGKGALAQLNIETGVPINEIEPLVLFNVLFFFIAAINPGTGKFIIGEDEE

SEQ ID NO: 1107 - DNA, 1307 bp, Panicum virgatum
  misc_feature: Ceres CLONE 1758517
  misc_feature: Encodes the peptide sequence at SEQ ID NO. 1108
acctccacacaccacagccaggcctcctcgatctcctctgctagctctccaccatggcggcgcccgaggcctggctatctccggcggcgtcccgcctcccctccctcgccaacgcaccacctcttcgctttcgcgccaagcctaagccatcatcagcggcctgctccttgctctcccgcccagctgcagccctgcacgtgctgcaccgaagggtgaccaccgtccgccgccgtcttggcgccaccgagcagcaaggccaggttcaggagcaggaggaggaggtggtcgacggcaacgtcctcccctactgcagcatcgacaggaagcagaagaggacgctgggagagatggagcaggagttcctacaggcgctccagtccttctactacgaccagaaggccatcatgtccaacgaggagttcgacaacctcaaggaggagctcatgtgggaagggagcagtgtcgttatgctaagccctgatgagcaaaggcttttggaggcttccatggcctatacggctggcaatcccatcatgtctgatgctgaatttgacgagttgaaactcaaattgaagaaagacgggagtgacattgtgactgaaggtcccaggtgcagtctaaggagtcgtaaggtgtacagtgacttgtctgttgactacttaaagatgttcctgctaaatgttccagccaccgtagttgctctgggactgttcttcttcattgacgagttgactggctttgagatcaatgtgttccagctgccagagccttttggtttcattttcacatggtttgctgctttgccactaatattgttcttagcacaatcgttgactaaagccatagtccaggactttctaatcttgaaggggccatgtccaaactgtggcactgaaaatctttccttcttcgggacaatactgtcggtctctagtggcggtacaacaaacaacgtcaaatgtgcagattgcggtaccgagttagtatacgactcaaaatctcggctcatcacacctgcagaggcgtcaaaagcataaggctgcaaggaaggagctccagcatgcattttggattgtgtggaacaatgcaataagcagagtatataatgcgtgcgtggtacggtgtggatgatgatgacccttcatgtagacctgtagtagtgtatgtatgtatagatcgaagagcctaggggtgtgtgtgtgtgtggatatatagctgacgatctattgtacagtgactgttaatcgtctcaagtacgtccagtccactacgtaccgtacctatgctaaaaaaaaaaaaaaaaaaaa

SEQ ID NO: 1108 - protein, 327 aa, Panicum virgatum
  misc_feature: Ceres CLONE 1758517
  misc_feature: Great-hit functional homolog of the protein sequence given in SEQ ID NO 9367
  misc_feature: Useful for making plants with modulated nitrogen use efficiency
MAAPEAWLSPAASRLPSLANAPPLRFRAKPKPSSAACSLLSRPAAALHVLHRRVTTVRRRLGATEQQGQVQEQEEEVVDGNVLPYCSIDRKQKRTLGEMEQEFLQALQSFYYDQKAIMSNEEFDNLKEELMWEGSSVVMLSPDEQRLLEASMAYTAGNPIMSDAEFDELKLKLKKDGSDIVTEGPRCSLRSRKVYSDLSVDYLKMFLLNVPATVVALGLFFFIDELTGFEINVFQLPEPFGFIFTWFAALPLILFLAQSLTKAIVQDFLILKGPCPNCGTENLSFFGTILSVSSGGTTNNVKCADCGTELVYDSKSRLITPAEASKA

SEQ ID NO: 1109 - DNA, 1160 bp, Panicum virgatum
  misc_feature: Ceres CLONE 1758545
  misc_feature: Encodes the peptide sequence at SEQ ID NO. 1110
ggtgccgcggcgccggtagcatctcgggcgcgcgcgcgcggcggcggcggaagcgtttaccggctcggctctaccggagggcgagcgcgcggggctccgcggccggtatgggcacgccggagttccccaacctggggaagcactgcagcgtcggcgactgcaaccagatcgacttcctccccttcacctgcgaccgctgcgaccacgtcttttgtcttcagcacagaagttatacaacacaccaatgtccaaatgcaaatatgaaggatgtcactgtcctcatctgcccactctgtgctcaaggggttcgccttaatccaagcgaagacccaaatatcacctgggatactcatgtcaacactgattgtgacccatcaaactaccagaaagtaacaaagaaacagaaatgccctgttcctgggtgcaaagagacactgacgttttccaacacgatcagatgcaaagactgcaccaatgaacactgcttgaagcatagattcgggcctgatcacaaatgcccaggaccaagaacagtggattcgggcttcccctttgtaaatatgctaaggagaagtcagaaagcagagacacgtccgaacagcagcagcaagaatggttcttcctggtggagctccagccttctgaatgcagcaacaaatttcaaatcgtctgctgaagctagaatgcagaaactgagcattgcgactagccaagccttccagaaggctaaggatgggatctccccaaacagcagtggcagcagtggtgaccttgtggaggaatgtgttcattgccctgcaagattttccaccgtgggcgccttaattgaacatgtcgagaaatcccaccagaagaaccagcaaccaattcgtggccatgtgactgtcgatgtttgcccaaaatgtagcaaggcatttcgagatccggtgttgctggtggagcatgtggagagggaccacgaccatggaggaacgtcaagagcataaagcttctcgtgtgtgatgtatgctgtgtgtacttgcagcttgttttttttcttctcttttcatccattttctttactcctttgggcttgaaatctgcccattgcaacaagtataggatgttcgattgaaggcaaagccgttgtccattccattgaaaaaaaaaaaaaaaaaaaa

SEQ ID NO: 1110 - protein, 292 aa, Panicum virgatum
  misc_feature: Ceres CLONE 1758545
  misc_feature (1)..(24): Pfam Name: zf-C2H2 Pfam Description: Zinc finger, C2H2 type
  misc_feature (1)..(43): Pfam Name: zf-AN1 Pfam Description: AN1-like Zinc finger
MGTPEFPNLGKHCSVGDCNQIDFLPFTCDRCDHVFCLQHRSYTTHQCPNANMKDVTVLICPLCAQGVRLNPSEDPNITWDTHVNTDCDPSNYQKVTKKQKCPVPGCKETLTFSNTIRCKDCTNEHCLKHRFGPDHKCPGPRTVDSGFPFVNMLRRSQKAETRPNSSSKNGSSWWSSSLLNAATNFKSSAEARMQKLSIATSQAFQKAKDGISPNSSGSSGDLVEECVHCPARFSTVGALIEHVEKSHQKNQQPIRGHVTVDVCPKCSKAFRDPVLLVEHVERDHDHGGTSRA

SEQ ID NO: 1111 - DNA, 1151 bp, Panicum virgatum
  misc_feature: Ceres CLONE 1758607
  misc_feature: Encodes the peptide sequence at SEQ ID NO. 1112
gctggcttttcctttccgccgcggcaaaagtgaggcgctgggcgagcgagctgggggagacgaacccgtcataattccattgcttaattgcgcctcacctcctgcgtatctatcctcggccgccggggccgccgggcggaggtgctcctcattctccccgttccctcctctctcgcgcgcgcgaaggccaaggccggatcggggggcgctctcagatcttgcgcgcttcgcggccgcgcggcaacccagggagtaggagctaggaggattggggcgaggatgtttagcgggacgcagcagaagtgcaaggtttgcaccaagacggtgtacccgatggaccagctctccaccgacggcgtcgtcttccaccgctcctgcttcaagtgccagcactgcaagtccaccctctccctgagcaactattcctcgttcgaaggagtgccatactgcaaggcccatttcgagcaactgttcaaggagaccgggagctacaacaagagcttccaatcacaatcacccgcaaagattactccggaaaagtcgggccctgagctgaccagaacaccaagcaaagctgcaaggatgttttcaggaacacaagaaaagtgtgcaacttgtggcaaaactgcatatcctcttgagaaggtgacagttgaagaaaaggcctaccacaagtcctgcttcaagtgctcccatggtggctgtgccatcacaccatccaactatgcagccttggaggggatcctctactgcaagcaccatttctctcaacttttcaaggagaagggaagctacaaccatctgatcaagtgcgcatcggtcaagcgtacggaggcacagcctgaacagccagctgctgattcctcttgatccgtgccatttcaacagtggggtttgaaggcaagagtttggaagcctcctttttttacttaaaaccacctggctgtatgttatgccgtctagccctgaggataccggacttctctactttggtatcttcggctgtgctagctgaatcacattggtgaaccatggaactgttgtcattttcaatgaaattgttgtgcaccggatactgaaatcgggtatcttgcccttattgatagatatattgttttgttgccttgcgataaaaaaaaaaaaaaaaaaaa

SEQ ID NO: 1112 - protein, 196 aa, Panicum virgatum
  misc_feature: Ceres CLONE 1758607
  misc_feature: Great-hit functional homolog of the protein sequence encoded by LOCUS At2g39900
  misc_feature: The sequence is a functional homolog of  SEQ ID NO 428 in the  10/412,699 US patent application
  misc_feature: The sequence is a functional homolog of  SEQ ID NO 616 in the  11/435,388 US patent application
  misc_feature: The sequence is a functional homolog of  SEQ ID NO 992 in the  11/479,226 US patent application
  misc_feature: Useful for making plants with modulated heat sensitivity
  misc_feature: Useful for making plants with modulated growth and phenotype characteristics
MFSGTQQKCKVCTKTVYPMDQLSTDGVVFHRSCFKCQHCKSTLSLSNYSSFEGVPYCKAHFEQLFKETGSYNKSFQSQSPAKITPEKSGPELTRTPSKAARMFSGTQEKCATCGKTAYPLEKVTVEEKAYHKSCFKCSHGGCAITPSNYAALEGILYCKHHFSQLFKEKGSYNHLIKCASVKRTEAQPEQPAADSS

SEQ ID NO: 1113 - DNA, 1160 bp, Panicum virgatum
  misc_feature: Ceres CLONE 1758635
  misc_feature: Encodes the peptide sequence at SEQ ID NO. 1114
aaccccagcagtcttgtcttcccccgcacgcctcctcgcctccgcctcccccggcctccgatctccagggctccgcgccggcggcggcagggatggcggctccggtggtggacgccgagtacctgcgccaggtcgacagggcgcgccgccagctccgcgccctcatctccaacaagggatgcgccccaatcatgctccgcctcgcatggcatgatgctggaacttatgatgtgaaaacaaaaactggtggcgcaaatggttcgattagatttgaggaagagtacacccatggttctaatgctggtttaaagattgctatcgatcttcttgagcctatcaaagccaagaacccaaagataacatacgcagacctttatcagcttgctggagtggttgcagttgaagtgactggtgggccaactgttgagtttgttcctggccgacgcgattcatcagtctgcccccgtgaagggcgtctaccagatgctaagaaaggtgcaccacatctgagggacatcttttatcggatgggcttaacagacaaagacattgtagctctatctggtggccacactctgggaaaggctcatcctgagaggtctggattcgaaggcgcctggacacaagagcctctaaagtttgataactcatactttgttgagctgttgaagggggaatctgaggggcttctgcagctccctactgacaaggcactgctgtcagatcctgaatttaggcactatgttgagctttacgcaaaggatgaagatgccttcttcaaagactacgctgaatcccacaagaaactctcagagcttggcttcactcctcgcggcgcagcatctgcaaagtcagatcttccaaccggtgccgtgcttgcacagggtgcctttggggtagcagttgctgcggctgtagttgttgctggctacttgtacgaggctgccaggaaggccaagtagatggcaaagttctctgtcgcaccgcttcgcttagtaagtacgtatgaagaccgaataacaggatcctaggaataaggtgccacagcattgtctcagaaaatatttcgaaattcttacaaacagaaacattgccttcatgtttacattgtactcatgagtatttgaatgagtgatatggaaaaaaaaaaaaaaaaaaaa

SEQ ID NO: 1114 - protein, 289 aa, Panicum virgatum
  misc_feature: Ceres CLONE 1758635
  misc_feature (1)..(208): Pfam Name: peroxidase Pfam Description: Peroxidase
  misc_feature (1)..(289): SWISSPROT Homolog: EC 1.11.1.11 L-ascorbate peroxidase 3, peroxisomal precursor
  misc_feature (6)..(289): SWISSPROT Homolog: EC 1.11.1.11 L-ascorbate peroxidase 5, peroxisomal precursor
MAAPVVDAEYLRQVDRARRQLRALISNKGCAPIMLRLAWHDAGTYDVKTKTGGANGSIRFEEEYTHGSNAGLKIAIDLLEPIKAKNPKITYADLYQLAGVVAVEVTGGPTVEFVPGRRDSSVCPREGRLPDAKKGAPHLRDIFYRMGLTDKDIVALSGGHTLGKAHPERSGFEGAWTQEPLKFDNSYFVELLKGESEGLLQLPTDKALLSDPEFRHYVELYAKDEDAFFKDYAESHKKLSELGFTPRGAASAKSDLPTGAVLAQGAFGVAVAAAVVVAGYLYEAARKAK

SEQ ID NO: 1115 - DNA, 1245 bp, Panicum virgatum
  misc_feature: Ceres CLONE 1758668
  misc_feature: Encodes the peptide sequence at SEQ ID NO. 1116
agcagctcctcacgagcacacctcctacacacaggtagacagacagagctagagaaagagagaccaagactcaggagagtagcagagagcagaaagagagagagagatgggaagagcaccctgctgcgacaaggcgacggtgaagaaggggccatggtcgccggaggaggacgcgatgctcaagaactacatcgaggagcatggcaccgggggcaactggattgcgctgccacacaagatagggctgaagaggtgtggcaagagctgcaggctgaggtggctcaactacctgaggccaaacatcaagcattgggacttcaccccagaggaggacagcatcatctgcagcctctacattagcatagggagcaggtggtcaatcattgccgcgcagctgccggggaggactgacaacgatgtcaagaactactggaacaccaagctgaagaagaggctcctcggccggcgcaaggaccgccagagcgccgccgccactgccgccacgagcgagacgtccgccgagaacatgaacgacgccggcgagcgggctctgagcgcgtcggccatggagaggatccagctctgcatgcagctgcaggagctgcagagccctctcggcgccgcccaccacaaccccttggtgtggcctggcactggctgcagcagggccgccaccctgagcaacaacagcttcaacagcaacagcagcacggtgacggtggccgagcaagcagggcggtccagctccatgaacgagcacctgatgagcgcgcagcagctggacggcggcctcggctcgccgtcgagcgcggagaactcgaacgtgatcagcatggaggccgggcttgaagaactgctctacggcgaggggaacggatcaggaaaggccgccggcgcggtcgacggcggcgtgcagcaagggggcgtggactggtggagctacgacgaccaggggaagtcgcctgtgggctgctgggacttcgcccctgaaacaacgaacgcggtgttccaggactacacatctgtttacgacatttgaaagcgtggagtcaagaagaagaagctgtgaatgttaaggtagagaggtgataggagttgtgtctagactctagagttggttcaggatttgtgacgtctgcataaaactggatcaaagcatcgtgtaaggaattcgtagtaagatgtaaggtataaaataaatgcatgtaaaaacgcaaggttctagaaaaaaaaaaaaaaaaaaaa

SEQ ID NO: 1116 - protein, 310 aa, Panicum virgatum
  misc_feature: Ceres CLONE 1758668
  misc_feature (1)..(49): Pfam Name: Myb_DNA-binding Pfam Description: Myb-like DNA-binding domain
  misc_feature: The sequence is a functional homolog of  SEQ ID NO 178 in the  10/412,699 US patent application
  misc_feature: The sequence is a functional homolog of  SEQ ID NO 389 in the  11/479,226 US patent application
  misc_feature: Useful for making plants with modulated growth and phenotype characteristics
MGRAPCCDKATVKKGPWSPEEDAMLKNYIEEHGTGGNWIALPHKIGLKRCGKSCRLRWLNYLRPNIKHWDFTPEEDSIICSLYISIGSRWSIIAAQLPGRTDNDVKNYWNTKLKKRLLGRRKDRQSAAATAATSETSAENMNDAGERALSASAMERIQLCMQLQELQSPLGAAHHNPLVWPGTGCSRAATLSNNSFNSNSSTVTVAEQAGRSSSMNEHLMSAQQLDGGLGSPSSAENSNVISMEAGLEELLYGEGNGSGKAAGAVDGGVQQGGVDWWSYDDQGKSPVGCWDFAPETTNAVFQDYTSVYDI

SEQ ID NO: 1117 - DNA, 1167 bp, Panicum virgatum
  misc_feature: Ceres CLONE 1758685
  misc_feature: Encodes the peptide sequence at SEQ ID NO. 1118
aagcaaggcatacacagattctgtctcgaggtgactgtcgtcctcttggcggcggcggcggcagcagcagcagaatcgaccgaccatgaggagtgcggcggcaatgggcttccaggagcacgggctagccttccaggtgatcaccgacggcggcggcggcgcaaccgcagcgccgtggtgggcggctgctgctgctcctcaggggtttgccgccaagtttccgatcatcagctcaggcgattctaaccctccgcaagacctcaaataccatgagcctttggcagcagccatggccgcctacccggagttgcacaagtaccatggccctttcgatctggcccttgggcagtccatggtgtggagcaacaatgccggtgccggtcagcgccagagctttggcctgtactctccatatggagctcaagctatgcacggcagggtgctcctgccgccggcgatcgccgccgaggagccggtctacgtgaacgccaagcagttcaaaggcatcctccggcggcgcctggcccgtgccagggcggcgagggacctcagggcctccaggaaccgcaagccatacctccacgagtcgcggcacctgcacgcgctccgccgcgcgcggggctccggcggccgcttcctcaacaccaggagcctcgccgccggcgacccgccgccccagctcgccagcacgcccctgggagggccggaacccactgagggcggcgcgtcgaaggcggcaaggctgcacccggcgaaggaacgccaggaggacgtcttcctctcgtcgttgacgaacatggccggcgacggcgacggcaaggcgaggtgggtcggagcggcgccgcggggctgctgcgacctgctcagggcgtgacggcggcgggcggccaggggccgagcctggtggctctaggacggcaactcattcttggctccgggttatccgggtatgtggttcatcggctgtgtgcagccgtgcagggcagtgagagatgcagccgcttctcctgcaccaaaccaagataaccagatgcggtcttgtgttccagtaaaaactgcaagttcatttgatgcatgtgcagacgctaactgttcatgtttgaaagctattgtcctgttcaattagataagagatttatgtgcgctgaaaaaaaaaaaaaaaaaaaa

SEQ ID NO: 1118 - protein, 262 aa, Panicum virgatum
  misc_feature: Ceres CLONE 1758685
  misc_feature (1)..(57): Pfam Name: CBFB_NFYA Pfam Description: CCAAT-binding transcription factor (CBF-B/ NF-YA) subunit B
MRSAAAMGFQEHGLAFQVITDGGGGATAAPWWAAAAAPQGFAAKFPIISSGDSNPPQDLKYHEPLAAAMAAYPELHKYHGPFDLALGQSMVWSNNAGAGQRQSFGLYSPYGAQAMHGRVLLPPAIAAEEPVYVNAKQFKGILRRRLARARAARDLRASRNRKPYLHESRHLHALRRARGSGGRFLNTRSLAAGDPPPQLASTPLGGPEPTEGGASKAARLHPAKERQEDVFLSSLTNMAGDGDGKARWVGAAPRGCCDLLRA

SEQ ID NO: 1119 - DNA, 919 bp, Panicum virgatum
  misc_feature: Ceres CLONE 1758700
  misc_feature: Encodes the peptide sequence at SEQ ID NO. 1120
ggaacacgataacgagacggcaggtgggggaggagccgaggagggcttcaggggtttcagggcggagaggagaagatggcggcgaagcgcgagaccgagtcggacggcgaagagctcggcggcgaggcctccaaccctgcgagcggtggcgcgactccgccgcccctagccgcagctcccgtcgtctgcctcctccgctccgctggggacttcgccggcggcgccttcgtcggatccatcgtcggatatggacaaggcctgatcactaagaaaggtttcaagggttcattcagcaatgctgggtcctctgctaagacttttgcagttctatctggggtccagagtttggttgtgtgcttgctgagaaggctgcgtgggaaagatgacattgtcaatgctggtatagctggttgttgcactggcattgctttgagcttcccaggagcaccacaagcgttgcttcagagctgtgccacctttgcagcgttttcttgcatcatggaggggctcaacaagcagcaggctgcaatggctcacactcttggcacaactgcattgacggttgcgcatgataaaggaggtgtactgcccccattcacgcttccaccaattctggatgcatcagatgctttagcttcatgctgccaagccttagtaaagcctaagcactagactacaggataggggagagagacatgctgaagaaagatagcttcagttttcatttctttattatgttgacctagcatatctgcatatgtaaattttgcttctggacaagctgtggaacgtgcctaaaacctagttttgctttgagcaactggacaggttttcttgatgtgttcgtgttgcgaattccgctggttctggcattattaaaatcataaatacttgcctcgaaaaaaaaaaaaaaaaaaaa

SEQ ID NO: 1120 - protein, 198 aa, Panicum virgatum
  misc_feature: Ceres CLONE 1758700
  misc_feature: Great-hit functional homolog of the protein sequence given in SEQ ID NO 9259
  misc_feature: Great-hit functional homolog of the protein sequence given in SEQ ID NO 9710
  misc_feature: Useful for making plants with modulated salt sensitivity
MAAKRETESDGEELGGEASNPASGGATPPPLAAAPVVCLLRSAGDFAGGAFVGSIVGYGQGLITKKGFKGSFSNAGSSAKTFAVLSGVQSLVVCLLRRLRGKDDIVNAGIAGCCTGIALSFPGAPQALLQSCATFAAFSCIMEGLNKQQAAMAHTLGTTALTVAHDKGGVLPPFTLPPILDASDALASCCQALVKPKH

SEQ ID NO: 1121 - DNA, 1412 bp, Panicum virgatum
  misc_feature: Ceres CLONE 1758705
  misc_feature: Encodes the peptide sequence at SEQ ID NO. 1122
aggagagacccgggagctcaatccctgatggctcagcagcaaacgagccccgaggaggtggtcctcgggcaggagaccggcagcgcgagggtgatcaccctgaaccgcccgcgacagctcaacggcatctccgaccgggtggtctacctcctcgcacagttcctggagaaatgggagaaagacggtaacgccaaattggtcatctttaagggagctggacgtgcattttctgctggtggggacctgaagatgttttatgaagggaaatcagatgattcctgccttgaggttgtgtataggatgtattggctctgctaccacatccatacgtacaagaaaaccacgatttttgctactcctgaggctagtgttggattgcacacagattgtagcttttcctacatccattctcggctcccaggatatttaggtgagtacctggctttaactggtgctagactgaatgcgaaggaaatgatttctgctggtcttgctactcatttcgtcagttccgataaattggaagaactcgaaaaatgtttactgaatttggactcaggtgacgagtctgcagtccgagctgttattgaagaattttctacagatgttcagcctgatgaagatagtgttttgaacaagctttcaactatcaacaaatgtttctccgcggaaactgttgaggacatcataaaagcatttgaatcagaagcgagcatagacggaaagcaatgggtagatccagtcctaaagggtctgagaaaatcatctccaactgcactgaagatcaccctgagatcgatcagagagggtcggaaacagagtttgcctgaatgtttgatgaaggaattcagacttacaatgaacattctccgatctgttgttaatggggatgtttatgagggaatcagagctcttagcatcgacaaggacaatacccctaagtagaatcctgcaacccttgaggaggtgaagagcgaggacattgaccgtgtgtttcagacgttcagtccagagcatgagctccaggtcccaagtgacgattccaacaggggagcggcgacttccttcaaatgtcccacatcacacatggattctgcctagtctgctaacgctttccgcaccaacaatgtgcaggtggagcggtaaatatgagaacacggtctatgctaaaattcctcagtaactgtatacaagattccagtctatgcttgttggcagcaaccagcagggaacaatactcctcacaccacgtgcataacggatagttcagtatgtaactcgtatgcatgtcgagtgtttgtgttctattggtataacaatttacgaacagtcgaaaaagattacacggtgatgtgaggaaataaagcatatgagttatgaggtttttgacccaaaaaaaaaaaaaaaaaaaa

SEQ ID NO: 1122 - protein, 305 aa, Panicum virgatum
  misc_feature: Ceres CLONE 1758705
  misc_feature (1)..(86): Pfam Name: ECH Pfam Description: Enoyl-CoA hydratase/isomerase family
MAQQQTSPEEVVLGQETGSARVITLNRPRQLNGISDRVVYLLAQFLEKWEKDGNAKLVIFKGAGRAFSAGGDLKMFYEGKSDDSCLEVVYRMYWLCYHIHTYKKTTIFATPEASVGLHTDCSFSYIHSRLPGYLGEYLALTGARLNAKEMISAGLATHFVSSDKLEELEKCLLNLDSGDESAVRAVIEEFSTDVQPDEDSVLNKLSTINKCFSAETVEDIIKAFESEASIDGKQWVDPVLKGLRKSSPTALKITLRSIREGRKQSLPECLMKEFRLTMNILRSVVNGDVYEGIRALSIDKDNTPK

SEQ ID NO: 1123 - DNA, 1314 bp, Panicum virgatum
  misc_feature: Ceres CLONE 1758752
  misc_feature: Encodes the peptide sequence at SEQ ID NO. 1124
ccctcccctccccgcccgcatctcacctcccgataagaagagagaagctcctccagtcctcttcctcttccttcccgcacctcccgcttcggctcctctcctcggcgggaacctgcgagctccgattcgagtactcccccacgccgcaggagcccgcgcgcgagctgatcgcgcggagtcgaggagaggagaggcgcgcggagctgctatcaccgccgccgcgggggccaagggagagaaggaaggaggagccgtatctatccagcccgcgccggaccgatggactcggagcactggatctcgcgcctggccgccgcaaagcgcttctacgcagcgcagctcggccacagcgatcgggcggggatggaggagctggacatggacgaggaggtgaggcccgagttcgcgtgcccctactgctacgaggaccacgacgtcgcctccctctgcgcgcacctcgaggaggagcacccgttcgagccccacgccgcggcttgtcctgtttgctctgagatggttacaagggatatggtaaaccatattactatgcaacatggatacttgttcaagaatcgtcgccggttgcgcagattcgttattccaggcagccaagccctttctttgctgagccgagatctacgggaagcccatttgcaggtgcttctaggaggtgggcataagtcaagcaacaataacaccacgacaaatatctcagctgatcctcgtctatcatcgttcggccttagcttcccaacatcagatgcagagcaaacatcaaaggccactgtttctgctcctaatgatgctaccatgataaaagagactcctcaggcacggaagttaagtatcgattcatccctttcaagtgaagaaagggagcagaaacggaagcaagccagcgtcagagcaacttttgtgcaggatctgctgctctctactctattcggggactaatgtggatgaacttaagttatcgctggaaggtgtactttcctggctgcatatactagcgtgctccacccaagttgctgaacgtaatatcaacagaacaggagctcttcccgagtgcaatccttcatctcttccagtaaggtgcagcgtcgatgtgggcatgttgtatcttctaagttattgtagccggtctcgatctccggttccatcacaatccgcgatcggcatgcggtgtgcatgtaagttgcggctgtaacttgtaccgcgtctgtgtctgaactatgaagccttggtttgttgtaccaatataataattatactatgcaacagcggattgcaccgcaaaaaaaaaaaaaaaaaaaa

SEQ ID NO: 1124 - protein, 224 aa, Panicum virgatum
  misc_feature: Ceres CLONE 1758752
  misc_feature (1)..(215): Pfam Name: Di19 Pfam Description: Drought induced 19 protein (Di19)
MDSEHWISRLAAAKRFYAAQLGHSDRAGMEELDMDEEVRPEFACPYCYEDHDVASLCAHLEEEHPFEPHAAACPVCSEMVTRDMVNHITMQHGYLFKNRRRLRRFVIPGSQALSLLSRDLREAHLQVLLGGGHKSSNNNTTTNISADPRLSSFGLSFPTSDAEQTSKATVSAPNDATMIKETPQARKLSIDSSLSSEEREQKRKQASVRATFVQDLLLSTLFGD

SEQ ID NO: 1125 - DNA, 1321 bp, Panicum virgatum
  misc_feature: Ceres CLONE 1758762
  misc_feature: Encodes the peptide sequence at SEQ ID NO. 1126
attcctacccctctagctaagctaataccaccaccagcagcagcagcagccatggcggcgagcggcaagaagctcccgccgttcctcttcacgctgctgcttctgctctccaccgccgtgacgcccatcctctcgctgccggccgccgaccacgaggtcgactgcgactgcgacaagcccaaggcgcccaagccgtcgcacccgcccaagaccaaaccctcccacccgtcgcccaagcccaagaaccccaagccgcccaagggcccctcctacccgtcgccggcgacgcgcccgcccaagggccgcccctccaacccgccaatcactcgtcctcgtccgccggtcgtcggcccccccaagggccccgtcacgcgcccgccggtcgtggggccaccggtcacgcgcccgccggtcgtggggccaccggtcacgcgcccgccggtcacacgtccgccggtcgtcatcagcccgccggtgacctacccaccaccgattaccggccctccgacgacgacgccacccgtcactggcccaccggtcacggtccccccgatcaccggcccaccggtcacggtccccccgatcaccggcccgccctcgacgacgcctccggtcaccggcccgcccttgacgaatcctcccggcggtggaagctcgacgccgtgcccgccgcctcctcccgcgaccccgactccgacgccgtcgtcgccgacgtgcccggcggactcgctgaagctgggcgcgtgcgtggacctgctgggcgggctggtgcacgtcgggctcggcgaccccatggtgaacaagtgctgcccgctgctggagggcctggtggagctggaggcggccgtgtgcctctgcaccaccatcaagctcaagctcctcaacatcaacatctacctgcccctggcgctccagctcctcatcacctgcggcaagacgccgccgcccggctacacctgcaccgtctgatcgatcaatgcaactagctagtaacccttgcacaatgcaggggttttggagtgagtttcttctgtaatttgaagagagatcaaccgacatgagaggatgtcatcgtctgcttcttcctagctatggtagctgtgtttagttgtttttctgttgtggttcgatcgatctcaagttctcgaccggcctgttaagtcgtttcagactttcagttaatttggctggccctcggcagcttgattgttggttttggtgtggtttcagtttgattcgagagagtcgttgatggctgatttctactgccatcaggtgacgatgaagagcttgcatgtccccaaaaaaaaaaaaaaaaaaa

SEQ ID NO: 1126 - protein, 305 aa, Panicum virgatum
  misc_feature: Ceres CLONE 1758762
  misc_feature (1)..(82): Pfam Name: Tryp_alpha_amyl Pfam Description: Protease inhibitor/seed storage/LTP family
MAASGKKLPPFLFTLLLLLSTAVTPILSLPAADHEVDCDCDKPKAPKPSHPPKTKPSHPSPKPKNPKPPKGPSYPSPATRPPKGRPSNPPITRPRPPVVGPPKGPVTRPPVVGPPVTRPPVVGPPVTRPPVTRPPVVISPPVTYPPPITGPPTTTPPVTGPPVTVPPITGPPVTVPPITGPPSTTPPVTGPPLTNPPGGGSSTPCPPPPPATPTPTPSSPTCPADSLKLGACVDLLGGLVHVGLGDPMVNKCCPLLEGLVELEAAVCLCTTIKLKLLNINIYLPLALQLLITCGKTPPPGYTCTV

SEQ ID NO: 1127 - DNA, 1278 bp, Panicum virgatum
  misc_feature: Ceres CLONE 1758877
  misc_feature: Encodes the peptide sequence at SEQ ID NO. 1128
acggagagcgccggccggcagctgggtgatcggagaagaacggcggccttgctaggatctttcgatcggtcgacatggacaggccagatcgccaccagcaccagtttttcatgccgctgccggtgctgcagcagcagcagcagcagctgtgcgcgcccatgatggacgagcacgagcaggcgtcgttcttggcggggagggccggcggcggcggcgggggaggtggaggtggagcggcggggaggggggagaggaagcggcggttcacggaggagcagatacggtcgctggagtccatgttccaggcgcaccacgccaagctggagccccgggagaaggcggagctggcgcggcagctgggcctgcagccgcggcaagtggccatctggttccagaacaagcgcgcccggtggcgctccaagcagctcgagcacgactacgccgcgctccgcgacaagttcgacgccctccacgcccgcgtcgagtccctcaagcaggagaagctcgccctcgccgcacagttgcaagagctaagcgagaggctgagggagcgggaggaccaccgggccgccagtggcggcgtcgcggcgacggctagcagcagcagctgcaacggcggcgaggaggaggcggaggacgacaagaggaacgtcgtcctccggtgcgtcgacatggagccgcccgagagctgcgtgctcgccggggcgtgcgcgacgccgccggcggacgtctcggtggagtccgagtgcgacgaccaccaccgcctcgactacgacgacgggttgttcccggagtccttctgcgcgacgccggagctgtgggagccctggccgctcgtggagtggaatgcggtcgcctgaaacggtggtggaagctagcagtacataggcttgcgtgtgtaagatgcgtgcatggtgccatggcgctctcaaatggaacaggaggacaacggcgggggccgggctatgtgccaatgacgattgggccccggcatcaggtcggggatgagaaggcgtaacgttcaagcgatggaaccttggagacgatcagccaatgggattagtgctttcgatctgcaaaggttaatggaattcattatattagaggcgtcattggtaggtcgactgctagagttgctctagaatgcggctttgttgttccctttggaattcaaagttagataatacaatcgatgcatatatgttcgcttgataaatatatatatatagtattcgcgtgtacgtatttgcttgggtgcaaaaaaaaaaaaaaaaaaaa

SEQ ID NO: 1128 - protein, 261 aa, Panicum virgatum
  misc_feature: Ceres CLONE 1758877
  misc_feature (1)..(56): Pfam Name: Homeobox Pfam Description: Homeobox domain
MDRPDRHQHQFFMPLPVLQQQQQQLCAPMMDEHEQASFLAGRAGGGGGGGGGGAAGRGERKRRFTEEQIRSLESMFQAHHAKLEPREKAELARQLGLQPRQVAIWFQNKRARWRSKQLEHDYAALRDKFDALHARVESLKQEKLALAAQLQELSERLREREDHRAASGGVAATASSSSCNGGEEEAEDDKRNVVLRCVDMEPPESCVLAGACATPPADVSVESECDDHHRLDYDDGLFPESFCATPELWEPWPLVEWNAVA

SEQ ID NO: 1129 - DNA, 1040 bp, Panicum virgatum
  misc_feature: Ceres CLONE 1758903
  misc_feature: Encodes the peptide sequence at SEQ ID NO. 1130
gaagagaagagacgagacagcggagctcgggcgctctcagctcagatctactttctgatccccgaccccgagtgcaaagacgacggcagcgctccggcgttttgtggcggtgaggctgcgcccctgcggtcttcaccgacacttgcttccattcttgctggagtgaaattaatctagttgctgttgggaatggcaagtacagcatgctttgtgattgtctgtaagaatgacataccaatctacgaggcagaagttggatctgcaccaaaaaaagaagatctctcttatcaccatcagtttatcctgcatgccgcgttagatgttgttcaggacctagcatggaccacaaatgcaatgttcctgaagtcagttgatagattcaatgaccttgtggtgtctgtttatgtaactgcaggtcataccagatttatgttgcttcatgactcacgcagtgaagatggaataaaaagcttctttcaggaggtccatgaactttacatcaagatattcctcaacccactttacctgcctggctctcgcatcacatcctcccattttgataccaaggtcagggccctcgcaaggaagtacctgtagtacgcaggcatggaggttttataagccaatgtagaagcaggcagcagaggaggcaaaatccattgttcgccatcttctcgtgtcctcgttactcgactctttgggaaatgctgaaatggaatgttattggcttattgcccatcacacaagtccgagcttcctgtgtttttttttcttcttagctttggcttgtgttatgagctatatcgaccgttgttattccgaaccaaatagcttatgaactgtgacttgagaatttgctccattattcggcaattcaaacctgaatggattgtgttgtacatgtcaggtttctaaggccagtcttagtgggagtgtcatcgacacagttatcaagactgaaaatttgagaactgtgtcagtggagtgtcatagtgatgacactcctctcacatttcatgacaaaaaaaaaaaaaaaaaaa

SEQ ID NO: 1130 - protein, 135 aa, Panicum virgatum
  misc_feature: Ceres CLONE 1758903
  misc_feature: Great-hit functional homolog of the protein sequence given in SEQ ID NO 9325
  misc_feature: Useful for biocontainment applications
MASTACFVIVCKNDIPIYEAEVGSAPKKEDLSYHHQFILHAALDVVQDLAWTTNAMFLKSVDRFNDLVVSVYVTAGHTRFMLLHDSRSEDGIKSFFQEVHELYIKIFLNPLYLPGSRITSSHFDTKVRALARKYL

SEQ ID NO: 1131 - DNA, 1167 bp, Panicum virgatum
  misc_feature: Ceres CLONE 1759003
  misc_feature: Encodes the peptide sequence at SEQ ID NO. 1132
atcgacagcctcgccgcaccttcacacactcacagctgacagctcccatattcaacatcgagctcactccctcactcactcactcactcggtcgctccggcctccggcgtcgatggagatggaggcgctgtggacgtcgtctccttgcggcggcatgatcaggttgccgtcgccagcggcgggggtcggcgaggacgaggccgcggcggcggcggcggagctgcggcgggggccgtggacggcggaggaggacgcgctgctggcgggctacgtggcggcgaacggggagggccggtggaacgagctggctctcgccgcggggctgcgccgcaccggcaagagctgccgcctccggtggctcaactacctccgccccggggtgcgccgcggcggcttcaccccgcgggagcagctgctcatcctcgacctccactcccgctggggcaaccgctggtccaagatcgccgcgcacctccccggccgcaccgacaacgaggtcaagaactactggcggacgcgggtgcagaagcacgccaagcagctcggctgcgacgtcggcagcggccgcttccacgacgccatgagaaacctctggatgccgcgcctgctcgagaggatccacgccgacgagtccgctgccgccggtgacgtttcgcactactactccgccgcgagcccagcgcagcacgcgccgacatcccaaccagcgtaccaaaacgctgctgcatctgcacccatcatcagcaactgcgcacgcgcaacttcaccggacgccgcgtcgtgcgtgaccgggtcgccgtcgtcgtgggagacgtcgccggcagcgcagttccagacgagcagtcaatgccaaaacggctgctcgagcacgacgagcggtgacatgttcggagagagctggtccgagcttcttgcgcgcgccagccacgacgacgctgattccgccgggctgccggacttcggattatttgaagaaactggagacagtttgtggagtttggacgatatctggcagcaaccgctgtactgatcgatatacgtatgctgctacgtactagtgacccaacttttttgtagtgttatctgattgacacaattgattaataatcagcagacttatgacaaataaaaaccatttaattgaacgaaaaaaaaaaaaaaaaaaaa

SEQ ID NO: 1132 - protein, 305 aa, Panicum virgatum
  misc_feature: Ceres CLONE 1759003
  misc_feature (1)..(48): Pfam Name: Myb_DNA-binding Pfam Description: Myb-like DNA-binding domain
  misc_feature: The sequence is a functional homolog of  SEQ ID NO 1565 in the  10/374,780 US patent application
  misc_feature: Useful for making plants with modulated growth and phenotype characteristics
MEMEALWTSSPCGGMIRLPSPAAGVGEDEAAAAAAELRRGPWTAEEDALLAGYVAANGEGRWNELALAAGLRRTGKSCRLRWLNYLRPGVRRGGFTPREQLLILDLHSRWGNRWSKIAAHLPGRTDNEVKNYWRTRVQKHAKQLGCDVGSGRFHDAMRNLWMPRLLERIHADESAAAGDVSHYYSAASPAQHAPTSQPAYQNAAASAPIISNCARATSPDAASCVTGSPSSWETSPAAQFQTSSQCQNGCSSTTSGDMFGESWSELLARASHDDADSAGLPDFGLFEETGDSLWSLDDIWQQPLY

SEQ ID NO: 1133 - DNA, 900 bp, Panicum virgatum
  misc_feature: Ceres CLONE 1759150
  misc_feature: Encodes the peptide sequence at SEQ ID NO. 1134
tgagccatatacctcctcagatcagtagtgatcagtcccagattaagccaaagtactgccaacacagctctcaccttagccacacagtactccagcaacaatgtcagctgaggcgtcggccgtgcgtgtgatcggcctgtggccgagcccgttcgtcatccgcgtcctgatcgcgctgaagctgaagggcgtcgagtacgagttcgtggaggaggaggtgcatttgggcaagaagagcgagctgctgctcaggtccaaccccgtgcacaagaagatccccgtcctgctccaccacggcaagcccatctccgagtccctcgtcatcgtccagtacgtcgacgaggcctggtcctccgccgcgccggccatcctcccggccgacccgtacacccgcgccgtccatcggttctgggcacagtacatcgacgacaagcttcctccggcgatccgcactctcaggggatcggacgacggcgacaaggagcaagcggcggggcagctgtccgccgccctgcagctgttggaggccgccttcgtggagctcagccaggggaagagctacttcggcggcgacggcgtcaggtacctggacatcgccctggtgtcgtacgtcgggtgggtgcgggcgctcgagaagatcgccggggtcgcgctgctggaccaagccaaggtccccaacctggcggcgtgggctggccggctctgcgcgcacgcggcggtggcggacgcgatccctgacgccgacaagttcgtggatttcagcgtcaagttttccaagcctatgaacactggtgccaagtgagcgaaagggtcgttactttcggtgcgcacgtgtgaccgtgtctatcaataaaatgattgtgtattcgatcttctcatcaaaaaaaaaaaaaaaaaaaa

SEQ ID NO: 1134 - protein, 233 aa, Panicum virgatum
  misc_feature: Ceres CLONE 1759150
  misc_feature (1)..(102): Pfam Name: GST_C Pfam Description: Glutathione S-transferase, C-terminal domain
  misc_feature (1)..(74): Pfam Name: GST_N Pfam Description: Glutathione S-transferase, N-terminal domain
MSAEASAVRVIGLWPSPFVIRVLIALKLKGVEYEFVEEEVHLGKKSELLLRSNPVHKKIPVLLHHGKPISESLVIVQYVDEAWSSAAPAILPADPYTRAVHRFWAQYIDDKLPPAIRTLRGSDDGDKEQAAGQLSAALQLLEAAFVELSQGKSYFGGDGVRYLDIALVSYVGWVRALEKIAGVALLDQAKVPNLAAWAGRLCAHAAVADAIPDADKFVDFSVKFSKPMNTGAK

SEQ ID NO: 1135 - DNA, 934 bp, Panicum virgatum
  misc_feature: Ceres CLONE 1759325
  misc_feature: Encodes the peptide sequence at SEQ ID NO. 1136
aaagtccgctccaccactcgtcgtttcttccacccacgggctcgcatcgcagcagccgccgggcttccagaagctctctcagcgcagggcgccgccatggctgcggaaggcaaggctccatcgctcgcggaggagtattcactcccaccccaggaggtccagttgcaaaatccatctgaagagaaatctgctgctagcactgtggctgaagttgttcccgagaaaagtgctgaaaccccaccagctaatgaggctactgttgctgttgaagaaacaagtgaaacttcagaggtgaaggaagcctctgaggagccagaagctgaggcaagccctgctgctgaagaaagtgatgaggttgctgaagaaagcagtgatgctgctgaggaaacagctgatgaaaaaccagaaattaagatcgagacagctccagcagattttcgtttcccaacaacaaatcaaacaagacattgcttcacgcgctatgttgaatatcataggtgtgtagctgcaaaaggggagggtgctcctgagtgtgaaaagtttgctaagtactacagatcactctgcccaagtgaatgggttgagcgttggaatgagcaacgtgaaaatggcacattccccggacccttatgatgccgctcagtggcgagaaagccatgcttgttctggcaccctaccttcgtcgataactacaggaggcttcctttccttttgggagactaataaagtgttggattgatgtgcaaggattcacttttgaattctttcctgaacttggatcgttcgaggattcaggtccccaattttgatgtacgtgttaccaccaagagctctttccggattataatatcttgtcactcgcttgttgcggagggacagcatatggaataaacgacagcttgttcctgcagtgtaaaaaaaaaaaaaaaaaaaa

SEQ ID NO: 1136 - protein, 178 aa, Panicum virgatum
  misc_feature: Ceres CLONE 1759325
  misc_feature (1)..(74): Pfam Name: COX6B Pfam Description: Cytochrome oxidase c subunit VIb
  misc_feature (114)..(178): SWISSPROT Homolog: EC 1.9.3.1 Cytochrome c oxidase polypeptide VIb
MAAEGKAPSLAEEYSLPPQEVQLQNPSEEKSAASTVAEVVPEKSAETPPANEATVAVEETSETSEVKEASEEPEAEASPAAEESDEVAEESSDAAEETADEKPEIKIETAPADFRFPTTNQTRHCFTRYVEYHRCVAAKGEGAPECEKFAKYYRSLCPSEWVERWNEQRENGTFPGPL

SEQ ID NO: 1137 - DNA, 750 bp, Panicum virgatum
  misc_feature: Ceres CLONE 1759391
  misc_feature: Encodes the peptide sequence at SEQ ID NO. 1138
attcgattccggagggaggccaccggcgccgccgacccacccgacccgaccccctccctccctcgctgacctccgccgtcgccggaggcgaagcgagcgcaaaggaggccgcagaagaattaggaggtgaaatcactcggagaactgtgcaatagtttcaatggctgctacaaagctccaagccttttggaaccatcccgctggccccaaaaccattcatttctgggcgccaacgttcaaatggggtatcagcattgccaacattgctgactttgctaagccacctgaaaagatatcttatcctcagcaaattgctgttacttgtactggactcatttggtcaaggtacagcttggttatcaccccgaaaaactggaaccttttcagcgttaacgttgcaatgactggtacgggcctgtatcagctttcgcggaagataaggcaggattacttatctggtgagaaggaagctgctccacaactggaagcataatgacaacaacagaccagaataacttgctatatgttccagtttcctgagactgcaagggtctctcagtccaggacatgaatcttttgctatatgttttctcgttctgaagtcatgagcagattaatgtgaaaattttctgccaaaaacgacacatgaagccatgcatttgtgcacctatggaaaaaaaaaccatgcaaaatacatgtttatatgttttgtttttgttcagttaatcttaaaaaaaaaaaaaaaaaaaa

SEQ ID NO: 1138 - protein, 110 aa, Panicum virgatum
  misc_feature: Ceres CLONE 1759391
  misc_feature: Great-hit functional homolog of the protein sequence given in SEQ ID NO 9626
  misc_feature: Useful for making plants with modulated flowering time
  misc_feature: The plant flowers significantly late compared to wild-type.
MAATKLQAFWNHPAGPKTIHFWAPTFKWGISIANIADFAKPPEKISYPQQIAVTCTGLIWSRYSLVITPKNWNLFSVNVAMTGTGLYQLSRKIRQDYLSGEKEAAPQLEA

SEQ ID NO: 1139 - DNA, 824 bp, Panicum virgatum
  misc_feature: Ceres CLONE 1759395
  misc_feature: Encodes the peptide sequence at SEQ ID NO. 1140
attcccccacagcacaaagcagctagacatccactcagctcacacactgcagctagcatttgcttagcttagcaggagcatcatatcgataataataatacaatgacaatggctttgatgatgaagaacaacaggatgcaggcggtggtggcgttggccgtcgtcatggcagctgcggcgctggtggcgtcggcgtcggcggccatcacgtgcgggcaggtgggttcggcgctggcgccgtgcatcccgtacgcgacggggaaggcgagcgcgctgccgtcgtcgtgctgcggcggcgtgcgcagcctgaacagcgcggcgcggacgagcgcggaccggcaggcggcgtgccggtgcctcaagagcctggccagcaccgtcaagtcggtgaacatgggcaccgtcgccaccatccccggcaagtgcggcgtctccgtcccattccccatcagcatgtccacagactgcaacaaggtcaactaaattaatggaatatatgtacataccagctgatcgacgatgacaagcttggtgacgtcgtccttcacaagatagctgctacgaggcagctatatatttaattaggagaataaaataaagttgttatcaaggcatcagcatcatctatactattatgtatgtatgtatgtagtaattaaatgcatgttgtgctcgatctgtgtgtacgtgcgcatatatatacatgtgtacatggctttgtacgatcgatgttatgtgcacatgtatgcttgtgtgtcctgctgtaataatcgagacagagaactgctgctacactgttagttcaaaaaaaaaaaaaaaaaaaa

SEQ ID NO: 1140 - protein, 124 aa, Panicum virgatum
  misc_feature: Ceres CLONE 1759395
  misc_feature (1)..(86): Pfam Name: Tryp_alpha_amyl Pfam Description: Protease inhibitor/seed storage/LTP family
MALMMKNNRMQAVVALAVVMAAAALVASASAAITCGQVGSALAPCIPYATGKASALPSSCCGGVRSLNSAARTSADRQAACRCLKSLASTVKSVNMGTVATIPGKCGVSVPFPISMSTDCNKVN

SEQ ID NO: 1141 - DNA, 841 bp, Panicum virgatum
  misc_feature: Ceres CLONE 1759397
  misc_feature: Encodes the peptide sequence at SEQ ID NO. 1142
acgcaagttccgcgagagaggccgaggcagagacgacgaccaggaagaatccgccaggtgctgtagcatcatccaagcaaagcaagtactctctgagctaggtaggataggacacggtcgccggccggagatgtcggaccgccgcgacaggatcagcgacgacgagatcaacgagctcatctccaagctccaggcgctcctcccggagtcctcacgccgccggaacgcgagccggtcgtcggcgtcgaagctcctgaaggagacgtgcagctacattaagagcctgcaccgggaggtggacgacctctcggagcggctgtcggggctcatgtcgaccatggacaacgacagcccccaggcggagataatccggagcctgctccggtgaccggccggcagcagggccttctcctgccagctagctgcagcggcccgcgccgcagctgaattatattaattagtgaagaagacgatggagctgctcgcttggcgcttgctacgaccaggagcttatgttcattcgtttttttctctctcttgttcttctacttcttcttcttcctcctcctcctccgatccgatgtgcgtgtgtttgtttccgtacctgctatcttccaaggaccctcgttcagaagacaacgaacgaagggctagctcttggtgtaccagaggggttagtagagataaatatatggacttctattaaccgaccaagcaaggtactgccggtaggcggtagcttgtagtagctcgtcatctgtagtagactgtagctgttcagagttgcagatgcatcctagctaagagtttattttttgcttaaaaaaaaaaaaaaaaaaaa

SEQ ID NO: 1142 - protein, 85 aa, Panicum virgatum
  misc_feature: Ceres CLONE 1759397
  misc_feature: Great-hit functional homolog of the protein sequence given in SEQ ID NO 9215
  misc_feature: Great-hit functional homolog of the protein sequence given in SEQ ID NO 9218
  misc_feature: Great-hit functional homolog of the protein sequence given in SEQ ID NO 9439
  misc_feature: Great-hit functional homolog of the protein sequence given in SEQ ID NO 9644
  misc_feature (2)..(49): Pfam Name: HLH Pfam Description: Helix-loop-helix DNA-binding domain
  misc_feature: Useful for making plants with altered Lignin content
  misc_feature: Useful for making plants with altered terpenoid content
  misc_feature: Useful for making plants with modulated nitrogen use efficiency
  misc_feature: Useful for making plants with modulated nitrogen use efficiency
MSDRRDRISDDEINELISKLQALLPESSRRRNASRSSASKLLKETCSYIKSLHREVDDLSERLSGLMSTMDNDSPQAEIIRSLLR

SEQ ID NO: 1143 - DNA, 761 bp, Panicum virgatum
  misc_feature: Ceres CLONE 1759449
  misc_feature: Encodes the peptide sequence at SEQ ID NO. 1144
agcgcaacaagccacagctcaacttcttcagcgaggagcagctgagatcgagatgacgaccaacggcatgggcgccgccgtcctcgctctcctcgtcgccggcggcctcgccgcggccgccgccgcgaggccctcccacgccggcgccatcatccgtctccccaccagcggcggcgaccggccgtgggagtgctgcgacttcgtcgtgcgggacccggacttccggccgccgcggtggcagtgcaacgacgtgtcggccgagtgccccgcggcctgcagccggtgcgaggcggcgccgggcgacggcggcggctacgtgtgccgcgactgggtcgtgagcctgctcgagccgcccgtgtgcacgccgaggccgtgggactgctgcgacgccgccgtctgcacccgggcgtacatccccgactgccgctgcgccgacgaggtggaggcgtgcccgagcaactgcagcgagtgcgagctggcgggggcggacccgccccgctaccgctgcctcgacctgttccacggataccccgggcccaagtgcacgccgttccttgattcgatgggcaactagcccagaacacgtacgtccacaaataaataaaattagctagctagcgtacaagctactgtagcaagtgattgttcatccgacgtgtacaattagctaccctgctcgctagctgctagctgctactgtatttcgtgcaactcaataagcgacgtggccaagtagacctcaaaaaaaaaaaaaaaaaaaa

SEQ ID NO: 1144 - protein, 173 aa, Panicum virgatum
  misc_feature: Ceres CLONE 1759449
  misc_feature (1)..(25): Pfam Name: Bowman-Birk_leg Pfam Description: Bowman-Birk serine protease inhibitor family
MTTNGMGAAVLALLVAGGLAAAAAARPSHAGAIIRLPTSGGDRPWECCDFVVRDPDFRPPRWQCNDVSAECPAACSRCEAAPGDGGGYVCRDWVVSLLEPPVCTPRPWDCCDAAVCTRAYIPDCRCADEVEACPSNCSECELAGADPPRYRCLDLFHGYPGPKCTPFLDSMGN

SEQ ID NO: 1145 - DNA, 510 bp, Panicum virgatum
  misc_feature: Ceres CLONE 1759489
  misc_feature: Encodes the peptide sequence at SEQ ID NO. 1146
accatccgatcctccgaatcctactactaccaccaccagctgacctcgatcgctcgctccagctagccatcatgaagccggcggcgcatcatctggtgctgctcgcggcggtcctggtcctggtgctgtgcgcgggggtcggcgacgcggcgacgtgcgacgcgacgcagctgacaccgtgcgcgggcgccatcatcgggaacgcgccgcccaccgcggcgtgctgcagcaggatgaaggagcagcagccgtgcctgtgcacgtacgcccgcgaccccaacctgcagcgctacgtcaactcgcccaacggcaagaaggccctggccgcctgcagggtgcccgtgccctcctgctgatcaattaacttcaataattcgcgtcggcaggcaccgcgcgcggtgtatgcgtcttggtcgatctccgtggtgttgcgctggtctcagctccctgtatctgccgagctcttcgggctcgcgtgtatgaataaaggatgtaataattacgtgcgtc

SEQ ID NO: 1146 - protein, 94 aa, Panicum virgatum
  misc_feature: Ceres CLONE 1759489
  misc_feature (1)..(66): Pfam Name: Tryp_alpha_amyl Pfam Description: Protease inhibitor/seed storage/LTP family
MKPAAHHLVLLAAVLVLVLCAGVGDAATCDATQLTPCAGAIIGNAPPTAACCSRMKEQQPCLCTYARDPNLQRYVNSPNGKKALAACRVPVPSC

SEQ ID NO: 1147 - DNA, 737 bp, Panicum virgatum
  misc_feature: Ceres CLONE 1759501
  misc_feature: Encodes the peptide sequence at SEQ ID NO. 1148
aataaggactcgcccggtcgccccgacctcagccagcgaccccagccggagcaccaaaaaaagcgagcagcgcaggcgggggagtagatggcggagggggagcccaagcagaagctgtcgccggcggactcccaggcggtggcactagcgttcatccgcgccctgggcgccggcgcgcgcctcccggccgcggccgaccagcccgatgcctactccgcgctcgtccgcgccatcctctcctccgccgccgtctccacctccccgggcccgcgggtctcctgcaccatcgccgtctcgcccgccgtgaccaacgggtacaacacgctccacggcggcgcggtggcggccttggccgaggccgtcgggatggcgtgcgcgcgggccgccgccggggacaaggagatgttcctcggtgagctcagcaccgcgtacctcgccgccgcgcgccttgattctgaagtggacgttgaagcgcagatactgaggaagggcaggtcggttgtggttaccactatcgagttcagactgaaggacaccaagaagctctgctacacatctcgggccaccttttacataatgccagtggcaagcctatgaacaatcaagatttatatgtgcaaattgttgtatttacaggaccagattcagtattgtgtgtaattaaattggagaacgcatgcctgtcttattaatatgaaataaacaccatatcgattcaaaaaaaaaaaaaaaaaaaa

SEQ ID NO: 1148 - protein, 169 aa, Panicum virgatum
  misc_feature: Ceres CLONE 1759501
  misc_feature (1)..(78): Pfam Name: 4HBT Pfam Description: Thioesterase superfamily
MAEGEPKQKLSPADSQAVALAFIRALGAGARLPAAADQPDAYSALVRAILSSAAVSTSPGPRVSCTIAVSPAVTNGYNTLHGGAVAALAEAVGMACARAAAGDKEMFLGELSTAYLAAARLDSEVDVEAQILRKGRSVVVTTIEFRLKDTKKLCYTSRATFYIMPVASL

SEQ ID NO: 1149 - DNA, 934 bp, Panicum virgatum
  misc_feature: Ceres CLONE 1759517
  misc_feature: Encodes the peptide sequence at SEQ ID NO. 1150
acagcaaaaaacactccaacacaattcaagcaggaccaaaggcagcaacagcaccccgggctcaagcgagcttgaagtgatcagaacaagatgtgccaaatcaagaaggagatgagcgccgagtcgggctccccgtgcagctcggccacgtcctcgacctcgacctcgtcggagcaccaccagacggtgtggccgtcgccgccgaagcggcccgcggggcggaccaagttccgggagacgcggcaccccgtgttccgcggcgtgcggcgccgggacaacgccgggcggtgggtgtgcgaggtgcgcgtgccgggccgccgcggctgcaggctctggctcggcaccttcgacaccgccgagggggccgcgcgcgcgcacgacgccgccatgctcgccatcgccggcgcgggcgcctgcctcaacttcgccgactcggcgtggctcctcgcggtccccgcctcctacgccagcctcgccgaggtgcgccacgcggtcgccgaggccgtggaggagttccagcgccgtgaggcgctcccggagcaggaggacgcgcgctcggccacgtcctcgacgccgtcgtaccctgccagcgacgacggcagcgccaccgacggcgaggggtcctctgactcctccccggccaccggggcctcgccgttcgagctggacgcgttcaacgacatgagctgggacttgtactacgcgagcatggcgcaggcgatgctcatggagccgccgtctgcggtcatggagttcggcgacgccagcatcatcgatgtgccactctggagctactagaagcgatgctgctgagccggagcttagcttttccttttctttcacatggcctcggacgccatttcttttgcctgtatgtaattttacttctttgagaaaacagagcaaaacagagcaaaaaaaaaaaaaaaaaaaa

SEQ ID NO: 1150 - protein, 235 aa, Panicum virgatum
  misc_feature: Ceres CLONE 1759517
  misc_feature (1)..(67): Pfam Name: AP2 Pfam Description: AP2 domain
  misc_feature: The sequence is a functional homolog of  SEQ ID NO 1230 in the  10/374,780 US patent application
  misc_feature: The sequence is a functional homolog of  SEQ ID NO 1235 in the  10/374,780 US patent application
  misc_feature: The sequence is a functional homolog of  SEQ ID NO 1236 in the  10/374,780 US patent application
  misc_feature: The sequence is a functional homolog of  SEQ ID NO 1246 in the  10/374,780 US patent application
  misc_feature: The sequence is a functional homolog of  SEQ ID NO 1248 in the  10/374,780 US patent application
  misc_feature: The sequence is a functional homolog of  SEQ ID NO 714 in the  11/435,388 US patent application
  misc_feature: The sequence is a functional homolog of  SEQ ID NO 724 in the  11/435,388 US patent application
  misc_feature: The sequence is a functional homolog of  SEQ ID NO 748 in the  11/435,388 US patent application
  misc_feature: Useful for making plants with modulated growth and phenotype characteristics
MCQIKKEMSAESGSPCSSATSSTSTSSEHHQTVWPSPPKRPAGRTKFRETRHPVFRGVRRRDNAGRWVCEVRVPGRRGCRLWLGTFDTAEGAARAHDAAMLAIAGAGACLNFADSAWLLAVPASYASLAEVRHAVAEAVEEFQRREALPEQEDARSATSSTPSYPASDDGSATDGEGSSDSSPATGASPFELDAFNDMSWDLYYASMAQAMLMEPPSAVMEFGDASIIDVPLWSY

SEQ ID NO: 1151 - DNA, 904 bp, Panicum virgatum
  misc_feature: Ceres CLONE 1759535
  misc_feature: Encodes the peptide sequence at SEQ ID NO. 1152
aactacgcgagaaccaccaccatacccatttcctcgtgcggtcggagcgcagcgcggcggcggcagcgggagaggggagccaccggcggaagggaggaggcagcggcggggccggcgaagatgagcggcagcggcgcgaagaaggtggccgatgtggcggtgaaggccggcaaggcgatcgactgggacggcatggccaagatgctcgtctccgaggaggcgcgcaaggagttcgccaccctccgccgcaccttcgaggacgtcaaccaccagctccagaccaagttctcccaggaaccccaaccgattgattgggagtactacagaaaaggaattggatctaaagtggtcgatatgtacaaagaggcttatgacagcatcgagatccccaagtacgttgacaccgtcactcccgagtacaagccaaagtttgacgctctggttgttgaactgaaggaggctgagaaagcatctctgaaggagtcagaaaggttagagaaggaaattgctgaactcagggaaatgaagaaaaagatcagcaccatgacagcggatgaatactttgagaagcaccctgaagtcaagcagaagtttgatgatgaaatccgtaatgactactggggatattgaagagcagaacagaactcttatctgtccatttccttgtctgtgaagaaccaataatttttccgtgccccgatatgtataggggaaaccaaccatctcaaatctggtggtttccgtgacatgtgcatggggcttggtggaatgcctacagaatcgactgtgtcaagctttcttgaaattccatctaaacacattttgtttgaccttcatcattttcttgaggactgtcggttgtcttataaagattatgttatgtcaaaaaaaaaaaaaaaaaaaa

SEQ ID NO: 1152 - protein, 169 aa, Panicum virgatum
  misc_feature: Ceres CLONE 1759535
  misc_feature (1)..(169): SWISSPROT Homolog: EC 3.6.3.14 ATP synthase D chain, mitochondrial
MSGSGAKKVADVAVKAGKAIDWDGMAKMLVSEEARKEFATLRRTFEDVNHQLQTKFSQEPQPIDWEYYRKGIGSKVVDMYKEAYDSIEIPKYVDTVTPEYKPKFDALVVELKEAEKASLKESERLEKEIAELREMKKKISTMTADEYFEKHPEVKQKFDDEIRNDYWGY

SEQ ID NO: 1153 - DNA, 827 bp, Panicum virgatum
  misc_feature: Ceres CLONE 1759545
  misc_feature: Encodes the peptide sequence at SEQ ID NO. 1154
aaaattcgaaacaatccagaagctctcctcgacaggactgaccgacgatggactggccgtactccggcggcggcggaggcgaggatggcgcgtacatgacggtgtcgtcggcgccgccgaagcggcgcgcggggcggaccaagttcaaggagacgcggcacccggtgtacaagggcgtgcgcagccggaaccccgggcgctgggtctgcgagctgcgggagccgcacggcaggcaccgcatctggctcggcaccttcgagaccgccgagatggcggcgcgcgcgcacgacgtcgccgcgctggcgctgcgcggcagggccgcctgcctcaacttcgccgactcgccgcgcaggctccgcgtcccgccgcagggcgccggccacgacgagatacgccgcgccgccgtggaggccgccgagctcttccgcccgcagcgcaatgcggggtctcccgaggcggcggcggcggcggcgatcgcggcgcccgacgcccaggcgaccgggggcctcggcggcgacttcgcttactacccgccggacgacggcctggacttcgaaatgcaggggtacctggacatggcgcaggggatgctgatcgacccgccgccggcgaacgcggggcagtcggcgtggatcgacgacgagtacgactgcgaggtcagcctgtggagctactgacgatcgcgggcgttcggaccgagccggcattaatggcgagaacgaccccgtgtacagtacaaacttatggtgtgctagtgtgtaccgtttccctgctattctgacgaaatgtgatgcgatcaggaggagcaaaaaaaaaaaaaaaaaaaa

SEQ ID NO: 1154 - protein, 209 aa, Panicum virgatum
  misc_feature: Ceres CLONE 1759545
  misc_feature: Great-hit functional homolog of the protein sequence given in SEQ ID NO 9589
  misc_feature (1)..(65): Pfam Name: AP2 Pfam Description: AP2 domain
  misc_feature: The sequence is a functional homolog of  SEQ ID NO 1223 in the  10/374,780 US patent application
  misc_feature: The sequence is a functional homolog of  SEQ ID NO 1412 in the  10/412,699 US patent application
  misc_feature: The sequence is a functional homolog of  SEQ ID NO 1720 in the  10/412,699 US patent application
  misc_feature: The sequence is a functional homolog of  SEQ ID NO 1956 in the  10/374,780 US patent application
  misc_feature: The sequence is a functional homolog of  SEQ ID NO 196 in the  11/375,241 US patent application
  misc_feature: The sequence is a functional homolog of  SEQ ID NO 2239 in the  10/666,642 US patent application
  misc_feature: The sequence is a functional homolog of  SEQ ID NO 422 in the  10/714,887 US patent application
  misc_feature: The sequence is a functional homolog of  SEQ ID NO 44 in the  10/412,699 US patent application
  misc_feature: The sequence is a functional homolog of  SEQ ID NO 55 in the  10/838,616 US patent application
  misc_feature: The sequence is a functional homolog of  SEQ ID NO 574 in the  11/435,388 US patent application
  misc_feature: The sequence is a functional homolog of  SEQ ID NO 70 in the  10/669,824 US patent application
  misc_feature: The sequence is a functional homolog of  SEQ ID NO 70 in the  10/870,198 US patent application
  misc_feature: The sequence is a functional homolog of  SEQ ID NO 716 in the  11/435,388 US patent application
  misc_feature: The sequence is a functional homolog of  SEQ ID NO 96 in the  10/675,852 US patent application
  misc_feature: Useful for making plants with altered terpenoid content
  misc_feature: Useful for making plants with modulated flowering time
  misc_feature: The plant flowers significantly late compared to wild-type.
  misc_feature: Useful for making plants with modulated growth and phenotype characteristics
MDWPYSGGGGGEDGAYMTVSSAPPKRRAGRTKFKETRHPVYKGVRSRNPGRWVCELREPHGRHRIWLGTFETAEMAARAHDVAALALRGRAACLNFADSPRRLRVPPQGAGHDEIRRAAVEAAELFRPQRNAGSPEAAAAAAIAAPDAQATGGLGGDFAYYPPDDGLDFEMQGYLDMAQGMLIDPPPANAGQSAWIDDEYDCEVSLWSY

SEQ ID NO: 1155 - DNA, 866 bp, Panicum virgatum
  misc_feature: Ceres CLONE 1759623
  misc_feature: Encodes the peptide sequence at SEQ ID NO. 1156
acagaagcacctatggatacgccgatggctgagagtcagacatcaggagaggattcacagcctccagctgagacaggaatcaacccttccgatctgccccaagaagaacccaagttcttctgtgcttgccggcggcctgccctgaaacggacctccggcacagctcggaatcctgggaggcgcttcttcacctgctattccgggaaagacatttgcaaagtctgggtctgggaagacctccttcagcagtatgttgagaagatggtggattacaacaaatcaacaacacgtgacatggcgatccaagagttagcaatagtcagggaggaactcaatgcaagagagaagcagatcaatgaattgaaggaaaaatgctggtcctatgaagagcagactaacgaattggcaaaaatagatgatcatgaagctttagttgcaacatttggtgatatggcaatttccaaagccaagtcagttaccaaggatgatggtggatcatctagctaaatcttggagctatggcatgactgtttgtgagatggctggctgctattgacctggcgactggaggtgcctttccatggctgtttcgacatcagaactataaagttccattgttggtcaagttagcatgtgctggtggtcattgccgcattgtttcatgtattctgtttctgttggtatttacctttattttagtatctgtttgagactatatatgtccttgtgtctaattagtcctattaacatttgtaccaggctatttggtatgttcttatgtgtgatgtcttaaggctatttcgtatgtcctgatgtgtgatgtattaagtatttgtgtgaaagactaaaaaaaaaaaaaaaaaaaa

SEQ ID NO: 1156 - protein, 164 aa, Panicum virgatum
  misc_feature: Ceres CLONE 1759623
  misc_feature (3)..(39): Pfam Name: zf-GRF Pfam Description: GRF zinc finger
MDTPMAESQTSGEDSQPPAETGINPSDLPQEEPKFFCACRRPALKRTSGTARNPGRRFFTCYSGKDICKVWVWEDLLQQYVEKMVDYNKSTTRDMAIQELAIVREELNAREKQINELKEKCWSYEEQTNELAKIDDHEALVATFGDMAISKAKSVTKDDGGSSS

SEQ ID NO: 1157 - DNA, 986 bp, Panicum virgatum
  misc_feature: Ceres CLONE 1759655
  misc_feature: Encodes the peptide sequence at SEQ ID NO. 1158
aatcgactaaaataattagcagaagccaattgtaaacgatggaccggagcgacgactccatctcaggtctcccgtctcccactcctataatccaatcatcggcaatcctttctgtcaatcattgccgcaattctttcttcccctccccagctagatcgaccggagcagcagagaggctgatccgaccaagcttcacctcaagatatggcaagcaaaaggattcagaaggaactcatggatttgcaaaaggatccaccaacatcatgcagtgctgggcctgctggagaggatctattccactggcaggccacaatcatgggtcctagtgacagcccttacgcaggaggggtgttctttgttaacatccactttcctcctgactacccctttaagcctccaaaagtgaacttccaaacaaaggtgtatcacccaaacatcaactctaacgggagcatttgccttgatatcctcaaggagcaatggagcccagccctgaccatatcaaaggtcctgctctccatcagctctctcctcaccgaccccaacccagacgacccccttgtcccagagattgctcacatgtacaagaaccagaggcaacgctacgaggaaactgcaagggcctggacccagaagtacgcgatgggctgatgccccatcacatggagcaatgttgccacttcccactgcaatgaccatcgtgaatgttgtaaaaattaagtcgaaccggttccatgttttgttatggtatcccaggaccccagacggctgtgtcagttgtactggcttctcaaggcaaattttatctgtgtacagaagctttaaagcatgacaatcttagttctggacccaaagtttggtttacaccctgaaaagcacctgctgcggtcaccgcatgtgtagctgccaagaaaaggtcaatttgtatgtgggaggatgttatattttctaaatatgttttgcttccaaaaaaaaaaaaaaaaaaa

SEQ ID NO: 1158 - protein, 148 aa, Panicum virgatum
  misc_feature: Ceres CLONE 1759655
  misc_feature: Great-hit functional homolog of the protein sequence given in SEQ ID NO 9309
  misc_feature (1)..(148): SWISSPROT Homolog: EC 6.3.2.19 Ubiquitin-conjugating enzyme E2-17 kDa
  misc_feature (1)..(148): SWISSPROT Homolog: EC 6.3.2.19 Ubiquitin-conjugating enzyme E2-17 kDa 10/12
  misc_feature: Useful for biocontainment applications
  misc_feature: The plant produces a reduced number of seeds.
MASKRIQKELMDLQKDPPTSCSAGPAGEDLFHWQATIMGPSDSPYAGGVFFVNIHFPPDYPFKPPKVNFQTKVYHPNINSNGSICLDILKEQWSPALTISKVLLSISSLLTDPNPDDPLVPEIAHMYKNQRQRYEETARAWTQKYAMG

SEQ ID NO: 1159 - DNA, 871 bp, Panicum virgatum
  misc_feature: Ceres CLONE 1759741
  misc_feature: Encodes the peptide sequence at SEQ ID NO. 1160
aacacctcaacagccagtagtagtgaaccaacccaaccagcaacaacccaagcgcaaccgatcgacatggctgactactacggcggcaggaccatgtactccaagaccgacgagtgctacgacaccggcaggcacggcggcagccagagggtgtactcccacaccgacgagtgctacgacgacgtggaccacaggaggccgggggcctacgccgacgactgctacaacggcgccggctacggcggcgccaggcaggccgccgtctactccgacgagtactcccgcagcggctatggcagcgagcaggagcacttcaagagggaggagagggaacacaagcataaggaacgcctcggcgagataggcgccctcgccggcggcgccttcgcactgtacgaggggcaccgtgcgaagaaggacccggagcacgcgcagaggcacaagatcgaggcgggcgtggcgacggcggcggcgctgggcgccggcggctacgcgtaccacgagcaccgcgagcagaaggaggcccgctacgagggcaaggaccacagggtgccgcacggctactactgcaactaactcagcgatcgatcgagtcatgctgatgcatcgagctagatggaatggatcgcatgcatgccggcggcgacacgacgggcgtgcaagtactctagtaaataagagcagatgtgacgactccttgtgtgctgctcactacactacatattgaccgttactagtaggcatacaaaaacggttgcaataataatgtaaatcactactctgcgtgcttcggcaggcaggtaccgtgtgtagtataaccatgcatcattattaatataatgcaattaagtaaaaaaaaaaaaaaaaaaaa

SEQ ID NO: 1160 - protein, 169 aa, Panicum virgatum
  misc_feature: Ceres CLONE 1759741
  misc_feature (1)..(54): Pfam Name: ABA_WDS Pfam Description: ABA/WDS induced protein
MADYYGGRTMYSKTDECYDTGRHGGSQRVYSHTDECYDDVDHRRPGAYADDCYNGAGYGGARQAAVYSDEYSRSGYGSEQEHFKREEREHKHKERLGEIGALAGGAFALYEGHRAKKDPEHAQRHKIEAGVATAAALGAGGYAYHEHREQKEARYEGKDHRVPHGYYCN

SEQ ID NO: 1161 - DNA, 953 bp, Panicum virgatum
  misc_feature: Ceres CLONE 1759790
  misc_feature: Encodes the peptide sequence at SEQ ID NO. 1162
acgtgtcaactgcacttccagaaaggcaaatccattccatggagctcgcgccgctgctcctgctccccccgctgctgctgctcccggcggcggccgtcgcctccggcggtgagccgccgctggcgcacccggcctatgcgcgcggcgccgaggaggcatgcggcgtggcggcgctgccagcgccggagcggcgcgaggagttcgacggcgggcggatcgtggacatcagccactactaccgcgcggacatgccggcgtgggagtcggcggagggctccggcgagttcctgcggctggcgcggtccatgcgcaacggctccgacatcgccaacttctcggagctccgcctcaccgcgcactccggcacccacgtcgacgcgccggggcacgtcttcgagcactactacgacaccggcttcgacgtcgacacgctcgacctcgccgtcctcaacgggccagcgctgttggttgacgttccccgagataagaacataacaggtgttcgacgtgtactcttccgaaccttaaatactgacagaaagcttatgtggaagaaagagtttgatactagttatgttggcttcatgaaggatggtgcacaatggctggtcgacaatactgacatcaaactagttggagttgattacttgtctgtgggtgcatttgacgaatgcattccagctcatctagtatttcttgaaaaaagggaggtaatccttgtggaagccttaaatctggagcatgctacccctggaatatatgccttgcattgcttgccactaagattgcgtggtgctgaaggttctcctgcaaaatgcatccttatcaagtgacacatggttacaaccatctagaaaacctttgtactatcttatggcacgtatgataatgaaataagaaaaggtcaacgcatatgacttcttctcttgcatcaaaaaaaaaaaaaaaaaaaa

SEQ ID NO: 1162 - protein, 264 aa, Panicum virgatum
  misc_feature: Ceres CLONE 1759790
  misc_feature (1)..(203): Pfam Name: Cyclase Pfam Description: Putative cyclase
MELAPLLLLPPLLLLPAAAVASGGEPPLAHPAYARGAEEACGVAALPAPERREEFDGGRIVDISHYYRADMPAWESAEGSGEFLRLARSMRNGSDIANFSELRLTAHSGTHVDAPGHVFEHYYDTGFDVDTLDLAVLNGPALLVDVPRDKNITGVRRVLFRTLNTDRKLMWKKEFDTSYVGFMKDGAQWLVDNTDIKLVGVDYLSVGAFDECIPAHLVFLEKREVILVEALNLEHATPGIYALHCLPLRLRGAEGSPAKCILIK

SEQ ID NO: 1163 - DNA, 688 bp, Panicum virgatum
  misc_feature: Ceres CLONE 1759802
  misc_feature: Encodes the peptide sequence at SEQ ID NO. 1164
atccatcaccacacgaagcttgatcaaccgcggctttccagtttccccctagagattaaacaggcagctagctgatcatcaacgcccggagacccgcggcgatggctgaggagaagaagcaccaccaccacctgttccaccgccacaaggacggcgaggaggagggggccgccgccgccggcgaggtggactacgagaagaaggagaagcaccacaagcacctggagcagctcggcgggctcggcgccatcgccgccggcgcatacgccattcacgagaagcacaaggcgaagaaggaccccgagaacgcgcacgggcacaaggtgaaggaggaggtggcggcggtggcggcgctgggcgcggccgggttcgcgttccacgagcaccaccagaagaaggacgccaagaagcacgctgctggcgacaactgatgacgatggggccgagagcctctgctcttgtgcttcgtgattgcgagattattgttgtttcgccgtagttcttctcctcccgccttttgctccatcgatccgtacatgtaccatgcgtatccgtaaaataattgtgcttgtgcgtgcgtgtcagcttgctcctcgcagcagctagctccgatccatgcttgtgtaatacgatacagtatttttttttcccgacgaatgctcgtgtaatatatgaataccaccacact

SEQ ID NO: 1164 - protein, 109 aa, Panicum virgatum
  misc_feature: Ceres CLONE 1759802
  misc_feature (1)..(54): Pfam Name: ABA_WDS Pfam Description: ABA/WDS induced protein
MAEEKKHHHHLFHRHKDGEEEGAAAAGEVDYEKKEKHHKHLEQLGGLGAIAAGAYAIHEKHKAKKDPENAHGHKVKEEVAAVAALGAAGFAFHEHHQKKDAKKHAAGDN

SEQ ID NO: 1165 - DNA, 840 bp, Panicum virgatum
  misc_feature: Ceres CLONE 1759827
  misc_feature: Encodes the peptide sequence at SEQ ID NO. 1166
tctccccgcctcgcacccatggcgacggccctgatggctgcggccaccacctcatgctccccgcgccgcgcggcgccgctcctgaagccggtggcctcctcctcgtctagctcggcgcggccgcgacggccctcggcgcagcagctcccgcggctgctggcgacggcgacggcggcggtggcggccgcgccgctcccggcgctggcggagcagatggagaaggcggcgctcttcgacttcaacctgacgctcccggcgatcgcgatcgagttcctgctgctcatggtcgcgctggacaagctctacttcacgccgctcggcaagttcatggacgagcgggacgccaagatccgcggcgagctaggagacgtcaaggacgcctccgaggaggtgaagcagctggaggagcaggccgccgccatcctgaaggccgcgcgcgccgagatcgccgcggcgctcaacaagatgaagaaggagaccaccgcggagctggaggccaagctggacgagggccgccgccgcgtggaggccgagctcgtcgaggcgctcgccaacctcgagtcccagaaggaggaggccgtcaaggcgctcgacgcgcagatcgcctcgctcagcgacgagatcgtcaagaaggtgctcccatccgcgtgagcgaatcaaaacagcgagccggccggccggccttcttccttgcttagcttctgatctgtgtgtatacgcttgttgggctgccgtccattgccggccctgctttatcctatgatgtgtgtaattgcatcaacattttgtggcaagtataaatgaatcaatcatatttctgaaaaaaaaaaaaaaaaaaaa

SEQ ID NO: 1166 - protein, 210 aa, Panicum virgatum
  misc_feature: Ceres CLONE 1759827
  misc_feature (1)..(132): Pfam Name: ATP-synt_B Pfam Description: ATP synthase B/B' CF(0)
  misc_feature (5)..(208): SWISSPROT Homolog: EC 3.6.3.14 ATP synthase B' chain, chloroplast precursor
MATALMAAATTSCSPRRAAPLLKPVASSSSSSARPRRPSAQQLPRLLATATAAVAAAPLPALAEQMEKAALFDFNLTLPAIAIEFLLLMVALDKLYFTPLGKFMDERDAKIRGELGDVKDASEEVKQLEEQAAAILKAARAEIAAALNKMKKETTAELEAKLDEGRRRVEAELVEALANLESQKEEAVKALDAQIASLSDEIVKKVLPSA

SEQ ID NO: 1167 - DNA, 650 bp, Panicum virgatum
  misc_feature: Ceres CLONE 1759894
  misc_feature: Encodes the peptide sequence at SEQ ID NO. 1168
cataaccaaactgaatttgcactagtggttatttgttaactcgatagaaatcatcatcatcatcatcatcatcaatgaggccgctcgttgtgcttggcctggtcctcgtgctcgcagcaggggtcgcgctggacggcgtcgacggcgccggggagtgcgggagggcctccgctgaccgagtggcgctgcggctggcgccgtgcgtctcggcggccgacgacccgcagtcgacgccgacgagcagctgctgctcggccgtgcacaccatcgggcagagccccagctgcctctgcgccgtcatgctgtccggcaccgccagggccgccgggatcaagccggaggtcgccattaccatccccaagcgctgcaacatggccgatcgccccgtcggctacaagtgcggagactacacgctgccctgacgacctcgtgagtgaggccaccgcgctggtaattaataaagagatggacgccaaggaaaggctttgtgttggaataatcgagtctgcgcgaaccatgaacgtggacgaggggctctagccctatcacactggactgtgcttgtatcgtaattgtgttccacttcgtctaaaattaataagaatgaatgtgttgcttatcaagcccattaaaaaaaaaaaaaaaaaaaa

SEQ ID NO: 1168 - protein, 115 aa, Panicum virgatum
  misc_feature: Ceres CLONE 1759894
  misc_feature (1)..(82): Pfam Name: Tryp_alpha_amyl Pfam Description: Protease inhibitor/seed storage/LTP family
MRPLVVLGLVLVLAAGVALDGVDGAGECGRASADRVALRLAPCVSAADDPQSTPTSSCCSAVHTIGQSPSCLCAVMLSGTARAAGIKPEVAITIPKRCNMADRPVGYKCGDYTLP

SEQ ID NO: 1169 - DNA, 697 bp, Panicum virgatum
  misc_feature: Ceres CLONE 1759951
  misc_feature: Encodes the peptide sequence at SEQ ID NO. 1170
acacacgaatcgaattgtttctaaccatttcatctcaaagacaagagtccatttgcttgaaagccaaaggcaggtagctacaatgatcagctccaagaagctagctcagctgtccaagaagtggcagggaatgggcgtaattgggctaaaaaggatcacaagtgtagacaaagagttcaacccatcttgcagcagcatggttgcagggaagggcaactgcattgtctattcttccgatgggaagcggtttgagatccccctcacgtacctccgcacgacagtctttgtggagctcctgaagttgtcacaggaagaatttgggttcacaagtgatgggagaatcacactgccttgcgatacagcagtgatggagtatgtgatgtgtttactgaggagagaggcctctgaagatgttgtgaaggcactcctcagttccatagtgatgccttgccaccaccaaagcagattatccagtggattgaaccagcaattcgctgtctgcagcacctgaagatgaagatatcatggatttgagcttgttttctctcttttcccccttccatctttttttcccagctgtaccttggagcacagttttgtgcaacgtttttacaatggtacactgtggttgtacagatggatgagtgtaaaaataatcatattgtgattagaaaagaaggaatcaagcttgccattg

SEQ ID NO: 1170 - protein, 142 aa, Panicum virgatum
  misc_feature: Ceres CLONE 1759951
  misc_feature (1)..(105): Pfam Name: Auxin_inducible Pfam Description: Auxin responsive protein
MISSKKLAQLSKKWQGMGVIGLKRITSVDKEFNPSCSSMVAGKGNCIVYSSDGKRFEIPLTYLRTTVFVELLKLSQEEFGFTSDGRITLPCDTAVMEYVMCLLRREASEDVVKALLSSIVMPCHHQSRLSSGLNQQFAVCST

SEQ ID NO: 1171 - DNA, 733 bp, Panicum virgatum
  misc_feature: Ceres CLONE 1760062
  misc_feature: Encodes the peptide sequence at SEQ ID NO. 1172
acgctatccaaacctctcaaaaaccacaccgagcttgctcggctcggcagtcggcaacacagccggaaaatatccccttttcttatccatggaggcggccgcgctcacgatacgctccacctccctgcgtcccgccgccgccgctcctgcgcacggcaaccggcgggccgcgcgcgcggcggccgtgcctcgccgcagccgggcgccgggcggcagacttcgggctttgccgccggagctcagcgagatcctcagccccaagctggtgcccggctcgccgtccgacaccggcgacgtctcgtcgctcatcccagtcagtgctctgatgctgctgttctacttcgtgtccaactgggtggtgcctgagttgctcatgaagcggctccagcccaaggccgaggaccaagaggcatcagcagcggcatccatgtcgttctccggggacgccaccgatggccaatcggatggcgacgacgcccgtcctaagatccggctgaaggtgatgaagaagaagaaaaagaagaagaacagaaaagcgcctgtggaggtctagcacgcatacacagtttacatgcatggaggcgtccctgatgattaagtatcaacagacatcagaacaaagtgcctctgaagaagaaatgctacaggagtagtacttagcgttgtctgatatatatgcatattgtactttgtctcttctgaataaaacctacactgttattgtttgcgctgt

SEQ ID NO: 1172 - protein, 154 aa, Panicum virgatum
  misc_feature: Ceres CLONE 1760062
  misc_feature: Great-hit functional homolog of the protein sequence given in SEQ ID NO 9520
  misc_feature: Useful for making plants with modulated nitrogen use efficiency
MEAAALTIRSTSLRPAAAAPAHGNRRAARAAAVPRRSRAPGGRLRALPPELSEILSPKLVPGSPSDTGDVSSLIPVSALMLLFYFVSNWVVPELLMKRLQPKAEDQEASAAASMSFSGDATDGQSDGDDARPKIRLKVMKKKKKKKNRKAPVEV

SEQ ID NO: 1173 - DNA, 890 bp, Panicum virgatum
  misc_feature: Ceres CLONE 1760066
  misc_feature: Encodes the peptide sequence at SEQ ID NO. 1174
acgggaccctcgacacacttgttcaagaacacccctccctcacaccccctgtcctggaagcagagacaagctctcgcagccgacacgcatgctgacgctgcacccgagggtggtggcggcgagcgcggccgaggacgacggcgcccacggcgagggccgcgcctgctactgcgtcgtggcggcctgcgtctcgctgctgctcttcgtcgtgctggccgccgcgacgggcagcgtcgccagggcctgcgccatcaccgccgcggccgcgctcctgctaggcctcgccggctgggccgcgaccgcgtgggacggcgccccggcggcggcggcggcggcggcgcggctgcaccagtccggagccggcggcagcgctccggcggcggcggcggtgaggctggtggtgcaccgccgatgcgcgtgcgggctggcggacgcggccatcggcgcgctgccggcgttcgcgtacgagccgccgcccgtcgcggcgaagggcggcggcgacgacgacaaaccgcgcggcggcggctccgtgctgctgtgcgcggtgtgcctggaggacgtgcgcgccggcgagatggtgcggcagctgccggcgtgccaccacctcttccacgccgactgcgtcgacgcctggctgcgcgctcaccggacctgcccgctctgccgctgcgacctctccccacggaaccccatcgccaaggccgccgcggcggccgccgtcacagtggagtcctcggccgacgccctgccgccggtttgagcaatccatcgatcagctcgccggaatctgggcggtgtattgtattcggcacgcctactgtacattctcgatctctaacacagcacaaagcagattagaatacattgatgaaaaaaaaaaaaaaaaaaaa

SEQ ID NO: 1174 - protein, 223 aa, Panicum virgatum
  misc_feature: Ceres CLONE 1760066
  misc_feature (1)..(42): Pfam Name: zf-C3HC4 Pfam Description: Zinc finger, C3HC4 type (RING finger)
MLTLHPRVVAASAAEDDGAHGEGRACYCVVAACVSLLLFVVLAAATGSVARACAITAAAALLLGLAGWAATAWDGAPAAAAAAARLHQSGAGGSAPAAAAVRLVVHRRCACGLADAAIGALPAFAYEPPPVAAKGGGDDDKPRGGGSVLLCAVCLEDVRAGEMVRQLPACHHLFHADCVDAWLRAHRTCPLCRCDLSPRNPIAKAAAAAAVTVESSADALPPV

SEQ ID NO: 1175 - DNA, 936 bp, Panicum virgatum
  misc_feature: Ceres CLONE 1760067
  misc_feature: Encodes the peptide sequence at SEQ ID NO. 1176
cactcgtttcattttcttcgccccgcccgaagccgaggaggagagggtaggggagcagcgggatcgcgcgcgcccgagatctcccggaagttgtggcaacatggggctcaccttcacgaagctcttcagccgcctcttctccaagaaggagatgaggatcctcatggtcagtctcgatgcagctggtaagaccaccatcctctacaagctgaagctcggggagatcgtcaccaccattcccacaatcgggttcaatgtggagactgtcgaatacaagaacattagctttactgtctgggatgtcgggggtcaggacaagatcagaccactgtggaggcactacttccagaacacacaaggtcttatctttgtcgttgatagcaatgacagagatcgtgttgttgaggcaagggatgagctccacaggatgctgaatgaggatgagttgagggatgctgtcttactcgtttttgctaacaagcaagatctgccaaatgcaatgaatgctgctgagataacagataagcttggtctccattccctgcgccaacgccactggtatatccagagcacctgtgctaccacaggagaaggtttgtacgagggtctggactggctctccaacaacattgcaaacaaggcctgattgtacaattctgcggtttcatggattacatgtcgattgcatcttccgcagaaacagacccatgggtcattttgaccttgagacttcagacttcattattatttcgttagaatgtttatcaagtattgtatttctttgctaggcttttcagagctggttttctgttacattgtgtgattatactctctaaaatcctgttcggatatcaagacactgtaattggccattggcactagatcgtatactgagtaatgcagtttatttcaatgcaaaaaaaaaaaaaaaaaaaa

SEQ ID NO: 1176 - protein, 181 aa, Panicum virgatum
  misc_feature: Ceres CLONE 1760067
  misc_feature: Great-hit functional homolog of the protein sequence given in SEQ ID NO 9285
  misc_feature (1)..(174): Pfam Name: Arf Pfam Description: ADP-ribosylation factor family
  misc_feature: Useful for making plants with altered Lignin content
  misc_feature: Useful for making plants with altered alkaloid content
MGLTFTKLFSRLFSKKEMRILMVSLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATTGEGLYEGLDWLSNNIANKA

SEQ ID NO: 1177 - DNA, 719 bp, Panicum virgatum
  misc_feature: Ceres CLONE 1760169
  misc_feature: Encodes the peptide sequence at SEQ ID NO. 1178
aacctccgtgttcgagatcgtgagcgcaagagacagaggagagagagagaggagggagggaagcagcgatgccgacgggtaggctgagcggcaacatcacccaggactgggagccggtggtgctgcggcggacgaagccgaaggcggcggacctcaagtcggcgaaggcggtgaaccaggcgctgcgctcgggcgcggccgtggagacggtgcggaagtcggcggcgggcacgaacaagcacgccgcggcgccggcggcgcccgcgcggaagctggacgagacgacagagcccgcggcggtggagcgggtggccgcggaggtgcgcgcggcgatccagcgggcgcgcgtggccaaggggtggagccaggcggagctggcgaagcgcatcagcgagcgcgcgcaggtggtgcaggagtacgagagcggcagggcggcgcccgcgcaggccgtgctcgccaagatggagcgcgcgctcgaggtcaagctccgcggcaggggcgtcggcgcgcccctggcggccggcggcggcaagtgatgcggtggccctgtgcagaccggaacgtcgatagcttaacttctttcggcccgtggaggaggatgcgaatcggcggtgaatgatgtgtaatttgtttgtgttgatctgatcggcttggaagatttggagaatgtaaatcagtagtgacgcattcgcaagtgatttctagaaatctattggtgc

SEQ ID NO: 1178 - protein, 155 aa, Panicum virgatum
  misc_feature: Ceres CLONE 1760169
  misc_feature: Great-hit functional homolog of the protein sequence given in SEQ ID NO 9298
  misc_feature: Useful for making plants with altered alkaloid content
  misc_feature: Useful for making plants with modulated drought sensitivity
  misc_feature: Useful for making plants with modulated heat sensitivity
MPTGRLSGNITQDWEPVVLRRTKPKAADLKSAKAVNQALRSGAAVETVRKSAAGTNKHAAAPAAPARKLDETTEPAAVERVAAEVRAAIQRARVAKGWSQAELAKRISERAQVVQEYESGRAAPAQAVLAKMERALEVKLRGRGVGAPLAAGGGK

SEQ ID NO: 1179 - DNA, 1032 bp, Panicum virgatum
  misc_feature: Ceres CLONE 1760357
  misc_feature: Encodes the peptide sequence at SEQ ID NO. 1180
ctccgtcttcctccccttctcttcttcccccgacagcgaactcgggactcgcaacgcaaccgagaagaagaggagaactcggcgagccgaggggagaagaacccgaacgggtgtccttaatcagcgatcgaagaaggtgggtacaggagcaaggcagcctgccgccaccatgaggcgcgcctcgaggaagtcgtcgtcgtccgccgcgaccgccagcgctggccctacgaaagcagtttccaaggaagttgaacggattgatcaatttttctatgcttatgctgatagctcatctggcatgattgacccagaaggcattgaaacactctgttctcatctcgaagttccccatactgatgttaggattctaatgttagcatggaaaatgggctgtgagaagcaaggttactttaccttggatgaatggcgaaccggtttgaaagctcttcgagctgacagtatcagtaagctgaagaaagcatttccagaattagttcaagaggttacaaggccaaccaatttccaggatttctacacatatgcatttcgttattgcctcaccgaggataagaagtgtatagaaatgccagttgcttgtgagttgctgaatctagtattaggcttacagttccgcccccaggttgacaagcttaataattacctcatgtaccaaaatgaatacaaggtgataaacatggaccaatggatgggatttattcggttctgtaatgagataaacttcccatcactcgacaattatgattcggaccttgcttggcctttgattctagacaattttgttgagtggctacgagaaaataaaagttagatcttctattcctgcagtggtggtgaagatgtcatccaaaatgtaataatattcaagaatgtaggtgaatattgtttcaatttgtatatgacatcaattttttgcccactcacttgtgtactttgacggtagtgcaaaaagcactgataactcccatgttcatgagttttattgcagatttacaaaaaaaaaaaaaaaaaaaa

SEQ ID NO: 1180 - protein, 219 aa, Panicum virgatum
  misc_feature: Ceres CLONE 1760357
  misc_feature: Great-hit functional homolog of the protein sequence given in SEQ ID NO 9720
  misc_feature: Useful for making plants with altered terpenoid content
MRRASRKSSSSAATASAGPTKAVSKEVERIDQFFYAYADSSSGMIDPEGIETLCSHLEVPHTDVRILMLAWKMGCEKQGYFTLDEWRTGLKALRADSISKLKKAFPELVQEVTRPTNFQDFYTYAFRYCLTEDKKCIEMPVACELLNLVLGLQFRPQVDKLNNYLMYQNEYKVINMDQWMGFIRFCNEINFPSLDNYDSDLAWPLILDNFVEWLRENKS

SEQ ID NO: 1181 - DNA, 513 bp, Panicum virgatum
  misc_feature: Ceres CLONE 1760407
  misc_feature: Encodes the peptide sequence at SEQ ID NO. 1182
accagccactcgctcgcgaatacgcgggctttaaagggcgtctccgcaaaaacgccacctcggctcctctctcgcggcggcggcgcaccccccttctccatctccggcatttggcatctcacctcaacagcaagcatggcaggtggcagggttgcacatgccaccctcaagggcccgagtgtggtgaaggagatcttcattggactcacccttgggctgattgccggtggcatgtggaagatgcaccactggaacgagcagaggaagactagatccttctacgacatgctggagaagggccagatcagcgttgttgtcgaggagtagcttccaggccccaagtctgaagttattttctcacagttgtttctgaaaactctggagagcatgaagaaatgaattctgtggagatttgtcttaaaaataagcataaccatttgagaacaccagattttgttgaatttccttccatttcatgaatatttgaacatgtccagatcataccaagcaact

SEQ ID NO: 1182 - protein, 63 aa, Panicum virgatum
  misc_feature: Ceres CLONE 1760407
  misc_feature (1)..(62): Pfam Name: COX5C Pfam Description: Cytochrome c oxidase subunit Vc (COX5C)
  misc_feature (1)..(63): SWISSPROT Homolog: EC 1.9.3.1 Cytochrome c oxidase polypeptide Vc
MAGGRVAHATLKGPSVVKEIFIGLTLGLIAGGMWKMHHWNEQRKTRSFYDMLEKGQISVVVEE

SEQ ID NO: 1183 - DNA, 865 bp, Panicum virgatum
  misc_feature: Ceres CLONE 1760469
  misc_feature: Encodes the peptide sequence at SEQ ID NO. 1184
gaacagagagcatccgagcatctcttggaacttggaagaggggcagcaatggcgacgaggtgcgtcgcgtctcttcccctcctctccgcatccagcgccgcggcggccagggcgcagcctatcccatccgccgccgcgccccgccgcttccgcacacgcctttcggtcgccacaggcggggagcagcagctcatcacggcgcaggagccggcccaggaacctgattatggagttgttagccttcatcatgttgggattctgtgtgaaaatcttgaaaggtcaatggcgttctacaaggacctcctaggtcttaaggtgaatcctgctaggccaaccgacaagctgccatacagaggtgcttggctctgggttggttctgagatgatccacttgatggagctgccaaatcctgatcctctgacaggacgcccagagcatggtgggcgcgatcgtcatacctgtatagcaatcaaagatgtgttgaagctgaaagaaatatttgacaaagctggaatcagctacacactcagcaaatctgggcgtccggcgatctttgcaagagacccagatgggaacgcattggagttcacccaagtgtagcaactgaaagatgccttttttttcggctagaacatctcatagccttacacttgtcaggtacactatacctagttgtcttagaccttgctgctggccttgcttgtagctatcaagaccacgcagaggcaggggaatacagcttgtacatatgacatcaataaagtatttgaggttgactggtttcatgggagcaatttgtatctccatatacaagcattctaaatgtcatcaatttggtttctattaaaaaaaaaaaaaaaaaaaa

SEQ ID NO: 1184 - protein, 183 aa, Panicum virgatum
  misc_feature: Ceres CLONE 1760469
  misc_feature (1)..(117): Pfam Name: Glyoxalase Pfam Description: Glyoxalase/Bleomycin resistance protein/ Dioxygenase superfamily
MATRCVASLPLLSASSAAAARAQPIPSAAAPRRFRTRLSVATGGEQQLITAQEPAQEPDYGVVSLHHVGILCENLERSMAFYKDLLGLKVNPARPTDKLPYRGAWLWVGSEMIHLMELPNPDPLTGRPEHGGRDRHTCIAIKDVLKLKEIFDKAGISYTLSKSGRPAIFARDPDGNALEFTQV

SEQ ID NO: 1185 - DNA, 1228 bp, Panicum virgatum
  misc_feature: Ceres CLONE 1760491
  misc_feature: Encodes the peptide sequence at SEQ ID NO. 1186
cggcgccactcgctcctgccccccgcgcgcctctccgctcccaactcgcatctcgatcccctccgatctatcttctctcgggggatcaggaaggaggaggatggaaggccctccggtcgcgcttttcgacagcctcaaggctgccaaaccattcttcttgctagccgggcccaatgtgattgaatcggaggagcatgtcctcaagatggccaaacacattaaaggcatcacaaccaagcttgggatcccacttgtgttcaaatccagctttgataaagcaaatcgtacatcatcaaaatctttccgtggccctggtctggaagaaggcctaaagatccttgaaaaggtgaaagcaacatatgaccttccagttgtcactgatgtgcatgaaagccaccagtgtgaagctgttggaaaagtcgctgacattatacaaattccagctttcctctgtcgtcagactgatcttctcgtggctgctgctaagactggaaaaattatcaatatcaagaaagggcaattctgtgcaccttctgttatggtcaactctgcagagaaaataagacttgctggaaatcctaatgtgatggtctgtgagcgtggtaccatgtttggctacaatgatctaattgttgacccaaggaattttgagtggctgagggaatctaactgcccagttgtagctgatataacacatgctttacaacaaccagctggaagaaagcttgatggtggaggtgttgcaagcgggggcttccgcgaattaataccttgcatcgcaaggacttctgttgctgttggtgttgatggtattttcatggaggtacatgatgatcccttgaatgctccatgtgatggcccaacccaatggccattgcgcaatttggaggagctattggaggaattgttagcaatcgctcgaattaccaagggaaagaagccgttccagattgatctcacaccgttccaggaatgatctggtttggtagatagagagcacaatgccactgtccactggtttcaacagggtgtatttctcttcgctgtacttgttattgtttcgggcatagctgccgtagacgacttatatctgaactactgaattgaagcctgttgttgctttgtgctgtttcatcagttgtaccatgttataatttcacacaaaataaatgtgatttattgctgattaccagcattctgcttaggtcaaaaaaaaaaaaaaaaaaaa

SEQ ID NO: 1186 - protein, 291 aa, Panicum virgatum
  misc_feature: Ceres CLONE 1760491
  misc_feature (2)..(268): Pfam Name: DAHP_synth_1 Pfam Description: DAHP synthetase I family
  misc_feature (4)..(291): SWISSPROT Homolog: EC 2.5.1.55 2-dehydro-3-deoxyphosphooctonate aldolase
  misc_feature (8)..(291): SWISSPROT Homolog: EC 2.5.1.55 2-dehydro-3-deoxyphosphooctonate aldolase
MEGPPVALFDSLKAAKPFFLLAGPNVIESEEHVLKMAKHIKGITTKLGIPLVFKSSFDKANRTSSKSFRGPGLEEGLKILEKVKATYDLPVVTDVHESHQCEAVGKVADIIQIPAFLCRQTDLLVAAAKTGKIINIKKGQFCAPSVMVNSAEKIRLAGNPNVMVCERGTMFGYNDLIVDPRNFEWLRESNCPVVADITHALQQPAGRKLDGGGVASGGFRELIPCIARTSVAVGVDGIFMEVHDDPLNAPCDGPTQWPLRNLEELLEELLAIARITKGKKPFQIDLTPFQE

SEQ ID NO: 1187 - DNA, 976 bp, Panicum virgatum
  misc_feature: Ceres CLONE 1760529
  misc_feature: Encodes the peptide sequence at SEQ ID NO. 1188
actgctgccactgcgagcgagcgaaagaggggggaatcggatgggggacgcctacgcgaagcgggtgctgctcaccgccgccggcgacgccatctccaggggaatcgcctctaacctcgccaagcacggctgcaggttggttttggtgggcgacgagggcgcgttggccgcgacggccgaggaggtgcggcgctgcgtgggcggaggcgtcgcggtggtgggtcgggcgtggcactgcttcgccggactcgacgccttcgtcaactgctacacctacgagggcaaggtgcaaggttgtctcagcataagtgaggatgagtacaagaagaccatgaaagtaaatgtgataacaccttggtttctaatgaaggcgattgcaaagcggttcgaggatacaaaatttggtggctctgttgtgttcttgactcagattattggtgctgagagaggattatatccaggtgctgcagcttatggtacaagcctaggagctattcaccaattggtccgactttctgcgatggagcttggcaagcacaagataagagtgaatgcagcctgtcgcggtctgcatgtgcaggacaagttccccgtctctgtggggaaggagaaggttgagaaggcaaccgcagaggtgatgcccctggggagatggctggatccggagaaggacctggcgtccacagtgctgtacctggtcggggatgagttgcggtacatgacgggcacgaccatatacgtggatggagcacagtccatcatgcgaccgcgcatgcggtcctacatgtagcttggcgaggacatggtggtagatctggaacgtgcagaacggtggtgtttgttcaacatgtggagccaactgctcatctggatatctgcataccatttgtatgattatgatctgcgtaggatgaattgattgggcaaccagtccggtaatgaagtactgaatacacaaaaaaaaaaaaaaaaaaaa

SEQ ID NO: 1188 - protein, 249 aa, Panicum virgatum
  misc_feature: Ceres CLONE 1760529
  misc_feature (48)..(178): Pfam Name: adh_short Pfam Description: short chain dehydrogenase
MGDAYAKRVLLTAAGDAISRGIASNLAKHGCRLVLVGDEGALAATAEEVRRCVGGGVAVVGRAWHCFAGLDAFVNCYTYEGKVQGCLSISEDEYKKTMKVNVITPWFLMKAIAKRFEDTKFGGSVVFLTQIIGAERGLYPGAAAYGTSLGAIHQLVRLSAMELGKHKIRVNAACRGLHVQDKFPVSVGKEKVEKATAEVMPLGRWLDPEKDLASTVLYLVGDELRYMTGTTIYVDGAQSIMRPRMRSYM

SEQ ID NO: 1189 - DNA, 593 bp, Panicum virgatum
  misc_feature: Ceres CLONE 1760584
  misc_feature: Encodes the peptide sequence at SEQ ID NO. 1190
accccttctcctcgcgccgccgccgctcgaagcgccgccgccgtcgccatgtcgaagcgcgggaggggaggttccgcggggaacaagttccgcatgtcgctgggtctgcccgtggcggcgacggtgaactgcgccgacaacactggcgccaagaacctctacatcatctccgtcaagggcatcaagggcaggctcaaccgcctgccgtccgcctgcgtcggcgacatggtcatggccaccgtcaagaaggggaagcccgacctcaggaagaaggtcatgcccgccgtcatcgtccgccagcgcaagccgtggcgccggaaggacggagtctacatgtacttcgaagataatgctggggttattgtgaacccaaaaggcgagatgaaaggatctgctatcactggacccattggcaaagagtgtgctgacctttggcctaggattgctagcgcagcaaacgccattgtctgaaatcaggatttgggaaaattcagagaaaattcagagttttgtgtgctccttatttaggtgcacctgatgtagttttgtacccaaacatctattgtaatgtacttctgagttatctatttcgg

SEQ ID NO: 1190 - protein, 140 aa, Panicum virgatum
  misc_feature: Ceres CLONE 1760584
  misc_feature: Great-hit functional homolog of the protein sequence given in SEQ ID NO 9582
  misc_feature: Useful for making plants with modulated biomass
  misc_feature: Useful for making plants with modulated heat sensitivity
  misc_feature: The plant is abnormally small.
MSKRGRGGSAGNKFRMSLGLPVAATVNCADNTGAKNLYIISVKGIKGRLNRLPSACVGDMVMATVKKGKPDLRKKVMPAVIVRQRKPWRRKDGVYMYFEDNAGVIVNPKGEMKGSAITGPIGKECADLWPRIASAANAIV

SEQ ID NO: 1191 - DNA, 830 bp, Panicum virgatum
  misc_feature: Ceres CLONE 1760586
  misc_feature: Encodes the peptide sequence at SEQ ID NO. 1192
aatcacagccgcaccggccggccaccagcatctcgctcgtagccatgtcgagctccgccgccgccgccgacggcgccgcgaagaacccggccatggagcccgacacggacgcgccggcgggggagggcctggagctggcgcagttcgcggcggggtgcttctggagcgtggagctgacgtaccagcggctccccggtgtggcgcgcacggaggtgggctactctcagggccaccgcgacgcgcccacgtacgagctcgtgtgcgcccacggcacgggccacgccgaggtggtgcgcctgcactacgaccccgcggcgtgtccctacgccaagctcctcgacgcgttctgggccaagatcgaccccaccacgctcaacaggcagggcaaggacgtcgggacgcagtaccggacggggatctactactacacggcggagcaggagaggctggcgcgggagtcgctggcggagcagcgggggaagtgggagggcgagatcgtcaccgagatcctgccggcgaagcggttctaccccgccgaggagtaccaccagcgctacctcgagaagggcggccagtctgcggccaagggctgcaccgaccccatgcgctgctacggctgacgccgccgccggccatccgtctccgtccgacgaaacggaggctagcaagttgggcgaagccgattatctgccgtccgtgtatgcatgtcactatatatgtcagcgtaaaacaataagcaggaagataccgacaaccgtgccgtgttagtatgtgctacgtcttacgtggaaataaacaccaagtgtttggaaaaaaaaaaaaaaaaaaaa

SEQ ID NO: 1192 - protein, 191 aa, Panicum virgatum
  misc_feature: Ceres CLONE 1760586
  misc_feature (1)..(156): Pfam Name: PMSR Pfam Description: Peptide methionine sulfoxide reductase
  misc_feature (8)..(191): SWISSPROT Homolog: EC 1.8.4.11 Peptide methionine sulfoxide reductase
MSSSAAAADGAAKNPAMEPDTDAPAGEGLELAQFAAGCFWSVELTYQRLPGVARTEVGYSQGHRDAPTYELVCAHGTGHAEVVRLHYDPAACPYAKLLDAFWAKIDPTTLNRQGKDVGTQYRTGIYYYTAEQERLARESLAEQRGKWEGEIVTEILPAKRFYPAEEYHQRYLEKGGQSAAKGCTDPMRCYG

SEQ ID NO: 1193 - DNA, 817 bp, Panicum virgatum
  misc_feature: Ceres CLONE 1760631
  misc_feature: Encodes the peptide sequence at SEQ ID NO. 1194
actcaactcaagcaggcctgcctcttcttctccttagttaatgttctagtaatataagcaagcatacactaccaagccaagccatggcccccaccgtgatggcctcgtcggccacctccgtggctccattccagggcctcaagtccaccgctggcctccccgtcagccgccgcgcccgatgctccggcttcggcaacgtcagcatcggcggaaggatcaggtgcatgcaggtgtggccgacggagaacaacaagaagttcgagaccctgtcgtacctgccgcccctctccacggaggacctcctgaagcaggtcgactacctgatccggaacaactgggtcccctgcctcgagttcagcaaggtcggcttcgtcttccgcgagaacgccacttcccccgggtactacgacggccgctactggaccatgtggaagctgcccatgttcggctgcaccgacgccacccaggtgtacgccgagctcgaggagtgcaagaaggcctaccccgacaactacatccgcatcctcggcttcgacaacgtcaggcaggtgcagtgcgtcatgttcatcgcctacaagcccccggccgccgcctaagcgcagctagctagctcctgcgtgatcgagcaaccatcaagtgtctcctttttgtttttgcttcgatcgggtcaccttgactttctttctttttcatggttgcttctgctgtatccatccatggcatgcatgcatgtgtgagggacatgtcagtgcaagctccggctatatatgatatgtaatgtggatactatctagagcaaaaaaaaaaaaaaaaaaaa

SEQ ID NO: 1194 - protein, 170 aa, Panicum virgatum
  misc_feature: Ceres CLONE 1760631
  misc_feature (1)..(109): Pfam Name: RuBisCO_small Pfam Description: Ribulose bisphosphate carboxylase, small chain
  misc_feature (1)..(167): SWISSPROT Homolog: EC 4.1.1.39 Ribulose bisphosphate carboxylase small chain A, chloroplast precursor
  misc_feature (1)..(167): SWISSPROT Homolog: EC 4.1.1.39 Ribulose bisphosphate carboxylase small chain, chloroplast precursor
MAPTVMASSATSVAPFQGLKSTAGLPVSRRARCSGFGNVSIGGRIRCMQVWPTENNKKFETLSYLPPLSTEDLLKQVDYLIRNNWVPCLEFSKVGFVFRENATSPGYYDGRYWTMWKLPMFGCTDATQVYAELEECKKAYPDNYIRILGFDNVRQVQCVMFIAYKPPAAA

SEQ ID NO: 1195 - DNA, 938 bp, Panicum virgatum
  misc_feature: Ceres CLONE 1760747
  misc_feature: Encodes the peptide sequence at SEQ ID NO. 1196
atcgcaaaaaccactcgagcacaacacaaccggcagaggcactccagagctaaagcgctcgctcgacagccgatccagaacaagatgtgtcagatgaagagggagatgggcgccgagccgtcgggctccccgcgcagctgggcgtcgccctcgccctcgacctcggagcaggagcagcaccggacggtgtggacgtcgccgccgaagcggccggcggggcggaccaagttccgcgagacgcggcaccccgtgttccgcggcgtgcggcgccggggcaaggccgggcggtgggtgtgcgaggtgcgcgtgccgggccgccgcgggtgcaggctctggctcggcaccttcgacgccgccgaggccgccgcgcgcgcgcacgacgccgccatgctcgccatcgccggcccgggcgcgtgcctcaacttcgccgactcggcgtggctgctcgcggtcccggcctcgtacgccagcctcgccgaggtgcgccacgcggtcgccgaggcgatcgaggagttccagcgccgggaggcgctcccgggggaggaggaggaggaggaggcgcgctcggccacgtcgtcgacgacgttctctcccaccagcgtcggagacgagggctccaccgacggggaggcgtcctcgccggccgccgaggactcgccgttcgaactggacctgttcggtgacttgagctcggacttgtactacgcgagcttggcgcaggcgatgctcatggagccaccgtccacagtcgcggcgttctgcgacgagggcatggccgatgtgcctctctggagctattaggacagacgccgctgtgcttcaattttgcgccttttctttctcttggattcggaagccaaattttggtcctgtaactgttactacttttggtaatgttgagacagagcaacttgggacaaaaaaaaaaaaaaaaaaaa

SEQ ID NO: 1196 - protein, 238 aa, Panicum virgatum
  misc_feature: Ceres CLONE 1760747
  misc_feature (1)..(67): Pfam Name: AP2 Pfam Description: AP2 domain
MCQMKREMGAEPSGSPRSWASPSPSTSEQEQHRTVWTSPPKRPAGRTKFRETRHPVFRGVRRRGKAGRWVCEVRVPGRRGCRLWLGTFDAAEAAARAHDAAMLAIAGPGACLNFADSAWLLAVPASYASLAEVRHAVAEAIEEFQRREALPGEEEEEEARSATSSTTFSPTSVGDEGSTDGEASSPAAEDSPFELDLFGDLSSDLYYASLAQAMLMEPPSTVAAFCDEGMADVPLWSY

SEQ ID NO: 1197 - DNA, 957 bp, Panicum virgatum
  misc_feature: Ceres CLONE 1760752
  misc_feature: Encodes the peptide sequence at SEQ ID NO. 1198
accggcacacttcaattccactcaaaactttcctcctcctcctcatcttcgtcttcctctctctagctgctgtgggcatactctctctctctctttctgccaagaacaccggccggctagcagcttgtgtttgttgttcccatggagatcgacggcgacaacctcagcgccaccgagctccggctcggcctgccggggaccagcagcggcgacgaccggccgaggaggccggcgccctccgtcggcgccaagcgcgcgctcgaggacaccaggagcgaggcgtccggcaccacggccgccggcgacgaccacgacgacgccacgcctgctgccaaagcgcaagtggtggggtggccgccggtgagggcgtacaggaagaacaccttccaggcggcggcgaagaaggccgagcagccgggagggctgtacgtgaaggtgagcatggacggggcgccgtacctcaggaaggtggacctccggatgtacaaggggtaccgggagctcagggaggcgctggacgccctcttcaccaagtccttctccgccgccgccgccgccgccgccggagcggagggcggcgacggccagcacgccctcgcctacgaggacaaggacggcgacctcatgctcgtcggagacgtgccctgggacatgttcatctcttcgtgcaagaagctcaggataataaagggttgtgaggccaggtgattgccgatacacaggcagcggctgcagactcatgggggatgaatcgaggagcacagatcgtgcaaaggagctgtgtggcttgggctctccagtgctgtacaaagagatggttgtttctgaaaccaagaaggagaaggatctatgaattgtgtatatagtcttaggctcttagctagccgccttgttttttgagttgtgttttgtatgagcgaaggctgtaaaaaaaatcaaaaaaaaaaaaaaaaaaaa

SEQ ID NO: 1198 - protein, 188 aa, Panicum virgatum
  misc_feature: Ceres CLONE 1760752
  misc_feature (15)..(194): Pfam Name: AUX_IAA Pfam Description: AUX/IAA family
  misc_feature: The sequence is a functional homolog of  SEQ ID NO 648 in the  11/479,226 US patent application
  misc_feature: Useful for making plants with modulated growth and phenotype characteristics
MEIDGDNLSATELRLGLPGTSSGDDRPRRPAPSVGAKRALEDTRSEASGTTAAGDDHDDATPAAKAQVVGWPPVRAYRKNTFQAAAKKAEQPGGLYVKVSMDGAPYLRKVDLRMYKGYRELREALDALFTKSFSAAAAAAAGAEGGDGQHALAYEDKDGDLMLVGDVPWDMFISSCKKLRIIKGCEAR

SEQ ID NO: 1199 - DNA, 973 bp, Panicum virgatum
  misc_feature: Ceres CLONE 1760764
  misc_feature: Encodes the peptide sequence at SEQ ID NO. 1200
gcgagcaccaccaccagcgcggacgtcgtggcgcgcatgtgggcggcctctacatcccgcgtcccacctccaccgccttcgtcgccgtcggcctagatccagcacgctcccgagcttccattccccccgaggccgccaccttccggccgacaaagcgtcggctgccgcgagttcctgcttgcggttgggagagagaggcgccgcgatggctgcggaccgcgggctcctgctgctgctcctctcggccgccgcccttgccggggtggcctccgccgctggccctttcttgtccgatggcgtgttccaggcgagcgccggatctacgggcaggagcttgctgcaggccaagaagaattgcgccatgaactttgagtttcaaaactacacaatcatcacaagcaagtgcaaagggccaaaatttcctgccgaccaatgctgtggggccttcaaggaattcgcatgcccgtttcgcgattacatcaatgatgacagcagcgactgttcatcagcaatgttcagctacatcaacctctatggcaagtaccccccaggtctctttgccaacatttgccgtgagggcaagaaggggcttgaatgcacagatgcccagagcgccgtcactgccaatggcagccaacgaacccgaagcagctcgcttgttttggttacccttgtgtgtggattgatagcattgttgttctattgaatgatgatgccttcaatttcgccaaagttggtgtttttataactgatgaggctcaagttcattctctgctccttgtgggtgggtctcagagtttcttccttttgtgtaaagtctttctcaatgtaatttatgacagattgcatattctatggtcttccacgtgtcgatgccgaattacaacgttgagactcaatccactgtaccattgtattgtgaccgttacattaaattaaattaaattcataccaaaaaaaaaaaaaaaaaaaa

SEQ ID NO: 1200 - protein, 166 aa, Panicum virgatum
  misc_feature: Ceres CLONE 1760764
  misc_feature: Great-hit functional homolog of the protein sequence encoded by LOCUS At5g56170
  misc_feature: Useful for making plants with altered cell wall content and/or composition
MAADRGLLLLLLSAAALAGVASAAGPFLSDGVFQASAGSTGRSLLQAKKNCAMNFEFQNYTIITSKCKGPKFPADQCCGAFKEFACPFRDYINDDSSDCSSAMFSYINLYGKYPPGLFANICREGKKGLECTDAQSAVTANGSQRTRSSSLVLVTLVCGLIALLFY

SEQ ID NO: 1201 - DNA, 1068 bp, Panicum virgatum
  misc_feature: Ceres CLONE 1760961
  misc_feature: Encodes the peptide sequence at SEQ ID NO. 1202
aagaccagacaaaaacggcacactgcgcgctcccaccagctagagcgagcgcagtggcggcttgtggtaatggcgacggccaggctcgtcctcctcgcggccctcgtggccgccaccgcatgggagctgccgccgagcctccgggtggcggcggcgccggtggcgatccacgcgctgcgcccgctggtgggctccgccggggacctgggccggcgcggcggcgtgccgtgcgacagctggcggctggccgtggaggcgaataacaagcgcgactggaagacggtgccggccgactgcgagggctacgtcggccactacatgctcggcgggcactaccgccaggactcccgcgtcgtcgtcgacgaggccatcgcgtacgccgaggggctcaagctcggcggcggcggcagggaggtgtgggtgttcgacatcgacgagacgtccctctccaacctcccctactacgccacccatggcttcggcactaagccgtacaacgcaacgagcttcaacgagtacgtgctggagggcagcgcgccggcgctgccggagacgctgcggctcttcaggaagctcatcgccctcggcatcaagccggtgttcctgacgggccgcaccgaggaccagcgggccgtcaccgtggccaacctccgccgccagggctactccgggtgggagaagctcctgctcaagcccctcgggtccaaggccaccgccgtcgcctacaagtccggcgagcgccggaagctggaggacgccgggttcgtcgtcgtcggcaacatcggggaccagtggagcgacatcctcggcgctccggagggggcgcgcaccttcaagctgcccgacccgctgtactacatcggctgatgatcaagcggtgcggcggccgcctcgctccgtaccatccgacggcggctctctcccttgatttagttaaccgctccgctcatgttgttttttaattaatcaaggttgatttttctgatttaagtggaaatatgactcgctggccgagagctgtcaatcaataaatcaatggttgtttattaaaaaaaaaaaaaaaaaaaa

SEQ ID NO: 1202 - protein, 265 aa, Panicum virgatum
  misc_feature: Ceres CLONE 1760961
  misc_feature (1)..(226): Pfam Name: Acid_phosphat_B Pfam Description: HAD superfamily, subfamily IIIB (Acid phosphatase)
MATARLVLLAALVAATAWELPPSLRVAAAPVAIHALRPLVGSAGDLGRRGGVPCDSWRLAVEANNKRDWKTVPADCEGYVGHYMLGGHYRQDSRVVVDEAIAYAEGLKLGGGGREVWVFDIDETSLSNLPYYATHGFGTKPYNATSFNEYVLEGSAPALPETLRLFRKLIALGIKPVFLTGRTEDQRAVTVANLRRQGYSGWEKLLLKPLGSKATAVAYKSGERRKLEDAGFVVVGNIGDQWSDILGAPEGARTFKLPDPLYYIG

SEQ ID NO: 1203 - DNA, 711 bp, Panicum virgatum
  misc_feature: Ceres CLONE 1760984
  misc_feature: Encodes the peptide sequence at SEQ ID NO. 1204
gaccagtctgtaccaccgaaccggaggacgtaggagggaggaggccaggagctgccagccaaacagaaacaggattgcgagaagatgccgccgccgccgccggtcaatccgcagcggctgtcgccggcggagtcccgggagcggacgctgcacttcttccacggcctgggcgtagacgtgccgctcccggcctcggccgagcgcgccgacgcctacgccgcgctcgtccgcaccatcgtctcctccgccaccgtctcctcgtcgcgcgtctcctgcaccctcgccatctcccccggcgtcgcgaaccagtacaacacgctccacggtggcgcggtggcggccgtggcggaggccgtcgggatggcgtgcgcgcgggccgcggcgggcgacaaggagatgttcctcggcgagctcagcacggcctacctcgccgccgcgcgagtcaactctgaagtagatgttgaagcgcagatactgaggaagggcaggtcggtcgtcgttaccactatcgagttcagactgaaggacaccaagaagctctgctacacatctcgggccaccttttacataatgcccgtggcaagcctatgaacaatctagtttacatgtgcaaattgttgtatttacagtaccagtgttgtattttgtataattaaatcggagaacatatgcatgtcgtattaatgatgaaataaaaccatatcaattcat

SEQ ID NO: 1204 - protein, 168 aa, Panicum virgatum
  misc_feature: Ceres CLONE 1760984
  misc_feature (1)..(78): Pfam Name: 4HBT Pfam Description: Thioesterase superfamily
MPPPPPVNPQRLSPAESRERTLHFFHGLGVDVPLPASAERADAYAALVRTIVSSATVSSSRVSCTLAISPGVANQYNTLHGGAVAAVAEAVGMACARAAAGDKEMFLGELSTAYLAAARVNSEVDVEAQILRKGRSVVVTTIEFRLKDTKKLCYTSRATFYIMPVASL

SEQ ID NO: 1205 - DNA, 845 bp, Panicum virgatum
  misc_feature: Ceres CLONE 1760995
  misc_feature: Encodes the peptide sequence at SEQ ID NO. 1206
aaaaaaaaaaaaaaagcagcagctagcatcacaagtaatccggccacacacaatcatcatccgatcctattgtcactctcgcacttgaaggttaagttccatccatggcggaggagaagcaccaccaccacctcttccaccacaagagggacgaggaggagcagcccgccggcgggtacggcggcgaggccgccaccgccgagtacacggagaccaccgtgacggaggtggtgtccaccggcgaggacgagtacgagaagtacaagaaggaggagaaggagcacaagcacaagcagcacctcggcgaggcaggcgccatcgccaccggcgccttcgcgctgtacgagaagcacgaggcgaagaaggaccccgagcacgcgcaccggcacaagatcgaggaggagatcgcggcggcggcggccgtgggctccggcggctacgccttccacgagcaccacgagaagaagaaggaccacaaggacgccgaggaagccggcggcgagaagaagcaccaccacctcttcggctgatgtgtccagtcgtcgactcagtacatacgtgtgcggcggccccaccacatgtatatgatgatctgtctatatacgtatatatgctgcgcatcttaattaatttctccgtgtgctactgctacgtacgcgtgtactgtaagagtgagaggctgagaggtggccccgcgcgccagctgtgtgtgtgtgtgtttgctttcctgggtagtacatatacatgtatacgtgttgaataaggggccccggctccgtgtatgtatgtgtgtatatgttgtatctacgagtggaaaatgtgtgcaaaaaaaaaaaaaaaaaaaa

SEQ ID NO: 1206 - protein, 141 aa, Panicum virgatum
  misc_feature: Ceres CLONE 1760995
  misc_feature (1)..(54): Pfam Name: ABA_WDS Pfam Description: ABA/WDS induced protein
MAEEKHHHHLFHHKRDEEEQPAGGYGGEAATAEYTETTVTEVVSTGEDEYEKYKKEEKEHKHKQHLGEAGAIATGAFALYEKHEAKKDPEHAHRHKIEEEIAAAAAVGSGGYAFHEHHEKKKDHKDAEEAGGEKKHHHLFG

SEQ ID NO: 1207 - DNA, 901 bp, Panicum virgatum
  misc_feature: Ceres CLONE 1761023
  misc_feature: Encodes the peptide sequence at SEQ ID NO. 1208
aagccacattggaaggcctgatagctttagtaggtgatagctactacaactacgaccgccaccatacactctcacaccaaaatatagcatggcaaacgactccttgacgagggggcatataatcggggatgtcttagacccgtttactagttcggtgcctttaactgtcatgtatgatggcagacctgtgtttgatgggatggagtttcgggcgtcggcggtgtcggtgaaacctagagttgagattggtggtgatgattttcgagtggcctataccctagttatggtggatcctgatgctcctaatcccagcaaccctaccctgcgagaatacttgcattggatggtgactgacatcccagcgtcaacagatgatagctttggccgagaagttataacatatgagagcccgaaccccaccatgggcatacaccgtatcgtcttggtgttataccaacaactggggcggggcacggtgtttgcaccgcaagtgcgtcaaaacttcaacttgcgcaattttgcacaccgtttcaacctcggcaaacctgtggctgcgatgtactttaactgtcagcgacaaacaggcacaggtgggagaaggttcacctgagtattttactcctcatgttcaaagttgaaggcaagcttgtctactggttatatatgcatgcgtgcttacctacatatggccgcattgtcataaagtatctggcacaaaatctagaaataagatgtatctattgtgcatgtaggctagtgtgcctccatgagggtaatgtctacttttcaataatctcatgataaaagaggttatactaggtgtactcatgtgacattttttgtcacatctcttgctaataaacatatatatggttctccttaaaaaaaaaaaaaaaaaaaa

SEQ ID NO: 1208 - protein, 173 aa, Panicum virgatum
  misc_feature: Ceres CLONE 1761023
  misc_feature: Great-hit functional homolog of the protein sequence given in SEQ ID NO 9507
  misc_feature: Useful for making plants with modulated flowering time
MANDSLTRGHIIGDVLDPFTSSVPLTVMYDGRPVFDGMEFRASAVSVKPRVEIGGDDFRVAYTLVMVDPDAPNPSNPTLREYLHWMVTDIPASTDDSFGREVITYESPNPTMGIHRIVLVLYQQLGRGTVFAPQVRQNFNLRNFAHRFNLGKPVAAMYFNCQRQTGTGGRRFT

SEQ ID NO: 1209 - DNA, 770 bp, Panicum virgatum
  misc_feature: Ceres CLONE 1761041
  misc_feature: Encodes the peptide sequence at SEQ ID NO. 1210
aagagttttttgggttgctcttccgcttaattctcacgcagttggagttcggcgccctccagtctcctgacccgtagcgcgagggaggaagaggcgagtagaagatgcagatcttcgtgaagaccctgacggggaagaccatcaccctcgaggtggagagcagcgacaccatcgacaacgtcaaagccaaaatccaggacaaggaagggatccctccggatcaacagcgcctgatatttgctggcaagcagctggaggatggacgcacactggctgactacaacattcagaaggagtcaactcttcacttggtcctcaggctcaggggtggcactatgatcaaggtcaagactctcactgggaaagagattgagatcgacattgaacccactgacacgatcgacaggatcaaggagcgcgttgaagagaaagaaggcattcctcccgtgcagcagaggctcatctatgctggtaagcagcttgctgatgacaagaccgcaaaggactacaacatcgaaggtggctctgtcctccatcttgtgcttgctctgaggggcggttactagagttcatgaactagtcagataaacggatgagccagttaaggtccggccgatttgtgcagacctggtggtgtggaatttacaaagagataataacataccagctttgcgcgtttgcccaatggaaggggttgtcttccatgttattaactgatactacatgatttaacgtgattgtttcaggttcaaaaaaaaaaaaaaaaaaaa

SEQ ID NO: 1210 - protein, 153 aa, Panicum virgatum
  misc_feature: Ceres CLONE 1761041
  misc_feature: Great-hit functional homolog of the protein sequence given in SEQ ID NO 9399
  misc_feature: Great-hit functional homolog of the protein sequence given in SEQ ID NO 9433
  misc_feature: Great-hit functional homolog of the protein sequence given in SEQ ID NO 9688
  misc_feature: Useful for making plants with modulated cold sensitivity
  misc_feature: Useful for making plants with modulated flowering time
  misc_feature: Useful for making plants with modulated nitrogen use efficiency
  misc_feature: The plant flowers significantly late compared to wild-type.
MQIFVKTLTGKTITLEVESSDTIDNVKAKIQDKEGIPPDQQRLIFAGKQLEDGRTLADYNIQKESTLHLVLRLRGGTMIKVKTLTGKEIEIDIEPTDTIDRIKERVEEKEGIPPVQQRLIYAGKQLADDKTAKDYNIEGGSVLHLVLALRGGY

SEQ ID NO: 1211 - DNA, 911 bp, Panicum virgatum
  misc_feature: Ceres CLONE 1761076
  misc_feature: Encodes the peptide sequence at SEQ ID NO. 1212
cccgcagctcgtgcaaaagcatcatcatcatcagctcgctagcagcggcagcaatggcgctcgccaagctctccgcgctgctggtcctcgccgtgctcgcgctctcctcctcgccgctcgccctcgcgtgggagaaagcgggaacggagtgcggatcgtgccagaaaggcacgccgcccgcgtcccgcgggctccccttgccccccgtcaccgtgccgtctgtccccctgccatccgtccctctgccgtcggtgcccctgccgccagtcgccgtgccgtcggtgcccctacccccgttgccggacctccccgtccccatcccgccgatcatcggtgggagcccgccgaagacgcccggcggccggaaggcgtgcccgccgcctccggcgcccccgaccccgacgcccccgccgtcctcggacaagtgccccatcgacgcgctgaagctcggcgcgtgcgtggacgtcctcggcaacgaggtgcacatcggcgacgccaacgtcaagtgctgcccgctcgtgaagggcgtcgccgggctctcggcggcggcgtgcctgtgcacctccctcaaggccaaggtgctggacctctccgtctacgtgcccatcgcgctcgaagtgctcctcaactgcggctgcgccgtcccgcccggctacaaatgcgcttaaatataaaccaccccatgcacagcaaaggtctccttttcttttccccctcgactcgaccacgaagtttgaaagcaggctatttatttgatttgatttgctatatcttctctcttgttgcatgtttgtatatgcatctagtgtcacctcaattgtcatcgatctgtaatttatgtatcttgtaacaaactatatttgttccgaattcaaatcatgtttgcactacaaaaaaaaaaaaaaaaaaaa

SEQ ID NO: 1212 - protein, 204 aa, Panicum virgatum
  misc_feature: Ceres CLONE 1761076
  misc_feature: Great-hit functional homolog of the protein sequence given in SEQ ID NO 9481
  misc_feature (1)..(79): Pfam Name: Tryp_alpha_amyl Pfam Description: Protease inhibitor/seed storage/LTP family
  misc_feature: Useful for making plants with modulated heat sensitivity
MALAKLSALLVLAVLALSSSPLALAWEKAGTECGSCQKGTPPASRGLPLPPVTVPSVPLPSVPLPSVPLPPVAVPSVPLPPLPDLPVPIPPIIGGSPPKTPGGRKACPPPPAPPTPTPPPSSDKCPIDALKLGACVDVLGNEVHIGDANVKCCPLVKGVAGLSAAACLCTSLKAKVLDLSVYVPIALEVLLNCGCAVPPGYKCA

SEQ ID NO: 1213 - DNA, 966 bp, Panicum virgatum
  misc_feature: Ceres CLONE 1761088
  misc_feature: Encodes the peptide sequence at SEQ ID NO. 1214
cgatccctgatttcatttcacagcttgagcaagagatcaagcaaatcaaaaggaagcatggcagcgggcttgcaagtgtttggccagccagcatctactgatgttgccagggttctgacttgcctttttgagaagaaattggaatttgagcttgtccgcattgatacatttaagacacatcacaagcttcctgaattcattaggctgcgggatccgaatgggcaggtgaccttcaaacatggtgacaaaactctcgttgattcaagagatatatgccggtacgtctgtaaccagtttccaaatgatggaaacaagaccctttatggatctggggctctagaacgggcatcaatagaacagtggcttcaggcagaagctcagaactttggccctcccagctctgcactagtctttcagctggcattcgttcctcatctcagccatctaggtgttcgtcaggaccatgctgttattgctgaaaatgaggataagctgaagcagatcctcgatgtttatgatgaaatactctcgaagaatgaatacctggctggcgatgaattcaccttggccgacgtttctcaccttccaaactcgcattatatcgtaaatactgagagaggaaggaagctcttcactaacaagaagaatgtggcaaagtggtatgacaaaatctcgaagcgtgagacatgggcgcaggtcgtcaagatgcagaaggagcatccaggtgcattcgagtgatggcttaatttggcgagcagtgaaggtatcttgaatggcttcattatttgtgtcagtctggcttctacagtgcagtgttcccatcagtgttttcgtgtcaaccaaaataatgtgaagccctattgtgatgtatgaatcttttgttttgaaacacgtttacctccatgtgtcgactgatctctgattaataaaattgcccgtttggcccaaaaaaaaaaaaaaaaaaaa

SEQ ID NO: 1214 - protein, 226 aa, Panicum virgatum
  misc_feature: Ceres CLONE 1761088
  misc_feature (1)..(76): Pfam Name: GST_N Pfam Description: Glutathione S-transferase, N-terminal domain
  misc_feature (1)..(100): Pfam Name: GST_C Pfam Description: Glutathione S-transferase, C-terminal domain
MAAGLQVFGQPASTDVARVLTCLFEKKLEFELVRIDTFKTHHKLPEFIRLRDPNGQVTFKHGDKTLVDSRDICRYVCNQFPNDGNKTLYGSGALERASIEQWLQAEAQNFGPPSSALVFQLAFVPHLSHLGVRQDHAVIAENEDKLKQILDVYDEILSKNEYLAGDEFTLADVSHLPNSHYIVNTERGRKLFTNKKNVAKWYDKISKRETWAQVVKMQKEHPGAFE

SEQ ID NO: 1215 - DNA, 779 bp, Panicum virgatum
  misc_feature: Ceres CLONE 1761101
  misc_feature: Encodes the peptide sequence at SEQ ID NO. 1216
gatgcacagacgagagcgagccaagtgtactactcccagtgaagccacactagctagccacaccagcagcttgacaagctagctagctagctaggccgcagccatgtcggaggagaagcaccaccacttcttccaccagcacaagaaggacgaagaggagcagcccgccggcgggtactcggaggccgtggccgccggcgagagcgagtacgagaggtacaagaaggaggagaaggagcacaagcacaagcagcacctcggcgaggccggcgccatcgccgccggcgccttcgcgctctacgagaagcacgaggcgaagaaggacccggagcacgcgcaccggcacaagatcacggaggagatcgccgccacggcggccgtcggcgccggcggctacgccttccacgagcaccacgagaagaagaaggaccacaaggacgccgaggatgccagcggcgagaagaagcaccaccacctcttcggctgacccgccggcaagcgagctccggcccggccgccgcgcacccacctgcttgctccaataattgtggccatgatttcgcaataagtcccttccggacccttagcttgcttgcttgtgtgagactgagaggtggggcccgcgcgtcgaggtgtgttccggcctgtacgtgcttgatttttctttgcgtccgtaattgcgttgaataaccgggagcgatgcacgtgtggctcccagtctgtctgtctgtggttgagtgtctgtatcctgatgatcaactcgtggaagtttttacacc

SEQ ID NO: 1216 - protein, 127 aa, Panicum virgatum
  misc_feature: Ceres CLONE 1761101
  misc_feature (1)..(54): Pfam Name: ABA_WDS Pfam Description: ABA/WDS induced protein
MSEEKHHHFFHQHKKDEEEQPAGGYSEAVAAGESEYERYKKEEKEHKHKQHLGEAGAIAAGAFALYEKHEAKKDPEHAHRHKITEEIAATAAVGAGGYAFHEHHEKKKDHKDAEDASGEKKHHHLFG

SEQ ID NO: 1217 - DNA, 985 bp, Panicum virgatum
  misc_feature: Ceres CLONE 1761125
  misc_feature: Encodes the peptide sequence at SEQ ID NO. 1218
ggaccagaccacaccacaccacaccgcgtccacatcctcccgcgcttctccgctcagcccgcgcgtttccgctgaggagggatagccgcgcggcgcgtcgaggggtttgtctttgatcgggtagctgaggctgagcgggcggggcaggatgatgcgcgacacggcggccgtggccgtggcggcgccgcggtacaggggcgtgcggaagcggccgtggggccggttcgcggcggagatccgcgacccggcgaagcgcgcgcgcgtctggctcggcaccttcgactccgccgaggccgcggcgcgcgcctacgacgtcgccgcgcggaccctgcgcggcccgctcgccaggaccaacttcccctgcgcctcctcccgcctcccgctgccctcccgccaccaaggcggctgtggcggcggcctcgtcgcgccgccgcccgccgcgccgacgtgcagctccagctccaccgtcgagtcctccagcggaccccgaggggcgcccagggctgctgcggcggcggcgcctcgaattcggaggcggtcggtgaaaaagccgcggccggcagcgcccgacatcgactgccacagcgactgcgcctcgtcggcctccgtcgtggacgacggcgacgacgcctccacggtccggtcgcgcgcgccgttcgacctcaacgtcccggctccggtggacggtgaccacgccctcgacctctgcacggagctgcggctctgagcaatatgatcctcgaacaacaacaacagcaaaacattgaaggcgatttttccccggtcttcttttcctgactaaattctgatatgatcaatatgctcgagagttctcgttttctttaacgcctcttgtatttggatctgctaccatcttctctgcccattctatttgtacaccagataacatgtaagatgttcacgaattaacacatatcttttcttaaaaaaatgaattaacacggaaaaaaaaaaaaaaaaaaaa

SEQ ID NO: 1218 - protein, 192 aa, Panicum virgatum
  misc_feature: Ceres CLONE 1761125
  misc_feature: Great-hit functional homolog of the protein sequence given in SEQ ID NO 9191
  misc_feature: Great-hit functional homolog of the protein sequence given in SEQ ID NO 9250
  misc_feature (1)..(64): Pfam Name: AP2 Pfam Description: AP2 domain
  misc_feature: Useful for biocontainment applications
  misc_feature: Useful for making plants with altered Lignin content
  misc_feature: Useful for making plants with altered cell wall content and/or composition
  misc_feature: Useful for making plants with modulated cold sensitivity
  misc_feature: The plant produces a reduced number of seeds.
MMRDTAAVAVAAPRYRGVRKRPWGRFAAEIRDPAKRARVWLGTFDSAEAAARAYDVAARTLRGPLARTNFPCASSRLPLPSRHQGGCGGGLVAPPPAAPTCSSSSTVESSSGPRGAPRAAAAAAPRIRRRSVKKPRPAAPDIDCHSDCASSASVVDDGDDASTVRSRAPFDLNVPAPVDGDHALDLCTELRL

SEQ ID NO: 1219 - DNA, 716 bp, Panicum virgatum
  misc_feature: Ceres CLONE 1761183
  misc_feature: Encodes the peptide sequence at SEQ ID NO. 1220
gtgctctctcagaggtgggttggcttctcctccccctcttaccaagtcctcggctctagggttttagtgggaagggagatggcggccgcggatgtggagtaccgctgcttcgtcggcggcctcgcctgggccaccgacaacgcgtccctccagcaggccttcgcctcctacggtgacgtcctcgactccaaggtcatcaccgaccgtgagacggggaggtcccgcgggttcggcttcgtcaccttctcctccgagcagtcgatgctggacgccatcgaagccatgaacggcaaggatctcgacggccgcaacatcaccgtcaaccaggctcagtcccgcggcggcggtggcggcggcggctacggcggcggtggtggcggtggtggctacggcggtggtcgccgtgagggcggctacggcggaggcggtggcggcggtcgccgcgagggcggctacggtggtggtggctacggcaaccgcggtgactccggtggtaactggaggaactgatggggtggccctcccgtgctggcagccaagttatcctatatatctattagtgttcgtgtcactgtttgatccgagttacccctgagttttgtccgtgtgttaccgttcgattaggtgttggttcccatgtttaccgttcccgagttgtttccgcaatgaaatgagaagaaaagagtgtccgcaattaaaaaaaaaaaaaaaaaaaa

SEQ ID NO: 1220 - protein, 143 aa, Panicum virgatum
  misc_feature: Ceres CLONE 1761183
  misc_feature: Great-hit functional homolog of the protein sequence given in SEQ ID NO 9185
  misc_feature: Great-hit functional homolog of the protein sequence given in SEQ ID NO 9423
  misc_feature: Great-hit functional homolog of the protein sequence given in SEQ ID NO 9703
  misc_feature: Great-hit functional homolog of the protein sequence given in SEQ ID NO 9716
  misc_feature: Useful for making plants with altered Lignin content
  misc_feature: Useful for making plants with altered alkaloid content
  misc_feature: Useful for making plants with modulated flowering time
  misc_feature: Useful for making plants with modulated nitrogen use efficiency
  misc_feature: The plant flowers significantly late compared to wild-type.
MAAADVEYRCFVGGLAWATDNASLQQAFASYGDVLDSKVITDRETGRSRGFGFVTFSSEQSMLDAIEAMNGKDLDGRNITVNQAQSRGGGGGGGYGGGGGGGGYGGGRREGGYGGGGGGGRREGGYGGGGYGNRGDSGGNWRN

SEQ ID NO: 1221 - DNA, 1052 bp, Panicum virgatum
  misc_feature: Ceres CLONE 1761211
  misc_feature: Encodes the peptide sequence at SEQ ID NO. 1222
gaggaaggaggagacggcagccaccgagcgaaaactggaaggggaagagctccactagcgcgtgcgttgcgaggagatgtggcggaggcggcgagctctccttctccgatccccgccgtcttcctcctccacagccgcctcttcttgccagcttcgccgccgccacctcctccccagcgaggaacctcttgctgtcaatcgtcttgcacggctcttcacgtcccaagctggaagtgattgtggcaattcccagaagccgttcattgctttcgtcttagggggtcctggtagtggcaaaggaacacaatgcaccaaaattgcttcggatttcggatttgcccatttgagcgctggtgaccttctgcgccatgaaatagcatctggcagtgagaaaggggagttgatcctggacaccattaaggaagggaggatcgtcccatcagagataaccgtggaactcataaggaaagctatggaaacgagcaatgccaataaggttcttattgatggcttcccaaggtgtgaggaaaacagaatcgcttttgaaagaattgttggaagagaaccggacgttgtggttttctttgactgtcctgaggatgagatggtaaaacgccttctaggccgtaaccaggggcgggttgatgataacattgagacaatcaagacgcgtctaaaagtgtttgagagtttgaatattcctgttattgactactattcttctaggggaaaggttcgcaagataaatgccacgggcactgcagatgaaatttttgatgcagtccacaagctcttttcgtccttaaggttctgatgaggatcttccaaggaatcccgggagtttgcttagcaattatctgttatttatttttcttaaagccagtgctcactttgtgccgtctaaatcttttgtgcagtaattgtatatacatgctatgccttcacgaaataatacccagggaaacacatataactttgtaacacatctaacctgaagctcgtcctgcatggcaggcattatttgttacctttaaaaaaaaaaaaaaaaaaaa

SEQ ID NO: 1222 - protein, 245 aa, Panicum virgatum
  misc_feature: Ceres CLONE 1761211
  misc_feature (1)..(151): Pfam Name: ADK Pfam Description: Adenylate kinase
  misc_feature (47)..(243): SWISSPROT Homolog: EC 2.7.4.3 Adenylate kinase
  misc_feature (60)..(245): SWISSPROT Homolog: EC 2.7.4.14 Cytidylate kinase
MWRRRRALLLRSPPSSSSTAASSCQLRRRHLLPSEEPLAVNRLARLFTSQAGSDCGNSQKPFIAFVLGGPGSGKGTQCTKIASDFGFAHLSAGDLLRHEIASGSEKGELILDTIKEGRIVPSEITVELIRKAMETSNANKVLIDGFPRCEENRIAFERIVGREPDVVVFFDCPEDEMVKRLLGRNQGRVDDNIETIKTRLKVFESLNIPVIDYYSSRGKVRKINATGTADEIFDAVHKLFSSLRF

SEQ ID NO: 1223 - DNA, 905 bp, Panicum virgatum
  misc_feature: Ceres CLONE 1761216
  misc_feature: Encodes the peptide sequence at SEQ ID NO. 1224
ctctctctccgcctcccccattcctcttcccctgcgatccgaggccgcacccgcagccgcagcaagtcactgaatctcaatccggagaagccatcacctgatcaggcgaggcctcgcgatctcgcgcaggagcggagatggggctcacgttcacgaagctgttcagccgcctcttcgccaagaaggagatgaggatcctcatggttggtctcgacgcggctggtaagaccaccatcctctacaagctcaagctcggcgagatcgtcaccaccatccccaccataggatttaatgttgaaactgttgagtacaagaacattagcttcactgtttgggatgttggtggtcaggacaagatccgtcccctgtggaggcactacttccagaacacccagggcctcatttttgttgtggacagcaacgacagagagcgtgttgttgaggccagagatgagctccatcgtatgctgaatgaggacgagctccgtgatgctgtgcttctggtgtttgcaaacaaacaagatcttcctaatgccatgaacgctgctgaaatcaccgacaagcttggcctgcactccctgcgccagcggcactggtacatccagagcacatgtgctacctctggtgagggtttgtatgaggggcttgattggctttccaacaacattgccaacaaggcttgaggcatcttggcagggctccaatgaatgaaaatactttggatgttgggagcacatattgcctttaccatactgctatgcaccatatagttgtgactgagataatgtgggggtgttttggggaggataaggctcctttgtcaaaggagctagttatcagatgttttcgtgggtattgttaattgtccactcttctattttggtcaaaaaaaaaaaaaaaaaaaa

SEQ ID NO: 1224 - protein, 181 aa, Panicum virgatum
  misc_feature: Ceres CLONE 1761216
  misc_feature: Great-hit functional homolog of the protein sequence given in SEQ ID NO 9285
  misc_feature (1)..(174): Pfam Name: Arf Pfam Description: ADP-ribosylation factor family
  misc_feature: Useful for making plants with altered Lignin content
  misc_feature: Useful for making plants with altered alkaloid content
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCATSGEGLYEGLDWLSNNIANKA

SEQ ID NO: 1225 - DNA, 842 bp, Panicum virgatum
  misc_feature: Ceres CLONE 1761235
  misc_feature: Encodes the peptide sequence at SEQ ID NO. 1226
acgctttgcttgtttccgccgctcctccccccgtcgtgacctcgccgccgggcgagatggggttcgtcggcgacacgctgcagtcgatccgatcgatgcaggtccgccacgtgctctcgcagatcatcagcctcggcatgattgttacctcagcgttgatcatatggaagggattgatagttgtgacagggagcgagtccccagtggtagtggttctttctggtagcatggagcctggatttaagaggggtgatatcctgtttttgcacatgagcaaagaccctatccgcacaggagaaatagttgtttttaacatcgatggtcgtgaaattccaattgtgcaccgtgtgattaaggtccacgaacgtcaggacactgcagaagttgacatcctcacaaaaggtgacaataattttggggatgaccgacttttatatgcccacggtcagctttggctccagcaacatcacatcatgggacgtgctgtaggctttcttccatatgtcggctgggttactattgtcatgaccgagaagccaattattaagtacctgctgatgggtgcactgggcttgctggtcataacatcgaaggattaaagatgtcaacctcatcatataactttttcttatggtgtgagcagtgaccctatgatgccattctgtcccaccacatcaaatggaaattttttaacttttatgtattttgagcatgacattaatctagtagtcagtttctcggacaatgtctatcttttgatactttatagttcatgagttgaatccgtaattgcaattgataaggattacttctcatttctggaaaaaaaaaaaaaaaaaaaa

SEQ ID NO: 1226 - protein, 180 aa, Panicum virgatum
  misc_feature: Ceres CLONE 1761235
  misc_feature (1)..(79): Pfam Name: Peptidase_S24 Pfam Description: Peptidase S24-like
MGFVGDTLQSIRSMQVRHVLSQIISLGMIVTSALIIWKGLIVVTGSESPVVVVLSGSMEPGFKRGDILFLHMSKDPIRTGEIVVFNIDGREIPIVHRVIKVHERQDTAEVDILTKGDNNFGDDRLLYAHGQLWLQQHHIMGRAVGFLPYVGWVTIVMTEKPIIKYLLMGALGLLVITSKD

SEQ ID NO: 1227 - DNA, 834 bp, Panicum virgatum
  misc_feature: Ceres CLONE 1761269
  misc_feature: Encodes the peptide sequence at SEQ ID NO. 1228
aatccatcacaaccgacctccgatccacttctgctcaccagacactgctaagctagctagctgctttacacttcactcactagtcactagcagcttgatcattcgacgatcagtgagtgttatcatatatcagtcgtagctgcaatattatatatagaattttatatatggctcgcctctccgccgttgtcgccgtcgtcctggtggctgcgctggtggcggccgagaccgcttcggctgcggtgagctgcagccaggtgacgtcggccgtggcgccgtgcctcgggtacgccatgggcagctcggcgtcgccctcgccggcgtgctgcaacggggtgaggtcgctcaacagccgggcgtcgtcgacggcggacaggcaggcggcgtgcgcctgcctcaagagcatggcggggaggctgggtggcaacatgggcaacgccgccgccagcatcccaagcaagtgcggcgtcaacgtcggcgtgccaatcagcccaaacgtcgactgcgccaagattaactgagacgaaggatggtggatgctcagctctttccttctctttgggtatgatgtcggccaacagagcagagagcagtcgtttaatttactacctcttccttttacatttgtacaacaccacgcaccacctgtgtacgtcgtcgtctatgtacaacaataatcctctctctgcttatgggtttgctgggtctctgttttcatgtactactaccatgatgctgctgctactgcttgttataggcaggtcatgcagctctccgctcaatcaataaactttttttctgtatacctacatgcaaaaaaaaaaaaaaaaaaaa

SEQ ID NO: 1228 - protein, 117 aa, Panicum virgatum
  misc_feature: Ceres CLONE 1761269
  misc_feature (1)..(86): Pfam Name: Tryp_alpha_amyl Pfam Description: Protease inhibitor/seed storage/LTP family
MARLSAVVAVVLVAALVAAETASAAVSCSQVTSAVAPCLGYAMGSSASPSPACCNGVRSLNSRASSTADRQAACACLKSMAGRLGGNMGNAAASIPSKCGVNVGVPISPNVDCAKIN

SEQ ID NO: 1229 - DNA, 729 bp, Panicum virgatum
  misc_feature: Ceres CLONE 1761328
  misc_feature: Encodes the peptide sequence at SEQ ID NO. 1230
ctagcgccgcacccgcacactcgcgccgccgcccagccgcaggaagagggaggaggaggaggaggaggaagatgccggcagggcacgggctgcggtcgcggacccgcgacctgttcgcgcggccgttccgcaagaaggggtacatcccgctcacgacctacctccgcacctacaagatcggcgactacgtcgacgtcaaggtgaacggcgccgtgcacaagggcatgccgcacaagttctaccacggccgcaccgggcgcgtctggaatgtcaccaagcgcgccatcggcgtcgagatcaacaagcaggttaatggacgcatcatcagcaagcggatccatgtccgtgtcgagcatgtgcagccatcaagatgcacggaagagttccgcctgcggaaggtcaagaacgaccagctcaaggcggatgccaaggcccgtggtgaggtgatcagcaccaagaggcagcccttgggtcctaagcctggcttcatggtcgagggtgctacaattgagacagtcactcctattccttatgatgtggtcaatgacctcaagggtggttactagagagaacggttgtatcttgatcagttcaagcgacctagcatcaatgcttatctgaatctttttttggtactggctagttctttttttgttcgctggatgctggtgttataaacctatgtggttattactggttaacattaaagattttgctatggttgattgc

SEQ ID NO: 1230 - protein, 164 aa, Panicum virgatum
  misc_feature: Ceres CLONE 1761328
  misc_feature: Great-hit functional homolog of the protein sequence given in SEQ ID NO 9311
  misc_feature: Useful for making plants with modulated flowering time
MPAGHGLRSRTRDLFARPFRKKGYIPLTTYLRTYKIGDYVDVKVNGAVHKGMPHKFYHGRTGRVWNVTKRAIGVEINKQVNGRIISKRIHVRVEHVQPSRCTEEFRLRKVKNDQLKADAKARGEVISTKRQPLGPKPGFMVEGATIETVTPIPYDVVNDLKGGY

SEQ ID NO: 1231 - DNA, 789 bp, Panicum virgatum
  misc_feature: Ceres CLONE 1761462
  misc_feature: Encodes the peptide sequence at SEQ ID NO. 1232
aaaccctaagcgcccgcctcccacccgctccccgccgccgccgccgccgccgccgcaagcaggaccagccaggatgccggccggccacgggctgcgctcgcggacgcgcgacctcttcgcgcgcggcttccgcaagaaggggtacatcccgctcaccacctacctgcgcacatacaagatcggcgactacgtcgatgtcaaggtgaacggcgccgtccacaaggggatgccgcacaagttctaccacggccgcaccggccgcgtgtggaacgtcactaagcgcgccatcggcgtcgagatcaacaagcaggttaatggccgcatcatcaggaagcgtatccatgtccgtgtggagcatgtgcagccatcccgctgcactgaggagttctgcctgaggaaggcaaagaatgaccagctgaaagcagaggccaagtcacgtggtgaggtcatcagtaccaagaggcagccgttgggtcccaagcctggcttcatggttgaaggtgctaccattgagaccgtcacccccatcccttacgatgttgtcaacgatctcaagggcggttactaggttgcttggtctatctatctggtctaccaattctatatctgtattactctagtgggtacaattttgctcgctccgagcagtagtctggacctattctgtgtgtttctgttgaaagattttccattctaggtgcaaacctgagttcggtagaacactcaatactgttatctttgcttctatgaacgaagatgtgctttccggaaaaaaaaaaaaaaaaaaaa

SEQ ID NO: 1232 - protein, 164 aa, Panicum virgatum
  misc_feature: Ceres CLONE 1761462
  misc_feature: Great-hit functional homolog of the protein sequence given in SEQ ID NO 9311
  misc_feature: Useful for making plants with modulated flowering time
MPAGHGLRSRTRDLFARGFRKKGYIPLTTYLRTYKIGDYVDVKVNGAVHKGMPHKFYHGRTGRVWNVTKRAIGVEINKQVNGRIIRKRIHVRVEHVQPSRCTEEFCLRKAKNDQLKAEAKSRGEVISTKRQPLGPKPGFMVEGATIETVTPIPYDVVNDLKGGY

SEQ ID NO: 1233 - DNA, 866 bp, Panicum virgatum
  misc_feature: Ceres CLONE 1761551
  misc_feature: Encodes the peptide sequence at SEQ ID NO. 1234
atctccctcgctctctctctctagtctctctcctcccagcagactctctctccacgcctcacgagcacgcccaccaggagaggcctcgcatcgcatcaccacaagacaccaaagactagacagctcaggcttctctccactcccctccccgtcccccaacgcgttttccccctttcctcctctcgccgccgccgccgccgccgcctgcattccgtcgagcaactccgcccggcggccatggcgaagctcgcgctggcgctgctgctgctcctggccgtggcggccgcggcgtcggccgcggcgcccatggacctggacctgggcttcctcgcctcgggcggcgccggcgccggggcccggcgggagtgccgcggtaccgtggccgagtgcctggccgaggacgaggaggccgagctgggcggctccgcctccgccgagtcgcaccgccgcgtgctccaaggccgcggctacatcagctacggcgcgctgcgccgggacaacgtgccctgctcccgccgcggggccagctactacaactgccgccccggcgcgcaggccaacccctaccaccgcggctgctcccgcatcacccgctgccgcggctgagctccctcctcaggtgccctccgccgccggatccgccgatgggagcggggaaaggccggatctttcgccgctcctcctccgagtcctaaaaaaataagttcttttttttccttctgctgctgctgtttacaagtactagagctatggatttgttggttgccgctgtatggatttgtgttcgtcgtgctgttgtaaagtaagacatggattgattcgtgcccctatggctacttaaatatgaaaaaaaaaaaaaaaaaaaa

SEQ ID NO: 1234 - protein, 122 aa, Panicum virgatum
  misc_feature: Ceres CLONE 1761551
  misc_feature: Great-hit functional homolog of the protein sequence given in SEQ ID NO 9695
  misc_feature: Useful for making plants with modulated biomass
  misc_feature: The plant is abnormally small.
MAKLALALLLLLAVAAAASAAAPMDLDLGFLASGGAGAGARRECRGTVAECLAEDEEAELGGSASAESHRRVLQGRGYISYGALRRDNVPCSRRGASYYNCRPGAQANPYHRGCSRITRCRG

SEQ ID NO: 1235 - DNA, 953 bp, Panicum virgatum
  misc_feature: Ceres CLONE 1761575
  misc_feature: Encodes the peptide sequence at SEQ ID NO. 1236
aaatccaccggagacaccactcactcagaatcaaggcgaccgaagatcttcgagctaagcaaccgagagatgataagacgaagatgtgtccgatgatcaagaaggagatgagcgccgccgagtcgagcccgccgtgcagctgggcgtcgacctcaacctcgtcgccggagcaggggcgccaccagacggtgtggacgtcgccgcccaagaagcctgcggggcggaccaagttccgggagacgcggcaccccgtgttccgcggcgtccgtcgccgcggcaacgccgggcggtgggtgtgcgaggtgcgcgtgccgggccgccgcggctgcaggctctggctcggcaccttcgacgccgccgatgccgcggcgcgcgcgcacgacgccgccatgctcgccatcgccggcgcgggcgcctgcctcaacttcgccgactcggcgtggctgctcgccgtgccggcctcgtacgccagcctcgccgaggtgcgcagcgcggtcgccgaggctgtcgaggtcttccagcgccgcgaggcgctctcggtctcggagtctgaggacgacgccgagtcgtcgtcggcgccctcctcccccgccagcgtcgagctcgaaggggcttccaccgacggggaggagtcgtcggcgttcgaactggacgtgttcaacgacatgagctgggacctgtactacgcgagcatggcgcaggcgatgctcatggagccgccgtccgcggttccggcgttcggagaggatggcctcgccggcgccggcgatgtgccactgtggagctactagaagccgttgcacttggaatttcacaattttgtttctcatggctgccgatgccaaattttgagaccgtagtagttagtggttgctaattctggtagtgaaacagagcaagttgggaatagaaaaacatagcattccgctgaattaaaaaaaaaaaaaaaaaaa

SEQ ID NO: 1236 - protein, 235 aa, Panicum virgatum
  misc_feature: Ceres CLONE 1761575
  misc_feature (1)..(67): Pfam Name: AP2 Pfam Description: AP2 domain
MCPMIKKEMSAAESSPPCSWASTSTSSPEQGRHQTVWTSPPKKPAGRTKFRETRHPVFRGVRRRGNAGRWVCEVRVPGRRGCRLWLGTFDAADAAARAHDAAMLAIAGAGACLNFADSAWLLAVPASYASLAEVRSAVAEAVEVFQRREALSVSESEDDAESSSAPSSPASVELEGASTDGEESSAFELDVFNDMSWDLYYASMAQAMLMEPPSAVPAFGEDGLAGAGDVPLWSY

SEQ ID NO: 1237 - DNA, 764 bp, Panicum virgatum
  misc_feature: Ceres CLONE 1761617
  misc_feature: Encodes the peptide sequence at SEQ ID NO. 1238
tcgcccctccgaaaaaatagcagcacggggagactaggaggcaccgaggcagtccacaactccacactcgacagagaagagagatggcgatgcggatggcggtggctgcggcggtcgtggtggtgttctgcgtgctggcgcccccctcggcagcgcagacgtcgaggacgccggactgtgcggcgaagctggcggcgtgtgcgccgtacataaacacgacggggccgccgccgcaggcctgctgcgggtcgatcaaggacgccgtccagaacgacctcaagtgcctctgcgggctctacgccacgccggagatcttcaaggccttcaacatcaacgtcacccaagctctcggcgtcgccaagcgctgcggcctcaacgacaccaccgaagcctccaagggcctttctcccacccagtctcctccaggttctccatcaggtggtgggagcaactccggtcatcgcaccctgtcattcggattcccaggattgatgagcttgttcctagctttgtggtctgtgttggcataagatccgtcacgctattactagattacctttgtttggtcccgcaatagatgatttactacaatgttctgctgagatggtgatgctatggctatgtatcgatacaatcaacatttgttttgctgtgtattcctatagtccgccagtagaggtgatggatctgaactagattttctcatcgctttcttcattgtgctgtattaaatttggataattacatcaaatgttctttgtacc

SEQ ID NO: 1238 - protein, 148 aa, Panicum virgatum
  misc_feature: Ceres CLONE 1761617
  misc_feature: Great-hit functional homolog of the protein sequence given in SEQ ID NO 9564
  misc_feature (1)..(70): Pfam Name: Tryp_alpha_amyl Pfam Description: Protease inhibitor/seed storage/LTP family
  misc_feature: Useful for making plants with modulated biomass
  misc_feature: The plant is abnormally small.
MAMRMAVAAAVVVVFCVLAPPSAAQTSRTPDCAAKLAACAPYINTTGPPPQACCGSIKDAVQNDLKCLCGLYATPEIFKAFNINVTQALGVAKRCGLNDTTEASKGLSPTQSPPGSPSGGGSNSGHRTLSFGFPGLMSLFLALWSVLA

SEQ ID NO: 1239 - DNA, 823 bp, Panicum virgatum
  misc_feature: Ceres CLONE 1761630
  misc_feature: Encodes the peptide sequence at SEQ ID NO. 1240
gtcgtcccatcccagcaaaagcaaagccaccgcgagcttatcactcccttgacgacacagagcaccaaggatcaattgatccatcgacgacgacgacgatggcaaggccgacgccgccgaccgcccgcctcctcgccgccggcttgctggccgccgcggcggtcgcgctcggctgcctcgccggcggcgccggcgcgacggtggtgacgacgtgcagggcggcggccgacagcgacgcgcgggtggactacggcttctgcgtggcggagctgggcacccaccgcgagagccccgacgccgacacctggggcctcgccaaggtggccgcgctgacgggcgtcaacaacgccgacgacaccgtctacgacgccaaggcgctgctcgccaagcccggcgcggcgggcgggccgacgcgcgcggcgctggagcggtgcgcgaagctgtacgactccatggggttcgcgttcgcggaggcggaggacgagatcaacaaccgccgctacgccaccgggaaggagaaggcggcggaggcggcgtccctcgcgcaccagtgcgacgacgcgctcgccaaggccggcgccgtcccctcgccgctggcaaagcacagctcttactccgtgaagattgccaccatctgcacggccatcaccaacctcatcaagtgaagggaacaaacgcaggtggctttgctactttaatagtgtataaattaagaaacgtggtcgatcgagttgacatcagacatcaaaatgttgtacgtgttggaaaacttgacaataaaagaatgtggcttttatgagtgcaaaaaaaaaaaaaaaaaaaa

SEQ ID NO: 1240 - protein, 188 aa, Panicum virgatum
  misc_feature: Ceres CLONE 1761630
  misc_feature (1)..(88): Pfam Name: PMEI Pfam Description: Plant invertase/pectin methylesterase inhibitor
MARPTPPTARLLAAGLLAAAAVALGCLAGGAGATVVTTCRAAADSDARVDYGFCVAELGTHRESPDADTWGLAKVAALTGVNNADDTVYDAKALLAKPGAAGGPTRAALERCAKLYDSMGFAFAEAEDEINNRRYATGKEKAAEAASLAHQCDDALAKAGAVPSPLAKHSSYSVKIATICTAITNLIK

SEQ ID NO: 1241 - DNA, 721 bp, Panicum virgatum
  misc_feature: Ceres CLONE 1761653
  misc_feature: Encodes the peptide sequence at SEQ ID NO. 1242
cactcgtgctcgtgccgtcgctgtctccttcggccgccatgtggaagcgcgccacctccctcctcctccgctactaccgctccgcccttgccccccgatccccggcggcctccgccgccgccgcgcctggcccctgccggacgccggcgcccctcttcttctccactcctgatgccgcagggacaaggacgagggtggaggacgtgatgccgatcgccacggggctcgagcgcgaggagatcgaggccgagctccaggggaagaagagattcgacatggacgcgctcgtaggtccctttggcaccaaggaagctcctgctgtgattcaatcatactacaacaaaagaattgttggttgccctggtggtgaaggagaagatgagcatgatgtggtgtggttttggttggagaaaggcaaaccacatgaatgcccagtctgtactcaatatttcatgcttggtgtgattggaggaggaggatcccctgatggacatgacgatgacgatgatcaccatcattaaggttctgtaggctatggcaataaaatggggttgcaaatacatttttgtcgcagcgttgtgaagctgtggaaaactcagcatttggactttatagagttcagtagaccatgtcaacccgattgccccacgtctggaaacagcacatggtttgtaagacataaaagtcacttcattaactcggctatacaaataacttagac

SEQ ID NO: 1242 - protein, 160 aa, Panicum virgatum
  misc_feature: Ceres CLONE 1761653
  misc_feature (1)..(87): Pfam Name: COX5B Pfam Description: Cytochrome c oxidase subunit Vb
MWKRATSLLLRYYRSALAPRSPAASAAAAPGPCRTPAPLFFSTPDAAGTRTRVEDVMPIATGLEREEIEAELQGKKRFDMDALVGPFGTKEAPAVIQSYYNKRIVGCPGGEGEDEHDVVWFWLEKGKPHECPVCTQYFMLGVIGGGGSPDGHDDDDDHHH

SEQ ID NO: 1243 - DNA, 889 bp, Panicum virgatum
  misc_feature: Ceres CLONE 1761749
  misc_feature: Encodes the peptide sequence at SEQ ID NO. 1244
aaaaaaaaaaaaaaaaaaaaaaaaaaaattcccatccagctgcaccagcattctcctagccctgtgtgctagcgcgctctctggggtttcacacacagtcgccatggcatccaaggccttcctcctcgttgccctcaacctgctcctctttgcggtggccaacgcctgcggcggcggctgcccgacgccgactccaccaacgccgacgccgccgtcaccgtcaccgtcgagcaaaggcaagtgccccaagaacgcgctcaagctcgcggcgtgcgccaacgtggccggcctcgtgagcgccgaggtcgggaagccgccggccgagccgtgctgcagccttctcggcggcctcgccgacctcgaggccgccgcctgcctctgcaccgccatcaaggccaacgtgctcggcatcaccctcgacatccctgtcaagctcagcctcattgtcaactactgtggcaagaacctccccagcggcttcacatgcgcttgatagatacgcgtgattacgtgcttgcatgcaacgcgcacgcttgaacacagccggttgttcattcgtgagtgcatgctgcatgcgtcggatttgttttctccgacttttgtttggtgtgctttctttgtcccgtcaggtggttctgaatgtagaaccacggacggatcaacaatgatgcatgtgcgcatcgagtgtttgattgtgttttaccttttactctttttccattcttccatctactcgtttgtctatggtaatttcttctccaaggtccaagctaggaaatgcactgttttgggttttatgtggtgtttaatttatctcattgttgtaattgcttgtagtggattccatggattgtatgtgctccaagcacaaaaaaaaaaaaaaaaaaaa

SEQ ID NO: 1244 - protein, 129 aa, Panicum virgatum
  misc_feature: Ceres CLONE 1761749
  misc_feature (1)..(82): Pfam Name: Tryp_alpha_amyl Pfam Description: Protease inhibitor/seed storage/LTP family
MASKAFLLVALNLLLFAVANACGGGCPTPTPPTPTPPSPSPSSKGKCPKNALKLAACANVAGLVSAEVGKPPAEPCCSLLGGLADLEAAACLCTAIKANVLGITLDIPVKLSLIVNYCGKNLPSGFTCA

SEQ ID NO: 1245 - DNA, 752 bp, Panicum virgatum
  misc_feature: Ceres CLONE 1761808
  misc_feature: Encodes the peptide sequence at SEQ ID NO. 1246
atcagctcatcacagctcttgatctctagctagctagagagataagcttcctctcttcctctcggtcgagggagtgatcctctctcactctcaccaggagctcagctcgggtagctcaaggaggccagaagaagaaatggcgtcgctgtcgatgaccagcagctcggtgcgggcgcagaggacgaagaagcagaacaagctcttcgagcaggcgttggccgtgtacgacaaggacacccccgaccggtggcacaacatcgcccgcgccgtcggcggcaagtccgccgaggaggtcaggcgctactacgagctgctggaggaggatgtcaagcacatcgagtccggcaaggtgcccctccccgcctaccgctgccccggcggcgccggcgccggcgccctcggctacgaggccgacaggatgaagcatctgaagatctaggcgaacttcaaaggatggtcgagaagaggctgcgcaggcacgtgtatatatgattgggatagcatgcatgtccatgctactcctacgcaagtggtctggaagaagcaagaagaatcagatgagatgcatgcatgtcataattaattaataattagtatgggatgatcgagtagtatcctagcctgtcacgcgagatcgaccgacccatcgatctcccagcatgtgtccttcgtacccacgcgcgtatgtgtattatatcctagctgcatctgtgtaccataccaatcaagaaacatgaacttgatattgatgc

SEQ ID NO: 1246 - protein, 100 aa, Panicum virgatum
  misc_feature: Ceres CLONE 1761808
  misc_feature: Great-hit functional homolog of the protein sequence given in SEQ ID NO 9276
  misc_feature (1)..(51): Pfam Name: Myb_DNA-binding Pfam Description: Myb-like DNA-binding domain
  misc_feature: The sequence is a functional homolog of  SEQ ID NO 510 in the  10/666,642 US patent application
  misc_feature: The sequence is a functional homolog of  SEQ ID NO 976 in the  11/435,388 US patent application
  misc_feature: Useful for making plants with altered Lignin content
  misc_feature: Useful for making plants with modulated low light sensitivity
  misc_feature: Useful for making plants with modulated growth and phenotype characteristics
MASLSMTSSSVRAQRTKKQNKLFEQALAVYDKDTPDRWHNIARAVGGKSAEEVRRYYELLEEDVKHIESGKVPLPAYRCPGGAGAGALGYEADRMKHLKI

SEQ ID NO: 1247 - DNA, 595 bp, Panicum virgatum
  misc_feature: Ceres CLONE 1761825
  misc_feature: Encodes the peptide sequence at SEQ ID NO. 1248
atccctcaccccacgccgcctacgccgcgccccgaatcgcgtcgtgtcgatcctcctgcgcgccatggccaccgcgtctctgtccgctttctcgtcgccgctgtccgtcgccgggctcaggaagccgctcggggccgcggcgtcgtcgttccatcccctgcagccgagggcgaggccggcggccaggatggccgtgcgggcggcagcggcgtccatgaaggagaaggcggcggccgggctgaccgcggcggcagtggcggcggcgctggtgctgcctgacgtcgcggaggccgcgcagtccgggctgacgccgtcgctcaagaacttcctgctcagcatcgtgtccggcggggtcgtgctcgtggccatcgtcggcgccgtcgtcgccgtctccaacttcgaccccgtcaagcgggcctgatggatggatcgttcgttcgttaggagctgaggcccgtttctcccctgtatcatgcatgtatcgagtggtaaatccttatgtgttcctattttctttggagaagagaatgttccaacatagtatttatcgtcatacagagtttgagttaaaccatcgttgcctttggtttaattt

SEQ ID NO: 1248 - protein, 118 aa, Panicum virgatum
  misc_feature: Ceres CLONE 1761825
  misc_feature: Great-hit functional homolog of the protein sequence given in SEQ ID NO 9275
  misc_feature: Useful for making plants with modulated nitrogen use efficiency
MATASLSAFSSPLSVAGLRKPLGAAASSFHPLQPRARPAARMAVRAAAASMKEKAAAGLTAAAVAAALVLPDVAEAAQSGLTPSLKNFLLSIVSGGVVLVAIVGAVVAVSNFDPVKRA

SEQ ID NO: 1249 - DNA, 776 bp, Panicum virgatum
  misc_feature: Ceres CLONE 1761844
  misc_feature: Encodes the peptide sequence at SEQ ID NO. 1250
aactgccggccgtctacaatcgcctgtcaaacacactcgaaacctcgccaccacaaacgagaaaccacacctaccggagattgcttgcaacgccaagccatcgaactaggccacaccatgaacatgaagctgctctccttcgtgctgttcctcctgctcgtcgtgcctgctacgtgcaagtcttccaccacgctggaagacgcgtgcaggtccttcgccgccggccacccgtccatcggctacgactactgcatcagaaccttccaggccgacaggccgagcgcagcggcggccgacgcgcgcggcctcgccgccgtcgcggccaggatctcggaggcgaaggccaacgccacggccgcgcgcgtcgcggccctgagcgccacggagacggacgcgaggcggcgggaccggcacgccgtgtgcgcggaggtgtactcggacgccgtcgaccagctcgcccaggccgcggaggacctcgcccgcggcgagggcgccgacaacgcggtcacgcagctaagcgcggcgctggacgcgcccgggacatgcgaggacgcgttcggcgaggccgacgacacgtcaccgctggccgcggaggacgctgagttcaagaagctcgccaccatcgtcctcgccgtcgcagtgtcactgacgccgccgccgccgccgccgccactgtcgacgctgacgccaatgattactggttaataacaagcaatcgtgcctaacattggagtaataagcgtgggcaaggagagtatttaagtacgagttaccag

SEQ ID NO: 1250 - protein, 195 aa, Panicum virgatum
  misc_feature: Ceres CLONE 1761844
  misc_feature (1)..(157): Pfam Name: PMEI Pfam Description: Plant invertase/pectin methylesterase inhibitor
MNMKLLSFVLFLLLVVPATCKSSTTLEDACRSFAAGHPSIGYDYCIRTFQADRPSAAAADARGLAAVAARISEAKANATAARVAALSATETDARRRDRHAVCAEVYSDAVDQLAQAAEDLARGEGADNAVTQLSAALDAPGTCEDAFGEADDTSPLAAEDAEFKKLATIVLAVAVSLTPPPPPPPLSTLTPMITG

SEQ ID NO: 1251 - DNA, 846 bp, Panicum virgatum
  misc_feature: Ceres CLONE 1761852
  misc_feature: Encodes the peptide sequence at SEQ ID NO. 1252
gcaccactcaagctgagctcagctgtagcctagctagctaggtagctaataaatccatcacatccccgcgccatggcgaagaaccaccaccgcattgtggcgctcctgctcgtcgcggccacgctggtcgcgcagctcatcgcgccggccgcggcctgcccgtcctgcccaacgcctaagcctccgccgccgcccccgacgcccgtgccgtgcccgccgccgccgtcgtccgcgccgccgtccacgggcaagtgccccctgaacacgctgaagctgctggcgtgcgtggacgcgctcaacgggctggtgcacgccgtggtcggcgccaaggccagcgagaagtgctgcccgctgctgcaaggcgtggccgacctcgacgccgcgctctgcctctgcaccaccatcaaggtcaaggcgctcagcatcaacctcgtgctccccatcgccatcgaggtgctcgtcaacgagtgccacaagaacgtccccgccagcttccagtgcccgtaatcacacactcactcatcactattgcgtatgtatgtaccattaattaattatacatctgcatgcatgcatccatgcatgatgggttaaggttatgataaaccagtcatatactcatatatctatatatatcttaagcatgtacgtatagcttaatgcatgagctctctttggcttgtgatataaatggagctgtggattgtccatttgtttttgtaattgtgtatcaatattgtaacatgaaccagtgtgagagttgtgggcttggaacttgtagtgaccaaaaagatttatatgaataaagcgtgtgtgtcatacatgtaaaaaaaaaaaaaaaaaaaa

SEQ ID NO: 1252 - protein, 144 aa, Panicum virgatum
  misc_feature: Ceres CLONE 1761852
  misc_feature (1)..(83): Pfam Name: Tryp_alpha_amyl Pfam Description: Protease inhibitor/seed storage/LTP family
MAKNHHRIVALLLVAATLVAQLIAPAAACPSCPTPKPPPPPPTPVPCPPPPSSAPPSTGKCPLNTLKLLACVDALNGLVHAVVGAKASEKCCPLLQGVADLDAALCLCTTIKVKALSINLVLPIAIEVLVNECHKNVPASFQCP

SEQ ID NO: 1253 - DNA, 942 bp, Panicum virgatum
  misc_feature: Ceres CLONE 1761924
  misc_feature: Encodes the peptide sequence at SEQ ID NO. 1254
gctggtgccttgtcttccgcctccgcagctccgtgcccccctgtcccgccgcacggcctcgccgcctccacccctcccttcaccgccgcaccgccaatggcttcgcgcctccgcctcgtcgccccgaccctaggctccgtccctaaacccggcgtctccggaaaggcggagggggaacgagagggagaggcgaagcggccggagccgccgcggcgggaggtgacggacctgggcggcggcagcgtggtggtgcacgtcccgcggttcgtggcccgcgacaaggcgtgggagtggttcgactgcctcgacaggaccatcccctggaggcgccccgacatccgcgtcttcggccgcttcggcccccagcctagagatatgtgctatgttgcagatgaagggctaacagatctgaaatacagtggtcatcaagctgatgcacattcttgggatgaattccctgtgctcaaggacatcttgaaagaggtgcttgaagcccttccggggagctattttaacagcgtgctcctgaacagatacaagaccggttcagactacgtttcatggcatgctgacgatgaggcactctacggaccaactccagagatagcatctgtcagctttgggtgtgaacgtgacttcgttcttaggaaaaagcctaccaaatcacaagccacttctggatctggacaagctgctcgaaagcggtgcaaagtcgatgctcctcaacagcagcattctttccttctgaagcatggctcgctgcttgtgatgagaggctacacccagcgggactggcagcactctgttccgaagcgagccaaagcaagctcaacaaggatcaatctgactttccggcatgtactgacctaaacaagacagttttttttttcttttgagaggataaacaagtcctgctgagtccaaaaaaaaaaaaaaaaaaaa

SEQ ID NO: 1254 - protein, 257 aa, Panicum virgatum
  misc_feature: Ceres CLONE 1761924
  misc_feature (2)..(121): Pfam Name: 2OG-FeII_Oxy Pfam Description: 2OG-Fe(II) oxygenase superfamily
  misc_feature (2)..(125): Pfam Name: 2OG-FeII_Oxy Pfam Description: 2OG-Fe(II) oxygenase superfamily
MASRLRLVAPTLGSVPKPGVSGKAEGEREGEAKRPEPPRREVTDLGGGSVVVHVPRFVARDKAWEWFDCLDRTIPWRRPDIRVFGRFGPQPRDMCYVADEGLTDLKYSGHQADAHSWDEFPVLKDILKEVLEALPGSYFNSVLLNRYKTGSDYVSWHADDEALYGPTPEIASVSFGCERDFVLRKKPTKSQATSGSGQAARKRCKVDAPQQQHSFLLKHGSLLVMRGYTQRDWQHSVPKRAKASSTRINLTFRHVLT

SEQ ID NO: 1255 - DNA, 866 bp, Panicum virgatum
  misc_feature: Ceres CLONE 1761955
  misc_feature: Encodes the peptide sequence at SEQ ID NO. 1256
agatcgagctccaggctccagcaaccagcaggggttggatcatcgtggcctgagcctgaccccgtccatcctctcctctcttccccggccggcgagatcccatggcgggctccaccttcagcggcgatgagaccgcccccttcttcggcttcctcggcgccgccgccgcgctcatcttctcctgcatgggcgccgcctacgggacggccaagagcggtgtcggggtcgcctccatgggggtcatgcgcccggagctcgtcatgaagtccatcgtccccgtcgtcatggccggagtcctcggcatctacggcctcatcatcgccgtcatcatctccaccgggatcaaccccaaggccaagccctactacctcttcgacggctacgcgcacctctcctccggactcgcctgcggcctcgccggcctcgccgccgggatggccatcggcatcgtcggagacgccggcgtcagggcgaacgcacagcagccgaagttgtttgtgggcatgatcctcatcctcatcttcgcggaagctcttgctctgtacggtctgatcgtcggtatcatcctctcctctcgcgctggccaatctcgtgccgattagagggggtcagagaaatgcacacgactcatggatgattgtattcaaagtgttccttttctcggtgaacattgtacagggtcatgttgaacctgttccaccctttgtaatattattatcattgctctgccaagacaaacctagctagcgcttgtagttcgtgctgttgtatttatttgaaataataggcagcaagccccgggtgtgatgaataaataagcaaagctggactaatttttgttcgttcaaaaaaaaaaaaaaaaaaaa

SEQ ID NO: 1256 - protein, 166 aa, Panicum virgatum
  misc_feature: Ceres CLONE 1761955
  misc_feature (1)..(66): Pfam Name: ATP-synt_C Pfam Description: ATP synthase subunit C
  misc_feature (4)..(166): SWISSPROT Homolog: EC 3.6.3.14 Vacuolar ATP synthase 16 kDa proteolipid subunit
MAGSTFSGDETAPFFGFLGAAAALIFSCMGAAYGTAKSGVGVASMGVMRPELVMKSIVPVVMAGVLGIYGLIIAVIISTGINPKAKPYYLFDGYAHLSSGLACGLAGLAAGMAIGIVGDAGVRANAQQPKLFVGMILILIFAEALALYGLIVGIILSSRAGQSRAD

SEQ ID NO: 1257 - DNA, 536 bp, Panicum virgatum
  misc_feature: Ceres CLONE 1762033
  misc_feature: Encodes the peptide sequence at SEQ ID NO. 1258
atacccctccccggcctcgccattcctcatcacaagcgaagcagagcacaagcaacaagaagcaccacaccttcttcagcgccagttcctgctcgtgatcaacacaaggatcagcatggcttgctgcagcggcaactgcgggtgcggcgccggctgcaagtgcggcaccggatgcggcggctgcaagatgtcccctgacgtggaggccacctccaccaccaccaccatggtcatcgccgccgccaccagcaaggcgagctccggcgggttcgaggcggcgacggagagcggcggctgcgactgcagcacctgcaagtgcggcaccagctgcggctgctcctgctgcggctgcaactgaggcagcgccgcgatggagcgtactatatagtagcaggccagcgtttaaataagatcttgattggcaactgaaaattgtggtcaactgaacactactgtatcaaggaaattgatgcgcctgcctgttggggaagaagttacatgcccccttgaaatgaagacattactacagtttggcc

SEQ ID NO: 1258 - protein, 80 aa, Panicum virgatum
  misc_feature: Ceres CLONE 1762033
  misc_feature (1)..(83): Pfam Name: Metallothio_2 Pfam Description: Metallothionein
MACCSGNCGCGAGCKCGTGCGGCKMSPDVEATSTTTTMVIAAATSKASSGGFEAATESGGCDCSTCKCGTSCGCSCCGCN

SEQ ID NO: 1259 - DNA, 624 bp, Panicum virgatum
  misc_feature: Ceres CLONE 1762052
  misc_feature: Encodes the peptide sequence at SEQ ID NO. 1260
  misc_feature (373)..(373): n is a, c, t, g, unknown, or other
  misc_feature (374)..(374): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
attcagctgagtgtgctcgatcatcccttaatcaacaaagcctcccaattatcctttcatcagatcatcttccttcttccaagatgtcttgcagctgcttctcaagctgcaactgcggctccaactgcaagtgcggcaagatgtaccctgaccttgaggagaagagcagcggcggcgctcaggccaccatcgtcctccgcgtggccccggagaagaagactggccagttcgaggcggcagcggagtccggcgagaccgcccacgcctgcaagtgcggtaacagctgcagctgcgacccctgcaactgctgatttcgatgggttttcgtcagaacacacctgcatgcatgcatgctagctactacctactactnnttttttttcccccccgatgattgaacaagaataaggatgannnnnnnnnntcatgtctcatgtatcggtttggctccggcctcatcaagcatgcatgcgtcgcctgcccctctgtgtgctttgcgtccgtcctgtgtctgtatgtgttgatcattgcaaagaaaccatgcaggcatacatctctgcatgtgtctctgtaatgatcggtccagagtgatgaatatataaaactggtttgctttatctgcct

SEQ ID NO: 1260 - protein, 75 aa, Panicum virgatum
  misc_feature: Ceres CLONE 1762052
  misc_feature (1)..(73): Pfam Name: Metallothio_2 Pfam Description: Metallothionein
MSCSCFSSCNCGSNCKCGKMYPDLEEKSSGGAQATIVLRVAPEKKTGQFEAAAESGETAHACKCGNSCSCDPCNC

SEQ ID NO: 1261 - DNA, 1001 bp, Panicum virgatum
  misc_feature: Ceres CLONE 1762238
  misc_feature: Encodes the peptide sequence at SEQ ID NO. 1262
gaagcagccaaccagatctagaattctctggaccccatcggcggcggcggcggcggcgaggagagcaccgaccggagatggcgccgagcgggtggaggaggagcgcgggggcgcggtccgtctggcgccccgccacggtgtgcctgtggctcgcggttgccgccgccgccctgacgctcgcccaggcgaagaaggacctgacggaggtcacccacaaggtctacttcgatatcgagattgacggcaagcccgcaggtcggattgtcatgggactcttcgggaagactgttcctaaaacagcagaaaacttccgagcgctttgcacaggagagaaaggagttggcaaaagtggcaaacctctccactacaagggaagcacattccacagaatcatccccagcttcatgctccaagcaggtgacttcactcttggtgatggaaggggtggtgaatccatctatggcttgaagttcgctgatgagaacttcaagatcaagcacactgggccaggccttttgtccatggccaatgccgggagagatacaaatggatcccagtttttcatcaccactgtaaccacaagctggttggatgggaagcatgttgtgtttggcaaggtgctgtctgggatggatgtcgtctacaaggtcgaagctgaaggccggcagagtgggcagccaaagagcaaggttgtcatagcagatagcggcgagctgccaatgtgatgatatgtactagtattctgatgaaaaaaataagaagttgctgccgctatttagcttctagaactggctatagtggtctgttttgcggtaactggtctataccagattcactttactgcagggactttcgtatttacttagttggaaagtttaaaagatgagctatagcgaatggtgtctcgattctgcattgttttcagtttcatctgtaagaatttttttgtggttgtttagccgctacgcctcttcagaagttaaaaaaaaaaaaaaaaaaaa

SEQ ID NO: 1262 - protein, 215 aa, Panicum virgatum
  misc_feature: Ceres CLONE 1762238
  misc_feature (1)..(167): Pfam Name: Pro_isomerase Pfam Description: Cyclophilin type peptidyl- prolyl cis-trans isomerase/CLD
  misc_feature (20)..(215): SWISSPROT Homolog: EC 5.2.1.8 Peptidyl-prolyl cis-trans isomerase CYP20-1 precursor
  misc_feature (31)..(215): SWISSPROT Homolog: EC 5.2.1.8 Peptidyl-prolyl cis-trans isomerase CYP19-4 precursor
MAPSGWRRSAGARSVWRPATVCLWLAVAAAALTLAQAKKDLTEVTHKVYFDIEIDGKPAGRIVMGLFGKTVPKTAENFRALCTGEKGVGKSGKPLHYKGSTFHRIIPSFMLQAGDFTLGDGRGGESIYGLKFADENFKIKHTGPGLLSMANAGRDTNGSQFFITTVTTSWLDGKHVVFGKVLSGMDVVYKVEAEGRQSGQPKSKVVIADSGELPM

SEQ ID NO: 1263 - DNA, 698 bp, Panicum virgatum
  misc_feature: Ceres CLONE 1762257
  misc_feature: Encodes the peptide sequence at SEQ ID NO. 1264
accattacagtacgcactccggctgacgcgccccgcactctctcacaaagctcaagcctttcgctcgctcgcggctacatctacaatggcgcgattccagctcgcggccctggccatggccatgctcttcgccgcggcggcggcgcaggccccggccgccaccccgacgccggcgcccagggcgtcccccccgccggcgactcctccgccgaccccggcgccggtgtctccgcccgcgcaggcccccgccgttcctcccccggccccggcgcccgcgactccagcccccgcccccgaggccgccgccccggcgccggctgaggcccccacccccgcggcgagctccccgccggcgcccgcccccatgggcccctccccgtcgcccaccagcgacgtgcccccggcccccagcgccgccgccggcgtctcccccgccgccaagtgggccgccgccgccgccgtggccgccgccttctactgaggagtacccccgcaccgcccccgcggtgctgtaatctattgctatccgtgttgaattttttgctttcatattccattcggcattcgattcggtaggagagactcctggcatctgtgcgcgttgctgctactgcagtctgtgtaggatcgtggcttggacagattggttggttggctgcccccggtggtgttgtgatcaaaaaaaaaaaaaaaaaaaa

SEQ ID NO: 1264 - protein, 131 aa, Panicum virgatum
  misc_feature: Ceres CLONE 1762257
  misc_feature: Great-hit functional homolog of the protein sequence encoded by LOCUS At5g10430
  misc_feature: Useful for making plants with altered cell wall content and/or composition
MARFQLAALAMAMLFAAAAAQAPAATPTPAPRASPPPATPPPTPAPVSPPAQAPAVPPPAPAPATPAPAPEAAAPAPAEAPTPAASSPPAPAPMGPSPSPTSDVPPAPSAAAGVSPAAKWAAAAAVAAAFY

SEQ ID NO: 1265 - DNA, 815 bp, Panicum virgatum
  misc_feature: Ceres CLONE 1762326
  misc_feature: Encodes the peptide sequence at SEQ ID NO. 1266
atctccatacaacgagcgcatcaccaccgcccacactacacagctcgtagcacaggagtaggtagagctcagttgctagctactatggcgtccaagaccgagctggtggtggaggtgaagtccccggcggacaagctgtgggcggcgctgcgcgactccacggagctgttccccaagatcttcccccagcagtaccagagcatcgagaccgtcgagggcgacggcaagtccgccggcaccgtccgcctcctcaagtacgccgagggggtgccgatgatgacgttcgccaaggagaaggtggagctggcggacgacgagaacaaggtggtgtcgtacagcgtggtggacggcgagctggtgaacttctacaagaacttcaggatcacgctcaaggtgtcccccgccaaggaggccaaggccggcgccgtcgtcaactggtccatggagttcgacaaggccaacgaccaggtgcccgacccggacgtcatcaaggagaccgccaccaagacgttccacgacctcgacgactacctcctcaagaactaggcggcggcggcgggggtggtcgtccacccgccgaggcatcggcgatcggtcgcagtcattttagcacgctagcgtgcatgtcgttggtgctggtgtccgagtccatgttcgtattggcgtggtagctacggagggtcgtgtccttgacttgtctccggttgaatgtttgatgttgctgcagggatcgtgcgcgtctgcactctgcagattgcaatctagtcccagtcaataataaaattatacgtgttcaaaaaaaaaaaaaaaaaaaa

SEQ ID NO: 1266 - protein, 153 aa, Panicum virgatum
  misc_feature: Ceres CLONE 1762326
  misc_feature (1)..(154): Pfam Name: Bet_v_I Pfam Description: Pathogenesis-related protein Bet v I family
MASKTELVVEVKSPADKLWAALRDSTELFPKIFPQQYQSIETVEGDGKSAGTVRLLKYAEGVPMMTFAKEKVELADDENKVVSYSVVDGELVNFYKNFRITLKVSPAKEAKAGAVVNWSMEFDKANDQVPDPDVIKETATKTFHDLDDYLLKN

SEQ ID NO: 1267 - DNA, 855 bp, Panicum virgatum
  misc_feature: Ceres CLONE 1762350
  misc_feature: Encodes the peptide sequence at SEQ ID NO. 1268
atcatcaagaagtgagtgagctcacaaacgatctaagccaaacagtcacagtatcctaagttcctaaccaccagcatgtcgatgatcaccagcatgctgaccggacgcaagcagcagcagagccagaagccgcagggcggcacgcgcaccggcggcggcggcgcggaggtcgttgagccggtgagcatcgacatcctggagccgttcgtggacgccatctcgctgacggcgttcgcggcgccggcgcaggggctgccgacgttcgcgacggcgagcatggactggaaggagacgccgacggcgcacgtgttcatggcggacctccccggggtgcgccgcgacgaggtgaaggtggaggtggaggaggagaaggtgctcaagatcagcgggcagcggcagcgcgccgccgaggacaagggcgaccggtggcaccgcgtcgagcggagctccgagcgcttcgtgcgcaccgtgcggctgccgcccaacgccaacaccgacaccgtccacgccacgctcgagaacggcgtgctcaccgtcaccgtgcccaaggacaacgaacgcaaggcctacggccgcctcatccccatcgccaactagctctctcgaccgattgataactcgacccatcaatcggcgatatggattattcatgatcactacttaccataatacagtacatgatagcgtccgatcaaaatagtatgtgtgtgtgtgtctcagtgttgaagcatgcctatgttcttgcttggttgaccaagtggtagtaaaagcacatctagatatgtatgcatacgtttgtggcataattcatggaataaatttgagttttctatacaaaaaaaaaaaaaaaaaaaa

SEQ ID NO: 1268 - protein, 173 aa, Panicum virgatum
  misc_feature: Ceres CLONE 1762350
  misc_feature (1)..(103): Pfam Name: HSP20 Pfam Description: Hsp20/alpha crystallin family
MSMITSMLTGRKQQQSQKPQGGTRTGGGGAEVVEPVSIDILEPFVDAISLTAFAAPAQGLPTFATASMDWKETPTAHVFMADLPGVRRDEVKVEVEEEKVLKISGQRQRAAEDKGDRWHRVERSSERFVRTVRLPPNANTDTVHATLENGVLTVTVPKDNERKAYGRLIPIAN

SEQ ID NO: 1269 - DNA, 930 bp, Panicum virgatum
  misc_feature: Ceres CLONE 1762419
  misc_feature: Encodes the peptide sequence at SEQ ID NO. 1270
atcgcaaaaaccactcgagcacaaccggcagaggcactccagagctaagcgttcgatcgacagccgatccagaacaagatgtgtcagatgaagatgaagatgaagatgaagatggagatgggcgccgagccgtcgggctcgccctcgacctcggagcaggagcaccaccggacggtgtggacgtcgccgccgaagcggccggcggggcggaccaagttccgggagacgcggcaccccgtgttccgcggcgtgcggcgccggggcaacgccgggcggtgggtgtgcgaggtgcgcgtgccgggccgccgcggctgcaggctctggctcggcaccttcgacgccgccgatgccgcggcgcgcgcgcacgacgccgccatgctcgccatcgcgggcccgggcgcctgcctcaacttcgcggactcggcgtggttgctcgcggtcccggcctcgtacgccagcctccccgaggtgcgccgcgcggtcgccgaggccgtggaggagttccagcgccgggaggcgctcccggaggaggaggacgcgcgctcggccacgtcgttgacgccgtcctcccccgccagcggcgaagacgaagcctccaccgacgaggacggggaggagtcctcgccggccgccgaggactcgccgttcgaactggacctgttcggtggcttgagctcggacttgtactacgcgagcttggcacaggcgatgctcatggagccaccgtccacagtcgcggcgttctgcgacgagggcatggccgatgtgcctctctggagctattaggacagaggccgccgctgggcttcaattttccgccttttctttctcttggactatccgaagccaaattttggtattgtaacggttactacttctggtaatgagacagagcaacttgggacagtagaaaaaaaaaaaaaaaaaaaa

SEQ ID NO: 1270 - protein, 235 aa, Panicum virgatum
  misc_feature: Ceres CLONE 1762419
  misc_feature (1)..(67): Pfam Name: AP2 Pfam Description: AP2 domain
MCQMKMKMKMKMEMGAEPSGSPSTSEQEHHRTVWTSPPKRPAGRTKFRETRHPVFRGVRRRGNAGRWVCEVRVPGRRGCRLWLGTFDAADAAARAHDAAMLAIAGPGACLNFADSAWLLAVPASYASLPEVRRAVAEAVEEFQRREALPEEEDARSATSLTPSSPASGEDEASTDEDGEESSPAAEDSPFELDLFGGLSSDLYYASLAQAMLMEPPSTVAAFCDEGMADVPLWSY

SEQ ID NO: 1271 - DNA, 937 bp, Panicum virgatum
  misc_feature: Ceres CLONE 1762440
  misc_feature: Encodes the peptide sequence at SEQ ID NO. 1272
aactggcaaaaccccaagcgacctcctccgcctccccacaccaccagggtcggatcgtcgggcacaagctcaagcggcggcggcggcggcggcggcgaagagcgaccgccggcgcggggccgcatcgggcgggaggacggagaatagttcggcttcccccctcttcctagagcagagatgccgctgtacgactgcatgctgctggtgaagccgctggtgaccagggaggccatggccgagctggtggcgcgggtggcgcgccgcgcgtaccagcgcaacggggtcgtcaccgacgtcaagtccttcggcaaggtccagctcggatacggcatcaagaagctcgacggccgtcactaccagggacagcttatgcaaatgacaatgatggttccaccttccttcactcaagaactccactatctgaacaaggaggacaggctgcttcgctggctgattgtgaagcatagagatgcagtatacggtctggagttcatcaacgaggatgatgggaggaacgagatgagcggtttcagtcttgctcataagaaagttgactacgatattgaagaatgctccgatgactctgagtcggagtttatgtcctcctctgatgaggattctgacaactacaagtatgagggcgaggaggaggagaagtagaattgcttgtccagatttctgcagttccagactgtattggcagatatcttttcttaccaaccatatgttgtcttcctaataccactcgctatagtaggatgagaattgacaagcagaacctatgaacttgattgtcacatatttttgcatcccagagcatgcctgtaatatgaagtttcaggcgtgcccttgttctggcaagcatgttgtatgaccctgtacggtaggtttgaataagctacaaatcttttagtgctaaaaaaaaaaaaaaaaaaaa

SEQ ID NO: 1272 - protein, 160 aa, Panicum virgatum
  misc_feature: Ceres CLONE 1762440
  misc_feature: Great-hit functional homolog of the protein sequence given in SEQ ID NO 9696
  misc_feature: Useful for making plants with modulated biomass
  misc_feature: Useful for making plants with modulated flowering time
  misc_feature: The plant flowers significantly late compared to wild-type.
  misc_feature: The plant is abnormally small.
MPLYDCMLLVKPLVTREAMAELVARVARRAYQRNGVVTDVKSFGKVQLGYGIKKLDGRHYQGQLMQMTMMVPPSFTQELHYLNKEDRLLRWLIVKHRDAVYGLEFINEDDGRNEMSGFSLAHKKVDYDIEECSDDSESEFMSSSDEDSDNYKYEGEEEEK

SEQ ID NO: 1273 - DNA, 1055 bp, Panicum virgatum
  misc_feature: Ceres CLONE 1762482
  misc_feature: Encodes the peptide sequence at SEQ ID NO. 1274
gctgatcgctctccccacaccaccacctcctcctccacagcaggctagccaggctttttctggggtttgcgaggggggcgctccggtccggcgagaggggggagatggcggcggagcgggcgcaggggacggtcaagtggttcaacgggagcaaggggttcggcttcatcagccccgacgacggcagccaggacctcttcgtccaccactcctccgtcaaggccgacggcttccccaacctcaaggacggcgaagccgtcgagttcaccgtcggcgccgacagcgacggccgcgccaaggccatcgacgtctccgcgcccggcggcggcacgctcgccggcggggaacgcccggacagcggctacggcgggcgcggcggcggcggcggctacggcgggggaggcgaccgcggctacggcggcggcggcgaccgcggctacggcggcggcgaccgcgggtacgggggaggcggcgaccgcgggtacgggggaggcggcgaccgcgggtacggctacggcggcggctacggcggcggcgggggaggcggccgcggctgctacaagtgcggcgaggagggccacatcgcacgcgactgctcccagggcggcggcggctacggcggaggccgcggcggcgggtgctacaactgcggcgaggagggccacatctcccgcgagtgcaccaacaagaggcgctaggcgcggcggctccacgtcggaggcgttccgacccctacctcctggctcttgcatcaagtcatagccatctatctatcagtagtagtatttcgttctcgtcgttcgctcgtgtcgtagtaggaagaaggcggcgtgtggagaagtggtgatgatgtggatccgtctgtctcggagtagaaatcaatgtttctgttttgcatcagctgtaaggcagccatgatcatggatggcactgcccgatctatatatctttctagatctatcaatggaatgggatgaacggactagtaatctatttgaactcagatatgcatgactgcctctgtggttctaattaaaaaaaaaaaaaaaaaaaaa

SEQ ID NO: 1274 - protein, 197 aa, Panicum virgatum
  misc_feature: Ceres CLONE 1762482
  misc_feature (1)..(68): Pfam Name: CSD Pfam Description: 'Cold-shock' DNA-binding domain
  misc_feature: The sequence is a functional homolog of  SEQ ID NO 1041 in the  10/374,780 US patent application
  misc_feature: The sequence is a functional homolog of  SEQ ID NO 851 in the  10/666,642 US patent application
  misc_feature: Useful for making plants with modulated growth and phenotype characteristics
MAAERAQGTVKWFNGSKGFGFISPDDGSQDLFVHHSSVKADGFPNLKDGEAVEFTVGADSDGRAKAIDVSAPGGGTLAGGERPDSGYGGRGGGGGYGGGGDRGYGGGGDRGYGGGDRGYGGGGDRGYGGGGDRGYGYGGGYGGGGGGGRGCYKCGEEGHIARDCSQGGGGYGGGRGGGCYNCGEEGHISRECTNKRR

SEQ ID NO: 1275 - DNA, 752 bp, Panicum virgatum
  misc_feature: Ceres CLONE 1762498
  misc_feature: Encodes the peptide sequence at SEQ ID NO. 1276
aaattcccccacagcacacacagcagctaatccagactcacactactgcagcatttgctttgcttagcacgaccgccgatcgataattaataataatacaacgataatggcggttctgatgatgaagaacaagaagcagatgcaggcggtggtggccttggccgttgtggtggcggcggcggcgctggtggcgtcggcgtcggcggccatcacctgcgggcaggtgggttcggcgctggcgccgtgcatcccgtacgcgacggggaaggcgagcgcgctgccgtcgtcgtgctgcggcggcgtgcgcagcctcaacagcgcggcgcgcacgagctcggaccggcaggcggcgtgccggtgcctcaagagcctggccagcaccgtcaagtcggtgaacatgggcaccgtcgccaccttccccggcaagtgcggcgtctccgtgccattccctatcagcatgtccactgactgcaacaagatcaactaaattaatcttacatcagatatgctgctacctgatggtgagaagcttggtccttcagaagatagcaacgagctatttattaggacaataaaataaagttgttaaggcatcatcatcagcatcatctatactattttgtagtaataattaattaattaattaaatgttgtactcgatctgtgtgtacgtgcgcgtatacatacatgcatgcttatccgatcgatgtatatatatgtgctgcttctctcaaaaaaaaaaaaaaaaaaaa

SEQ ID NO: 1276 - protein, 126 aa, Panicum virgatum
  misc_feature: Ceres CLONE 1762498
  misc_feature (1)..(86): Pfam Name: Tryp_alpha_amyl Pfam Description: Protease inhibitor/seed storage/LTP family
MAVLMMKNKKQMQAVVALAVVVAAAALVASASAAITCGQVGSALAPCIPYATGKASALPSSCCGGVRSLNSAARTSSDRQAACRCLKSLASTVKSVNMGTVATFPGKCGVSVPFPISMSTDCNKIN

SEQ ID NO: 1277 - DNA, 698 bp, Panicum virgatum
  misc_feature: Ceres CLONE 1762546
  misc_feature: Encodes the peptide sequence at SEQ ID NO. 1278
ctcatctcttccttccctggcggcgacgactgggcgagcggcggcgccatttgtcacgtcttcgcccagccctttgccggcgacgagcgcatcctccagccacttcttcgagatgccgagggccacgagcgacgcaaagcttctgatccagtccctcaacaaggcgtatgctgccacaccgacaaatcttaagattatcgacttgtacgtgatttgtgctctcgctaccgccgtgattcaggttgcatacatgggattggttgggtcattccctttcaactccttcctctcaggtgtactttcatgcataggaactgcagtgcttgctgtttgtctccgcattcaagtgaacaaagacaacaaggaatttaaggatctacccccagaaagggcctttgctgactttgttctgtgcaacctggtgctccacctggtgatcatgaacttccttggataagcaactgccgtacaccgagtggttaagattttgcagccccagattttggtcgctgatcagtgttttaaagtttggaactgtcataataccgagtatccatatgatctctcacatattacctatgtaaagctagaattctcgaggaactgttagtcgaatggacagtgttgatccagtattgacaatgttatactgcgagcatttgcgtaatttcaaggaagtgaaatggctatgttacatc

SEQ ID NO: 1278 - protein, 114 aa, Panicum virgatum
  misc_feature: Ceres CLONE 1762546
  misc_feature: Great-hit functional homolog of the protein sequence given in SEQ ID NO 9749
  misc_feature (1)..(114): SWISSPROT Homolog: EC 2.4.1.119 Dolichyl- diphosphooligosaccharide--protein glycosyltransferase subunit DAD1
  misc_feature: Useful for making plants with modulated flowering time
  misc_feature: The plant flowers significantly late compared to wild-type.
MPRATSDAKLLIQSLNKAYAATPTNLKIIDLYVICALATAVIQVAYMGLVGSFPFNSFLSGVLSCIGTAVLAVCLRIQVNKDNKEFKDLPPERAFADFVLCNLVLHLVIMNFLG

SEQ ID NO: 1279 - DNA, 663 bp, Panicum virgatum
  misc_feature: Ceres CLONE 1762599
  misc_feature: Encodes the peptide sequence at SEQ ID NO. 1280
aacctaagcattacatctagctagcagcagctgagtaccaacagaatattctctgaacattcagccaggaaagcaggaggagcaaccatgatcactgccaagagacttgttcagatggcaaagaagtggcagagaatggccgctctggcgaggaagcggctcacgtcggcaccaatgaaagaagctgaaggatcatgcagtacctcatcgtccatggccagcaagggccactgcatcgtgtactcggccgatggccagcgattcgaggtcccactggcgtacctcggcacagcggtcttcggcgagctcctaatgatgtcgcaggaagagtttgggttcgccagcgacgacggcaagatcacgctgccctgtgactccgcggtcatggagtacgttatgtgcttgcttagaagagacgcctctgaagaggttgtgagggcgttcttgagctccatggtcaggccgtgccacaatgtcagcagcgtggtgccatgcaaccagccgttagctgtttgtgtatagcctattgttagctcctgacgcactatacaaattccggttcaaccggatgtaaagttgtagaatcatataggaaattgaaatcatgaaattttgttatataaaaaaaaaactcgaccggggggacggccccaccgttttttc

SEQ ID NO: 1280 - protein, 144 aa, Panicum virgatum
  misc_feature: Ceres CLONE 1762599
  misc_feature (1)..(103): Pfam Name: Auxin_inducible Pfam Description: Auxin responsive protein
MITAKRLVQMAKKWQRMAALARKRLTSAPMKEAEGSCSTSSSMASKGHCIVYSADGQRFEVPLAYLGTAVFGELLMMSQEEFGFASDDGKITLPCDSAVMEYVMCLLRRDASEEVVRAFLSSMVRPCHNVSSVVPCNQPLAVCV

SEQ ID NO: 1281 - DNA, 534 bp, Panicum virgatum
  misc_feature: Ceres CLONE 1762603
  misc_feature: Encodes the peptide sequence at SEQ ID NO. 1282
acgactccataacagccacaccagccctccgcaatctctcaaagctaaaacacacacacacacacacacagttaccaaaataaccatggcaaaggcccaggcaatgggcgcactgctgaccatcttgttggtcctcgccatgtcctccgaggtggcgcacggcatctgcaacctgtcgagcgacggcatccgggcgtgccagccggcgaccgccatccgcaacccgaccgaccagccctcggcggcgtgctgcgccgccctggccggggccgacctgccgtgcctgtgccggtacaagaacgccgccggcgtgtgggtgaggttctacaagatcgacatcaaccgcgccatggggctgccccgcaagtgcggcctcgccatgccggcccactgctgatgatcttctccagcattgtcactctcgttataactactatatatacatgtgtagcttcgagatcgaataaatggggtatactgtaacattgagctgtaagctagtgagcttgttaaatcagggcacaagtaagtttc

SEQ ID NO: 1282 - protein, 103 aa, Panicum virgatum
  misc_feature: Ceres CLONE 1762603
  misc_feature (1)..(78): Pfam Name: Tryp_alpha_amyl Pfam Description: Protease inhibitor/seed storage/LTP family
MAKAQAMGALLTILLVLAMSSEVAHGICNLSSDGIRACQPATAIRNPTDQPSAACCAALAGADLPCLCRYKNAAGVWVRFYKIDINRAMGLPRKCGLAMPAHC

SEQ ID NO: 1283 - DNA, 734 bp, Panicum virgatum
  misc_feature: Ceres CLONE 1762639
  misc_feature: Encodes the peptide sequence at SEQ ID NO. 1284
agacgcttcctcgccggccgcgccgctcccaagcccgcacgcttctcttccccctctcctccgatggcgacgctgcagctcaaccacatcgcgcgggagacctccgacgtggcccgcctcgcggccttctacgaggccgtgctggggttcgagcgcgtgccgtccccgacctactcgggcttccaggtcgcctggctccgcctcccgggctcccccgacgtcgcgctccacctcatcgagcgggacccagccgcggcccccgtcgcggtggggcccggcgccgagggcgcgccgccggcgcagctgccccggcgccaccacctggccttctccgtcgccgactacgacgggttcgtgaccgggctcaaggcgcgcgggaccgagctgttcgagaagacgcagcccgacggccgcacgcgccaggtcttcttcttcgaccccgacggcaatggcctagaagttactagctcagctgcaggcagtgatgagtaattagagagcatgatgtgctagctatttctgctttagcctgcaatgtaaactgaagatgttaccagaccaagctttgttgcgataaataaatccgaagcttacaaagcaatgtatatttgctttagtccgaagcttatgaagcaatgtatttttcctatgttgtaagttgtaacatgactctgttcccaactggactctactgtatgaaaaatgaagtttcaatgctagcttcttgtcagttt

SEQ ID NO: 1284 - protein, 142 aa, Panicum virgatum
  misc_feature: Ceres CLONE 1762639
  misc_feature: Great-hit functional homolog of the protein sequence encoded by LOCUS At2g32090
  misc_feature (1)..(123): Pfam Name: Glyoxalase Pfam Description: Glyoxalase/Bleomycin resistance protein/ Dioxygenase superfamily
  misc_feature: Useful for making plants with modulated nitrogen use efficiency
MATLQLNHIARETSDVARLAAFYEAVLGFERVPSPTYSGFQVAWLRLPGSPDVALHLIERDPAAAPVAVGPGAEGAPPAQLPRRHHLAFSVADYDGFVTGLKARGTELFEKTQPDGRTRQVFFFDPDGNGLEVTSSAAGSDE

SEQ ID NO: 1285 - DNA, 1047 bp, Panicum virgatum
  misc_feature: Ceres CLONE 1762703
  misc_feature: Encodes the peptide sequence at SEQ ID NO. 1286
aaccgatcccgcagttaccacctcgctccgccgccgctgccgggccgccccgagtccccgaccgcctgaggaagtcaggaagcaccccccccctcccccgccgacccggctcgcggccccgcccgcccggatctgacggctcgcttccgcacgcggggaggtgcggagccttcgtcagggctccgggatggcggcgccgccggcgagggccagggccgactacgactacctcatcaagctgctcctcatcggcgacagcggtgttgggaaaagttgtctccttttacggttctcagatggctccttcaccactagctttatcaccaccattgggatcgacttcaaaataagaacaattgagcttgatggtaaacgcataaagttgcagatctgggatactgctggccaagaacattttcgaactattacaactgcctactacaggggtgcaatgggcattttgctcgtctatgatgtcaccgacgagtcgtcgttcaataatataagaaactggattaggaacattgagcaacatgcttctgacaatgtgaataaaattttgattggcaacaaagccgacatggatgaaagcaaacgggctgtaccaacttctaaagggcaggctcttgctgacgagtatggcatcaagttctttgaaacgagtgcaaagaccaacttgaatgtggagcaggttttcttttcaatagcaagagatatcaagcaaaggctagcggaaaccgactcaaagccagaggagcgtacgatcagtattaacagacctgaggacgcttcggcgccacagaagtcagcatgctgcgggtcctgactcctgactcctgattgggttatgttgtcacacggaagataagatagtggtgataccatgcttgtaatttacccttttacccttttctctggctggctgtcatcatgtgccttgtccgcaatcgcctgggttcagatttctgtgtttcattgtgaacaattttagctacaatactggtagaaatgcaattggtctcgagtcaaaaaaaaaaaaaaaaaaaa

SEQ ID NO: 1286 - protein, 212 aa, Panicum virgatum
  misc_feature: Ceres CLONE 1762703
  misc_feature: Great-hit functional homolog of the protein sequence given in SEQ ID NO 9467
  misc_feature: Great-hit functional homolog of the protein sequence given in SEQ ID NO 9640
  misc_feature: Useful for making plants with altered Lignin content
  misc_feature: Useful for making plants with modulated oxidative stress sensitivity
MAAPPARARADYDYLIKLLLIGDSGVGKSCLLLRFSDGSFTTSFITTIGIDFKIRTIELDGKRIKLQIWDTAGQEHFRTITTAYYRGAMGILLVYDVTDESSFNNIRNWIRNIEQHASDNVNKILIGNKADMDESKRAVPTSKGQALADEYGIKFFETSAKTNLNVEQVFFSIARDIKQRLAETDSKPEERTISINRPEDASAPQKSACCGS

SEQ ID NO: 1287 - DNA, 1334 bp, Panicum virgatum
  misc_feature: Ceres CLONE 1762721
  misc_feature: Encodes the peptide sequence at SEQ ID NO. 1288
gctgaacccgcaccgccacttgttgggtttcttcctcctcttcttgctccccccggcggcggccactcatcctcctgccccacctgctgctgccttcccttgcagtgaccactccctcccgttcccgtccatccccttcctccacttgtcgcctccgctgctccggcgaccgcatcatggtgaaggccaaagccatcagggtacatgagctcggcggccccgaggtgatgaggtgggaggaggtggagcttggggaccccaaggaaggggagatccgcatcaggaccaccgccatcggcgttaacttcatcgatgtctatttccggaagggggtctacgccgcgcccgcgctgcccttcaccccaggcatggaagctgtcggcgttgtcactgcagttgggcctggcctcactggtagaaaagttggggatgttgttgcttatgctggcaacccgatgggatcctatgcccaggagcagatccttccagccagcgtcgctgttcccgtgccgccttcagttgatcaccagcaagcagcttcggtcatgctcaagggcatgactgcccatgtcttgcttcgccgtgtgttcaaggttgagagtggccacactgtcctggtgcacgctgctgctgggggagttggctcactcctttgtcagtgggcatatgcacttggtgccactgtcattgggactatttccaatgaagagaaagcggctcaggcgacccaggatggatgccaccatgtcataatttacacaaaggaagatgttgtggcaagagtcaaggagattacttctggaaaaggtgtgagcgtggtctatgattctgttggaaaggatacatacaaggcttctgtggagtgcttggcgtcccgcggcttccttgtgtcatttgggcagtcctcaggcaaacctgacccgattccaatgagcgacctggcttccaagtcgctgttcctgactcggcctagcctgatgcattacactgctacccgcgatgagctgctggagtctgcgggcgaggtgtttgccaatgttgctaacggggtgctgcgcattcgcgtaaaccacacctatccgttgtcggaagctgcacgggcccatgcagatctggagggcaggaagacctctgggtccatagtgctcatcccggatacggatagctaggctagggattggcctcaactcgaatgaagcatggttggggggaacagggttatgatatgtatgctggtttgctgtttatgttgcatctgttcatgtctgtttctctgaaggaataaatttgtcgtccttgtgttattggatgatgaaaaaaaaaaaaaaaaaaaa

SEQ ID NO: 1288 - protein, 330 aa, Panicum virgatum
  misc_feature: Ceres CLONE 1762721
  misc_feature (1)..(82): Pfam Name: ADH_N Pfam Description: Alcohol dehydrogenase GroES-like domain
MVKAKAIRVHELGGPEVMRWEEVELGDPKEGEIRIRTTAIGVNFIDVYFRKGVYAAPALPFTPGMEAVGVVTAVGPGLTGRKVGDVVAYAGNPMGSYAQEQILPASVAVPVPPSVDHQQAASVMLKGMTAHVLLRRVFKVESGHTVLVHAAAGGVGSLLCQWAYALGATVIGTISNEEKAAQATQDGCHHVIIYTKEDVVARVKEITSGKGVSVVYDSVGKDTYKASVECLASRGFLVSFGQSSGKPDPIPMSDLASKSLFLTRPSLMHYTATRDELLESAGEVFANVANGVLRIRVNHTYPLSEAARAHADLEGRKTSGSIVLIPDTDS

SEQ ID NO: 1289 - DNA, 780 bp, Panicum virgatum
  misc_feature: Ceres CLONE 1762738
  misc_feature: Encodes the peptide sequence at SEQ ID NO. 1290
cctccacttcgcatcacgcccaccacgcacacaggcgctcgtcccgcagcgcacgagcacacatccaaacccacttcccgatccgacccggaggttcggagatgaagtcgagggcgaggtccagcggagccgactccaggctctccgtgaggaagtccaaggccgagaaggaccccaacaagcccaagaggcctccgagcgccttcttcgtcttcatggaggagttcaggaaggactacaaggagaagcaccccaatgtcaagcaagtctccgtgattggcaaggctggtggggacaagtggaagtccctgtccgatgctgaaaaatctcccttcgtgtccaaggccgagaagctcaaggctgagtacaacaagaagatggacgcctacaataacaagacggctggaggccctacagcttctggtgactctgacaagtccaagtccgaggtgaacgatgaggatgaggagggtgacgagtgatgcatccagctctcagtagtcgcagtcagtagtagggaagtcttcgtcgtcggcctaaccgggcattgctgccccttagcctttggatgctgtctgtctctctagatgtagcagtagtagctgtcccctctcgagttggtagttgcaagtgtcgtccctgaagtgaggcagtttagtgttagtgtgttcgcttcttcgtcacttgaccgtcgttggaatgtcaacctgcagtctgtacttaccccgagcatccgttcctgttttaaatctaagatctcaaaagacgagttaatttgct

SEQ ID NO: 1290 - protein, 126 aa, Panicum virgatum
  misc_feature: Ceres CLONE 1762738
  misc_feature: Great-hit functional homolog of the protein sequence given in SEQ ID NO 9488
  misc_feature: Useful for making plants with altered Lignin content
  misc_feature: Useful for making plants with altered terpenoid content
MKSRARSSGADSRLSVRKSKAEKDPNKPKRPPSAFFVFMEEFRKDYKEKHPNVKQVSVIGKAGGDKWKSLSDAEKSPFVSKAEKLKAEYNKKMDAYNNKTAGGPTASGDSDKSKSEVNDEDEEGDE

SEQ ID NO: 1291 - DNA, 984 bp, Panicum virgatum
  misc_feature: Ceres CLONE 1762859
  misc_feature: Encodes the peptide sequence at SEQ ID NO. 1292
accccgttcccgtggcgtgccttctagggtttccttccttccctcgcctccccgcgccgctccctcccgcccgccagatttggatctgcgctccagccccaggttgttctgatggctcccgctgtagaagctgtgaaggaggcaggctcattccaaaaggttcctgctttgaatgaaagaatactgtcatccatgtccaggagatctgttgctgcgcacccttggcatgatctggagattggccctggtgcaccaaccatattcaactgtgtcattgagatacccaggggcagcaaggtgaagtacgaacttgacaagaaaactggactgataaaggtggaccgtgtgctgtattcatcagttgtgtaccctcacaactatggattcattcctcgcacactttgtgaagacagtgaccctctggatgtgctggttataatgcaggagccagttattccaggctgtttccttcgggcaaaggccatcggccttatgcctatgattgatcagggagagactgatgataagatcattgctgtgtgcgccgatgatcctgaatacaagcactacaatgatatcaaggagcttccacctcaccgcttggctgaaatcaggcgcttctttgaggactacaagaagaatgagaacaaggaggttgctgtgaatgactttctgcctgctagcgctgcttatgaagccatacaacactctatggatctgtatgctacctacattgttgagggcctgaggaggtaggctgctgctgcgtggtgcaacggtgccttgcttgaagggatgtttttcaccggttgggtctggaggatgttgacgaaaactgagatacactacctaatgaaacacaagtattgttattttgttggtaacttgtataccgctagtaatgaaacctgaaccaaatcccctggggaatcagtagtagttgaagctagtaacacgagaatggaaaaaagaaaaaaaaaaaaa

SEQ ID NO: 1292 - protein, 214 aa, Panicum virgatum
  misc_feature: Ceres CLONE 1762859
  misc_feature (1)..(155): Pfam Name: Pyrophosphatase Pfam Description: Inorganic pyrophosphatase
  misc_feature (1)..(214): SWISSPROT Homolog: EC 3.6.1.1 Soluble inorganic pyrophosphatase
MAPAVEAVKEAGSFQKVPALNERILSSMSRRSVAAHPWHDLEIGPGAPTIFNCVIEIPRGSKVKYELDKKTGLIKVDRVLYSSVVYPHNYGFIPRTLCEDSDPLDVLVIMQEPVIPGCFLRAKAIGLMPMIDQGETDDKIIAVCADDPEYKHYNDIKELPPHRLAEIRRFFEDYKKNENKEVAVNDFLPASAAYEAIQHSMDLYATYIVEGLRR

SEQ ID NO: 1293 - DNA, 903 bp, Panicum virgatum
  misc_feature: Ceres CLONE 1762959
  misc_feature: Encodes the peptide sequence at SEQ ID NO. 1294
aagcagtggttggcctcccgaccgagtcctatctgcatctgctattcctcctcctccacgccgtcctctccgtcgccgccgccgccgcagccaccgcctagccaagatgaatgtggataagctcaagaagatggcgggcgctgtgcgcaccggaggaaagggcagcatgcgcaggaagaagaaggcagttcacaagaccacaaccaccgatgacaagaggcttcaaagtactttaaaaagaattggagtgaacactattcctggtattgaggaggtcaacattttcaaggatgatgttgtgatccaatttcagaaccctaaagtgcaagcatccattcctgcaaatacatgggtggtcagtggagtaccacagacgaaaagtctgcaggacctgctgccaactattatcaaccaattgggccctgataacctggacaaccttcggaggcttgctgagcagttccaaaagcaggtacctggtgctgagactggtgccggtgcagctgcacaggatgatgatgatgtccctgagcttgtcccaggagagacatttgaagaggcggctgaggagaagaaggaaccggagcctgaagagaagaaagaatcataattttgttacacatctcatccattgttgtgaggggtagttggtccagtgttgccatctaccatctatcattcgtctccatgtgctccagttttcagttttacaaggatttggtggaatcccagtcaaattgagagttgcaacaagtgtgtgtttcacgttttcaattgattttttgtttacgagaaatgtgtagagctgtaatctagtggaggcttaagcttctaatggtgggtggcgattatggatgggagctcttaagcacttgagtttttcaaaaaaaaaaaaaaaaaaaa

SEQ ID NO: 1294 - protein, 167 aa, Panicum virgatum
  misc_feature: Ceres CLONE 1762959
  misc_feature: Great-hit functional homolog of the protein sequence given in SEQ ID NO 9453
  misc_feature: The sequence is a functional homolog of  SEQ ID NO 1614 in the  11/479,226 US patent application
  misc_feature: The sequence is a functional homolog of  SEQ ID NO 1617 in the  11/479,226 US patent application
  misc_feature: The sequence is a functional homolog of  SEQ ID NO 784 in the  10/412,699 US patent application
  misc_feature: The sequence is a functional homolog of  SEQ ID NO 786 in the  10/412,699 US patent application
  misc_feature: Useful for making plants with modulated biomass
  misc_feature: The plant is abnormally large.
  misc_feature: Useful for making plants with modulated growth and phenotype characteristics
MNVDKLKKMAGAVRTGGKGSMRRKKKAVHKTTTTDDKRLQSTLKRIGVNTIPGIEEVNIFKDDVVIQFQNPKVQASIPANTWVVSGVPQTKSLQDLLPTIINQLGPDNLDNLRRLAEQFQKQVPGAETGAGAAAQDDDDVPELVPGETFEEAAEEKKEPEPEEKKES

SEQ ID NO: 1295 - DNA, 1065 bp, Panicum virgatum
  misc_feature: Ceres CLONE 1762966
  misc_feature: Encodes the peptide sequence at SEQ ID NO. 1296
gcacatcccagagatcaaacaaaacccaccgccgcggcgactccgcctcccaccgacccggcgatcaccggagcacgcaccagcagcgggagggcgcagggagttctcaagatggagggcgtggacgtgtcgcggcagcttaagcagatgacggacttcatccgccaggaggccgtcgagaaggccgtcgagatcgaggccgcagccgccgaggaattccaaattgaaaaattgcatttggtggaagctgaaaagaagaagatcaggcaggaatttgatcgcaaagagaagcaagttggtatcaagaagaaaattgactactcaatgcagctcaatgcttcccgaattaaagttcttcaagctcaggatgacttagtaacaaatatgatggaatcagcaaggaaagagctactgtacatcagccgagatcaccaaacctacaagaaacttctgaagatacttattgttcagagtttgctgcgtctgaaagagccagctgtgcttctccgctgcagaaaagaggatcttgagcttgttgattcagttttggagtcggcaaggaatgagtatgcagaaaaagcaaatgtatatcctcctgagatagtggtagaccgtcatgtctatctgccatctgctcccagtcattatcaggcacctggtccctcctgctctggcggagttgtgctagcttcccgagatggaaagatcgtctgtgaaaacacactggatgctagactacaggtggtttttagaaagaagctgcccgagatccgtcaaagccttttcgggcaggtagctgtgtaaccaatccttgaaagaagaatgcggcacagtactctttggggtaccctgatgatgtccaggagcatgctttggcagctcaattgtgatttatcaaactgtttgatctcaactattattatttttgttatggaggcgttgtcatcagattccaaaccgtccaatcctgcaccaaaataaataagagaataaaactgtgctcatatttgtgacgatctttcttaaaataataaggtggacgtccaaaaaaaaaaaaaaaaaaaa

SEQ ID NO: 1296 - protein, 230 aa, Panicum virgatum
  misc_feature: Ceres CLONE 1762966
  misc_feature (1)..(209): Pfam Name: vATP-synt_E Pfam Description: ATP synthase (E/31 kDa) subunit
  misc_feature (1)..(229): SWISSPROT Homolog: EC 3.6.3.14 Vacuolar ATP synthase subunit E
MEGVDVSRQLKQMTDFIRQEAVEKAVEIEAAAAEEFQIEKLHLVEAEKKKIRQEFDRKEKQVGIKKKIDYSMQLNASRIKVLQAQDDLVTNMMESARKELLYISRDHQTYKKLLKILIVQSLLRLKEPAVLLRCRKEDLELVDSVLESARNEYAEKANVYPPEIVVDRHVYLPSAPSHYQAPGPSCSGGVVLASRDGKIVCENTLDARLQVVFRKKLPEIRQSLFGQVAV

SEQ ID NO: 1297 - DNA, 879 bp, Panicum virgatum
  misc_feature: Ceres CLONE 1762978
  misc_feature: Encodes the peptide sequence at SEQ ID NO. 1298
aaaaaatttcagagtccgccgccgccgccctaccccgagacatggagctctccgtcgtgccttccatctccctctccccgcgccgcgcccttccactcccgggcaggagggcggcgcggcggccggccttcacctgccgctgcagctgctccccggacgagtcccccggggccacccggcggtggttcgcctccctcctcgccgccaccgcagtggtgggagttcgcatggccggaggggaagccggcgcggtgtccaccagccggagggcgctcagggcgtccaagattccggagagcgagttcacaaccctgccaaatggcctcaagtactatgacatcaaggtaggaagtggggctgaagctgttaaaggatcccgtgtcgcggtacattatgtggccaagtggatgggcatcacattcatgacaagccggcagggtctcggtgttggaggtggaactccatatggttttgatgttggcaattctgatagaggcaatgttttaaaaggactggatcttggggttgagggaatgaaagttggtggccagaggttgatcatcgttccacctgaactggcatatggaaagaaaggtgtccaagaaattcctccaaatgcaaccattgagctggatgttgagctacaatcaatcaagcagagtccatttgggactcctgtgaagatcgtcgaaggataactgtgcatagcattgtaaagataatggtacatatttgtgtggaaagtagagtgtttctttgaaaaaaaggctagtttacaaagatatactggtggtattgcattgatagtgcactcgtgtaagattttgaacttcattgaaatatagaattcgttttcctcaaaaaaaaaaaaaaaaaaaa

SEQ ID NO: 1298 - protein, 218 aa, Panicum virgatum
  misc_feature: Ceres CLONE 1762978
  misc_feature (1)..(99): Pfam Name: FKBP_C Pfam Description: FKBP-type peptidyl-prolyl cis-trans isomerase
MELSVVPSISLSPRRALPLPGRRAARRPAFTCRCSCSPDESPGATRRWFASLLAATAVVGVRMAGGEAGAVSTSRRALRASKIPESEFTTLPNGLKYYDIKVGSGAEAVKGSRVAVHYVAKWMGITFMTSRQGLGVGGGTPYGFDVGNSDRGNVLKGLDLGVEGMKVGGQRLIIVPPELAYGKKGVQEIPPNATIELDVELQSIKQSPFGTPVKIVEG

SEQ ID NO: 1299 - DNA, 818 bp, Panicum virgatum
  misc_feature: Ceres CLONE 1763018
  misc_feature: Encodes the peptide sequence at SEQ ID NO. 1300
acaccagctcaagcaaaacatagagccgcacattcaaaatcaaaatcacaccagctctagcagctagagaacattagatccgatggcaaaagcacaggcactagctgcactgctccttgccatggtggtggccctcgccgccatagagggcgcccacgccatctgcggcatggcgaacgaggacttcaagctgtgccaggccgcggcgtccgcgaatgacccgaccgacagcccgtcggcggagtgctgcgctgcgctgggtaaggccgacctgggttgcatctgccgctaccggggcgtcgccggcatctggatgaggatctaccacatcgaccccagccgcgccatggagctgccgggcaagtgcggcctcaccatgcccagcaactgctcgtgatcgatcaatctatgagctacggcatgtatcacgagttcatgggaccgggcacaagtagttgtgtatcggtatgctaaataactggagcgcatgaaaagaacttgtgttccttgatgattttatctattttctgcgtgattgtgatcgtattatgtattatgcgtgtgtgtgtgtgcgcgcgcgcgctgtaagctcaatctgtggtcgtttcagctcatcagtttgattcaagcaatagtgtcgtcagcaagctgttgtcattgtcacagtatgacagtattgttaagagcagagcttgttcttggcaaacatttgtttgggttaagcatagttgccgagctagcatatacgtgtgcttctacaataccattgtgcttccgctatggattctagcatttcagaaaaaaaaaaaaaaaaaaaa

SEQ ID NO: 1300 - protein, 104 aa, Panicum virgatum
  misc_feature: Ceres CLONE 1763018
  misc_feature (1)..(75): Pfam Name: Tryp_alpha_amyl Pfam Description: Protease inhibitor/seed storage/LTP family
MAKAQALAALLLAMVVALAAIEGAHAICGMANEDFKLCQAAASANDPTDSPSAECCAALGKADLGCICRYRGVAGIWMRIYHIDPSRAMELPGKCGLTMPSNCS

SEQ ID NO: 1301 - DNA, 698 bp, Panicum virgatum
  misc_feature: Ceres CLONE 1763047
  misc_feature: Encodes the peptide sequence at SEQ ID NO. 1302
atcgccatcctcctctccctccgatcagaagcagcacagccagcaccggccgaccagcgcagcggccacaccgagcgaccggtccaccatccacagcttcaatcacacgaccatggcgtcgcagcagcggaggcagatgcagcagcagcaggagcagcaggcggcggcggcggcggcggcggcgccggtggggttcgaggactacctgccggtgatggcggagcggctgggcgaggagggcctgatgcgggagctggcgagcgggttccggctgctcatggacccggcgcgcgggctcatcaccttcgacagcctccgccgcagcgcgccgctgctgggcctgggcgccatgtccgacaacgacctccgcgggatgctcgccgagggcgacttcgacggcgacggcgcgctcagcgagatggagttctgcgcgctcatgctccgcctcagccccgagctcatggacgggccccgcaggtggctcgacgacgccgtctcgcaggcctcgcacttcctcttcttcaccagctaggcgcgctgccagcccgggacgtgcgcataggaattcctgagctcttcttcttcgttctcgttgttcatagctggattaggaagggactggcggctgattggtcgatcgatggattccatatcatgtgtactagcctgttcctcccctactggagtctgaattgatc

SEQ ID NO: 1302 - protein, 139 aa, Panicum virgatum
  misc_feature: Ceres CLONE 1763047
  misc_feature: Great-hit functional homolog of the protein sequence given in SEQ ID NO 9669
  misc_feature: Useful for making plants with altered glycerol content
MASQQRRQMQQQQEQQAAAAAAAAPVGFEDYLPVMAERLGEEGLMRELASGFRLLMDPARGLITFDSLRRSAPLLGLGAMSDNDLRGMLAEGDFDGDGALSEMEFCALMLRLSPELMDGPRRWLDDAVSQASHFLFFTS

SEQ ID NO: 1303 - DNA, 808 bp, Panicum virgatum
  misc_feature: Ceres CLONE 1763083
  misc_feature: Encodes the peptide sequence at SEQ ID NO. 1304
aagccgcggcgcccgcacacgcgcgcgcagatacctttcctctccccccttcccctcccctcttcgccccttccgcctccgccggaacccagcggccggccggccggcaggcgcccgcgccatgacgagctcctccccctcctcctcgtccccttcccggaaggcgctgagcaagatcgcgtgcagccgcctgcagaaggagctctcggagtggcaggtcaacccgcccgccggcttcaagcacagggtcaccgacaacctccagaggtgggtcatcgatgtggctggggcaccaggcaccctctacactggcgagacgtaccagctgcaggtggacttccccgagcattatcccatggaggcacctcaggttatatttctgcacccggcaccaatgcatccgcacatctacagcaatgggcacatctgtttagatatattgtatgattcatggtccccagcaatgacagtcagttctgtctgtatcagcatcttgtctatgttgtcaagctcgccagcaaagcaacgcccagccgataatgatcgctatgtcaggaactgccgcaatggtaggtcaccaaaggagactaggtggtggttccatgacgacacggtgtgatgggtgttccattggtgtttccttttggcagcagccccttcagttgccagactagcttaatttcgagcaacccatttgactggaaattaacatgcccttgtggtttgtaaatgaatgtgcatcagcgacagttgctgaaattgttaatccttacaccttcgatgatgacaaaaaaaaaaaaaaaaaaaa

SEQ ID NO: 1304 - protein, 165 aa, Panicum virgatum
  misc_feature: Ceres CLONE 1763083
  misc_feature: Great-hit functional homolog of the protein sequence given in SEQ ID NO 9434
  misc_feature (7)..(165): SWISSPROT Homolog: EC 6.3.2.19 Ubiquitin-conjugating enzyme E2-18 kDa
  misc_feature: Useful for making plants with modulated oxidative stress sensitivity
MTSSSPSSSSPSRKALSKIACSRLQKELSEWQVNPPAGFKHRVTDNLQRWVIDVAGAPGTLYTGETYQLQVDFPEHYPMEAPQVIFLHPAPMHPHIYSNGHICLDILYDSWSPAMTVSSVCISILSMLSSSPAKQRPADNDRYVRNCRNGRSPKETRWWFHDDTV

SEQ ID NO: 1305 - DNA, 790 bp, Panicum virgatum
  misc_feature: Ceres CLONE 1763093
  misc_feature: Encodes the peptide sequence at SEQ ID NO. 1306
gtccaataattaattaatttctctcggtcgtccaccacacccaccggctccgtaccatccgtcgccgccggcgcgcgcactcaccagacgccagccaccgcgatggccgcctccgccacggccgcgaggcctctcgccggggcctccgcccctctccccttctccgcgcggccgcagcccgctagggtcgccttgctcccgcgggctcctgctgcgattcggggcctcagcctcggccgtcccgcgcaggcgcagccctccgcgcgcggccggtcggtgcggtgcctggcagcgctgagcccggagatgcgggcgacgctggacaaggtggtggggtccagcaaggtggtgctgttcatgaaggggaccaaggacttcccgcagtgcggattctcccacaccgtcgtgcagatcctgcgctcgctcgacgtgcccttcgagacgctcgacgtgctcgccaacgaggcgctccgccaggggctcaaggagtactccagctggcccaccttcccgcagctctacatcgacggcgagttcttcggcggatgcgacatcaccgttgaggcatacaagagtggagaactacaggaaactctagagaaagcgatgtgttcttagagaccattgaatcaagacgacacgatataaagttaatcaaaatgttgtagtatttgctgtacaattcaggcatgttaaagaactggagatgctaagctgtagacaattcattacaaatgcttcagttcccttgattggaataagataaaattttctggaatttgtgatcttc

SEQ ID NO: 1306 - protein, 171 aa, Panicum virgatum
  misc_feature: Ceres CLONE 1763093
  misc_feature (1)..(65): Pfam Name: Glutaredoxin Pfam Description: Glutaredoxin
MAASATAARPLAGASAPLPFSARPQPARVALLPRAPAAIRGLSLGRPAQAQPSARGRSVRCLAALSPEMRATLDKVVGSSKVVLFMKGTKDFPQCGFSHTVVQILRSLDVPFETLDVLANEALRQGLKEYSSWPTFPQLYIDGEFFGGCDITVEAYKSGELQETLEKAMCS

SEQ ID NO: 1307 - DNA, 896 bp, Panicum virgatum
  misc_feature: Ceres CLONE 1763168
  misc_feature: Encodes the peptide sequence at SEQ ID NO. 1308
atcaccatttcacttcacagaactccttgtcctaggccccagaaacacaaacgaccgctctttgtttaggcaagatgaacaggaagcctggagactgggattgcagggcttgccaacacctcaacttcagtcggcgggacctatgccagcgctgtggtgagccacgtggagctgctgaccgtggcagcggcggtggaggtgactatgccaacttcggtggccgtggtggctcctccttcggcggtggctttggtgctggctctgatgtccgccctggtgactggttatgttcctgcggcgcgcacaacttcgccagccgctccaactgcttcaagtgctctgccttcaaggaggaggctgctgtcaacagtggtgctggtggctttgatggtgacatgtcacgctcgcgctacggcttcggtggcggtgctgcccgcaccaaccgccctggttggaagtctggagactggatctgcaccaggtccggatgcaacgagcacaactttgccagcaggatggagtgtttcaggtgcaacgcaccacgggactccggtagcgctgccatgacctacgatatttataacttgcactgaggtgtaggatcggagctggtgcttcgaacggaccccgacgagcagaagcagcaagaaacctgataagaagagtagtagatttgcaaaaggcatcccggtgttttgttccacccctaccgtttccttttagaatttggttctcgtctccttagtacccctcggacctatgtttgctgttttattcccgttgtttcccgcaatgtttgcgctttgcatcgagtcatgtgatgtaaccccaaaacgcttgcttcacaagtattaactagtactgttgcttcttaataaaaaaaaaaaaaaaaaaaa

SEQ ID NO: 1308 - protein, 172 aa, Panicum virgatum
  misc_feature: Ceres CLONE 1763168
  misc_feature: Great-hit functional homolog of the protein sequence given in SEQ ID NO 9683
  misc_feature: Useful for biocontainment applications
  misc_feature: Useful for making plants with modulated biomass
  misc_feature: The plant is abnormally small.
  misc_feature: The plant produces a reduced number of seeds.
MNRKPGDWDCRACQHLNFSRRDLCQRCGEPRGAADRGSGGGGDYANFGGRGGSSFGGGFGAGSDVRPGDWLCSCGAHNFASRSNCFKCSAFKEEAAVNSGAGGFDGDMSRSRYGFGGGAARTNRPGWKSGDWICTRSGCNEHNFASRMECFRCNAPRDSGSAAMTYDIYNLH

SEQ ID NO: 1309 - DNA, 1075 bp, Panicum virgatum
  misc_feature: Ceres CLONE 1763234
  misc_feature: Encodes the peptide sequence at SEQ ID NO. 1310
atatttcttctcccctcttccctcttcttgttcttggagttgttggtctccccggagctaaaaggccccgccttttggctcgttctcagactcaccacctgctccaagaaaagcttcctgggggagatggcgcgcaccgagaaggttgccggcggtggctgctccggcggcgaaggccacgtagaggtggaggtcggcgtgggggtggacggcaagggggtgattgagtgccggatatgccaggaggagggcgaggaggacgccatggactcaccctgcgcctgcactggcacgctcaagttcgcccacaggaaatgcatacagagatggtgcaacaagaaggggaacattacatgcgaaatctgcaaccaggtctactcaccaaattatgtcctccctccacccaaatgttgttcagatgaaatggacatggatcttaggcaaaactgggttggaagaatcgatactcatgatgattctcattttttagccattgccatcgcaaagcagcagctgctgcaagctgaatttgaggattgtgtatccgcaagttctagtggtgttacatgctgccgaaccattgctttaattttgatgttccttctgcttgtgcgccatgtaattgtcattgtgaggaatgttagcatgctacaagatgcaacagtgctgttcagtgcaactcttcagtttgcaggattctttcttccctgttatgtgatagcccgttcttgctatgctttgcaacaccgcagacgaagacaggtatagggacttagctgaaccttgaagaacaccagacataccaactgaaacaccatcttggcaccaggctactaagtattgggagcttgcaaagtaacgcttccggttgcttggagccactgcaaggcatttggtttctctcctgaaaatgtaggcggtgtagatcatgatgtcgcgagaacacccctcgtaaagctcaactgtacatacgagaacaaggcctttttacaactgcaaaacatgtaacctcacacatttctattgcaaataaagaacaagcaatgaccgcccaccaaaaaaaaaaaaaaaaaaa

SEQ ID NO: 1310 - protein, 213 aa, Panicum virgatum
  misc_feature: Ceres CLONE 1763234
  misc_feature (1)..(46): Pfam Name: zf-C3HC4 Pfam Description: Zinc finger, C3HC4 type (RING finger)
MARTEKVAGGGCSGGEGHVEVEVGVGVDGKGVIECRICQEEGEEDAMDSPCACTGTLKFAHRKCIQRWCNKKGNITCEICNQVYSPNYVLPPPKCCSDEMDMDLRQNWVGRIDTHDDSHFLAIAIAKQQLLQAEFEDCVSASSSGVTCCRTIALILMFLLLVRHVIVIVRNVSMLQDATVLFSATLQFAGFFLPCYVIARSCYALQHRRRRQV

SEQ ID NO: 1311 - DNA, 806 bp, Panicum virgatum
  misc_feature: Ceres CLONE 1763274
  misc_feature: Encodes the peptide sequence at SEQ ID NO. 1312
acggttgcagagccagagccagagcaagacgcgactgcttttgcttcatcagtagcgagcctacgcgttgccgcccatcactttcttggtcgtgtctcatcgatcgggctgagctagctcccggcagcggaagggcaggaagaggacgaggatgagctcggtgtgcgcgaggcccgtgggcgcggggtgctacttcgtcggcggggccaggggcccgcggcggacgcgggtgcgggtggcggcggcggcggcggcggcggtggccgcgccggcgtcgagggcggcgacgatgtacgaggtgctggcggtggaggagacggcggggcccgcggagatcaaggcggcgtaccggcgcgaggcgcggcggtggcacccggacgcgtgccccggcggcgccgaccgcttcatggcggcgcgggaggcctacgaggtgctgtccgacccggagcgcaggcgcggctacgacatccagctccgctgcggcgggttcggtggcgccggcgactctggctaccgcgcggcgcggcgcgcggggttcgccgactgggaggcgcagctggccgggctgcagtggcgcgcggcggagcggcgcggccgcgcgggcggggagacgtggggtagcaggatgcgccgggccgccgcgtagcagtcccggtgggtgggtggcgtcggaggtggctgctgatttagttttaccctcctctttcttcttttctttcccgcttctacagcgttcgcgctgtttgtagtgtacaggagctctcgcagtaaatattatggtgtactaaaaaaaaaaaaaaaaaaaa

SEQ ID NO: 1312 - protein, 164 aa, Panicum virgatum
  misc_feature: Ceres CLONE 1763274
  misc_feature (3)..(62): Pfam Name: DnaJ Pfam Description: DnaJ domain
MSSVCARPVGAGCYFVGGARGPRRTRVRVAAAAAAAVAAPASRAATMYEVLAVEETAGPAEIKAAYRREARRWHPDACPGGADRFMAAREAYEVLSDPERRRGYDIQLRCGGFGGAGDSGYRAARRAGFADWEAQLAGLQWRAAERRGRAGGETWGSRMRRAAA

SEQ ID NO: 1313 - DNA, 552 bp, Panicum virgatum
  misc_feature: Ceres CLONE 1763314
  misc_feature: Encodes the peptide sequence at SEQ ID NO. 1314
aaccacggaaccacaaccctgcaaccccattacatattctcatatactcagcacctgcaccgcactgtaccaaccatgagcgacctcctctcctacatttccaagatgttgtgcatcaaggcaaggtccgaggtgacgcagtccggcgaggacggtggctgtctggtggacgagtgccgcgtctgcttgtccaggatgcgcgttggcgaggccacccggcggctgccgtgccggcaccttttccaccgggactgcgttaatcgctggttggtgtcctgcaagcaaacctgtccgctttgtcgggtttatgtggccgacgagaataggcatccggtggcggcgaagcacaccggccgtgaagcactcgccgacgacctggtgatctggttctccaccgtgcttgtccccggtttctgaattctgaggctaagatcttcttcattttctattgatgccattctttttttctttttttttggcatatactacacaacttttttacgagtactattcaacttatatgtacctatgttagactatagaacagctttc

SEQ ID NO: 1314 - protein, 113 aa, Panicum virgatum
  misc_feature: Ceres CLONE 1763314
  misc_feature (1)..(42): Pfam Name: zf-C3HC4 Pfam Description: Zinc finger, C3HC4 type (RING finger)
MSDLLSYISKMLCIKARSEVTQSGEDGGCLVDECRVCLSRMRVGEATRRLPCRHLFHRDCVNRWLVSCKQTCPLCRVYVADENRHPVAAKHTGREALADDLVIWFSTVLVPGF

SEQ ID NO: 1315 - DNA, 844 bp, Panicum virgatum
  misc_feature: Ceres CLONE 1763405
  misc_feature: Encodes the peptide sequence at SEQ ID NO. 1316
gcacgcagccaaaaagcacacggggcagagctcgactgctcgatgaggcgggaggcgatcgggatggccgctcctcttgcgtagcagagtgttgcttgcctgctgcttccgtcacttgccattgccactgcgtgagcgagaggaaggcggcgtgaagggagcagctaaggatcgcgcgcttcgggggccgcttctcctactgcctcgtcgaccacctcgcgccgcgcaacgccaccagctacctcaccttcggcccggggcccgaggacgccgccgcgccggagcagacgccgctgctgctcgaccgccggatgagcccgttctacgccgtgacggtcgacaccatctacgtggccggcgaggcgctcgacatccccgcggacgtctgggacgtcgacaagagcggcggcgcgattctcgactcggggacgagcctcacgatcctcgctaccccggcgtacagggccgtggtcgcggcgctgagcaggcagctcgcggggctcccgagggtgagcatggatccgttcgagtactgctacaactggacggccggcgcgccggagatcccggagctggaggtgcacttcgcggggtcggcgcgtctgctgccgccggcgaagagctacgtgatcgacgcggcgcccggggtgaagtgcatcggcgtgcaggagggggcgtggcccggggtgtcggtcatcggcaacatcctgcagcaggagcacctctgggagttcgacctcagggaccggtggctccggttcaaggacacgcgctgcgtcgcccaatgattctgacaggcgcacacgattaatccatccatcgtcttgataaatttgtaacggcc

SEQ ID NO: 1316 - protein, 158 aa, Panicum virgatum
  misc_feature: Ceres CLONE 1763405
  misc_feature (200)..(351): Pfam Name: Asp Pfam Description: Eukaryotic aspartyl protease
MSPFYAVTVDTIYVAGEALDIPADVWDVDKSGGAILDSGTSLTILATPAYRAVVAALSRQLAGLPRVSMDPFEYCYNWTAGAPEIPELEVHFAGSARLLPPAKSYVIDAAPGVKCIGVQEGAWPGVSVIGNILQQEHLWEFDLRDRWLRFKDTRCVAQ

SEQ ID NO: 1317 - DNA, 770 bp, Panicum virgatum
  misc_feature: Ceres CLONE 1763444
  misc_feature: Encodes the peptide sequence at SEQ ID NO. 1318
accggctctcaatctccgtctcggcctcctttcctcccggcggcgacagggcgagtggcgccgcgccgccctttgctagtttctccggcgacgagcatccgataggagcgaagctaatatggctgccttgccactggccactgctgaagtatgtgatgctaatcctcatttgattatgaatggcgagcttcgtgctctccatcccatcttccaaatctacggaaggcgccaagtttttgctggtcctattgtgaccctgaaggtctacgaggacaatgttctgatccgtgagttccttgaggagaaaggccacggcagggtccttgtggttgatggtggtgggagtatgcgctgtgccattctgggtggcaaccctgtccagcaggcacagaacaatgggtgggctggcattgtggtgaatgggtgtatcagggatgttgatgagatcaacggctgtgacattggtgttcgagctctcaactcccacccgatgaaggcaaacaagaagggcattggtgagaagcatgtccctgtgaccatggcaggaactaggatttgcgatggcgaatggctctatgccgatacagatggcgttcttgtctcgaggacggagttgactgtgtagacccattccctgtttgtacgtgtgtataagaattgggcacatgaaagcagggctgctcctgtcgttgcctgttggtgttctgtctgaacttgtaataatggattgttgttggatcacacgattaccaggaataattggatgttac

SEQ ID NO: 1318 - protein, 168 aa, Panicum virgatum
  misc_feature: Ceres CLONE 1763444
  misc_feature (1)..(158): Pfam Name: Methyltransf_6 Pfam Description: Demethylmenaquinone methyltransferase
MAALPLATAEVCDANPHLIMNGELRALHPIFQIYGRRQVFAGPIVTLKVYEDNVLIREFLEEKGHGRVLVVDGGGSMRCAILGGNPVQQAQNNGWAGIVVNGCIRDVDEINGCDIGVRALNSHPMKANKKGIGEKHVPVTMAGTRICDGEWLYADTDGVLVSRTELTV

SEQ ID NO: 1319 - DNA, 622 bp, Panicum virgatum
  misc_feature: Ceres CLONE 1763527
  misc_feature: Encodes the peptide sequence at SEQ ID NO. 1320
attcagttgagtgtgctccatcaccaagcaaagcaacctcgctcgctctcccaatcatccttatcagatcatcttcttccaagatgtcttgcagctgcggctccagctgcaactgcggcaagatgtaccctgaccttgaggagaagagcagcggcggtgctcaggccaccgtcgtcctcggcctggccccggagaagaaggccggccacttcgaggcggcggcggagtccggtgagaccgcccacgcctgcaagtgcggcaacagctgcacctgcgacccctgcaactgctgatttggatggggaacgtacacgcctgcgtgcatgctagctactgcctactctgcttgtgtgtgacttgattgaacaagaataaggatgagcctgagccaacgtgcccgatgtatcggtttggctccggcctcatccagcatgcatgcgtcgtctgcccttatgtgtgctttgctacctccttattaccttgtgcttggcgtcagtcatgtatctgtatgtgtctgtatgtgttgatcattgcaaataaaccatgcaggcatgatgcatctctgcatgtgtctctgtaatgatcggtccagagtgatgaatatataaaactggtttgcttt

SEQ ID NO: 1320 - protein, 69 aa, Panicum virgatum
  misc_feature: Ceres CLONE 1763527
  misc_feature (8)..(74): Pfam Name: Metallothio_2 Pfam Description: Metallothionein
MSCSCGSSCNCGKMYPDLEEKSSGGAQATVVLGLAPEKKAGHFEAAAESGETAHACKCGNSCTCDPCNC

SEQ ID NO: 1321 - DNA, 753 bp, Panicum virgatum
  misc_feature: Ceres CLONE 1763590
  misc_feature: Encodes the peptide sequence at SEQ ID NO. 1322
atctgccaagtcagaaccccgctatatacccaactccactaaccaagcagcacgttagatcaaggacaccgccgcccgagcccctccccgatccccaagagcagcagcagcagcgagccatggccacctcgaccgccgccgccgtgctgtgcccgccgtccgtggcggggctccgcctggcgccctcgcccagggcgcgcgtgtcgttccgcgcggcgccggcgaggcggtccgtggcggcgcgggcggagctgagcccatcgctggtgatcagcctcagcacgggcgtctcgctcttcctgggccgcttcgtcttcttcaacttccagcgggagaacgtggcgaagcaggtgcccgagcagaacggcaagacgcacttcgaggccggcgacgagcgcgccaaggagttcgccgccctgctcaagtccaacgaccccgtcgggttcaacctcgtcgacctcctcgcctggggctcgctcggccacatcgtcgcctactacatcctcgccacctccagcaacggatacgaccccaacttcttctgagcgccggggcggtgttcctgacaggcctgctgtaatctacgactcggtcactgtgttggtgttgctgctgcgttttggtgatgtatctggtgccgcggaaagattggttaaatttggacaagtagtgcaactgcgtgtgtacattgccgcatgaatttgatcttcatctgtgtctgtgaattcagctacttccacgttccacctttcc

SEQ ID NO: 1322 - protein, 141 aa, Panicum virgatum
  misc_feature: Ceres CLONE 1763590
  misc_feature: Great-hit functional homolog of the protein sequence given in SEQ ID NO 9745
  misc_feature: Useful for biocontainment applications
  misc_feature: The plant produces a reduced number of seeds.
MATSTAAAVLCPPSVAGLRLAPSPRARVSFRAAPARRSVAARAELSPSLVISLSTGVSLFLGRFVFFNFQRENVAKQVPEQNGKTHFEAGDERAKEFAALLKSNDPVGFNLVDLLAWGSLGHIVAYYILATSSNGYDPNFF

SEQ ID NO: 1323 - DNA, 855 bp, Panicum virgatum
  misc_feature: Ceres CLONE 1763639
  misc_feature: Encodes the peptide sequence at SEQ ID NO. 1324
atcgaacacacacacacacacacagacaggtgccaaagtaaaaccgctggaaactttggccatggcggtggcggcacgcagaaacggccgtggcgcgacggcaccggccgccattctggcgctgagccagctcctcctcctcctcctcgccacccactcggccgcgtgcggcgggtactcgccgtgccccaagccaccgcccacgccggcgccgtgcccgccgaccccgagggcgcccacgcccagcggcggcgcgggcggcagcaggtgcccggtgaacgcgctgaagctgggcgcgtgcgcgagcgtgctgggcgggctgctgagcctggagctgggccaggagcagcagcagcaaggctcgtcgtcgccgtccggttccacttccaccacgcagccgtgctgccacctcctgggcgggctggccgacctggacgcggccgtgtgcctgtgcacggcgctgcgcgccaacgtactgggcgtcgtccagctcagcctccccgtcgagctcagcgtcctcgtcaactcctgcggcaagaagctcccgcagggcttccagtgctcgacctgatcgagagcactctccatgcgtgcacgagcgcatgcagagcaactgggcctcaatttgctagtaggtgaacgctgttaatttgggcctgttcggtggcctcttgttgtgtgtagttgtgtcgtgactcgtgacaatcctgtgctgctatggtgttggtacgttcgctctgggctatcgggagtaggaaatcgtgttgactgttgctaatctgttgtaagattgtgatcattaattatgcaactcgtttctgtattctaaacgttcaaaaaaaaaaaaaaaaaaaa

SEQ ID NO: 1324 - protein, 169 aa, Panicum virgatum
  misc_feature: Ceres CLONE 1763639
  misc_feature (1)..(83): Pfam Name: Tryp_alpha_amyl Pfam Description: Protease inhibitor/seed storage/LTP family
MAVAARRNGRGATAPAAILALSQLLLLLLATHSAACGGYSPCPKPPPTPAPCPPTPRAPTPSGGAGGSRCPVNALKLGACASVLGGLLSLELGQEQQQQGSSSPSGSTSTTQPCCHLLGGLADLDAAVCLCTALRANVLGVVQLSLPVELSVLVNSCGKKLPQGFQCST

SEQ ID NO: 1325 - DNA, 1097 bp, Panicum virgatum
  misc_feature: Ceres CLONE 1763648
  misc_feature: Encodes the peptide sequence at SEQ ID NO. 1326
actcgcccagacgagacgacagccaccgcgatggcgcagatcatcgacggcaaggccatcgccgctgacatccgcggcgaggtcgcggccgaggtcgccgcgctttcctccgcccacaacgtcgtgcccgggctggcggtggtgatcgtggggagcaggaaggactcgcagacgtacgtgagcatgaagcgcaaggcctgcgccgaggtcggcatccgctccgtccacgtcgacctccccgaggacatctccgagctcgcgctcgtcgccgaggtccaccgcctcaacgccgaccccgccgtgcacggcatccttgtgcagcttccattgccgaagcatatcaacgaagagaagatattgagtgagatcagcatcgagaaagatgtcgatggtttccatcctctcaatattggcaaacttgcaatgaaaggcagggagccactttttgtaccatgtacaccaaagggatgcatggagctcttgtcacggagcggagttaccgttaaagggaagcgagctgttgtggttggccgcagcaacatagtcgggctaccagtatccctgctccttctgaaggcagatgcgacggtatcaattgtgcactcacggacccctgatccggaaagcattgtccgtgaagctgacattgtcattgcagcagctgggcaggctatgatgatcaaaggggactggatcaagccaggcgctgcagttatcgatgttgggacgaactcggttgacgaccctaccaggaagtctgggtaccggcttgtcggtgatgttgattttgcagaggtgagcaaggtcgctggttacctgacgccagtcccaggaggtgttggcccaatgacggtggctatgcttctgaagaacacggtggatggcgcaaagcgaggaattgtcgagtaggagggatttcatctcattttcatgtgctgtacgatctgtgtattgcaaggatgggaactggctcaaaaagtgtgttgatgtaacggcttgttcccattttggttgtttcaacttgccatcaataagaacagtagttatcctgtttaataaatgcggtaaaaatgatttaaaaaaaaaaaaaaaaaaaa

SEQ ID NO: 1326 - protein, 292 aa, Panicum virgatum
  misc_feature: Ceres CLONE 1763648
  misc_feature (1)..(168): Pfam Name: THF_DHG_CYH_C Pfam Description: Tetrahydrofolate dehydrogenase/cyclohydrolase, NAD(P)-binding domain
  misc_feature (1)..(288): SWISSPROT Homolog: EC 1.5.1.5 Bifunctional protein folD [ Includes: Methylenetetrahydrofolate dehydrogenase
MAQIIDGKAIAADIRGEVAAEVAALSSAHNVVPGLAVVIVGSRKDSQTYVSMKRKACAEVGIRSVHVDLPEDISELALVAEVHRLNADPAVHGILVQLPLPKHINEEKILSEISIEKDVDGFHPLNIGKLAMKGREPLFVPCTPKGCMELLSRSGVTVKGKRAVVVGRSNIVGLPVSLLLLKADATVSIVHSRTPDPESIVREADIVIAAAGQAMMIKGDWIKPGAAVIDVGTNSVDDPTRKSGYRLVGDVDFAEVSKVAGYLTPVPGGVGPMTVAMLLKNTVDGAKRGIVE

SEQ ID NO: 1327 - DNA, 714 bp, Panicum virgatum
  misc_feature: Ceres CLONE 1763711
  misc_feature: Encodes the peptide sequence at SEQ ID NO. 1328
gccaagcaagcagcagcacaagtaatcccattgtcactctgatctcgcatacacttgaaggttcccaccagttaaaattccttcttccatccatggcggaggagaagcaccaccaccacctcttccaccacaagaaagatgaggaggagcagcccgccggcgggtacggcgaggccgccgccgagtacacggagaccaccgtgacggaggtggtgtccaccggcgaggacgaggacgagaggtacaagaaggaggagaaggagcacaagcacaagcagcacctcggcgaggccggcgccatcgccgccggcgctttcgctctgtatgagaagcacgaggcgaagaaggaccccgagcacgcgcaccggcacaagatcgaggaggagatcgcggcggcggcggccgtgggctccggcggctacgccttccacgagcaccacgagaaggaccacaaggacgccgaggaggccagcggcgagacaatactagaataagtgccataggcaccggttgagattgccctttggtaccggtttcttgaaccggtacctcgaaagtggtaccaatggctcgagcctttggtatcgggtaaaataaccggtatctaaggcttctaaaatgagacaaaatattctttcgctgcttttttaccatctcaactacacagcagttcggattgaaaaggagatattttccttttaaagtaactcacgg

SEQ ID NO: 1328 - protein, 133 aa, Panicum virgatum
  misc_feature: Ceres CLONE 1763711
  misc_feature (1)..(54): Pfam Name: ABA_WDS Pfam Description: ABA/WDS induced protein
MAEEKHHHHLFHHKKDEEEQPAGGYGEAAAEYTETTVTEVVSTGEDEDERYKKEEKEHKHKQHLGEAGAIAAGAFALYEKHEAKKDPEHAHRHKIEEEIAAAAAVGSGGYAFHEHHEKDHKDAEEASGETILE

SEQ ID NO: 1329 - DNA, 619 bp, Panicum virgatum
  misc_feature: Ceres CLONE 1763757
  misc_feature: Encodes the peptide sequence at SEQ ID NO. 1330
aagcaagtaagcaagcacacctactacttaaagcatcttataagaagctcgatcttctcgctcgcctacattttgttcctcaactctttcaacttccccgtagaagatcaccttcctgctcgatggaccgggtgacgaagctgacttctcagcgtgcggtggtgatcttcagcatgagctcctgctgcatgtgccacacggtgacgcgcctgttccgcgagctcggggtgaacccgacggtggtggagctagacgaggaccagcgggggaaggagatggagaaggcgctggcgaggctgctgggccgcagccccgccgtgccggcggtgttcatcggtggcaggctcgtcggctccaccgacaaggtcatgtcgctccaccttggcggcaacctcgtcccgctgctgcgcaatgccggcgcgctctgggtataacctggcgacggctgctctgagtcacctcacacactggaataactgtcgtgtgtgctttttatcaggagacggaggaaagtaactgagcaggccttttttctgcactgtaataatttatagaaggggtgagtgttggatcagggtctttcgtgctgtatcgatgcatattttgatatgttctgcct

SEQ ID NO: 1330 - protein, 103 aa, Panicum virgatum
  misc_feature: Ceres CLONE 1763757
  misc_feature (1)..(64): Pfam Name: Glutaredoxin Pfam Description: Glutaredoxin
MDRVTKLTSQRAVVIFSMSSCCMCHTVTRLFRELGVNPTVVELDEDQRGKEMEKALARLLGRSPAVPAVFIGGRLVGSTDKVMSLHLGGNLVPLLRNAGALWV

SEQ ID NO: 1331 - DNA, 545 bp, Panicum virgatum
  misc_feature: Ceres CLONE 1763847
  misc_feature: Encodes the peptide sequence at SEQ ID NO. 1332
aagcctacaaccacccctcggcaaaccggcaggtagcgcgcgccatggacgacgccacgcggcggcttccggcggagaagggctccgtcgccaaggcgggcgagctggacccgccgctgcaagccatcggcttcgaggtcgaggagctctccccgtcccggatcaccggccgcctcctcgtcacgcccacctgctgccagcccttcaaggtgctgcacggcggcgtgtcggcgctggtggcggagtcgctggcgagcatgggcgcccacatggcctcgggctaccgccgcgtcgccggggtgcagctcagcatcaaccacttccgcagcgccgcgctcggcgacaccgtcctcgcgcgggccgtccccgtccacctcggccgctccacccaggtgtgggaggtgaagctctggaagatggatccatcgacaggagagaagggccctcagatcgctgagtccagagtcactctgctgtgcaacctgccgttgccggaggaacacaagaacgctggagatgctctgaggaaatactcaaaactgtag

SEQ ID NO: 1332 - protein, 166 aa, Panicum virgatum
  misc_feature: Ceres CLONE 1763847
  misc_feature (1)..(78): Pfam Name: 4HBT Pfam Description: Thioesterase superfamily
MDDATRRLPAEKGSVAKAGELDPPLQAIGFEVEELSPSRITGRLLVTPTCCQPFKVLHGGVSALVAESLASMGAHMASGYRRVAGVQLSINHFRSAALGDTVLARAVPVHLGRSTQVWEVKLWKMDPSTGEKGPQIAESRVTLLCNLPLPEEHKNAGDALRKYSKL

SEQ ID NO: 1333 - DNA, 985 bp, Panicum virgatum
  misc_feature: Ceres CLONE 1763858
  misc_feature: Encodes the peptide sequence at SEQ ID NO. 1334
gtagagtctaattctcacacttagaaactagaatcattctagaaacatattttacctgaatacactaatttgcctaaggaaatgtttaaaagcttttgaagtggtcttagttgggtcttattttttatgcgcagatagcaaattcggtaaatgaagggaggcttgtgcccgaggacatcatatttggattgctgacgaagcggcttgaggagggatacaacaagggtgaaactggattcattcttgatgggataccacgcacccgtatgcaagctgagattcttgatgagattgtggacattgatttggttctgaatttcaaatgtgctgatgactgtttcatgaagaagcggtcaaggggcgatatatgttcccactgtggtcagctttttgatgtcagcaagtcagcatctacgaactgtagcccttgtgttgggagctatacatggcattctcaggtagagcctgcaagtgttctaggcctcgaagactcaaggttggagaggatgcgtacttatgctaagcagaccaagctactggaagattactacaagcaacagagaaaaattgtggaactgaagacatcggctcgccctggggaaacatggcaggggcttgtagccgccctgcacctccagcatctggatgcacccccaacaccacacaaactcaccgtgtaaatattattcgtgctacgtctgagtagagtctaagggtctgaatttcgatcctgcctgcagcatatctaatatccctatgtttgtgggttctggctccagagggagtcagtcggctatgttgttttttgttgttgttactatagataaaatgtaagcgattttgcagacgcgcttatatggctgtaaccgagagttttggacttccaagtgcaagcgtactcgcttatgtggctccatggtgctgatgttttgcacctgttttatattatcatgctcctttagtccaaaaaaaaaaaaaaaaaaaa

SEQ ID NO: 1334 - protein, 137 aa, Panicum virgatum
  misc_feature: Ceres CLONE 1763858
  misc_feature (89)..(188): Pfam Name: ADK Pfam Description: Adenylate kinase
MQAEILDEIVDIDLVLNFKCADDCFMKKRSRGDICSHCGQLFDVSKSASTNCSPCVGSYTWHSQVEPASVLGLEDSRLERMRTYAKQTKLLEDYYKQQRKIVELKTSARPGETWQGLVAALHLQHLDAPPTPHKLTV

SEQ ID NO: 1335 - DNA, 688 bp, Panicum virgatum
  misc_feature: Ceres CLONE 1763946
  misc_feature: Encodes the peptide sequence at SEQ ID NO. 1336
aaatatctcgccccgtcagcagcttcacgcacagcacagggagaaaaaggccggctagcgatggctgccaaggccgtctccttcctggtgctcgcgctcctgctcctcgccgtcgcggcgttccccgtggtggtcgtggccggcggcggcaacggcaaagggtacgggtacgggtacgggaacgggaacgggaacggcggcggcggcaacctgaagccgtgggagtgctcgcccaagtgcgcgtcgcggtgctccaacacgcagtacaagaaggcctgcctcaccttctgcaacaagtgctgcgccaagtgcctctgcgtgcccccggggttctacggcaacaagggcgcctgcccctgctacaacaactggaagaccaaggagggagggcccaagtgcccctagatcagatcagatcccggccgccattgttcctgctcctcctccggtggccgctgctgtcaagatccaccggcttacttacttactgatgatcccggcactgttcgtgctctgttctccccctagctgctaggtgtgctagtgatgcactggttgctgaatctggggatgctattccgagcagatctggatggcgtatcatgtgcttagtgcaactgttggtgaggcatgaggcgagtttcagtgggagtgtcatcgacacagttatctagattgaaatcttatg

SEQ ID NO: 1336 - protein, 114 aa, Panicum virgatum
  misc_feature: Ceres CLONE 1763946
  misc_feature (6)..(109): Pfam Name: GASA Pfam Description: Gibberellin regulated protein
MAAKAVSFLVLALLLLAVAAFPVVVVAGGGNGKGYGYGYGNGNGNGGGGNLKPWECSPKCASRCSNTQYKKACLTFCNKCCAKCLCVPPGFYGNKGACPCYNNWKTKEGGPKCP

SEQ ID NO: 1337 - DNA, 980 bp, Panicum virgatum
  misc_feature: Ceres CLONE 1763963
  misc_feature: Encodes the peptide sequence at SEQ ID NO. 1338
acgagcacctctgtggctctgtctcgactctcaagacttctctccgcagcctcagatgatactcccctgccgcagacgctgacacgcacatttcccatggcggcagccacggcctcgcgccccctcacgcccctcctccaccggcaccagccgcgcagccggcggcgcgcgagcgccatcgtcgttgccgccgcgagcacgccggacgccgagccgacggccgcagccggtgcggggcaggagaagaagaagacggtggatacgaggatacactggtccgacccggacgaagggtggatcggtggcaaggccaagaaggacggcgctggcggccgcggcaagaacgagccgctgggagggaggttcgccgacctcatcaacgccgcgtccgagtctcactaccagttcctggggataacgccggaggcggacatcgaggagatcaaggcagcgtaccggcggctgtccaaggagtaccacccagacacgacgactctacaactcaaggtggcgtcggagaagttcatccgcctccgggaggtgtacaacgtgctgagcaaggaggaaagccggcggttctacgactggacgctggcgcaggaggccgagagccggcggctgcagcagctcaggtccaggctcgaggacccctacgagcaggacatccagaactacgagtccgtgccagacatggtcgaccgcctcggcggcaggaacatgaagctcagcgaccaggccatgaccgcgctcaccattgatttcgtcatcatcattatctccgtcatctgcatcatctacgctgtgttcaaggagcagtactgacagcagcaaggttgaaggagtgtaccatatacagaacagtattcctaggtaaattaactgataatacctcaagactgtctttacagatgttatatacagtgtcatcttgttttgtcaaatagaacaagatagcaacaaataattcatggtattgtgtc

SEQ ID NO: 1338 - protein, 241 aa, Panicum virgatum
  misc_feature: Ceres CLONE 1763963
  misc_feature (1)..(64): Pfam Name: DnaJ Pfam Description: DnaJ domain
MAAATASRPLTPLLHRHQPRSRRRASAIVVAAASTPDAEPTAAAGAGQEKKKTVDTRIHWSDPDEGWIGGKAKKDGAGGRGKNEPLGGRFADLINAASESHYQFLGITPEADIEEIKAAYRRLSKEYHPDTTTLQLKVASEKFIRLREVYNVLSKEESRRFYDWTLAQEAESRRLQQLRSRLEDPYEQDIQNYESVPDMVDRLGGRNMKLSDQAMTALTIDFVIIIISVICIIYAVFKEQY

SEQ ID NO: 1339 - DNA, 757 bp, Panicum virgatum
  misc_feature: Ceres CLONE 1764004
  misc_feature: Encodes the peptide sequence at SEQ ID NO. 1340
ccccaaccctagccgccgcgccgccgccgcttctcctcctcgcttgaaggagcttgtgaagggtccatcagactgagaagatggttcttaagactgaactttgccgttttagtggccagaagatatatccagggaagggtattaggttcattcgtgctgattcccaggttttcctttttgctaactcaaaatgcaagcgttacttccacaaccgcctgaagcctgcgaagcttacctggacagctatgtacaggaagcagcacaagaaggacattcatgctgaagctgtgaaaaagaggcgtcggaccaccaagaagccatactcacgctcaattgttggtaccactttggaagttattcaaaagaagagaagtgagaagcctgaagttcgtgatgctgctagggaggctgctctacgtgagataaaggagcgcattaagaagaccaaggatgagaagaaggccaagaaagcggaggtggcgaaatctcagaagacacaaaccaagggtgcagcaccgaaggttcctaagggccccaagattggtggtggcggtgggaagcgctgaatgcccattgcatcatagagatatagttctgtcaactagccttctctcccatcctatcttagacattggtcaaattagtctgctgtcttgagttttcacctttctgatgagattggtgtcctgaatgttttggattgtttcttgagttgatttaaattggcacttatgtcgaaaaaaaaaaaaaaaaaaaa

SEQ ID NO: 1340 - protein, 161 aa, Panicum virgatum
  misc_feature: Ceres CLONE 1764004
  misc_feature: Great-hit functional homolog of the protein sequence encoded by LOCUS At2g36620
  misc_feature: Useful for making plants with modulated nitrogen use efficiency
MVLKTELCRFSGQKIYPGKGIRFIRADSQVFLFANSKCKRYFHNRLKPAKLTWTAMYRKQHKKDIHAEAVKKRRRTTKKPYSRSIVGTTLEVIQKKRSEKPEVRDAAREAALREIKERIKKTKDEKKAKKAEVAKSQKTQTKGAAPKVPKGPKIGGGGGKR

SEQ ID NO: 1341 - DNA, 573 bp, Panicum virgatum
  misc_feature: Ceres CLONE 1764036
  misc_feature: Encodes the peptide sequence at SEQ ID NO. 1342
atcggagtaaggcgaggcgacgacggcgcgatgagctaccagaaggtcccggagtcctacccgccgccagggtactcgcagccgtacccgccgccgggcactcagtatccgcctccccaggctccaccgcaggggccttactacccgccgcagcagcagccacctccggggtaccagggctacttcaacgacgggcagcagctctacggatatccgccaccgcatggtggacatcaccaccacggccaccaccatcactatgatgaccaccatcatcaccaccatcaccatggtcaccaccatcaccacgaggaggatgactgctgcctcggcttcctgaaaggatggttggccgctatttgctgctgctgcatactggacgagtgctgtttctgacatatatgcctttgaagcctccttgtgtctggcatcctgcgacagcaaaatttctctctgtatttaacttgctatgattgttggacagtataaaagtgaaccttggttgtgttactcttcgtaaataagttggttgtcgatttctgttatggtaatataaaggtgttcatacaaatt

SEQ ID NO: 1342 - protein, 121 aa, Panicum virgatum
  misc_feature: Ceres CLONE 1764036
  misc_feature (45)..(70): Pfam Name: HATPase_c Pfam Description: Histidine kinase-, DNA gyrase B-, and HSP90-like ATPase
  misc_feature (121)..(147): Pfam Name: Cation_efflux Pfam Description: Cation efflux family
MSYQKVPESYPPPGYSQPYPPPGTQYPPPQAPPQGPYYPPQQQPPPGYQGYFNDGQQLYGYPPPHGGHHHHGHHHHYDDHHHHHHHHGHHHHHEEDDCCLGFLKGWLAAICCCCILDECCF

SEQ ID NO: 1343 - DNA, 696 bp, Panicum virgatum
  misc_feature: Ceres CLONE 1764095
  misc_feature: Encodes the peptide sequence at SEQ ID NO. 1344
aaacctttcccttctcttggacagcgatcactcgactgggcgagcggcggcgccctctgtcacgtcttcccccagctctttgccggcgaccagcgcatcctccagcttcaagcggaaggcgccgcttcttcaagatgcccaggtccacgagcgatgcaaagcttctgatccagtccctgagcaaggcgtatgctgccccaccaacaaatcttaagattatcgacctgtatgtcatttgtgctgtcgctaccgccgtgattcaggttgcatacatgggattggttgggtcattccctttcaactccttcctctcaggtgtcctttcatgcataggaactgcagtacttgctgtttgcctccgcattcaagtgaacaaagacaacaaggaatttaaggatcttcccccagaaagggcctttgctgacttcgttctgtgcaacctggtgctccacctggtgatcatgaacttccttggataagcaaccgctgtacaccgagtggttaagattttgtagagacagcagagggcatgtcgcatgtgccatagaagtagagcgaaatcaaacgtagagatagtaaaatcgagtaaaatgcactgagagtccttaaactagttgacctgttctgtttaggtccataaatttcgaaagtgcatttttaggtctacgatctatttaagtgtgtcaattgaggtcc

SEQ ID NO: 1344 - protein, 114 aa, Panicum virgatum
  misc_feature: Ceres CLONE 1764095
  misc_feature: Great-hit functional homolog of the protein sequence given in SEQ ID NO 9749
  misc_feature (1)..(114): SWISSPROT Homolog: EC 2.4.1.119 Dolichyl- diphosphooligosaccharide--protein glycosyltransferase subunit DAD1
  misc_feature: Useful for making plants with modulated flowering time
  misc_feature: The plant flowers significantly late compared to wild-type.
MPRSTSDAKLLIQSLSKAYAAPPTNLKIIDLYVICAVATAVIQVAYMGLVGSFPFNSFLSGVLSCIGTAVLAVCLRIQVNKDNKEFKDLPPERAFADFVLCNLVLHLVIMNFLG

SEQ ID NO: 1345 - DNA, 660 bp, Panicum virgatum
  misc_feature: Ceres CLONE 1764132
  misc_feature: Encodes the peptide sequence at SEQ ID NO. 1346
agcgtttcagccgccgccgccgccgcgccccgagcagagacagagagggagggggagagagaggtcgacgccatggtgcagcggctcacgtaccgaaagcggcacagctacgccaccaagtccaaccagaccagggtcgtcaagaccccaggagggaggctcgtgtaccagtacaccaaaaagagggcgagcgggcccaagtgcccggtcaccggcaagaagatccaggggatacctcacctaaggcctgctgagtacaagagatccagattatccaggaacaggaggaccgtgaaccgtccttatggtggtgttctgtctggtcaggctgttagggaaaggatcatccgcgctttcctggttgaggagcaaaagatcgtgaagaaggttctaaagatccaaaagaccaaggagaagacaacttcaaaatgaggcagccaaagctctctacacccttgaggactttttggaggacgatggtgatggatgtttagtaaaaaaatctctatctgtatgctaggctggtggtttctgaatttgaatctagctagagattgcgatcaattttccatgttgtcgagttggaagtctagacatcttccatgttccttgtggttggctactctaaattatatatccacagattttctctgtctgggc

SEQ ID NO: 1346 - protein, 119 aa, Panicum virgatum
  misc_feature: Ceres CLONE 1764132
  misc_feature: Great-hit functional homolog of the protein sequence given in SEQ ID NO 9667
  misc_feature: Useful for making plants with modulated nitrogen use efficiency
MVQRLTYRKRHSYATKSNQTRVVKTPGGRLVYQYTKKRASGPKCPVTGKKIQGIPHLRPAEYKRSRLSRNRRTVNRPYGGVLSGQAVRERIIRAFLVEEQKIVKKVLKIQKTKEKTTSK

SEQ ID NO: 1347 - DNA, 770 bp, Panicum virgatum
  misc_feature: Ceres CLONE 1764148
  misc_feature: Encodes the peptide sequence at SEQ ID NO. 1348
agacagctcagctccatgattttcacaggcaaacacctaacagcagctcgctgcctgccagtacactgaggcacctgaggcacctcattcagctgatagagggccgagtgatcgagcgttaggtcgcaatgaaggggagcaaggtccacgagcacgaggccgacgtccccgcctccgacctgtgggcgatctacggcacgctccgcgccgccgagctgttaccggagctgcttccgcacgtcctggccaaggtcgaagttgtcagtggcgacggcggcgtcggtaccatcttgcagctgacgttcccccctggtttgcctggcctggagagttacaaggagaagttcaccaaggttgacgacgagagttacatcaaggaggcgcaggcgatcgatggcgacatcctgaagctggggttcctctcctatatggtacggttcgaggtcatcgcaaaggggcccgactcgtcagtgatacgaacgactgtcgagtacgagattgatgatgcgcacccggagctcgaagcgatggtgagcatcgcgcctttggctgcgaccgccgagaaattctccgaatatgccaaggagaagaaggtcatcactcaggcagcctcttgattggagctcaagagcaaatcttatcatcacgaaagacaaatggtctactacaattgcggcgtgtgtttctattttgcatatcgagtgtggctgtgaacgcaaattcatccggatcgaacaaatcacagatgcttcatctaatttgttcaccac

SEQ ID NO: 1348 - protein, 162 aa, Panicum virgatum
  misc_feature: Ceres CLONE 1764148
  misc_feature (1)..(142): Pfam Name: Bet_v_I Pfam Description: Pathogenesis-related protein Bet v I family
MKGSKVHEHEADVPASDLWAIYGTLRAAELLPELLPHVLAKVEVVSGDGGVGTILQLTFPPGLPGLESYKEKFTKVDDESYIKEAQAIDGDILKLGFLSYMVRFEVIAKGPDSSVIRTTVEYEIDDAHPELEAMVSIAPLAATAEKFSEYAKEKKVITQAAS

SEQ ID NO: 1349 - DNA, 1010 bp, Panicum virgatum
  misc_feature: Ceres CLONE 1764173
  misc_feature: Encodes the peptide sequence at SEQ ID NO. 1350
ctgctagccaactcggcgtttcttcctctccgcggctccgggcgctttgttcctctcggcggccggcttcggcgatggcggccgtcggctccgcagtgcggcagatctacctggctgtctacaattggatcgtcttcaccggatgggtgcaggtgctgtgctacgcgattttggcgctgtgggagagcggccatgaggctgtctacggcgctgtcgagcggccgctgcagttcgcgcaaacagctgccatcatggagattctacatggacttgtaggtcttgtgaggtctccaatctctgcaactcttccacaaattggatcaaggttgttccttacatggggcatcttgtggagttttcctgagactcgctctaatattcttgttacttcattggtcataagttggtccattactgagatcattcgatactctttctttggtatgaaggagacatttggattcgcaccttcatggctattgtggctaaggtatagcacttttatggtattataccctactggtatctcgagcgaggtgcgtctaatttttgctgctctacctcatatgatggcatctcagaaatattgtctaaggttgccaaacaaatggaatttctcttacgattacttgtatacatctattcttgctctcgcggtttacattccaggaagtccgcatatgtttaaatatatgctttcccagcgtaagaaggcattgtcgaagtcaaaaaccgtgtaatgttgctccatggcccagcacatgtgtcatctctcaaagttccccattagtatttttaaaacttttccagcagaagttagtgaaatggggaatggcactcttacgtgattgcccaaaagtatgttgtaccttaaaatatctgcttttatttggtcattattagaattattggcccaaatcgcccagcatggacattatgacattacaatatgatatggctacatactgtaacttaaatttgtgattttccaaaaaaaaaaaaaaaaaaaa

SEQ ID NO: 1350 - protein, 221 aa, Panicum virgatum
  misc_feature: Ceres CLONE 1764173
  misc_feature: Great-hit functional homolog of the protein sequence given in SEQ ID NO 9475
  misc_feature (1)..(165): Pfam Name: PTPLA Pfam Description: Protein tyrosine phosphatase-like protein, PTPLA
  misc_feature: Useful for making plants with modulated drought sensitivity
MAAVGSAVRQIYLAVYNWIVFTGWVQVLCYAILALWESGHEAVYGAVERPLQFAQTAAIMEILHGLVGLVRSPISATLPQIGSRLFLTWGILWSFPETRSNILVTSLVISWSITEIIRYSFFGMKETFGFAPSWLLWLRYSTFMVLYPTGISSEVRLIFAALPHMMASQKYCLRLPNKWNFSYDYLYTSILALAVYIPGSPHMFKYMLSQRKKALSKSKTV

SEQ ID NO: 1351 - DNA, 695 bp, Panicum virgatum
  misc_feature: Ceres CLONE 1764174
  misc_feature: Encodes the peptide sequence at SEQ ID NO. 1352
gcagcagcagcatctagctagcataatcaaactgagtttgcattagtggttaactcgagagaaaatcatcaacaatgacaatgaggccgctcgttgtgctcggtctggtccttgtggtcgcagcaggggtggcgctggacggcgccgacggcgccggggagtgcgggagggcctccgccgaccgggtggcgctgcggctggcgccgtgcatctcggcggccgacgacccgcagtcgacgccgacgagcagctgctgctcggccgtgcacgccatcgggcagagccccagctgcctctgcgccgtcatgctgtccggcaccgccagggccgccgggatcaagccggaggtcgccattaccatcccgaagcgctgcaacatggccgatcgccccgtcggctacaagtgcggagactacacgctgccctgacgacctcgtgagagaggccgccgcgctggtgattatgaaagagatggacgccaaggaaggctttgtgttggaataatcgagtccgcgcgaaccatgaacgtggacgaggggctccagccctatcacactgtgactgtgtgtgcttctcgtactagtactgtgtgttcaacttcgtctaaaattaataagaatggacgtgttgcttgtcaagaccattattggcccattaataaaaatggtgttgggttgaagaggcccatgaaaccc

SEQ ID NO: 1352 - protein, 117 aa, Panicum virgatum
  misc_feature: Ceres CLONE 1764174
  misc_feature (1)..(82): Pfam Name: Tryp_alpha_amyl Pfam Description: Protease inhibitor/seed storage/LTP family
MTMRPLVVLGLVLVVAAGVALDGADGAGECGRASADRVALRLAPCISAADDPQSTPTSSCCSAVHAIGQSPSCLCAVMLSGTARAAGIKPEVAITIPKRCNMADRPVGYKCGDYTLP

SEQ ID NO: 1353 - DNA, 916 bp, Panicum virgatum
  misc_feature: Ceres CLONE 1764204
  misc_feature: Encodes the peptide sequence at SEQ ID NO. 1354
atcctagctacctcacccgagaagcaccgtagcgcgccatggccactctcttgggcagctcgccggcgttcctcgcccgccccgtcgccaagccgcacagcatctcctgcgcgcaggccccgcgcccgcccagcgcccagaaccagcctccgcccggcgagcagcagcagcagtccgtgcaggcgcagccgcagccggcggcgaggccgaagcgcgcgggcggcgcggactccacggactgggtggcctcgtcgctgacgcggcggttcgggatcggcgccgggctggcgtgggcggggttactggccgtcggcgtcgtgtccgagcagctcaagacccgcttcgaggtcgcgcagcagcaggccaacaccaaggacgtggagcaggagcaggaggtcgtgctccccaacgggatccggtactacgagctgcgcgtcggcggcggcgacgccccgcgccccggcgacctggtggtgatcgacctgcagggccgggtggccggcggcggggaggcgttcgtggacacgttcggcgagggcaagcgaccgctggcgctggtgatggggtcccggccctacaccaggggcatgtgcgagggcgtcgagtacgcgctgcgcaccatgagggccggcggcaagcggcgggtggtcgtgccgccggggctcgggttcggcgacgacggcgccgacttcggggaggagcacgtgcagataccgcccggcgccacgctcgagtacgtcgtgcaggtcgacaaggtgtccatcacgccggcgtgaggcacgactgaggggcgagttgatacatcacagttcttttaaagccatgagacgagtttctactcgattgtgaacttcacactgctatctcgttaaatgaattgtttttgggaaattttcaaaaaaaaaaaaaaaaaaaa

SEQ ID NO: 1354 - protein, 245 aa, Panicum virgatum
  misc_feature: Ceres CLONE 1764204
  misc_feature (1)..(104): Pfam Name: FKBP_C Pfam Description: FKBP-type peptidyl-prolyl cis-trans isomerase
MATLLGSSPAFLARPVAKPHSISCAQAPRPPSAQNQPPPGEQQQQSVQAQPQPAARPKRAGGADSTDWVASSLTRRFGIGAGLAWAGLLAVGVVSEQLKTRFEVAQQQANTKDVEQEQEVVLPNGIRYYELRVGGGDAPRPGDLVVIDLQGRVAGGGEAFVDTFGEGKRPLALVMGSRPYTRGMCEGVEYALRTMRAGGKRRVVVPPGLGFGDDGADFGEEHVQIPPGATLEYVVQVDKVSITPA

SEQ ID NO: 1355 - DNA, 868 bp, Panicum virgatum
  misc_feature: Ceres CLONE 1764207
  misc_feature: Encodes the peptide sequence at SEQ ID NO. 1356
aggcactaaggcacaggcacagccacccgcccgagcccgagcaggcgagcacactcgactcgacggacgactcctactccgagcatggaagccgcggcggtcaagcccgtcctccgcgtcgccgccatctgcggctccctccgcaaggcctccttcaaccgcggcctcctccgcgccgccgcggaggtgtgcgaggactccatccccggcctgcgcgtccaccacctcgacatctccgacctgcccatcatcaacaccgacctcgagaccgacgccggcttcccgcccgccgtcgaggccttccgcgccaacgtctcccaggccgactgcttcctcttcgccgcgcccgagtacaactactccatctcaacccccctgaagaacgcacttgactgggcatctagaggaaagaactgttgggcagacaaacctgctgcgattgtcagtgcaggaggtggctttggaggagggagatcacaataccatctccgccaggttggagtgttcttggatcttcatttcatcaacaagccggaactattcgtccaagcatttcagcagccgccgaagtttgatagtgatggaaatctgattgacgatcaaatcagagagaggctgaagcaagtgctcttatctcttcaggccttcacactcaggctccagaaggactgaatcaactcaggaccattgcagtccatgcttgcctgaagaagtgtttataattcctgtttattacataccatgattgggattggcacctgtaattcatcgtggacagcctgaaagttgtaataaatccctgtagaaatattctcctgtttgcagattatttaagatttgatcacatcaaaaaaaaaaaaaaaaaaaa

SEQ ID NO: 1356 - protein, 195 aa, Panicum virgatum
  misc_feature: Ceres CLONE 1764207
  misc_feature (1)..(168): Pfam Name: FMN_red Pfam Description: NADPH-dependent FMN reductase
  misc_feature (1)..(193): SWISSPROT Homolog: EC 1.6.5.2 NADPH:quinone oxidoreductase
  misc_feature (5)..(193): SWISSPROT Homolog: EC 1.6.5.2 NAD(P)H:quinone oxidoreductase
MEAAAVKPVLRVAAICGSLRKASFNRGLLRAAAEVCEDSIPGLRVHHLDISDLPIINTDLETDAGFPPAVEAFRANVSQADCFLFAAPEYNYSISTPLKNALDWASRGKNCWADKPAAIVSAGGGFGGGRSQYHLRQVGVFLDLHFINKPELFVQAFQQPPKFDSDGNLIDDQIRERLKQVLLSLQAFTLRLQKD

SEQ ID NO: 1357 - DNA, 667 bp, Panicum virgatum
  misc_feature: Ceres CLONE 1764224
  misc_feature: Encodes the peptide sequence at SEQ ID NO. 1358
agtacgctaccagcccaaccaccccgccgacccgaccgtctcttccagtctcctcgcgagtttccttcaacctcccgtcctcttcgatccgtgcgccatggcgcccaaggcggagaagaagccggccgagaagaagcccgcggaggagaaggccgagaaggcccccaaggcggagaagaagcccaaggccgagaagcggctgccggcgtccaaggagggcggcgacaagaagggcaagaagaaggccaagaagagcgtcaagacctacaagatctacatcttcaaggtgctaaagcaggtgcacccggacatcggcatctcctccaaggccatgtcgattatgaactcgttcatcaacgacatcttcgagaagctcgcgcaggaggctgcgcgcctcgccaggtacaacaagaagcccaccatcacgtcgcgcgagatccagacctcggtccgcctcgtcctccccggcgagctcgcgaagcacgccgtctccgagggcaccaaggccgtcaccaagttcacctcctcctagattgctagatgatgcgccccctttgaccttgtctgttcttcgcctctttcccctagttaggggtcgaggattagtttgtaattgatgatgctggtttacgaaacgatgaaatgaattggcaatgccacgtttggt

SEQ ID NO: 1358 - protein, 144 aa, Panicum virgatum
  misc_feature: Ceres CLONE 1764224
  misc_feature: Great-hit functional homolog of the protein sequence given in SEQ ID NO 9491
  misc_feature: Useful for biocontainment applications
  misc_feature: Useful for making plants with modulated flowering time
  misc_feature: No seed is being produced by the plant
  misc_feature: The plant flowers significantly late compared to wild-type.
MAPKAEKKPAEKKPAEEKAEKAPKAEKKPKAEKRLPASKEGGDKKGKKKAKKSVKTYKIYIFKVLKQVHPDIGISSKAMSIMNSFINDIFEKLAQEAARLARYNKKPTITSREIQTSVRLVLPGELAKHAVSEGTKAVTKFTSS

SEQ ID NO: 1359 - DNA, 823 bp, Panicum virgatum
  misc_feature: Ceres CLONE 1764288
  misc_feature: Encodes the peptide sequence at SEQ ID NO. 1360
aaggtgcttccagttgcacctggacaagtgccctccgatccatccatttaagccctcggttctcgagtcttccacagactcgcgctcgctgctcgccttctcttccgacttctccactcgcgtcgcacgcagcggtcgcctgagatcacatagacaatggtgaaggctgtcgctgtcctcgctggcagtgatgtcaagggcaccatcttcttttcccaagagggagatggtccaaccaccgtgaccggaagtatctctgggctcaagccggggctccatgggttccatgtgcatgcgcttggtgacaccaccaatggctgcatgtccactgggccacacttcaatcctgctggtaaggagcatggtgcaccagaagatgagaatcgccatgccggtgatcttgggaatgtgacagctggtgaagatggtgttgctaatgtcgatattactgactgccagattcccctcactgggccacactcaatcattggccgagctgtagttgtccatgccgatcctgatgaccttggcaagggtggacatgagcttagcaagagcacgggaaatgctggtggccgtgttgcctgtggtatcattgggctccagggctaaatgctgtctttgttggcaaacattcacatctgagcacctccggtcttgctgcttcatttcccttatattggatacttaattggctacacttaataatcgcctgatcaatggtcagagcactattcccatcattccagtgtatgaacattgcacaactatcatttggctttagtgcgaagtggctgttttagaaaaaaaaaaaaaaaaaaaa

SEQ ID NO: 1360 - protein, 151 aa, Panicum virgatum
  misc_feature: Ceres CLONE 1764288
  misc_feature (1)..(150): Pfam Name: Sod_Cu Pfam Description: Copper/zinc superoxide dismutase (SODC)
  misc_feature (1)..(151): SWISSPROT Homolog: EC 1.15.1.1 Superoxide dismutase [Cu-Zn] 2
  misc_feature (1)..(151): SWISSPROT Homolog: EC 1.15.1.1 Superoxide dismutase [Cu-Zn] 4A
MVKAVAVLAGSDVKGTIFFSQEGDGPTTVTGSISGLKPGLHGFHVHALGDTTNGCMSTGPHFNPAGKEHGAPEDENRHAGDLGNVTAGEDGVANVDITDCQIPLTGPHSIIGRAVVVHADPDDLGKGGHELSKSTGNAGGRVACGIIGLQG

SEQ ID NO: 1361 - DNA, 918 bp, Panicum virgatum
  misc_feature: Ceres CLONE 1764303
  misc_feature: Encodes the peptide sequence at SEQ ID NO. 1362
atccattcgcaaagctccaacagcaatcaagctagcgagaagctacgacaagaagccagcaagcggcgagatcactcggatcaaagtgatccatggcgccgaggaggtcgacttcgccggccgggagcagcggcagcagcgggggcagcggcgcggagcagcagccgaggctgcgcggcgtgcggaagcggccgtggggccggtacgcggcggagatccgggaccccgtgcgcaaggcgcgcgtgtggctcagcaccttcgacacgcccgaggaggcggcgcgcgcctacgacgccgccgcgcgcaggctccgcgggcccggcgccgccaccaactaccccgcccagggcgcaaaggcaccggcggcgagcgcgagcgggagcatcgggttgtcggaggacgcgtcgtcatcctgctcctcccgggactcgccgcgggcggtgacggcgtccgtcgcggcgcccccgtcgctggacctgagcctggcgctcccggccatggcgaccacaccgtcgtcgcaccacatgttcatggacccggcctcgacgatggtggccgtggcgccggcgctgctgcagttcctgccgcccaagagcgaggaagagcagagcttgtcagggttgtcctcgtggtcgtcgtcggtggtgttcgacgcggcgccggccgtgggcctgggcctggacctcaacctggcgctgccggccgggatggtgatgtagagacggacaaatcgtttggtcaatttagctcataggctcctagctcactcaacgataggctgcagagatttgtttgtgcatcttcgcagccttcgtttctttactttctttgtactggcagattttgcgtctcgcaatgatgcgccaccgcaagaacgaagaaacttttttcccttgccaaaaaaaaaaaaaaaaaaaa

SEQ ID NO: 1362 - protein, 208 aa, Panicum virgatum
  misc_feature: Ceres CLONE 1764303
  misc_feature (1)..(60): Pfam Name: AP2 Pfam Description: AP2 domain
MAPRRSTSPAGSSGSSGGSGAEQQPRLRGVRKRPWGRYAAEIRDPVRKARVWLSTFDTPEEAARAYDAAARRLRGPGAATNYPAQGAKAPAASASGSIGLSEDASSSCSSRDSPRAVTASVAAPPSLDLSLALPAMATTPSSHHMFMDPASTMVAVAPALLQFLPPKSEEEQSLSGLSSWSSSVVFDAAPAVGLGLDLNLALPAGMVM

SEQ ID NO: 1363 - DNA, 685 bp, Panicum virgatum
  misc_feature: Ceres CLONE 1764351
  misc_feature: Encodes the peptide sequence at SEQ ID NO. 1364
tagcactcccccgccgccacctcccctccggcttcatcgaggcgaaaccctagcgcccgacctcctctccgcttcaccccactcagccatggcggcggcggacgtggcgtacgctccgccgatgaagtccggcaaggcggggttcgagggggcgatggagtcgcagcacaggatccgcatcactctctcctccaggaacgtcaagaacctcgagaaagtctgcggcgatctggtgaagggtgccaagggtaagctgctgaggttgaggggccccgtccggatgcccaccaaggtgctccacatcaccaccaggaagtctccctgtggcgaaggcaccaacacctgggatcgttttgagatgaggattcacaaaagggtgattgatctcgtcagcacaccagatgtggtcaagcagatcacctccatcaccatcgagcctggtgtggaggttgaggtgacaatcagtgacgcgtaatgtggtagccagcatcttatcgttttgaaggattggaaatgcaactgaacaggatgttttgagagtttctagcatgagaaaactctgtagcagaggaatcccctcctaatcgatagtttattcgcatcagaattgttgagcccatcgggattttgtggcatgctagtctgtttcagttgatgttatgcatgagtggaatgattaagggat

SEQ ID NO: 1364 - protein, 128 aa, Panicum virgatum
  misc_feature: Ceres CLONE 1764351
  misc_feature: Great-hit functional homolog of the protein sequence given in SEQ ID NO 9345
  misc_feature: Useful for making plants with modulated phosphate use efficiency
MAAADVAYAPPMKSGKAGFEGAMESQHRIRITLSSRNVKNLEKVCGDLVKGAKGKLLRLRGPVRMPTKVLHITTRKSPCGEGTNTWDRFEMRIHKRVIDLVSTPDVVKQITSITIEPGVEVEVTISDA

SEQ ID NO: 1365 - DNA, 1182 bp, Panicum virgatum
  misc_feature: Ceres CLONE 1764390
  misc_feature: Encodes the peptide sequence at SEQ ID NO. 1366
acagagcgatgccaccaacccacatacgagaagatggtttgatcgattaatcgagcgagggagaggcagagagggttgtcgagatcaccaaccggcggcgaggtgggggagagatgaccggggaaggaaacggagacgaagggtggaggcggagcggcatcgaggtcagcgccctgcagttcggctacgaagggcagccgccgctattcgcgcgattcaacctccgagtcgcccctggctcccgctgcctcctcgtcggcgccaatggatcaggcaagactacactcttgaagattcttgcgggaaagcatatggttgggggaagggatgtggtccgtgttctcaatggttcagcttttcatgacacacagttggtgtgcaatggtgacctttcgtacttggggggctcttggagccggactattggttcagctggcgatgttccgctgcaaggcgacttctctgctgagcacatgatttttggagttgacggggttgatcctgttaggcgagagaagctgattgatctgctagacattgatctgcaatggcgcatgcataaagtttcagatggacagcgccgcagggtgcaaatctgcatgggtcttcttcatccatacaaggtgcttttacttgatgaaatcaccgttgatctggatgttgtgaccagaatggatcttcttgacttctttaaggaagagtgcgaacagagagaagccaccattgtgtacgccacccatatattcgatggcctagagacatgggctacggacattacatatatccaggaaggcgaactgagaaaatcagcaaaatacatggacatcgaagagctgaagaatgccaaaaatttgttgaccgtcgttgagtcatggctccgatcagagaccaaactccccaagaaggatcctccacgttcagaggcccagcccaggcgctcctcgccgtttgatagttcccctttacgctcatcttgccacatggcatactaccgttgatgatttggcaaccctgcacttacttttgtacaactactagtagtcatatattgctatagtatctgtcacctctgcttttttttcttttttgaaaaacatatttggcatcgtatctgcttcgcttgcttgtatgcagcaatatatgtgtagaataaagttagcttaaaaaaaaaaaaaaaaaaaa

SEQ ID NO: 1366 - protein, 294 aa, Panicum virgatum
  misc_feature: Ceres CLONE 1764390
  misc_feature: Great-hit functional homolog of the protein sequence given in SEQ ID NO 9493
  misc_feature: Useful for biocontainment applications
  misc_feature: The plant produces a reduced number of seeds.
MTGEGNGDEGWRRSGIEVSALQFGYEGQPPLFARFNLRVAPGSRCLLVGANGSGKTTLLKILAGKHMVGGRDVVRVLNGSAFHDTQLVCNGDLSYLGGSWSRTIGSAGDVPLQGDFSAEHMIFGVDGVDPVRREKLIDLLDIDLQWRMHKVSDGQRRRVQICMGLLHPYKVLLLDEITVDLDVVTRMDLLDFFKEECEQREATIVYATHIFDGLETWATDITYIQEGELRKSAKYMDIEELKNAKNLLTVVESWLRSETKLPKKDPPRSEAQPRRSSPFDSSPLRSSCHMAYYR

SEQ ID NO: 1367 - DNA, 572 bp, Panicum virgatum
  misc_feature: Ceres CLONE 1764418
  misc_feature: Encodes the peptide sequence at SEQ ID NO. 1368
gattgccgaaggccggaacgaaccaaaccccctcgtcgtccttctagaagctcccgcgtcccctccccgtagcctctgctctccaatggcgccctccctcctggccgtcgccgcctcacccttcctcgtcgccggcagcagttgcagccgccggccgctggtcgccgccgccacccgccgggccgggctgcgcgttgccgcgctcaagtacgaccctgccaaggtggcgccgcagtccgaccgggtgctcgtccgtctccagcagatccctgagaaatctgctggaggtgtattgctacctaagtctgctgttaagtttgagaggtttctgatgggtgagattctatcggtcggtgctgatgttagtgaagttgaggctggaaagaaggttctattttcagatatcaatgcttatgaagtggaccttggtactgatgagaagcactgtttctgccgggaatcggatctgttagctgttgttgaatgaattttaccctaaaatttcagacttgggctacagtgctccaagcctacaagtgaaagttcttgaccaaaaaaaaaaaaaaaaaaaa

SEQ ID NO: 1368 - protein, 133 aa, Panicum virgatum
  misc_feature: Ceres CLONE 1764418
  misc_feature (1)..(87): Pfam Name: Cpn10 Pfam Description: Chaperonin 10 Kd subunit
MAPSLLAVAASPFLVAGSSCSRRPLVAAATRRAGLRVAALKYDPAKVAPQSDRVLVRLQQIPEKSAGGVLLPKSAVKFERFLMGEILSVGADVSEVEAGKKVLFSDINAYEVDLGTDEKHCFCRESDLLAVVE

SEQ ID NO: 1369 - DNA, 1022 bp, Panicum virgatum
  misc_feature: Ceres CLONE 1764459
  misc_feature: Encodes the peptide sequence at SEQ ID NO. 1370
atccgtccagccatccatcaagccattcatcgcagtgtggacgcgtgcgactcccttccctagaattgactgacttaccctgccctgccggccttccccggcgaaagagagagaggaggagccatggcgccgcggaagctgtacgggatgccgctgtcgcccaacgtggtgcgcgtggccaccgtgctcaacgagaagggcctcgacttcgagatcgtccccgtcgacctccgcaccggcgcccacaagacaccggaattcctcgccctcacccctttcggccagatccctgcgttgcaggacggagatgaagttctctacgagtcccgggccatcaaccggtacatcgcttccaagtacaagtcggagggccccgacctgctcccgaccccgtcggcgaagctggaggtgtggctggaagtggagtcgcaccacttctaccccaacgtgtcgccgctggtgttccagctcctcatcaagccgctcctgggcggcgccccggaccccgtggtcgtcgacaagcacgcgcaccagctcgccaaggtgctcgacgtctacgaggcgcacctcgccggcaacaagtacctcgccggcgacgagttctcgctcgccgacgccaaccacatgtcctacctcttctgcctcagcaagacccccaaggcgggcctcgtcgacgagaggccccacgtcaaggcctggtgggaggacatcgccgcccgccccgccttcaagaagaccgtcgccgccatccccctgccgccgccgccgccgtccgcctgagctcaaagcttaattagctaggtggtggtacatcatccgttgaataaaaacaaaaactgcgcgttggattgggtgtgctcaattatgtgaaagagcgcggtgatgtggaatttgcctttaatttactcctcactcctcagatattattctcttcgtgctggcttctagtaattgttcgtgtgattagcggtatgccaggtgttgtagagttgatcatttcggaaaaaaaaaaaaaaaaaaaa

SEQ ID NO: 1370 - protein, 218 aa, Panicum virgatum
  misc_feature: Ceres CLONE 1764459
  misc_feature (1)..(96): Pfam Name: GST_C Pfam Description: Glutathione S-transferase, C-terminal domain
  misc_feature (1)..(76): Pfam Name: GST_N Pfam Description: Glutathione S-transferase, N-terminal domain
  misc_feature (1)..(212): SWISSPROT Homolog: EC 2.5.1.18 Glutathione S-transferase I
  misc_feature (1)..(218): SWISSPROT Homolog: EC 2.5.1.18 Glutathione S-transferase III
MAPRKLYGMPLSPNVVRVATVLNEKGLDFEIVPVDLRTGAHKTPEFLALTPFGQIPALQDGDEVLYESRAINRYIASKYKSEGPDLLPTPSAKLEVWLEVESHHFYPNVSPLVFQLLIKPLLGGAPDPVVVDKHAHQLAKVLDVYEAHLAGNKYLAGDEFSLADANHMSYLFCLSKTPKAGLVDERPHVKAWWEDIAARPAFKKTVAAIPLPPPPPSA

SEQ ID NO: 1371 - DNA, 886 bp, Panicum virgatum
  misc_feature: Ceres CLONE 1764477
  misc_feature: Encodes the peptide sequence at SEQ ID NO. 1372
atccgcctccaccagccactcgaaaccctagcgcgccgccgccgccgcctccgcctcacacaggtaagggcgcgatggtgtccggctccggcgtgtgcgccaagcgcatcgtggtggacgcgcgccaccacatgctcggccgcctcgcctcgatcatcgccaaggagctgctcaacggccagaaggtcgtggtggtccgctgcgaggagatctgcatgtccggcggcctcgtccgccagaagatgaagtacctccgcttcctccgcaagaggatgaacaccaagccgtcccacgggcccatccacttccgcgcccccgccaagatcctgtggcgcaccatccgcggtatgattccgcacaagaccaagaggggagaggctgcgctcgcgaggctcaagacgtacgagggcgtcccgccgccgtacgacaggaccaagcgcatggtcatccctgacgcgctcaaggttctgaggctacagcctgggcacaagtactgcctccttggcgagctctccaaagaggtcggatggaactaccatgacaccatcagggaactcgaggagaagaggaaggagaaggccaaggttgcctatgagaggaggaagcaactggctaagctccgtgtcaaggctgagaaggctgctgaggagaagctgggatctcagctggagattcttgccccgatcaagtattgagaagctgtgctttcgcgcgtcaccagttttgtggaacatctggccccttattttcagtagttcggtaaaactttgtggcagtataatcttgagtggtaaaccgtgttatctgtcaacttctgcgactattatttcaaacattttctagtcgaatgaactctttcgtttgtcaaaaaaaaaaaaaaaaaaaa

SEQ ID NO: 1372 - protein, 206 aa, Panicum virgatum
  misc_feature: Ceres CLONE 1764477
  misc_feature: Great-hit functional homolog of the protein sequence given in SEQ ID NO 9442
  misc_feature: Useful for making plants with modulated nitrogen use efficiency
MVSGSGVCAKRIVVDARHHMLGRLASIIAKELLNGQKVVVVRCEEICMSGGLVRQKMKYLRFLRKRMNTKPSHGPIHFRAPAKILWRTIRGMIPHKTKRGEAALARLKTYEGVPPPYDRTKRMVIPDALKVLRLQPGHKYCLLGELSKEVGWNYHDTIRELEEKRKEKAKVAYERRKQLAKLRVKAEKAAEEKLGSQLEILAPIKY

SEQ ID NO: 1373 - DNA, 708 bp, Panicum virgatum
  misc_feature: Ceres CLONE 1764580
  misc_feature: Encodes the peptide sequence at SEQ ID NO. 1374
cacaaatcccccgcaacctcccaacgcttcaacgcatcctctcattccaaaccctcgttcctccagcaccgagagaatcggagcggcctcgatggcgcccaaggcggagaagaagccggcggccaagacgcccgcagaggaggagcccgcggagaaggcggctccggcggagaaggcccccgctggcaagaagcccaaggcggagaagcggctcccggcgggcaagtctgccggcaaggagggcggcgacaagaaggggaagaagaaggccaagaagagcgtggagacgtacaagatctacatcttcaaggtcctcaagcaggtgtttcccgacatcggcatctcctccaaggccatgtccatcatgaactccttcatcaacgacatcttcgagaagctcgccgcggaggccgccaagctcgcccgctacaacaagaagcccaccatcacctcccgcgagatccagacctcggtgcgcctcgtcctccccggggagctcgccaagcacgccgtgtcagagggcaccaaggctgtcaccaagttcacctcgtcttaggctatgctgaaaggcttgtttgcgcctgcctgtgatgtgttgcttctgctgttagtagtggtagttcggagtattggctggtgtggtgtagtgagctgttccggtggcttttgtgacttatcgtggtggtaatggaaggctattgttatccg

SEQ ID NO: 1374 - protein, 154 aa, Panicum virgatum
  misc_feature: Ceres CLONE 1764580
  misc_feature: Great-hit functional homolog of the protein sequence given in SEQ ID NO 9491
  misc_feature: Useful for biocontainment applications
  misc_feature: Useful for making plants with modulated flowering time
  misc_feature: No seed is being produced by the plant
  misc_feature: The plant flowers significantly late compared to wild-type.
MAPKAEKKPAAKTPAEEEPAEKAAPAEKAPAGKKPKAEKRLPAGKSAGKEGGDKKGKKKAKKSVETYKIYIFKVLKQVFPDIGISSKAMSIMNSFINDIFEKLAAEAAKLARYNKKPTITSREIQTSVRLVLPGELAKHAVSEGTKAVTKFTSS

SEQ ID NO: 1375 - DNA, 1054 bp, Panicum virgatum
  misc_feature: Ceres CLONE 1764591
  misc_feature: Encodes the peptide sequence at SEQ ID NO. 1376
acgaaaaaaaaaattcgcgtctccccccgtctgcgcagcccccagatccggcgccgtccgctcttcaatcaccgcgcccgcaggtcggggggtttgcgcgccccgggcaccggaggaggaggagcggcatggcggcgccgccggcgagggcccgggccgactacgactaccttattaagctgctcctcattggggatagcggtgttggcaagagttgcctcctattgcggttctccgatggttccttcactacaagctttattaccacaattggtattgattttaagataagaacaatagagttggatggtaaacgcatcaagctacagatttgggatacagccggccaagaacgcttccggaccattaccactgcatactaccgaggagcaatgggcatcctgttggtttatgatgtcaccgacgagtcttcttttaacaacatccgaaactggattcggaacatcgagcaacatgcctctgataatgtcaacaaaatattggtcggcaataaggcagatatggatgagagcaaaagggctgtacctactgcaaaaggacaagcgcttgctgatgagtacggaatcaagttctttgaaactagtgccaagacaaaccttaatgtcgagcaagtgtttttctcaattgcacgtgacatcaagcagaggcttgcggagactgattctaagcctgaggagaaagcaatcaaaattaacaagccagaccagggtgccgagcaagcagctggtcagcgatccgcttgctgcggctcataagagatgtgcaacgtccatgatcattggttatttgacgttatttatttcccgcttggctattataggaagaatttgaagaagccacttatgatatactgatgtggttgtacctgtgtttgcttccattctttgaagcaatcacctcttgctgttgacgtagctattgctattgctgggagctattgcactctggatttcggtccgttgaaaaaaatctctcctccctacagtgtgtaatgaatgaaatccatgtcgttgaaaaaaaaaaaaaaaaaaaa

SEQ ID NO: 1376 - protein, 215 aa, Panicum virgatum
  misc_feature: Ceres CLONE 1764591
  misc_feature: Great-hit functional homolog of the protein sequence given in SEQ ID NO 9467
  misc_feature: Great-hit functional homolog of the protein sequence given in SEQ ID NO 9640
  misc_feature: Useful for making plants with altered Lignin content
  misc_feature: Useful for making plants with modulated oxidative stress sensitivity
MAAPPARARADYDYLIKLLLIGDSGVGKSCLLLRFSDGSFTTSFITTIGIDFKIRTIELDGKRIKLQIWDTAGQERFRTITTAYYRGAMGILLVYDVTDESSFNNIRNWIRNIEQHASDNVNKILVGNKADMDESKRAVPTAKGQALADEYGIKFFETSAKTNLNVEQVFFSIARDIKQRLAETDSKPEEKAIKINKPDQGAEQAAGQRSACCGS

SEQ ID NO: 1377 - DNA, 489 bp, Panicum virgatum
  misc_feature: Ceres CLONE 1764605
  misc_feature: Encodes the peptide sequence at SEQ ID NO. 1378
acatgcgtacaagcagagaaccactcggccacggagatttctcttgccccttcctcccctctctcctccctccccgaatcacgcgcagtcccatccggcaccagccgccatggcaagaaccactccgttcggtctcgccgtcgcggcggcgctcgtcttcgccgtcgccatgccggccctcgccgccgcgcaggcccccgcgccggcgcccacaagcgacggcacgtcgattgaccagggcatcgcctacctcctgatgatcgtcgccctcgtgctcacctacctcatccaccctctcgacgcctcctccccgtacaagctcttctgagagcagagcagaaatcttttttccttccttgttttgatagggtagtggattatttgagtgagggagaggcatcattggtggtcggtccggtccgtattcatttgtggcgagttctattgggttctgcatgcatgtgtataatattactcctaccttcatgc

SEQ ID NO: 1378 - protein, 72 aa, Panicum virgatum
  misc_feature: Ceres CLONE 1764605
  misc_feature: Great-hit functional homolog of the protein sequence given in SEQ ID NO 9217
  misc_feature: Useful for making plants with altered cell wall content and/or composition
  misc_feature: Useful for making plants with modulated salt sensitivity
  misc_feature: Useful for making plants with modulated nitrogen use efficiency
  misc_feature: Useful for making plants with modulated salt sensitivity
MARTTPFGLAVAAALVFAVAMPALAAAQAPAPAPTSDGTSIDQGIAYLLMIVALVLTYLIHPLDASSPYKLF

SEQ ID NO: 1379 - DNA, 916 bp, Panicum virgatum
  misc_feature: Ceres CLONE 1764629
  misc_feature: Encodes the peptide sequence at SEQ ID NO. 1380
aagaccccaccaccaccaccaccaccaccaccattccccagctcggcaggctcttcatcgcccgcccgcccgccgcgccggacgcgccccgatccagatccaggggcttatcatggcatcaaatcgtatctttaaggacttaagggacatgcaaaaggaccctccgacatcatgcggtgcaggtcctactggtgaggatatgttccactggcaggcaaccatcatgggtcatcctgatagtccatatgctggaggtgttttcttagtgaacattcatttccctccggactaccccttcaagcctccaaaggtatcttttaagacaaaggtgttccatccgaatatcaatagcaatgggagcatatgtctagacattcttatagaggagcagtggcgccctgctttgacaatctctaaggttttgctttctatctgctcgctgctcactgatcccaacctagaggaccctcttgtccctgagattgctcacatgtacaagacagaccggcctaagtacttggcgacagcccgcagctggacccagaagtatgccatgggatgttcctgcacaaatgcagacaattgtcactctgttcagctggctgtggctggtggctggtgctaatttggtgtgagaggaaagtactactggctggctgcggctggtggttggtgctgatttggtgtgagagaaaaacactgttagctggttggctgagaagccaagtgaacagagtgtgtgatgttaccccataaactctttctggggctgttatgttattccattccttgtggtctgtttgcatttctccgatccatctaggatcgagccctagcccaacatcaacatatctttgtcgtcgataacgagatgacttatgcttgttgtgatgactaaaaaaaaaaaaaaaaaaaa

SEQ ID NO: 1380 - protein, 170 aa, Panicum virgatum
  misc_feature: Ceres CLONE 1764629
  misc_feature: Great-hit functional homolog of the protein sequence given in SEQ ID NO 9309
  misc_feature (1)..(149): SWISSPROT Homolog: EC 6.3.2.19 Ubiquitin-conjugating enzyme E2-17 kDa
  misc_feature (1)..(149): SWISSPROT Homolog: EC 6.3.2.19 Ubiquitin-conjugating enzyme E2-17 kDa 11
  misc_feature: Useful for biocontainment applications
  misc_feature: The plant produces a reduced number of seeds.
MASNRIFKDLRDMQKDPPTSCGAGPTGEDMFHWQATIMGHPDSPYAGGVFLVNIHFPPDYPFKPPKVSFKTKVFHPNINSNGSICLDILIEEQWRPALTISKVLLSICSLLTDPNLEDPLVPEIAHMYKTDRPKYLATARSWTQKYAMGCSCTNADNCHSVQLAVAGGWC

SEQ ID NO: 1381 - DNA, 584 bp, Panicum virgatum
  misc_feature: Ceres CLONE 1764631
  misc_feature: Encodes the peptide sequence at SEQ ID NO. 1382
atatgcaaagcaaccaagcacaatctcagatcatctatcctacattttcaactgtccaagtttttttcctacaacaagaccacctgatcgatggaccaggtgacgaggctggcatcgcagcgtgcagtggtgatcttcaccacgagctcctgctgcatgtgtcacacagtgacgcagctcttccgtgagctcggggtgaacgcgacagtggtgaagttggacgaggaccctcggggaatggagatggagaaggcactggcgaggctgctgggccgcagctccggtgtgccagcagtgttcatcggcggcaggctcgtcgggtccacggacaaggtcatgtcgctccacctcagcagcaacctcgtcccgctactgcgcaatgcgggggcactctgggtgtagcttaatagggccttgtgctctaagtcagctgatgatccaaattaagggcttcatcggtattttgtaagagtacctgatattttgacgagtgagagtgtttccttcctgatatgcactggccatggacatacatgtgagtgacatacatgtgaccgatgtaagagcttcagtattgctcgttg

SEQ ID NO: 1382 - protein, 103 aa, Panicum virgatum
  misc_feature: Ceres CLONE 1764631
  misc_feature (1)..(64): Pfam Name: Glutaredoxin Pfam Description: Glutaredoxin
MDQVTRLASQRAVVIFTTSSCCMCHTVTQLFRELGVNATVVKLDEDPRGMEMEKALARLLGRSSGVPAVFIGGRLVGSTDKVMSLHLSSNLVPLLRNAGALWV

SEQ ID NO: 1383 - DNA, 933 bp, Panicum virgatum
  misc_feature: Ceres CLONE 1764681
  misc_feature: Encodes the peptide sequence at SEQ ID NO. 1384
acatccgaatctagggtttttatcctcctctccagccgccgccgcgccgcaccaccggccgctcctccatcccatctgccaatggcgaccactcacgcgatcagcaagaaacgtaagttcgtggcggatggcgtgttcttcgcggagcttaacgagatgctcacccgcgagctcgcagaagacggctactccggcgtcgaggtccgcgtcacccccatgcgcactgagatcataattcgcgccacccgcacccagaacgtcctcggcgagaagggcaggaggatcagggaactaacttctgtggttcagaagcgcttcaacttcccggagggtggcgtcgagctctacgccgagaaggtgaacaaccgcggcctctgcgccattgcccaggctgagtcgctccgctacaagctcctcggtggactcgccgtcagaagggcatgctatggtgttctacgttttgtcatggagagtggtgccaaaggctgtgaggttattgttagtgggaagctcagggcccaacgtgctaaatccatgaagttcaaggatggatacatgatctcttctggtcatcctgtcaacctatatattgactctgctgtgaggcatgttctcctgagacagggtgtgctcggtatcaaggtaaagattatgctcgactgggatccaaagggcaagcaagggccaaccatgcctttacctgatcttgttacaattcaccctccaaaggaagaggatgagctcttgaggccccttgcaccagaaatctcagttgcttaagtaaaaaagtttagatatggtttgacccagttttgtgttcatgtaatgttcattattaacgttgtcgcaagtaaaaagagctttactttttgaagttgcaaacagtgagcaatcaatataatctttttgcttcaaaaaaaaaaaaaaaaaaaa

SEQ ID NO: 1384 - protein, 232 aa, Panicum virgatum
  misc_feature: Ceres CLONE 1764681
  misc_feature: Great-hit functional homolog of the protein sequence given in SEQ ID NO 9400
  misc_feature: Useful for making plants with modulated biomass
  misc_feature: There is no branching.
MATTHAISKKRKFVADGVFFAELNEMLTRELAEDGYSGVEVRVTPMRTEIIIRATRTQNVLGEKGRRIRELTSVVQKRFNFPEGGVELYAEKVNNRGLCAIAQAESLRYKLLGGLAVRRACYGVLRFVMESGAKGCEVIVSGKLRAQRAKSMKFKDGYMISSGHPVNLYIDSAVRHVLLRQGVLGIKVKIMLDWDPKGKQGPTMPLPDLVTIHPPKEEDELLRPLAPEISVA

SEQ ID NO: 1385 - DNA, 801 bp, Panicum virgatum
  misc_feature: Ceres CLONE 1764685
  misc_feature: Encodes the peptide sequence at SEQ ID NO. 1386
actgcatgcccttggttcgtcctctaccatcactactgctggctggccatcctagacactaagagagaagggaaagaagaagttgatccaactagcactcacattcgcactgccggccagtgcaacacgatggctctcaggctgtgggctagctcagcagccaatgcgctcaagctctccggagccaggactgccggcccgtcctactccatctccagattcttctccacagttcatgacgggttgctgtacactacgtctcatgagtggctcaaggaccatggggacggcgtcgtctcggttggcatcacggaccatgctcagagtcaccttggcgaggtggtcttcgtggagctgccggaacccggcgcgacggtcgctgcaggaggatccttcggcaacgtggagagtgtgaaggccaccagcgacgtcaactcccccatctccggcgaggtcgtcgaggtcaactccaagctgtccgagacgcccggcctgatcaactcgagcccgtacgaggaggggtggataatcaaggtgaagccgagcagcccggcggagggcctgctggacgccgccaactacaccaagcactgcgaggaggaagacgctcactagagagccagcagatagatcatgcacgtacacgctgcgtttgctgcttatgatccacatacatagtgtgttctattggttgtttcagtcatttttttttttttgctttatttattttcttgcaaaagctccaccaacctttatgcaataaccaaaggcactcacctttaaaaaaaaaaaaaaaaaaaa

SEQ ID NO: 1386 - protein, 161 aa, Panicum virgatum
  misc_feature: Ceres CLONE 1764685
  misc_feature (1)..(121): Pfam Name: GCV_H Pfam Description: Glycine cleavage H-protein
MALRLWASSAANALKLSGARTAGPSYSISRFFSTVHDGLLYTTSHEWLKDHGDGVVSVGITDHAQSHLGEVVFVELPEPGATVAAGGSFGNVESVKATSDVNSPISGEVVEVNSKLSETPGLINSSPYEEGWIIKVKPSSPAEGLLDAANYTKHCEEEDAH

SEQ ID NO: 1387 - DNA, 959 bp, Panicum virgatum
  misc_feature: Ceres CLONE 1764700
  misc_feature: Encodes the peptide sequence at SEQ ID NO. 1388
gaccaacccactggctctggctctggctcctcccggttgcagttgcaagctgacctcgctgctgctgccaccactcactgctctgccagttctttccctcgacctcacacagtagcaagctattaagagcactccccggagttcaccagctaggtttaaggcattgaaaccctatccttttcaggtccctctcgccttttcttttcctcccttggctcctatttccgtttgcagaccggagctcgcacacacgtactactacatatatacccaagttctgcgagaggccgaggccgaggcagggacgacgacgaagaagaataatccaccaggagctgtatagtagcatcatccaagcacgtactctctgagctaggactcgccggagatgtcaggccgccgcggcaggatcagcgacgacgagatcaacgagctaatctccaagctccaggcgctcctcccggagtcctcacgccgccggaacgcgagccggtcgtcggcgtcgaagctcctgaaggagacgtgcacctacattaagagcctgcaccgggaggtggacgacctctcggagcggctgtcggggctcatggcgaccatggacaacgacagcccccaggccgagataatccggagcctactccgatgaccgccaggccgggccctcctgccggctacctagttagctgcagcgggccgcgcagctgaattatattagtgaagacgacgaattgaaggagcttgctcgctcgcttgctacgaccttttcattttttttttctcttcttcttcctccagtatgtgtgtgtgtgtgtttgtttccgtacctgctgtcttattaatccaaggaccctcatcgttcagaagacaacgaacgaagggctagctcttggtgtaccagaggggttagtagagatatatatggacttctattaaccgaccaaaaaaaaaaaaaaaaaaaa

SEQ ID NO: 1388 - protein, 85 aa, Panicum virgatum
  misc_feature: Ceres CLONE 1764700
  misc_feature: Great-hit functional homolog of the protein sequence given in SEQ ID NO 9215
  misc_feature: Great-hit functional homolog of the protein sequence given in SEQ ID NO 9218
  misc_feature: Great-hit functional homolog of the protein sequence given in SEQ ID NO 9439
  misc_feature: Great-hit functional homolog of the protein sequence given in SEQ ID NO 9644
  misc_feature (2)..(49): Pfam Name: HLH Pfam Description: Helix-loop-helix DNA-binding domain
  misc_feature: Useful for making plants with altered Lignin content
  misc_feature: Useful for making plants with altered terpenoid content
  misc_feature: Useful for making plants with modulated nitrogen use efficiency
  misc_feature: Useful for making plants with modulated nitrogen use efficiency
MSGRRGRISDDEINELISKLQALLPESSRRRNASRSSASKLLKETCTYIKSLHREVDDLSERLSGLMATMDNDSPQAEIIRSLLR

SEQ ID NO: 1389 - DNA, 575 bp, Panicum virgatum
  misc_feature: Ceres CLONE 1764705
  misc_feature: Encodes the peptide sequence at SEQ ID NO. 1390
cgccatgaccttcaagcgccgcaacggcggccgcaacaagcacggccgcggccatgtcaagtacatccgctgctccaactgcgccaagtgctaccccaaggacaaggccatcaagaggttccaggtgaggaacatcgtggagcaggcggccatcagggacgtccaggaggcgtgcgtccatgacggatacgtccttcccaagctgtacgccaaggtgcaccactgcgtctcgtgcgcgatccacgctcacatcgtccgcgtccgatcccgtgagaagcgcagggaccgctttttttcggaacgcttcaggcgcagggaggataggcctgctggtgggcaaggaggcccccgccctggtggacctggccctgctggtgctgctgcagctccgccaccaaatgctcctcgcccataggtttagcttatcgaccgcataagttaagtctggcctgttgttgggtagcgctggatgtcagtatcagtatgtcatcaagcaggggagtttggagttgctatattagtagaacttttgtctgaattctggaatgtttgctaagagaacatcttgtcattcg

SEQ ID NO: 1390 - protein, 136 aa, Panicum virgatum
  misc_feature: Ceres CLONE 1764705
  misc_feature: Great-hit functional homolog of the protein sequence given in SEQ ID NO 9225
  misc_feature: Useful for making plants with modulated nitrogen use efficiency
MTFKRRNGGRNKHGRGHVKYIRCSNCAKCYPKDKAIKRFQVRNIVEQAAIRDVQEACVHDGYVLPKLYAKVHHCVSCAIHAHIVRVRSREKRRDRFFSERFRRREDRPAGGQGGPRPGGPGPAGAAAAPPPNAPRP

SEQ ID NO: 1391 - DNA, 889 bp, Panicum virgatum
  misc_feature: Ceres CLONE 1764730
  misc_feature: Encodes the peptide sequence at SEQ ID NO. 1392
gccacggtacccgtttctctcacacctcgcgcagcatcggagcactagagaggaatccagcccagcagcccaagcaatggagtgcgtcctgggcgtggtcggccgcgacttcgcggtggtggcggcggacacctccgccgtgcagagcatcctcgtccacaagacggacgaggacaaggtgatggtcctcgactcgcacaagctgatgggcgcctcgggggagcccggcgaccgggtgcaattcacggagtacatacagaagaacctccacctgtaccagttccgcaacaccaccccgctctccaccgccgccaccgccaacttcacccgcggcgagctcgccacagccctccggaagaatccatacatggtcaacgttatacttggtggttatgataagaatgttggcgcttccttgtactacatcgactacattgcaaccttgcacaagattgacaagggtgcttttgggtacggctcctacttctgtttgtcgctaatggacaagctgtaccacccggacatgactgttgaggaagcagtagatcttgttgacaagtgcatcaaggagatccatctgaggttggtcgttgcgcctcagaactttgtaatcaagatcgtggataaggatggggcgagggagtatgcgaggcgtgagctcgtcggtgacaacacatcagcatcagcatcagcatcagcgggagctgcagtaactacagttgccgcctgaggcgtgaagccgtgaactcgttggagctcgcatattgttaattgtttctcagcgctgctactatgtaatcacaagatactttgggggtcccagaactgtttttatcaattctagcccagacgtgtaactctgttgtttcaaaaaaaaaaaaaaaaaaaa

SEQ ID NO: 1392 - protein, 217 aa, Panicum virgatum
  misc_feature: Ceres CLONE 1764730
  misc_feature (1)..(202): SWISSPROT Homolog: EC 3.4.25.1 Proteasome subunit beta type 2-A
  misc_feature (1)..(211): SWISSPROT Homolog: EC 3.4.25.1 Proteasome subunit beta type 2
MECVLGVVGRDFAVVAADTSAVQSILVHKTDEDKVMVLDSHKLMGASGEPGDRVQFTEYIQKNLHLYQFRNTTPLSTAATANFTRGELATALRKNPYMVNVILGGYDKNVGASLYYIDYIATLHKIDKGAFGYGSYFCLSLMDKLYHPDMTVEEAVDLVDKCIKEIHLRLVVAPQNFVIKIVDKDGAREYARRELVGDNTSASASASAGAAVTTVAA

SEQ ID NO: 1393 - DNA, 1008 bp, Panicum virgatum
  misc_feature: Ceres CLONE 1764751
  misc_feature: Encodes the peptide sequence at SEQ ID NO. 1394
gctgagcgagccatctggaatcctcctctcgctccccgtcacgtcttctccggcgattcctcctgcccctgccccgcaccccaccccaccactgccggccgccccgaaccccggagaagaatcgaggcggcgtcaacctctctaccctccccatcgccatggagcacgcgctgtggtcgagcggggccagcgacaagaacaagtccatggtcgagcagctgcggaggtacgggatcatccggtccagcaaggtcgccgaggtgatggaggccgtcgacaggggtctgttcgtgccgccaggcggctcgccctacttcgacagccccatgccgatcgggtacaacgccacaatatcggcgccgcacatgcacgcggcctgcctggagctcctggagaagaatcttcagccggggatgcgtgctctcgatgttggatcaggcactggatacctaactgcttgctttgcactgatggttggaccggaagggcgagcagttggtgttgaacatattccagagctggttgctacttctattgaaaatataaagaaaagtgcagcagctccacagctaaatgacggatctcttagtatacacattgctgatggcagggaaggttggccagagctggcaccctatgatgccatccatgtaggagctgcagcgccgcagatcccagaggcgctggtcgagcagttgaagcctggtggcagaatggtgatcccggttgggacaatgttccaggagctcaaggtggtggacaagaagttggatggcacagtcagcattagagatgagacgtctgtgcgctatgtgccgcttaccagcaaggaagctcaattgcgcgcaaactgattgcgcttaatgcaccaccttgccagctcaggccttggatgattcgactgatcgaatcattattgttgtacataaattgatcctactgtgtctagtgcatgcacttttgaaataatgtaaaatggtatctcatcaaaaaaaaaaaaaaaaaaaa

SEQ ID NO: 1394 - protein, 231 aa, Panicum virgatum
  misc_feature: Ceres CLONE 1764751
  misc_feature (1)..(216): Pfam Name: PCMT Pfam Description: Protein- L-isoaspartate(D-aspartate) O-methyltransferase (PCMT)
  misc_feature (6)..(229): SWISSPROT Homolog: EC 2.1.1.77 Protein-L-isoaspartate O-methyltransferase
MEHALWSSGASDKNKSMVEQLRRYGIIRSSKVAEVMEAVDRGLFVPPGGSPYFDSPMPIGYNATISAPHMHAACLELLEKNLQPGMRALDVGSGTGYLTACFALMVGPEGRAVGVEHIPELVATSIENIKKSAAAPQLNDGSLSIHIADGREGWPELAPYDAIHVGAAAPQIPEALVEQLKPGGRMVIPVGTMFQELKVVDKKLDGTVSIRDETSVRYVPLTSKEAQLRAN

SEQ ID NO: 1395 - DNA, 928 bp, Panicum virgatum
  misc_feature: Ceres CLONE 1764766
  misc_feature: Encodes the peptide sequence at SEQ ID NO. 1396
cgctttcgccaccggggaggggagggcgaccctccgatcggctccgctatggctggcactgctgttctcaacgagcgcatcctttcttccatgtcccagaaacatgttgctgctcatccatggcatgatttggagataggaccaggggctcctgaagttttcaactgtgtggttgagattcctagaggcagcaaggtgaagtatgagttggacaaggcatctggtctgatcaaggttgatcgtgtcctttactcctctgttgtttacccacacaactatggtttcattccacgcacactctgtgaggatagtgaccccatggacgtcctcatcctgatgcaggaacaagttgtccctgggtgtttcctgcgagctcgtgctattgggctcatgcctatgattgatcaaggagagaaagatgataagatcatagcagtttgcgctgatgaccctgaataccgtcactacacggacatcaaggaccttcctccacatcgccttcaagagattcgccgcttctttgaagattacaagaagaatgaaaacaaagaggtcgcggtgaatgagttcctcccagcaaaagatgccatcgacgcaatcaaatactctatggacctgtatggctcatacatcatcgaaggactgaggaagtaacaagattgcagatgcttcatgatttactcagcagctcgagagtactgtagcacgacatatgttaacatgcacgaactgaaatcatgacaaaggaatattaccttctgttcatgttgagagaagcagcagtgccttttgtttccattatatatgcttatcttggccttgatgaaatctgtcgtcaaaccaacatttgacagaacgattgcctgatagaaaatcacttgatacataaatgtcatttgcttatcttcaaaaaaaaaaaaaaaaaaaa

SEQ ID NO: 1396 - protein, 201 aa, Panicum virgatum
  misc_feature: Ceres CLONE 1764766
  misc_feature: Great-hit functional homolog of the protein sequence given in SEQ ID NO 9627
  misc_feature (1)..(155): Pfam Name: Pyrophosphatase Pfam Description: Inorganic pyrophosphatase
  misc_feature (5)..(201): SWISSPROT Homolog: EC 3.6.1.1 Soluble inorganic pyrophosphatase
  misc_feature: Useful for making plants with modulated nitrogen use efficiency
MAGTAVLNERILSSMSQKHVAAHPWHDLEIGPGAPEVFNCVVEIPRGSKVKYELDKASGLIKVDRVLYSSVVYPHNYGFIPRTLCEDSDPMDVLILMQEQVVPGCFLRARAIGLMPMIDQGEKDDKIIAVCADDPEYRHYTDIKDLPPHRLQEIRRFFEDYKKNENKEVAVNEFLPAKDAIDAIKYSMDLYGSYIIEGLRK

SEQ ID NO: 1397 - DNA, 890 bp, Panicum virgatum
  misc_feature: Ceres CLONE 1764769
  misc_feature: Encodes the peptide sequence at SEQ ID NO. 1398
accacaagccttccaagctgatacagccaggggagaagagagcgagcgacagtgggagagcgagccaggaagacgacgatggcggcggcggcggcccagtgggcggtggtcatggcggtggcggcggcggcgacgctggcgggcggcgacatgaacgcggacaagacggagtgcgcggaccagctggtggggctggcgccgtgcctgcagtacgttcaggggcaggcgcgcgcgccgccgcccgactgctgcggcggcctccggcaggtgctcgggaagagccccaagtgcctctgcgtcctcgtcaaggacaaggacgaccccaacctgggcatcaagatcaacgccaccctcgccctcgccctcccctccgcctgcggcgccacccgcgccaacgcctcccactgcgcccagctcctgcatattcctccgggatcgaaagacgccgccgtcttcagccccggcggcgtcaagggctccgctgctgccccaggcaaggacaactcgacggccacgaccgactcgcgcggcctccaggcgaccaatggaggcggccgcgtctcctcggcggcgaccgccggcgttgcgctcacggcgctgctcgtaggctgccttctcctgctcgtgccggagctgtcgcctagctcattctagacctctgtcaagtgctcccacaagagatcaccggggtgtgtgtgtgtgtgtcatgctgtagtagttcgtgacagataaattctgtatgctcgtggtggtgttgtgctgctctactgttgtatgctactggtgttaagcgtacgggtgtgtaggccaagatagacgattgatttcgctagcttgaatttattataccagtgcctctggtttcttatcaaaaaaaaaaaaaaaaaaaa

SEQ ID NO: 1398 - protein, 191 aa, Panicum virgatum
  misc_feature: Ceres CLONE 1764769
  misc_feature (1)..(78): Pfam Name: Tryp_alpha_amyl Pfam Description: Protease inhibitor/seed storage/LTP family
MAAAAAQWAVVMAVAAAATLAGGDMNADKTECADQLVGLAPCLQYVQGQARAPPPDCCGGLRQVLGKSPKCLCVLVKDKDDPNLGIKINATLALALPSACGATRANASHCAQLLHIPPGSKDAAVFSPGGVKGSAAAPGKDNSTATTDSRGLQATNGGGRVSSAATAGVALTALLVGCLLLLVPELSPSSF

SEQ ID NO: 1399 - DNA, 619 bp, Panicum virgatum
  misc_feature: Ceres CLONE 1764887
  misc_feature: Encodes the peptide sequence at SEQ ID NO. 1400
atcccgccgccgcgcaggacgaaggagacctcccggtcgccgccgccatgtcgtcgatgatgtccgtgctgtcgaactggctggtgaacccgcgccgcaacccgctcgcccgcctccacatgcacgccgtctcctcgcgcctcaggaaatacgggctgaggtacgacgacctgtacgacccgtacttcgacctggacatcaaagaggcgctcgggaggctgcctagggaggtggtcgacgcccgtatccagcgcctcaagcgcgccatggacctctccatgaagcatcagtacctccccgaggacctccaggctgcgcaaactccattcagaggctatttgagtgacatgttggctctggtgaaaaaggagagtgctgagcgtgaagctctgggagcccttcccctgtatcagagaaccattccttaaaaaagtgctgcctagaagctctctcaatttttctctttaggacacaccgaaatgcatgaaataatatgcagtggatgaaactgtttttccttcctatcaagttccattttacttgttgatgcgcttgtagttctgcttccactctaattgatgggaaaaaattatgtgttcaaaaaaaaaaaaaaaaaaaa

SEQ ID NO: 1400 - protein, 126 aa, Panicum virgatum
  misc_feature: Ceres CLONE 1764887
  misc_feature (4)..(126): SWISSPROT Homolog: EC 1.10.2.2 Ubiquinol-cytochrome c reductase complex 14 kDa protein
MSSMMSVLSNWLVNPRRNPLARLHMHAVSSRLRKYGLRYDDLYDPYFDLDIKEALGRLPREVVDARIQRLKRAMDLSMKHQYLPEDLQAAQTPFRGYLSDMLALVKKESAEREALGALPLYQRTIP

SEQ ID NO: 1401 - DNA, 868 bp, Panicum virgatum
  misc_feature: Ceres CLONE 1764906
  misc_feature: Encodes the peptide sequence at SEQ ID NO. 1402
atcaccatttcacttcacagaactccttgtcctaggccccagaaacacaaacgaccgctctttgtttaggcaagatgaacaggaagcctggagactgggattgcagggcttgccaacacctcaacttcagtcggcgggacctatgccagcgctgtggtgagccacgtggagctgctgaccgtggcagcggcggtggaggtgactatgccaacttcggtggccgtggtggctcctccttcggcggtggctttggtgctggctctgatgtccgccctggtgactggttatgttcctgcggcgcgcacaacttcgccagccgctccaactgcttcaagtgctctgccttcaaggaggaggctgctgtcaacagtggtgctggtggctttgatggtgacatgtcacgctcgcgctacggcttcggtggcggtgctgcccgcaccaaccgccctggttggaagtctggagactggatctgcaccaggtccggatgcaacgagcacaactttgccagcaggatggagtgtttcaggtgcaacgcaccacgggactccggcactgaggtgtaggatcggagctggtgcttcgaacgggccccgacgagcagaagcagcaagaaacctgataagaatagtagatttgcaaaaggcatcccggatgctctattactgttttgttccacccctaccgtttccttttagaatttggttccagtctccttagtacccctcggacctatgtttgctgttttattcccgttgtttcccgcaatgtttgcgctttgcatcgagtcatgtgatgtaaccccaaaacgcttgcttcacaagtattaactagtactgttgcttcttaaaaaaaaaaaaaaaaaaaa

SEQ ID NO: 1402 - protein, 163 aa, Panicum virgatum
  misc_feature: Ceres CLONE 1764906
  misc_feature: Great-hit functional homolog of the protein sequence given in SEQ ID NO 9683
  misc_feature: Useful for biocontainment applications
  misc_feature: Useful for making plants with modulated biomass
  misc_feature: The plant is abnormally small.
  misc_feature: The plant produces a reduced number of seeds.
MNRKPGDWDCRACQHLNFSRRDLCQRCGEPRGAADRGSGGGGDYANFGGRGGSSFGGGFGAGSDVRPGDWLCSCGAHNFASRSNCFKCSAFKEEAAVNSGAGGFDGDMSRSRYGFGGGAARTNRPGWKSGDWICTRSGCNEHNFASRMECFRCNAPRDSGTEV

SEQ ID NO: 1403 - DNA, 737 bp, Panicum virgatum
  misc_feature: Ceres CLONE 1764924
  misc_feature: Encodes the peptide sequence at SEQ ID NO. 1404
agaaatcctccgcaacttccccgagcatcctcgcattccaaccgagcaaaccctcgttcctccaccgccgagagaagccaagcggcatcgatggcgcccaaggcggagaagaagccagcggccaagaagcccgcagagcaggagcccgcggagaaggcggcgcctgcggagaaagcccccgcgggcaagaagcccaaggcggagaagcggctcccggcgggcaagtccgccggcaaagagggcggcgacaagaaggggaagaagaaggccaagaagagcgtggagacgtacaagatctacatcttcaaggtcctcaagcaggtgcaccccgacatcggcatctcctccaaggccatgtccatcatgaactccttcatcaacgacatcttcgagaagctcgccgcggagtccgccaagctcgcccgctacaacaagaagcccaccatcacctcccgcgagatccagacctcggtgcgcctcgtcctccctggggagctcgccaagcacgccgtgtcagagggcaccaaggctgtcaccaaattcacctcgtcttaggctgtgatgaaaggcttgtttgcgcctacctatcatgtgtcgcttctcctggtagtagtagtagttgttcggagacttggctggtgtggtgtagtgaactgttccggtggcttttgacttgtatgaattatcgttctggcaatggaaggcaattgttatcagaaaaaaaaaaaaaaaaaaaa

SEQ ID NO: 1404 - protein, 154 aa, Panicum virgatum
  misc_feature: Ceres CLONE 1764924
  misc_feature: Great-hit functional homolog of the protein sequence given in SEQ ID NO 9491
  misc_feature: Useful for biocontainment applications
  misc_feature: Useful for making plants with modulated flowering time
  misc_feature: No seed is being produced by the plant
  misc_feature: The plant flowers significantly late compared to wild-type.
MAPKAEKKPAAKKPAEQEPAEKAAPAEKAPAGKKPKAEKRLPAGKSAGKEGGDKKGKKKAKKSVETYKIYIFKVLKQVHPDIGISSKAMSIMNSFINDIFEKLAAESAKLARYNKKPTITSREIQTSVRLVLPGELAKHAVSEGTKAVTKFTSS

SEQ ID NO: 1405 - DNA, 1138 bp, Panicum virgatum
  misc_feature: Ceres CLONE 1764952
  misc_feature: Encodes the peptide sequence at SEQ ID NO. 1406
atcggctgctgatcgctctccagccttcgcgacccccgaaatcgcttgcgcttctgccctcgaaatcttccggtagattcgcgcggtgccctcttctgttaattcccctccgcgcgaggatccatggctacgacgatagattggcacggccgcagcggcgcgcttcccgcggcgctgtacgagatggcggacagcaaggagctcgtgcgcgcgctcgccgccccgcccgtgcagcagcagcctccgaccatctcgttcgcgtacccgtgctccggcggcgtggagcagcagagcgccgcgagctcgctcctcggcgccgccggcggcctgacgccggcgcaggtgctgcaggtgcagtcgcagctccagttcctacgccggcccgccgcggcgggcggcgcgctggccgcggtcgccacgcagccgatgaagcggcaggcgccggcgccgctccccgagcggccggtgtcgaagctgtaccgcggcgtccggcagcggcattgggggaagtgggtggcggagatccgcctgccgcgaaaccgcacccgcctctggctcggcaccttcgacaccgccgaggaggccgcgctcgcctacgacagcgccgcgttccgcctccgcggggactccgccaggctcaacttccccgagctcaggcgcggcggcgcgcacctcggcccgccgctccacgccgcggtcgacgccaagctccacgccatctgcaacggcacggacgtagcgtcgcagagccagagccagagcaacgcctctgcggcaacggccgcaacgactccgagtacattctcctcagcgagcccggacatcaagagcgagccgggctgctccgggtccgagagcttgtcgtccgcggacggcgacgtgtcctcgaccagctcctccgacgtggttccggagatgcagctcctcgacttctcagaagcgccatgggacgaatccgagagcttcctcctgcgcaagtacccctcgctggagatcgactgggaatccatcctttcgtaatgcaaaggctctggtcgtctcgtccccgcagttcctgatcaagctgttcttgctctgtacttcacagctccaaagattaaagtggtgtcttgatggttaaaaaaaaaaaaaaaaaaaa

SEQ ID NO: 1406 - protein, 298 aa, Panicum virgatum
  misc_feature: Ceres CLONE 1764952
  misc_feature (1)..(65): Pfam Name: AP2 Pfam Description: AP2 domain
  misc_feature: The sequence is a functional homolog of  SEQ ID NO 1289 in the  10/374,780 US patent application
  misc_feature: The sequence is a functional homolog of  SEQ ID NO 1435 in the  10/412,699 US patent application
  misc_feature: Useful for making plants with modulated growth and phenotype characteristics
MATTIDWHGRSGALPAALYEMADSKELVRALAAPPVQQQPPTISFAYPCSGGVEQQSAASSLLGAAGGLTPAQVLQVQSQLQFLRRPAAAGGALAAVATQPMKRQAPAPLPERPVSKLYRGVRQRHWGKWVAEIRLPRNRTRLWLGTFDTAEEAALAYDSAAFRLRGDSARLNFPELRRGGAHLGPPLHAAVDAKLHAICNGTDVASQSQSQSNASAATAATTPSTFSSASPDIKSEPGCSGSESLSSADGDVSSTSSSDVVPEMQLLDFSEAPWDESESFLLRKYPSLEIDWESILS

SEQ ID NO: 1407 - DNA, 915 bp, Panicum virgatum
  misc_feature: Ceres CLONE 1764959
  misc_feature: Encodes the peptide sequence at SEQ ID NO. 1408
cctcccccccagactggtccgccgccgctcctttcgccgccgtcgcgtctccttctcaggtaggtaggacaagaagagggcgaaatggtgaagcacaacaacattatccccaacgggcacttcaagaagcactggcagaactatgtcaagacatggttcaaccagcccgcccgcaagcagaggcgccgcattgctcgtcaaaagaaggctgcgaagatattcccacgcccaactgctggacctcttcgccccattgtccaatgccagactctcaagtataacatgaagtcaagggctggcagaggctttactcttgaggagctgaaggctgcgggcattccgaagaagcttgctccaaccattggcatttctgtggatcaccgccgcaagaacaaatcacttgagggacttcaggctaatgtccagaggctgaagacatacaaggccaagctggttatcttcccaaggcgtgctcgcaaggtcaaggctggtgactctactcccgaggagcttgccagcgccacccaggtccagggtgactacatgcctattactcgtggtgaaaagcgctcggttgaggttgtgaaggtcagcgatgagatgaagtcgttcgcagcctatggcaagatccgccttgagaggatgaacaagaagcaccttggtgcccgccagaagaaggccgctaaggcagagaaggaagagaagaagtaaagcggccagatatcggatatagtatcttctagttgatgctacagcgaagggcttgctctaagttctttttgctgctgaaaatagagaccagccgattgttttggtgtccttgtactgtttgatacctggtactcatttgcgtactctattatctaatggttcatcggacacttgccctctcctcaaaaaaaaaaaaaaaaaaaa

SEQ ID NO: 1408 - protein, 208 aa, Panicum virgatum
  misc_feature: Ceres CLONE 1764959
  misc_feature: Great-hit functional homolog of the protein sequence given in SEQ ID NO 9243
  misc_feature: Useful for making plants with modulated nitrogen use efficiency
  misc_feature: Useful for making plants with modulated phosphate use efficiency
MVKHNNIIPNGHFKKHWQNYVKTWFNQPARKQRRRIARQKKAAKIFPRPTAGPLRPIVQCQTLKYNMKSRAGRGFTLEELKAAGIPKKLAPTIGISVDHRRKNKSLEGLQANVQRLKTYKAKLVIFPRRARKVKAGDSTPEELASATQVQGDYMPITRGEKRSVEVVKVSDEMKSFAAYGKIRLERMNKKHLGARQKKAAKAEKEEKK

SEQ ID NO: 1409 - DNA, 749 bp, Panicum virgatum
  misc_feature: Ceres CLONE 1764977
  misc_feature: Encodes the peptide sequence at SEQ ID NO. 1410
cccctcgcctcacacagcaatcgaatccaagcatccccaattccccaaaccccaagcacctccgcagccgcagcaccaccgatggcgcccaaggcggagaagaagccggcggcgaagaagcccgcggaggaggagcccgcggcggagaaggcggagaaggccccggcggggaagaagcccaaggcggagaagcgcctccccgccggcaagtccagcgccggcaaggacggcgagggcaagaagggcaagaagaaggccaagaagagcgtcgagacctacaagatctacatcttcaaggtgctcaagcaggtgcacccggacatcggcatctcctccaaggccatgtccatcatgaactccttcatcaacgacatcttcgagaagctcgccgccgaggccgccaagctcgcccgctacaacaagaagcccaccatcacctcccgcgagatccagacctccgtccgcctcgtcctccccggggagctcgccaagcacgccgtctccgagggcaccaaggccgtcaccaagttcacctcgtcttagttaggtttgccgcctcttgtggtgccagtactagttcggttgggtgctgctgctagacctggctccctcggtttaatttatctggtagaagtagtactatcatcagcagtgtcgaatggaaatggatggttagtgtgtagttgtatgaattgtgtacctaatctggaacatcaatggtgcctgttctgttctattaacttttgttc

SEQ ID NO: 1410 - protein, 153 aa, Panicum virgatum
  misc_feature: Ceres CLONE 1764977
  misc_feature: Great-hit functional homolog of the protein sequence given in SEQ ID NO 9491
  misc_feature: Useful for biocontainment applications
  misc_feature: Useful for making plants with modulated flowering time
  misc_feature: No seed is being produced by the plant
  misc_feature: The plant flowers significantly late compared to wild-type.
MAPKAEKKPAAKKPAEEEPAAEKAEKAPAGKKPKAEKRLPAGKSSAGKDGEGKKGKKKAKKSVETYKIYIFKVLKQVHPDIGISSKAMSIMNSFINDIFEKLAAEAAKLARYNKKPTITSREIQTSVRLVLPGELAKHAVSEGTKAVTKFTSS

SEQ ID NO: 1411 - DNA, 619 bp, Panicum virgatum
  misc_feature: Ceres CLONE 1765021
  misc_feature: Encodes the peptide sequence at SEQ ID NO. 1412
ctcatcacaagcgaagcagagcacacaagaagcagcactccaccttcttcagccgcgctacctgcttccttcctcgctcgtgatcaccgagaggatatgtcttgctgcggcggcaactgcgggtgcggctccggctgcaagtgcggcaacggatgcggcggctgcaagatgtcccctgacgtggaggcctcctccaccaccaccaccaccatggtcatcgccgccgccagcagcaaggcgagctccggcgggttcgaggcggccaccgagggcggcggctgcgactgcaacacctgcaagtgcggcaccagctgcggctgctcctgctgcagctgcaactgaggcggccatgcgccgccgccatggagcacgaggaggaaggagaagcccccggcgtagtatatagtagcagcgcgtctaaataagaacttgccaactgcgccatccatcatctatcgtgtcgtgtcgtgacattcatggtcgcctgccgtgtctcagctggggttgtcgatctgaacatctctgctgatcgacgacgcatgccggtcgtcgatcttagcttgtgtgtccgtcctcctcgtgcacgccacctctcctttaatatatgtatttcagaact

SEQ ID NO: 1412 - protein, 81 aa, Panicum virgatum
  misc_feature: Ceres CLONE 1765021
  misc_feature (1)..(83): Pfam Name: Metallothio_2 Pfam Description: Metallothionein
MSCCGGNCGCGSGCKCGNGCGGCKMSPDVEASSTTTTTMVIAAASSKASSGGFEAATEGGGCDCNTCKCGTSCGCSCCSCN

SEQ ID NO: 1413 - DNA, 559 bp, Panicum virgatum
  misc_feature: Ceres CLONE 1765063
  misc_feature: Encodes the peptide sequence at SEQ ID NO. 1414
ttgttcagatcctacgattcatcgtcctcctcgtcacctctcgtgcacaccaccttccattcttcggctaactcctaatcttccgattcagagcgggcggggcgtttggctcagatcgggcagccgccatggtggatcagttcgcggattcggcgaacaatgtgatcatcgaggaggtaaacaagggcctgaacccaggaatgatagtcctgcttgtagttgcaagcttcctgctgctcttctttgtgggaaactatgcgctgtatgtgtacgcacagaagacgcttccacctaagaagaagaagccggtctccaagaagaagctgaagagggaaaagctgaagcagggcgtctccgctccaggagagtaaacagccatgctactgatctcctcctgagctcctctttacatgataaaaatatatatatatagaccagctggagctgcattgtctgaagtgagtctgtagaagctttgtcttgagtggtacatttgtattgtgtttcagcaactgatggaacctttagcctaaattgagctactccattgtttcctgtc

SEQ ID NO: 1414 - protein, 80 aa, Panicum virgatum
  misc_feature: Ceres CLONE 1765063
  misc_feature: The sequence is a functional homolog of  SEQ ID NO 1769 in the  11/479,226 US patent application
  misc_feature: The sequence is a functional homolog of  SEQ ID NO 2604 in the  10/374,780 US patent application
  misc_feature: The sequence is a functional homolog of  SEQ ID NO 960 in the  10/225,066 US patent application
  misc_feature: Useful for making plants with modulated growth and phenotype characteristics
MVDQFADSANNVIIEEVNKGLNPGMIVLLVVASFLLLFFVGNYALYVYAQKTLPPKKKKPVSKKKLKREKLKQGVSAPGE

SEQ ID NO: 1415 - DNA, 734 bp, Panicum virgatum
  misc_feature: Ceres CLONE 1765182
  misc_feature: Encodes the peptide sequence at SEQ ID NO. 1416
gctggacaccgtgtggtgacgaagacggtgtgaagccaaagctctctggaactactccggcgatcatcggaagcacacgcacgaggccgcgggaccttccggaaccttcgcgaggatgctcaccaggttctcggcgtggttcgtgaacccgcgccggaacccgctggcgcgcctccaccggaacgccgtcgcctcccgcctccgcaaatacgggctccggtacgacgacctgtacgacccgtaccacgatctggacatcaaggaggcgctggcgcgcctgccgcgggaggtggtggacgcgcgcaaccagcgcctgaagcgggccatggacctctccatgaagcaccagtacctccccgacgacctccaggcaatacagacgccattcagaagctacctttctgacatgcttgctcttgtgaaaaaggagaatgcagagcgtgaagctctgggagcacttcccctgtaccagagaaccatcccataatgtgctttcttcattatgatctaacaatgatcgcaataaaatacagcgatggtgctatagtgtgtattatgtttaatcaaagacactgccagcccaaaacccactgtgtcagcgcaatgtaatagttgacggagcctttgtgtagttgcgaagtcctgaacgattcagtacgttttgtaaactggaatattgtttctgaagtccgctcggtgctaccgctgcggagtatagttttgtgtcgatcatt

SEQ ID NO: 1416 - protein, 123 aa, Panicum virgatum
  misc_feature: Ceres CLONE 1765182
  misc_feature (1)..(123): SWISSPROT Homolog: EC 1.10.2.2 Ubiquinol-cytochrome c reductase complex 14 kDa protein
MLTRFSAWFVNPRRNPLARLHRNAVASRLRKYGLRYDDLYDPYHDLDIKEALARLPREVVDARNQRLKRAMDLSMKHQYLPDDLQAIQTPFRSYLSDMLALVKKENAEREALGALPLYQRTIP

SEQ ID NO: 1417 - DNA, 724 bp, Panicum virgatum
  misc_feature: Ceres CLONE 1765260
  misc_feature: Encodes the peptide sequence at SEQ ID NO. 1418
aaataaaccatcacaggaactcagcaattgagttgattgatcacttctgctctgtgcgcctgtggcccagtaatttccgcagagcgaaatggcaggcaaggcctcggtcgcgctgttcctggccgtcaacatggtcgtgttcgccatggccagcgcctgcggtggcgactgccccacgccgtcgaccccgtccaccccatccacgccgaccccgacgccggcgtcgagaggcaggtgcccccgcgacgcgctgaagctgggcgtgtgcgccaacgtgctgggcctgatcaaggccaaggtcggcgtgccgccggcggagccctgctgcccgctgctggaggggctcgtcgacctcgaggccgccctgtgcctctgcaccgccatcaagggcaacatcctcggcatcaacctgaacctgcccatcgacctcagcctcatcctcaactactgcggcaagaccgtgcccactggcttcaagtgcctctaagcatgcgtccggccgcggggtcacgagtttattatgcacacgcgtgcgttgatcgttcgaatcctggtgtgtttggttaatctgcattcgtggtggtctgcactctgcacgagctcatgcaagcgcggtcgccgcatgtaccgatcgatctctcgttcgatcagctctattttgtttccattgcttgatctattgttcgtttccagtttactatctatccagtttccgttttgtatt

SEQ ID NO: 1418 - protein, 132 aa, Panicum virgatum
  misc_feature: Ceres CLONE 1765260
  misc_feature (1)..(82): Pfam Name: Tryp_alpha_amyl Pfam Description: Protease inhibitor/seed storage/LTP family
MAGKASVALFLAVNMVVFAMASACGGDCPTPSTPSTPSTPTPTPASRGRCPRDALKLGVCANVLGLIKAKVGVPPAEPCCPLLEGLVDLEAALCLCTAIKGNILGINLNLPIDLSLILNYCGKTVPTGFKCL

SEQ ID NO: 1419 - DNA, 663 bp, Panicum virgatum
  misc_feature: Ceres CLONE 1765295
  misc_feature: Encodes the peptide sequence at SEQ ID NO. 1420
acaggaggccgcaggctggaaccgggagctctcaagaaagctctagcccaaggtccggccggcatcgatggcgcccagcaagctcgcagtggccgtcgccctggtggcgactctcctccttctcagcaacagcaacatcaaggctgctcccggcggcggctacccgccggctccccccgtcgggcctccgccgcaccagatcgtcgaccccgccaaagactgcggcggcgcctgcgacgtgcggtgcggcgcgcactcgcgcaagaaccggtgcacccgggcgtgcctcacgtgctgcaaagcctgccgctgcgtgccggcgggcacggccggcaaccaggagacctgcggcaagtgctacactgactggaccacgcacggcaacaggaccaagtgcccgtgagcggcggcgccgtgtttggtgttccccggccgagagcagccagagagaggttgccggcgcactaccggcgccgtgtcttgtacttgatccatcggctttagatgtaggatgcgtgctctgttgtttcttctttctgatgttgatgggctggttgtgactgcatccctttgtagtaaaaaagaagaagagtgcgaggcgtctctctagccgtaaaatccatttgggttgtattacctgtctaaaaaaaaaaaaaaaaaaaa

SEQ ID NO: 1420 - protein, 111 aa, Panicum virgatum
  misc_feature: Ceres CLONE 1765295
  misc_feature (2)..(102): Pfam Name: GASA Pfam Description: Gibberellin regulated protein
MAPSKLAVAVALVATLLLLSNSNIKAAPGGGYPPAPPVGPPPHQIVDPAKDCGGACDVRCGAHSRKNRCTRACLTCCKACRCVPAGTAGNQETCGKCYTDWTTHGNRTKCP

SEQ ID NO: 1421 - DNA, 884 bp, Panicum virgatum
  misc_feature: Ceres CLONE 1765342
  misc_feature: Encodes the peptide sequence at SEQ ID NO. 1422
aaccgccgccttccagtgccccgccggtctgcctatttatgccccgctccggaccagcgctcagggcctcaagccactgctagccgctgcgcgctgcatcctagctcactagtactactactagctagtaaagccatggctcccaccgtgatggccgcctcggccacctccgtggctccgttccagggcctcaagtccactgccaggctccccgtcagccgccgcaccagcagcaacggcttccgcaacgtcagcaacggcggaaggatcaggtgcatgcaggtgtggccgactgagaacaacaagaagttcgagaccctgtcgtacctgccaccactctccacagaggacctcttgaagcagatcgactacctgatccggaacaactgggtcccttgcctcgagttcagcaaggtcggcttcgtcttccgtgagaacgccacttctcccgggtactacgatggccgctactggaccatgtggaagctgcccatgttcggctgcaccgacgccacccaggtgtacgccgagctcgaggagtgcaagaaggcctatcccgacaactacatccgcatcctcggattcgacaacgccaggcaggtgcagtgcgtcatgttcatcgcctacaagcccgagtagaccggccgcggctaagattaccgatcgcgcgcggacagctagcactcggttttggcaaccttgaagccctatgtttcgtcttcatcctttgtttgtttcctttcttgatacttcattgtttgtttcctttcttgatacgtcattgttgacaccaattttggcttagtccaaaatatggaaaatacttatatagtataccatatcaaataaaatatgttgatggctaaaaaaaaaaaaaaaaaaaa

SEQ ID NO: 1422 - protein, 167 aa, Panicum virgatum
  misc_feature: Ceres CLONE 1765342
  misc_feature (1)..(109): Pfam Name: RuBisCO_small Pfam Description: Ribulose bisphosphate carboxylase, small chain
  misc_feature (1)..(166): SWISSPROT Homolog: EC 4.1.1.39 Ribulose bisphosphate carboxylase small chain A, chloroplast precursor
  misc_feature (1)..(166): SWISSPROT Homolog: EC 4.1.1.39 Ribulose bisphosphate carboxylase small chain, chloroplast precursor
MAPTVMAASATSVAPFQGLKSTARLPVSRRTSSNGFRNVSNGGRIRCMQVWPTENNKKFETLSYLPPLSTEDLLKQIDYLIRNNWVPCLEFSKVGFVFRENATSPGYYDGRYWTMWKLPMFGCTDATQVYAELEECKKAYPDNYIRILGFDNARQVQCVMFIAYKPE

SEQ ID NO: 1423 - DNA, 844 bp, Panicum virgatum
  misc_feature: Ceres CLONE 1765346
  misc_feature: Encodes the peptide sequence at SEQ ID NO. 1424
gaacggggcggagcgacttcagaagaggtcgacccgcaccccttgcaggttgagaatcccaagctcccacccgcagtccgcagacacgctccgccgcttcgccccaattcccaaccaccaccaccttcacttcacctcgaccgaaccgatggagcagcaagggagcgagaacacgcaggagccgctcccctgcgccaacaactgcggtttcttcggctccccggccacgcgcaacctctgctccaagtgcttccgcgacagcctccgccacgccgaggcccaggcggtggcggcgacagcgacagcgacggccgcgctcgccgcctcttcttctccggccgcggcgtcagcggatcccgacgcggcgacagcggcagcgacggaggaggcggggaaggcgcgagcgaaggggaagaagagcggccggtgcgcggcgtgcgggaggaaggtggggctgatggggttcgagtgccggtgcggcggcgtcttctgcggcgcgcaccgctactcggaccggcacgactgcggctacgactacaggggcgccggccgcgacgccatcgcccgcgccaaccccgtcgtcagggccgacaagcaggtcgacaagctctgaccgagcagcgccggcgcgtgctctgctctcaggcagcaaaccatcactggcctggcctggctgctcgatcgaagattcgaagtatgcagtatgcttgattgaagtctagtcgattgcaattcgcgtcaacatctctgtacctcttcgctagttcatgatgtatatttgctatacctacctgctgctagtgcagttgcttgttaacagacagaaaaaaaaaaaaaaaaaaaa

SEQ ID NO: 1424 - protein, 154 aa, Panicum virgatum
  misc_feature: Ceres CLONE 1765346
  misc_feature: Great-hit functional homolog of the protein sequence given in SEQ ID NO 9272
  misc_feature (1)..(41): Pfam Name: zf-AN1 Pfam Description: AN1-like Zinc finger
  misc_feature: Useful for making plants with altered Lignin content
MEQQGSENTQEPLPCANNCGFFGSPATRNLCSKCFRDSLRHAEAQAVAATATATAALAASSSPAAASADPDAATAAATEEAGKARAKGKKSGRCAACGRKVGLMGFECRCGGVFCGAHRYSDRHDCGYDYRGAGRDAIARANPVVRADKQVDKL

SEQ ID NO: 1425 - DNA, 782 bp, Panicum virgatum
  misc_feature: Ceres CLONE 1765360
  misc_feature: Encodes the peptide sequence at SEQ ID NO. 1426
ctctctcacacacacacacacacatggcggcgtcggcgtcgacgccgcagggggtggcggagcggcggggcatcccggcggcggccttcgtcgaggacgtcgaggcctacctccgccaggccgggctcgacgtcaattccgccctcgccttcctccaggagaggctgcagcaatacaaaatagtggagatgaagcttctagcacaacaaagggatcttcaggcaaaaattcctgatatagagaagtgcttggatattgttgcagcgttacaagctaaaaaggatttgggtgaggcactcattgctgattttgaattatctgaggggatctactcccgagcaaaaattgaggataccgactcagtgtgcctttggttgggagcaaatgtgatgctggaatattcctgcgatgaggccaacgccctcttgaaaaagaacttggaaaatgccaaggccagcttagaagtccttgttgctgatcttcagttcttgcgagaccaacaaaccatcactcaggttacaattgctcgggtattcaactgggatgtgcaccaacggagaagcaagcaggctgtaaaagaaacttgatcagttatttcacaagtccagccagtgagatagggacattttttggggtactttttgctacctctgtcagattagtccatcatagcgtgccctttgttgttgatggttcctttgccgtgtaacattgtatcggtttatatgttctgtggtgtggagactccattagtagaagattataactttactgcatgccct

SEQ ID NO: 1426 - protein, 187 aa, Panicum virgatum
  misc_feature: Ceres CLONE 1765360
  misc_feature: Great-hit functional homolog of the protein sequence given in SEQ ID NO 9342
  misc_feature: Useful for making plants with modulated nitrogen use efficiency
MAASASTPQGVAERRGIPAAAFVEDVEAYLRQAGLDVNSALAFLQERLQQYKIVEMKLLAQQRDLQAKIPDIEKCLDIVAALQAKKDLGEALIADFELSEGIYSRAKIEDTDSVCLWLGANVMLEYSCDEANALLKKNLENAKASLEVLVADLQFLRDQQTITQVTIARVFNWDVHQRRSKQAVKET

SEQ ID NO: 1427 - DNA, 752 bp, Panicum virgatum
  misc_feature: Ceres CLONE 1765397
  misc_feature: Encodes the peptide sequence at SEQ ID NO. 1428
gtctcgctaatccactgaccggccaccgtttcccgcccaacggaaccatctcggcgtctcgctccatggcggccgccgcgtcgtccacgctgcagcagggaagcaacttcacaaacgcttaccgtgtcccaagaacctccagtcaacagcgcattccaagtggcttagtgaggagatcggcgccttcctcactctgcttccgcgccgggagcgagcggacagcggcagtcgtccgcgcggcggcggcgggcgacgggggtgcgccggccgtctccctgccggcggcgctgctgtttgactgcgagggcgtgctggtggacacggagaaggacggccaccgcatctctttcaacgaggcctttgccgagagggaattaggtgtcagctgggatgttgaattgtacggagaattgctcgagataggtggtgggaaggaaagccatgccgaaggccgccttccagtttggggtgaagatgcaggacggcaggaaaacgaggaagcagaacaaggaccagaagctcactaatgatctccacaagatcaacaagatccttgctaggaagaagggtgagaaagatggaacagatgatggcaggaatacagtttgattcaacgcgctgctcttgttgattctggtctgccccttggggtgaggttaacttttgtaacatgtgctaatgctcttgttgccggcctcctgcctggttgacccccatagttgatttcatttatgaaaaagggcagtctttgc

SEQ ID NO: 1428 - protein, 153 aa, Panicum virgatum
  misc_feature: Ceres CLONE 1765397
  misc_feature (1)..(77): Pfam Name: Hydrolase Pfam Description: haloacid dehalogenase-like hydrolase
MAAAASSTLQQGSNFTNAYRVPRTSSQQRIPSGLVRRSAPSSLCFRAGSERTAAVVRAAAAGDGGAPAVSLPAALLFDCEGVLVDTEKDGHRISFNEAFAERELGVSWDVELYGELLEIGGGKESHAEGRLPVWGEDAGRQENEEAEQGPEAH

SEQ ID NO: 1429 - DNA, 778 bp, Panicum virgatum
  misc_feature: Ceres CLONE 1765425
  misc_feature: Encodes the peptide sequence at SEQ ID NO. 1430
aatccatcccgcgctgcaacctgcaagctgccatccatccattccattcgcatccaatggcgctctcgctctccctgaagccgccagtagccgcatcagccgccgccggcagcagcagctgctgcccgagcttcctgcggccggcggcggtggcgatgaggcgtggtcggagcagtagtgcgcgcggcagcgtggtggcgatggccgacctgctgggcgacttcggtgcgcgcgatcccttcccggaggagatcgagagcaagttcggggagaaggtgctgggcaacgtggacactctccaccagatcctcatcccgaccctgtcggctctctcgctggctcgcctcccgctgcagcccgacgcggaggcgctctccctggacgatgcgcgcaggctgctcctcaaggtggtcgggtggaggctgctgctctccgacgacgagcagcggcccgcgcggctgcagtgcgtctggaaggtacgcgacgagtcctgcggccaggagctcatcgccaggatcaacgcagcgctcgacggtgccggccacgcgccggcagcactggtctgggaggcccccagccaggtgagggccttgctctcaacgccctccgccgccggtgacagcctcaccgtcaacgactacatcgtcgccgccaggatagacaaagtcaagacgctcgatcttatccccaagaagcgagtatgggcatgaatggcaattgatcttacattttctatcccttcaattaattaattagaattacttgcccacttgaattt

SEQ ID NO: 1430 - protein, 217 aa, Panicum virgatum
  misc_feature: Ceres CLONE 1765425
  misc_feature: Great-hit functional homolog of the protein sequence given in SEQ ID NO 9689
  misc_feature: Useful for making plants with altered alkaloid content
  misc_feature: Useful for making plants with altered terpenoid content
MALSLSLKPPVAASAAAGSSSCCPSFLRPAAVAMRRGRSSSARGSVVAMADLLGDFGARDPFPEEIESKFGEKVLGNVDTLHQILIPTLSALSLARLPLQPDAEALSLDDARRLLLKVVGWRLLLSDDEQRPARLQCVWKVRDESCGQELIARINAALDGAGHAPAALVWEAPSQVRALLSTPSAAGDSLTVNDYIVAARIDKVKTLDLIPKKRVWA

SEQ ID NO: 1431 - DNA, 1152 bp, Panicum virgatum
  misc_feature: Ceres CLONE 1765449
  misc_feature: Encodes the peptide sequence at SEQ ID NO. 1432
gctggtcccagtggccgccgccgcctcatcctcctttttccaactccgcctccaccagccccctatccccggcggaccccggagcccgtgcagatggcgaccgtggcgacggcgtccgccacggcggcgacccgcttcacgctcctagctggcgccggcctccgcagccgtgccagccgcctccccaccgccgtgcggttccagcgccagcgggggctcaccaccaccgcgctcctcaagaccgccgacctccggcccaaggagcagggccagcccgagacgctcgactaccgcgtcttcctcatcgacggcgggggccggaagttgtcgccgtggcacgacgtgccgctgcgcgccggggacggcgcgttccacttcatcgtcgagatccccaaggagagcagcgctaagatggaggtcgccaccgacgaggccttcacgcccatcaagcaggacaccaagaagggcaacctccgatactacccgtacaatattaattggaactatggattatttcctcaaacatgggaagacccgactactgcaaattctgatgttgaaggagcattcggagataatgaccctgttgatgttgttgagataggtgaaagacgtgccaatattggggatgtccttaaggttaaaccattggcagctttagcaatgattgatgagggggagctcgactggaaaattgtggccatttctttggatgacccaaaagcatctcttgttaatgatgtggatgatgttgagaagcattttccggggacactgactgccatcagagactggttcagagactacaagataccagatggaaagcctgccaacagatttggtctcggcaacaagcccacaagcaaggaatatgcgctgaaggtcattgaggaaactaacgaatcatgggagaaattggtgaagaggaatatccctgctagagagctctcactagcctaatctcgaggccatgagaagccacaacattctttgaaccgcgtttttcttgatcatgtcgttttgtatgctgtaactatgtaagcatgcttcttcattttgcagacgttttttcgaactgtgtaacaggaataatcttgtcgggtgaataatgattctggagcgagtttttactaaaaaaaaaaaaaaaaaaaa

SEQ ID NO: 1432 - protein, 288 aa, Panicum virgatum
  misc_feature: Ceres CLONE 1765449
  misc_feature (1)..(181): Pfam Name: Pyrophosphatase Pfam Description: Inorganic pyrophosphatase
  misc_feature (33)..(287): SWISSPROT Homolog: EC 3.6.1.1 Soluble inorganic pyrophosphatase 1, chloroplast precursor
MATVATASATAATRFTLLAGAGLRSRASRLPTAVRFQRQRGLTTTALLKTADLRPKEQGQPETLDYRVFLIDGGGRKLSPWHDVPLRAGDGAFHFIVEIPKESSAKMEVATDEAFTPIKQDTKKGNLRYYPYNINWNYGLFPQTWEDPTTANSDVEGAFGDNDPVDVVEIGERRANIGDVLKVKPLAALAMIDEGELDWKIVAISLDDPKASLVNDVDDVEKHFPGTLTAIRDWFRDYKIPDGKPANRFGLGNKPTSKEYALKVIEETNESWEKLVKRNIPARELSLA

SEQ ID NO: 1433 - DNA, 678 bp, Panicum virgatum
  misc_feature: Ceres CLONE 1765454
  misc_feature: Encodes the peptide sequence at SEQ ID NO. 1434
aactcgtcgtcgccgccgctcttcctcccctgtcgacgacccaaacccaatctcttcagccggacagggggcaagcagccgagcgacgacggccatgctctccgccgccgctgcctccaccatccccaggctccgcctcgcggcgcagccgctgccgaggctcccttcggctaggtcccactggctgcggcccctctcctccgccacccatgtaacggcgcctgctgctgcggcggcgggggcggggtcgctggagccgccggacctgccccgcctcgccaacgccgcgcgcatctcgctctccccacaggaggccgaggagttcgagcctaagattcggcaggtcgtcgattggtttgggcagcttcaggcagttgatcttgagtccattgagccttcacttagagctggcacagctgctggtagttctttgagggaagataagcctgaaacatttgttaacagagatgccatagtcgaggccgttccaagctttgatgatccatttatcaaagtgccaagagtgctgaataaagaatgatttgtaggcatatcaacattgttagaatgttaaaacgctgagccatttgtacaacacagcagggtttaacaaaacgatgaaagctgcaaaagattgaacagagaaatcagcaaactgagttgatttcgtggcatttc

SEQ ID NO: 1434 - protein, 148 aa, Panicum virgatum
  misc_feature: Ceres CLONE 1765454
  misc_feature (1)..(73): Pfam Name: Glu-tRNAGln Pfam Description: Glu-tRNAGln amidotransferase C subunit
MLSAAAASTIPRLRLAAQPLPRLPSARSHWLRPLSSATHVTAPAAAAAGAGSLEPPDLPRLANAARISLSPQEAEEFEPKIRQVVDWFGQLQAVDLESIEPSLRAGTAAGSSLREDKPETFVNRDAIVEAVPSFDDPFIKVPRVLNKE

SEQ ID NO: 1435 - DNA, 938 bp, Panicum virgatum
  misc_feature: Ceres CLONE 1765479
  misc_feature: Encodes the peptide sequence at SEQ ID NO. 1436
atcagcttggctgcgcctgacccgcgaatccccggcgaccgccctcgcagcttcctccgccggttgccggctggcctcgaacctgcgagaagcttccggcgccggcccaccgagaaccgcaatggcgtccgccggcggagcggccatctcggcggggcccacgccgccgtcggcgacggcgacggcggtggagtggcaccagcggccgccgaacccgaagaacccggtggtattcttcgacgtcaccattgggtccatccccgccggccgcatcaagatggagctcttcgccgacatcgcccccaagaccgccgagaacttccggcagttctgcactggcgagcacagaaaaaatggtttaccacaaggttttaagggctgtcaattccatagagtgatcaaagatttcatgattcagggtggtgacttcttgaagaatgatggtactggatgcatatcaatctacggtgccaaatttgatgatgagaattttattgcaaagcatacggggcctggactgctctcaatggcaaacagtggtgctaactctaatggatctcagttctttataacttgtgcaaagtgtgactggctggacaacaaacatgtggtctttgggagagtgcttggggatggtctacttgttctgaggaagattgaaaatgttgccactggaccgaacaaccgaccaaagcttgcctgcattataagcgagtgtggtgaaatgtaacgtgatccctgaatgcagctaaccgtgcactcttgatgctgctgatgcgtagacactgtttggttgatgaaagcactggaggagtggagacaatgaagcatgtcaaaatcgatgctgatcgagttgtaccgtttctgcgcaatctgtagaacaatattcgaaacaagaaattaatgttcctgtttgacaaaaaaaaaaaaaaaaaaaa

SEQ ID NO: 1436 - protein, 202 aa, Panicum virgatum
  misc_feature: Ceres CLONE 1765479
  misc_feature (1)..(167): Pfam Name: Pro_isomerase Pfam Description: Cyclophilin type peptidyl- prolyl cis-trans isomerase/CLD
  misc_feature (33)..(202): SWISSPROT Homolog: EC 5.2.1.8 Peptidyl-prolyl cis-trans isomerase H
MASAGGAAISAGPTPPSATATAVEWHQRPPNPKNPVVFFDVTIGSIPAGRIKMELFADIAPKTAENFRQFCTGEHRKNGLPQGFKGCQFHRVIKDFMIQGGDFLKNDGTGCISIYGAKFDDENFIAKHTGPGLLSMANSGANSNGSQFFITCAKCDWLDNKHVVFGRVLGDGLLVLRKIENVATGPNNRPKLACIISECGEM

SEQ ID NO: 1437 - DNA, 449 bp, Panicum virgatum
  misc_feature: Ceres CLONE 1765483
  misc_feature: Encodes the peptide sequence at SEQ ID NO. 1438
ggagagcgcgcagtaaccagccaccgatagcccgtgcgggacttggagcgcaagcaaggcgggcgcgcggccatggactccttctcgtcgccctcgctgtcgtcgtcaagttccagccccaacccggaggccgttatggagcagatcaaggcgcagctcgcacaggcttacgcgcaggagtttctcgagaccgtggggaacaagtgcttcgaaaagtgtgtgaccaagccaggatcaagcttgagcggaagcgagagcagctgcatatcacgttgtgttgaccgctacattgaggccaccggtattgtgagccgagccttgttcagctcccagcgctaagagcacattatgatttcagtgatcgctcctgagagtgatgtacccttgagaattttgacttgtcaggatatgcaataacaattgatgcttggttgcccaagcagcgaatc

SEQ ID NO: 1438 - protein, 88 aa, Panicum virgatum
  misc_feature: Ceres CLONE 1765483
  misc_feature: Great-hit functional homolog of the protein sequence given in SEQ ID NO 9363
  misc_feature: Useful for making plants with altered alkaloid content
  misc_feature: Useful for making plants with altered terpenoid content
MDSFSSPSLSSSSSSPNPEAVMEQIKAQLAQAYAQEFLETVGNKCFEKCVTKPGSSLSGSESSCISRCVDRYIEATGIVSRALFSSQR

SEQ ID NO: 1439 - DNA, 922 bp, Panicum virgatum
  misc_feature: Ceres CLONE 1765506
  misc_feature: Encodes the peptide sequence at SEQ ID NO. 1440
ccgactcggcccttcttccccaatcctcctcccccgatccagccccgcagcgacgccgaggcagagcgagcgagaggagagaccgagatcgcgcgcggagatgtcgtcggactcgtcgtcgtgggcgcgcgccatggtgcagatctcgccctacaccttctccgccatcggcatcgccgtctccatcggcgtctccgtcctcggcgcggcatggggcatcttcatcacggggagcagcctcatcggggccgccatcaaggcgcccaggatcacatctaagaacctcatcagtgtcatcttctgtgaggctgtcgcaatttatggtgtaattgtggcaatcatcctccagacaaaacttgaaagtgtgccatcatctcaaatgtatgctccggagtctcttcgagctggctatgcaatctttgcatctggccttattgttggctttgctaatcttgtgtgcggggtttgcgtgggcataattggaagtagctgcgcactgtctgatgctcagaactcgtcgctctttgtaaagatcttggtaattgagatcttcggcagcgctctggggctgtttggagtcattgtgggcatcatcatgtcatctcaagcgacatggccggccaaagcttgattttccccactcaccactctgttaattatttcgaatgaaatgtatccgaatgtcaagatgtggtcctactgcctttacctgtctctccctctctctctgtttttttttcttttgcacctttttggaaaaatacttaattcggtgccctcagcgcaaccgattgtagagttgatattcctactgccgagactccatgtgtgctggatatcttgtaggtgctattgctgttgcaagacacttggcttattgaataaatgcattggaactgaataaaaaaaaaaaaaaaaaaaa

SEQ ID NO: 1440 - protein, 176 aa, Panicum virgatum
  misc_feature: Ceres CLONE 1765506
  misc_feature (1)..(66): Pfam Name: ATP-synt_C Pfam Description: ATP synthase subunit C
  misc_feature (12)..(169): SWISSPROT Homolog: EC 3.6.3.14 Vacuolar ATP synthase 21 kDa proteolipid subunit
  misc_feature (7)..(171): SWISSPROT Homolog: EC 3.6.3.14 Vacuolar ATP synthase subunit c''
MSSDSSSWARAMVQISPYTFSAIGIAVSIGVSVLGAAWGIFITGSSLIGAAIKAPRITSKNLISVIFCEAVAIYGVIVAIILQTKLESVPSSQMYAPESLRAGYAIFASGLIVGFANLVCGVCVGIIGSSCALSDAQNSSLFVKILVIEIFGSALGLFGVIVGIIMSSQATWPAKA

SEQ ID NO: 1441 - DNA, 893 bp, Panicum virgatum
  misc_feature: Ceres CLONE 1765562
  misc_feature: Encodes the peptide sequence at SEQ ID NO. 1442
ccatccattgctcgtctccctcccaactttgatgcctttgtagcgctgccgcttcgcccgtgcgtcgcgccgcgccgcgccgtgcagtccgctcgccgctgcgcttcccatggacaccggggccggggccggatccggcaatgcctccggcggcggcggcgcgtccgtgtgctgctactacgccctgctcggcatccgcaagaacgcctccgccaccgacatccgcaccgcctaccggaggctcgcgatgaagtggcacccggaccggtgggcgagcgaccccggcgccgccggcgaggccaagcggcggttccagcggatttttttggcctattccgtcttgtcggacaaggggaagaaggccatgtacgacgccgggcttttcgatcccctggatgacgacgaccaggatttttccgacttcatgcaggagatgctgggaatgatggataacgtgaaaaacgagaagccggacacgctggaggacctgcagaagatgctggaggacatcgtcaacggcgacgatgggagccgcggcgtgggcggccgcgtgccgccggacggtgcccggcgggcgcgcgtcgcgccgtacccgcagcaccaggggcgcaggtgaccggcgcgcctgtgtacgagatgtacacgcgacgagcctgcgctttcgcggcgagaggaggcggagaaggaagatcagccagcaaagccaacgggaggctctggaagaacaagggggagaataaaaatgaagttgccaagtcggtggtggttgccatccgataatttgaccgtagttgccgggcgcccgctcggtcccggccgcgccgccgcacgaaaccggcggacgcgtggccggggactctgatttgttattacatctcatcgacatttcgtgc

SEQ ID NO: 1442 - protein, 168 aa, Panicum virgatum
  misc_feature: Ceres CLONE 1765562
  misc_feature (2)..(67): Pfam Name: DnaJ Pfam Description: DnaJ domain
  misc_feature (1)..(68): Pfam Name: DnaJ Pfam Description: DnaJ domain
MDTGAGAGSGNASGGGGASVCCYYALLGIRKNASATDIRTAYRRLAMKWHPDRWASDPGAAGEAKRRFQRIFLAYSVLSDKGKKAMYDAGLFDPLDDDDQDFSDFMQEMLGMMDNVKNEKPDTLEDLQKMLEDIVNGDDGSRGVGGRVPPDGARRARVAPYPQHQGRR

SEQ ID NO: 1443 - DNA, 827 bp, Panicum virgatum
  misc_feature: Ceres CLONE 1765585
  misc_feature: Encodes the peptide sequence at SEQ ID NO. 1444
gtcgctgctttcatttcgcaaccgaaccaagaaaaaagaaaagaagagcaagtcgtgcaagaagccgcgcgccgaggagaatgtaccaggccatcccgtacggcgccagccagccgtggccgccgcggccgctccccgcgccgatggccgccgaggcggcggccgtagtggacgccgccgtcgcagcggtggcggcggaggagaggctgcctgcgcagcagccggctgcggcgagggaggaggtgaggcgggccgtggcggagagccccgtggtggttgtggggaggcgcgggtgctgcctcagccacgtcgtgaagcggctgctgcaggggctcggggtcaacccggccgtgcacgaggtcgccagcgaggcggagcttgccgggatcgtcgacggcgacgtcgcgctcccggcggtgttcgtcgggggcaggctcctcgggggcctcgaccggctcatggccgtgcacatctccggcgagctcgtgcccatactgaaggaggccggtgcgctctggctttgaggatcggacacggacggagctccccgcggctcatggccgtgccccgtgcacatcgacttcttcctgttggcgctccgatcctccaaatcttcatcttttcttcttctttttttcctcctccgattaatgaaggcgttcttaattatcattagataggacttcgattcttttaggggaagcgtatattgccgaagcgtatttattaggaaattggagtgcttatcttaagcgatttctatttatttcccatcatgtgaatatgaagagtgctgagaatttacctaaaaaaaaaaaaaaaaaaaa

SEQ ID NO: 1444 - protein, 147 aa, Panicum virgatum
  misc_feature: Ceres CLONE 1765585
  misc_feature (1)..(60): Pfam Name: Glutaredoxin Pfam Description: Glutaredoxin
MYQAIPYGASQPWPPRPLPAPMAAEAAAVVDAAVAAVAAEERLPAQQPAAAREEVRRAVAESPVVVVGRRGCCLSHVVKRLLQGLGVNPAVHEVASEAELAGIVDGDVALPAVFVGGRLLGGLDRLMAVHISGELVPILKEAGALWL

SEQ ID NO: 1445 - DNA, 895 bp, Panicum virgatum
  misc_feature: Ceres CLONE 1765593
  misc_feature: Encodes the peptide sequence at SEQ ID NO. 1446
gccgacttgccttgtcgaaccgtccaggtacaggtccagccgtcccggtcaggggcgccgtctcccctagccgctcctcccgccggcgagtggccgtcgccgcagcaaggagaggagagcagcgatgggcgacgagcgggtaaaggcggaggcactgcagatcctgggcctcttccaggtgctcccccgcctcgtcgttttcgaccttgactacaccctgtggcccttctactgcgagtgccggtcgaagagggattcgcccagcctcttccggcatgccaggggcatcatgtacgccctcaaggagaagggggtcgacatggcaattgcgtctcgctcgcccaccccggacatagccaaggtgttcatcgacaagttggagctccagtccatgttcgttgcccaagaaatattctccagctggactcataagactgagcatttccaaaagatccagaggaaaactgggattccctacaagtctatgcttttctttgatgatgaggacaggaatattaaaacggtatcaaaaatgggagtgacgagtgttctagtagagaacggagtgaacctcgacatgtttaagttgggtctcagtaactttgcaagtaactttgctgcctccagcagaaagcaagacgagtagccttgaaaaggaaaaagcaatacattctccaaaaaaaaccttcggaacgttgtacccgaatttcttataatcaattgcctttattcatgaacattgttttgaggaaggatggcctcagaaactagctagtgtgctgatgcagcaactatctaatgtgtgtttgaagcaaagcactgcatgtatttattttacccactcagttgatgtatttgtgcatttttgattgatcaaaaaaaaaaaaaaaaaaaa

SEQ ID NO: 1446 - protein, 173 aa, Panicum virgatum
  misc_feature: Ceres CLONE 1765593
  misc_feature (1)..(100): Pfam Name: Hydrolase Pfam Description: haloacid dehalogenase-like hydrolase
MGDERVKAEALQILGLFQVLPRLVVFDLDYTLWPFYCECRSKRDSPSLFRHARGIMYALKEKGVDMAIASRSPTPDIAKVFIDKLELQSMFVAQEIFSSWTHKTEHFQKIQRKTGIPYKSMLFFDDEDRNIKTVSKMGVTSVLVENGVNLDMFKLGLSNFASNFAASSRKQDE

SEQ ID NO: 1447 - DNA, 809 bp, Panicum virgatum
  misc_feature: Ceres CLONE 1765670
  misc_feature: Encodes the peptide sequence at SEQ ID NO. 1448
gcaggcagagccgaaagccgagggcgaaaccaatcgcgaaggcgaagcgaagccaccgcgagaggagagggagaggaggcgaggagggatggggcggaagcggaaggagctgctgtcgtcggcgccgtggcggacgggggaggccgccgaggacgaggaggcggccaggctcagccgcgaggggaaggtcagcgtcaccaacaaccccggcgagacggccaccatgaacgtcccccgcagcaggcgccaggacctcgacctcactgttgacgacttcgacgaggaggagatcgaccccgagctgcgctactccttccagcggaacagcaggtttttgaagagaatttttagtgtggatacacttgtcaagcctcttcctcctgtaatggcatacagtgtatctcgtaatgtaaactttttcttcaggatcttcacacagttctgggacgaagaaggaattgccaacgcacagaagtcccttggactggggaatgatgatggttcccgccgaatgcgctaattgtagtcaaacaaagtttctgtactgagctcagaagtcagaactctttgtcctagaccctggagatctgttatatatgcttcaaaagacagctgtggcgcttcttaagtttggattataattttgtttattttagtgtttctttgatgtattttctgctagtaaaactggttgtaccatatgttcagattcaacatcttgtactaaggtttctatttgatctcagaacaagattgagtgaaatgtgggtcagttccacatcttgaatcaaaaaaaaaaaaaaaaaaaa

SEQ ID NO: 1448 - protein, 143 aa, Panicum virgatum
  misc_feature: Ceres CLONE 1765670
  misc_feature: Great-hit functional homolog of the protein sequence given in SEQ ID NO 9648
  misc_feature: Useful for making plants with modulated nitrogen use efficiency
MGRKRKELLSSAPWRTGEAAEDEEAARLSREGKVSVTNNPGETATMNVPRSRRQDLDLTVDDFDEEEIDPELRYSFQRNSRFLKRIFSVDTLVKPLPPVMAYSVSRNVNFFFRIFTQFWDEEGIANAQKSLGLGNDDGSRRMR

SEQ ID NO: 1449 - DNA, 717 bp, Panicum virgatum
  misc_feature: Ceres CLONE 1765679
  misc_feature: Encodes the peptide sequence at SEQ ID NO. 1450
acccgctccccgcccaccaaaaccctagccgccgccgcagcggcatcccaggtaaggaagcaggagcgtcccccgccgccgccgccatgaagcgcaacccccgcgtcacgagctcccgccggaagtgccgcaaggcgcacttcacggccccgtcctccgtccgccgcgtgctcatgtccgcggcgctgtcgacagagctccgccacaagtacaacgtgcgctccatcccgatccgcaaggacgacgaggtgcaggttgtgcgcggcaccttcaagggccgcgagggcaaggtggtgcaggtgtaccgccgccgctgggtcatccacgtcgagcggatcacccgcgagaaggtgaacggctccaccgtcaacgtcggcatccacccctccaaggtcctcgtcaccaagctgaagctcgacaaggaccgcaaggcgctcctcgaccgcaaggcgcgcggccgcgccgccgacaaggccaagggaaaattcaccgccgacgacgtcgccgtcgctgctggtggcgccgccgccaccggtgcctccctccaggagatcgactaggcgctgcgcggcggggatctgatggtggtcgtgccgcctttccctccttattgctcgctctagttttgctatcaatgattatgtgctaggagtttatgttacttgaaaactgctgctttaatatccttgaaatgcctcgatgagagttttggaaccg

SEQ ID NO: 1450 - protein, 157 aa, Panicum virgatum
  misc_feature: Ceres CLONE 1765679
  misc_feature: Great-hit functional homolog of the protein sequence given in SEQ ID NO 9414
  misc_feature: Useful for making plants with modulated biomass
  misc_feature: The plant is abnormally small.
MKRNPRVTSSRRKCRKAHFTAPSSVRRVLMSAALSTELRHKYNVRSIPIRKDDEVQVVRGTFKGREGKVVQVYRRRWVIHVERITREKVNGSTVNVGIHPSKVLVTKLKLDKDRKALLDRKARGRAADKAKGKFTADDVAVAAGGAAATGASLQEID

SEQ ID NO: 1451 - DNA, 827 bp, Panicum virgatum
  misc_feature: Ceres CLONE 1765751
  misc_feature: Encodes the peptide sequence at SEQ ID NO. 1452
ctgaagtttcggcggcggcgtgctcgtgatctcaacaccaggcgctcggctccggtcacccgtcgctccaagcaaccatgtcgaggaggaagactagggagcccaaggaggagaatgtcacccttggccccactgtccgcgaaggagagtttgtctttggagttgctcacatctttgcatccttcaacgataccttcattcatgttactgatttgtctgggagggaaactctggttcggatcactggtggcatgaaggtcaaggctgatcgtgatgaatcgtcaccttatgctgctatgcttgcagctcaagatgttgcagctcgttgcaaggagcttggtatcactgcactgcacattaagcttcgtgcgaccggaggcaacaaaaccaagactcctgggcctggtgctcagtctgctctcagggctcttgctcgttctggcatgaaaattgggcgcattgaggatgttacccctgttcccactgacagcactcgcagaaagggtggtaggaggggaaggaggttgtaggcgtcttctcctggcaatttgccatctcgtggctcaggccatgaagaaactagtccttcctgggtagtgttgcaatttgccatctcgtggctcaggccatgaagaaactagtcctctctgggtagtgttgctgtttctatgcttgtcaagaggagctttaattttgctctatgttgaggatcatttaccgttagttgaacctgtgatgttgcacggatgatattttggttgaggaattgacttgtcatatttatgctaaaacatgtgttttcactctaaaaaaaaaaaaaaaaaaaa

SEQ ID NO: 1452 - protein, 150 aa, Panicum virgatum
  misc_feature: Ceres CLONE 1765751
  misc_feature: Great-hit functional homolog of the protein sequence given in SEQ ID NO 9712
  misc_feature: Useful for making plants with modulated biomass
  misc_feature: The plant is abnormally large.
MSRRKTREPKEENVTLGPTVREGEFVFGVAHIFASFNDTFIHVTDLSGRETLVRITGGMKVKADRDESSPYAAMLAAQDVAARCKELGITALHIKLRATGGNKTKTPGPGAQSALRALARSGMKIGRIEDVTPVPTDSTRRKGGRRGRRL

SEQ ID NO: 1453 - DNA, 807 bp, Panicum virgatum
  misc_feature: Ceres CLONE 1765786
  misc_feature: Encodes the peptide sequence at SEQ ID NO. 1454
ctcctccaaattcctctcctcccctcccccacccatccggcggaaaccctagcgagcgaaccaccggagcagcggcgcttgggcggcggaagccatggcagacgacgattacaacgaaatggacatggggtacgaggatgagcccccagaacctgagattgaggaaggggctgaggaagagcttgagaacaacaatgaggatgcccctgatgatgtggtagatgcagagggtgaagggaaggaacaggaaaaggccaagcgtgagcgcaaaacgtcaaagtatatgacgaagtatgagcgtgcacgcatcctgggtacacgggctttgcagataagcatgaatgctccagtaatggttgagcttgagggagaaactgatcctcttgagattgcaatgaaggagctgagagcgcgcaagatccccttcacaatcaggcggtatttacctgatggaagctatgaggattggggagttgatgagctcatcgtggaggactcatggaaacgccaagttggtggggactgaagctactgagctactcggcgtggaaggcctttgtggtgcagctggactttcctgtatttataatggtctatgctactcctacatatgtggatgctgtagtggatgaactgagacgagatgatgctatgtaacctcaacgtctgtggtcgccttacactctgcaactgttgctcactagctctgttgcactccgtttgtttcaatttcagacatgcagttgcatcacgctcgtgtttcaccttgtgacgttgaacttcgctaatggtttgttcgcctggtcc

SEQ ID NO: 1454 - protein, 143 aa, Panicum virgatum
  misc_feature: Ceres CLONE 1765786
  misc_feature (1)..(54): Pfam Name: RNA_pol_Rpb6 Pfam Description: RNA polymerase Rpb6
  misc_feature (1)..(134): SWISSPROT Homolog: EC 2.7.7.6 DNA-directed RNA polymerases I, II, and III 14.4 kDa polypeptide
MADDDYNEMDMGYEDEPPEPEIEEGAEEELENNNEDAPDDVVDAEGEGKEQEKAKRERKTSKYMTKYERARILGTRALQISMNAPVMVELEGETDPLEIAMKELRARKIPFTIRRYLPDGSYEDWGVDELIVEDSWKRQVGGD

SEQ ID NO: 1455 - DNA, 824 bp, Panicum virgatum
  misc_feature: Ceres CLONE 1765827
  misc_feature: Encodes the peptide sequence at SEQ ID NO. 1456
atggacgagattggtgcggggagtcggagccgacccgtgcgccgccgctgccgccgtcatgggtttccccacccccttcctgcagctgaagccgaagctaattgcgctggagcctccggtcggaggatatccgcggtcgaggaggcacatgcggcgcctgcgctgcgccctcaactctgagaatcctcccatgactgtttccatcactggagccacaggtttcatcggacgcagattggttcagaagcttctattgggtctgctcatctacctgctcactagcttatttttttatataattaagattaaacctgcttgctcactagttagctagctggacagcatgtactcctatatatgttttatcacacccaacgcagatgatcacaaggttttcgtcttaacaaggtctgccaccaaggccgcatcagtttttcctgcttccacctaccctggagtcacaatagccgaacaaggagattgggaggcatgcgttagaggctcttctgctgttgtcaacttggccggcatgcccataagcacaagatggtcaccagaggttaaacaggaaattaagcggagtcgggtcaatgttacatcaaaggtggtgaaatacataaaccatgctggaaatgctgatgctcaaccctcagtgtttgtgagtgcgacagccattggctactatggtaccagcgaaatccatagctttgatgaatcaagtccatccggcaatgactacctagcagaggttaggttcatcagttgcagcttgcactgcctgctttcgaacactactcgagcagtccagcaccgtcacgtttttc

SEQ ID NO: 1456 - protein, 160 aa, Panicum virgatum
  misc_feature: Ceres CLONE 1765827
  misc_feature (20)..(143): Pfam Name: Epimerase Pfam Description: NAD dependent epimerase/dehydratase family
MYSYICFITPNADDHKVFVLTRSATKAASVFPASTYPGVTIAEQGDWEACVRGSSAVVNLAGMPISTRWSPEVKQEIKRSRVNVTSKVVKYINHAGNADAQPSVFVSATAIGYYGTSEIHSFDESSPSGNDYLAEVRFISCSLHCLLSNTTRAVQHRHVF

SEQ ID NO: 1457 - DNA, 770 bp, Panicum virgatum
  misc_feature: Ceres CLONE 1765871
  misc_feature: Encodes the peptide sequence at SEQ ID NO. 1458
gttggctaacaatcccattgctgcgctgcagcccatctgtagcaatggcacaggagagctggaaacaggagtccgaggagactggagtccatgcgcctgaggccccaattctgtgcataaacaactgtgttttcttcggcagcagcatgacaaacaatatgtgctcgaagtgctacagggacttcatcaagttgatggaagcccctgtggttgagaagaaggtgatcacggtggcatcttcttctgcggcaccaatggagacagcaaatcaagatgatgtgcctgcagctgctgccgctgaagctgttgcggagaagcaagcagagcaggagccgccaaagccgcccagcaaccggtgcctgacctgccgcaagaaggttgggctgaccggctttctctgccgctgtgggggcaccttctgctccatgcaccgctacaccgactcccaccagtgcacctttgactacaagaaggtggcacgggagcagattgccaagcaaaatccagttgtgatggcagagaagatcaacaagatatgatgcatggtcgtgtgcagggattgctgaattcatgcctgagttcctgagtcctcaagttcactccaaacgataggttccttcaggtggtggtctgggttagcgtggtagggggtctcaattgtgtctatccttctcctttatcatggtttcattctctcgattgtgtaataatgtaaatatattcaaactgtaatttaatcatattgcttccaaaaaaaaaaaaaaaaaaaa

SEQ ID NO: 1458 - protein, 164 aa, Panicum virgatum
  misc_feature: Ceres CLONE 1765871
  misc_feature: Great-hit functional homolog of the protein sequence given in SEQ ID NO 9336
  misc_feature (1)..(40): Pfam Name: zf-AN1 Pfam Description: AN1-like Zinc finger
  misc_feature: Useful for making plants with modulated nitrogen use efficiency
MAQESWKQESEETGVHAPEAPILCINNCVFFGSSMTNNMCSKCYRDFIKLMEAPVVEKKVITVASSSAAPMETANQDDVPAAAAAEAVAEKQAEQEPPKPPSNRCLTCRKKVGLTGFLCRCGGTFCSMHRYTDSHQCTFDYKKVAREQIAKQNPVVMAEKINKI

SEQ ID NO: 1459 - DNA, 860 bp, Panicum virgatum
  misc_feature: Ceres CLONE 1765892
  misc_feature: Encodes the peptide sequence at SEQ ID NO. 1460
acgtcgctctgctggtcttctttccccacgccttcccttcctagcgccggcgacctcggggggagcgtcgccgcccgccgattgtttcgtccggcgacgagcgtccggcaggtactcagccatggtgtttcttgaggcggagatgtcatggaatgtgttgatctcacctagccagctggaccgcaagggcctcctgctccgcaagggtatcattgtacgtcttctggaggatgttacgaataggagggcttccaaggagcatggctactacgttgccgtcaatcagctgaaggcgatatctgaaggcaaagtgcgtgagctaactggagatgttctgttcccagttacgttcacctgcatcacgcagaagcctatgaagggtgaggtcatggttggacacgtggataggatcctcaagcatggcgtgtttctcaaatctggtcccatcgagagcatcttcatggctgagaagtcgatgagcgactacaagtacattggtggggagaacccgatcttcatgaatgaccactcgaagctggagaagggcactgctgtgcgtttcaaggtcatggggttccgttggatggaagctgaccgccagttccagcttcttgctacgatcgctggtgactttctcgggccgctgtgaactgcttccacaggttaaatgcgattctgatgtatattgcccatcagatggttgatggatgggtggatctgaagtgttagaatgaactttgcagtcagcagtttctctttagtggcaacacatggctgatgtcttatctgacggtaatgctatccactgatgccagagacatttggctccgtggttttgacaaaaaaaaaaaaaaaaaaaa

SEQ ID NO: 1460 - protein, 175 aa, Panicum virgatum
  misc_feature: Ceres CLONE 1765892
  misc_feature (1)..(74): Pfam Name: RNA_pol_Rpb7_N Pfam Description: RNA polymerase Rpb7-like, N-terminal domain
MVFLEAEMSWNVLISPSQLDRKGLLLRKGIIVRLLEDVTNRRASKEHGYYVAVNQLKAISEGKVRELTGDVLFPVTFTCITQKPMKGEVMVGHVDRILKHGVFLKSGPIESIFMAEKSMSDYKYIGGENPIFMNDHSKLEKGTAVRFKVMGFRWMEADRQFQLLATIAGDFLGPL

SEQ ID NO: 1461 - DNA, 878 bp, Panicum virgatum
  misc_feature: Ceres CLONE 1765898
  misc_feature: Encodes the peptide sequence at SEQ ID NO. 1462
atagctaaaacttcattgccttttttttttgttagccatagtggtttggaaaactgcaacctgtttctgatcaacttgggagggacatggctgggaggaacattggagttgcagtggacttctcatcatgcagcaaagcagctctgagatgggcatcgacgaaccttaccaggagtggtgataaactcatacttatccatgtgaagagctcctatcagaatgaacagggcgcagttcacctctgggaacagagtggttctccactcatccctctggctgagttctcagatgtcaccaagacatatggtgtgtctccagacaaggagacaatcgagatcctcactcaagtggcaaatcagagagggattgaagtctttgcaaagatactctacggagaccctgcgaagaagctttacgaagcagttgacctggttcccctcagctgcatggttatagggagtagagggttgagcacgctcaaaagggctctgatgggcagcgtgagcacctatattgttaaccacgcggcctgccccgtcacggttgtgaaggagaacatgtagacatatagcggcagtcaacccgttgaacactgctgtttacatgctcagtcactgcaacagcaacgtctatgtatggtagtcagaataaaatgagtgtgcttggcatgcactgatccggtggatgtttcctgcttttacttcttgtttagagcttaaccaggaccggatggaagaggtcttgacactgttatctgaagcatattatatcttaagcctgatgtaatagtaaaaaaataattacttgtaaataagtttaaaaaatcctactgcccaagttaaaagttcaggcactcagaaaaaaaaaaaaaaaaaaaa

SEQ ID NO: 1462 - protein, 158 aa, Panicum virgatum
  misc_feature: Ceres CLONE 1765898
  misc_feature (1)..(155): Pfam Name: Usp Pfam Description: Universal stress protein family
MAGRNIGVAVDFSSCSKAALRWASTNLTRSGDKLILIHVKSSYQNEQGAVHLWEQSGSPLIPLAEFSDVTKTYGVSPDKETIEILTQVANQRGIEVFAKILYGDPAKKLYEAVDLVPLSCMVIGSRGLSTLKRALMGSVSTYIVNHAACPVTVVKENM

SEQ ID NO: 1463 - DNA, 733 bp, Panicum virgatum
  misc_feature: Ceres CLONE 1765997
  misc_feature: Encodes the peptide sequence at SEQ ID NO. 1464
gtctgggcatacacctaaaagactccgtctctccaccctccttccccttcccccttctcgtctgggtctgcccgtctcgcttccccccacctccgcccccagatctccaaggccaggagccccggggacctctcgcgcccgcagcgatgtcggcgagcagcgcgcccgtggacgcctcgggggagccgatcccgacgtcgtcggtgttgatggcggcgtccaagcacatcgcggtccggtgccgcccggagaacgtggccttcctcaactgcaagaagaaggaccccaaccccgataagtgcctcgagaagggacgccaggtcacgcactgcgtcctcagcctgttgaaagaactgcaccagaagtgtcccaaagagatggacgcgtatgctgcttgcatgtattactacaccaatgaatttgacttctgtcgtaaggagcagcaagcttttgaggaagcctgccccatatccgagtagatcattcagagttttacttcaagtgatcttcgcgaataaggagaaaagccaacaaaccgagttcattatctcccatgtttgctgccctcgtggaatttttactgaatgaatagcacgccctgaagctattcaccccacttgtctctctcgatatttttcaaacttgaattgactcagcccatcagtcgtaggctctaaaatgatgatgatgatggtttcacttgctatggttcacaaattacatttggcggact

SEQ ID NO: 1464 - protein, 110 aa, Panicum virgatum
  misc_feature: Ceres CLONE 1765997
  misc_feature: Great-hit functional homolog of the protein sequence given in SEQ ID NO 9190
  misc_feature: Useful for making plants with modulated nitrogen use efficiency
  misc_feature: Useful for making plants with modulated oxidative stress sensitivity
MSASSAPVDASGEPIPTSSVLMAASKHIAVRCRPENVAFLNCKKKDPNPDKCLEKGRQVTHCVLSLLKELHQKCPKEMDAYAACMYYYTNEFDFCRKEQQAFEEACPISE

SEQ ID NO: 1465 - DNA, 989 bp, Panicum virgatum
  misc_feature: Ceres CLONE 1766000
  misc_feature: Encodes the peptide sequence at SEQ ID NO. 1466
acgacaacggataacgctcttctccctcacctcgctcctctcctctccccttccctccccgccaatggcgaccgccatttcctccctgattacccctccggccctccacctccgctgccggagtacttcttcggcctccgtctctgtatccgcccgcctctccttacgtgccgtggcggcgccgcaggcccggggccgtgggttggcgctgcgggtagccgcctcctcggcgttgctcgaggcgccggcggaggtggcggcgcggaagctctacgtcgggaacatcccccggaccgtcaccaacgacgagctccgcgacatgtttgctgcgcacggcaccgtcgagcgggcagaggttatgtacgacaagtacacaaatcggagccggcgctttggatttgtcaccatgagcactgctgaagaggccaatgctgcaattgaggctcttaacaggactgaggttggtggtagaaaagttaaagtgaatgtcacagagagtttcttgccaaacattgatcgatcagcaccagaaccagagcctgtatttgtagatagtcagtacaaggtttatgttggtaaccttgcgaagactgtgacaacagaagttcttaaaaacttcttctctgaaaagggccagatcctcagcgccacggtttcccacattcctgggacttcaaaatccaagggatacggcttcgtcaccttctcttccgaggaagaagttgaagctgctgttgctactttcaataatgcggaattggaaggacaacccattcgtgtgaatagagcttagattagcaggaatttgcaggagcaccgaaggcagggggaatatctcggcgaatacatgtagaatgagggatacttggaggttagattttgataacagtgatcaagaccttcaatgtaatttcgatctgtcaaacaattttcgtaccataacagtgtatgtgaaggattttgtttgtcaaaaaaaaaaaaaaaaaaaa

SEQ ID NO: 1466 - protein, 242 aa, Panicum virgatum
  misc_feature: Ceres CLONE 1766000
  misc_feature: Great-hit functional homolog of the protein sequence given in SEQ ID NO 9588
  misc_feature: Useful for making plants with altered alkaloid content
MATAISSLITPPALHLRCRSTSSASVSVSARLSLRAVAAPQARGRGLALRVAASSALLEAPAEVAARKLYVGNIPRTVTNDELRDMFAAHGTVERAEVMYDKYTNRSRRFGFVTMSTAEEANAAIEALNRTEVGGRKVKVNVTESFLPNIDRSAPEPEPVFVDSQYKVYVGNLAKTVTTEVLKNFFSEKGQILSATVSHIPGTSKSKGYGFVTFSSEEEVEAAVATFNNAELEGQPIRVNRA

SEQ ID NO: 1467 - DNA, 912 bp, Panicum virgatum
  misc_feature: Ceres CLONE 1766024
  misc_feature: Encodes the peptide sequence at SEQ ID NO. 1468
ctcccacacacctcccctctcccacccctcgccgcgagatcctgcccaaatcccgatccggcggcgccatgggcggcggcaaggacctcacggacgaccagatcgcctccatgcgggaggccttctcgctcttcgacaccgacggcgacggccgcatcgcgccctcggagctcggcgtcctcatgcgctccctcggcggcaaccccacgcaggcgcagctccgcgacatcgccgcgcaggagaagctcacggcccccttcgacttcccgcgcttcctcgacctcatgcgcgcccacctccgcccggagcccttcgaccgcccgctccgcgacgccttccgcgtcctcgacaaggacgcctccggcaccgtctccgtcgccgacctccgccacgtcctcacctccatcggcgagaagctcgagccccacgagttcgacgagtggatccgcgaggtcgacgtcgcgcccgacggcaccatccgctacgacgacttcatccgccgcattgtcgccaagtgattccggtccttacagacgatttcatctgcttcgctttggtttcgtttcctttcctttcctttcctactatcatctgatctgatcttgtctcgtttcaatttgcccatcacttctactattctcttctcctctctctctcttccgtgctttcatttcggaactgctgctgtgcctaccagggtttggataaatggatggataatggtgtgcgtgtgtgtttgtcgaccgaccgatcaattaattaatggatctcgctgatgatgctttgcttagctacatgtgatgtaatacagctcttttttttgcaatgtaaagtgtggatctgtttcggtgtttccttcatcactgtttcgctatcttgcttaattgatgctaccattattgcaattgatgc

SEQ ID NO: 1468 - protein, 149 aa, Panicum virgatum
  misc_feature: Ceres CLONE 1766024
  misc_feature: Great-hit functional homolog of the protein sequence given in SEQ ID NO 9736
  misc_feature: Useful for making plants with modulated biomass
  misc_feature: The plant is abnormally small.
MGGGKDLTDDQIASMREAFSLFDTDGDGRIAPSELGVLMRSLGGNPTQAQLRDIAAQEKLTAPFDFPRFLDLMRAHLRPEPFDRPLRDAFRVLDKDASGTVSVADLRHVLTSIGEKLEPHEFDEWIREVDVAPDGTIRYDDFIRRIVAK

SEQ ID NO: 1469 - DNA, 1075 bp, Panicum virgatum
  misc_feature: Ceres CLONE 1766170
  misc_feature: Encodes the peptide sequence at SEQ ID NO. 1470
accagcctctcctcgtccccgatctcctcccacccccgcacccaagggtttcgctctccaccggcgcggagcaagccagcgaacagggatggcggcggcgcggcacctcagatccggcctccccctcatccgcgcccacctcgcggcctccgaatccgcggccgtcgcccagggttcgaggggcttctcgtcgcaggtggccaagcccactgggaagcaggtcaaggttccagatgctctatatggtggaacaggcaactatgctagtgcactgttccttacagcagccaaagcaaacacattggacaaagttgaatctgagattaaaactgttgtagaggcatccaagaagagcccgctgttttctcaattcataaaggacttgtcagttccaaaagaaaccagagtgaaggctataactgaaatattcgcagaagctgggttttcagatgtcacaaagaatttcatggctgtcttggcggacaatggcaggctgaaatatattgagcgcattgctgagagatttgttgatttgaccatggcacataagggggaggtgaaggttgttgtcaggacagttattccacttcctgaggaggaggagaaggaactcaaggagaccttgcaagatatccttgggaagaacaaaaccattttggttgaacaaaagattgactacagcatcatgggaggacttgtgattgaattcgggcagaaggtgtttgatatgtcgatcaagactagggcgaaacaaatggaagcattcttgaggcaaccccttgaaatctaactgccttttggataaaaacatcatcagaatgcagtggctgtgctgctgaaggtttcctcatgtccgcaactttgatctggcctttgaataaaatgtttcctctaacaagagaatgccactgttttttattttcttgtgggctagaggcctgctgaacaatttatgtttatttcttgttacttgaagaagcttgcaccgaaaacatgatggatgccatgaaaagtttttcagctccaagtcattggaatatatgaattttttcctcaaaaaaaaaaaaaaaaaaaa

SEQ ID NO: 1470 - protein, 233 aa, Panicum virgatum
  misc_feature: Ceres CLONE 1766170
  misc_feature (1)..(172): Pfam Name: OSCP Pfam Description: ATP synthase delta (OSCP) subunit
  misc_feature (31)..(231): SWISSPROT Homolog: EC 3.6.3.14 ATP synthase delta chain, mitochondrial precursor
MAAARHLRSGLPLIRAHLAASESAAVAQGSRGFSSQVAKPTGKQVKVPDALYGGTGNYASALFLTAAKANTLDKVESEIKTVVEASKKSPLFSQFIKDLSVPKETRVKAITEIFAEAGFSDVTKNFMAVLADNGRLKYIERIAERFVDLTMAHKGEVKVVVRTVIPLPEEEEKELKETLQDILGKNKTILVEQKIDYSIMGGLVIEFGQKVFDMSIKTRAKQMEAFLRQPLEI

SEQ ID NO: 1471 - DNA, 704 bp, Panicum virgatum
  misc_feature: Ceres CLONE 1766212
  misc_feature: Encodes the peptide sequence at SEQ ID NO. 1472
agcccttcagcaagctaggcactacatctagtagctgagcacccacccgatacaagctaaagttctctctctgaacctttctccaaagaaaaaaaaagcaggagaaacaaccatggtcagtgccaagagacttgttcaaatggcgaagaagtggcagagaatggcggccatagcgaggaaaaggatcatgccgccggcgaaaggaaccgaagggtcttcgtgcagcacgtcgtcggtggccagcaagggccactgcgtggtgtactcggctgatggccggcggttcgaggtcccgctgacgtacctcggcacagcgatcttcggcgagctcctgagcctttcgcaggaggagttcgggttcgccggcgatgacggcaggatcatgcttccctgcgacgctgccgtgatggagtacgtgatgtgtttgctcggaagagacgcatcagaagaggtcccgagggcgttcctgagctctatggcgaggcctcgccattgtggaaatggcttggtgcaatccatgggtgttagccagcaagttgctgtctctaccttctgaagattagcacttagattgttttctttttcttgcacgatatatgtaaatagttacatgtgggagattggaaatgaaactagatatgattgttcaaaaagaaatggaagagagatatacacagcccgtttttggtgtaacactcttaact

SEQ ID NO: 1472 - protein, 147 aa, Panicum virgatum
  misc_feature: Ceres CLONE 1766212
  misc_feature (1)..(102): Pfam Name: Auxin_inducible Pfam Description: Auxin responsive protein
MVSAKRLVQMAKKWQRMAAIARKRIMPPAKGTEGSSCSTSSVASKGHCVVYSADGRRFEVPLTYLGTAIFGELLSLSQEEFGFAGDDGRIMLPCDAAVMEYVMCLLGRDASEEVPRAFLSSMARPRHCGNGLVQSMGVSQQVAVSTF

SEQ ID NO: 1473 - DNA, 919 bp, Panicum virgatum
  misc_feature: Ceres CLONE 1766225
  misc_feature: Encodes the peptide sequence at SEQ ID NO. 1474
aaaaaaatgtaaaacccccgcttactgaccgctggtgagagtgagagacgacgtcagacgagtcgcagagaagaagaaaaaaggaatctatggcgtcggcgctgtcgaggagggcgaggggctcggccgcggtgctgtggggcgcggcgagggggttcgcgtcggtggggaccgacatcatctcggcggcgcccggcgtgtcgctgcagaaggcgcggtcctgggacgaaggcgtcgccaccaagttctccaccacgcctctcaaggacatcttctacgggaagaaggtggtcatcttcggcttgcctggggcatatacaggagtttgttcacaatcacatgttcctagttacaagaacaacattgataagttgaaagcaaaaggaattgactctgttatttgtgtagctgtgaatgacccgtatgtcctgaatggatgggcagaaaagctacaggctaaagatgcaattgagttctacggcgacttcgatgggagcttccacaaaagcttggatttggagatagatctgtctgctgctttgctcggccgccgatctcacaggtggtcagctttcgttgttgatggcaagatcaagtcattcaatgttgaggaagcaccctccaatttcaaggtttctagcgcggaggtgattcttgaccaaatctgagcttaccaatgaacctgggataccttcagtttgctcatgcagcatgcttgctcagctgcagcgaataaatgaaaacctctccttttacctttgtaaaaatgctaggtgctctacttccagacaaaagtgttatgagattattttcgtggagtgatccaataagctcccatatactgtctggggcacaccgcactaagtctttaactggaccgtgaaggatgagtattctgtaaaaaaaaaaaaaaaaaaaa

SEQ ID NO: 1474 - protein, 192 aa, Panicum virgatum
  misc_feature: Ceres CLONE 1766225
  misc_feature (5)..(170): Pfam Name: Redoxin Pfam Description: Redoxin
  misc_feature (1)..(192): SWISSPROT Homolog: EC 1.11.1.15 Peroxiredoxin-2F, mitochondrial precursor
MASALSRRARGSAAVLWGAARGFASVGTDIISAAPGVSLQKARSWDEGVATKFSTTPLKDIFYGKKVVIFGLPGAYTGVCSQSHVPSYKNNIDKLKAKGIDSVICVAVNDPYVLNGWAEKLQAKDAIEFYGDFDGSFHKSLDLEIDLSAALLGRRSHRWSAFVVDGKIKSFNVEEAPSNFKVSSAEVILDQI

SEQ ID NO: 1475 - DNA, 628 bp, Panicum virgatum
  misc_feature: Ceres CLONE 1766237
  misc_feature: Encodes the peptide sequence at SEQ ID NO. 1476
aactattctccacccgttccccaagcaccagcggcgccaccacaccaccacccatggctctggcggcggcgagatccggcctccggtcgctggcgccgcgcgccgcgccggccaggcgccgcatgtcctcctccgtccacgacgacgcctatgagacggccaagtgggagaagatcacctacgccgggatcgtgacctgcaccctcctggcggcgtacaacctctccaagggccacccccatttcgacgagccgccggcgtacccatatctgcacatccgcaacaaggagttcccctggggacctgatggcctctttgagaagaaggaccaccattaagcatgaataacaacacactgtcaggagtcatgcatgtcttaaagattatctggttgttccagtgtttttcttttctattgaaacctgtttgctgcaacaagaaataagaatgacaaaactcttgtgttgactgtcaggtcgtaactgtgtcgttagctgaacaatacctgtctttgatttctttgctgtcccatccgcattaaagatcacacgcaagtttgtcttgcccagtttcaggaaaccatgtcactgttatcaaaaagcttgctattatattctgattgcttcag

SEQ ID NO: 1476 - protein, 94 aa, Panicum virgatum
  misc_feature: Ceres CLONE 1766237
  misc_feature (2)..(75): Pfam Name: COX6A Pfam Description: Cytochrome c oxidase subunit VIa
MALAAARSGLRSLAPRAAPARRRMSSSVHDDAYETAKWEKITYAGIVTCTLLAAYNLSKGHPHFDEPPAYPYLHIRNKEFPWGPDGLFEKKDHH

SEQ ID NO: 1477 - DNA, 999 bp, Panicum virgatum
  misc_feature: Ceres CLONE 1766321
  misc_feature: Encodes the peptide sequence at SEQ ID NO. 1478
gagatggcgcaggagaggcgggcgatacggcggatagagaacgcggcggcgcggcaggtgaccttctcgaagcgccgccgcgggctgttcaagaaggcgcaggagctggcggtgctctgcgacgccgacgtcgcgctcatcgtcttctccgccaccggcaagctctcgcagttcgcgagctccagtatgaataagatcattgacaaatacagtacacattctaagaatctgggcaaatcacatgagcagccttctatcgatttgaatgtagagcagagcaagtatagcggtttgaatgaacaactcgctgaagcaagtcatggacttagacagatgagaggtgaggagctcgagggtttgagtgtagaggaattgcaccaaatggaaaggaaacttgaagcaggactgcatagagttcttagtacaaaggaccagctattcatgcaacaaatcagcgaattacagcaaaagggcgcacagcttgaagatgacaacaggcttctgaaaaaacaggtgcctcaggtgattacagctggcgcggctgtggttgctgctgatacagaagatgtcctcaccgaagacggacagtcatctgaatctgtgatgactgcattgcattcaggaagctcgcatgacaatgatgatggttctgatatatccttgaaactatcgttgccgtaaaagcaaggaccaccatgatctgcctgtgagtggtactaagaagagttagactggaagagtcacaaactcgagaccgggttaacaacagctgctatctgcagcttaaaagttgcagtcctaaatttgtaatgttgtatacgttatctccgttctaaaaatctgtgtattatttgttgcttgcgctacactattttcatgtcattgtacttgttgacttttatatgaaacctatgctccggagcttacaaaaagtgggtttgattaaagcccgttcttgtataaaaagaatgctttcaccaaaaaaaaaaaaaaaaaaaa

SEQ ID NO: 1478 - protein, 225 aa, Panicum virgatum
  misc_feature: Ceres CLONE 1766321
  misc_feature: The sequence is a functional homolog of  SEQ ID NO 1453 in the  10/374,780 US patent application
  misc_feature: Useful for making plants with modulated growth and phenotype characteristics
MAQERRAIRRIENAAARQVTFSKRRRGLFKKAQELAVLCDADVALIVFSATGKLSQFASSSMNKIIDKYSTHSKNLGKSHEQPSIDLNVEQSKYSGLNEQLAEASHGLRQMRGEELEGLSVEELHQMERKLEAGLHRVLSTKDQLFMQQISELQQKGAQLEDDNRLLKKQVPQVITAGAAVVAADTEDVLTEDGQSSESVMTALHSGSSHDNDDGSDISLKLSLP

SEQ ID NO: 1479 - DNA, 896 bp, Panicum virgatum
  misc_feature: Ceres CLONE 1766356
  misc_feature: Encodes the peptide sequence at SEQ ID NO. 1480
gttggcgcgccatttcggcccctcgcatcaccccctcccctcccctcttcgacttcccctcccccatggcttcctctggcctgccttctagaaccttccaccaccaccggctcccctcgtctgctccttctcatccttcgagggagacttgcgtcccgtgctgcctccccggtgtcgtctcccggcggcgggctgccgtgcagctcctctccgccggtttcttgaccgctgtctcgccgccgccgccttcgctcgccgcgaggaggggacgcattgtagtgccaccggaggactatgtcactgcacctgatggactgaagtactatgatcttgttgaagggaagggtccaactgctgaaaaaggctcaactgtgcaggttcatttcgactgcatttaccgtggcatcaccgcagtgtcaagccgtgagtccaagctcctagcagggaaccgaagtattgcgcagccttacgagttcattgttgggtcactgcctgggaaagaacgaaagcgggactttgcagacaatgccaatgggctatactcagcgcaagcagcaccaaagcctccagcagccatgtacacgataactgaggggatgaaagtagggggaaagaggagagtaattgtccctccagagctcggatatgggaaaagggggatgagtgagataccgcctgatgctccttttgaactggatatagagctattggaagtgacctctcctgcagaaaaatgaccatttttgtttgcagtcgatgggaagaattaatgtacttatgaaccgtgcgagtttcagaggaatggattaaataatttactgacatttcaagttcatgttgatcagagtgcaattgtaacaacctagttgctgggacaaaaaaaaaaaaaaaaaaaa

SEQ ID NO: 1480 - protein, 223 aa, Panicum virgatum
  misc_feature: Ceres CLONE 1766356
  misc_feature (1)..(124): Pfam Name: FKBP_C Pfam Description: FKBP-type peptidyl-prolyl cis-trans isomerase
  misc_feature (177)..(217): SWISSPROT Homolog: Peptidyl-prolyl cis-trans isomerase FK506-binding protein
MASSGLPSRTFHHHRLPSSAPSHPSRETCVPCCLPGVVSRRRAAVQLLSAGFLTAVSPPPPSLAARRGRIVVPPEDYVTAPDGLKYYDLVEGKGPTAEKGSTVQVHFDCIYRGITAVSSRESKLLAGNRSIAQPYEFIVGSLPGKERKRDFADNANGLYSAQAAPKPPAAMYTITEGMKVGGKRRVIVPPELGYGKRGMSEIPPDAPFELDIELLEVTSPAEK

SEQ ID NO: 1481 - DNA, 733 bp, Panicum virgatum
  misc_feature: Ceres CLONE 1766370
  misc_feature: Encodes the peptide sequence at SEQ ID NO. 1482
actccactccgctcctcccccactccagccgagcgccgccccagccatggccgtgaccgcccgcgcctccgccgtggcgtgcctcctcctcgcgctcgccgcctccgccgcgggcgcgggctccccctcccctgccccggcgccggcggtcgactgcatcgcggcggcctcgagcctgatcgactgcgtgggctacgtctcccccgggagcacggagaagaccccgtccaaggcctgctgcggggaggtcaagaccgccgtcgccaaccccaccatcgtcagctgcctctgctccctcgccggctccaaggacacccccgtgcccatcgacatgaaacgcgtgctcgcgctccccggcgcctgcggcgcgtccaacgccgccttcagcaagtgccacatttccgcgggttctccgaccgaagcacctgtaccgtctggtaccggaggatcatcgagcggcggggcgagctccccgatgacggcgaccgccctcgtggccgccgtggcggcgccgctgctcgcctactgctacctcctctgagctagctgaggatatcttcgctctgatgcttgagctgcgcgccgtgctgctggccgagtgaccgccctttgccgtcgagctgcgccgtgattcagttactctgttgtcgagactgctgttttacttgagctgttatatggagtatttgacgcgacttcttcccgtgctgcctgccttcgatcttttttgcct

SEQ ID NO: 1482 - protein, 164 aa, Panicum virgatum
  misc_feature: Ceres CLONE 1766370
  misc_feature (1)..(81): Pfam Name: Tryp_alpha_amyl Pfam Description: Protease inhibitor/seed storage/LTP family
MAVTARASAVACLLLALAASAAGAGSPSPAPAPAVDCIAAASSLIDCVGYVSPGSTEKTPSKACCGEVKTAVANPTIVSCLCSLAGSKDTPVPIDMKRVLALPGACGASNAAFSKCHISAGSPTEAPVPSGTGGSSSGGASSPMTATALVAAVAAPLLAYCYLL

SEQ ID NO: 1483 - DNA, 855 bp, Panicum virgatum
  misc_feature: Ceres CLONE 1766420
  misc_feature: Encodes the peptide sequence at SEQ ID NO. 1484
ctgcctctcgctccgaagcggcgaagcttctcctctcgcgtctggcaccaggaggagggccgcggcgtgcgcagctcgcgcgcgctggggggccgcggggggcgagggatcggggcctgaccgcctgagacaagggtttgggaggcggagatgtcgacgccggcgaggaagcggctgatgcgggacttcaagcggctgcagcaggacccgcccgccggcatcagcggcgcgccgcaagacaacaacatcatgctctggaacgccgtcatattcgggccggatgacacgccgtgggatggaggaacgtttaagctgacactgcaatttacagaagattaccccaacaagccaccaactgttcggtttgtttcgaggatgtttcacccaaacatctatgcagatggaagcatctgcttggacatcctacaaaaccagtggagccctatatatgatgttgcagcaatattgacctctattcagtccctgctttgtgacccaaacccaaattctcctgctaactctgaagcagccagaatgttcagtgagaacaagcgagagtacaaccgcaaagttcgtgaggttgtggaacagagctggacagctgactaagtttctatccgcttcatcagatggtgcaataagcatctgcatttcatacttcgctggtctgtattatcggcttaaccgttaaaaatcctcggtggctgttgtgtccttgtggttcagtcccttgttgtactgctgcctgctgctttccctgatgtagtggtgaacggtctcatgaactcgggtattgatggatatgcaaaagctatagctaagccaagttattgctaaaaaaaaaaaaaaaaaaaa

SEQ ID NO: 1484 - protein, 152 aa, Panicum virgatum
  misc_feature: Ceres CLONE 1766420
  misc_feature (1)..(152): SWISSPROT Homolog: EC 6.3.2.19 Ubiquitin-conjugating enzyme E2-17 kDa
  misc_feature (1)..(152): SWISSPROT Homolog: EC 6.3.2.19 Ubiquitin-conjugating enzyme E2-17 kDa 2
MSTPARKRLMRDFKRLQQDPPAGISGAPQDNNIMLWNAVIFGPDDTPWDGGTFKLTLQFTEDYPNKPPTVRFVSRMFHPNIYADGSICLDILQNQWSPIYDVAAILTSIQSLLCDPNPNSPANSEAARMFSENKREYNRKVREVVEQSWTAD

SEQ ID NO: 1485 - DNA, 682 bp, Panicum virgatum
  misc_feature: Ceres CLONE 1766440
  misc_feature: Encodes the peptide sequence at SEQ ID NO. 1486
aaacgctcgtctcacctgtcaatcgaaagccaagccaatgggggcagcagcctgcgccgccgccgtgcgcgccctgggcgtagccgtggcggccgcgctcctggcgtgccggtgcgcggcgcagccgtcgggctccggctgcatgccggagctggtcggcctgtcgccgtgcatggactacctgtcgggcaacgccacgacgcccgacgcgccgtcgtgctgctcagcgctgtcgagcatgctgaggtcgaacccgggctgcctctgcacggtgctcggcggcacggccgcgtcgctcggcgtcgccgtcgacggcgcccgcgtggcgcagctgcccggggcgtgcaaggtccaggcgcctcctgccacccagtgcaacgccgtgggagctccagtggcgtctccggcggcgccgtcagacgccaacgcgacccctgcagggtctggatccaagtctacaccagcatccacccttccatactctgacggaaataccgggaagcctggaaggatcttcgtcttcgcagccgcagcactggcgctgctccatcgtttgtgagatgaatcagatgatgcgaaagcttcttgtgttcgtctccgacgaccgaatcgtttcacacgagcagcttgtaaagtttggggtgtttgttgctccaggattcagaggagcagcgcgtttttt

SEQ ID NO: 1486 - protein, 173 aa, Panicum virgatum
  misc_feature: Ceres CLONE 1766440
  misc_feature (1)..(78): Pfam Name: Tryp_alpha_amyl Pfam Description: Protease inhibitor/seed storage/LTP family
MGAAACAAAVRALGVAVAAALLACRCAAQPSGSGCMPELVGLSPCMDYLSGNATTPDAPSCCSALSSMLRSNPGCLCTVLGGTAASLGVAVDGARVAQLPGACKVQAPPATQCNAVGAPVASPAAPSDANATPAGSGSKSTPASTLPYSDGNTGKPGRIFVFAAAALALLHRL

SEQ ID NO: 1487 - DNA, 807 bp, Panicum virgatum
  misc_feature: Ceres CLONE 1766517
  misc_feature: Encodes the peptide sequence at SEQ ID NO. 1488
aaaaaccaagctaagcatcatcaaccccttattagcttattggttgtggaggcaacaacccaacaaacaacaagaaccaaggccgccgatcgacatggctgactactacggcggccggaccatgtactccaagaccgacgagtgctacgacgccggcaggcacggcagccggagggtgtactcccacaccgacgagtgctacgacgacgtggaccgcaggaggccgggggcctacgccgacgactgctacaacggcgccggctacggcggcgccaggcaggccgccgtctactccgacgagtactcccgcggcggctacggctacggcggcgagcaggagcacttcaagagggaggagagggagcacaagcacaaagagcgcctcggcgagataggcgccctcgccggcggcgccttcgcactgtacgagggtcaccgtgcgaagaaggacccggagcacgcgcagaggcacaagatggaggcgggcgtggcgacggcggcggcgctgggtgccggcggctacgcgtaccacgagcaccgcgagcagaaggaggcccgctacgagggcaaggaccacagcagggtgccgcacggctactactgcaactaactcatcattatattactagctacttggatcgatcgagtcatgcatgcatcgacgagatgaataatggacgaccacgatgacgtacgggcgtgcaagtactagtaaataagagcagatgtgacgacttgctgcttgtgtgttgctcgctacactacatattaatgatatactactgccaaaaaaaaaaaaaaaaaaaa

SEQ ID NO: 1488 - protein, 171 aa, Panicum virgatum
  misc_feature: Ceres CLONE 1766517
  misc_feature (1)..(54): Pfam Name: ABA_WDS Pfam Description: ABA/WDS induced protein
MADYYGGRTMYSKTDECYDAGRHGSRRVYSHTDECYDDVDRRRPGAYADDCYNGAGYGGARQAAVYSDEYSRGGYGYGGEQEHFKREEREHKHKERLGEIGALAGGAFALYEGHRAKKDPEHAQRHKMEAGVATAAALGAGGYAYHEHREQKEARYEGKDHSRVPHGYYCN

SEQ ID NO: 1489 - DNA, 736 bp, Panicum virgatum
  misc_feature: Ceres CLONE 1766528
  misc_feature: Encodes the peptide sequence at SEQ ID NO. 1490
agagaagctagatcgatcgagcattctggttgacgcaagcagagtgacacacgacgatggccgcgccggcgccgcagcaggggcagacggtgatggtggcggtggacgagagcgagtgcagccgccgcgcgctggagtgggcgctgcggaacctggcgcccacgctggcgcccccgctgctgctgctcaccgtgcagccgctcgtcccccttggatacgtctccgcagcctccttcggcacccctctgggcaccgttcctcctgtagccccggagctcatcaagtcgatgcaggatcagcagagggagctcacgcaggcgctcctcagcaaggccaaggccatctgtgcagagcatggggttccagtagagacaattgttgaagtaggagatccgaaggagatgatatgtgaagcagctgagaaaaaaaatgtcgatctgctagtccttggaagccacagtcgtgggcctatacaaaggttgtttcttgggagcgttagtaactactgcgttcatcattgcaagtgtccagttcttgttgtgaagaatcaaggctgaggattcctgcataaatcaacttccaatgttgtcgtaattctgtttgggtatttatcaatatatatatatatatatatatattgaatgctatcaacatatattgtacacaataacgggcaagatagtgcaagtattactttggtcaaacacatttggcaaataaagcatcttgcttccgg

SEQ ID NO: 1490 - protein, 166 aa, Panicum virgatum
  misc_feature: Ceres CLONE 1766528
  misc_feature: Great-hit functional homolog of the protein sequence given in SEQ ID NO 9665
  misc_feature (3)..(155): Pfam Name: Usp Pfam Description: Universal stress protein family
  misc_feature: Useful for making plants with modulated biomass
  misc_feature: The plant is abnormally small.
MAAPAPQQGQTVMVAVDESECSRRALEWALRNLAPTLAPPLLLLTVQPLVPLGYVSAASFGTPLGTVPPVAPELIKSMQDQQRELTQALLSKAKAICAEHGVPVETIVEVGDPKEMICEAAEKKNVDLLVLGSHSRGPIQRLFLGSVSNYCVHHCKCPVLVVKNQG

SEQ ID NO: 1491 - DNA, 788 bp, Panicum virgatum
  misc_feature: Ceres CLONE 1766550
  misc_feature: Encodes the peptide sequence at SEQ ID NO. 1492
atcccaaagctaggctaagaacacagcaataatggcgccgatgaaggtctacgggtgggccgtgtcgccgtggatggcgagcgcgctggtgtgcctggaggaggccggcgccgagtacgagatcgtccccatgagcaggtgcggcggcgaccaccgccgccccgaccacctcgccagaaacccgttcggtgaaatcccagttctggaggacggtgatctaacgctctaccaatcacgcgccatcgcgaggtacgtcctccgcaagtacaggcccgagcttctcaaggaaggggacctggagggatcagcgatggtggacgtatggatggaggtggaggcccaccacgtggagccgaccctgtggcccatcatccggcactgcatcatcggcccgtacgtcggccgcgagcgcgaccaggccgccgtcgacgagagcctcgccaagctgagggcgctgctcccggcgtacgaggcgcgcctgtcggcgtgctggtacctcgccggcgacgacgtcaccgccgcggacctctgccacttcggcttcatgcgctacttcatggaaaccgagtacgccgccatcgtggacgcgtacccgcacgtcaaggcgtggtggcacgcgctgctggcgaggccgtcggtcaagaaggtcatcgccggcatgccgccggacttcggctacgccagcggcaacataccgtagtatatgagtatatctacgccatgttttacatttcacaaataaatcgtcagatatttggtgttattggcaaaaaaaaaaaaaaaaaaaa

SEQ ID NO: 1492 - protein, 222 aa, Panicum virgatum
  misc_feature: Ceres CLONE 1766550
  misc_feature (2)..(76): Pfam Name: GST_N Pfam Description: Glutathione S-transferase, N-terminal domain
  misc_feature (1)..(93): Pfam Name: GST_C Pfam Description: Glutathione S-transferase, C-terminal domain
  misc_feature (1)..(212): SWISSPROT Homolog: EC 2.5.1.18 Glutathione S-transferase I
  misc_feature (4)..(215): SWISSPROT Homolog: EC 2.5.1.18 Glutathione S-transferase IV
MAPMKVYGWAVSPWMASALVCLEEAGAEYEIVPMSRCGGDHRRPDHLARNPFGEIPVLEDGDLTLYQSRAIARYVLRKYRPELLKEGDLEGSAMVDVWMEVEAHHVEPTLWPIIRHCIIGPYVGRERDQAAVDESLAKLRALLPAYEARLSACWYLAGDDVTAADLCHFGFMRYFMETEYAAIVDAYPHVKAWWHALLARPSVKKVIAGMPPDFGYASGNIP

SEQ ID NO: 1493 - DNA, 850 bp, Panicum virgatum
  misc_feature: Ceres CLONE 1766568
  misc_feature: Encodes the peptide sequence at SEQ ID NO. 1494
gcataggaacgctcgtctcacctgtcagccgaaagccaatggggtcagcatcctgcgccgccgccgtgcgcgcgctgggcgtagccgtggcggccgcgctcctggcgtgccggtgcgcggcgcagccgtcgggctccggctgcatgccggagctggtcggcctgtcgccgtgcatggactacctgtcgggcaacgccacgacgcccgacgtgccgtcgtgctgctcggcgctctcgggcatgctgaggtcgagcccgggctgcctctgcacggtgctcggcggcacggccacgtcgctcggcgtcgccgtcgacggcgcccgcgtggcgcagctgcccggggcgtgcaaggtccaggcgcctcctgccacccagtgcaacgccgtgggagctccagtggcgtctccggcggcgccgtcagacgccaacgcgacccctgcaggagggtctggatcgaagtctacaccagcatccacccttccatactctgacggaaatactgggaggcctggaaggatcttcgtattcgccgcagcagcactggcgttgctccatcgtttgtgagatgaatcagatgacgcgaaagcttcttgtgttcgtctccgagcgaccgaatcgtttcacacgagcagcttgtacagtttggggtgcttgttgctccaggattcagaggagcagagcattttttacattgttcactcgagcattttttttttgtagctatcgattaggctgcgtgttttggggtctcttagggtcgatgtcatggtggatgatggcgttggattttctgttcccaaaatgcgcccaaccgctactcagctcgagcgtcgaaaacaaaaacaacaaac

SEQ ID NO: 1494 - protein, 174 aa, Panicum virgatum
  misc_feature: Ceres CLONE 1766568
  misc_feature (1)..(78): Pfam Name: Tryp_alpha_amyl Pfam Description: Protease inhibitor/seed storage/LTP family
MGSASCAAAVRALGVAVAAALLACRCAAQPSGSGCMPELVGLSPCMDYLSGNATTPDVPSCCSALSGMLRSSPGCLCTVLGGTATSLGVAVDGARVAQLPGACKVQAPPATQCNAVGAPVASPAAPSDANATPAGGSGSKSTPASTLPYSDGNTGRPGRIFVFAAAALALLHRL

SEQ ID NO: 1495 - DNA, 934 bp, Panicum virgatum
  misc_feature: Ceres CLONE 1766572
  misc_feature: Encodes the peptide sequence at SEQ ID NO. 1496
atcgcaaaaaccactcgagcacaaccggcagaggcactccagagctaagcgttcgatcgacagccgatccagaacaagatgtgtcagatgaagatgaagatgaagatgaagatgaagatggagatgggcgccgagccgtcgggctcgccctcgacctcggagcaggagcaccaccggacggtgtggacgtcgccgccgaagcggccggcggggcggaccaagttccgggagacgcggcaccccgtgttccgcggcgtgcggcgccggggcaacgccgggcggtgggtgtgcgaggtgcgcgtgccgggccgccgcggctgcaggctctggctcggcaccttcgacgccgccgatgccgcggcgcgcgcgcacgacgccgccatgctcgccatcgcgggcccgggcgcctgcctcaacttcgcggactcggcgtggttgctcgcggtcccggcctcgtacgccagcctcaccgaggtgcgccgcgcggtcgccgaggccgtggaggagttccagcgccgggaggcgctcccggaggaggaggaggaggacgcgcgctcggccacgtcgtcgacgccgtcctcccccgccagcggcgaagacgaggcctccaccgacgaggacggggaggagtcctcgccggccgccgaggactcgccgttcgaactggacctgttcggtggcttgagctcggacttgtactacgcgagcttggcgcaggcgatgctcatggagccaccgtccacagtcgcggcgttctgcgacgagggcatggccgatgtgcctctctggagctattaggacagaggccgccgctgggcttcaattttccgccttttctttctcttggactatccgaagccaaattttggtactgtaacggttactacttgtggtaatgagacagagcaacttggaaaaaaaaaaaaaaaaaaaa

SEQ ID NO: 1496 - protein, 239 aa, Panicum virgatum
  misc_feature: Ceres CLONE 1766572
  misc_feature (1)..(67): Pfam Name: AP2 Pfam Description: AP2 domain
  misc_feature: The sequence is a functional homolog of  SEQ ID NO 1228 in the  10/374,780 US patent application
  misc_feature: The sequence is a functional homolog of  SEQ ID NO 1244 in the  10/374,780 US patent application
  misc_feature: The sequence is a functional homolog of  SEQ ID NO 1248 in the  10/374,780 US patent application
  misc_feature: The sequence is a functional homolog of  SEQ ID NO 722 in the  11/435,388 US patent application
  misc_feature: The sequence is a functional homolog of  SEQ ID NO 744 in the  11/435,388 US patent application
  misc_feature: Useful for making plants with modulated growth and phenotype characteristics
MCQMKMKMKMKMKMEMGAEPSGSPSTSEQEHHRTVWTSPPKRPAGRTKFRETRHPVFRGVRRRGNAGRWVCEVRVPGRRGCRLWLGTFDAADAAARAHDAAMLAIAGPGACLNFADSAWLLAVPASYASLTEVRRAVAEAVEEFQRREALPEEEEEDARSATSSTPSSPASGEDEASTDEDGEESSPAAEDSPFELDLFGGLSSDLYYASLAQAMLMEPPSTVAAFCDEGMADVPLWSY

SEQ ID NO: 1497 - DNA, 1093 bp, Panicum virgatum
  misc_feature: Ceres CLONE 1766581
  misc_feature: Encodes the peptide sequence at SEQ ID NO. 1498
cctcggtggttcgcttcggtctccagagatttcgcttgaagagaagaaacccaagaggaatccgcagatgaagataattcctgtaccttgcctggaggacaactatgcctacctaatcgtggacgagagcaccaagaaggcggtggccgttgacccggtggagccggagaaggttctcaaggcggccagcgaggtcggcgcctacgtcgactgcgtcctcaccacccaccaccactgggatcatgctggtggcaatgagaagatgaggctgcaggtgccagggataaaggtctttggaggatccctggacaatgtgaaaggctgcactgatcaggtggagaatggaacaaaattgtcacttgggagggacattgagatactatgcctacacactccttgtcacacaaaaggtcatattagctactatgttactagtaaagaggggggagatccagcggtattcactggagacactttgttcattgctggttgtggaaggttttttgagggtactgcagagcaaatgtaccagtcccttattgttacactgggctcactgccaaagtcaactcgagtttactgtgggcatgagtacactgtgaagaacctaaagttcatgctgacactcgagccggagaacgagatgatgaaacagaaactggaatggtctgaaaagcagcgtgaagcgaatcagcctacagttccctcaactataggagatgagtttgagatcaatacgttcatgcgtgtcgatctaccagaaatacagggaaagtgcagtgccaagtctccagttgaagcgctgagcgaggtcaggaagatcaaagataactggaaaggttgatacccatgcggctgccactcctctgttggacggtccgcctctcgaagtgagctaatgcagaaaccttgcctgtaggtgggaatgaggtttactgccgtgcaatgctttgataggtatggcgtcgggaaggagaagactcgtaataagctccgtgttgataaaaacaataatcattaaacttatgaactgtttgtttgcgaacagtaatgcatgaactattttatatcggaaaaaaaaaaaaaaaaaaaa

SEQ ID NO: 1498 - protein, 258 aa, Panicum virgatum
  misc_feature: Ceres CLONE 1766581
  misc_feature: Great-hit functional homolog of the protein sequence given in SEQ ID NO 9277
  misc_feature (1)..(161): Pfam Name: Lactamase_B Pfam Description: Metallo-beta-lactamase superfamily
  misc_feature (1)..(258): SWISSPROT Homolog: EC 3.1.2.6 Hydroxyacylglutathione hydrolase cytoplasmic
  misc_feature: Useful for making plants with modulated biomass
  misc_feature: The plant is abnormally small.
MKIIPVPCLEDNYAYLIVDESTKKAVAVDPVEPEKVLKAASEVGAYVDCVLTTHHHWDHAGGNEKMRLQVPGIKVFGGSLDNVKGCTDQVENGTKLSLGRDIEILCLHTPCHTKGHISYYVTSKEGGDPAVFTGDTLFIAGCGRFFEGTAEQMYQSLIVTLGSLPKSTRVYCGHEYTVKNLKFMLTLEPENEMMKQKLEWSEKQREANQPTVPSTIGDEFEINTFMRVDLPEIQGKCSAKSPVEALSEVRKIKDNWKG

SEQ ID NO: 1499 - DNA, 856 bp, Panicum virgatum
  misc_feature: Ceres CLONE 1766694
  misc_feature: Encodes the peptide sequence at SEQ ID NO. 1500
tctctctgtctcctccctttcccctcccaaggccaggccaggcttgccctctccgcgtccaagaatccgccatgaagggggccaaatccaagggcgccgccaaggccgatgccaagttggcggtgaagagtaagggggcggagaagccggccaagggcaggaagggaaaggccggcaaggaccccaacaagcccaagagggcgcccagcgccttcttcgtcttcatggaggaattccgcaaggagttcaaggagaagaaccctaaaaacaagtctgttgctgcggtggggaaagctgccggtgacaggtggaaatccctgacagaagcggacaaggctccttatgtagccaaggccaataaactcaagcttgagtacaacaaggccattgcggcctacaacaagggcgagagcactgctgccaagaaggctcctgccaaggaggaagaggaggaggatgaagaggagtctgacaagtcaaagtctgaggtcaacgacgaggatgatgaagagggtagtgaggaggatgaagacgatgacgagtaagctcaggtcaagttgatgctccattcaacaatggagtgccagaatgcaaaggccctgtgtcgggaattaaaaggagcctatccagtctactagaattattcagtttcacttcacatcgtgatgttttacttttgtctgtcctataatggatatcgctccttgttggcgccaccggcgggctagtgtttgcacggtgggcacaccggcaatacccgcttgtacctagattaccgtttccattgtcatcagctaacattgtgataatatcagtttgggtaatgttagattaagcaaaaaaaaaaaaaaaaaaa

SEQ ID NO: 1500 - protein, 157 aa, Panicum virgatum
  misc_feature: Ceres CLONE 1766694
  misc_feature: Great-hit functional homolog of the protein sequence given in SEQ ID NO 9232
  misc_feature: Useful for making plants with altered alkaloid content
MKGAKSKGAAKADAKLAVKSKGAEKPAKGRKGKAGKDPNKPKRAPSAFFVFMEEFRKEFKEKNPKNKSVAAVGKAAGDRWKSLTEADKAPYVAKANKLKLEYNKAIAAYNKGESTAAKKAPAKEEEEEDEEESDKSKSEVNDEDDEEGSEEDEDDDE

SEQ ID NO: 1501 - DNA, 595 bp, Panicum virgatum
  misc_feature: Ceres CLONE 1766773
  misc_feature: Encodes the peptide sequence at SEQ ID NO. 1502
acccctttctctgttcctctcggccctccgctctcctccccacgtttccaccggagccgcacccacggccgccgcgatctcctctcctcgcctccgaatccgccgcctgccgcccgccgccgagcccagcctcctccgcgacccgctgcgtctccgactaacatggattccgaaccgtcatcgcagaacccaacagatatgactgcatttgtgcaaaatctccttggacagatgcaaacaaggtttgagaccatgtcgcagaacattgtgtcgaagatagatgaaatgggaaccaagatcgacgagttggagcagagcatcaatgatctcaaagctgagatgggcacggagatgcctgccaagaagcctgatgaggcgaagcctgctgattctgcttaacttggctgtgatctagagactggcgagtgaaaatttggatactttgtgacagatttttagagctatgagtaattcattgtcttccatggaccatctccattgcatgagtgtgctgtcagctatgtagactggagccatcttatgaaatactgtatccatcgtttgggcactcagctctctgcatttgtgcaaattc

SEQ ID NO: 1502 - protein, 78 aa, Panicum virgatum
  misc_feature: Ceres CLONE 1766773
  misc_feature (1)..(54): Pfam Name: HSBP1 Pfam Description: Heat shock factor binding protein 1
MDSEPSSQNPTDMTAFVQNLLGQMQTRFETMSQNIVSKIDEMGTKIDELEQSINDLKAEMGTEMPAKKPDEAKPADSA

SEQ ID NO: 1503 - DNA, 927 bp, Panicum virgatum
  misc_feature: Ceres CLONE 1766838
  misc_feature: Encodes the peptide sequence at SEQ ID NO. 1504
acactcggcagccacgcgcacgcacacacagctcgagctcgcggcgagtcgagcacgccccgcgcatccgacgaggcggctgctggtggatttggtctgcggacgcgatggccggcggcggcggcggcggcagcggcgggagggtgagcctgtacgcggtgctgggcgtggccagcgactgctccgaagccgagctgcgcagcgcctaccgcaagctcgccatgagatggcaccccgacaagtgcgccggcgcggggagctccggcggcggcggcgccgacgcggccaaggcgaggttccagaagatccagggagcctacgccgttctgtcggaccccaacaagcggatcctgtatgacgtcggggcctacgacagcgacggcgacgatgacggcgccggggagatcctcggagacattctcgacgccatgagccaggcaggccctgccgagcagggcaagggggagagcctggaggacctgcagcggcagttcgaggagctgttcctgcggccgtcgccgtcgtccttctgcccgccggacgacgccgccgggaagtcggcggccaagaggaggaccgcgcggaagtagggccggcgagtgccggcccgcgcgtgattgaagaagacgcacgctgcgatttgggatgatctactatgtaatgagccagcagtgacagcgacctgcgagtaccggaggaggctgccagttctgtttctgtctgtgtgacccaataatccccagcggcggcctcctgcacattctgatgcttggcgtgctctcaactttgttgctacagattggtgccgttattagaattagatggccacgcacacacccacacccgtctctgtacgcgcgcaccatgccttgtcgaattaacaagaccccgttgggaatttcccccaaaaaaaaaaaaaaaaaaaaa

SEQ ID NO: 1504 - protein, 160 aa, Panicum virgatum
  misc_feature: Ceres CLONE 1766838
  misc_feature (1)..(66): Pfam Name: DnaJ Pfam Description: DnaJ domain
MAGGGGGGSGGRVSLYAVLGVASDCSEAELRSAYRKLAMRWHPDKCAGAGSSGGGGADAAKARFQKIQGAYAVLSDPNKRILYDVGAYDSDGDDDGAGEILGDILDAMSQAGPAEQGKGESLEDLQRQFEELFLRPSPSSFCPPDDAAGKSAAKRRTARK

SEQ ID NO: 1505 - DNA, 781 bp, Panicum virgatum
  misc_feature: Ceres CLONE 1766852
  misc_feature: Encodes the peptide sequence at SEQ ID NO. 1506
gaacggctcatcgacgaggaagcgatggtggggcgaaagccgatgcgccgccgcagaactgatcggcagccgcctccgccgccgcagtccttcggcgccacggatcgcccgacctccccacgttcatccgcctccgccgccgcggtggccgccgacctggacgagctgctgctcacggcggcgccgccgtcggcgtcggagccccggagcttctcgtacgcggtgaagcagcagtgctgggagaaggcggagcgagtgccggggcgcgacccggagaggtggcgccgcgacgcgcttggcaacatcgtcttccgcaagctcgtcggctgccccggctgcctctgccacgactacgaccacatcgtcccctactccaagggcgggaagagcacattggagaattgccaggttttgcaggctacagtgaatcgatctaaaggcaacaaaactgaggtatccaaatctgagctcatacagaagagtgcatattgtagggtttcaggacgcgatatggatcttgttgaactctctgcctatggaaatgtccggcgaggaccaaattcagggggctgcaaaatccaatgaagtacagagtagatatatctgaggagttgtgttaatcagttccaagtagttgccagaatctaaatgaagaaagcttgattaatttttctgtcaaacatgttcgattatgtttgtactatgtagcttgacgcttcaagtgatttatccgagaacagcaattgtgatatcttcgaatcaaaaaaaaaaaaaaaaaaaa

SEQ ID NO: 1506 - protein, 186 aa, Panicum virgatum
  misc_feature: Ceres CLONE 1766852
  misc_feature (1)..(43): Pfam Name: HNH Pfam Description: HNH endonuclease
MVGRKPMRRRRTDRQPPPPPQSFGATDRPTSPRSSASAAAVAADLDELLLTAAPPSASEPRSFSYAVKQQCWEKAERVPGRDPERWRRDALGNIVFRKLVGCPGCLCHDYDHIVPYSKGGKSTLENCQVLQATVNRSKGNKTEVSKSELIQKSAYCRVSGRDMDLVELSAYGNVRRGPNSGGCKIQ

SEQ ID NO: 1507 - DNA, 876 bp, Panicum virgatum
  misc_feature: Ceres CLONE 1766864
  misc_feature: Encodes the peptide sequence at SEQ ID NO. 1508
catcaaagtctccactctccagtgcgaggaggagcccagtccagctccggcccgagcgctcgccccgccacgggcgcagagcagcacaaaccatggccgcgctgctcctcgctctcctcctcctcctcctcgccgcctcgccgccgctctccgcggccggcgacgcgcacccgggctactcgtcggccggcgagggcacctgcacagtgggcgccggcgccggcgcggcgccggggggcctgcagctgcgggagcgcggcccggggcgcgtcatcgacatcacgcacgcgtacgtgccggacctgcccgcgttcgcgcagggggcggtggcggggcccgtggtgcggctcaagcactccatggcggacggctccgagtacaacctctcggagctgcggatggagtgccacacgggcacccacgtcgacgcgccggggcacatcaaccaggcccacttcgccgccggcctcgacgtcgacacgctcgacctcgacctcctcaacggctgcaggctgactgatggagcgctggggtcgagtgggctggcgagagctgacgtggcgctgacgtggctgtggctgtgggctggggctgcagacccgctgttggaaccagcctaacacacaagatcttctgctaaaaaaaaacacacacaagatcctgggtgtgtttagatctctaaaataggggtaaaaaagagtcacatcggatactgtggcacactgtatcattatttgtttgtttgtggtaattgttgttctactatgacctaattagtctcaaaagattcgtctcgtcgtttacatcaaaactatgtaattagtttttttatctatctatatttaatacttcatgtaaaaaaaaaaaaaaaaaaaa

SEQ ID NO: 1508 - protein, 175 aa, Panicum virgatum
  misc_feature: Ceres CLONE 1766864
  misc_feature (1)..(79): Pfam Name: Cyclase Pfam Description: Putative cyclase
MAALLLALLLLLLAASPPLSAAGDAHPGYSSAGEGTCTVGAGAGAAPGGLQLRERGPGRVIDITHAYVPDLPAFAQGAVAGPVVRLKHSMADGSEYNLSELRMECHTGTHVDAPGHINQAHFAAGLDVDTLDLDLLNGCRLTDGALGSSGLARADVALTWLWLWAGAADPLLEPA

SEQ ID NO: 1509 - DNA, 714 bp, Panicum virgatum
  misc_feature: Ceres CLONE 1766920
  misc_feature: Encodes the peptide sequence at SEQ ID NO. 1510
atcccacccagcaagcaagacccgcgcgttcacacctgaacgaccgaccctccgctgcgacggtcgggcccgccgccgtagccgactagcggttcgcttcccccggcccgccgccggcgcagcagcaggagagatgaactgggggttggccgccgccgtggcgtccgccgctgccgtcgcggccgcgtccggcgccgagctcctcgcctgcgactgcgatgcctccgcgccgccggccgtcgggaggtgcgacggcctgctcctctcgcggcagcaccacgacgaggaggtccgggaggggtcggcgtcgtcagcgtcgagggagaagcataggggcggaggcggcaacaggttcgcgccgcgcttcgacgggctgcgcttcatcgagactctcgtcacggcgcaccgctgaaaaaacgacgcatcgtccgctggtacttcccgccatgattcggcgatcgattgttggtggcgcttaggccagccagttttgttagaccagattctcgggattccctttccctttctccttcggttgtgttttcttcctcctgttgttgatgacgacgattactgtgtccatcacgtgcgtttgcgtgcgtgcgtgtgtgtgtgtttgagagagagaggatgaagactataagcggcatgtaaatttaagcacatactcttaatactatgttccataattatccatcacctgatttgtttgtt

SEQ ID NO: 1510 - protein, 92 aa, Panicum virgatum
  misc_feature: Ceres CLONE 1766920
  misc_feature: Great-hit functional homolog of the protein sequence given in SEQ ID NO 9184
  misc_feature: Useful for making plants with modulated cold sensitivity
MNWGLAAAVASAAAVAAASGAELLACDCDASAPPAVGRCDGLLLSRQHHDEEVREGSASSASREKHRGGGGNRFAPRFDGLRFIETLVTAHR

SEQ ID NO: 1511 - DNA, 698 bp, Panicum virgatum
  misc_feature: Ceres CLONE 1767016
  misc_feature: Encodes the peptide sequence at SEQ ID NO. 1512
agttacctgccgagcgaactccatcgcccgttttgtctgcccggtggtgcgacctcccgtcctcgccggcccggcgcgccgccgaccatggacccggacgcggtgcggcgcagcctcgagcccaccgcctccgcggaggagatcacgggatccaccccggcccgcctccacttctacgaccccttcgtcctcagcggcgtcagcatcgagtacgccgagcacggccgcctcctctgctccttcgtcgtcgccccgcgccacgccagccccgcggggtacctccgcagcggcgtcacggcgacgctcgccgaccagctggggtccgccgtcttcttctgcagcgggctccgcgcgagcggggtctccgtggagatcagcgtctcctttgtcgacgcggctactgtcggggaagaaatagaggtcgagggaaagttgttgcgtgctggaaaatctgttggcgtcgtttctgtcgatttcaggaagaaaaagacaggaaagttgatggcacaggcccgtcataccaagtatcttgctgtgtcaagcagattgtgaggctcccattctgctaacaagataataagatatcaacacaattgcggccaaactcaccaatctccataactgtgccattattactcgtcaacaatcatacaatgcttgtggtctatctttttttagaaaaaaaaaaaaaaaaaaaa

SEQ ID NO: 1512 - protein, 154 aa, Panicum virgatum
  misc_feature: Ceres CLONE 1767016
  misc_feature (1)..(78): Pfam Name: 4HBT Pfam Description: Thioesterase superfamily
MDPDAVRRSLEPTASAEEITGSTPARLHFYDPFVLSGVSIEYAEHGRLLCSFVVAPRHASPAGYLRSGVTATLADQLGSAVFFCSGLRASGVSVEISVSFVDAATVGEEIEVEGKLLRAGKSVGVVSVDFRKKKTGKLMAQARHTKYLAVSSRL

SEQ ID NO: 1513 - DNA, 693 bp, Panicum virgatum
  misc_feature: Ceres CLONE 1767035
  misc_feature: Encodes the peptide sequence at SEQ ID NO. 1514
ctctacggcgccgaccaaacctgaccaaacccccacaccgaggaacggaggaagagcgagcaccctcttgccctcgccgcaatggagcacaccttcatcatgatcaagcccgacggcgtccagaggggcctcgttggtgagatcatcagccgcttcgagaagaagggcttctacctcaagggcttgaagcttgtgaacgtggagaggtcgttcgccgagaagcactatgctgatctgtccgccaagcccttcttccagggcctcgtggactacatcatctctggccctgtggtcgccatggtctgggagggcaagagcgttgtcacaactggccgcaagatcatcggcgccaccaaccccctggcttctgagcctggcaccatccgtggtgactttgctgtcgacattggcaggaatgtcattcatggaagcgacagcattgagagtgctaccaaggagattgccctgtggttccctgagggcctcgccaactggcagagcagccagcacccctggatctatgagaagtaaactgggatagcttcactccgagccttgagagcctgggaaagcattgcgccagcctactttaatatttacagttggaggaaattattctctgtatctcagaaccttactttggtgaacaggatttccttgtccttcatgctatgcatgcttgacgttttgctc

SEQ ID NO: 1514 - protein, 149 aa, Panicum virgatum
  misc_feature: Ceres CLONE 1767035
  misc_feature (1)..(134): Pfam Name: NDK Pfam Description: Nucleoside diphosphate kinase
  misc_feature (1)..(149): SWISSPROT Homolog: EC 2.7.4.6 Nucleoside diphosphate kinase 1
MEHTFIMIKPDGVQRGLVGEIISRFEKKGFYLKGLKLVNVERSFAEKHYADLSAKPFFQGLVDYIISGPVVAMVWEGKSVVTTGRKIIGATNPLASEPGTIRGDFAVDIGRNVIHGSDSIESATKEIALWFPEGLANWQSSQHPWIYEK

SEQ ID NO: 1515 - DNA, 939 bp, Panicum virgatum
  misc_feature: Ceres CLONE 1767098
  misc_feature: Encodes the peptide sequence at SEQ ID NO. 1516
aggccacaagccacaggccacagcctgagccagccacagccgcctcgccgccgatctgcccaccgcccgcccgggccacgtcgcccagcacctgcgcggccgcaccgcccccgacggcatcgaactcgtccccttcccccgggcggccgctgctactgcggattcccctcgagagagagatccggcatggggctctgggactcgctgctcaactggctccgaagcctgtttttttaagcaggagatggagctctccttggttggtctgcaaaatgctggaaagacatctctagtcaatgctgtcgccactggtggctacagcgaggacatgattccaaccgtaggctttaatatgcggaaagttaccaagggaaatgtcacaattaaactttgggaccttggtggacaacggagattccggactatgtgggagcgctattgccgaggagtttctgccattctatatgtggtggatgctgctgatcgagatagtgtcccaatagcgaaaagtgaattgcatgatctgctgacgaaacagtctttagctgggattcccttgcttgttcttggcaacaaaattgataagtctgaagctctttctaagcaggcattggttgaccaacttggattggaagcaatacaggatcgtgaagtttgttgctacatgatctcctgtaaggattctgtgaacatagacgttgtcattgactggcttatcaagcactccagaacagcaaagtagcttctgtgtgtttgtatcacttgatgtacggtgatttgagtgtacccctaaatcaccacttcccgtttcctggtccagatgttaaaagtgaccaccttgtaatcaatgatctctttggtgtcagacaaacagcatggtgtctagtacttgaacatctgaacctttctactcctttgtaaaaaaaaaaaaaaaaaaaa

SEQ ID NO: 1516 - protein, 165 aa, Panicum virgatum
  misc_feature: Ceres CLONE 1767098
  misc_feature: Great-hit functional homolog of the protein sequence given in SEQ ID NO 9273
  misc_feature (15)..(175): Pfam Name: Arf Pfam Description: ADP-ribosylation factor family
  misc_feature: Useful for making plants with altered terpenoid content
MELSLVGLQNAGKTSLVNAVATGGYSEDMIPTVGFNMRKVTKGNVTIKLWDLGGQRRFRTMWERYCRGVSAILYVVDAADRDSVPIAKSELHDLLTKQSLAGIPLLVLGNKIDKSEALSKQALVDQLGLEAIQDREVCCYMISCKDSVNIDVVIDWLIKHSRTAK

SEQ ID NO: 1517 - DNA, 948 bp, Panicum virgatum
  misc_feature: Ceres CLONE 1767127
  misc_feature: Encodes the peptide sequence at SEQ ID NO. 1518
cagatccacccatccatcccgagacgagcagaaaatctccccacccaaaaaaaatcccaaaaccctaggcttcggatctcccgatctgcgatggcgaacccccgcgtgttcttcgacatgaccgtcggcggcgccccggccggccgcatcgtcatggagctgtacgccaacgaggtcccccgcaccgccgagaacttccgcgccctctgcactggcgagaagggcgtgggcaagaggggcaagccgctccactacaagggatccaccttccaccgcgtcatccccgacttcatgtgccagggcggcgacttcaccaacggcaacggcaccggcggcgagtccatctacggcgagaagttcgccgacgagaagttcgtccgcaagcacacggcccccggggtgctctccatggcaaacgccgggcccaacaccaacggctcccagttcttcatctgcaccgtgcccaccccgtggctcgacggcaagcacgtcgtcttcggccaggtcgtcgagggcatggacgtcgtcaaggccatcgagaaggtgggctcccgcagcggctccacctccaaggtggtcaagatcgcagactgcgggcagctcgcctagatccccagtcggatctgtctgcccggccgccgccctccgtcgtcgtcgtcgtcggttcctccttcgttcgtcccttccattcgctctgttccctctgaataagacgatggtgatctgagaggtggtctgagttgagtcgtgtcgtgtcgaatcgtttatcgtggtttaattaggggtttaggtgctggatctgcgaatcagcatgtggtggatggtgtctctccctaatccatgtttctgctgttatggtattgtctcgaggatgataactggaacttccctttagtgtttcggaattgttctacacttctacttgtgtaaaaaaaaaaaaaaaaaaaa

SEQ ID NO: 1518 - protein, 172 aa, Panicum virgatum
  misc_feature: Ceres CLONE 1767127
  misc_feature (1)..(167): Pfam Name: Pro_isomerase Pfam Description: Cyclophilin type peptidyl- prolyl cis-trans isomerase/CLD
  misc_feature (1)..(172): SWISSPROT Homolog: EC 5.2.1.8 Peptidyl-prolyl cis-trans isomerase
MANPRVFFDMTVGGAPAGRIVMELYANEVPRTAENFRALCTGEKGVGKRGKPLHYKGSTFHRVIPDFMCQGGDFTNGNGTGGESIYGEKFADEKFVRKHTAPGVLSMANAGPNTNGSQFFICTVPTPWLDGKHVVFGQVVEGMDVVKAIEKVGSRSGSTSKVVKIADCGQLA

SEQ ID NO: 1519 - DNA, 686 bp, Panicum virgatum
  misc_feature: Ceres CLONE 1767187
  misc_feature: Encodes the peptide sequence at SEQ ID NO. 1520
gtgagcttagcgagctatcataatcccacacagatcaagtgctcatcttgaaggccagggatggcttccgattccaagtctctgcttctgattggcgtcgtcctggcttccctcctcctcgtcaccaaggatgtggctgctgctagaaatcacttcatcgaggacaaggaatctgaggcaaagaacatgaagattaatggtgaggctgaactcaatgatgagaagggggctcgcggatattacggcggcgggtatggtggtggatatggtggagtgtacggcggtggctatggcggctatgttcctgggcgtggttggtatggtggcgggtatggttaccctggctttggcggtggatatggtggtggtggaggtggtggcggtggcggtggctatggtagtggatatggcgctggcggcggtggatatggtggcggcggttatcctggagtaggatattatggtggcggaggtggtggcaagcattaggagctatatacaagcattgtgcttcaacaatattacctgttactgtggttcacttgctttagacatggtttcatgttatccctttggtattaagttcgtcttggtgcaatgctgttatatcatgttgtattatgccaatatatatttcaaataaatgacagcccaattactttggacaaaaaaaaaaaaaaaaaaaa

SEQ ID NO: 1520 - protein, 142 aa, Panicum virgatum
  misc_feature: Ceres CLONE 1767187
  misc_feature: Great-hit functional homolog of the protein sequence given in SEQ ID NO 9328
  misc_feature: Useful for making plants with altered Lignin content
  misc_feature: Useful for making plants with altered alkaloid content
MASDSKSLLLIGVVLASLLLVTKDVAAARNHFIEDKESEAKNMKINGEAELNDEKGARGYYGGGYGGGYGGVYGGGYGGYVPGRGWYGGGYGYPGFGGGYGGGGGGGGGGGYGSGYGAGGGGYGGGGYPGVGYYGGGGGGKH

SEQ ID NO: 1521 - DNA, 939 bp, Panicum virgatum
  misc_feature: Ceres CLONE 1767240
  misc_feature: Encodes the peptide sequence at SEQ ID NO. 1522
actcccagttctcccacacacacttgtcaccttcctcccctgccacgagccgcgaggataagacgcagcccgtgagcgaacagcgccagcgccggccgccccgatcgagcaagcgaggaggatgcaccgcgcggcgaggaggctgatgtggggggccagccagcccggggcggacgtccccagcgaccacgacgtggtcatcgtgctcgcctcgctgctctgcgccatgatcaccgtcctcggcatcggcctcgtggcgcggtgcgcgtgcgggcgcggcggggccagcaggccgcccgccgccgccaacaggggcgtcaagaagtcggtgctccgcaagatccccaccgtgccgtacgcctcctccgccggcgcggcctgcggcggcgacgaggagtccggggaggcggcggcggaggaggagtgcgccatctgcctggcggagttcgaggagggcgaggccgtgcgcgtgctgcccccctgcggccacggcttccacgccgcctgcatcgacaagtggctgcgcgggcactccacctgcccctcctgccgccggatcctgtccctccggctgccgcccggcgagcgctgcagccgctgcggcgcgcggccccacgccggggacgccggctggaagccgacctcctacagcggcgtgccgccgttcctgccgtaggcagctgcgcgccaccagcagagaggcagagatgctgcttctgggctggagctagaagaagacaaggaccggaggaatcgaccaacccaaaagcaaacaatctggttggtaatgcgtagcaatccggagctggaaatggggaagtctgataaggtgtttgcaggcttgcagccgcggcgtactagctctgtacatttgtaaatattagtagtataaattaatatatatgcaatcagctttggcaaaaaaaaaaaaaaaaaaaa

SEQ ID NO: 1522 - protein, 184 aa, Panicum virgatum
  misc_feature: Ceres CLONE 1767240
  misc_feature (1)..(42): Pfam Name: zf-C3HC4 Pfam Description: Zinc finger, C3HC4 type (RING finger)
MHRAARRLMWGASQPGADVPSDHDVVIVLASLLCAMITVLGIGLVARCACGRGGASRPPAAANRGVKKSVLRKIPTVPYASSAGAACGGDEESGEAAAEEECAICLAEFEEGEAVRVLPPCGHGFHAACIDKWLRGHSTCPSCRRILSLRLPPGERCSRCGARPHAGDAGWKPTSYSGVPPFLP

SEQ ID NO: 1523 - DNA, 921 bp, Panicum virgatum
  misc_feature: Ceres CLONE 1767280
  misc_feature: Encodes the peptide sequence at SEQ ID NO. 1524
atatacatgctcagatcacactctttttgttgctgcctagctagcctgctatcttctttcctgcgagcattgcattggcaattgaacaaccaccggcaggctccaaccttttctacctccgccatccatcagtttctcccatccctgtcaaagtcaccacaaaggcaaaatgggctcggagacggagacggtccccgtggaaggcatcccgttcccggcggagatcacattcaccgccggcaaccctgctctgtccctcgtagctaacggcatcacggacatcgagatccacttcctgcagatcaagtacaacgccatcggcatctacctccacaacagcgacgtcctgctcgaccacctgcagggctggaagggcaagtcggccgacgagctgctcggagacgacgccttcttccaggccctcgtcgcggctcgcgtggagaagctgttccgggtcgtcgtcatcaaggagatcaagggctcgcagtacggcgtgcagctcgagagctctgtacgcgaccgcctcctcgccgccgacaagtacgacgacgacgaggaggcggcgctcgagaagatcaccgacttcttccaggccaagtacttcaagcctggctccgtcatcaccttccacttcccggccacttcagcagctggggctgcggagatatcgttcgcgacggagggcaaggacgaggccaagatgaaggttgagaacgagaacgtggccaggatgatccagaagtggtacctcggcggcgactccgcggtgtctccgaccaccgtccggagcctggcagatcgtttcgcggcgctgctctccgccgccgcctgatcaatttgctgcggatgctaattacgtaataatttccagcttccaccggaattgaactcgttattaatgaaaaaaaaaaaaaaaaaaaa

SEQ ID NO: 1524 - protein, 220 aa, Panicum virgatum
  misc_feature: Ceres CLONE 1767280
  misc_feature (1)..(209): Pfam Name: Chalcone Pfam Description: Chalcone-flavanone isomerase
MGSETETVPVEGIPFPAEITFTAGNPALSLVANGITDIEIHFLQIKYNAIGIYLHNSDVLLDHLQGWKGKSADELLGDDAFFQALVAARVEKLFRVVVIKEIKGSQYGVQLESSVRDRLLAADKYDDDEEAALEKITDFFQAKYFKPGSVITFHFPATSAAGAAEISFATEGKDEAKMKVENENVARMIQKWYLGGDSAVSPTTVRSLADRFAALLSAAA

SEQ ID NO: 1525 - DNA, 747 bp, Panicum virgatum
  misc_feature: Ceres CLONE 1767339
  misc_feature: Encodes the peptide sequence at SEQ ID NO. 1526
ccgatcccgatttgtttcgtttccccatccttgcggccgctccaccgccgccgccctccgctccggccgccgaggtcaccgattcagatccaggtaacccccgcgccgagatccctcccccggtccgtccgctctctccccctcctcccgatcgctcgccgccggctccagatccgcccgagatcgcccgtacgtcccgtcggacacgagagatggacgcgagcaggcgccagagcgggatccagcagctgctggccgcggagcaggaggcgcagcagatcgtcaatgcggccagggctgctaagtcggcaaggcttaggcaagcgaaagaggaggctgagagggaaatagctgaataccgtaaacagatggaggatgaattccagaggaaggttgcagagagcagcggtgactctggtgcaaatgtcaagcgcctcgagcaggagacagcggcgaagatcgaacagctcaaccaacaggctgcaagcatctccccagaagtcatccagatgcttctgaggcatgtcaccaccgtgaagaactgagccttgctgtgcctgagaatacgatcgcaagcttgtatcatctgtccatttattatttcggagagcgtggtgagaaataatttgacttgtggctgtaattcattgaccaccgaataagctgctgcagtagagcagcaaccgtgcctggtactatcagatattgcattgtttggtatattggcaaaaaaaaaaaaaaaaaaaa

SEQ ID NO: 1526 - protein, 110 aa, Panicum virgatum
  misc_feature: Ceres CLONE 1767339
  misc_feature (1)..(110): SWISSPROT Homolog: EC 3.6.3.14 Vacuolar ATP synthase subunit G 1
MDASRRQSGIQQLLAAEQEAQQIVNAARAAKSARLRQAKEEAEREIAEYRKQMEDEFQRKVAESSGDSGANVKRLEQETAAKIEQLNQQAASISPEVIQMLLRHVTTVKN

SEQ ID NO: 1527 - DNA, 820 bp, Panicum virgatum
  misc_feature: Ceres CLONE 1767399
  misc_feature: Encodes the peptide sequence at SEQ ID NO. 1528
aaaactggacacgataacgagacgggaagtgggggaggaggagctgaggagggctcccgggcagagagaagaagatggcggcgaagcgcgagaccgagtcggaccgcgaagagctcggcggcgaggactccaaccctgtcagcggtggcgcgactccgtcgcccctagccgcagctcccgtcgtctgcctcctccgctcctctggggacttcgccggcggcgccttcgtcggatccatcgtcggatatggacaaggcctgatcactaagaaaggtttcaagggctcattcagcaatgctggttcctccgctaagacttttgcagttctatctggcgtccagagtttggttgtgtgtttgttgagaaagctgcgtgggaaagatgacattgtcaatgctggtatagctggttgttgcactggcattgctttgagcttcccaggggcaccacaagcgttgcttcagagctgcgccacctttgcagcattctcttgcatcatggagggtctcaacaagcagcaggctgcaatggctcacactcttggcacaactgcattgacggttgcgcatgataaaggaggtgttctgcccccattcaggcttccaccaattctggatgcatcagatgctttagcttcatgctgccaagccttagtaaagcctaagcactagactacaggataaggggggagagagacatgctgaagaaagttagcttcagttttcatttctttattatgttgaccgagcatatctgcatatgtaaattttgcttctggacaagctgtggaacgtgcctggaaaaaaaaaaaaaaaaaaaa

SEQ ID NO: 1528 - protein, 198 aa, Panicum virgatum
  misc_feature: Ceres CLONE 1767399
  misc_feature: Great-hit functional homolog of the protein sequence given in SEQ ID NO 9259
  misc_feature: Great-hit functional homolog of the protein sequence given in SEQ ID NO 9710
  misc_feature: Useful for making plants with modulated salt sensitivity
MAAKRETESDREELGGEDSNPVSGGATPSPLAAAPVVCLLRSSGDFAGGAFVGSIVGYGQGLITKKGFKGSFSNAGSSAKTFAVLSGVQSLVVCLLRKLRGKDDIVNAGIAGCCTGIALSFPGAPQALLQSCATFAAFSCIMEGLNKQQAAMAHTLGTTALTVAHDKGGVLPPFRLPPILDASDALASCCQALVKPKH

SEQ ID NO: 1529 - DNA, 852 bp, Panicum virgatum
  misc_feature: Ceres CLONE 1767430
  misc_feature: Encodes the peptide sequence at SEQ ID NO. 1530
ttccactcctcaactctccccgcctcgcacccatggcgacgaccctgatggctgcggccaccacctcctgctccccgcgccgcgcggcgccgctcctgatgaagccggtggcctcctcctcgtctagctcggcgcggccgcggcggcccttggcgcagcagctcccgcggctgctggcgacggcggcggctgcggtggcggccgcgccgctcccggcgctggcggagcagatggagaaggcggcgctcttcgacttcaacctgacgctcccggcgatcgcgaccgagttcctgctgctcatggtcgcgctggacaagctctacttcacgccgctcggcaagttcatggacgagcgggacgccaagatccgcggcgagctcggcgacgtcaaggacgcctccgaggaggtcaagcagctggaggagcaggccgccgccatcatgaaggcggcgcgcgccgagatcgccgcggcgctcaacaagatgaagaaggagaccaccgccgagctggaggccaagctggacgagggccgccgccgcgtcgaggccgagctcgtcgaggcgctcgccaacctcgaatcccagaaggaggaggccgtcaaggcgctcgacgcgcagatcgcctcgctcagcgacgagatcgtcaagaaggtgctcccatccgcgtgagggggaatcgaaacagcgagccagccttcttccttgctcagctttctgatctgtgtgtatacgcttgttgggccgccgtccgttgccggccctgctttatcctatgatgactgtaactgcatcaacattttgtggcaagtataaatgaatcaatcatatttttgaaaaaaaaaaaaaaaaaaaa

SEQ ID NO: 1530 - protein, 211 aa, Panicum virgatum
  misc_feature: Ceres CLONE 1767430
  misc_feature (1)..(132): Pfam Name: ATP-synt_B Pfam Description: ATP synthase B/B' CF(0)
  misc_feature (4)..(209): SWISSPROT Homolog: EC 3.6.3.14 ATP synthase B' chain, chloroplast precursor
MATTLMAAATTSCSPRRAAPLLMKPVASSSSSSARPRRPLAQQLPRLLATAAAAVAAAPLPALAEQMEKAALFDFNLTLPAIATEFLLLMVALDKLYFTPLGKFMDERDAKIRGELGDVKDASEEVKQLEEQAAAIMKAARAEIAAALNKMKKETTAELEAKLDEGRRRVEAELVEALANLESQKEEAVKALDAQIASLSDEIVKKVLPSA

SEQ ID NO: 1531 - DNA, 961 bp, Panicum virgatum
  misc_feature: Ceres CLONE 1767463
  misc_feature: Encodes the peptide sequence at SEQ ID NO. 1532
gcctgcgttcccaatcatcgccaccgtctccctcaatcccctctccccaaaacctctccgcttcattcgtgaactgcgcgtgcgcgtgtcgctggccgccgccgccgctccccgtgcatgcgtccgagctctaggaaggaggaggccgaggggagtcgaccggccgatcgatcgattcatcgatggcgaagggcgggctgagtaagctgcggtgcatgatccggaggtggcactcgtccagccgcatcgcgcgcgcgccgtcgcccggcgaggacggccacgccggcggcggcggcggcgacgcccggggcgcgtcgttccacggcgcggacgaggtgcccaagggcctgcacccggtctacgtcggcaagtcgcgccgccggtacctcatcgccgaggagctcgtgggccacccgctgttccagtccctcgtccaccgcgccggcggcggcggcgccgaggccggctgcaccgtcgtcggctgcgaggtcgtcctcttcgagcacctcctgtggatgctcgagaacgcggacccgcagccggagtccctcgacgagctcgtcgagtactacgcgtgctgaccggccagagccgccgcgcccggtcccggacgccggggttggaagcttctggaaacagcacatggctgcggcggatcgtcctgcgatccgcgtggtttgagcagtagcggtagagtgtcgtcgtggcaagctccgaacgccggcgggacggcaaggcgtaagcccaagaaccctgctcctccggcgccgtcgatccggttccattcttctttaatcgcttcgtgtaattgacttccctttcattttgcttctcgattcttttctttccccttccttctgtcagtaagggtctagctggcagagcgcgtccatgtacattgcaaatcgcgacagaaatcgcccatttcgttcctctgaattaaaaaaaaaaaaaaaaaaaa

SEQ ID NO: 1532 - protein, 132 aa, Panicum virgatum
  misc_feature: Ceres CLONE 1767463
  misc_feature (1)..(103): Pfam Name: Auxin_inducible Pfam Description: Auxin responsive protein
MAKGGLSKLRCMIRRWHSSSRIARAPSPGEDGHAGGGGGDARGASFHGADEVPKGLHPVYVGKSRRRYLIAEELVGHPLFQSLVHRAGGGGAEAGCTVVGCEVVLFEHLLWMLENADPQPESLDELVEYYAC

SEQ ID NO: 1533 - DNA, 903 bp, Panicum virgatum
  misc_feature: Ceres CLONE 1767466
  misc_feature: Encodes the peptide sequence at SEQ ID NO. 1534
agcccgggaggcattcccctattaaaacccgcctctctcatccgccgcgagccgagtctttgctagggtttcctcgctccccgccgccgccgcctccttgccgcacgcccgcagcgcgtccctccctcgttctcggccatggcggaggtggagcagccgctgcagcagcagcaggatgtgaagctcttcaaccgctggaccttcgacgatgtccaggtgaacgacatctcgctgaacgactacctggcggtgtcggcgacgaagcacgcgacctacctgccgcacaccgcggggcgctactcgaagaagcggttccgcaaggcgcagtgccccatcgtcgagcgcctcaccaactcgctcatgatgcacggccgcaacaacggcaagaaggtcatggccgtccgcatcatcaagcacaccctggagatcattcacctgctcaccgacgccaaccccatccagatcgtcgtcgacgcgatcatcaacagtgggccacgtgaggatgccacccgtattggttctgctggtgttgtgaggaggcaggctgtggatatctcgcccctgaggagggtgaaccaggccatctacctcctaacaactggagctcgggagagcgctttcaggaacatcaagaccattgctgaatgccttgcagatgagttgatcaatgctgctaagggctcatccaacagctatgccatcaagaagaaggatgagattgagcgtgttgccaaggccaaccgttgagtgaagcttgtgtatcttggtgcaatggagtcatgttatgtcattggcagttgttttggttcatgttttacccgatgtttagacttttctgagacctagctaaggttttgctttgaatgaacaatgaaaattacggaaaaaaaaaaaaaaaaaaaa

SEQ ID NO: 1534 - protein, 202 aa, Panicum virgatum
  misc_feature: Ceres CLONE 1767466
  misc_feature: Great-hit functional homolog of the protein sequence given in SEQ ID NO 9304
  misc_feature: Useful for making plants with modulated biomass
  misc_feature: Useful for making plants with modulated flowering time
  misc_feature: The plant flowers significantly late compared to wild-type.
  misc_feature: The plant is abnormally small.
MAEVEQPLQQQQDVKLFNRWTFDDVQVNDISLNDYLAVSATKHATYLPHTAGRYSKKRFRKAQCPIVERLTNSLMMHGRNNGKKVMAVRIIKHTLEIIHLLTDANPIQIVVDAIINSGPREDATRIGSAGVVRRQAVDISPLRRVNQAIYLLTTGARESAFRNIKTIAECLADELINAAKGSSNSYAIKKKDEIERVAKANR

SEQ ID NO: 1535 - DNA, 730 bp, Panicum virgatum
  misc_feature: Ceres CLONE 1767503
  misc_feature: Encodes the peptide sequence at SEQ ID NO. 1536
atcgcggcgcattctcgctctgttgtgtgactgatggccaagaaggaaacgctctctgcttgtgttccagtctctgaatctggtgtgaggatgtcgtgctgcggaggcaactgcgggtgcggctccagctgcaagtgcggctccggctgcggagggtgcaagatgtacccggacatggctgagcagggcaccaccaccaccaccaccacccagactgtcatcaagggcgttgcaccaaccaacaaggggcatgccgagggcgggttcgaggccggcgccggagccgagaagggcggctgcaagtgcggcgacaactgcacctgcaacccctgcacctgcaagtgaggagctcatggccatggccggaccggaggagatctcggaaggacaaaaaagctagtatagcagtgttgtgtatgtgcgtcgttcgtttgtctgaaagtgtgggtggcatgcttagtaacagtgttgcgcgtgctgctagtagatggtactgatgaggaacaataataatgatggtgctgagatgtcgtcggcgtcgccgccgtcgtgtccttcctccccggccggtcgagcacctgtggcggtgctctagcagtgtgtcggtgtgtgcagcaggccatgctctgatctgtggtgtaggtgtgtggcctgcttggtgtcccttgtgtcatgtgtaaccagccatctatatcattatctatctatctacatccatgttgtgtgctcg

SEQ ID NO: 1536 - protein, 103 aa, Panicum virgatum
  misc_feature: Ceres CLONE 1767503
  misc_feature (18)..(42): Pfam Name: Metallothio Pfam Description: Metallothionein
  misc_feature (1)..(80): Pfam Name: Metallothio_2 Pfam Description: Metallothionein
MAKKETLSACVPVSESGVRMSCCGGNCGCGSSCKCGSGCGGCKMYPDMAEQGTTTTTTTQTVIKGVAPTNKGHAEGGFEAGAGAEKGGCKCGDNCTCNPCTCK

SEQ ID NO: 1537 - DNA, 797 bp, Panicum virgatum
  misc_feature: Ceres CLONE 1767507
  misc_feature: Encodes the peptide sequence at SEQ ID NO. 1538
gtcatctcatgcgtgggtgccctcctggggcttagcgtgcacggcggggccgtcgacgcgggcagcagcggcgctcaaagaaaatctctcgttttcgtccggtctccacgacaaatatgcagcgctcggtggtataaaccggaccgggtggggtggggctcggaaatcacatcgccgtgcagtctgaagttcacacgcgcggcgtcttcttcctcgcgacctcgcccgtccagcaacgagcccgggatcgggagaaacaagcaagcctcccatggcgctcgcgaaggccaaggagatcgtcgcctccacccctgttgtcgtcttcagcaaaacttattgtcctttctgcacccgagtaaagcaactgctagcacagctgggggcgaattacaatgctgttgaattggatgtggaaagtgatggatctgatttgcaatcagctctcgctgagtggacggggcagagaactgttccgaatgtcttcgttaaaggagagcgtatcggtggctgtgatgcgaccatggcaatgcacaacggtgggaagctggtgcctctgctgacggaggctggagcaattagtgcccccggcactgcaactccgtctctgtagacagcattctgctcgtttggtggttacatgcaagtgttgtactactactgtggttgttgtaaagtaaaggtgaacgatgtgtttcatcgacctgaatcgcttcttgatgttgactgtaattgtagcttttggtggctatcaagcctctcggtaaatcttcagacaccaaaaaaaaaaaaaaaaaaaa

SEQ ID NO: 1538 - protein, 112 aa, Panicum virgatum
  misc_feature: Ceres CLONE 1767507
  misc_feature (1)..(63): Pfam Name: Glutaredoxin Pfam Description: Glutaredoxin
MALAKAKEIVASTPVVVFSKTYCPFCTRVKQLLAQLGANYNAVELDVESDGSDLQSALAEWTGQRTVPNVFVKGERIGGCDATMAMHNGGKLVPLLTEAGAISAPGTATPSL

SEQ ID NO: 1539 - DNA, 577 bp, Panicum virgatum
  misc_feature: Ceres CLONE 1767544
  misc_feature: Encodes the peptide sequence at SEQ ID NO. 1540
atctcgacaccgtcatcctagctacctcacccgggaagcaccgtagcgcgcgccaggccaacaccaaggacgtggagcaggagcaggaggtcgtgctccccaacgggatccggtactacgagctgcgcgtcggcggcggcgacgccccgcgccccggcgacctggtggtgatcgacctgcagggccgggtggccggcggcggggaggcgttcgtggacacgttcggcgagggcaagcggccgctggcgctggtgatggggtcccggccctacaccaggggcatgtgcgagggcgtcaagtacgcgctgcgctccatgagggccggcggcaagcggcgggtggtcgtgccgccggggctcgggttcggcgacgacggcgccgacttcggggaggagcacgtgcagataccgcccggcgccacgctcgagtacgtcgtgcaggtcgacaaggtatccatcgcgccggcgtgagacgcgactgaggcgcgagtagatacatcacagttctgtgttgccatgagacgagtttctactcgattgtttcacactgctatctcgttaaatgaattgtttttggg

SEQ ID NO: 1540 - protein, 71 aa, Panicum virgatum
  misc_feature: Ceres CLONE 1767544
  misc_feature (41)..(104): Pfam Name: FKBP_C Pfam Description: FKBP-type peptidyl-prolyl cis-trans isomerase
MGSRPYTRGMCEGVKYALRSMRAGGKRRVVVPPGLGFGDDGADFGEEHVQIPPGATLEYVVQVDKVSIAPA

SEQ ID NO: 1541 - DNA, 773 bp, Panicum virgatum
  misc_feature: Ceres CLONE 1767599
  misc_feature: Encodes the peptide sequence at SEQ ID NO. 1542
accctagcctagcccccagggagaggggagagggaggcgaagcgaagcgaagaccatctgcccaccaaccactccacctggccgcagtcgagtccccgtctgcatcccccggcgcggccatggctccgatcgccgtcggcgactccctccccgacggccagctcgggtggttcgatgagagcgaccagctgcagcaggtctccgtccacgcgctcgccgccggcaagaaggtcatcctcttcggcgtgcccggagccttcacgcccacctgcagcatgcagcatgtgccgggcttcattgcacaggctgagcagctcaaagccaagggtgtagatgaaatcctgcttatcagtgttaacgacccctttgtcatgaaggcatgggcaaagacataccctgagaacaagcatgtgaagttcctagccgatggatcaggaaactacaccaaggcactcggtcttgagcttgacctgacagagaagggattgggcattcgctcaagacggtttgctctcctggccgacaacctcaaggtcactgttgcaaacatcgaggaaggtggccagttcacaatctctggcgctgaggagatcctgaaagcgctgtaggagtttcagcttcagctcttgtaaaagcgcagcaatgttgtcggcatcagtctaatttgaactcgtcttccataccgcgaataacttgtcaatggacaagatccagttccatgtacactagacgaaacttttggaggctgcctattaccgctgttgatttatgcg

SEQ ID NO: 1542 - protein, 162 aa, Panicum virgatum
  misc_feature: Ceres CLONE 1767599
  misc_feature (1)..(158): Pfam Name: Redoxin Pfam Description: Redoxin
  misc_feature (1)..(162): SWISSPROT Homolog: EC 1.11.1.15 Peroxiredoxin-2C
MAPIAVGDSLPDGQLGWFDESDQLQQVSVHALAAGKKVILFGVPGAFTPTCSMQHVPGFIAQAEQLKAKGVDEILLISVNDPFVMKAWAKTYPENKHVKFLADGSGNYTKALGLELDLTEKGLGIRSRRFALLADNLKVTVANIEEGGQFTISGAEEILKAL

SEQ ID NO: 1543 - DNA, 967 bp, Panicum virgatum
  misc_feature: Ceres CLONE 1767609
  misc_feature: Encodes the peptide sequence at SEQ ID NO. 1544
gaatccggcaaaacctaaccctagcggctccccccactcgtcggcggggcgatggcgatggacgcggagcggcggcaggcggagctgatcgggcagttctctgcgcaggcggcggcgctgtcgtcggcgccgcagctcgccgcgctggtactcgaggccacctcgcacccggccctcttcgccttctccgagctactcaccctccccgccctctccaagctcgctggcacgcagtacgcgtcgtcactggacgtcctccggctctttgcctacggcactttgaaggactataagagtaattctgggtctcttcctgcattgttgcctgatcaaatccgaaagctaaagcaactcagtgtgctaactctggcagagtcaactaagatactaccttatgatcagctcatgcaagagttggacgtttccaatgtaagagaacttgaagacttcctcatcaatgagtgcatgtactcaggtattgttagaggcaaactggatcagttgagaaggtgctttgaggtacaatttgcagctggaagggatcttacacctgatcagctgaacaacatgatagacaccttgtctgactggttgggaacatcagatagtctgttgcatcaaattcaggagaaaatcaagtgggctgacacaatgagtgaggtgaacaagaagcaccagaaagaatttgaagacagagtggaagaagccaaaaaatcaatcaaggcagacaatgacttacgggggcatgacgactttctctctgaatctggaggaataatggattttgaagaggaccgcatccggccaaaaaggaggcgacaaccaccggcgtagtttcaatgaagtccttacccctctttcctcgtttgtgaactgctgatgccttgattgaaactttttgacgccagagttgaagaaactttgtacatcaattatggtgtgcctccaaaaaaaaaaaaaaaaaaaa

SEQ ID NO: 1544 - protein, 260 aa, Panicum virgatum
  misc_feature: Ceres CLONE 1767609
  misc_feature: Great-hit functional homolog of the protein sequence given in SEQ ID NO 9464
  misc_feature: Useful for making plants with modulated low light sensitivity
MAMDAERRQAELIGQFSAQAAALSSAPQLAALVLEATSHPALFAFSELLTLPALSKLAGTQYASSLDVLRLFAYGTLKDYKSNSGSLPALLPDQIRKLKQLSVLTLAESTKILPYDQLMQELDVSNVRELEDFLINECMYSGIVRGKLDQLRRCFEVQFAAGRDLTPDQLNNMIDTLSDWLGTSDSLLHQIQEKIKWADTMSEVNKKHQKEFEDRVEEAKKSIKADNDLRGHDDFLSESGGIMDFEEDRIRPKRRRQPPA

SEQ ID NO: 1545 - DNA, 911 bp, Panicum virgatum
  misc_feature: Ceres CLONE 1767624
  misc_feature: Encodes the peptide sequence at SEQ ID NO. 1546
actcctgcccgccgccgtcacttgagcctcctcttttcgctctgcttcttcttgcactccctcgatctcgccggcggaggaaatggcggaagttgaggcgcccacccaggaggtcaagctcttcggccgctggtccttcgatgacgtccaggtcaatgacatttctctggctgattaccttgccgtcagtcatacaaagcacgccatatatcttccccacaccgctggaaggtattctgctaagaggttccgcaaggctcagtgcccaattgttgagaggctgacaaactctctgatgatgcacggccgcaacaatggcaagaaggtcatggctgttcgcattgtgatgcatgctatggagattattcacctgctgactgatgccaaccctattcaaattatcgttgatgccatcataaacagtgggccaagagaagacgctacccggattggatctgctggtgttgttagaaggcaagctgttgatatatctcctttgaggcgtgtgaaccaggcaatctacctgcttaccactggtgctagagaaagtgctttcaggaacatcaagaccattgcagagtgccttgccgatgagcttatcaatgcagctaaaggttcttctaacagctatgcgatcaagaagaaggatgagattgagcgtgttgccaaggccaaccgttgagcattctcattcaaatcaggaaaagcagagttttggggtggaacgatgcctacttatgtatctaccttgtttatttgtgaacttagcttggtgttggagctacagacctgtatgttcctaaaaacccaaaagtacctttcccgttctggttgtcttagccgcagtatgaattgaagttttgcacagctgtaatcttttgtcgtgttgccaaaaaaaaaaaaaaaaaaaa

SEQ ID NO: 1546 - protein, 199 aa, Panicum virgatum
  misc_feature: Ceres CLONE 1767624
  misc_feature: Great-hit functional homolog of the protein sequence given in SEQ ID NO 9304
  misc_feature: Useful for making plants with modulated biomass
  misc_feature: Useful for making plants with modulated flowering time
  misc_feature: The plant flowers significantly late compared to wild-type.
  misc_feature: The plant is abnormally small.
MAEVEAPTQEVKLFGRWSFDDVQVNDISLADYLAVSHTKHAIYLPHTAGRYSAKRFRKAQCPIVERLTNSLMMHGRNNGKKVMAVRIVMHAMEIIHLLTDANPIQIIVDAIINSGPREDATRIGSAGVVRRQAVDISPLRRVNQAIYLLTTGARESAFRNIKTIAECLADELINAAKGSSNSYAIKKKDEIERVAKANR

SEQ ID NO: 1547 - DNA, 845 bp, Panicum virgatum
  misc_feature: Ceres CLONE 1767654
  misc_feature: Encodes the peptide sequence at SEQ ID NO. 1548
aagagcgacgaagccgaactagtgccggcacgccggacggagaaacatggcagggaaagccggcggactcaagggggttgccctcatcggcggcggggccaacagctcggtcgccggcgccctacacttcttccaggaccccgccaccgggtacaccgaggtgaggggcaaggtcacgggcctggctccgggcatgcatggattccacatccacgtcttcggcgacaccaccaacggctgcaactccaccgggccccattttaaccctcacaataagccccatggagcaccatttgatgatgaacgacatgtgggtgacctgggaaacatagcagccaacaaagatgaagtgttcataagggacctacagatttcattgagtggacctcattccatactgggaagggcagttgttgttcatgctgatccggatgacctagggaggggtggccatgaactcagcaagtcaacaggaaatgcaggagctagagttggatgtggtatcattggaattcagtcttcagtttagcaagtaacagcctagttccaccagaaaaaagggccaagggatatgtcatggtatatgcagattgtgcggagacatggaaatgatgtgcattgttctggaacatctcaaaactaaacagtttagtaccctaactgtctacagtgatgtatacaataatcttgttactatcagaataagaggaaaattgccagtagattcttgtatcgacttctgcatgtcctgaataatggtatctgtgcttatcagtggctataggcctatatgcaaaaccccttcgaaagggaaaggtacatgtcaaaaaaaaaaaaaaaaaaaa

SEQ ID NO: 1548 - protein, 160 aa, Panicum virgatum
  misc_feature: Ceres CLONE 1767654
  misc_feature (1)..(152): Pfam Name: Sod_Cu Pfam Description: Copper/zinc superoxide dismutase (SODC)
  misc_feature (6)..(157): SWISSPROT Homolog: EC 1.15.1.1 Superoxide dismutase [Cu-Zn]
  misc_feature (6)..(160): SWISSPROT Homolog: EC 1.15.1.1 Superoxide dismutase [Cu-Zn] 2
MAGKAGGLKGVALIGGGANSSVAGALHFFQDPATGYTEVRGKVTGLAPGMHGFHIHVFGDTTNGCNSTGPHFNPHNKPHGAPFDDERHVGDLGNIAANKDEVFIRDLQISLSGPHSILGRAVVVHADPDDLGRGGHELSKSTGNAGARVGCGIIGIQSSV

SEQ ID NO: 1549 - DNA, 769 bp, Panicum virgatum
  misc_feature: Ceres CLONE 1767908
  misc_feature: Encodes the peptide sequence at SEQ ID NO. 1550
gtgctctctcagaggtgggttggcttctccccctcttaccaagtcctcggttctagggttttagttggaaggggagatggcggcggcggatgtggagtaccgctgcttcgtcggcggcctcgcctgggccaccgacaacgcgtccctccagcaggccttcgcctcctacggcgacgtcctcgactccaaggtcatcaccgaccgtgagacggggaggtcccgcgggttcggcttcgtcaccttctcaaccgagcagtcgatgctcgacgccatcgaggccatgaacggcaaggagctcgacggccgcaacatcaccgtcaaccaggcccagtcccgcggcggtggcggcggcggcggcggttacggcggcggtcgccagggaggctacggcggcggcggcgggtacggtggcggcggcgggtacggtggcggcggcggtcgccgtgagggcgggtacggtggcggcggctacgacggtggcggtggcggatacggtggcggtcgccgcgagggcggctacggcggtggtggctacggcagccgcggtgactccggtggcaactggaggaactgatggggtagccctcccgtgctggcagccaagttatcctagatatctattagtgttcgtgttaccatttgatcccgagttaccccagagtttagtgtccgtgttaccgtttgattaggtgttggttcccatgttaccgttcccgagttgtttccgcaatgaaatgagaagaaaagagtgagcaaggtttttgttcgc

SEQ ID NO: 1550 - protein, 165 aa, Panicum virgatum
  misc_feature: Ceres CLONE 1767908
  misc_feature: Great-hit functional homolog of the protein sequence given in SEQ ID NO 9183
  misc_feature: Great-hit functional homolog of the protein sequence given in SEQ ID NO 9185
  misc_feature: Great-hit functional homolog of the protein sequence given in SEQ ID NO 9703
  misc_feature: Useful for making plants with altered Lignin content
  misc_feature: Useful for making plants with altered alkaloid content
  misc_feature: Useful for making plants with modulated biomass
  misc_feature: Useful for making plants with modulated nitrogen use efficiency
  misc_feature: Useful for making plants with modulated nitrogen use efficiency
  misc_feature: The plant is abnormally small.
MAAADVEYRCFVGGLAWATDNASLQQAFASYGDVLDSKVITDRETGRSRGFGFVTFSTEQSMLDAIEAMNGKELDGRNITVNQAQSRGGGGGGGGYGGGRQGGYGGGGGYGGGGGYGGGGGRREGGYGGGGYDGGGGGYGGGRREGGYGGGGYGSRGDSGGNWRN

SEQ ID NO: 1551 - DNA, 784 bp, Panicum virgatum
  misc_feature: Ceres CLONE 1768002
  misc_feature: Encodes the peptide sequence at SEQ ID NO. 1552
tcgtctcccccacaccgcaaaccagcgaatcgcagaccacgccccactgcactcactcaggccatctcttcccttctcgtgaccgagggagagagcgagcaggcaggcaggcggcagggatggctggcccgaggctcgcgacgctggcgctggccgtgctcctggcggcggccgtggcggctcccccggcggcggtgcgcgcggccatgtcgtgcagcaccgtgtacaacaccctgatgccgtgcctgccgttcgtgcagatgggcggcgcgatgcccccgcagccgtgctgcggcggcatccgcagcctgctggcgcaggccaacaacacccccgaccgccgcaccatctgcggctgcctcaagaacgtcgccaacggcgcctccggcgggccctacgtcacccgcgccgcctcgctgcccagcaagtgcggcgtctccctgccctacaagatcagcaccgacgtcaactgcaacacgattaactgaggcgtcccgggcgaggaaaaggaaatgcatggcggagaataaataaaaaagatgctgcaagtatttaagaagctggaatgaactagtagatcgaggtgtggtagtctctagtcgtcgtcgttgatggtgtttaggaatcgtctgaagaagttcctcctcctggtgcgtcgtggatgctcccgcgagcagagtagtcatgaacctgtgtgtgcgcgcgcttctgtgtaccgtgtctatgtatttcctcgagtcgaagtacctattattgccgtttagaaaaaaaaaaaaaaaaaaaa

SEQ ID NO: 1552 - protein, 122 aa, Panicum virgatum
  misc_feature: Ceres CLONE 1768002
  misc_feature (1)..(86): Pfam Name: Tryp_alpha_amyl Pfam Description: Protease inhibitor/seed storage/LTP family
MAGPRLATLALAVLLAAAVAAPPAAVRAAMSCSTVYNTLMPCLPFVQMGGAMPPQPCCGGIRSLLAQANNTPDRRTICGCLKNVANGASGGPYVTRAASLPSKCGVSLPYKISTDVNCNTIN

SEQ ID NO: 1553 - DNA, 980 bp, Panicum virgatum
  misc_feature: Ceres CLONE 1768031
  misc_feature: Encodes the peptide sequence at SEQ ID NO. 1554
gtagcgattacccgggtcctcctcgctcccctcgcctgtcttcggtcgacagcaatcgtcggggcaacgaaaggaaatcctcgatctcctgttcccactcctcactacccagcaagcgcgccgagaggaggagcgaagccatgtccatgccggggccggggcaatcggcggagagagatgagcgcgggagggacgactacgagcagcagcaggcccgggtgctcatggcgctgatgcagggtttctgcgccgcgcggtaccgcaaggccgacaacacgccatgccccatcgagcagggtctctacttgggatctgttggcgcagcattgaacaaggaggctcttaagagcttgaacatcacccatgtattgattgtagcaagatcacttaatccagcttttccagctgaattcaattacaagaagatcgaggtacttgacagccctgacactgatctgttaatgcactttgatgaatgctttagtttcatagatgaagctataagctctggaggcaatgtgttagtccattgttttgctgggcggtcaaggagtgtgacaattgttgttgcatatctaatgaagaagcatcgaatgagcctcgaaagtgccttatctctagttagaagcaaacgacctcaagtggctcctaatgaggggtttatttcccagctggagaactttgagaaatccctggaagtggagcaggagcacagaacgcattctttgcagagctaattataggtgtaggagcgtgtatgtcaagaatacaatgtcaagagcctcctgcctacatatgaatgccttggtaaatcggtagggcttcactgctttgttctgtaaacaagtgacattggtcactcatcgaatgggttccattgaatgtggtttacatgctcaacaatcatcactgtaatttctattccaatgaatcaaatgttaataatctgtgctacttcttaaaaaaaaaaaaaaaaaaaa

SEQ ID NO: 1554 - protein, 198 aa, Panicum virgatum
  misc_feature: Ceres CLONE 1768031
  misc_feature (2)..(139): Pfam Name: DSPc Pfam Description: Dual specificity phosphatase, catalytic domain
MSMPGPGQSAERDERGRDDYEQQQARVLMALMQGFCAARYRKADNTPCPIEQGLYLGSVGAALNKEALKSLNITHVLIVARSLNPAFPAEFNYKKIEVLDSPDTDLLMHFDECFSFIDEAISSGGNVLVHCFAGRSRSVTIVVAYLMKKHRMSLESALSLVRSKRPQVAPNEGFISQLENFEKSLEVEQEHRTHSLQS

SEQ ID NO: 1555 - DNA, 561 bp, Panicum virgatum
  misc_feature: Ceres CLONE 1768062
  misc_feature: Encodes the peptide sequence at SEQ ID NO. 1556
atgcaagctagcaaccaagcacaagtacccgaagaatcatacagcagatctcctatcctacattttcaaactgtccaagtttttcttttttcttttcccacaacaagacccacctgatcgatggaccgggtaacgaggctggcatcgcagcgtgctgtggtgatcttcaccacgagctcctgctgcatgtgtcacacagtgacgcagctcttccgtgagctcggggtgaacgcaacggtggtggagttggacggggaccctcggggaacggagatggacaaggcactggcgaggctgctgggccgcagcaccggtgtgccagcagtgttcatcggcggcaggctcgtcgggtccacggacaaggtcatgtcgctccacctcagcggcaacctcgtcccgctgctgcgcaatgcgggggcgctctgggtgtagcgtgatagggccttgtgctctatataagttagttttactgacagcaccatgtcgatccaatgcaaattatgggcttcagtattttgtaagagtacctgataaattgacgagtgagtgttttcctcccgg

SEQ ID NO: 1556 - protein, 103 aa, Panicum virgatum
  misc_feature: Ceres CLONE 1768062
  misc_feature: Great-hit functional homolog of the protein sequence given in SEQ ID NO 9279
  misc_feature (1)..(64): Pfam Name: Glutaredoxin Pfam Description: Glutaredoxin
  misc_feature: Useful for making plants with altered protein content
MDRVTRLASQRAVVIFTTSSCCMCHTVTQLFRELGVNATVVELDGDPRGTEMDKALARLLGRSTGVPAVFIGGRLVGSTDKVMSLHLSGNLVPLLRNAGALWV

SEQ ID NO: 1557 - DNA, 1204 bp, Panicum virgatum
  misc_feature: Ceres CLONE 1768064
  misc_feature: Encodes the peptide sequence at SEQ ID NO. 1558
gtgaacttagcggagcgagcacgagcagtgcaagccaagcattctattcaggctctcgatctccctctctcttcttcctctatcttctcggtgagttcgttgtcgctgcatccgagatctttttgtgggttcggccatggagatgatgatcgacgcggagctgcgtctcggcccgcccggcggcgatgtcacagtcgtgcagccggcaaggaagccggcggcggcgaaacggtcgtcgtcggcggtgaagagcgaggcctccgggaccggtggccatgacgacgacgccgcgccggcctccaaggtgcaggtgatggggtggccgccggtgagggcgtaccggaagaacgcgttccatgcggcggcggaggcagcgtcggcgaggacgaccaagcagggtggtgagcagcagggggggctgtacgtgaaggtgagcatggacggagcgccctacctccggaaggtggaccttcggacgtacggcgggtacagggagctgagggacgcgctggacgcgctcttcggctgcttctcctcggcggcggccgacgacggctgccagttcgccatcgcctacgaggacaaggacggcgacctcatgctcgccggcgacgtgccatgggatatgttcatctgttcttgcaagaagctgaggatcatgaggggctccgaagcaagatgatccgagtgtcgacgtccatcgcgagaatttgttggacgcgtgtggatcagatgtataggtcatcatctggtcagactcacgagagatctatcgatcattcgatggatgcgcatggtgctccatcaatctacgagtacagacatggggttgaaggcgtcggatggatacctgcatggggagggcggcggccagcccatacatgcatgcctaggtgcatcgtgttctacggccaggttgccatacacgaacactcccacacatgcacatgtatataggtgacggcggggtactcatcatgctgctccttgtcatcagatgggcggtgctgtgttggtctgcaaatcacacacattcagccaagtagtggaggggatgaactaggatctgtgtacatatgatgaagctgtttcatttgtaattttgaatttccctttttgtatgagtgaacaaagtttgatgctgagcgaaatatgtgcaagaaacgagagggaaatttgatttcaaaaaaaaaaaaaaaaaaaa

SEQ ID NO: 1558 - protein, 181 aa, Panicum virgatum
  misc_feature: Ceres CLONE 1768064
  misc_feature (1)..(187): Pfam Name: AUX_IAA Pfam Description: AUX/IAA family
MEMMIDAELRLGPPGGDVTVVQPARKPAAAKRSSSAVKSEASGTGGHDDDAAPASKVQVMGWPPVRAYRKNAFHAAAEAASARTTKQGGEQQGGLYVKVSMDGAPYLRKVDLRTYGGYRELRDALDALFGCFSSAAADDGCQFAIAYEDKDGDLMLAGDVPWDMFICSCKKLRIMRGSEAR

SEQ ID NO: 1559 - DNA, 941 bp, Panicum virgatum
  misc_feature: Ceres CLONE 1768094
  misc_feature: Encodes the peptide sequence at SEQ ID NO. 1560
agtgaacgaatctggtccgctaatcttacccacctccgcgtttcgtgaaagcgcgcggcggcgagaggagcggaagcggcgacaagcagagagatggccggcggtggcgccgccgccgccgcgccgccgctttcgagcccctggagggcgctgctccagcgagctttggacgccaacgcccacctcaggcactccacctatttccaacttgccacggtgggcgccggcggcaggcccgccaatcgcaccgtcgtgttcaggggtttccaggaacattctgataagattcagattaacacggatgcccgaagcaacaagattggtgagataaggaattgccccttcggagagatttgttggtacttcacagacagctgggagcaattccgtatcagtggaagcatagatgcgattgatagctccagtgcagaccctgccaagctccagaacagggagaaagcttggttcgcgagctcagtgaggtcaagattgcagtacttgggacctcagccaggtgttcccattatagatgaggagcaagttaaggatgttcgtctagatccatcagctgtcccagtagaagccttttgccttctggttcttgatccagaaaaggtcgattatttgaatctaaaaaacaaccaaaggtgatattcacaagaagccaaaaggaagatggctccattgattggatggctgaaaaagttactccgtaaactgctgtgagaagtttgtttgtgaacttcttaaggtccgaaagctatcatgattgttttatttgttttatatgctttcagaatgtttatgtgagtgtccattgaggtcttttggatgctcctaagtttgagagtcaggaatgttttgttgaaatctcagtgatttattatttattatacctgaacatacaggtagaactactggaaaaaaaaaaaaaaaaaaaa

SEQ ID NO: 1560 - protein, 185 aa, Panicum virgatum
  misc_feature: Ceres CLONE 1768094
  misc_feature (3)..(90): Pfam Name: Pyridox_oxidase Pfam Description: Pyridoxamine 5'-phosphate oxidase
MAGGGAAAAAPPLSSPWRALLQRALDANAHLRHSTYFQLATVGAGGRPANRTVVFRGFQEHSDKIQINTDARSNKIGEIRNCPFGEICWYFTDSWEQFRISGSIDAIDSSSADPAKLQNREKAWFASSVRSRLQYLGPQPGVPIIDEEQVKDVRLDPSAVPVEAFCLLVLDPEKVDYLNLKNNQR

SEQ ID NO: 1561 - DNA, 736 bp, Panicum virgatum
  misc_feature: Ceres CLONE 1768110
  misc_feature: Encodes the peptide sequence at SEQ ID NO. 1562
acgcacaccacacacgtcgtcgccgcacgcacacgcacgatcttcgtctggcgtggcgctcgctgttgccagatacatggaggggaggcggtggtcgccgtgccacgggcggcgccggcggcgtgcggcggagacgacagcgctgatgagccggaaggtccgggagctgcggcggctggtgcccggcggcacggcggtgccggcccaccggctgctcctccgcaccgccggctacatcgtgcgactccgggcgaggatagagctcctcagggggctctccgagctcgccgccgtgacgacgacgacgaatcatggctgctaccatgtcgacggtgacgcgcgcctctaggctgtaagctggctgttggcgggctagctggccactacggtggttcgtgtgcatcgtacataattatacgtggcgtccgcgtatatatatatatatatatatatatatatatatatatatatatatatatatatgcacaatatatcatggataaatctcagttttggtactacgtagagatgaaggatcgattattgagctatttacagcgaattaatgctgtagttaagtcatctgtatcattctatatcttcctacagtttgttgtttccttaatttctttctcttttttttctagcgacgcattatttatacttttgtcactgtttataagtcgtttgatttgtcaagagtgcctttcttgagatgtcctattctttttcttcc

SEQ ID NO: 1562 - protein, 90 aa, Panicum virgatum
  misc_feature: Ceres CLONE 1768110
  misc_feature: Great-hit functional homolog of the protein sequence given in SEQ ID NO 9624
  misc_feature: Useful for making plants with modulated biomass
  misc_feature: Useful for making plants with modulated low light sensitivity
  misc_feature: The plants are small.
MEGRRWSPCHGRRRRRAAETTALMSRKVRELRRLVPGGTAVPAHRLLLRTAGYIVRLRARIELLRGLSELAAVTTTTNHGCYHVDGDARL

SEQ ID NO: 1563 - DNA, 921 bp, Panicum virgatum
  misc_feature: Ceres CLONE 1768114
  misc_feature: Encodes the peptide sequence at SEQ ID NO. 1564
acgcagcagcagccgagccagccaccggatttctttctccttcccccacccgagcaagagcaaatccctagactactaaaccctcgccatggccaacccccgcgtgttcttcgacatggccatcggcggcgcccccgcggggcgcatcgtgatggagctgtacgcgaacgaggtgccgcgcacggcggagaacttccgcgcgctgtgcacgggcgagaagggcgtgggcaagaaggggaagccgctccactacaagggctcggtcttccaccgcgtcatccccgacttcatgtgccagggcggcgacttcaccgacggcaacggcaccggcggcgagtccatctacggcgccaagttcgccgacgagaagttcgtgcgcaagcacacgggccccggggtgctctccatggccaacgccgggcccaacaccaacggctcccagttcttcatctgcaccgtgccctgcccttggctcgacggcaagcacgtcgtcttcggccaggtcgtcgaggggctcgacgtcgtcaaggccatcgagaaggtgggctcccgcagcggctccaccgccaaggtggtcaaggtcgccgactgcggccagctcgcctagatccgcgccgatctgctggtcccggccgccctccatccgccgtcgtcgcctccttccgttcgctccgctccccccctccgcactgaataagatgacggtgatctgagaggtgcttcttccgaattgagtcgagtcgtgttcgtttgtcgtgtgctgtgctggtggtgtctagggttttaggtggtggatctgcgaatccgatgggccatggttggatggtgtctctgcctgcttgttgtggtacgatgaattgatgatgatgatgctatgatgagaagtgagaactgaaacctgaaaaaaaaaaaaaaaaaaaa

SEQ ID NO: 1564 - protein, 172 aa, Panicum virgatum
  misc_feature: Ceres CLONE 1768114
  misc_feature (1)..(167): Pfam Name: Pro_isomerase Pfam Description: Cyclophilin type peptidyl- prolyl cis-trans isomerase/CLD
  misc_feature (1)..(172): SWISSPROT Homolog: EC 5.2.1.8 Peptidyl-prolyl cis-trans isomerase
MANPRVFFDMAIGGAPAGRIVMELYANEVPRTAENFRALCTGEKGVGKKGKPLHYKGSVFHRVIPDFMCQGGDFTDGNGTGGESIYGAKFADEKFVRKHTGPGVLSMANAGPNTNGSQFFICTVPCPWLDGKHVVFGQVVEGLDVVKAIEKVGSRSGSTAKVVKVADCGQLA

SEQ ID NO: 1565 - DNA, 722 bp, Panicum virgatum
  misc_feature: Ceres CLONE 1768122
  misc_feature: Encodes the peptide sequence at SEQ ID NO. 1566
gggatctcatcgcattctcgctctgttgtgtgactgattgccaagaaggaaacgctctctgcttgtgttccagcctctgaatctcgtgtgaggatgtcgtgctgcggaggcaactgcgggtgcggctccggctgcaagtgcggctccggctgcggagggtgcaagatgtacccggacatggctgagcagggcaccaccaccaccacccagactgtcatcatgggcgttgcaccaaccaacaaggggcatgccgagggcgggttcgaggccggcgccggagccgagaacggcggctgcaagtgcggcgacaactgcacctgcaacccctgcacctgcaagtgaggagctcatggccatggccggaccggaggagatctcggaaggataaaaaagctagtatagcagtgttgtgtatgtgcgtcgttcgtttgtctgaaagtgtgggtggcatgcttagtaacagtgttgcgcgtgctgctagtagatggtactgatgaggaacaataataatgatggtgctgagatgtcgtcggcgtcgccgccgtcgtgtccttcctccccggccggtcgagcacctgtggcggtgctctagcagtgtgtcggtgtgtgcagcaggccatgctctgatctgtggtgtaggtgtgtggcctgcttggtgtcccttgtgtcatgtgtaaccatccatctatatcattatctatctatctacatccatgttgtgt

SEQ ID NO: 1566 - protein, 82 aa, Panicum virgatum
  misc_feature: Ceres CLONE 1768122
  misc_feature (1)..(80): Pfam Name: Metallothio_2 Pfam Description: Metallothionein
MSCCGGNCGCGSGCKCGSGCGGCKMYPDMAEQGTTTTTQTVIMGVAPTNKGHAEGGFEAGAGAENGGCKCGDNCTCNPCTCK

SEQ ID NO: 1567 - DNA, 480 bp, Panicum virgatum
  misc_feature: Ceres CLONE 1768143
  misc_feature: Encodes the peptide sequence at SEQ ID NO. 1568
acacacatcggcgagcagcttccccacattccggttctcaatccacccacccacctgcggcggcgcaagaagagggggaagcgaagcggaggcgacgcgatgtcggcgacgacggcggcggtgcccttctggcgcgcggcgggtatgacctacatcggctactccaacatctgcgccgcactggtgcggaactgcctcaaggagcccttcaagtccgaggccgcgtcccgcgagaaggtccacttctccgtcgccaagtggacggacggcaagcaggagaagcccactgtccgcacggagtcagatgaataaaaatctggtgccatgatgacagtcctttctatagatgttttgttttgaagtgttgttgcaagatttggaacttgctgtttatctggcttgattttatggtcaacactgaagaataaatacttttttcaacaattgatctttttgaacaatgccatgtcgttactgttt

SEQ ID NO: 1568 - protein, 70 aa, Panicum virgatum
  misc_feature: Ceres CLONE 1768143
  misc_feature (1)..(49): Pfam Name: ATP-synt_Eps Pfam Description: Mitochondrial ATP synthase epsilon chain
  misc_feature (1)..(70): SWISSPROT Homolog: EC 3.6.3.14 ATP synthase epsilon chain, mitochondrial
MSATTAAVPFWRAAGMTYIGYSNICAALVRNCLKEPFKSEAASREKVHFSVAKWTDGKQEKPTVRTESDE

SEQ ID NO: 1569 - DNA, 956 bp, Panicum virgatum
  misc_feature: Ceres CLONE 1768393
  misc_feature: Encodes the peptide sequence at SEQ ID NO. 1570
ctgctctccggccctccctccccttcccaccccagcgaatccaatcgagcccaaggcgatggagcagccgggcgcggacggcgaggtgccggcggggctggggctgacggcggcggagtacgagcagctgcggtcgacggtggaagcgcaccaccgctacgccgtgggggcgggccaatgctcctccctgctggcgcagcgcatccaggcgccgccgtccgccgtctgggccatcgtccgccgcttcgattgcccgcaggtgtacaagcacttcatccgcagctgcgcgctccgcccggaccccgaagccggcgacgccctccgccccggccgcctccgcgaggtcagcgtcatctccggcctccctgccagcaccagcacggagcgcctcgacctcctcgacgacgccgccagggtcttcggcttctccatcactggcggcgagcaccgcctccgcaactaccgctccgtcaccaccgtcaacgagctcgcgggccccgggatctgcaccgtcgtgctcgagtcctacgtcgtcgacgtccccgacggaaacaccgaggacgacacccgcctcttcgccgacaccgtcatcaggctcaacctccagaagctcaagtccgtcgccgaggccaacgcagccgccgagccggcggagtagcggcggccggaatgagcaagtgaagaaagcaacagcaagttttgggtgtttctgtaatttcgcttcattgggaagggtttctctgaattgaatctgatcatggatggactcggacaggacgaggggggatcagcttgaattaggtgtcattgcaagggtgctgcactgctgctacctgtaataatctctttcttctgctggattccttccgttcttctttacttattattctggaatttggttaatttcagctttatgtgattggaatgattccttagaaaaaaaaaaaaaaaaaaaa

SEQ ID NO: 1570 - protein, 199 aa, Panicum virgatum
  misc_feature: Ceres CLONE 1768393
  misc_feature (3)..(150): Pfam Name: Bet_v_I Pfam Description: Pathogenesis-related protein Bet v I family
  misc_feature (1)..(139): Pfam Name: Polyketide_cyc Pfam Description: Polyketide cyclase / dehydrase and lipid transport
MEQPGADGEVPAGLGLTAAEYEQLRSTVEAHHRYAVGAGQCSSLLAQRIQAPPSAVWAIVRRFDCPQVYKHFIRSCALRPDPEAGDALRPGRLREVSVISGLPASTSTERLDLLDDAARVFGFSITGGEHRLRNYRSVTTVNELAGPGICTVVLESYVVDVPDGNTEDDTRLFADTVIRLNLQKLKSVAEANAAAEPAE

SEQ ID NO: 1571 - DNA, 850 bp, Panicum virgatum
  misc_feature: Ceres CLONE 1768400
  misc_feature: Encodes the peptide sequence at SEQ ID NO. 1572
agaaaccgcccctccgccgccgccgcaggccgctcgccgctcgcgccatgggtatcgatctcgtcgccggcggccggaacaagaagaccaagcgcaccgcgcccaagtccgacgatgtctacctcaagctcctcgtcaagctgtaccgcttcctggttcgcaggaccaagagcgacttcaacgccgtgatcctgaagcggctcttcatgagcaagaccaaccgcccgccgctctcgctacgccgcctcgtcaaattcatggagggcaaggagaaccagattgctgtgatcgtgggcagcgtgaccgacgacaagagggtctacgaggtcccagcgatgaaggtggctgcgctcaggttcactgagacggcgagagcccggatcgtgaatgctggtggcgagtgcctcacctttgaccagctggcgctccgtgcgcctctgggccagaacacggttctgctgaggggacctaagaatgctagggaagctgtgaaacactttggcccagcacctggtgtgcctcacagccataccaagccatacgttcgctctaagggaaggaagtttgagaaggcaagaggaaggaggaacagcagaggcttcaaggtctaagttgtcgtgtctcatccatgtggtctcacctagtggactaaataggttttgcttgagcctgagttctgtgttattacctcagttcaagacttttgagggctatgttatttgtataccggttccaggatctgctcaattttgccctgaatttgcgttttgtattggaatttgcaagtgtttttggcagtattatgcactagatgcactataatctttcttaaaaaaaaaaaaaaaaaaaa

SEQ ID NO: 1572 - protein, 187 aa, Panicum virgatum
  misc_feature: Ceres CLONE 1768400
  misc_feature: Great-hit functional homolog of the protein sequence given in SEQ ID NO 9458
  misc_feature: Useful for making plants with modulated nitrogen use efficiency
MGIDLVAGGRNKKTKRTAPKSDDVYLKLLVKLYRFLVRRTKSDFNAVILKRLFMSKTNRPPLSLRRLVKFMEGKENQIAVIVGSVTDDKRVYEVPAMKVAALRFTETARARIVNAGGECLTFDQLALRAPLGQNTVLLRGPKNAREAVKHFGPAPGVPHSHTKPYVRSKGRKFEKARGRRNSRGFKV

SEQ ID NO: 1573 - DNA, 965 bp, Panicum virgatum
  misc_feature: Ceres CLONE 1768420
  misc_feature: Encodes the peptide sequence at SEQ ID NO. 1574
acacggcagacgagaggaggcgaggccggccaccccggggggaggagtggcgggcgcggggatggcgatccagtacgcgctggtggcgcgcggcacggtggtgctggcggagcacagcgccgcggccaccaacgcgggcgccgtcacgcgccaggtcctcgagcgcctccccggcggcggcgccgacagccacgtctcctacacgcaggaccgctacgtcttccacgccaagcgcaccgacggcatcaccgcgctctgcatggccgacgacgccgccgggagacggataccctttgcatttttggaagacattcatggaagatttgtcaaaacatatggccgcgctgcgctgactgctcttgcgtatgcaatgaatgatgaattctcaagggttcttagccagcaaatggactactattcaaatgaccctaacgcagatagaataaaccgcatgagaggtgaaatcaatcaggttcgtagtgttatgattgataacattgacaaagtccttgaaagaggtgaccgtttggagctgctggttgacaagaccgcaaatatgcaaggaaatactgttcgattcagaagacaagctcggcgcttcagaaacaccgtttggtggagaaatgtcaaactcacggctgcgttgatacttctccttctggtaatagtatatgttgcgcttgtcttcgtgtgccatggtttcaccttaccaacttgtatacgctagggtatggtgtgcctgtttgtgtgattatgtctccattccttgggagcagctatcgcagtactgttgcagttggttttgatgtagaggaaagctccagattgtggtgtaatagtgatggtgtcaattgtgaaaaactcaattaaagatgtaaacttcacataagactgcatctcgcagggtcttgctatggcgtagctgcgcgcgcctgggttgtgttcaaaaaaaaaaaaaaaaaaaa

SEQ ID NO: 1574 - protein, 221 aa, Panicum virgatum
  misc_feature: Ceres CLONE 1768420
  misc_feature: Great-hit functional homolog of the protein sequence given in SEQ ID NO 9573
  misc_feature: Useful for making plants with modulated heat sensitivity
  misc_feature: Useful for making plants with modulated heat sensitivity
MAIQYALVARGTVVLAEHSAAATNAGAVTRQVLERLPGGGADSHVSYTQDRYVFHAKRTDGITALCMADDAAGRRIPFAFLEDIHGRFVKTYGRAALTALAYAMNDEFSRVLSQQMDYYSNDPNADRINRMRGEINQVRSVMIDNIDKVLERGDRLELLVDKTANMQGNTVRFRRQARRFRNTVWWRNVKLTAALILLLLVIVYVALVFVCHGFTLPTCIR

SEQ ID NO: 1575 - DNA, 720 bp, Panicum virgatum
  misc_feature: Ceres CLONE 1768423
  misc_feature: Encodes the peptide sequence at SEQ ID NO. 1576
accagcgcttgcaacaactcatccatccagcaccgtatcgtgccctcatcacattcacgcacaatggctcgcgctcagcaggtcgtggcgatcgccgtcgttgccgccgtcgtgctgctcgccgccgcggccacctccgaggccgccgtgacctgcgggcaggtcaactccgccatcagcccctgcatcacctacgcccgcgggtccggctccggcccctcctcagcctgctgcagcggagtcaggagcctcaactccgccgccaggagcaccgccgacaggcgcgccgcatgcaactgcctcaagtccgccgcaggcagggtgagcggcctcaacgccggcaacgccgccagcatcccgtccaagtgcggagtcagcatcccctacaccatcagcccatccgtcgactgctccaaggtggcttaatatcgatcgtgatgagttggttggagcctgctgccaagcacatccaccgatatatctagctatcgtctatatatgatcgatcgagttcttgctagctcgctgatgaataaaatctctccgccgtcgctcatcatgtgagagacacggccggatcggatgtgtcagtccctgctacgttttgtacgtgtctgctgcatgtacacctccatttccgttccagagtctgtaccttgtccactaccttttaatacatacaccactttttggtatgtataaaaaaaaaaaaaaaaaaaa

SEQ ID NO: 1576 - protein, 120 aa, Panicum virgatum
  misc_feature: Ceres CLONE 1768423
  misc_feature (1)..(85): Pfam Name: Tryp_alpha_amyl Pfam Description: Protease inhibitor/seed storage/LTP family
MARAQQVVAIAVVAAVVLLAAAATSEAAVTCGQVNSAISPCITYARGSGSGPSSACCSGVRSLNSAARSTADRRAACNCLKSAAGRVSGLNAGNAASIPSKCGVSIPYTISPSVDCSKVA

SEQ ID NO: 1577 - DNA, 912 bp, Panicum virgatum
  misc_feature: Ceres CLONE 1768470
  misc_feature: Encodes the peptide sequence at SEQ ID NO. 1578
ctgtccgtctgtcgctctctctctccgcctctcctccgcccggcgcctcggcctagggttaggcagctcctgcgcgcgggccaggtcttcgtcgggcgcttcgccggccgacagggtactcagccatggtttttcttgaggcagagatgtcatggaatgtgttgatctcacctagccagctggaccgcaagggcctcctgctccgcaaggctataattgtgcgtcttctggaggatgttaccaacaggagggcttccaaggagcatgggtactacattgccgtcaatcggctgaaggcaatatctgaagggaaagtgcgtgagctcactggagacgttctgttcccagtcacattcacctgcatcacgcacaagcctatgaagggtgatatcatggttggatacgtggataggatcctcaagcacggtgtgtttctcaaatctggacctgtcgagagcatcttcatggctgagaagtcgatgggcggctacaagtacattggcggggagaacccaatgttcatgaacgaccactcaaagctggagaaggacaccgccgtgcgtttcaaggtcatggggtaccgctggatggaagccgaccgccaattccagctccttgccacgattgctggagacttccttgggcctgtgtgaactggttcgacagattaaacgtggcactgatgtacattgcttgttggacgatccatggatgggtgggtggttgtgatgtgctagatttaactttgcagtcagtagtttgctctgtagcgtcagggcatgaccgatgtcttctgtgacggtaatgcttatggctgatgccgggccatttggctccgtggtttaacatcagtgtactgtgatgaaccttcgttgtcaattggtgttccttccaaaaaaaaaaaaaaaaaaa

SEQ ID NO: 1578 - protein, 175 aa, Panicum virgatum
  misc_feature: Ceres CLONE 1768470
  misc_feature (1)..(73): Pfam Name: RNA_pol_Rpb7_N Pfam Description: RNA polymerase Rpb7-like, N-terminal domain
MVFLEAEMSWNVLISPSQLDRKGLLLRKAIIVRLLEDVTNRRASKEHGYYIAVNRLKAISEGKVRELTGDVLFPVTFTCITHKPMKGDIMVGYVDRILKHGVFLKSGPVESIFMAEKSMGGYKYIGGENPMFMNDHSKLEKDTAVRFKVMGYRWMEADRQFQLLATIAGDFLGPV

SEQ ID NO: 1579 - DNA, 894 bp, Panicum virgatum
  misc_feature: Ceres CLONE 1768484
  misc_feature: Encodes the peptide sequence at SEQ ID NO. 1580
actaaaaaaactgtctccaacaagaccagaattagcatgcactaagatctctctccctctccattcctcactggcggcatagatgtcgacgattatgggatcttacacgagccggtcgccggttctgccggcttcgtctcaagctgccatagcccgtggttcttggaagcccgcagtggcagcattccgaccttgtgccggcgttaggtgccggcgagcacttaccgtgacctgcgcgctcccggagaaagaacggccgccggcgttcagcatcccgcccaccgttctgctgtgccccgtgccgccgccggacgggaaggagcggtgggacatcaaggaggaggaggaccgcgtcacgctgtggctccaggtgcccgggctgtcggcgagcgacatcgaggtaaccaccggcgacgacgtcctggagatcaagcggaaggccacggcccagcagcccgcggcgcccgtggacgcgcacagcgtgggcgcgttccacatccggctgctcatgaccaaggagtacgacggcaccagggtcaccgccgacctcaaggccggcatgctggaggtcaccgtcccaaagaaccttcaacgcgggggtgaacgcgtcgagctggggaagcctgcgccccggccaaagcagggcacgaacaccaagaaaggctcggaggacacgaaactggccggaccagaccctgggcaaataaaaggcaggggactggctggctgagggttgtgctgtctccgtcggtcctgtttcctttccttttgtgttgaaataagtctcatttttagttccctatggatggaatgacggagagagatcgactcaagccagcaatcagcttagatcactggcccgaagtgagctctcaaaaaaaaaaaaaaaaaaaa

SEQ ID NO: 1580 - protein, 215 aa, Panicum virgatum
  misc_feature: Ceres CLONE 1768484
  misc_feature (1)..(98): Pfam Name: HSP20 Pfam Description: Hsp20/alpha crystallin family
MSTIMGSYTSRSPVLPASSQAAIARGSWKPAVAAFRPCAGVRCRRALTVTCALPEKERPPAFSIPPTVLLCPVPPPDGKERWDIKEEEDRVTLWLQVPGLSASDIEVTTGDDVLEIKRKATAQQPAAPVDAHSVGAFHIRLLMTKEYDGTRVTADLKAGMLEVTVPKNLQRGGERVELGKPAPRPKQGTNTKKGSEDTKLAGPDPGQIKGRGLAG

SEQ ID NO: 1581 - DNA, 672 bp, Panicum virgatum
  misc_feature: Ceres CLONE 1768535
  misc_feature: Encodes the peptide sequence at SEQ ID NO. 1582
catcagccagcttaggcatcacagaggcaatcacgacacgtacgggttccgtaatcatcagagtgtgtgagcgaggtgacgaggatgaggggtctgcttgtgctggctctcctgctcgccgccgcggcgtgcctcgccgagggcgcgggcgagtgcggggcgacgccgccggacaggatggcgctgaggctggcgccgtgcgcgtcggcggcgcagaacccgaacgcggcgccgtcgagcgggtgctgcagcgcggtgcgcaccatcgggaagcagagcccccagtgcctctgcgccgtcatgctgtccaacaccgccaagagctccgggatcaagcccgaggtcgccatcaccatccccaagcgatgcaacctcgccgaccgccccgtcggctacaagtgcggagcttacactctgccatgagcagaaaggactgcaaggctgatgcgtggcatgttcaagttcaagtatcaccgaaccacaagcacgaagtcgtgtccgcgtgtctctctgtgttaccaataaacgacaattgcgagtaccatccttgtggaactctagtatgtttgagtctgtcactagaggcgtactactcatgtggtcatgttcagggtcatgagatgtagtcctgcattgtcgaaataaaactaagagtctctctccttttctttt

SEQ ID NO: 1582 - protein, 112 aa, Panicum virgatum
  misc_feature: Ceres CLONE 1768535
  misc_feature (1)..(83): Pfam Name: Tryp_alpha_amyl Pfam Description: Protease inhibitor/seed storage/LTP family
MRGLLVLALLLAAAACLAEGAGECGATPPDRMALRLAPCASAAQNPNAAPSSGCCSAVRTIGKQSPQCLCAVMLSNTAKSSGIKPEVAITIPKRCNLADRPVGYKCGAYTLP

SEQ ID NO: 1583 - DNA, 723 bp, Panicum virgatum
  misc_feature: Ceres CLONE 1768661
  misc_feature: Encodes the peptide sequence at SEQ ID NO. 1584
ctaacgccgctcgcgtcccctctccccctcgagccgccgccgccgccgcagctgctgccgcaagaccccaccccgccgtcgccggagacaaacccccagctgccgccatggggcgtatgcacagccgcgggaagggtatctcgtcgtcggcgctgccgtacaagaggactcccccgacctggctcaagactgccgcctccgatgtggaggagatgatcaccaaggccgcgaagaagggccagatgccgtcgcagattggcgtcctcctccgtgaccagcacggtatcccgctagtcaagagcgtcactggtagcaagattctttttttcctcaaggcccatgggctcgcgccggagatcccggaggacctttacttcctgatcaagaaggcggtggcgattaggaagcatctggagaggaacaggaaggacaaggactccaaattcaggctcattcttgttgagagcaggatccaccgccttgcccgttactacaagcgcaccaagaagctcccgcccacctggaagtatgagtcgaccactgccagcactctggtggcttaagtgatctcttcagatggtgtggtctttagcttctttgagattgccttattctagatatgaatttatgtaatgcttaatgagtctggagcgggttagatggacaaggaacctcaactttttctatgtttacttggagaatcccataaaccatttttggttt

SEQ ID NO: 1584 - protein, 151 aa, Panicum virgatum
  misc_feature: Ceres CLONE 1768661
  misc_feature: Great-hit functional homolog of the protein sequence given in SEQ ID NO 9202
  misc_feature: Useful for making plants with modulated nitrogen use efficiency
MGRMHSRGKGISSSALPYKRTPPTWLKTAASDVEEMITKAAKKGQMPSQIGVLLRDQHGIPLVKSVTGSKILFFLKAHGLAPEIPEDLYFLIKKAVAIRKHLERNRKDKDSKFRLILVESRIHRLARYYKRTKKLPPTWKYESTTASTLVA

SEQ ID NO: 1585 - DNA, 957 bp, Panicum virgatum
  misc_feature: Ceres CLONE 1768678
  misc_feature: Encodes the peptide sequence at SEQ ID NO. 1586
ggtgttcattctccccgttccctctcgcgcgcgcgaaggccaaggctggatcgggagggccctctcagatctcgcgcgcttcgccggccgcgcagcaacccagggagtaggagctagggggatcggggcgaggatgtttagcgggacgcagcagaagtgcaaggtgtgcaccaagacggtgtacccgatggaccagctctccaccgacggcgtcgtcttccaccgctcctgcttcaagtgccagcactgcaagtccaccctctccctgagcagctattcctcgttcgaaggagtgccatactgcaaggcccatttcgagcagctgttcaaggagacagggagctacaacaagagcttccaatcacaatcacaatcacccgcaaagattactccagaaaagtcggcacctgagctgaccagaacaccaagcaaagctgcaaggatgttttcaggaacacaagacaagtgtgcaacttgtggcaaaaccgcatatcctcttgagaaggtaacagttgaagaaaaggcctaccacaagtcctgcttcaaatgctcccatgggggctgtgccatcacaccatccaactatgcagccttggaggggatcctctactgcaggcaccatttctctcaacttttcaaggagaagggaagctacaaccatctgatcaagtgtgcatcggtcaagcgtacagaagcacagcctgaacaaccagcacagccagctgctgattcctcttgatccttgccatttcaacagtggggtttgaaggcaagaatttgcctgtttttacttaaaaccacctggttgtatgttatgccgtctagccccaacgatactggacttctctactttggtatccccggctgttctagctgaatcacattggtgaaccatggaactgtcattttcaatgaaattgttgtgcacccgatactgaaaaaaaaaaaaaaaaaaaa

SEQ ID NO: 1586 - protein, 201 aa, Panicum virgatum
  misc_feature: Ceres CLONE 1768678
  misc_feature: Great-hit functional homolog of the protein sequence encoded by LOCUS At2g39900
  misc_feature: The sequence is a functional homolog of  SEQ ID NO 428 in the  10/412,699 US patent application
  misc_feature: The sequence is a functional homolog of  SEQ ID NO 616 in the  11/435,388 US patent application
  misc_feature: The sequence is a functional homolog of  SEQ ID NO 992 in the  11/479,226 US patent application
  misc_feature: Useful for making plants with modulated heat sensitivity
  misc_feature: Useful for making plants with modulated growth and phenotype characteristics
MFSGTQQKCKVCTKTVYPMDQLSTDGVVFHRSCFKCQHCKSTLSLSSYSSFEGVPYCKAHFEQLFKETGSYNKSFQSQSQSPAKITPEKSAPELTRTPSKAARMFSGTQDKCATCGKTAYPLEKVTVEEKAYHKSCFKCSHGGCAITPSNYAALEGILYCRHHFSQLFKEKGSYNHLIKCASVKRTEAQPEQPAQPAADSS

SEQ ID NO: 1587 - DNA, 681 bp, Panicum virgatum
  misc_feature: Ceres CLONE 1768688
  misc_feature: Encodes the peptide sequence at SEQ ID NO. 1588
cgccaccgtttcccccatctcgcccgccgtcctcctcctcgatctcctcgcacctcgcatccgcagctctccccggcgcttaaccaagggtttaggaccggcggcgatggcggcgaggctggcgcagctgcgtgcgcaggcggcgcgtgcggcggagctcgcctcgaagcacggctgcgcctactacaaggaggtcatggagaagaacaagcagtacgtcgtgcagccccccaccgtcgagaagtgccaggagctctccaagcagctcttctacacccgcctcgcaagtctaccaggccgctatgaagcattctggaaggagcttgatggtgtcaagcaggtatggaagaacagaaaggagctcaaggttgaggaccttgggattgcgaccttatttggagttgagctttatgcatggttctgtgtaggcgagattgttggcagagggttcaccttaaccggatataaggtctagatgatttctcctggttaagacctgctttacaatctatacttttagttgatgcttgttgaaacgacgatgatacctgccttcgttcacaattttgtttcttaaaaagagtttctctagtgctggatgccagcaaggacgggcacatcgttgcaacattgcctcaataatttgctcgctcaattgtccaaaaaaaaaaaaaaaaaaaa

SEQ ID NO: 1588 - protein, 122 aa, Panicum virgatum
  misc_feature: Ceres CLONE 1768688
  misc_feature (1)..(113): Pfam Name: ATP-synt_G Pfam Description: Mitochondrial ATP synthase g subunit
MAARLAQLRAQAARAAELASKHGCAYYKEVMEKNKQYVVQPPTVEKCQELSKQLFYTRLASLPGRYEAFWKELDGVKQVWKNRKELKVEDLGIATLFGVELYAWFCVGEIVGRGFTLTGYKV

SEQ ID NO: 1589 - DNA, 873 bp, Panicum virgatum
  misc_feature: Ceres CLONE 1768768
  misc_feature: Encodes the peptide sequence at SEQ ID NO. 1590
atcgatctccctcgcccgcctcctcctgtactcgtcaaccccgcgagatgctgggctagccattactcccctcataatctctctctccctcactcgaccattcagagccaagcaaagcaagcaagaagattaggaagaggcaggagtatcggagcggaaagattaattaggtggccgccggtgtgtgtgtgtgatgatgaagaggatggtgatcctgcggcggtgccacccaccgccgccgccgccggcggtgctcctgggcgggtgcggcggcggcggcgtgcggtacggtgagtgccggaggaaccacgcggcgagcatgggcgggcacgccgtggacgggtgccgcgagttcctggccgagggggaggacggcaccgccgccgcgctccgctgcgcggcgtgcgggtgccaccgcagcttccaccgccgcgtcgtgcggcgctgctgctgccgcgacgacgacgacgcctcggcggccggcgcccgcctctggcggggcggcgagggctgctcgccggagtcctcggcgtccagcgccacgccgaggtagaaaaagcaaagatcagatcggcaacaaacgcaggtgccaagcccacgcctgcaactcgcgccgagcttctgcttcttctcctctaactagctagctagctcgatcaggtctcttgcctagctaaattattgctactgcctttttccccctgcaaaattatttgtaaggttgttcatcgatcacacgctacccgtgtttgtacaattttacgcctgctatccttctttttgcatgagattgttgagttaccatatgatggcttgctgcgagatctacagatggaagaagccttgtcaggccaaaaaaaaaaaaaaaaaaaa

SEQ ID NO: 1590 - protein, 118 aa, Panicum virgatum
  misc_feature: Ceres CLONE 1768768
  misc_feature: The sequence is a functional homolog of  SEQ ID NO 110 in the  10/714,887 US patent application
  misc_feature: The sequence is a functional homolog of  SEQ ID NO 110 in the  11/435,388 US patent application
  misc_feature: Useful for making plants with modulated growth and phenotype characteristics
MKRMVILRRCHPPPPPPAVLLGGCGGGGVRYGECRRNHAASMGGHAVDGCREFLAEGEDGTAAALRCAACGCHRSFHRRVVRRCCCRDDDDASAAGARLWRGGEGCSPESSASSATPR

SEQ ID NO: 1591 - DNA, 692 bp, Panicum virgatum
  misc_feature: Ceres CLONE 1768772
  misc_feature: Encodes the peptide sequence at SEQ ID NO. 1592
cgtgctctctcagaggtgggttggcttctcctccccctcttaccaagtcctcggctctagggttttagtgggaagggagatggcggccgcggatgtggagtaccgctgcttcgtcggcggcctcgcctgggccaccgacaacgcgtccctccagcaggccttcgcctcctacggtgacgtcctcgactccaaggtcatcaccgaccgtgagacggggaggtcccgcgggttcggcttcgtcaccttctcctccgagcagtcgatgctggacgccatcgaagccatgaacggcggcggctacggcggcggtcgtcagggtggctacggcggcggcggcggcggctacggaggcggtggtggctacggcggtggtcgccgtgagggcggctacggcggaggcggtggcggcggtcgccgcgagggcggctacggtggtggtggctacggcagccgcggtgactccggtggtaactggaagaactgatggggtggccctcccgtgctggcagccaagttatcctatatatctattagtgttcgtgtcactgtttgatccgagttacccctgagttttgtccgtgtgttaccgttcgattaggtgttggttcccatgtttaccgttcccgagttgtttccgcaatgaaatgagaagaaaagagtgtccgcaatgaaatgagatttgatctgcgcgc

SEQ ID NO: 1592 - protein, 134 aa, Panicum virgatum
  misc_feature: Ceres CLONE 1768772
  misc_feature: Great-hit functional homolog of the protein sequence given in SEQ ID NO 9423
  misc_feature: Great-hit functional homolog of the protein sequence given in SEQ ID NO 9716
  misc_feature: Useful for making plants with altered Lignin content
  misc_feature: Useful for making plants with modulated flowering time
  misc_feature: The plant flowers significantly late compared to wild-type.
MAAADVEYRCFVGGLAWATDNASLQQAFASYGDVLDSKVITDRETGRSRGFGFVTFSSEQSMLDAIEAMNGGGYGGGRQGGYGGGGGGYGGGGGYGGGRREGGYGGGGGGGRREGGYGGGGYGSRGDSGGNWKN

SEQ ID NO: 1593 - DNA, 902 bp, Panicum virgatum
  misc_feature: Ceres CLONE 1768782
  misc_feature: Encodes the peptide sequence at SEQ ID NO. 1594
accacgcgtgtcgcattggccttcttcgttgccgacttcccttgtcgaaccgtccagccgtccaggtcctcgcgggcgccgtctcccctagccgctccgcccgccggcgagtggccgtcgccgcagcaaggagaggagagtggcgatgggggacgagcgggtgaaggcggaggcgctgcagatcctgggcctcttccaggtgctcccccgcctcgtcgtctttgaccttgactacaccctgtggcccttctactgcgagtgccggtcgaagagggattcacccagcctcttccggcatgccaggggcatcatgcacgccctcaaggagaaggggatcgacatggcgattgcttctcgctcgcccaccccggacatagccaaggtgttcatcgacaagttggagctccagtccatgttcgtcgcccaagaaatattctccagctggactcacaagaccgagcatttccaaaagatccagaggaaaactgggattccatacaagtccatgctcttctttgatgatgaggacaggaatattcaaacagtatcaaaaatgggagtaacgagtgttctagtggagaacggagtgaacctcgacatgtttaagttgggtctcaataactttgcaactaactttgccgcttccagcagaaagcaagacgagtagcctcaaggaaaaagcaatacattctccaaaaagaaccttcgagatattatacctgagtttcttataatcatcaattgctactattcatgaacattattttgagtaaggatggcctcggaaactagctactgtactgatgcagcaactatctaatgtatgtttgaagcaaagcactgcatgtatttattttatccactcagttgatgtatttgtgcaaaaaaaaaaaaaaaaaaaa

SEQ ID NO: 1594 - protein, 173 aa, Panicum virgatum
  misc_feature: Ceres CLONE 1768782
  misc_feature (1)..(100): Pfam Name: Hydrolase Pfam Description: haloacid dehalogenase-like hydrolase
MGDERVKAEALQILGLFQVLPRLVVFDLDYTLWPFYCECRSKRDSPSLFRHARGIMHALKEKGIDMAIASRSPTPDIAKVFIDKLELQSMFVAQEIFSSWTHKTEHFQKIQRKTGIPYKSMLFFDDEDRNIQTVSKMGVTSVLVENGVNLDMFKLGLNNFATNFAASSRKQDE

SEQ ID NO: 1595 - DNA, 742 bp, Panicum virgatum
  misc_feature: Ceres CLONE 1768855
  misc_feature: Encodes the peptide sequence at SEQ ID NO. 1596
ctgaccgtcttcgcgagcaaactcgagacctggaaaactccctcgatcggagcggagcggagcagaggagaagaggagggaactcgagcacgagatgacgatccggttcgtgctgttcgtgaacaagcagggccagacgcgggtggcgcagtactacgagcacctctccctcgacgagcgccgcgccctcgagggcgagatcgtccgcaagtgcctcgcccgcacagaccagcagtgctcgttcgtggagcaccggaactacaaggtcgtgtacaggcgctacgcctccctcttcttcctcgtcggcgtcgacaacgatgagaatgagttagctatccttgaattcatacatcttttggtggagactatggatcgccactttggcaatgtgtgcgagcttgacatcatgttccacctggagaaggtgcacttcatgctggaagagatggtgatgaatggttgcattgtggagacaagtaaacagaacatcttggcaccgatccagcttatggagaaaacttcttgaagtattcaatctgtctggttttccctcctctggatactacggaataatgaaccaagctgtgaattggtgctgatgcctgacgacataaaacgaatgaactactgggactattttggtgtgatgattactttacaaacatgaggtatagaacatgtagcgagtatcataatatgattctttacattaacttgtctgaataaatggaattgggatgtc

SEQ ID NO: 1596 - protein, 143 aa, Panicum virgatum
  misc_feature: Ceres CLONE 1768855
  misc_feature: Great-hit functional homolog of the protein sequence given in SEQ ID NO 9596
  misc_feature: Useful for making plants with modulated oxidative stress sensitivity
  misc_feature: Useful for making plants with modulated oxidative stress sensitivity
MTIRFVLFVNKQGQTRVAQYYEHLSLDERRALEGEIVRKCLARTDQQCSFVEHRNYKVVYRRYASLFFLVGVDNDENELAILEFIHLLVETMDRHFGNVCELDIMFHLEKVHFMLEEMVMNGCIVETSKQNILAPIQLMEKTS

SEQ ID NO: 1597 - DNA, 996 bp, Panicum virgatum
  misc_feature: Ceres CLONE 1768879
  misc_feature: Encodes the peptide sequence at SEQ ID NO. 1598
gcggcgcgtcgctagagcacgaagagagagagagagagagagagagagagagagcggcgaagggttacccggagatggagttggtggacgccctcaccggcttccgcgtcgacgggcgccgccccaacgagatgcggaagctcaagggcgaggtcggcgtggtcgcgcgggccgacgggtccgcgctgttcgagatgggcaatactagggtcatcgccgccgtctacggccctcgagaggtccagaacaaaggtcaacaagtgaacagcaaagaggctttggttcgttgtgagtataggatggcagaatttagtacaggagatcggaggagaaagccgaaaggtgacaggcgatcaacagaaatttctcttgttattcgacagacaatggaggcaagcatattaacagagttaatgccacgttcacagattgatatatttgtccaagttcttcaagctgatggtggaacaaggtcagcatgcatcaatgctgcaacactagctcttgcagatgctgggattccaatgcgagacattgtcacgtcttgcagtgctgggtatctgtgttccactcctttgctcgatctgaattacgtagaagacagtgctgggggtccagatgtcacagttggtattcttgcaaagatggacaaagtgactcttcttcagatggatgcaaaattaccgatggacacatttgaaaacgtaatgggacttgccatagaagggtgcaaagcaattgcaacacacatccgagaggtgctattggagaacacaaagcggctggagtgtcaacgtggttaattttaaaagttaagaggtgaatcccatctacctagcttgtgtaacgtttgaagtccgggctgatctgtctaacagaaacactgacatttatctgcttactcggcagactaggaagattaatagcctgaacatgttgaagattgctacccataaatggacatctcacattgtgtaaaaaaaaaaaaaaaaaaaa

SEQ ID NO: 1598 - protein, 242 aa, Panicum virgatum
  misc_feature: Ceres CLONE 1768879
  misc_feature (1)..(131): Pfam Name: RNase_PH Pfam Description: 3' exoribonuclease family, domain 1
MELVDALTGFRVDGRRPNEMRKLKGEVGVVARADGSALFEMGNTRVIAAVYGPREVQNKGQQVNSKEALVRCEYRMAEFSTGDRRRKPKGDRRSTEISLVIRQTMEASILTELMPRSQIDIFVQVLQADGGTRSACINAATLALADAGIPMRDIVTSCSAGYLCSTPLLDLNYVEDSAGGPDVTVGILAKMDKVTLLQMDAKLPMDTFENVMGLAIEGCKAIATHIREVLLENTKRLECQRG

SEQ ID NO: 1599 - DNA, 1560 bp, Panicum virgatum
  misc_feature: Ceres CLONE 1768889
  misc_feature: Encodes the peptide sequence at SEQ ID NO. 1600
gaccaaattatccgcacgctccgcctccccactcccccgagctcgctcgcacgcacgccgcggcggagcaccgccgccgccatggcctccacgtccaccttcctctcgctgcgcctccccaccccatcccctgcccacgcagcttcctctccatccctcccgctgcctctgatccggcaggcgcggggcgggacggcgtcctcggctctggtggcgcgggcggcgccaggggctccgtcgccgctcttcaaccccaggggcgaccctttcctgtccaccctcgcggctgcctcaccggaggaccttgcggcctccgctggtggcgagcgccgcggtgaggaccacctgccgttcctcgagatcttccagaacgccaagctcatggccacgcccgcgcaggtggagcgttctagcagttcttacagtcaacacagacctagaaggcctccaccagatttgccttcattgcttcttcatggtcgaattgtttatattggaatgccgttggtgccagcagtgactgagcttgttgttgctcagttgatgtaccttgaatggatgaacagtaaagagcctgtttatatatacatcaactcaacaggaacagctcgtgatgatggtgagccggtcgggatggagagtgaaggttttgcgatctacgatgcaatgatgcgtatgaaagctgagatccacacactttgtataggagctgcagcaggtcatgcttgtcttgtgcttgcagccggaaagaaaggaaaacgctatatgttccctcatgccaaagctatgattcagcagcctcgtattccttcttatgggatgatgcaagcatcagatgttgttattcgagctaaggaggtcgtgcacaacaggaacacgttggtcaaacttttagctaggcatacaggaaatccgccagagaaaatagacaaggtaatgagaggaccgttttacatggactccttgaaggcaaaggagtttggggtcattgacaagatcctttggcgcggtcaggaaaagtacatggctgacatgctctccccagatgaatgggacaaagttgccggagtcaggcgccctgatctaatgtgatattgtacactggaacattagtacttagttaggctcaaagcttgcaaggggaggtaacagctgttgctgaacaataatgcttgattgtcaatggtgacagtcggtaagagccaagggaatcttgtcttactagataagtgtagattggagcatgggccatcaaaatatcgtgtggtgcttggatgagagctagcacgagctttccatgaagttattcttgttcctctcaccagttcttggccagattttggtatttacttgttagtatatatagttcacatattttgatcgacccgaaggttgaactagccaagctcatagtattatcagcacgagatggtggtaatgggatacattatccttgaaatttccatggccacgatgcccttacgatctggacttctgcgaatcatgtgaattgcaatcatcagcacacttcggtttccgcaaaaaaaaaaaaaaaaaaaa

SEQ ID NO: 1600 - protein, 336 aa, Panicum virgatum
  misc_feature: Ceres CLONE 1768889
  misc_feature (1)..(183): Pfam Name: CLP_protease Pfam Description: Clp protease
MASTSTFLSLRLPTPSPAHAASSPSLPLPLIRQARGGTASSALVARAAPGAPSPLFNPRGDPFLSTLAAASPEDLAASAGGERRGEDHLPFLEIFQNAKLMATPAQVERSSSSYSQHRPRRPPPDLPSLLLHGRIVYIGMPLVPAVTELVVAQLMYLEWMNSKEPVYIYINSTGTARDDGEPVGMESEGFAIYDAMMRMKAEIHTLCIGAAAGHACLVLAAGKKGKRYMFPHAKAMIQQPRIPSYGMMQASDVVIRAKEVVHNRNTLVKLLARHTGNPPEKIDKVMRGPFYMDSLKAKEFGVIDKILWRGQEKYMADMLSPDEWDKVAGVRRPDLM

SEQ ID NO: 1601 - DNA, 1842 bp, Panicum virgatum
  misc_feature: Ceres CLONE 1768902
  misc_feature: Encodes the peptide sequence at SEQ ID NO. 1602
gccaggcgccagcccccatgccccacgccgctcggcgctcgctcacggacaccgccaccggccggccaccccggcatctccccctgcagcacgactacaccggccaccacggctcccacgcgctgccaacccgccaccatctatccatctctctctccaatcctctccatctcttcaccggagcaggaggccaggaggcaggagctcgagtctgcaccgccggatcctcctcctccacgcccccagctcccgcagctccggaggccaggaacttgagtctgcgcctccggatccgcctcctccacgcccccccagcttccgctccaagctcccgtagtcctgctggtggcggcggcgggtgggtcttcgagccttcagcggcgacggcgacggccgagtccagtcgacccattttctacataaagggcaatgggagcatccgtgacaactggtatgcagatgctggccatgcgcccatgcatcccagcctgcaaacaagtgcttggttcgacatcagtgctatctgcatttggaagggcacttagtaccagaactgggtttggcagctgttccaaacccacatcagtggggccaatgacttcttcaaattgtaagggggttattgtgagggcaatgtctcagagaggttctcaagggcttcccattgatctcacaggcaaaagagcatttattgctggagttgctgatgataatggttatggttgggcaattgctaaggctcttgctgcagctggtgctgagattcttgttggtacatgggtgcctgcgttgaacatatttgagacaagcttgagacgtggaaagtttgacgaatcacggaagctgcctgatggatcccttatggagatcgctaaagtatatccactggatgcagtttatgacattcctgaggatgttcctgaagatgttaaagccaacaaaagatatgctggtgcttcaaactggactgttaaggaagttgctgaaactgtgaagaatgattttggcagcattgatatccttgtgcattctctcgctaatggtcctgaggtaacaaagccactgttggagacatcaaggagagggtatcttgctgcaatttcagcatctagttattcctttgtttccttacttcaacacttccttcccataatgaatccaggaggtgctagtatctctttgacctacatagcttctgagaggataattcctggctatggtggtggtatgagttcagcaaaagcagcactcgagagtgatacaagagttcttgcgtacgaagcaggtcgaaaaggcaaaatcagagtaaacacaatatcagcaggtccactgggaagccgggctgcgaaagctatcggattcatcgagaagatgatagagtattcctatgtcaatgcaccactgcaaaaggagctattggcagatgaagttgggaacacagcagcattcctcgtgtccccgttggcgtctgcagtcactggctcgactatctatgttgacaatgggctcaacacaatgggacttgcacttgacagccctactttatccacataagaggctctcggctttggaattagctcagagggcggtagattttgcaggaaattgagtttattgtttgcattaatttgatctatcagttgccaccgggaatagaattgtaggatgcagtttccatgtaatgctagtattttgcttttataggcaactgaggtccctttgctgtcttcagcttctgttcgtgtaagtaaatcgtccaaggtctggaccttttgtggtaaatgttttcttttataaagaatcacaaaatgtgttggaacagaaaaaaaaaaaaaaaaaaaa

SEQ ID NO: 1602 - protein, 374 aa, Panicum virgatum
  misc_feature: Ceres CLONE 1768902
  misc_feature (4)..(370): SWISSPROT Homolog: EC 1.3.1.9 Enoyl-[acyl-carrier-protein] reductase [NADH], chloroplast precursor
MGASVTTGMQMLAMRPCIPACKQVLGSTSVLSAFGRALSTRTGFGSCSKPTSVGPMTSSNCKGVIVRAMSQRGSQGLPIDLTGKRAFIAGVADDNGYGWAIAKALAAAGAEILVGTWVPALNIFETSLRRGKFDESRKLPDGSLMEIAKVYPLDAVYDIPEDVPEDVKANKRYAGASNWTVKEVAETVKNDFGSIDILVHSLANGPEVTKPLLETSRRGYLAAISASSYSFVSLLQHFLPIMNPGGASISLTYIASERIIPGYGGGMSSAKAALESDTRVLAYEAGRKGKIRVNTISAGPLGSRAAKAIGFIEKMIEYSYVNAPLQKELLADEVGNTAAFLVSPLASAVTGSTIYVDNGLNTMGLALDSPTLST

SEQ ID NO: 1603 - DNA, 1616 bp, Panicum virgatum
  misc_feature: Ceres CLONE 1768915
  misc_feature: Encodes the peptide sequence at SEQ ID NO. 1604
aaccacagcccaccacggattaaacaaagcgcgcacccaatcaacgcggcggcgcattcgcacctcgcagccatatctaccctcgcttaaaagctcgcgcgagccgtgtctggggaggaggatccactgatccagtcccatccggccgaatcccctcgccgccgccgccctctccttcctctaactaaaaccctagcgtgcgtgcgcggggatgaagatccagtgcaacgcgtgcggggccgcggaggcgcgggtgctgtgctgcgcggacgaggcggcgctctgcggggcctgcgacgaggaggtgcacgccgccaacaagctcgcggggaagcaccagcgggtgccgctgctctcggacgccggcgccgccgcggcggcggcggcgcccgccgtgcccaagtgcgacatctgccaggaggcttctggatacttcttctgcctagaggaccgtgcactactttgtagagattgtgatgttgctatacacacggtaaattcatttgtttcggtgcatcagagattcctgctaactggagttcaggtgggccttgatcctgccgatccagttccgcccattgctgaaaaccgtgttaatgacgctggtggctcggtatatcaaccagcaaaacatctgccaaggagaaacccaacagttcaattttcaggtgaaggcactgcttctgttcccagcaaaaatttaataaatggagactattcaagacagaattctgttccaacagtcaggacgggagtagttgattggacaatgcacaatgctgcaattcaatccgtagaatctccgactaagtacatgtcagaggaaagtccaacacttctgcaatctagccagaccacagcggccttttccaatcaaattaacagcaatagtgatcgggcctacaacttgccgttctcaggtggtaatgggtcagacagcctaccagactggcctgtggatgagttcttcactaactcagaatatggcacaaatttcagcttttcggagcatggtacttctaagagtgacaatgctaagctggggagtgctggggggtctccacaatgccgtttagccgaaggcttcgttgctgaggaactattaggccaggtgcctggattggtaaccgatgaatatatgagccgagtacctgagaattcatgggcagtccctgaggttccctcaccaccaacagcatcggggctcaattggcatgggaatttgcatttcgctgcatatgacagcaccatgttcgttcctgaaatctcctccctccagagctctcaagatcaatttgctgtaccttccagtttcaagcgccagaggcgacagtattgagtgacaacaaagagcactagacaccactgtctattttagacactcttgagaaaggcctcttgctgggccaaacgtcgagaaaggatcagaacttgatgatcattccaacttcaactgaattatctggtagccaggttttaagtgtgttgtccattttccaaatattcgagcttcaacagtgaatcgttgtggtgtttgagtttgtatatatagagaaataaagaggagcaccagtaacatcataattagtggcacagaaaaaaaaaaaaaaaaaaaa

SEQ ID NO: 1604 - protein, 375 aa, Panicum virgatum
  misc_feature: Ceres CLONE 1768915
  misc_feature: Great-hit functional homolog of the protein sequence given in SEQ ID NO 9212
  misc_feature (1)..(48): Pfam Name: zf-B_box Pfam Description: B-box zinc finger
  misc_feature: Useful for making plants with altered Lignin content
MKIQCNACGAAEARVLCCADEAALCGACDEEVHAANKLAGKHQRVPLLSDAGAAAAAAAPAVPKCDICQEASGYFFCLEDRALLCRDCDVAIHTVNSFVSVHQRFLLTGVQVGLDPADPVPPIAENRVNDAGGSVYQPAKHLPRRNPTVQFSGEGTASVPSKNLINGDYSRQNSVPTVRTGVVDWTMHNAAIQSVESPTKYMSEESPTLLQSSQTTAAFSNQINSNSDRAYNLPFSGGNGSDSLPDWPVDEFFTNSEYGTNFSFSEHGTSKSDNAKLGSAGGSPQCRLAEGFVAEELLGQVPGLVTDEYMSRVPENSWAVPEVPSPPTASGLNWHGNLHFAAYDSTMFVPEISSLQSSQDQFAVPSSFKRQRRQY

SEQ ID NO: 1605 - DNA, 1970 bp, Panicum virgatum
  misc_feature: Ceres CLONE 1768922
  misc_feature: Encodes the peptide sequence at SEQ ID NO. 1606
acacctccgtctccccagcaattcccagatcgccgaaacgggagctgctcctccgcggcggcgcccccccccccctgaacgctccccacgccatggccctctcccgccgcctcctcccgctcttcctccgccgcggcgccggcgcccgcgcgcacctctccacggctgccgcggcggcgtccgcctcggagggggaggacgagcagtccgtcaccgtcaagggcgtccgcatctcgggccgcccgctctacatggacatgcaggccacgacccccgtggacccgcgcgtcctcgacgccatgctccccttctacctctcccgctacgggaacccgcactcccgcacccacctctacggctgggagtccgacgccgccgtcgaggccgcgcgcgcccgcgtcgccgccctcgtcggcgccgacccgcgcgagatcttcttcacatccggcgccaccgagtgcaacaacatcgccgttaagggcgtcatgcgcttctaccgcgaccgccgccgccacgtcgtcaccacgcagaccgagcacaagtgcgtcctcgactcctgccgctacctgcagcaggaaggattcgaggtcacctacctccccgtgcgcggcgacggcctggtcgacctcgcgcagctcgaggacgccatccgcccagacaccgggctcgtctccgtcatggccgtcaacaacgagatcggcgtcgtgcagccgctcgaggagattgggcgtatctgcaaggagaaaggcgtgccgttccacactgatgccgcgcaggcgctggggaagatcccgattgatgtgaacaggatggggatcgggctcatgtccctctccgggcacaagatttatggccccaagggcgtgggggcgctctaccttcgcaggcggccgcgtatcagggtggagccgcagatgagcggtggtgggcaggagcgtggcatccgcagtggcacggtacccacaccgctcgtcgttggatttggtgctgcctgtgagattgcggttcaggagatggattatgaccataggcgtgtcagtgccctgcagcaaaggctgctcgatggcatccgagcgcaggttgatgaggttgtcatcaatggaagcatggagcatcgttacccaggcaacctcaacttgtcatttgcatatgtggagggggagagcttgctgatggggctgaaggaggtggctgtatcgagtggtagtgcttgcactagtgccagcttggagccctcatatgtgctgcgggcgctcggggtggaggaggacatggcgcacacctctattcgctttggtattggccgctttaccaccgaggaagaggttgacagagcaattgagctcactgtgcatcaggtgaagaagctccgtgacatgagcccactctacgagatggccaaggctggtattgacctcaagagcattgagtggtcgcagcactgaggtgactttcatgacaatccgtcacttgaaagtgcttttgatgtacacggatcgcttaattaggcttcgtgtctggtactgtgaagacattccattgggtggaatgatttcgatactcaaatagtcagattacaacatgattcacatcatcttatactggaacttcccattgttcggctcttggatgggacgctaagatgtattctggaggattagctatgctttttatggtagagtatcttgacactaaataaagatacttcaaatactcgataatgtatcatctggaataaaagtttaaagtagctagcagtggcagtgctgtgaatatctcttggtgctgattaaataaattgatgttactagcatagtgctcgtgcggtgctacaggcaataatagacctatgtaataccatcaactttgtatttattcaccgtgattgtgcgagacattgacagttcacgttccaattgcatttcaaattgatttattcaggttccgatcaaaaaaaaaaaaaaaaaaaa

SEQ ID NO: 1606 - protein, 450 aa, Panicum virgatum
  misc_feature: Ceres CLONE 1768922
  misc_feature (1)..(363): Pfam Name: Aminotran_5 Pfam Description: Aminotransferase class-V
  misc_feature (1)..(362): Pfam Name: Aminotran_5 Pfam Description: Aminotransferase class-V
  misc_feature (21)..(450): SWISSPROT Homolog: EC 2.8.1.7 Cysteine desulfurase 1, mitochondrial precursor
  misc_feature (50)..(450): SWISSPROT Homolog: EC 2.8.1.7 Cysteine desulfurase, mitochondrial precursor
MALSRRLLPLFLRRGAGARAHLSTAAAAASASEGEDEQSVTVKGVRISGRPLYMDMQATTPVDPRVLDAMLPFYLSRYGNPHSRTHLYGWESDAAVEAARARVAALVGADPREIFFTSGATECNNIAVKGVMRFYRDRRRHVVTTQTEHKCVLDSCRYLQQEGFEVTYLPVRGDGLVDLAQLEDAIRPDTGLVSVMAVNNEIGVVQPLEEIGRICKEKGVPFHTDAAQALGKIPIDVNRMGIGLMSLSGHKIYGPKGVGALYLRRRPRIRVEPQMSGGGQERGIRSGTVPTPLVVGFGAACEIAVQEMDYDHRRVSALQQRLLDGIRAQVDEVVINGSMEHRYPGNLNLSFAYVEGESLLMGLKEVAVSSGSACTSASLEPSYVLRALGVEEDMAHTSIRFGIGRFTTEEEVDRAIELTVHQVKKLRDMSPLYEMAKAGIDLKSIEWSQH

SEQ ID NO: 1607 - DNA, 1603 bp, Panicum virgatum
  misc_feature: Ceres CLONE 1768936
  misc_feature: Encodes the peptide sequence at SEQ ID NO. 1608
atcccatctctcagccggcctgccgccgccctccccaacgagcagtgttcggcaactcggcgtcgcgtcgcgggcggcggccacggcggagctcctcttccctgctgatccccgacctgcagcagctgccccgcacgacccctcgcccgttgccggccatggcgtccggcgcccggggcccggagcccccgcggccccctcgcgcgcccacccacctcgcgccgctgctgctgctgcccgcgctcctcctcgcctcctcctccccctcccccgccgccgccgccgcgatgcacaacaacaactgggccgtgctcgtatgcacctcccggttctggtttaattatcgacatatggcgaatactctgtctttgtacaggactgttaagagattaggaatacctgatgagcgaatcatacttatgttggcggatgatatggcttgcaatcctaggaacagttatcctgcccaagttttcaacaatgagaaccaccagctaaatctttatggtgacaatgttgaggttgattatcgagggtacgaggtcacagtggaaaactttttgagagttttgactggcagacatgaaagtgcggtaccaagatcaaagcgtctcctaagtgatgaaggaagccatattcttctgtacatgactgggcatggaggtgatgagtttttgaagttccaagattctgaagagcttcagagccatgacttagcagatgcagtgaagcagatgaaggagaaacatagatttaaagagctgctgataatggtagatacttgccaagctgctactctcttttcacagcttcattcacctggtgttttggcgatcggtagcagcatgaagggtgaaaactcttattctcaccatcttgattcagatattggtgtttctgttgttgataggtttacctattatacacttgctttctttgagaaactgaacatgtatagcaatgcctcattgaacagtcttttcaattcatatgatcgttccatgctgatgtctactgcatattatcgaatggatctttatgagcggcccttaaatgaggtgcctgtgacaaatttctttggatcagtcatgaagactctccatacagattcagcctacacaggtttcttgtctgcacatgacgatgaaactcccatgtccatcagagataaccaacatgatcatttcatgtcaaagaatgaggctagagcaagaagatcaaacaaagaaaaggaggcacaaataataccccatggatggacagaagttctgcttgaacagctggagggcaagaatactgacactgttgtgctgtatggtctgggagcaatgggtatattgttggcactttcaacctggttatcaatgtaggcactatgaagagtattgttcacacgccattctcttccacagagcactgaatcatactaaccccctagagacagggatcaaaatagaaaagaacaaactttggaggttctttttttattttatctcctttttaaattttgttactgtctataagaattggttcaaaattgatgtatgtagttcttgtatgcaccttctgttcttatatgttttaaaaaaaaaaaaaaaaaaaa

SEQ ID NO: 1608 - protein, 403 aa, Panicum virgatum
  misc_feature: Ceres CLONE 1768936
  misc_feature: Great-hit functional homolog of the protein sequence encoded by LOCUS At1g08750
  misc_feature (3)..(160): Pfam Name: Peptidase_C13 Pfam Description: Peptidase C13 family
  misc_feature: Useful for making plants with altered cell wall content and/or composition
MASGARGPEPPRPPRAPTHLAPLLLLPALLLASSSPSPAAAAAMHNNNWAVLVCTSRFWFNYRHMANTLSLYRTVKRLGIPDERIILMLADDMACNPRNSYPAQVFNNENHQLNLYGDNVEVDYRGYEVTVENFLRVLTGRHESAVPRSKRLLSDEGSHILLYMTGHGGDEFLKFQDSEELQSHDLADAVKQMKEKHRFKELLIMVDTCQAATLFSQLHSPGVLAIGSSMKGENSYSHHLDSDIGVSVVDRFTYYTLAFFEKLNMYSNASLNSLFNSYDRSMLMSTAYYRMDLYERPLNEVPVTNFFGSVMKTLHTDSAYTGFLSAHDDETPMSIRDNQHDHFMSKNEARARRSNKEKEAQIIPHGWTEVLLEQLEGKNTDTVVLYGLGAMGILLALSTWLSM

SEQ ID NO: 1609 - DNA, 1898 bp, Panicum virgatum
  misc_feature: Ceres CLONE 1768945
  misc_feature: Encodes the peptide sequence at SEQ ID NO. 1610
cccgtcccgtcccgtccccgtcactggaggaggagaaaatccgggcccacccgcgcgccgctgctgctccgcccaccgccatggcgacccgctcccccgcggcctggatctcgctgctgctcgcgctcgcgctcgcgctgtcggcgcgcgcggaggaggcgcccgcggcggcggcggcggagggggaggccgtgctcaccctcgacgtcgacaccttcgacgaggccgtcgccaagcaccccttcatcgtcgtcgagttctacgccccctggtgtggacactgcaaggcgctcgctccagagtatgagaaggcggcacagtcgctcagcaagcacgacccaccgattgttctcgctaaggttgatgccaacgaggacaagaacaggccgcttgctaccaagtacgaggtccaagggttcccgaccctcaagatcttcaggaaccagggcaagaacattcaagagtacaagggaccaagggaggccgagggcatcgttgagtacctgaagaagcaagtcggccctgcctccaaggaaatcaagtccccggaagatgcggcatcccttatcgatgacaaaaagatctacatcgttggtgtcttcacagaattcagtggcactgagtttacaaatttcatggaggttgctgagaagctgaggtctgactacgactttggccacactatgcacgccaaccacctcccacgtggtgatgctgcggtggagaggccattggttaggctgttgaagccatttgatgagcttgttgttgacagcaaggattttgatattactgctctggagaagtttattgatgctagcagcaccccccgagttgttacttttgacaagaaccctgacaaccacccataccttttgaagttcttccaaagctcagcccccaaggctatgctatttgtgaacttctccactggaccttttgactccttcaagtctacttatgctgctgccgcagaggagttcaaggacaaggaactcaagttcctcattggtgacattgaagctgcccagggtgccttccagtactttggtctgaaagaggagcaagcaccccttatcctcatccaggatggtgactccaagaagttcttgaaggatcacattgaggcggaccaggttgtctcttggttgaaggaatactttgatggcaagttgtcaccgttcaagaagtctgagcctattcctgaggtcaacaacgagcctgttaaggtggttgtggctgacagcctccacgatgtggtgttcaagtctggcaaaaatgttcttatcgagttctatgccccctggtgtggacactgcaagaagttggcccctatcttggaggaggcagccaccacacttaaaagtgatgaggaagtcgtggttgccaagatggatgccaccgcaaatgacgtgcccagtgagttcgacgtccagggctacccaaccatgtactttgtgacccccagcgggaagatcacctcctacgacgctggcaggacggctgatgagatcattgacttcatcaagaagaacaaggagacgtccggcgcgacgcccgtgtccgagaaggcagcggaggcagccccagcctccgagcccgtgaaggacgagctgtaaaacccaaggctctggacgcttgcggctgtgagcatgggagaggagagggaaaacctggcgccgcgaacatgtttgacagctcaaatgccagattttgcgagggggagagagagcaaagagagagagagagaggggatccgtcccatggaggatgattctgtacaatcacagtaccttttagttgattctgagaagtgacagtagaaaaatacatggaattctgatcaggctgaatgaataaatggcggttccaccttgcaaaaaaaaaaaaaaaaaaaa

SEQ ID NO: 1610 - protein, 512 aa, Panicum virgatum
  misc_feature: Ceres CLONE 1768945
  misc_feature (1)..(512): SWISSPROT Homolog: EC 5.3.4.1 Protein disulfide-isomerase precursor
  misc_feature (9)..(512): SWISSPROT Homolog: EC 5.3.4.1 Protein disulfide-isomerase precursor
MATRSPAAWISLLLALALALSARAEEAPAAAAAEGEAVLTLDVDTFDEAVAKHPFIVVEFYAPWCGHCKALAPEYEKAAQSLSKHDPPIVLAKVDANEDKNRPLATKYEVQGFPTLKIFRNQGKNIQEYKGPREAEGIVEYLKKQVGPASKEIKSPEDAASLIDDKKIYIVGVFTEFSGTEFTNFMEVAEKLRSDYDFGHTMHANHLPRGDAAVERPLVRLLKPFDELVVDSKDFDITALEKFIDASSTPRVVTFDKNPDNHPYLLKFFQSSAPKAMLFVNFSTGPFDSFKSTYAAAAEEFKDKELKFLIGDIEAAQGAFQYFGLKEEQAPLILIQDGDSKKFLKDHIEADQVVSWLKEYFDGKLSPFKKSEPIPEVNNEPVKVVVADSLHDVVFKSGKNVLIEFYAPWCGHCKKLAPILEEAATTLKSDEEVVVAKMDATANDVPSEFDVQGYPTMYFVTPSGKITSYDAGRTADEIIDFIKKNKETSGATPVSEKAAEAAPASEPVKDEL

SEQ ID NO: 1611 - DNA, 2433 bp, Panicum virgatum
  misc_feature: Ceres CLONE 1768954
  misc_feature: Encodes the peptide sequence at SEQ ID NO. 1612
ggaggcgacggaccacggaccagagagagctcaccgccgtcgcgagataaaccacccgtggctccacggattccgagctgccgctgcccgtcgggaggaagatgacggtgggcgccgggatcgcggtccaggacgggagcctggtggcgctgggggccaagatcctgcgggaggtgcgcggcaatgtgcacgtcacgccggccgccgggggcggcctcaccaacggcgccttcctcggcgtgcggtccgcgcccgccggcagccgcagcgtcttccccgttgggaagctccgggacctacggttcatgtgcactttccggttcaagatgtggtggatgacgcagaggatgggctcgtcaggccgtgacatccccttcgagacacagttcttgatcgtcgagggcactgatggaccgcagttcaccagcgatagcaccgagcgacctgtggtgtacactgtcttccttccgatattggaggggtcattccgtgctgttcttcaggggaacgctgatgatgagctggagatttgcttggagagtggtgatccagatgtggaatcctttgaaggcacccatcttgttttcgtcggtgctggatcggatccatttgaagtgatcacaaattcagtaaaagctgttgagaggcacttgcagacgttttctcacagggaaaagaaaaagatgccagacattctaaactggtttggttggtgcacgtgggatgcattttacacaaacgttactgctgaaggagtgaaggagggattacagagctttcaaaaaggtggagtttctcctaagtttgtcataattgacgatggatggcaatcggtcggtatggatcccgtgggaattgcgtgcttagctgataactcagccaactttgcaaacaggttgactcacattaaggagaaccacaagtttcagaaaaatgggagggagggtcacagggaagatgatccagcaaaaggccttgcacatatcgtcagtgaaattaaaggaaagcatgagctgaagtatgtgtatgtgtggcacgcgattaccggatactggggtggagtcaggccaggtgttgttggaatggagcaatatgaatcgaagatgcagcaccctgtgtcatcaccaggagttcagaaaaacgaaccctgtgatgctttgaacagtataacaactaatggactgggccttgtgaaccctgaaaaagtattcagtttctacaatgagctccattcttatcttgcatctgctgggatcgatggagttaaggtggacgtgcagaacatccttgagacactaggtgctggccatgggggaagggtactgctggctagaaagtatcaacaggctttggaagcttccatcgctaggaacttccctgacaatggcatcatatcatgcatgagccacaacacagacaacttatatagttcaaaaaggagcgcagttgtgagagcctctgatgatttctggccgagagacctggcttcccatactatacacattgcatctgttgcctataacactgtctttctcggagaattcatgcagcctgattgggacatgttccatagtgttcaccctatggctgaataccacgctgcagcccgagcagttggcggttgtgccatatacgtcagtgacaagcctggaagccatgacttcaatttgctgaagaaacttgtgcttcctgacggatcgatcctgcgtgccaaactccctgggagaccaaccagagactgcctgttctccgatcctgccagggacggcaaaagcatcctcaagatctggaacctgaacgatcactccggtgtcattggcgccttcaactgccaaggtgccggctggtgccgggtagggaagaagaaccttgtccatgatgagcagcccggaacggtcaccggtgtcatccgggcacgggatgtggactaccttgcaaaggttgctgatcaaagctggaacggcgacgtgatcgtgtattcgcacgtcggaggagaggtggtctacctgccgaagaacgcctccttgcccgtgacgctgagatcacgcgagtacgaggtgttcaccgtcgtcccagtgaaatgcctgccgagtggcgcctcctttgcgccgatcggcctgaccggaatgttcaactccggcggcgcggtgagggagctgagattcggcgaggacgcaggcgtccagctcaaagtgcggggctcgggcactgtggcggcatactcctcagcaaagccgaagagtgtagccgtcgattccacggtggttgatttctcctacgacgaggcctgtggtttggtcacctttgagcttggccttcccaagcaagaactgtacctgtggaccgtttcggtagagtactgagatcgatgtaatgagaaaagttttttttaaagatgtaatgagaaaagttcagatatggcttcctgagagc

SEQ ID NO: 1612 - protein, 753 aa, Panicum virgatum
  misc_feature: Ceres CLONE 1768954
  misc_feature (1)..(692): Pfam Name: Raffinose_syn Pfam Description: Raffinose synthase or seed imbibition protein Sip1
MTVGAGIAVQDGSLVALGAKILREVRGNVHVTPAAGGGLTNGAFLGVRSAPAGSRSVFPVGKLRDLRFMCTFRFKMWWMTQRMGSSGRDIPFETQFLIVEGTDGPQFTSDSTERPVVYTVFLPILEGSFRAVLQGNADDELEICLESGDPDVESFEGTHLVFVGAGSDPFEVITNSVKAVERHLQTFSHREKKKMPDILNWFGWCTWDAFYTNVTAEGVKEGLQSFQKGGVSPKFVIIDDGWQSVGMDPVGIACLADNSANFANRLTHIKENHKFQKNGREGHREDDPAKGLAHIVSEIKGKHELKYVYVWHAITGYWGGVRPGVVGMEQYESKMQHPVSSPGVQKNEPCDALNSITTNGLGLVNPEKVFSFYNELHSYLASAGIDGVKVDVQNILETLGAGHGGRVLLARKYQQALEASIARNFPDNGIISCMSHNTDNLYSSKRSAVVRASDDFWPRDLASHTIHIASVAYNTVFLGEFMQPDWDMFHSVHPMAEYHAAARAVGGCAIYVSDKPGSHDFNLLKKLVLPDGSILRAKLPGRPTRDCLFSDPARDGKSILKIWNLNDHSGVIGAFNCQGAGWCRVGKKNLVHDEQPGTVTGVIRARDVDYLAKVADQSWNGDVIVYSHVGGEVVYLPKNASLPVTLRSREYEVFTVVPVKCLPSGASFAPIGLTGMFNSGGAVRELRFGEDAGVQLKVRGSGTVAAYSSAKPKSVAVDSTVVDFSYDEACGLVTFELGLPKQELYLWTVSVEY

SEQ ID NO: 1613 - DNA, 1597 bp, Panicum virgatum
  misc_feature: Ceres CLONE 1768958
  misc_feature: Encodes the peptide sequence at SEQ ID NO. 1614
ggccaggaagaagtagcgacttgcattgggccatccaaaactagctagtggctgctgcacacagcgcacacacctgagctagctgctagccatttgtgtgcgactgtgcgtagcacatcggcacttgaaagttgttcgttgcaaacatgaccatgtcacggctcatcctcgccgccgttgtcgtcgtggccagcgcgtgcgccaccgctccccgcgcgctcgcggcgcgcgagctcgccgccggggaggatgacgccgccgcgatggcgctgcggcacgaggagtggatggcggagcacgggcgcgcgtacaaggacgaggcggagaaggcgcggcggctggagatattccgggccaacgcgaggctgatcgactcgttcaacgccgccgcgggggagcgcggtcaccggctggccacgaacaggttcaccgacctcaccgacgaggagttccgcgccgccaggaccgggtaccggcggccggcgccggcggccgggagccgcgccggccggttcaggtacgagaacgtcagcctggcggacgcgccggcgagcgtggactggcgggcgatgggcgccgtcaccggcgtcaaggaccaaggagattgtggctgttgctgggcgttctcggcggtggcggcggtggaagggctgaacaagatccggacggggcggctggtgtcgctgtcggagcaggagctggtggactgcgacgtctacggcgaggaccagggctgcgagggcggcctcatggacgacgccttccagttcatcgcgcgccgcggcggcctggcctcggagtcggggtacccgtacgacggcgaggacgggtcgtgccgctcgtccggcgccgccgcggcgcgggccgcgtccatccggggccacgaggacgtgccgcgcaacaacgaggcggcgctcgcggcggccgtggcgcaccagccggtgtccgtggccatcaacggcgcggaccccgcgttccggttctacgccggcggcgtgctgggcggcggcgactgcgacaccgagctgaaccacgccgtcacggccgtcggctacggcacggccggcgacggcacccggtactgggtgatgaagaactcgtggggcgcgtcgtggggcgagggcggctacgtccgcatccgccgcggcgtccgcggcgagggcgtctgcggcctcgccaagctgccgtcctaccccgtctagcttgcgcgccgccgtgacgggtggtgctgctctgtcggatctaagcgatgcacggctggtggcgtccgttggttcgggtgctcgtagcacgaaggccgcgcacgaaacgtcagacgtgcatggcagtttcgactagtttgctagtcttaagttaatgtcgtcctaattaagacgtgcgtgcgtgcgtgtctctaagctacagtatggcatgatgtgtgtagatcacgactcagcactgcaattgtgcaaagccattactcctgcagcagtaggaatggtcggggttgtaccttacctgggggcgacacgcgtactgtactgtgcagattggctctcagaccagttaaatgtatacaggaaatcaggaatacatgtaaaaaaaaaaaaaaaaaaaa

SEQ ID NO: 1614 - protein, 351 aa, Panicum virgatum
  misc_feature: Ceres CLONE 1768958
  misc_feature (1)..(215): Pfam Name: Peptidase_C1 Pfam Description: Papain family cysteine protease
MTMSRLILAAVVVVASACATAPRALAARELAAGEDDAAAMALRHEEWMAEHGRAYKDEAEKARRLEIFRANARLIDSFNAAAGERGHRLATNRFTDLTDEEFRAARTGYRRPAPAAGSRAGRFRYENVSLADAPASVDWRAMGAVTGVKDQGDCGCCWAFSAVAAVEGLNKIRTGRLVSLSEQELVDCDVYGEDQGCEGGLMDDAFQFIARRGGLASESGYPYDGEDGSCRSSGAAAARAASIRGHEDVPRNNEAALAAAVAHQPVSVAINGADPAFRFYAGGVLGGGDCDTELNHAVTAVGYGTAGDGTRYWVMKNSWGASWGEGGYVRIRRGVRGEGVCGLAKLPSYPV

SEQ ID NO: 1615 - DNA, 1037 bp, Panicum virgatum
  misc_feature: Ceres CLONE 1768963
  misc_feature: Encodes the peptide sequence at SEQ ID NO. 1616
cacacaactcccccacctggtgaacgacacggcggcacgaacgcgtcggcgtcgtcctcgtcgtgcacttgctccgacgatggctcagcgccggcagcgcggcttcccgccggtcaccatgccgtgcctggccctcgcggtgacggctctgatgtgcgccgcttccaccaccacggcgcagccgcaggcaccgccgctgccgctgccactaccgcagcagccggcgacgacgacggcgcccgcggtgccgagcctgccggcagcgtgcccgccggcgcaggccagcctgtcgccgtgcctgggcttcttcatcggcaactcctcgtcgccgccggccgagtgctgcgcccagatccgggccatgttccagtcgcaggcgccgtgcctgtgcgccgccatggcgtcgggggcctcgcagctcgggtccgcgatcggccagctgctgcccagctcgtgcgacctgcccgccaacgcctgctcggggtcggggaccgtgagcggtgccccggctggtccaacgacgacgccgacgtcgtcagggtcaggaacaaccgccgcggcggcgccggggactgggccgacgggtgcagacacgaccgcgccagccggtggtggtggagtgaagtcagttccaggcgtgcttggctcgggagctgctgctgccgcaccagcaggctaccgcggcgtctctgccgccgctgctctggtctcgttgctcgtcgcctatcttctctgaactctgatcggatcatgtgcttagtcgtgtacattcagatgtggattcgtagcacgccgttcatgtagcatgttcactaaaaaacatgtactacctcccgaaccgcgcgcagtcgtgtaccgcaccgtgcgcaggagttgaatgaacatttgttacgtttgtaagcgaatggtagcaacacgattgctgtacctcccgaacagagttaccaccgacctcatcgttcgtgtatattgctcctacagattaagcgtcaatttaatgaatttcactgaaacgtgaaaaaaaaaaaaaaaaaaaa

SEQ ID NO: 1616 - protein, 218 aa, Panicum virgatum
  misc_feature: Ceres CLONE 1768963
  misc_feature (1)..(74): Pfam Name: Tryp_alpha_amyl Pfam Description: Protease inhibitor/seed storage/LTP family
MAQRRQRGFPPVTMPCLALAVTALMCAASTTTAQPQAPPLPLPLPQQPATTTAPAVPSLPAACPPAQASLSPCLGFFIGNSSSPPAECCAQIRAMFQSQAPCLCAAMASGASQLGSAIGQLLPSSCDLPANACSGSGTVSGAPAGPTTTPTSSGSGTTAAAAPGTGPTGADTTAPAGGGGVKSVPGVLGSGAAAAAPAGYRGVSAAAALVSLLVAYLL

SEQ ID NO: 1617 - DNA, 1289 bp, Panicum virgatum
  misc_feature: Ceres CLONE 1768964
  misc_feature: Encodes the peptide sequence at SEQ ID NO. 1618
acctatgaaaaaaaacccaaaaaaaaaaatcgaaacggaagtgcgaggaaggcgcccgtcgctccaatggctgcgggcctccgcctcctcccgcgccttctcgccttctccgcctcctctcgcccgctcttcgccacgcactctggagccctgcccctgcccgtgcgccgcgccggcccgtccatgcccctcgccgcccgcgcgcgccgcggcataggctcctccaccggcgccgcccctcccgccgaggacgaggacttcgccacggctgccgacctccggttcgagccgccgctcgaggtcgtcaagtaccccgaccccatcctgcgcgcgcgcaacaagcgcatcaacaccttcgacgccaacctccgcgccctggccgacgagatgttcgacgttatgtacaagactgatggcattggtctctcagcaccacaagtcggagtgaatgtgcagcttatggtgttcaatccagctggggtgaagggggaaggagaggagattgtccttgtcaacccagtggtatacaagtctgggaaacgattgcttgtgttcgaagaagggtgcttatcatttcctggaatatatgccaatgtggtgagaccagaaagtgtgaaaattgaagctcaagacgttacaggagcaaaaatcaaagtaaaattatctggcctacctgcaagagttttccagcacgagtttgatcatttgctgggcattcttttctttaacagaatgacaatggatgttcttgagactgtacgggaggaactgaagaatctagagaagaaatacgaggaaagaacaggactgactagtcctgaaactgttgagagctacaagggtacaaaggatgtcttcagtttttcaagatgaaggttgaagggttgtagcagactacggaaattttggaaatacatcatcaagctgagctttagcctgaagagttttttggacagctcacacactcgcacgcattcgcgcgtgcgcgcacacacacacactactttagttgcagtgctggcaatcttgctatgtctaattttctgcgatatcaattaaactagagacaccaagttcactagttacaaatgaggtttaattttcaatgcttatgtctgtattactgttttgtctgtgtatttatgactcttggataaggagatattgtagaactggttttcccagaaattatttatgtaatgatcattttttttgtttcttcaatttcttattaataaacataccatagagacataattttttttaaacaaaaaaaaaaaaaaaaaaaa

SEQ ID NO: 1618 - protein, 268 aa, Panicum virgatum
  misc_feature: Ceres CLONE 1768964
  misc_feature (1)..(154): Pfam Name: Pep_deformylase Pfam Description: Polypeptide deformylase
  misc_feature (38)..(268): SWISSPROT Homolog: EC 3.5.1.88 Peptide deformylase, chloroplast precursor
MAAGLRLLPRLLAFSASSRPLFATHSGALPLPVRRAGPSMPLAARARRGIGSSTGAAPPAEDEDFATAADLRFEPPLEVVKYPDPILRARNKRINTFDANLRALADEMFDVMYKTDGIGLSAPQVGVNVQLMVFNPAGVKGEGEEIVLVNPVVYKSGKRLLVFEEGCLSFPGIYANVVRPESVKIEAQDVTGAKIKVKLSGLPARVFQHEFDHLLGILFFNRMTMDVLETVREELKNLEKKYEERTGLTSPETVESYKGTKDVFSFSR

SEQ ID NO: 1619 - DNA, 1792 bp, Panicum virgatum
  misc_feature: Ceres CLONE 1768967
  misc_feature: Encodes the peptide sequence at SEQ ID NO. 1620
ctcgctagctccgtccaccggacaacccacacctcctctctagccgcctcttctcctccgcccagttccgtcggctcctggctgcaggagcagcaatggcggcttcctggagggccctggcgctggcgatggcagccgtgggctgggttcttggcggtggtttcgtgtgggggttcccggcggaggatttggtgaccaggctgcccgggcagccgccggtgacgttcaggcagttcgccgggtacgtggacgtcgacgtcaaggccggcaggagcctcttctactacttcaccgaggcgcaggaggacgccgccgccaagccgctgacgctgtggctcaatggaggtcccggctgttcttcaattggaggtggcgctttcacggagctgggtccattttatccgaggggagatggcaggggtctcagattaaacaagaagtcatggaacagagcgtccaatcttctgtttgtcgaatcaccagctggagttggatggtcttactcaaatacttcatcagactacaacaccggcgatctgcgcactgctgatgacatgtacaaatttttgcttggatggtacgagaaattcccagagtacagatcgagagccctgtttcttactggagagagctatgcagggcattacataccacaacttaccgatgtactccttacccataatgagaaatcaaagggtttcaggttcaatatcaagggtgttgctattgggaatccacttcttaagcttgatagggatgtccctgcaacctatgaatatttctggtctcatggcatgatctctgatgaaatatttctagcgatcagccacagttgtgattttgaggattacaccttcaataacccccataatgagagcaagtcatgtaatgatgccatatctgaagcaaacactatagttggggagtacgtcaataactatgatgttattctcgatgtctgctacccatcaattgtgatgcaggagctacgtctgcgaaaatatgcaacaaaaatcagcttgggtgtggatgtttgcatgacctatgagaggtttttctatttcaatcttccagaagtgcagcaggctctgcatgctaacaggacacatttgaagtatcactggagcatgtgcagtgatgtcctgaattacagcaatacggatggcaacatcaatatcttgcctatacttcaaagaattgtggagcacaaaataccactctgggtgttcagtggtgatcaagactctgttgtgcccttgttgggcagcagaacccttgtgcgagagctagctcacaccatggggctgcctgttacagtcccctacagtacttggttccgcaaaggccaggttggtggctgggtgatggagtatggcaaatttttgacttttgcaacagtgaggggtgcatctcacatggtgccattcgcacagccagaccgggcgcttgggctatttcgatccattgtacttggaaaaagactaccaaacacaacaaatccacccattgactaagtgtacctacgaaagaagctgaagatagaaacaagtagcttaggttttttccggtttacttctgtagattagtccataaagatgtggggtgctcaataagttctttattctttataaggagcagaaaaataacacttcctgtattatgtttatcgccttacatagattgtcagattgcaatcctgaagtctggaacagagtaattgtaagacattgtgcaatttgacactgcaagtacaccaaaattgttcagggtttaaaaaaaaaaaaaaaaaaaa

SEQ ID NO: 1620 - protein, 472 aa, Panicum virgatum
  misc_feature: Ceres CLONE 1768967
  misc_feature (1)..(424): Pfam Name: Peptidase_S10 Pfam Description: Serine carboxypeptidase
MAASWRALALAMAAVGWVLGGGFVWGFPAEDLVTRLPGQPPVTFRQFAGYVDVDVKAGRSLFYYFTEAQEDAAAKPLTLWLNGGPGCSSIGGGAFTELGPFYPRGDGRGLRLNKKSWNRASNLLFVESPAGVGWSYSNTSSDYNTGDLRTADDMYKFLLGWYEKFPEYRSRALFLTGESYAGHYIPQLTDVLLTHNEKSKGFRFNIKGVAIGNPLLKLDRDVPATYEYFWSHGMISDEIFLAISHSCDFEDYTFNNPHNESKSCNDAISEANTIVGEYVNNYDVILDVCYPSIVMQELRLRKYATKISLGVDVCMTYERFFYFNLPEVQQALHANRTHLKYHWSMCSDVLNYSNTDGNINILPILQRIVEHKIPLWVFSGDQDSVVPLLGSRTLVRELAHTMGLPVTVPYSTWFRKGQVGGWVMEYGKFLTFATVRGASHMVPFAQPDRALGLFRSIVLGKRLPNTTNPPID

SEQ ID NO: 1621 - DNA, 1924 bp, Panicum virgatum
  misc_feature: Ceres CLONE 1768976
  misc_feature: Encodes the peptide sequence at SEQ ID NO. 1622
cctttcgctcctctcgccgctttgggttggggtttaagcgagtgtgcgggaggccggaggcgacgacgacggcgccggcgtcggagaagaagaagcagccagctctcgtgtatatgtcttcttgccccttctccgatctggtggtcgttgtgctcatcgtcgccgtcgtcgccgtcctcctccgcgccctcgcctgctccagccgatctatgcgccaggggctcaacggctggaacaaatcctcgtcgatgctcaggtccgcgcgccgctctctcccgctttttttacccccgcggaaatctcttctttttcaccgatctgggaggttttgaccgggtttatggccctggttcctccagatctggggagttcttgcctgggttttcatggggggttttgacggatttctctcttgtgatgctgcagggacgggttcggggtgaagtattctggattcctccacataaggccgtgtggcttctgtcgaggagactgacggattcggtcgattcgcgcccggctccgtccaatttttgcacccgccggagaaattttcatcttttctagagtttttttccccttcagttttagcaattttggtgtcaagtttgggagtcctctccggcacaagagatagaagagagatggctccgttgaaccaccagcagattctcatcaggaaggccctgacgaagaagcccaagagcaagaggatctccgggtttggccttaaaccctccgctgctctcctcaaggccaggccgcagcagcagcagccggcgccggtccagcagaggcgccgcgtccgcgtcctctttgaggaccctgacgcgacggactcggactccgacgacgaggaggaggccggcactgccaggtccaagcgcttctcttttgagatgttcgtcggcaaggcccctgcaaagcctgttctgccggcggccactgtggccgcgaccaccagcggcgggacgccggagagctaccgtggcgtgaggctccgcaagtggggcaagtgggcggctgagatccgcaaccccttcaccggcaagaggcagtggcttggcaccttcgacaccgccggcgcggcctctgccgcctacctgtctgcctccaggagctttgccgaggagaagcgccgccgccgcgggcaacctgtgcccgcttcctcaccggctacctcgccgagcaccaccccgacagcgtcctcttcgtcgtccacatcggctgctccgctcgcccacccgtcgccgtcctccgtgctcgagggcgcgaagcctgcaccgaacccggagtctcccgagccggctacaactcccgccctgccgtccaccgagtctgcgcagctgccggacgaccccgagttctaccaggaccttctgcgcgggctgcagctccccgacatcgaccccatggacttccgcgccggcctggacgccttggatgtctccgactcgccgttctgcttggaggacgagcaggacctgctgtttggggacttcgcggacgaggagatggacgacctcgacctcctcgacgacatcaacgacgtcttcccggagctgcccggctgcgacctcggccggggcatggacgacttcctccaaaccgtggatttctgcgtgtgaattatgaagtgccttagcgttactttgttggtgtgataattgggcctgcgagtgttcttgggacggagatttctttgggttttttccccgggcaacaccatctgcccgcgcccatggaaattctccggctccaagctttttgccttttgtgaggtaattttggtaggttatgctaagttatagtagtggttaagccttgttttttccaatgttatttgataatgcttgtcaagacattatagtggacaagtcattgagtgttactcctaagctatggaaggaaaataagcttttgc

SEQ ID NO: 1622 - protein, 327 aa, Panicum virgatum
  misc_feature: Ceres CLONE 1768976
  misc_feature (4)..(43): Pfam Name: AP2 Pfam Description: AP2 domain
  misc_feature: The sequence is a functional homolog of  SEQ ID NO 1191 in the  10/374,780 US patent application
  misc_feature: The sequence is a functional homolog of  SEQ ID NO 1262 in the  11/479,226 US patent application
  misc_feature: The sequence is a functional homolog of  SEQ ID NO 1383 in the  10/412,699 US patent application
  misc_feature: The sequence is a functional homolog of  SEQ ID NO 144 in the  10/225,066 US patent application
  misc_feature: The sequence is a functional homolog of  SEQ ID NO 172 in the  10/374,780 US patent application
  misc_feature: The sequence is a functional homolog of  SEQ ID NO 224 in the  10/225,068 US patent application
  misc_feature: The sequence is a functional homolog of  SEQ ID NO 582 in the  10/412,699 US patent application
  misc_feature: Useful for making plants with modulated growth and phenotype characteristics
MAPLNHQQILIRKALTKKPKSKRISGFGLKPSAALLKARPQQQQPAPVQQRRRVRVLFEDPDATDSDSDDEEEAGTARSKRFSFEMFVGKAPAKPVLPAATVAATTSGGTPESYRGVRLRKWGKWAAEIRNPFTGKRQWLGTFDTAGAASAAYLSASRSFAEEKRRRRGQPVPASSPATSPSTTPTASSSSSTSAAPLAHPSPSSVLEGAKPAPNPESPEPATTPALPSTESAQLPDDPEFYQDLLRGLQLPDIDPMDFRAGLDALDVSDSPFCLEDEQDLLFGDFADEEMDDLDLLDDINDVFPELPGCDLGRGMDDFLQTVDFCV

SEQ ID NO: 1623 - DNA, 1760 bp, Panicum virgatum
  misc_feature: Ceres CLONE 1768985
  misc_feature: Encodes the peptide sequence at SEQ ID NO. 1624
acctacccagcagctagccatggggtcgctgccgccggcggagcagccgccgccgcacgcggtgatgatcccgtacccggcgcagggccacgtcacgcccatgctgcagctggccaagctcctccacgcgcggggcttccacgtcaccttcgtcaacaacgagttcaaccaccgccgccacctccgcgcgcgggggcccgccgcgctcgacggcgcccccgggttccgcttcgccgccatcgacgacggcctcccgccctgcgaagccgacgccacccaggacgtcccggcgctctgccgctccaccatgaccacctgcctgccccgcttcagggacctcgtcgccgggctcgacgccgaggccgcccgcgacggccgcccgcgcgtcacctgcgtcgtcgccgacagcaccatgacgttcgcgctccgcgccgcgcgggagctcggcctccgcgccgccacgctctggaccgccagcgcctgcggcttcctcacctactaccactaccgccacctcgtcgaccgcggcctcgtcccgctcagggacgaggcgcagctcgccgacggctacctcgacaccgtcgtcgactgggtccccggcgcgcccgcggacctgcgcctccgcgacttccccagcttcgtgcgcaccacggaccccgacgacgtcatgctcaacttcttcatccacgagaccgccggcatgtcgcaggcgtcggccgtcgtcatcaacaccttcgacgagctcgacgccacgctgctcgacgccatggccaagctcctgccggcgcccgtctacaccgtgggcccgctcccgctgacggtgcggaacaacgttccggcggggagcccggtcgccgccatcgggtccaacctgtggaaggagcaggacgcgccgctccggtggctggacggccgcccgccgcgctccgtcgtgtacgtcaacttcgggagcatcacggtgatgtccaaggaggagctggccgagttcgcgtggggcctcgccggcaccggctacgccttcctctggaacgtgcgcccggacctcgtcaagggcgtcggcgactcagccgggctgccgccggagttcgcggcggccacggagggccggagcatgctgtcgacgtggtgcccgcaggcggcggtgctggagcacgacgccgtgggggtgttcctcacgcactccggctggaactccacgctggagagcatctgcggcggcgtgcccatggtgtgctggcccttcttcgccgagcagcagaccaactgccgcttcaagtgcacagagtggggcatcgggatggagatcggcggcgacgtcaagcgcgtcgaggtggaggcgctcatccgggaggccatggaggggaagaaggggagggagatgcgccgccgcgtggccgagctcagggacagcgccgtggcggcggcgagccccggcggccggtccatgcgcaacgtcgacaggctcatcgacgaggtgctcctagcttgaacgctcatcaacacgctactgaacgttgccccgtgttcgttattggcctcttgttgattggcggctgccgcgctagcttgatatccactatctctgtgagctgaatgcgattgcgatatatcagtttgaggtgatagtgatataagtttgggttctttttggctcgaatttatacggagtttatgtgcttgtgctccacctcatgcaaatatatctagtttcttgtataattattaaagaaagtgttttgcaaaaaaaaaaaaaaaaaaaa

SEQ ID NO: 1624 - protein, 489 aa, Panicum virgatum
  misc_feature: Ceres CLONE 1768985
  misc_feature (1)..(124): Pfam Name: UDPGT Pfam Description: UDP-glucoronosyl and UDP-glucosyl transferase
MGSLPPAEQPPPHAVMIPYPAQGHVTPMLQLAKLLHARGFHVTFVNNEFNHRRHLRARGPAALDGAPGFRFAAIDDGLPPCEADATQDVPALCRSTMTTCLPRFRDLVAGLDAEAARDGRPRVTCVVADSTMTFALRAARELGLRAATLWTASACGFLTYYHYRHLVDRGLVPLRDEAQLADGYLDTVVDWVPGAPADLRLRDFPSFVRTTDPDDVMLNFFIHETAGMSQASAVVINTFDELDATLLDAMAKLLPAPVYTVGPLPLTVRNNVPAGSPVAAIGSNLWKEQDAPLRWLDGRPPRSVVYVNFGSITVMSKEELAEFAWGLAGTGYAFLWNVRPDLVKGVGDSAGLPPEFAAATEGRSMLSTWCPQAAVLEHDAVGVFLTHSGWNSTLESICGGVPMVCWPFFAEQQTNCRFKCTEWGIGMEIGGDVKRVEVEALIREAMEGKKGREMRRRVAELRDSAVAAASPGGRSMRNVDRLIDEVLLA

SEQ ID NO: 1625 - DNA, 2166 bp, Panicum virgatum
  misc_feature: Ceres CLONE 1768987
  misc_feature: Encodes the peptide sequence at SEQ ID NO. 1626
gcgtctccgccccgccgccaccagcagatccatcccctcccctcatctttaccctcgagctcggcggcgacctcgccctgctcgctcgtcccgccaagctccttgcccctccggccaagcccccgtgcccggcgccatgaacccctacgacatccgcttcgccgacccctcgtcgtaccacgacaggcgcagcgacctggccgtggctcctattgtcgctccgccggtccccatgccggcggtgaacacttacgccgccgcgtatccgcccgtgccggcggcacccgctggcgtcgattacccgcgctacgggcagggcggcagaggccgtggaggaggcagaggcggaggcggctttggaggtggcggtggaggcggctatggtggcggcagaggggcgcgcggcagggacgggcttgacacgctcgcactgcccaagcctgacttccggagcctgataccgttcgagaagaacttctacgtggagtctccctccgtgcaggctatgtcggatgcggaggtggcgcagtaccgccgcctacgggatatcaccgtcgagggccgggaggtgcccaagccggtccgatacttccaggaagccaacttcccagattactgcatgcaagcaattgccaaatctgggtttgtggagccgacacctattcaatctcaaggttggcctatggctctgaatggtagggacctgattggtatcgctcaaacaggctcagggaaaacattatcttatctgctacctgggttggttcatgttggcgcccagcctcggctagagcaaggtgatggcccaattgtattaatcctcgccccaacaagagaacttgctgttcaaatacaggaagaatccacaaaatttggatcatattcaagaactagaagcacatgtgtctatggtggtgcacctaagggtccacaaatacgtgaccttagaagaggagtggaaattgtcatcgcaactcctgggaggttgattgatttgctggaagctggtcacacaaacctacgtagagtgacataccttgtgctggacgaggcagaccggatgttagatatggggtttgagcctcaaattcgaaaaattgttgcacagatccggccagacaggcaaaccttatattggagtgccacttggcctagagaagttgaagccttagctaaacagtttctgcaaaatccttacaaggtaaccataggatcatctgaccttaaagctaatcattccatacaacaaattgttgaagttatttcagatcatgagaagtacccgagactcagtaagctcttgtctgatttaatggatgggagccgtatcttgatatttttccaaacgaaaaaggactgtgataagatcaccaggcaacttagaatggatgggtggccagcattatctatacatggtgataaagctcaagctgaaagggactatgttcttgcagagtttaagagtggcaagagttcaataatggctgccacagatgtagcagcacgtggtcttgatgtgaaggacataaaatgtgtgataaattatgatttcccaacaactcttgaagattatattcacaggataggccgaactggccgtgctggtgccagcggaacagcatttacttttttcacacatgcaaatgcgaagttctcaaggaatcttgtcaagattttgcgggaagctggccaagtcgtgaatcctgcactagaatccatgtccaaatctgcaagtttgatgggaggaggcaatttccgatcgaggggaagaggtgggtttggtaaccggggtcatatgtctggatcaaattcctttccgttaggaggaaggaggccatactaatcggtgcgaaggaactatgagacttctatttgtatactactagacattaaatgcactctttgggagtgggaaatttctgagaaattccctcaactactaggacatcaaagtcatttgcttccgttactgaagctatgaagcttctgatcatatgaaacatcaacttttatcaacttcttaccatttgcatttaagtcaaatttctcttttggaggactgttttaccggagtccctttggtcaaagtctggtcgtatactgtacttcaccctgtgttgctgaaggaaaggatgcttctttgtcgaaaaaaaaaaaaaaaaaaaa

SEQ ID NO: 1626 - protein, 568 aa, Panicum virgatum
  misc_feature: Ceres CLONE 1768987
  misc_feature (1)..(171): Pfam Name: DEAD Pfam Description: DEAD/DEAH box helicase
MNPYDIRFADPSSYHDRRSDLAVAPIVAPPVPMPAVNTYAAAYPPVPAAPAGVDYPRYGQGGRGRGGGRGGGGFGGGGGGGYGGGRGARGRDGLDTLALPKPDFRSLIPFEKNFYVESPSVQAMSDAEVAQYRRLRDITVEGREVPKPVRYFQEANFPDYCMQAIAKSGFVEPTPIQSQGWPMALNGRDLIGIAQTGSGKTLSYLLPGLVHVGAQPRLEQGDGPIVLILAPTRELAVQIQEESTKFGSYSRTRSTCVYGGAPKGPQIRDLRRGVEIVIATPGRLIDLLEAGHTNLRRVTYLVLDEADRMLDMGFEPQIRKIVAQIRPDRQTLYWSATWPREVEALAKQFLQNPYKVTIGSSDLKANHSIQQIVEVISDHEKYPRLSKLLSDLMDGSRILIFFQTKKDCDKITRQLRMDGWPALSIHGDKAQAERDYVLAEFKSGKSSIMAATDVAARGLDVKDIKCVINYDFPTTLEDYIHRIGRTGRAGASGTAFTFFTHANAKFSRNLVKILREAGQVVNPALESMSKSASLMGGGNFRSRGRGGFGNRGHMSGSNSFPLGGRRPY

SEQ ID NO: 1627 - DNA, 2255 bp, Panicum virgatum
  misc_feature: Ceres CLONE 1768989
  misc_feature: Encodes the peptide sequence at SEQ ID NO. 1628
aatcattagttccgttcttgaatccgggcactcgctttccccaaaattagaatcaaaccctagctcgtcctcctccccgattccccccatccccaccagccgactcgccggaaccctaactaggcttagatccaccgtgtcgcgcgcgcggccgccgccatggcgaccctaaaggatctcctcccggcgcccaagacgtcggcgtccaccttctacgaccacagcagcgacccctggttcaaggagcggtacggcggggagtcggcgcaggcgtcggccgcatcgaggcccgcgggcgccgccaggaccatccctccgtacgggaagcgggcggggttcgtgccgcgccggccggaggactttggggatggcggcgccttcccggagatccatgtcgcgcagtatcctctcggcatgggccgccgcgacgacaagggcgggtccaagatcctcgcgctcaccgtcgatgcgcacgggagcgtcgccttcgacgccgtcgtcaagcagggcgagaacgccggcaagatcgtctactccaagcacagcgacctcgtgccgaagatcgccacgtccgattcgcaggcgccggacaacgacgaggaggagcagaagcagatcgaggagtccacagagcggacgaaggctgccttggagaaggtcgtcaacgtccgcctctcagctgctcagcccaagaatgtgccgacacatgattctgagtccaagtttattaagtataagccgtcacagcaatcagcggccttcaattcaggtgccaaggagaggatcattcggatgtcggagatggcagtggatcctcttgagccgccgaagttcaagcacaagcgtgtgccccgggcatctgggtcgccacctgtgccggtgatgcactcgccaccgcggccagttacagtgaaggatcagcaggattggaagatcccaccgtgcatttctaactggaaaaatccaaagggttacacgattccacttgataagaggttggcggctgatggaagagggctacaggaggtgcaaattaatgacaactttgcaaagctttctgaagcattgtatgtggcagaacagaaggcgagggaggcagtacagatgcgctccaaggtccagagggaactgatgctgaaggagaaggagagaaaggagcaagaactgagggctcttgcacagaaggctcgcatggagaggactggtggcccacccgcgccatcagctgtgcctgctggtggtggcaggggagcagttgatgctatcgatgaagatatggatatggagcaaccacctgaaccgcgtgagcagcgcagggagagtagagaagagagggaagcgaggattgagcgtgatagaatccgtgaggagcgcaaacgtgagagggagagagagaggaggctggaagccaaggatgctgcaatgggcaagaagagtaagatcacaagagacagggatcgtgacatcagtgagaagattgctctgggtatggcaagcactggtggtgccaaaggtggtgaggtcatgtatgaccagcggctgttcaaccaggacaaggggatggactccgggtttgccacggatgatcagtacaacatctactctaaggggctcttcacagcgcagtctacgatgtctacattgtacagacctaagaaggacggtgattctgatgtgtatggtgatgcggatgaacagttggagaaggttatgaagactgagaggttcaagcctgacaaggcttttactggtgcttctgagaggactggcaagcgagacaggcctgtggagttcgataagcaggaggagaatgatcccttcggtctggatcagttcttgactgaggtgaagaagggaaagaaagctgtggagaaaatcggaggcggaggcaccatgaaggcgagtggtgggtcctcaatgagggatgattataatggaggatctgggaggtcccgcattaattttgaaagggggcgttgaggtccatggggattacacaaaggaggatgttggtggtgaagcttgagaggcctgctgagggagatgaggccgtggttggccaggaggctgcagcagctgagtaggatagttttgatcacttttttttttccattaatatatttgaaggatatatgcgctgttacctttctgtctgagaactagggtggctttatcttggcgatctggtagttcatgtctggaaacaagtcattcgtttgtggttatttggatcgcaaaaaaaaaaaaaaaaaaaa

SEQ ID NO: 1628 - protein, 606 aa, Panicum virgatum
  misc_feature: Ceres CLONE 1768989
  misc_feature: Great-hit functional homolog of the protein sequence given in SEQ ID NO 9743
  misc_feature: Useful for making plants with modulated biomass
  misc_feature: Useful for making plants with modulated flowering time
  misc_feature: The plant flowers significantly late compared to wild-type.
  misc_feature: The rosette leaves do not appear in the normal fashion, i.e., their phyllotaxy may be abnormal or too many leaves may be emerging in comparison to the control.
MATLKDLLPAPKTSASTFYDHSSDPWFKERYGGESAQASAASRPAGAARTIPPYGKRAGFVPRRPEDFGDGGAFPEIHVAQYPLGMGRRDDKGGSKILALTVDAHGSVAFDAVVKQGENAGKIVYSKHSDLVPKIATSDSQAPDNDEEEQKQIEESTERTKAALEKVVNVRLSAAQPKNVPTHDSESKFIKYKPSQQSAAFNSGAKERIIRMSEMAVDPLEPPKFKHKRVPRASGSPPVPVMHSPPRPVTVKDQQDWKIPPCISNWKNPKGYTIPLDKRLAADGRGLQEVQINDNFAKLSEALYVAEQKAREAVQMRSKVQRELMLKEKERKEQELRALAQKARMERTGGPPAPSAVPAGGGRGAVDAIDEDMDMEQPPEPREQRRESREEREARIERDRIREERKRERERERRLEAKDAAMGKKSKITRDRDRDISEKIALGMASTGGAKGGEVMYDQRLFNQDKGMDSGFATDDQYNIYSKGLFTAQSTMSTLYRPKKDGDSDVYGDADEQLEKVMKTERFKPDKAFTGASERTGKRDRPVEFDKQEENDPFGLDQFLTEVKKGKKAVEKIGGGGTMKASGGSSMRDDYNGGSGRSRINFERGR

SEQ ID NO: 1629 - DNA, 1952 bp, Panicum virgatum
  misc_feature: Ceres CLONE 1769046
  misc_feature: Encodes the peptide sequence at SEQ ID NO. 1630
acgcttcgctcaacgcctcttggcatttgctttgcttgccttgcatcgaaagctccaaacgcaaagcccctactccacttccattgatccccatccatcccaccaccggacgcagcaagcagcgaagcggaagcgccggcaatggggtccggctccacccgcgccgcgaccgccgcggccgctctcctcctcctcatgctcgcgcgaggcggcgagtccgtcagtttctggctcccgccgccgtccgccggggtagggggcgagggcttcctcggcggcgccagccgttacctgacgctggacaagcggtggatgaaccaaaccctcgaccacttcaaccccacggaccatcggcaattcaaacaacgttactatgaatttttggactactaccgagctccaaatggaccgatcttcctaaaaatctgtggagaagcctcatgcaatggaattagcaatgactacttagctgtgatggcaaagaaatttggtgctgcaattgtttctcctgagcatcgatactatggaaagagttctccttttgacagtctgacgacagaaaatctacagttcttgtcatcaaagcaggctttatttgatcttgctgttttccgccaatattatcaggaaaccttaaatgccaagtataatcgctctggggcagacagttcttggtttgtttttggagggtcatatgctggagcactcagtgcttggttcagattgaagtttcctcacttgacatgtggaagtcttgcaagctcaggagttgttcttgctgtttacaactttaccgattttgacaaacagattggggactctgctggtcctgaatgcaaggaagcacttcaagaagtaacaaggcttgttgatggacagcttcagtgtggcagcaactcagttaagcagttgtttggagcaccaaagttagaaaatgatggtgacttcctctacttactggcagatgctgctgctattgcgttccaatatggtaatcctgatgccttgtgctcccctctaattgaagcaaagaagaacgggacagatttggtggaaacatttgctagttacgtgaaagattattacattggaaaatttggggcatctgtagcatcatatgatcaacagtatttgaagaacacaactcctgctattgctgaatccgcatatagactgtggtggtaccaagtttgcagtgaggttgcatatttccaggtggcacccaaaaatgatagtgtacgctccccaaagattgacacaaggtaccatttggacttgtgcagaaatgtttttggggaaggagtctaccctgatgtcttcataacaaacttatactatggaggcacaaaaattgcaggttctaaaattgtttttgcaaatggatctcaagacccatggcgccatgcttctaagcagaaatcatcagaagaattaccatcatacttaattgagtgcaagaactgcggacattgcagtgatctctctggatgccctcaagctccttcaaacattgaaggtgattcatccaagtgctcatccccagaagctctcaacaaagtaagaaagcagatagtcgatcacattgacctgtggttatcggaatgtcaagaacaaggacatgacaaggagccatcactgggaagcagatggaacatagccactatctgattaatctgtgcgagctacaggcatatgttgcaaggccaatgcaaatatggttgtgtaatagaggctgatgtataatcccgctggtggcaaataaataaaacaggcggttctcagcttattgggatgcccgcagagttcaggcgtgagagatgccccagtgccccacctttgggctcggacgcgttgacctgtacagacattaccaggatttgtaaatgtgaacgaactgcatacaaaccaaatttgtcaatatacatctggcgcaaaaaaaaaaaaaaaaaaaa

SEQ ID NO: 1630 - protein, 508 aa, Panicum virgatum
  misc_feature: Ceres CLONE 1769046
  misc_feature (1)..(418): Pfam Name: Peptidase_S28 Pfam Description: Serine carboxypeptidase S28
MGSGSTRAATAAAALLLLMLARGGESVSFWLPPPSAGVGGEGFLGGASRYLTLDKRWMNQTLDHFNPTDHRQFKQRYYEFLDYYRAPNGPIFLKICGEASCNGISNDYLAVMAKKFGAAIVSPEHRYYGKSSPFDSLTTENLQFLSSKQALFDLAVFRQYYQETLNAKYNRSGADSSWFVFGGSYAGALSAWFRLKFPHLTCGSLASSGVVLAVYNFTDFDKQIGDSAGPECKEALQEVTRLVDGQLQCGSNSVKQLFGAPKLENDGDFLYLLADAAAIAFQYGNPDALCSPLIEAKKNGTDLVETFASYVKDYYIGKFGASVASYDQQYLKNTTPAIAESAYRLWWYQVCSEVAYFQVAPKNDSVRSPKIDTRYHLDLCRNVFGEGVYPDVFITNLYYGGTKIAGSKIVFANGSQDPWRHASKQKSSEELPSYLIECKNCGHCSDLSGCPQAPSNIEGDSSKCSSPEALNKVRKQIVDHIDLWLSECQEQGHDKEPSLGSRWNIATI

SEQ ID NO: 1631 - DNA, 2345 bp, Panicum virgatum
  misc_feature: Ceres CLONE 1769052
  misc_feature: Encodes the peptide sequence at SEQ ID NO. 1632
aacaaaacaacccccgcaacctctcctatctctctctccacttgttttcttgatctccgccgcttcctctcctctcctctcctctcccccgcgtctctagggtttccacgccgccggattcgaaacccgcgctcccgagcaagtgaccagcggggcaactccatcaagtgacctgtgctaattatgcgatcttcatgggctgattcagttgcgaacgccgaggaatcggcgcccgcgactggtgctgctaacggatccgttgctaatcacggcaacccgcgccccacgcgcagctcctacgtgcctcctcacctccgtggccgtccagctggtgctggtgttgacgcccaagcaggctcagcagcgccggcgcaaggtggcccattgccctcagctgccgcacagccatctggtccggctgctgctgttggtggccctcgctgggctggcattgttaacggtggtggaagtggcagtgtgggtgctcctcgtcagggttatggcggtgggggccgtggtggtgggggcggtggcggtgcctggaactcccgtcctggcggttgggaccgcagagaccgtgagccggatccctttgctaaagctgaggcagaagaagttgacttcgagggtgctgagaacactggcatcaattttgatgcctatgaagacatccctgttgagaccagcggccacgatgtacccgcaccagtgaacacattcgcagagattgatttgggtgatgcgctgaatgagaatatccggaggtgcaagtatgtgaaaccaacaccagtgcagcgttatgctatcccaatctccatcgctggacgggatcttatggcctgcgcacagacggggtctggaaaaaccgcagccttctgtttcccaatcatcagtggcatcttgaagtctaggccaccccagaggcagcgtagttcaaggactgcatgtcctctggctctgatcttatctcccactcgtgagctttcagtccaaatccatgaagaagcaaagaaatttgcatatcagactggtgtcagagttgtggttgcatatggaggtgcaccgataacaaatcagctgagggagttagaaagaggtgttgaaatcctggtggcaactcctggacgcttaatggatctgttggagagggctagagtctcactgcaaaacattatgtatttagctctcgatgaagctgatcgaatgcttgatatgggttttgagccacagatacgtaaaattgttgagcagatggacatgcctccacgtggccagaggcagacaatgttgtttagtgctacattcccgaaagagatacagagtatggctgcagattttcttgctgattacatctttcttgctgttgggagggttggttcaagtaccgatttgattgttcagagggtggagtttgtcctagatgcagacaaacgtagctaccttatggaccttcttcatgcgcaaaaggctaatggtacacatgggaagcaagctcttactttggtctttgtggagacaaagaggggggctgatgctctggaggactggctctttagaaatggtttcccggcaactagcattcatggagacaggtcacaacaggaaagggagcatgctctcagatcattcaagagtggagcaactcccatccttgtggcaactgatgttgctgctcgtggtcttgacataccacatgtcgctcatgttatcaattttgacctcccaaatgatatagatgactatgtccatcgtattggaaggactgggcgtgccggcaaatctggcctggcgactgcatttttcaatgagaacaacacgtcgctggcaaggcagttgagtgagctcatgcaagaggccaaccaggaggttccacagtggcttgagcggtatgctgcccgttcaacctacggaggtggtggcggtagaaaccgcagatcaggtggcggtgccaggtttggtggccgtgacttcaggcgagacaggggcagtggtgggtatggcggcggcggcggtggtgcttatggtggcggcggtggtggcggatatggggggtcatcgggatatggtggtgggtatggaggcggcggcagcggctacggtggtggtcagagcgcttgggactgatcttgatccgtactaagtgtgaagctgaaaatgaaccgacagtgatcaattggttcccttgggttaaatggatgcgtggaaatgaaatttgtatcttcactggatgagtatggtgttgggaaacgtccccttcgctagtgttctggttttaatccttttgtttatgttgtactaggaattggcttgtgtgatcttttattaaaaaaaaaaaaaaaaaaaaa

SEQ ID NO: 1632 - protein, 646 aa, Panicum virgatum
  misc_feature: Ceres CLONE 1769052
  misc_feature (1)..(181): Pfam Name: DEAD Pfam Description: DEAD/DEAH box helicase
  misc_feature (576)..(641): SWISSPROT Homolog: EC 5.99.1.2 DNA topoisomerase 3-alpha
MRSSWADSVANAEESAPATGAANGSVANHGNPRPTRSSYVPPHLRGRPAGAGVDAQAGSAAPAQGGPLPSAAAQPSGPAAAVGGPRWAGIVNGGGSGSVGAPRQGYGGGGRGGGGGGGAWNSRPGGWDRRDREPDPFAKAEAEEVDFEGAENTGINFDAYEDIPVETSGHDVPAPVNTFAEIDLGDALNENIRRCKYVKPTPVQRYAIPISIAGRDLMACAQTGSGKTAAFCFPIISGILKSRPPQRQRSSRTACPLALILSPTRELSVQIHEEAKKFAYQTGVRVVVAYGGAPITNQLRELERGVEILVATPGRLMDLLERARVSLQNIMYLALDEADRMLDMGFEPQIRKIVEQMDMPPRGQRQTMLFSATFPKEIQSMAADFLADYIFLAVGRVGSSTDLIVQRVEFVLDADKRSYLMDLLHAQKANGTHGKQALTLVFVETKRGADALEDWLFRNGFPATSIHGDRSQQEREHALRSFKSGATPILVATDVAARGLDIPHVAHVINFDLPNDIDDYVHRIGRTGRAGKSGLATAFFNENNTSLARQLSELMQEANQEVPQWLERYAARSTYGGGGGRNRRSGGGARFGGRDFRRDRGSGGYGGGGGGAYGGGGGGGYGGSSGYGGGYGGGGSGYGGGQSAWD

SEQ ID NO: 1633 - DNA, 2436 bp, Panicum virgatum
  misc_feature: Ceres CLONE 1769056
  misc_feature: Encodes the peptide sequence at SEQ ID NO. 1634
atttttcccgtccccgcatctcctccgcgccgcgccgcagccgtctccctcctacctctcccagtcgtcgtcgtcctcctgcctgccactccttccgctccgcccgaaccttgctcggcccgcctcttcttggattggcggcgcgggcgccggggccaggtcattggcggagagggcccggccgggtcttcaagaacgggcggcggcgcttttcctgaggcgaattcggcctggtccctcttgcccccccgcgcgtgggagggggcgggggggctcgggaatgggcggagagcagcggctgcgtcgcctgccccggttcccatctctctgaacttagatggatgcatctgtgaacgccaagaagaaggttagttcctgcgggggtaccggtcacagccgctgtggtgaggtgcatcgagccaccgtgcgctccggtcgtatgcgaagcaaccccttctcccttcaggtttggttcgcttttccattcaagtataaaggaagtaggatttggcatggcatttgaatagcatcagaacctttaaaacaaagttttgtgtattggtgttatactttacgaaaacatggtggacgaagaactgttttataaggacactagtgatcacagcatcagctctgaggaagaagacatgcttgtgaggagttgtagcaatctcaatgtcagctttggataccattgtgattcttatacaagctttccttctgaaaattctcatgagaatggtatctccccgaggaacatatttgggactgataccatgatgggctcacgaaatggctcatttacttgtttatctggtgctgcaataagtgcaaatttcacactggcaaatacaaatatctgcaagggtcttattggtgaagaaattttaccaggactagattctccaaattcctttagaaaaattgtttcttctccatcaatgtcaagattggactcgttctccaactcacaaggcagccctgatagctctatttttgaaatcagtaaaaatacttggaggtcaagcgctccaacagctgtatcatccaattttctgactaataccgaggtaaaaatggctggcggagctgctggggaggatagagtccaagctgtgtgctcggagaaaaatggatggctgatttgtggaatatatgatggatttaacgggagagatgctgctgattttctagcagtaactctatatgacaacatagtatactacttatacttgttggagaatcggatcaagcagcaaaatggtctgtataattcatcagaaagctctcttagtggtgttaaaagtgagctaacactagccatgagaatggcagaaaatgaagatataaagttttctgaaacatttcgagctggtgtgctgaactgcctttccactgctgttgagcaagctgagaatgattttctatgcatggttgaacaagagatggatgatagaccagacttagtttcagtaggatcttgtgttctggttgtgcttcttcatggaaaagatttgtgcatcttgaatctgggtgatagtagagctgtgcttgcttccatgccatatgcagaaaagggcaccttaaaggctattcaattaacggagacccactcacttgaaaatccattggagtaccaaaaacttatagctgatcatcccaatgattcttcagttgtaaggggtaacaaaataaaaggaaagctgaaggttactcgtgcttttggagttggctatctaaagcagaaaaagttcaatgatgcactcatgggcattctccgtgttcgtgatttgagtagcccaccttatgtttatacaaatccacacacattgagtcacaaagttacagatgatgatttgtttgtcgtgcttagtagtgatggcttatttgatttcttcagtaacaatgaagttgttcagttggtttatcagttcatgcatgataatccaatgggagatcctgcaaaatatctcatcgagcaacttatactcaaagcagccagggaagcagctttaacagctgaagaattgatgaggatacctgttgggagtaggaggaaataccacgatgatgtgaccatcattgttatcatccttggaaatgcacagaggacaatgactgcatcaacttccttgtgagataacaaagaactaaacagagaagctatcagctggtaaaattttgtgggtgttcgcatacaactatttcaaataatatgttttttattagtctagagtggcagtcaataaaccaaaaaactgtatatatccttttggaattttggttgtgaacaaaaccttttgttcaatcaaaaggtcacatggatttgtttcacttattttgtacatgactgaaacatggatgctcttctttgcgactgaatccatgaaagaaacggcaaaccatttcagttttcaaaaaaaaaaaaaaaaaaaa

SEQ ID NO: 1634 - protein, 518 aa, Panicum virgatum
  misc_feature: Ceres CLONE 1769056
  misc_feature (1)..(330): Pfam Name: PP2C Pfam Description: Protein phosphatase 2C
MVDEELFYKDTSDHSISSEEEDMLVRSCSNLNVSFGYHCDSYTSFPSENSHENGISPRNIFGTDTMMGSRNGSFTCLSGAAISANFTLANTNICKGLIGEEILPGLDSPNSFRKIVSSPSMSRLDSFSNSQGSPDSSIFEISKNTWRSSAPTAVSSNFLTNTEVKMAGGAAGEDRVQAVCSEKNGWLICGIYDGFNGRDAADFLAVTLYDNIVYYLYLLENRIKQQNGLYNSSESSLSGVKSELTLAMRMAENEDIKFSETFRAGVLNCLSTAVEQAENDFLCMVEQEMDDRPDLVSVGSCVLVVLLHGKDLCILNLGDSRAVLASMPYAEKGTLKAIQLTETHSLENPLEYQKLIADHPNDSSVVRGNKIKGKLKVTRAFGVGYLKQKKFNDALMGILRVRDLSSPPYVYTNPHTLSHKVTDDDLFVVLSSDGLFDFFSNNEVVQLVYQFMHDNPMGDPAKYLIEQLILKAAREAALTAEELMRIPVGSRRKYHDDVTIIVIILGNAQRTMTASTSL

SEQ ID NO: 1635 - DNA, 1790 bp, Panicum virgatum
  misc_feature: Ceres CLONE 1769061
  misc_feature: Encodes the peptide sequence at SEQ ID NO. 1636
aaagttagcccgggagcatctttcaatggcgtaggcgctcttgtctgcagtctgccgtctgcacctgaacggccatttcctcctcggtttcattatccgcatctttcgatttttatatcctggggagtggggaagatcagacccgatccgatctctatcgaggccaactttgtcttcgagcgtgcaagatcctttgcggccatggcgaggccgcacgtcatggttgtgccgtacccgggcgccggcaacatcaacccggcgctgcaggtcgccaagctgctgcaccgccacggcgtctacgtcaccttcgtcaacaccgagcacaaccaccggcgcgtgcaggccacggagggcgccggcgccgtgcggggccgcgaggggttccgcttcgaggccatcccggacgggctctccgaggccgaccgcggcaagcaggactacggccgcggcctcgccgtgtccacgagcacgcgctgcgcggcgccgctcagggacctcatcgcgctgctcaacgccacacccggcgtgccgccggtcacctgcgtgctgcccacgatgctgatgagcttcgcgctgggcgtggcgcgggagctcgggatcccgaccatggcgttctggaccggcagcgccgccgcgctcatgacgcacatgaggctccgggagctcgaggagcgaggatacgtgccactcaaggatgagagctacttgaccaacggctacctcgagaagacggtcatcgactggatccccggcatgccgccgatccgcctcggcgacttctccagcttcctccgcaccaccgacccgaacgacttcggcctccgcttcaacgagtcggaggccaacaaatgcgccaaggccggcgctctcatcctcaacaccttcgacggcctcgaggccgacgtcctcgccgctctccgagccgagtacccgcgcatctacaccgtcggccctctgggctccctcctccgacagaacctcgacagcgccgccgccgccgacgactcgaccggcctaagcctgtggaagcaggacgccgagtgcctggcgtggctggacgcgcaggagcagcagcgctccgtcgtctacgtcaacttcggcagccacacggtgctgacgccggagcagctggccgagttcgcctggggcctcgcggcgagcggccacctgatcctatggtgcatcagggacaacctcgtccgcggcggcggcggcggcccggccgtgctgcccccggacttctgggctgcagcggcggggaggtgccacgtgacggcgtggtgcccgcaggagcaggtgctgcgccacccggccgtgggctgcttcctgacgcacagcgggtggaactcgacgtgcgagggcgtggccgccggcgtgccgatggtgtgctggccggggttctcggaccagtacaccaactgcaagtacgcctgcgaggtgtggggcgtcggcgtccggctggacccggaggtgtggagggagcaggtcgccgcgcacgtcagggaggccatggagagcgaggagatgaggaggagggcggccaagtggaaggaggaggcggagacggccaccagccccggcggctcgtcgtttgagaacctgctgaccatggtgagagcgctcagcggcacacacgagagctgaaggatcagttgttggacttggactgatacacaatgcaaaagtgtctgtttagttagcgtcaataaaaaaaagtattggattttcagcaattttaatcgccttaaataaaattggcttgtttctgtcaaaaaaaaaaaaaaaaaaaa

SEQ ID NO: 1636 - protein, 480 aa, Panicum virgatum
  misc_feature: Ceres CLONE 1769061
  misc_feature (1)..(156): Pfam Name: UDPGT Pfam Description: UDP-glucoronosyl and UDP-glucosyl transferase
MARPHVMVVPYPGAGNINPALQVAKLLHRHGVYVTFVNTEHNHRRVQATEGAGAVRGREGFRFEAIPDGLSEADRGKQDYGRGLAVSTSTRCAAPLRDLIALLNATPGVPPVTCVLPTMLMSFALGVARELGIPTMAFWTGSAAALMTHMRLRELEERGYVPLKDESYLTNGYLEKTVIDWIPGMPPIRLGDFSSFLRTTDPNDFGLRFNESEANKCAKAGALILNTFDGLEADVLAALRAEYPRIYTVGPLGSLLRQNLDSAAAADDSTGLSLWKQDAECLAWLDAQEQQRSVVYVNFGSHTVLTPEQLAEFAWGLAASGHLILWCIRDNLVRGGGGGPAVLPPDFWAAAAGRCHVTAWCPQEQVLRHPAVGCFLTHSGWNSTCEGVAAGVPMVCWPGFSDQYTNCKYACEVWGVGVRLDPEVWREQVAAHVREAMESEEMRRRAAKWKEEAETATSPGGSSFENLLTMVRALSGTHES

SEQ ID NO: 1637 - DNA, 1746 bp, Panicum virgatum
  misc_feature: Ceres CLONE 1769073
  misc_feature: Encodes the peptide sequence at SEQ ID NO. 1638
cttccctcccttcccctcccgtccctggctcgcttcccaatacccaaccccgccggccgcgagcgatgcccgcgatccccaccgcccctgcgcccgccaccggcagctccctccacgcgcgccgcctccgccttcagttctcctccccgttgccgcgctctaaccagcagcggctcctccccacccgcctcccccgcctgcccgctcgcgcccgggccgctcccatgtccgccgaggcgcgggcgcccgcgccgccggtggcgccgccggcgcaccccacctacgacctcagggccgtcatcgcgctcgccctctccgaggacgccggcgaccgaggggatgtgtcttgtttggccacaattccttcggacgtggaagctgaagccacgtttattgctaaagcagatggtgttattgctggaataagcctagcagacatgatatttaaccaagttgatccatcgttgaaggttgaatggtttgaaagtgatggaaattatgtccataaagggttgcaatttggcaaagtatatgggtgcgctaggagcatcatcattgctgaaagggttgtgctcaatttcatgcagaggatgagtggtattgcgaccttaacaaaggctatgtctgatgctgcacgtccagcatgcatattggaaacaaggaaaactgccccagatttacgtctggttgacaagtgggcagtaatgataggtggtggaaagaaccacaggcttggtttatttgatatggttatgataaaggataatcatatttctgttgctggcgggattgcaaatgcagtgagatccgttgaccaattcctggagaaggaaaaacttacaattcctgtagaggttgagacaaggacaattgaagaagtgaaagatgtgctgaagtatgctgctgagaacagaacttcattaacccatataatgttggacaacatggtcgttcctcttccaaatggggatgtggatgtatcaatgcttaaggatgcagttcaattgataaatggtagatttgagactgaggcatctggaaatgtgacaatcgatacagtgaagaaaataggagaaacaggagttacctatatttcaagcggagcattaacgcattctgtgaaggctcttgacatctctctcaagatagacaccgagctcgctcttcaagtcggaagacgtacaaatcgtgcctgactccactgcattatgttgtacccgccttgccacatctacaagatggtagattaacccagcgtggcaaatcaagttaaataacttatcaaatctgcgccggccgcgtggtgctgagaactgtgactgctacaaaatgggattcattcttcagttttaggttttcagccgaaatacacaaacaccacaatatgcaacagaataattggcagggtggtaggttgcttctcgcatatgttctggcaccagatttggaagctggaaaaggagcggctgctgcgttctgcggcaggtagctcatagccggtgaggtagatctccctgcaacctgcccagaaggtaggttaggctgaccacagcggagggagcaagagtaaatttgctccctcctcgtttcccacgtcctctctgtctacagtgccaaacagtgcatctacagtgtcaaacagtgcatttgctctttcatttgctccttccactgtggatggtcttactgcgaacgggatgccccactgaaattgcgaagttgcaataaaaaaaaaaaaaaaaaaaa

SEQ ID NO: 1638 - protein, 376 aa, Panicum virgatum
  misc_feature: Ceres CLONE 1769073
  misc_feature (1)..(182): Pfam Name: QRPTase_C Pfam Description: Quinolinate phosphoribosyl transferase, C-terminal domain
MPAIPTAPAPATGSSLHARRLRLQFSSPLPRSNQQRLLPTRLPRLPARARAAPMSAEARAPAPPVAPPAHPTYDLRAVIALALSEDAGDRGDVSCLATIPSDVEAEATFIAKADGVIAGISLADMIFNQVDPSLKVEWFESDGNYVHKGLQFGKVYGCARSIIIAERVVLNFMQRMSGIATLTKAMSDAARPACILETRKTAPDLRLVDKWAVMIGGGKNHRLGLFDMVMIKDNHISVAGGIANAVRSVDQFLEKEKLTIPVEVETRTIEEVKDVLKYAAENRTSLTHIMLDNMVVPLPNGDVDVSMLKDAVQLINGRFETEASGNVTIDTVKKIGETGVTYISSGALTHSVKALDISLKIDTELALQVGRRTNRA

SEQ ID NO: 1639 - DNA, 1694 bp, Panicum virgatum
  misc_feature: Ceres CLONE 1769076
  misc_feature: Encodes the peptide sequence at SEQ ID NO. 1640
actcacctcggcctcacccttcttcccaaatcaatcgcattctcctccaggacccaatccacgactcccgcagtccacgttgagctcgaggggagatggcgaccgcctcgctccaactgctcgatcagaagctgctgccgtcgccggcggcgctcggcggctccgaccgcctcagccaggagatcttctccatcctcgagtccaacttcctgttcggcgcgtcgccgctggaggattcctgctccgtgggccgcgtccgcgtgctctccatcgacggcggagccgacggcggcgcgctggccgcggccgcgctggcccgcctcgagcgcaggctgcaggagctctccggcgaccccgacgcgcgcgtcgcggacttcttcgacctcgccgtgggctccggcgcggggggtttcctcgcggcggcgctgttcgcgtgccggatgcccgccgacgcggcgcgcgacgtcgtggcgaagaaccggaaggtgctgtcggggcgcggcgggcggggcggcctgttccggcgcccggaggccgtgttccggaaggtgttcggggacctgacggtgcgcgacgccgcaaagccgctgctgatcccgtgctacgacatggcgagcgcggcgccgttcgtgttctcccgcgccgacgccgtggaggcggaggcgttcgacttcccgctgtggcaggtctgcgcggcggcgtgcggggtcggccccgcggaggtggcgtcgctggacgggcgcaccaggctgcgctccgcggcggcgggcgcgggaaggggcgccgccgccgccgccgccgtggccaacccgacggccgtggccgtcacgcacgtgctccacaacaagcgcgagttcccgttcgccgccggcgcgggcgacctcctggtgctgtcgctcggcgggagcgccgccgcctcgctcctccgcccctcgtcctccagcctcctgcgcatcgccggagcttgccaggccgacatggtggaccaagccgtgtcaatggcgttcagggagagcagggtcagcaactacgtccgcatccagggcaacggcctcgcccccggcgagacgtctgaggcggcgctggcggagcggggcgtggaatcggtgctgttccgctggaggaagctgatggcgcagaccaacggcgagcggctggacggcgtggcggagcagctggtgcaggagcaccaccggcggctggagagcaaggcgcccgtggtgctcgtgaagccatccgcgacgccgcggacgtcggcgtcgtcggcgtccacgctcatcaccgtgtccaccaactcctcctcggagtcgccctgagctggcgagagaaggcagcagcagccagaagcagtttggctttcttcctttttttctttttatttatccgtttgctggggtttttagtgtagcgcggcgccggcgcccggggttttgattgcctgccggcgccgcctcgctcccggtccccggcccgcgctcgccgccggccgccgggaagaaagaggagggccgtcgagcgaaggtgttctctagtagagctaggagatggatgctgatgcactgtgtgggtgtgtgcggtgtgcctgcaactgcaaattgcaatgtactgcgtgtagagagtgtccggagcttggattgcgatgtgatgctactgtcggtgtggcgtttactgatcaaaaaaaaaaaaaaaaaaaa

SEQ ID NO: 1640 - protein, 406 aa, Panicum virgatum
  misc_feature: Ceres CLONE 1769076
  misc_feature (1)..(184): Pfam Name: Patatin Pfam Description: Patatin-like phospholipase
MATASLQLLDQKLLPSPAALGGSDRLSQEIFSILESNFLFGASPLEDSCSVGRVRVLSIDGGADGGALAAAALARLERRLQELSGDPDARVADFFDLAVGSGAGGFLAAALFACRMPADAARDVVAKNRKVLSGRGGRGGLFRRPEAVFRKVFGDLTVRDAAKPLLIPCYDMASAAPFVFSRADAVEAEAFDFPLWQVCAAACGVGPAEVASLDGRTRLRSAAAGAGRGAAAAAAVANPTAVAVTHVLHNKREFPFAAGAGDLLVLSLGGSAAASLLRPSSSSLLRIAGACQADMVDQAVSMAFRESRVSNYVRIQGNGLAPGETSEAALAERGVESVLFRWRKLMAQTNGERLDGVAEQLVQEHHRRLESKAPVVLVKPSATPRTSASSASTLITVSTNSSSESP

SEQ ID NO: 1641 - DNA, 1051 bp, Panicum virgatum
  misc_feature: Ceres CLONE 1769084
  misc_feature: Encodes the peptide sequence at SEQ ID NO. 1642
caacccagcagcatccggccagccggcgaccaccgtccgcctgtgagcgagcgagcgagcggcggcgcacgaccgtacaatggcccgggcttcctctccccggtttcttggagcggcggtcgcggtggcgcttgtagtccttgccgccgcgccgccggcgctcgccggcgacccggactacctccaggacctctgcgtcgccgacctcaactccgaagtgaaggtgaacgggttcccgtgcaaggcgaacgccaccgccgacgacttcttctccggcgtgctggccaagccgggcgccaccaacaccagcgccgtgggctccgtggtcacgggcgccaacgtcgagaaggtgccggggctcaacaccctgggcgtctcgctcgcccgcatcgactacgcccccggcgggctcaacccgccgcacacgcacccgcgcgccaccgagctcgtcttcgtcctctacggcaccctcgacgtgggcttcctcaccaccgccaacaagctcgtcgccaagaccatcgcccagggcgacgtcttcgccttcccgcgggggctcgtgcacttccagaggaacgccggcgacgagcccgccgccgtcatctcggccttcaacagccagctccccagcacgcagtccatcgccatgacgctcttcggggcctcgcccgaggtgcccgacgaggtgctcgccaaggcgttccagatcggcgccgaggagatggacaagatcaaggccaagttcgcgcccaagaagagctgaggatcagacccggacaggagaaataagttttggtctgtccatcagtcgttgatgatgatgatattggtatgcattggttggttggattattctgctgtttcttcgtttgcttgtgatacgatcgtcggttaagtgtgacctgcagaatgagttggtagggattctctcttgtaataagctgcaggcctgatggagaacattgtgttcatcttatattataagcccaatcatttgtaaaccatttcatattactattacgcctatttaagtcaaaaaaaaaaaaaaaaaaaa

SEQ ID NO: 1642 - protein, 226 aa, Panicum virgatum
  misc_feature: Ceres CLONE 1769084
  misc_feature (5)..(225): SWISSPROT Homolog: EC 1.15.1.1 Nectarin-1 precursor
MARASSPRFLGAAVAVALVVLAAAPPALAGDPDYLQDLCVADLNSEVKVNGFPCKANATADDFFSGVLAKPGATNTSAVGSVVTGANVEKVPGLNTLGVSLARIDYAPGGLNPPHTHPRATELVFVLYGTLDVGFLTTANKLVAKTIAQGDVFAFPRGLVHFQRNAGDEPAAVISAFNSQLPSTQSIAMTLFGASPEVPDEVLAKAFQIGAEEMDKIKAKFAPKKS

SEQ ID NO: 1643 - DNA, 1768 bp, Panicum virgatum
  misc_feature: Ceres CLONE 1769117
  misc_feature: Encodes the peptide sequence at SEQ ID NO. 1644
gcgtgccgccttttgccagaggaaggaggacggggcagatctccctcccgtgccacgaccattcccctgcccctgcccctgccccctgctcctcctcccaccgccaccaccagctcagcctccttgctctgcctctgctagcgctagctgctgccgccgcgcgggcgtggacgggtccgttgatctctcttgcgcgggggcgccggtggcggtggtggcagcggtggttggtggtgcgcggcgggagaaaaaaaggagaaaaaaaagccgcggcactttgcgctgctctgctcctgtaggtgtcacgagatttgggcttagcctttcgctttcctttttcctctcgcgcacaagggaagcattgtggaggcctggaggggagcgagccgtaacatccgagctgttccaatggcgacccctgctgccgttgctgtcgtctccggcgcgtcgttggggcggtggtagcgctggaggcagactagtactgcagcggggggggagtactaggttggtaggtggttgtagctctgctcgtgccccgggcgctcgctctctcgctcgtgtgctccggttgatgagcatggggcattgctccgagcagcggcccggcttcgaggtgaccaaggactggaacggcgccgaccaggtcgcgatccggtcgccgaggggggcctccgtccgggtctgcctgcacggcgggcaggtcgtctcgtggaggaacgaccgcggcgaggagctcctcttcaccagcagcaaggcgatcttcaagccgccaagagcgacacgtggtggaattccaatttgcttcccacagtttggaaactgtggaacattggagcagcatggatttgcaaggaacaagatatggacaatagatgaagaggctccaccactaaattatggtgataacaacaacaacaaagcttctgttgaccttctgctaaagccatctgaagatgacctaaagtgctggccacactgttttgagttacgtctcagagtttcactttcaacggatggaaacctttcactgatatcacgtgtcaggaatgttaatgggaagccattcagtttcgcatttgcttatcatacatatctttctgtttctgacatcagtgaagtgaggatagaaggtttggagacccttgattatcttgacaaccttaaccagcgagaacggtttaccgagcaaggagatgctataacgtttgaagcagaggttgatcgagtctatgttggctccccaggcgtaattgctgttcttgaccatgaaaagaaacgcacattcatcgtacgcaaagaggggctccctgatattgttgtgtggaacccctgggagaagaagtcgaagacgatggcggacttcggcgacgacgagtacaagcagatgctctgcgttgacgccgccgcggtggagcgagccatcacgctgaagcccggagaggagtggacggggaagctggagctctccgccgtgccgtcgaccaactgcagcgaccacctggaccacccgggcaggctctagagccccgcccgctcgcccctggcgaaaggcatgtactacgttttttcatgtacatgggggcgccgctaggtctgccggccctgctggcagcagtatgttcagcctgctagctgttgagtttaaaacttaatgtcagatgcaagtattgctgtcatcgacatggttcccgttcctgcaatgtgaatctcaagagtttatctgcatctgttttttcacgtcttgcaaaaaaaaaaaaaaaaaaaa

SEQ ID NO: 1644 - protein, 316 aa, Panicum virgatum
  misc_feature: Ceres CLONE 1769117
  misc_feature (1)..(276): Pfam Name: Aldose_epim Pfam Description: Aldose 1-epimerase
MSMGHCSEQRPGFEVTKDWNGADQVAIRSPRGASVRVCLHGGQVVSWRNDRGEELLFTSSKAIFKPPRATRGGIPICFPQFGNCGTLEQHGFARNKIWTIDEEAPPLNYGDNNNNKASVDLLLKPSEDDLKCWPHCFELRLRVSLSTDGNLSLISRVRNVNGKPFSFAFAYHTYLSVSDISEVRIEGLETLDYLDNLNQRERFTEQGDAITFEAEVDRVYVGSPGVIAVLDHEKKRTFIVRKEGLPDIVVWNPWEKKSKTMADFGDDEYKQMLCVDAAAVERAITLKPGEEWTGKLELSAVPSTNCSDHLDHPGRL

SEQ ID NO: 1645 - DNA, 1192 bp, Panicum virgatum
  misc_feature: Ceres CLONE 1769141
  misc_feature: Encodes the peptide sequence at SEQ ID NO. 1646
cgccgcccacggcgcagaatagaagacgcgtcccacctgagaaccggaagagagctgccccctcctccccttgccatccgccgccgatggcgtccgcccccgcccccgccaccggcgcggcggtggtgttcgacttcgaccgcaccatcatagactgggacagcgacgactgggtcatcaccaagctcggcgccgccgacgccttcctacgcctgcgccccactatgcgctggaacccgctcatggacaggatgatggcggagctgcacgcgcgggggaagacggtggaggacatccgcgactgcctcaggagcgcgccgctcgacgcgcacgtcatctccgcaatcaagacggcggcggcgttaaggtgcgacctgagggtggtcagcgacgccaacaccttcttcgtcgagaccgtcctggcgcaccacggcgtgctcggctgtttctccgagatcagcaccaacccagcgcgcgtcgacgctgatggcaggctcaggatctcgccgttccacgatactgcggccgcgccccacgggtgcagcctctgccctgagaacatgtgcaagggcaagataattgagaggatccaggcaacagctggcaccaagaaccagcatttcatctacataggtgacgggaagggagattactgcccatcccttaagctgggtgaaggggactatgtcatgccaaaggagaactactccctgtggaaactcatctgcagcaacaagcagcttctcaaggctgaagttcatccatggaatagtggcgaggaactggaaaagactctacttaagttggtcgacaagataatcaccccacctgcacaggtgtcccaatttgattgcagcaaatgcgagatgagcaaaccagcatccactgaagtaggccaccatcaggctctccgtgtgccacactgaccagtgatcaattcttagtttacaagtacaggcatgagtgcctgatttccatatgcctccactgatagaagtcctcagtctgcattattgatagaagtcctcagtctgcattcaaaatgtagcgatttagcagatggatactctgggcactatcactcaataaactgtagcatgacatcgaaaaatattaatcgagactgaattgctagtgacgcaagtaaatacatatccaagtttccagagcagaaaaaaaaaaaaaaaaaaaa

SEQ ID NO: 1646 - protein, 279 aa, Panicum virgatum
  misc_feature: Ceres CLONE 1769141
  misc_feature (3)..(234): Pfam Name: Put_Phosphatase Pfam Description: Putative Phosphatase
MASAPAPATGAAVVFDFDRTIIDWDSDDWVITKLGAADAFLRLRPTMRWNPLMDRMMAELHARGKTVEDIRDCLRSAPLDAHVISAIKTAAALRCDLRVVSDANTFFVETVLAHHGVLGCFSEISTNPARVDADGRLRISPFHDTAAAPHGCSLCPENMCKGKIIERIQATAGTKNQHFIYIGDGKGDYCPSLKLGEGDYVMPKENYSLWKLICSNKQLLKAEVHPWNSGEELEKTLLKLVDKIITPPAQVSQFDCSKCEMSKPASTEVGHHQALRVPH

SEQ ID NO: 1647 - DNA, 1153 bp, Panicum virgatum
  misc_feature: Ceres CLONE 1769145
  misc_feature: Encodes the peptide sequence at SEQ ID NO. 1648
atcctgatccacatccactccaagctccagctccggcggccatggcgtgctgcgcctccccccacgccctcttgtacttgtaccgcagcagcagccgcctcagcgtcagcagcctccgcctcatctacccctcggcagcagcagcagcagcagtagctgttgcagcagcacctgccccgccgccgaggctctcctcgcgaaccctaggcgcctcgcccgatccgccgccgccgctcgccgacgaccgggacgacgccatcggcttccagatccaggtgtccagcgtggtggggaagcggaaccggcggctggtgcgagccagggtgcgcgtcgacgcgccgctggaggccgtctgggccacgctcaccgactacgagggcctcgccgacttcatccccggtctctccgagtgccgcctgcttgaccaagcccacggcttcgcgcgcatctaccaggtcggggagcaggatctggcgcttggcttcaagttcaacgccaagggcaccatcgactgctacgagggggacatggagttcctgcccgccgccgacggcgaggctcaggctctgggcgcgcgccggagggagatcgccttcaccatgatcgacggcgatttcaagctcttccaggggaaatggtccgtcgtccaggaacaacaccaccagggtccaccagcagattcggattctgattctgattctgattcttcataccactaccacaccacactgtcctacctggttgagctggagcccaagctgtgggttccggtcagcctactggaaggaaggatctgcactgagatcaagaacaaccttgtttccatcagggaacaagcacagcagcaccacgaggtaacaagaagctaacacatactactccagactcactgcgttcggctggcgggcagttctcccgtgctacagtgtttctttctaatttttctccggccaccagccacataatattattatttttctctcacactattccaacctccagctagcttctggcttctagcttctggcttctgcaattcgctgctgcctgcgcctctaacaaaagttggtgcattcatgtaactataatcaatacaatacactgtatggtatggtatactccagctctgctctaaaaaaaaaaaaaaaaaaaa

SEQ ID NO: 1648 - protein, 275 aa, Panicum virgatum
  misc_feature: Ceres CLONE 1769145
  misc_feature (1)..(118): Pfam Name: Polyketide_cyc Pfam Description: Polyketide cyclase / dehydrase and lipid transport
MACCASPHALLYLYRSSSRLSVSSLRLIYPSAAAAAAVAVAAAPAPPPRLSSRTLGASPDPPPPLADDRDDAIGFQIQVSSVVGKRNRRLVRARVRVDAPLEAVWATLTDYEGLADFIPGLSECRLLDQAHGFARIYQVGEQDLALGFKFNAKGTIDCYEGDMEFLPAADGEAQALGARRREIAFTMIDGDFKLFQGKWSVVQEQHHQGPPADSDSDSDSDSSYHYHTTLSYLVELEPKLWVPVSLLEGRICTEIKNNLVSIREQAQQHHEVTRS

SEQ ID NO: 1649 - DNA, 1849 bp, Panicum virgatum
  misc_feature: Ceres CLONE 1769148
  misc_feature: Encodes the peptide sequence at SEQ ID NO. 1650
attcaccaaccgccgctccgtccccgcgccgcgcagcggacccacgcagcagagaatcacccgagatggcgacggctctgcgccgcctcgcgggcgtgcccggctccccgtcggccgccgcggccgcggccgcgctgctcctccgcccggcgctgacccgcccgatctccaccggcttccgcgaggagcgcgacaccttcggccccatccaggtccccaacgacaagctgtggggtgcacagacgcagaggtcgcttcagaacttcgacattggcggcgagcgcgagcggatgcccgtgcccatcatccgcgcctttggcgtgctcaaaaagtgcgccgctaaggtgaatatggagtatggacttgatccaacaataggcaaggcgataatgcaggcagctgaggaggtcgcagagggaaagctggatgatcacttcccacttgttatctggcaaactggtagtggcacacaaagcaacatgaatgccaatgaggtaattgcaaatagggcagctaagattcttggacacaagcgtggtgagaagtttgtgcaccctaatgaccacgtgaataggtcacaatcctccaatgatacatttcccactgttatgcatatagcagctgctgtcgagatcaattcaaaatttatcccaagtttgcaacagttgcatgattcacttcactcaaagtctgtcgagtttaatgacataatcaaaatcggacgtacacatacccaagatgccaccccgttaactcttggccaggagttcagtggttacactacacaggtcaaatatggaattgaccgaattaattgtacattacctcggatgtaccagcttgctcaaggtggaactgcagttggaactggcttgaacactaagaaaggatttgatgtcaaaattgccgctgcagtggccgaggaaacaaatctaccctttgtgacagctgagaacaagtttgaagctttggcagcacatgatgcttttgttgagagcagtggtgccgtaaacacaatttctgcgtcccttatgaagatagcaaacgacatacgcttgctgggaagtggccctcgctgtggtcttggtgaactaatcctgccagaaaatgagcctgggagcagcatcatgcctggaaaagttaatccaacacagtgtgaggctctgaccatggtttgcgctcaggttatgggtaatcatgttggtgttacagttggtggtgcgaatgggcattttgaactgaatgttttcaagccaatgattgcagctggattacttcgatcattgagattgttgggagatgcttctgtgtccttcgagaaaaattgtgtccggggaattcaagcaaaccataagagaatttcacagcttttgcatgagtctctgatgttggtgacatctttgaatcctaaaattggctatgacaatgctgcagctgtagctaagaaagctcacaaagaaggaaccacattaaagaaagctgcactagatcttggagtattaacggaagatgaattccatgagcttgtcgtcccagagaaaatgattggcccttctgattgataaccccatgctagctatgtttcttgaagcattcaggctgccacatctgagtttcattggttgcctgtgatgtcagaattcatgatgctggcccatccgtaaataaagcaaatcatatttcatatcatcattagctcctcaccccattggagacatgtttttgtacggcccatggtgcctgagaaaataacattcattcctgttcaaatagggagcagtgtactttggttaactggaagagatgcctttttccccctcttggacatcaaaaaaaaaaaaaaaaaaaa

SEQ ID NO: 1650 - protein, 498 aa, Panicum virgatum
  misc_feature: Ceres CLONE 1769148
  misc_feature (1)..(331): Pfam Name: Lyase_1 Pfam Description: Lyase
  misc_feature (16)..(498): SWISSPROT Homolog: EC 4.2.1.2 Fumarate hydratase 1, mitochondrial precursor
  misc_feature (32)..(498): SWISSPROT Homolog: EC 4.2.1.2 Fumarate hydratase 2, chloroplast precursor
MATALRRLAGVPGSPSAAAAAAALLLRPALTRPISTGFREERDTFGPIQVPNDKLWGAQTQRSLQNFDIGGERERMPVPIIRAFGVLKKCAAKVNMEYGLDPTIGKAIMQAAEEVAEGKLDDHFPLVIWQTGSGTQSNMNANEVIANRAAKILGHKRGEKFVHPNDHVNRSQSSNDTFPTVMHIAAAVEINSKFIPSLQQLHDSLHSKSVEFNDIIKIGRTHTQDATPLTLGQEFSGYTTQVKYGIDRINCTLPRMYQLAQGGTAVGTGLNTKKGFDVKIAAAVAEETNLPFVTAENKFEALAAHDAFVESSGAVNTISASLMKIANDIRLLGSGPRCGLGELILPENEPGSSIMPGKVNPTQCEALTMVCAQVMGNHVGVTVGGANGHFELNVFKPMIAAGLLRSLRLLGDASVSFEKNCVRGIQANHKRISQLLHESLMLVTSLNPKIGYDNAAAVAKKAHKEGTTLKKAALDLGVLTEDEFHELVVPEKMIGPSD

SEQ ID NO: 1651 - DNA, 1680 bp, Panicum virgatum
  misc_feature: Ceres CLONE 1769152
  misc_feature: Encodes the peptide sequence at SEQ ID NO. 1652
aaacaatcaataaactagcaaaagtcagcgcctcccccttatctcctcctcctccttccttccttcctccggggtgagccggccaagaaatccaaccactccgccgccgcccgccgatggaagaggagcgctgcttcaacaactgggacctggacgccgtcgtgcgcctgggctgccgcagccgcctctccccgccgcggcaggggggcaccaaccccttcgccgcgcttctgccgccgcagccgcggaaggagaaggagcaggagcaggcggagcctgccaaggagccggaggcagacaccgggtggcgcttcccggacctgtgcgccggcggcgggcaaggcggcgatgagctcctcagggcgctgctggccgcccagcctcccctgcctcagcctcagcctctgccaacgccaccatctccgccgacgccgccccagcgacagctgcagccggtggacgtgccgccgccaccccaggtgcacgcagctccggcggcttctgctccggcgagggcgcagccgagcgggcggccggtgcccggtggcgttccaagatccaagagaaggaagaaccaggtcaagaaggtggtctgccacgttcccgccgacagctcgtcgtcggacgtgtgggcgtggcgcaagtactgccagaagcccatcaagggctccccctacccaaggggatactaccggtgcagcagctccaaagggtgcgcggcgcggaagcaggtggagcgcagccgctcggaccccagcatcttcatcctcacctacaccggcgaccacaaccacgcggcgcccacccaccgcaactcgctcgccgggaccacccgccacaagttccccacatcctcctcggcggcgccccagccgccgccgccatccgtggtggtgtgcggcagcggcgctgccagccccggcgacgagccgcacccgcctcagcagccgagcccgggccggaattccacgccgacagcggggctttcccccacgacgccgctgcgcacaccgtccatggaggaggacgatgacgacgaggacgggctgcgggtggaggacattgagatggccggcgaggacgagctgctgttcatgaacactgacgacgacgacgcggcaccgctggagtcgatgccctcgctctttgacaccgtccacgagcccttcctgagctcttcctgggtgtcggcctccaccaccgccggcgagccacctacaggagcggccggggccaagagctgacttcttcaagagacaattgttgtgtgccctcgtcattgtagatgaaagaaatcaagggaaacagagagaggagaagacaagaaagcatatgatccgccatcctaatcgatccatcgatggcaacagcaccatgatagtatgatactagtactagttgtagcataagtagtcagtccagacctgtatcgagcttgatcaatcaccaaccaatccaaccttcttcactgactagaccaacatcttggcatttcattctctttttttttctcgcttttcttctttaggaatagttgaaactttgtatatctttctcttaggtgcctttttttttgtgcgaaactgaaagtggtagatgatgaaccaacaaaaaggagtgcaaaaatgaaggaaaaagtggatggtgtgtttgggtggctaaaaaaaaaaaaaaaaaaaa

SEQ ID NO: 1652 - protein, 375 aa, Panicum virgatum
  misc_feature: Ceres CLONE 1769152
  misc_feature: The sequence is a functional homolog of  SEQ ID NO 1020 in the  10/412,699 US patent application
  misc_feature: The sequence is a functional homolog of  SEQ ID NO 1021 in the  10/412,699 US patent application
  misc_feature: The sequence is a functional homolog of  SEQ ID NO 1024 in the  10/412,699 US patent application
  misc_feature: The sequence is a functional homolog of  SEQ ID NO 239 in the  11/479,226 US patent application
  misc_feature: The sequence is a functional homolog of  SEQ ID NO 26 in the  10/374,780 US patent application
  misc_feature: The sequence is a functional homolog of  SEQ ID NO 525 in the  10/374,780 US patent application
  misc_feature: The sequence is a functional homolog of  SEQ ID NO 526 in the  10/374,780 US patent application
  misc_feature: The sequence is a functional homolog of  SEQ ID NO 530 in the  10/374,780 US patent application
  misc_feature: The sequence is a functional homolog of  SEQ ID NO 76 in the  10/225,068 US patent application
  misc_feature: The sequence is a functional homolog of  SEQ ID NO 98 in the  10/412,699 US patent application
  misc_feature: Useful for making plants with modulated growth and phenotype characteristics
MEEERCFNNWDLDAVVRLGCRSRLSPPRQGGTNPFAALLPPQPRKEKEQEQAEPAKEPEADTGWRFPDLCAGGGQGGDELLRALLAAQPPLPQPQPLPTPPSPPTPPQRQLQPVDVPPPPQVHAAPAASAPARAQPSGRPVPGGVPRSKRRKNQVKKVVCHVPADSSSSDVWAWRKYCQKPIKGSPYPRGYYRCSSSKGCAARKQVERSRSDPSIFILTYTGDHNHAAPTHRNSLAGTTRHKFPTSSSAAPQPPPPSVVVCGSGAASPGDEPHPPQQPSPGRNSTPTAGLSPTTPLRTPSMEEDDDDEDGLRVEDIEMAGEDELLFMNTDDDDAAPLESMPSLFDTVHEPFLSSSWVSASTTAGEPPTGAAGAKS

SEQ ID NO: 1653 - DNA, 2030 bp, Panicum virgatum
  misc_feature: Ceres CLONE 1769161
  misc_feature: Encodes the peptide sequence at SEQ ID NO. 1654
accaaattgatagcccacctcacctcacctccgcacccgctgtttcgtgcaccgcacttctccccccacctacctctccccctcaaaaactatccgcctccgcccgccgacgagcgcgatcggtcgattcggttcgggccggccggagctcggaggggcggagcccagatccgggtgccggcggcgatgatgaagtcgctgctgccgcagagccagctgcggcgctcgtcggcgcggccgtcgggggccgccgccgccgcgggcggagacggggccgcggctgacggcggcggggccttggcgcgggcgcccgcctcgggcaccttctggttcctgctccacgcgctctgctgcctcatctcgctcttcctcgggttccgcttctcgcggctcctcttcttcctgctcttctccaccaccgcgctctaccactccaccacctcgtcctcctccgccgcagtcctgcgcgccaccacgacgaccacaaccaccacgaccacgacgaccaccaccaccaacattttcacgctctccttcgcggcggcgaaccctccgccctccaaccccgccaaccgcaccgcgctggaggcggcctcggcggcggacaagggcgcgacctccgggaacccccagagccacgtggtggtggggcggcacgggattcggatccgcccgtggccgcacccggaccccgtcgaggtgatgcgggcgcaccagatcatggagcgcgtgcaggaggagcagcgccgctggtacggcgtcaaggagccgaggcaggtgctcgtcgtcacgccgacctactcccgcgccttccaggcgctccacctcaccggcctactccactccctccgcaacgtgccgtacccgcttacctggattgtcgtcgaggcgggcggcaccaccaacgccacggcgtccctgcttgggcgctccggcctcaccttcgtccacgtccccttccctgaccacatgccccatgactgggcagaccgccatgctactgagaaccggatgcgcctccatgccctgcgggtgattcgggagaggaagatggatggcgtagtggtatttgcggatgacagcaatgttcatagcatggagctttttgatgaggtgcagaaggtccagtggatgggtgctgtatccgttggaatcctagcacatactggagcggcagaccaaccgcacctcagcgaggaggacaagcagaacatgcctcttccagttcaaggccctgcttgcaactcctctgggcatctggctggatggcacacatttaactcattgccattttctgggaagactgccacggtggttggcgaggcagcccctgttctgcccagaggtttggagtgggctggctttgtgttgaactcgagaatgctgtggaaggaggcaaagggcaagcctgactgggtgaaggatctcgatgctgtcggtgagaatggagaggagattgagaacccacttactctattgaatgatccgtcctctgttgaaccactggggaactgtggcaagaaggtcctgctgtggtggctccgcgtggaagctcgggctgatagcaagtttcctcagggatgggtgattgagccacctttggacattctcgttcctgcaaaacgcactccatggcctgaaaccaccaccgagcttccatccgagttgttggatgacaagcaagaccaggaagataggcggttgtcaagagccaacaaatcatctcggccccgaagcaccacgaaacggaagggtgaccttcaagggcaagtgaactgatgcaaattgtactggccttataatgtatatctcttacacctgcaaacacacagtaggaagcatgtccggttaatctggtggtggttgtgtttatttttttctgatgtttttgctcatgtggcaatggcctgtacttctgtagaatgggcactttttcctgtagttgtatctgtaatctgttgtgttgtaatgtacactgcattggaaactgagatggtggctgaattacagaaaaaaaaaaaaaaaaaaaa

SEQ ID NO: 1654 - protein, 530 aa, Panicum virgatum
  misc_feature: Ceres CLONE 1769161
  misc_feature (1)..(270): Pfam Name: Glyco_transf_43 Pfam Description: Glycosyltransferase family 43
MMKSLLPQSQLRRSSARPSGAAAAAGGDGAAADGGGALARAPASGTFWFLLHALCCLISLFLGFRFSRLLFFLLFSTTALYHSTTSSSSAAVLRATTTTTTTTTTTTTTTNIFTLSFAAANPPPSNPANRTALEAASAADKGATSGNPQSHVVVGRHGIRIRPWPHPDPVEVMRAHQIMERVQEEQRRWYGVKEPRQVLVVTPTYSRAFQALHLTGLLHSLRNVPYPLTWIVVEAGGTTNATASLLGRSGLTFVHVPFPDHMPHDWADRHATENRMRLHALRVIRERKMDGVVVFADDSNVHSMELFDEVQKVQWMGAVSVGILAHTGAADQPHLSEEDKQNMPLPVQGPACNSSGHLAGWHTFNSLPFSGKTATVVGEAAPVLPRGLEWAGFVLNSRMLWKEAKGKPDWVKDLDAVGENGEEIENPLTLLNDPSSVEPLGNCGKKVLLWWLRVEARADSKFPQGWVIEPPLDILVPAKRTPWPETTTELPSELLDDKQDQEDRRLSRANKSSRPRSTTKRKGDLQGQVN

SEQ ID NO: 1655 - DNA, 1466 bp, Panicum virgatum
  misc_feature: Ceres CLONE 1769167
  misc_feature: Encodes the peptide sequence at SEQ ID NO. 1656
atctcaccatatccgccgccgtcttctcgtcctcgacctcgcggcatctagatcccatctccccccgtctctcgtcgtcgcggcacccttcgccatgggcaagattaagatcggaatcaacggtttcggaaggatcggcaggctcgtggcccgtgtcgccctccagagcgaggatgtcgagctcgtcgccgtcaacgaccccttcatcaccactgagtacatgacctacatgttcaagtacgacaccgtgcacggccactggaagcacagtgacatcaaactcaaggactccaagacccttctcttcggtgagaagccggtcaccgtcttcggcttcaggaacccagaggagatcccgtggggtgaggctggcgccgactatgttgtggagtccacaggtgtcttcactgacaaggataaggctgcggctcacttgaagggtggtgccaagaaggttattatctctgctccaagcaaagatgccccgatgtttgttgttggtgtcaatgaggacaagtacacctcagatattaacattgtctccaatgctagctgcaccacaaattgccttgctcccctcgctaagatcatcaatgacaactttggtatcatcgagggtctgatgacaactgttcatgccatcactgccacccagaagaccgttgatgggccatcagccaaggactggagaggtggcagggctgccagcttcaacatcattcccagcagcactggtgctgccaaggctgttggtaaggttcttcctgaattgaacggcaagctcactggtatgtccttccgtgttccgacagttgatgtctccgttgttgacctcactgttagacttgagaaggctgcctcgtatgaggatattaagaaggctatcaaggccgcgtctgaggggcctctcaagggtattatgggatacacagaggaggatttggtttccaccgatttcactggtgacagcaggtcgagcatctttgatgccaaggctggaatcgctctgaacgagcacttcgtcaagctcgtctcctggtacgacaacgagtggggctacagcaaccgtgtcgtcgacctgatccgccacatattcaagacccagtagagcatttccgcttgatggttctattcccatgggcttttctggtggtggaccggcctgctgcttgtctatgcagtgaataaatgtgaatggcgcccaccttacgccaggattcatgctaagttgggacatgggttgccttttgtttttcgtatcagccaccatcctgtaacgaaattgctaatatggacctgggttagttttttgctcgtgaagaatataaacaggcggttgtaattttgctgtgttggtggtcggtttgttgagtttttggtgatgacattctcgtgcatggtcctgcttagttttctgctgtcttatgcaatcatcatgattggttcaaaaaaaaaaaaaaaaaaaa

SEQ ID NO: 1656 - protein, 337 aa, Panicum virgatum
  misc_feature: Ceres CLONE 1769167
  misc_feature (1)..(151): Pfam Name: Gp_dh_N Pfam Description: Glyceraldehyde 3-phosphate dehydrogenase, NAD binding domain
  misc_feature (1)..(158): Pfam Name: Gp_dh_C Pfam Description: Glyceraldehyde 3-phosphate dehydrogenase, C-terminal domain
  misc_feature (1)..(337): SWISSPROT Homolog: EC 1.2.1.12 Glyceraldehyde-3-phosphate dehydrogenase, cytosolic 1
  misc_feature (1)..(337): SWISSPROT Homolog: EC 1.2.1.12 Glyceraldehyde-3-phosphate dehydrogenase, cytosolic 2
MGKIKIGINGFGRIGRLVARVALQSEDVELVAVNDPFITTEYMTYMFKYDTVHGHWKHSDIKLKDSKTLLFGEKPVTVFGFRNPEEIPWGEAGADYVVESTGVFTDKDKAAAHLKGGAKKVIISAPSKDAPMFVVGVNEDKYTSDINIVSNASCTTNCLAPLAKIINDNFGIIEGLMTTVHAITATQKTVDGPSAKDWRGGRAASFNIIPSSTGAAKAVGKVLPELNGKLTGMSFRVPTVDVSVVDLTVRLEKAASYEDIKKAIKAASEGPLKGIMGYTEEDLVSTDFTGDSRSSIFDAKAGIALNEHFVKLVSWYDNEWGYSNRVVDLIRHIFKTQ

SEQ ID NO: 1657 - DNA, 1629 bp, Panicum virgatum
  misc_feature: Ceres CLONE 1769175
  misc_feature: Encodes the peptide sequence at SEQ ID NO. 1658
accagccttctcagttcacacgtcccgtccctaattcggcaactcccgctgcctcggccttgacctagggtttcggcgcctgatctcctaccctccccgtcctcgccgtgtccctcgctcgtttcaactcgccatccggcaaaccggaggcgaaggcgagcgggggcgcctctcttcggtcaccgcgtgaacgatttgaggccgcgcgtccatggcggcgacggggcagcaggaggatgacatcgaccactacgaggtgctctgcctcccgtcgggggaggaaggcgccgcgctgaccatcgagcagatcgagaaggcctaccggacgcagtcgcggctgcgccaccccgacaagcgccgcgacgaccccaacgccactgcggacttccagcgcctctcgagctcctacaagctcctctgcgacgagtcccttcgccgccagttcgatgctcgcctacgcggccgccgggaggcagcggcccgcgccgccgccgcgggcgtcaagcgccgcaaggctgtctccgacctcgaggagcgtgagcgcgctgccgccgcgggccagcacgccgaccccgaagagcttgcgaagcgcgagatggagcgggcggccgccgacatccagcgcgagctcgacgagttccgcgtcgccaagcaggctgccgcctcaggtgccggggcaacttcggcgtatggggataagaagggtggaacctcgcaagatggggtgaaaacagacaagggcaagatcttgaaggtttcatgggatgggagtgccgattcttacactgcagcaaagttggaagaactcttccagaaatttggcaaagtcgaagatgtagtgatcaagacaaggaaatcgaggaggaagggctcagcaattgtagtcatgggcagcaaggaagctgctctgttagcaatacagaaccatttttctcttttcccattaaatgttgctcctgttcaagaatcgggtgggttaccagcaaggtcagctcaagcccatgaatcgaggacaagcaacattgatggaactggatttagcgatttggaagcatcggtattccggaaacttcaagaggcccagaaaaggaaacaatgtggttgattgcttctttctgaaacatgagtattgttgacatgtcgcacaatggacagtaccgagtattcctgtggcagatgagttacagaaagagctacacatttttttaggtggagtcttgttgctgataaatttatccaactcagagcaactacagatttttttttgtgtcaatgtacaaactgtaccatgtatgtagtttgtaattctaattcctactccctccgtcccaaaaagaatgcaactctcgcttttcctagaagtcaaacaatttcaagtttgactaaatttatacaaaaaattactaacatttatgtctttaaatagacttagtatgaaaatatattacataattaatctaatgatatttatttggtaccataacaattaatactattttgtataaatttggtcaaatttaaaattgtttgattccttaggaaacgagagatgcattctttttgggaggggggagtaattatgttctggagtatgtcattgtcatgtcacaaaaaaaaaaaaaaaaaaaa

SEQ ID NO: 1658 - protein, 297 aa, Panicum virgatum
  misc_feature: Ceres CLONE 1769175
  misc_feature (1)..(68): Pfam Name: DnaJ Pfam Description: DnaJ domain
MAATGQQEDDIDHYEVLCLPSGEEGAALTIEQIEKAYRTQSRLRHPDKRRDDPNATADFQRLSSSYKLLCDESLRRQFDARLRGRREAAARAAAAGVKRRKAVSDLEERERAAAAGQHADPEELAKREMERAAADIQRELDEFRVAKQAAASGAGATSAYGDKKGGTSQDGVKTDKGKILKVSWDGSADSYTAAKLEELFQKFGKVEDVVIKTRKSRRKGSAIVVMGSKEAALLAIQNHFSLFPLNVAPVQESGGLPARSAQAHESRTSNIDGTGFSDLEASVFRKLQEAQKRKQCG

SEQ ID NO: 1659 - DNA, 1341 bp, Panicum virgatum
  misc_feature: Ceres CLONE 1769200
  misc_feature: Encodes the peptide sequence at SEQ ID NO. 1660
acttgcttgcttgcttgattgattgctttccgtgtagccgaagaagaatcaatccaccgtccgctcgcctcaggagaagaaccaatcaatggcgcccctcggagacggatcagcttccggcgcgtcgcccaacctggtggtgtcgttcggcgagatgctcatcgacttcgtgcccgacgtggcgggcctctcgctcgccgagtcgggcggcttcgtcaaggcccccggcggcgcgcccgccaacgtcgcctgcgccatctccaagctcggcggctcctccgccttcctcggcaagttcggcgacgacgagttcgggcacatgctggtgaacatcctgaagcagaacggcgtcaactcggagggctgcctcttcgaccagcacgcgcgcaccgccctggccttcgtcaccctcaagaagaacggcgagcgcgagttcatgttctaccgcaaccccagcgccgacatgctgctcaccgaggccgagctcaacctcgacctcatccgccgcgccaagatcttccactatggctccatctcgctcatctccgagccctgccgcggcgcccacctcgccgccatgcgcgccgccaaggccgccggcatcctctgctcctacgaccccaacgtgcgcctcccgctctggccctcggaggaggccgccagggccggcatcctcagcatctggaaggaggccgacttcatcaaggtcagcgacgacgaggtcgccttcctcacccagggcgacgccaccgacgagaagaacgtgctctcgctctggttcgacgggctcaagctcctcatcgtcaccgacggcgacaaggggtgcagatacttcaccaaggacttcaagggcagcgtgcccggctacaaggtgaacaccatcgacaccaccggcgccggtgacgccttcgtcggctccctgctcgtcaacgtcgccaaggacgactccatcttccacaacgaggagaagctccgcgaggcgctcaagttctccaacgcctgcggcgccatctgcaccacccagaagggcgccatcccggcgctgcccaccgtcgccgccgcgcaggagctcatcgccaagggcaactagacgccgccgctgcggccaccaccgtgccgccttggtcgcccctcgacgtcgtcatccttttaattcgtattattaggaggttgttagctgctcttcttaattattagatggctggtggtgtgttctcgtgcgggttaatttagctcagtgtggtgtgcggtgtgtgagatgaacatggttttcgcccggggcattaataaaagttggcatgcgtggtggattttttttagcaaaaaaaaaaaaaaaaaaaa

SEQ ID NO: 1660 - protein, 333 aa, Panicum virgatum
  misc_feature: Ceres CLONE 1769200
  misc_feature (1)..(331): SWISSPROT Homolog: EC 2.7.1.4 Fructokinase-2
  misc_feature (1)..(333): SWISSPROT Homolog: EC 2.7.1.4 Fructokinase-2
MAPLGDGSASGASPNLVVSFGEMLIDFVPDVAGLSLAESGGFVKAPGGAPANVACAISKLGGSSAFLGKFGDDEFGHMLVNILKQNGVNSEGCLFDQHARTALAFVTLKKNGEREFMFYRNPSADMLLTEAELNLDLIRRAKIFHYGSISLISEPCRGAHLAAMRAAKAAGILCSYDPNVRLPLWPSEEAARAGILSIWKEADFIKVSDDEVAFLTQGDATDEKNVLSLWFDGLKLLIVTDGDKGCRYFTKDFKGSVPGYKVNTIDTTGAGDAFVGSLLVNVAKDDSIFHNEEKLREALKFSNACGAICTTQKGAIPALPTVAAAQELIAKGN

SEQ ID NO: 1661 - DNA, 1633 bp, Panicum virgatum
  misc_feature: Ceres CLONE 1769212
  misc_feature: Encodes the peptide sequence at SEQ ID NO. 1662
aactgaagccgcacaacaggaacagggcacccaccgacaccggcgatggcgcccgccgtgtcctccccgacgccgcacgtggccgtggtagcgttcccgttcggctcccacgcgccggcgctgctcgccttcgcgcgcgcgctggccgccgccgcggcgcccgcgggggccacgctctcgttcctctccaccgcgggctccatcgcgcagctccgcggggcggctagcgccgagatcccggggaacctgcgcttcgtggaggtcccggacggcgccgggctgcccgcggccaaggggcccgtgccggtgccagtgccgcggcagatggagctgtttatggccgccgcggaggccggcggcttgaaggccgggctggaggcggcccgcgccatggcgggcggcgccagggtgagctgcgtggtcggggacgctttcgtgtggcccgcggcggaggcggccgccgcggcggggtcgccgtgggtgccggtgtggatgggcgcgccgtgcgcactcctggcgcacctccgcaccgacgcgctccgggcggaagtcggcgaccaggccgcgagcagggcggacgagctgctggcctcgcacccgggcctcggcagctactgcgtcggcgacctccccgacggcgtcgtctccggtgacttcaaccacgtcatcagccgcctcgtccaccgaatggggcagctcctcccgcgcgccgccgccgccgccgtggcgctcaacaccttcccgggcctcgacccgcccgacttcaccgcggtcctcgcggagacgctccccaactgcctcccgctcgggctcggcctcgaccacctcctcctccccaaggacatcaccgacgccgcggcgccaacagcaggcgacccgcacggctgcctcgcctgggtggacgctcacccggcgcgctcggtggtgtacgtcggcttcggcagggtggcgtccccgcgctccgacgagctccgggagctggctgccgggctggagtcctccggtgcgccgttcctgtggtccctgcgcgaggactcgtggccgctcctgcccgaggggttcctggcccgcgccgcggccgccggcgccgggctcgtggtcccctgggcgccgcaggtggccgtgctgcgccatgcgtccgtgggcaccttcgtgacgcacgccgggtgggggtcggtgctggaggccctgtccagcggcgtgcccatggcgtgccgccccttcttcggggaccaccggatgatcgcgcggtccgtggcgagcgtgtggggagtcggcgtggcgttcgagggcgccgcgatgacgcgcgccggggtggccgccgccgtgggggagctgctgcgcggggaggaaggggcgaggatgagggccagggcgcaggagctgcaggccgctgcggccgcggcgttcgcgcccggcggcgcgtgcaggaggaacttcgacgagttcgtggagatagtctgtcgcgtgtgaagtcctgttgccggattcatacctcttgccgggcgatccaactgtaactggttttacgtattcaggggtttctgtagagctagtgttgtgctgaatgcttcatttcctttctctcttttttttggatatataatatatttgaatgcttcatttctcgtag

SEQ ID NO: 1662 - protein, 475 aa, Panicum virgatum
  misc_feature: Ceres CLONE 1769212
  misc_feature: Great-hit functional homolog of the protein sequence given in SEQ ID NO 9323
  misc_feature (1)..(474): SWISSPROT Homolog: EC 2.4.1.115 Anthocyanidin 3-O-glucosyltransferase
  misc_feature: Useful for making plants with modulated flowering time
  misc_feature: The plant flowers significantly late compared to wild-type.
MAPAVSSPTPHVAVVAFPFGSHAPALLAFARALAAAAAPAGATLSFLSTAGSIAQLRGAASAEIPGNLRFVEVPDGAGLPAAKGPVPVPVPRQMELFMAAAEAGGLKAGLEAARAMAGGARVSCVVGDAFVWPAAEAAAAAGSPWVPVWMGAPCALLAHLRTDALRAEVGDQAASRADELLASHPGLGSYCVGDLPDGVVSGDFNHVISRLVHRMGQLLPRAAAAAVALNTFPGLDPPDFTAVLAETLPNCLPLGLGLDHLLLPKDITDAAAPTAGDPHGCLAWVDAHPARSVVYVGFGRVASPRSDELRELAAGLESSGAPFLWSLREDSWPLLPEGFLARAAAAGAGLVVPWAPQVAVLRHASVGTFVTHAGWGSVLEALSSGVPMACRPFFGDHRMIARSVASVWGVGVAFEGAAMTRAGVAAAVGELLRGEEGARMRARAQELQAAAAAAFAPGGACRRNFDEFVEIVCRV

SEQ ID NO: 1663 - DNA, 1742 bp, Panicum virgatum
  misc_feature: Ceres CLONE 1769243
  misc_feature: Encodes the peptide sequence at SEQ ID NO. 1664
ccgttccatccatccattggctatttggctcccttcgctcagtccagtttctcccccactcctcaccactctgcttgctccgctgctctgctccgcctcaatcagtgagagctgccatccactgacccgccgcgagcgccaatggcggcggccgcggccctggcagcggccgtgctggcgctgtcatgcttcggcgcgcccgcgacggcggaggcggaggcggaggcggaccgcatctgcagcctgccggggcagccgccggtcaacttctccatgtactccgggtacgtcaccgcggacgcggccgcggggcgggcgctcttctactggctcatcgaggcggccggcgcgcccgcggagtccgcgccgctcgtgctctggctcaacggcgggcccgggtgctcctccgtcggttacggcgcgtccgaggagctcggcgccttccggatcaaccccgacggcaggtcgctctccttgaacgcttacccctggaacaaagtggcgaacattctgttcctggactcgccggccggcgtcggctactcctactccaacaccacggccgatctgtacaccgccggtgacaacaagacagctcatgattcgtacaatttcttggtgaattggctggagcggtttccgcagtacaagcatcgcgatttctacatcacgggagagagctacgcaggtcactacgtgcctcagctgtctcagctagtgtaccggaacaacaaaggaattagaaagccaatcctgaacttcaaaggcttcatggtcggaaacgcggtaattgacgactaccatgactacatgggcacatttgagtactggtggacgcatgggcttatctctgatgaaacctatgagaacttgcgattagcctgtgagtttgattcagctgagcacccctctaagaaatgcgacaagatctacgatatcgctgaggctgagcaagggaatattgatgcgtacagtatctacacgcctacttgtaagaagacttcacttcacaagcgcaggttgataaaaggaagaatgccctggttgccgagaggatatgatccctgcaccgagaactacgcaacaaagtactataacttacctgaggtgcaggaagctttgcatgccaatgtcactggaataccatatgcctgggtagcctgcagtgatccaatttttgactattggaaagattcaccgaagtccatgcttcctatttaccgtgaacttattgctgcaggcataaggatatgggtcttcagtggtgatgctgattctgttgtccccctaaccgcgacaagatactccatcgatgcgctctctctaccaaccgtgacaaactggtatccttggtacgacgatgaagaggttgctggatggtgccaagtttacaaaggtttgacgctggtgacgatccgcggcgcggggcacgaggttcccctccaccgtccgcggcaagccctgaagctcttcgagcacttcctgcgcgacgagcccatgcccaagcctgtagatagcattcagacgttttagaatgtgctatctcgcttgtcttgtcgtggaagaacaaaatgcgccaagccatcttgttgtaaaatatctgttgccacattttcaggcaaacgtatttcgcctgtgataaaaaacaataggtctttcgaaaaaaaaacaataatcaggatagaataatgctcattggagtggacggggcagttctttgccaaaaaaaaaaaaaaaaaaaa

SEQ ID NO: 1664 - protein, 463 aa, Panicum virgatum
  misc_feature: Ceres CLONE 1769243
  misc_feature (1)..(415): Pfam Name: Peptidase_S10 Pfam Description: Serine carboxypeptidase
  misc_feature (2)..(454): SWISSPROT Homolog: EC 3.4.16.6 Serine carboxypeptidase 2 precursor
  misc_feature (29)..(454): SWISSPROT Homolog: EC 3.4.16.6 Serine carboxypeptidase 2 precursor
MAAAAALAAAVLALSCFGAPATAEAEAEADRICSLPGQPPVNFSMYSGYVTADAAAGRALFYWLIEAAGAPAESAPLVLWLNGGPGCSSVGYGASEELGAFRINPDGRSLSLNAYPWNKVANILFLDSPAGVGYSYSNTTADLYTAGDNKTAHDSYNFLVNWLERFPQYKHRDFYITGESYAGHYVPQLSQLVYRNNKGIRKPILNFKGFMVGNAVIDDYHDYMGTFEYWWTHGLISDETYENLRLACEFDSAEHPSKKCDKIYDIAEAEQGNIDAYSIYTPTCKKTSLHKRRLIKGRMPWLPRGYDPCTENYATKYYNLPEVQEALHANVTGIPYAWVACSDPIFDYWKDSPKSMLPIYRELIAAGIRIWVFSGDADSVVPLTATRYSIDALSLPTVTNWYPWYDDEEVAGWCQVYKGLTLVTIRGAGHEVPLHRPRQALKLFEHFLRDEPMPKPVDSIQTF

SEQ ID NO: 1665 - DNA, 1720 bp, Panicum virgatum
  misc_feature: Ceres CLONE 1769251
  misc_feature: Encodes the peptide sequence at SEQ ID NO. 1666
agccaacccaccaccaccggatcagcttcctcccggattaggcggcgccagccgaggacaccgtcggaaccaaccaaccacccgaacaaggcgcccagaatggagaacggcaacggcggcccgtcgtcgtgctgcaacggcaacggctcggtggcgccgccgcacgtggcgatgctggtgacgccggggatggggcacctgatcccgctggcggagctggccaagcggctggcgtcgcggcacggcgccacggcgacgctcctcacgttcgcgtcgacggcgtcggccacgcagcgcgcgttcctggcgtcgctgccgcccgccgtgtcgtcccgggcgctcccgcccgtcgacctctccgacctgccccgcggcgccgccatcgagacgctcatgtccgaggagtgcgcgcgcagcgtgccggcgctcaccggcatcctccgggacctgcggcggaccacccgcctcgtcgcgttcgtcgccgacctcttcggcgcggactcgttcgacgccgcgcgcgccgcgggggtcgcccggaggtacatcttcttcccgaccaacctccacgtgctcacgctcctcctccacctcccggagctcgacgcctccgtgcccggcgagttccgggacctcgccgagccgctccgcctccccgggtgcgtgcccatcccggggcccgacgtgctcatgccgctgcaggacaagtccaacccctgctacaagtggatggtccaccacggcgccaagtaccgcgaggccgacgccatcctcgtcaactccttcgacgccgtcgagccgggccccgccaagatcctccggcagccggcgcccgggaacccggcggtgttccccatcggcccgctcatccaggccgaccgcggcggcagcgacgacgggccgtgcccgtgcctggagtggctcgaccggcagccggcccgctcggtcatcttcgtctccttcggctccggcggcgcgctgccggccgagcagatgcgggagctcgccctcggcctggagctcagcgggcagcgcttcctgtgggtggtgcgcagccccagcgacgagggcgccgtcaacgacaactactacgacgccgagagcaagaaggaccccttcgcgtacctgcccgaaggcttcgtcgagcggacccgggccgtgggcctcgtggtgccctcgtgggccccgcagataaaggtgctggcccacggggccacgggcgggttcctgacgcactgcgggtggaactcggtgctggagagcctcgtctacggcgtgcccatggtggcgtggccgctctacgccgagcagcggcagaacgcggcgatgctgtcggaaggggtcggcgccgcgatccgcgtccccgagtccaaggggcgggagaagatcgcggcggcggtgcgggaggtgatgcagggggaaggccgaggtgccgcggtgcgagctaaggtggcggagctgcagaaggccgcggcggaagggctccgggaaggcggcgccgcggccgcggcgctcgccgaggtggtggagaagtggacgtgcggggagaactagacgatgctgagcctgaactgtgtgcagctaccaccaatccatcccagctgcccctccaccatccttgggctggggccccaccatgcatggtttgtccttttgtaaactattccagacttttggtttgtatttttggccacagtttcggcaaaaaaaaaaaaaaaaaaaa

SEQ ID NO: 1666 - protein, 483 aa, Panicum virgatum
  misc_feature: Ceres CLONE 1769251
  misc_feature: Great-hit functional homolog of the protein sequence given in SEQ ID NO 9586
  misc_feature (1)..(148): Pfam Name: UDPGT Pfam Description: UDP-glucoronosyl and UDP-glucosyl transferase
  misc_feature (21)..(478): SWISSPROT Homolog: EC 2.4.1.218 Hydroquinone glucosyltransferase
  misc_feature: Useful for making plants with altered Lignin content
MENGNGGPSSCCNGNGSVAPPHVAMLVTPGMGHLIPLAELAKRLASRHGATATLLTFASTASATQRAFLASLPPAVSSRALPPVDLSDLPRGAAIETLMSEECARSVPALTGILRDLRRTTRLVAFVADLFGADSFDAARAAGVARRYIFFPTNLHVLTLLLHLPELDASVPGEFRDLAEPLRLPGCVPIPGPDVLMPLQDKSNPCYKWMVHHGAKYREADAILVNSFDAVEPGPAKILRQPAPGNPAVFPIGPLIQADRGGSDDGPCPCLEWLDRQPARSVIFVSFGSGGALPAEQMRELALGLELSGQRFLWVVRSPSDEGAVNDNYYDAESKKDPFAYLPEGFVERTRAVGLVVPSWAPQIKVLAHGATGGFLTHCGWNSVLESLVYGVPMVAWPLYAEQRQNAAMLSEGVGAAIRVPESKGREKIAAAVREVMQGEGRGAAVRAKVAELQKAAAEGLREGGAAAAALAEVVEKWTCGEN

SEQ ID NO: 1667 - DNA, 1874 bp, Panicum virgatum
  misc_feature: Ceres CLONE 1769254
  misc_feature: Encodes the peptide sequence at SEQ ID NO. 1668
cgtgccgtggccacgcttcgtgctgttgcctcgtgagtcgtgagcgtgtctccaccgccagccgcgccattccccctgcctggctccgacacggcgacaccccggccctccacgcgcgcgcccgacggaacggaatgccggcggagcgcgtcgacgtcgcggtcctctcgaggacgctggtgcgggcgtccgacccgccgcggggcttccccgcggtcctcccggtctccaacctcgacctcatcctcggctccttccacatctacctcgtgtccgtctaccccgccccggccgcgggcttccccgccgtggccgcggccgcgcgcgccgccctgccggccttcctctcccgcttcttccccttcgccggccgcgtcgtggccgacgcctccaccggcgtgcccgcggtcgcctgcgacaacgccggcgcggagctcgtggtggcggaggccgcggcgcggctggcggacgtcgacttcgccgacgccgaccgctcgctcgcccgcctcgccgtgccgttccagcgcggcctcgcgctgtcgctgcagctcgtccggttcgcctgcggcgggttcgcgctctcgtggggcaccgaccacctgctcgccgacggccacggcatcacggcgctgcccaacgcgtgggcggagctgctccgcaccggcggcctctcgtgggagccgcaccacgagcgggcgtccctcttccgcccgcgctcgccgccgcggttcagcccgtcgctggacgccgagttcacgcggtacgcgccggcgcgcctccccaacgcgctcctcgcggccgccctcgtgcgccgcaactacgtggtcgccgccgcggacgtcgcccgcctccgcgccgcggccagcaccccggcccgccgcgccacccggctcgaggccctgtccgcgcacgtctggaagctgctcgccgcggccgcgcgcggctccgacgagcgctgctgccgcatggcgtggctcgtcgacggccggccccgcctcgacccctccagattcgacgccggcaccgtgcgccggtacctcggcaacgtgatcacgtacgcgtcgcgggaggcggccgtggacgccgtgtcgtcgtccccgctgcccgaggtggcggcgatggcgggcgcggccatcgcaggggtgttccggtcggagcggttcgaggagctggtggactggatggaggcgcgcaagggggtgttccgggagggcggcaagtggacggaggcggtgggcgtgggcacggggagccccgcgctggtggtctcggcgttcgtggcgttccgcgtggagggggacttcgggttcgggcgcccgcggctggtgatgccgtgggtgcgcccggggcggctgggctcggcggccatgacggtggcgcggagcccgcgggaggacgggtcctgggtgatcaccgccaggctgtggccgcgcttggccgacgccgtggacgcggacccggaggccgtgctcaagccggccacggccgcggcgctcgggttcgccgcgctcgagccggcagacgtggcgccgcacgcgagccgcttgtgagggacgagcctactacccgtggccctcagtgcaagtgcagggcggctgggagctgtggcgccgacacgctgtacagtggcaattcttaagtcttcttgtccgtgccatctcaagacaaaatattttggaccgtggtgttcaattacttttcccccgtgccggtccttgcgacaagttttcagtcgtgaccgaacaagtagctgtccgactatccagaccttttgcaaaagtgtatctttgcaagtgaaggggtgatgtcaggagattattctgtaattacctttttctacatttgaattattccaaaaaaaaaaaaaaaaaaaa

SEQ ID NO: 1668 - protein, 471 aa, Panicum virgatum
  misc_feature: Ceres CLONE 1769254
  misc_feature (3)..(440): Pfam Name: Transferase Pfam Description: Transferase family
MPAERVDVAVLSRTLVRASDPPRGFPAVLPVSNLDLILGSFHIYLVSVYPAPAAGFPAVAAAARAALPAFLSRFFPFAGRVVADASTGVPAVACDNAGAELVVAEAAARLADVDFADADRSLARLAVPFQRGLALSLQLVRFACGGFALSWGTDHLLADGHGITALPNAWAELLRTGGLSWEPHHERASLFRPRSPPRFSPSLDAEFTRYAPARLPNALLAAALVRRNYVVAAADVARLRAAASTPARRATRLEALSAHVWKLLAAAARGSDERCCRMAWLVDGRPRLDPSRFDAGTVRRYLGNVITYASREAAVDAVSSSPLPEVAAMAGAAIAGVFRSERFEELVDWMEARKGVFREGGKWTEAVGVGTGSPALVVSAFVAFRVEGDFGFGRPRLVMPWVRPGRLGSAAMTVARSPREDGSWVITARLWPRLADAVDADPEAVLKPATAAALGFAALEPADVAPHASRL

SEQ ID NO: 1669 - DNA, 1629 bp, Panicum virgatum
  misc_feature: Ceres CLONE 1769255
  misc_feature: Encodes the peptide sequence at SEQ ID NO. 1670
atcctcacgggactcccccccttctcctctgtttcttcctcccccttcctcccccacgccctcgctcgcggctggaggtggtggccgtagcgtgcgtcgcgaggcctccggttggttcatggcgctgccgctccgatcctagctgcgcaccgcccccggccaggagcgccacccccctctccctctctcgttaaaaaatggcgacgatggtggatcctccgaatggaataggaagccaaggaaagcattactactctatgtggcaaacattatttgagattgacaccaaatatgtgccgatcaagcccatagggcgaggagcttacggaatagtttgttcatccatcaaccgcgagacaaatgagaaagtagcaataaaaaagattcacaatgtttttgacaaccgggtggatgcactaaggaccttgcgggagttgaaactccttcgccatctccgccatgaaaatgtcattgctttgaaggacataatgatgccagtacacaggaggagctttaaagatgtgtacttggtctatgagctcatggatactgatttgcatcagataatcaaatcacctcagggactttctaatgaccactgccagtattttctttttcagttgctccgaggactgaagtatctccattcagcagaaatactccacagagacctaaaacctggaaacctgctggtgaatgcaaactgtgatctgaagatatgtgatttcggtcttgcgcgtacaaacagtagtaaaggccagtttatgaccgaatacgtcgtcacccgctggtacagagctcctgaattgctcctctgctgtgacaactacggcacttccatagatgtttggtctgttgggtgcatctttgctgaactccttggtcggaagccaatatttccaggaactgagtgcctaaaccagctcaagctcatagtaaatgttctcggcacgatgggtgagtctgacctagagttcatcgacaacccgaaagctcggagatacatcaagtcccttccctacactcctggtgtccccctcgcaactatgtacccacatgctcaccctcttgccattgatctactgcagaagatgctcatcttcgaccccaccaaaaggattagtgtcaccgaggctcttgagcacccttacatgtcccctctgtatgatccaagcgcgaatcctcctgcccaggtgcccatcgatctcgacttagacgagaacatcagctcggagatgatcagagaaatgatgtggcaagagatgctccactaccaccctgaagtcatcacgacaataagcatgtcatgatcttgcactgccccaggacctcggcaggcacacttttttttttataaaagcctactgtgatgcgattgccaattatggcgtctagctgttgtagcacccttaatgtctgtttggatacttcgcttgtgtaaatatgatgcgccgaataggagtggcgtatggatatcctttatctttatggaccatcatatggtgtatgtatactgtatatcagtcgactgtcgttatgttgtatgagttcgtgacactctgttaaagtgaacccagtaatcccatgagtacttagtttcagttcgtataaaaaaaaaaaaaaaaaaaa

SEQ ID NO: 1670 - protein, 370 aa, Panicum virgatum
  misc_feature: Ceres CLONE 1769255
  misc_feature (1)..(368): SWISSPROT Homolog: EC 2.7.11.24 Mitogen-activated protein kinase 3
  misc_feature (1)..(369): SWISSPROT Homolog: EC 2.7.11.24 Mitogen-activated protein kinase 4
MATMVDPPNGIGSQGKHYYSMWQTLFEIDTKYVPIKPIGRGAYGIVCSSINRETNEKVAIKKIHNVFDNRVDALRTLRELKLLRHLRHENVIALKDIMMPVHRRSFKDVYLVYELMDTDLHQIIKSPQGLSNDHCQYFLFQLLRGLKYLHSAEILHRDLKPGNLLVNANCDLKICDFGLARTNSSKGQFMTEYVVTRWYRAPELLLCCDNYGTSIDVWSVGCIFAELLGRKPIFPGTECLNQLKLIVNVLGTMGESDLEFIDNPKARRYIKSLPYTPGVPLATMYPHAHPLAIDLLQKMLIFDPTKRISVTEALEHPYMSPLYDPSANPPAQVPIDLDLDENISSEMIREMMWQEMLHYHPEVITTISMS

SEQ ID NO: 1671 - DNA, 1318 bp, Panicum virgatum
  misc_feature: Ceres CLONE 1769277
  misc_feature: Encodes the peptide sequence at SEQ ID NO. 1672
acacaaaaagctcactctctgaaaccaagagggcatcaaaccctttctttgagcaccaatggcacggtatcttctcgctcccacctccacctcctcctccctcctccccaaggacggcgccaagaactcgccgccgtcgcggactctccgcctccccgtgcttggctccaggtccggcaaggcgccccccatcatggcggtggcgtcggagcagacggccactcccgcgaagtaccctaaggtggccgcccccaccaccggcccgatccccgccgacgagctgctcggcgtcatcgaggccgccgcaaaagctggggccgatgttataatggaagctgttaacaaaccacgcaatatccactataaaggtgttgcagacttggtcacagacacagacaagttgagtgaatcagtgattctggaagttgtcacgaagaacttcaaaaaccacctcatacttggggaggaaggtggctttattggggattccttgtcagagtatctctggtgcattgaccctttagatggaacaacaaactttgcacatggttatcccagcttttctgtgtccattggggttctcttccgtggaaagccagttgcttccactgtggtggaattttgtggtgggcctatgtgctggagcacccgtacaatttctgcatcttctggtggaggagcttattgcaatgggcagagaattcatgtcagtcagacagacaaggtggagcaatctcttcttgtcacagggtttggatatgaacacgatgatgcttggacaaccaatataaatttgttcaaagaatttactgacattagcaggggagtgcgaaggctagggtctgctgctgctgacatgtctcatgttggactgggcatttcagaagcctactgggaataccagcttaagccatgggatatggctgctggtgtcctgatagttgaagaagctggtggggtggtaacacgcatggatggtggagcatttacagtctttgatcgttctgttcttgtttccaatggtcttgttcatggacagctgttggatcggattgggcctcctactgaagatcttaagaagaaaggaattgatttttcgttgtggttcaagcccgacaagtacccaaccgacttttgagtttcaccagagccgtggactatcataataaatcagccatcatctgttgttttccttcatgaaaaaatagtaacgttcaattcaacagcgatgtacctaaacagacaaatacaatgtacagtccttcgactcaactttcagagattcaagagccaagctcgaaaaagaatacagctttac

SEQ ID NO: 1672 - protein, 359 aa, Panicum virgatum
  misc_feature: Ceres CLONE 1769277
  misc_feature (1)..(271): Pfam Name: Inositol_P Pfam Description: Inositol monophosphatase family
MARYLLAPTSTSSSLLPKDGAKNSPPSRTLRLPVLGSRSGKAPPIMAVASEQTATPAKYPKVAAPTTGPIPADELLGVIEAAAKAGADVIMEAVNKPRNIHYKGVADLVTDTDKLSESVILEVVTKNFKNHLILGEEGGFIGDSLSEYLWCIDPLDGTTNFAHGYPSFSVSIGVLFRGKPVASTVVEFCGGPMCWSTRTISASSGGGAYCNGQRIHVSQTDKVEQSLLVTGFGYEHDDAWTTNINLFKEFTDISRGVRRLGSAAADMSHVGLGISEAYWEYQLKPWDMAAGVLIVEEAGGVVTRMDGGAFTVFDRSVLVSNGLVHGQLLDRIGPPTEDLKKKGIDFSLWFKPDKYPTDF

SEQ ID NO: 1673 - DNA, 2722 bp, Panicum virgatum
  misc_feature: Ceres CLONE 1769278
  misc_feature: Encodes the peptide sequence at SEQ ID NO. 1674
gagagcgtgcagagcgagacacgtcgtccctccccaccccactcacccccgccgccggcccgtgcgttcccccgcccgcgtagggttagggttcggtcccgccgccatggcgatcctctcggcgctcgcgaccgaggtgctcatccccgtcgccggcgtcatcggcatcgccttcgccgtcgtgcagtgggtgctcgtgtcgcaggtgaagctctccccggccgcggccgccgcgggcggcagcaagaacggctacggcgactacctcatcgaggaggaggagggcctcaacgaccacaacgtcgtcgtcaagtgcgccgagatccagaacgctatctccgaaggagcaacatcgtttctcttcacagagtaccaatatgttggtattttcatgtcgatctttgctgttgtcatctttctcttccttggctctgttgagggattcagtacaaagagccagccctgcacctatagcgagggcaagttctgcaagcctgccctgttcaccgcactcttcagcactgcatccttcttgcttggagccatcacctctttggtctctggtttccttggaatgaagatcgccacatatgccaatgccagaaccaccctggaagctaggaagggtgttgggaaggcattcatcactgctttccgctctggtgctgttatgggctttttgctcgcatcgagtggtcttgtggttctctacatcaccattaatgtatttaagttgtactatggtgatgactgggagggtcttttcgagtctatcactgggtatggtcttggtggatcttccatggctctcttcggaagagttggtgggggtatctacacaaaggcagctgatgtgggtgctgatcttgttagcaaagttgaaaggaacatccctgaggatgatcctaggaacccagctgtgattgctgacaatgttggtgacaatgttggtgacattgctggaatgggatctgatctctttgggtcatacgcagaatcttcctgtgctgcccttgttgttgcatctatttcatcttttggaattaatcatgatttcactgggatgtgctacccattgcttgtgagctctgttgggatcattgtctgcttgatcaccacactctttgccactgacttctttgagatcaaggccgtgaaagaaatcgaacctgcacttaagaagcagctcatcatctccactgctttgatgactgttggtattgcgataatcagctggttggcccttccagctaagttcaccatctacaactttggcactcagaaggaagtatcgaactggggcttgttcttctgtgttgcaatcggtctgtgggctggtcttattattggttttgtcacagaatactacactagcaatgcatacagtcctgtgcaagatgttgcagattcctgcagaactggtgccgccaccaatgtcatttttggtcttgctctaggatacaagtcagttattatcccaattttcgccattgctgtcaacatctatgtcagtttctctattgccgcaatgtatggcattgctgttgctgcccttggcatgctaagcacaatcgcaactggccttgctattgatgcttatggtcccatcagtgacaatgctggtggcattgctgagatggctggaatgagccacagaattcgtgagagaactgatgctcttgatgctgctggtaacacaactgctgctattggaaagggatttgccattggatcagctgctcttgtctccctggccctttttggcgcctttgtcagcagggctggagtgcaggttgtcgatgtcctctcccccaaggtcttcattggcttgattgttggagccatgcttccgtactggttctctgccatgaccatgaagagtgttggaagtgctgctctgaagatggttgaggaggtccgcaggcagttcaacaccattcctgggctgatggagggaactggcaagcctgactatgctacctgcgttaagatctccactgatgcttccatcaaggagatgatccccccgggtgctctggtcatgctcacacccctcattgttggaaccctctttggagtggagaccctctctggtgttcttgctggtgccctggtttctggagtgcagattgccatctctgcttccaacactggtggcgcatgggacaatgccaagaagtacattgaagctggtgccagcgagcacgcaaggaccctgggccctaagggatcagactgccacaaggctgctgtgatcggtgacaccatcggtgaccccctgaaggacacctccggcccatccctcaacatcctcatcaagctcatggccgtggagtctcttgtattcgcccccttctttgctacccacggtggcctgctcttcaagtatctgtaagagcaacatcaagtgcaggagaagtatacaatcaatcgatccatgggcatcttgaataacgcctgccagatcacctgttagcgtgtcgcgcctggcattgcgccgctgtttttttggtctcattatttcaggattgctgcaactgttggcctttctctttgggcctcctggaggcgttactgttagccttactcttactgcttgtagctccacgtagaaaagaggtgtcgtgcgtctggcaaattttcccagtccctgatgatggcgatgatgttgaaatctttgaacaatgatacatgattattgcaaaaaaaaaaaaaaaaaaaa

SEQ ID NO: 1674 - protein, 762 aa, Panicum virgatum
  misc_feature: Ceres CLONE 1769278
  misc_feature (1)..(762): SWISSPROT Homolog: EC 3.6.1.1 Pyrophosphate-energized vacuolar membrane proton pump
  misc_feature (2)..(760): SWISSPROT Homolog: EC 3.6.1.1 Pyrophosphate-energized vacuolar membrane proton pump
MAILSALATEVLIPVAGVIGIAFAVVQWVLVSQVKLSPAAAAAGGSKNGYGDYLIEEEEGLNDHNVVVKCAEIQNAISEGATSFLFTEYQYVGIFMSIFAVVIFLFLGSVEGFSTKSQPCTYSEGKFCKPALFTALFSTASFLLGAITSLVSGFLGMKIATYANARTTLEARKGVGKAFITAFRSGAVMGFLLASSGLVVLYITINVFKLYYGDDWEGLFESITGYGLGGSSMALFGRVGGGIYTKAADVGADLVSKVERNIPEDDPRNPAVIADNVGDNVGDIAGMGSDLFGSYAESSCAALVVASISSFGINHDFTGMCYPLLVSSVGIIVCLITTLFATDFFEIKAVKEIEPALKKQLIISTALMTVGIAIISWLALPAKFTIYNFGTQKEVSNWGLFFCVAIGLWAGLIIGFVTEYYTSNAYSPVQDVADSCRTGAATNVIFGLALGYKSVIIPIFAIAVNIYVSFSIAAMYGIAVAALGMLSTIATGLAIDAYGPISDNAGGIAEMAGMSHRIRERTDALDAAGNTTAAIGKGFAIGSAALVSLALFGAFVSRAGVQVVDVLSPKVFIGLIVGAMLPYWFSAMTMKSVGSAALKMVEEVRRQFNTIPGLMEGTGKPDYATCVKISTDASIKEMIPPGALVMLTPLIVGTLFGVETLSGVLAGALVSGVQIAISASNTGGAWDNAKKYIEAGASEHARTLGPKGSDCHKAAVIGDTIGDPLKDTSGPSLNILIKLMAVESLVFAPFFATHGGLLFKYL

SEQ ID NO: 1675 - DNA, 1470 bp, Panicum virgatum
  misc_feature: Ceres CLONE 1769320
  misc_feature: Encodes the peptide sequence at SEQ ID NO. 1676
atcacgccgcgcgcgctcctgttccatctctgcacctagacgtgatcatcgcagcgcgacacatctgacccgcggagagaccaggcgcatcgcaattcgcatcggcatggcgtccgcggcggtgccggtgccggaggtggccctgcggccgggcggcggcgcgcggccgatgccggcggtgggcatgggcacggcgtcgttgcggccggtgcccggggccaccagggacgccgtgctggcggccatcgagctgggctaccgccacttcgacacggccgccatgtacggcacggaggggccgctcggcgaggccgtggccgaggccgtgcgccgcgggctcctccggtcccgggaggaggtgttcgtcacctccaagctctggtgcacgcagagccacccggacctcgtcctcccctccctccgggagaccctcaggagcctgcagatggagtacctggacctgtacctgatccactggccggtggccctcaagcccggggtgccgactttccccagcaggaaggaggacgccgtgccgttcgacttggagggcgtgtggcgggcgatggaggagtgccaccggctggggctcgccagggccatcggcgtcagcaacttcaccaccaagcacctcggcagggtcctcgccgccgccaccgtcccgcccgcggtgaaccaggtggagctcaacccggcgtggcagcagcggacgctgcgggcgtactgcgccgacaagggcatccacgtcgcggcgtactcgccgctgggggggcagaactgggacggcacggacagcaacgccgtgctggggtcggaggtgctcgccgggatcgccaaggcgagggggaaatccgtcgcgcaggtggcgttgagatggatatacgagcagggcgtgacgtccatcgtcaagagctacaacaaggagaggctcaggcaaaacctcgacatcttcgactgggagctgaccgacgacgaccggctcaagatcagccagatcccacacaagaagattgtcagggctgaggctttgttctcgcaggagggtgaattcacgtccgttgatccagcagacctggaaatcgtagaggaatagggaataacgctgcatatggctccgcaggcatgatgaacatttgaataagcaggcttttccggtcttgatcgtgtcgatgcagtaatttccttttgttatctccttgtaaagttgcgatatggactataaccagacagcaatactgaagcaccaagtaaaaccgcattggacatatttaccaagataagttacctgctaaattttggacagttcaaaagatatactgtaatatctttcaaaaaaagatatactgtaataaacacttgtcagacctagattttctttcctcccagtaaggttgtcaagccccgctattctcatggcaagcgatttctgtatataaataaatccctgctccagctgaaaaaaaaaaaaaa

SEQ ID NO: 1676 - protein, 328 aa, Panicum virgatum
  misc_feature: Ceres CLONE 1769320
  misc_feature: Great-hit functional homolog of the protein sequence given in SEQ ID NO 9390
  misc_feature (1)..(282): Pfam Name: Aldo_ket_red Pfam Description: Aldo/keto reductase family
  misc_feature (3)..(303): SWISSPROT Homolog: EC 1.6.5.2 NAD(P)H:quinone oxidoreductase
  misc_feature: Useful for making plants with modulated drought sensitivity
MASAAVPVPEVALRPGGGARPMPAVGMGTASLRPVPGATRDAVLAAIELGYRHFDTAAMYGTEGPLGEAVAEAVRRGLLRSREEVFVTSKLWCTQSHPDLVLPSLRETLRSLQMEYLDLYLIHWPVALKPGVPTFPSRKEDAVPFDLEGVWRAMEECHRLGLARAIGVSNFTTKHLGRVLAAATVPPAVNQVELNPAWQQRTLRAYCADKGIHVAAYSPLGGQNWDGTDSNAVLGSEVLAGIAKARGKSVAQVALRWIYEQGVTSIVKSYNKERLRQNLDIFDWELTDDDRLKISQIPHKKIVRAEALFSQEGEFTSVDPADLEIVEE

SEQ ID NO: 1677 - DNA, 1248 bp, Panicum virgatum
  misc_feature: Ceres CLONE 1769327
  misc_feature: Encodes the peptide sequence at SEQ ID NO. 1678
ctccttcaattccctctcatctcgcgtctccgcacggagagccgccctcctcgtccgccgccgcctgccgccggcgagctcttcattaccccggcgatggccggcctatccaaaaccaccatcaccaatcacgtctagcacatctcgcccgagcggctgagccacacgtcacagcaacacatcaagccgcgcggatcgacaggaagatggaggcgagcgtgggcatccgggcgcggcccggtgcgtgggccgggctcgagaagccgcgcggcgcttgctctgcaagagtcccggcggcggggctcacggcggagaagctgccggcgaggctggctctgggaaccgatccgcggaggagcacggatcctgtgctccgtgccgcaaagatgaaagcttcgtgttgcaagaaatcgacaggtactgaaaaggtccactactctgccgatgaagctctcatactacagcaaaaagcccaggatgttctcccttacttggatggccgatgcatttatctagtcggaatgatgggttcaggcaaaactacagttgagaagatattagctgaagtactaggttattctttcttcgacagtgataagttggtagagaaggctgtcggtatatcatctgttgctgagatttttcagctccacagtgaagcattcttcagagataatgagagtgaggtcctaagggatttgtcatcaatgcatcggttagttgttgcaactggaggtggtgccgtgatccgaccaatcaattggagttacatgaagaaagggctgactgtgtggttagatgttccactggatgcacttgcaagaaggattgctgccgtgggaactgcatctcggcccctcttgcatcaggaatctggtgacccatatgcaaaggcttatgcaaaacttacatcactttttgagaaaagaatggactcgtatgctaatgcggatgccagagtttcacttgaacatattgcattaaaacaagggcataatgatgtcactatacttacacctagtaccattgccattgaggcattattaaagatggaaagttttcttactgagaaggccatggtcagaaactgaccgcttgttgctggggaaaagggcaccaacagcatatggcccctgtttgtttaattgtgcttgtacatatgcctttgcatgagctctttacagtactgttagattgttgttcatgcaacatgaaagatgattattcgaaaaaaaaaaaaaaaaaaaa

SEQ ID NO: 1678 - protein, 294 aa, Panicum virgatum
  misc_feature: Ceres CLONE 1769327
  misc_feature: Great-hit functional homolog of the protein sequence given in SEQ ID NO 9205
  misc_feature (1)..(177): Pfam Name: SKI Pfam Description: Shikimate kinase
  misc_feature (1)..(292): SWISSPROT Homolog: EC 2.7.1.71 Shikimate kinase, chloroplast precursor
  misc_feature (96)..(255): SWISSPROT Homolog: EC 2.7.1.71 Shikimate kinase
  misc_feature: Useful for making plants with modulated salt sensitivity
MEASVGIRARPGAWAGLEKPRGACSARVPAAGLTAEKLPARLALGTDPRRSTDPVLRAAKMKASCCKKSTGTEKVHYSADEALILQQKAQDVLPYLDGRCIYLVGMMGSGKTTVEKILAEVLGYSFFDSDKLVEKAVGISSVAEIFQLHSEAFFRDNESEVLRDLSSMHRLVVATGGGAVIRPINWSYMKKGLTVWLDVPLDALARRIAAVGTASRPLLHQESGDPYAKAYAKLTSLFEKRMDSYANADARVSLEHIALKQGHNDVTILTPSTIAIEALLKMESFLTEKAMVRN

SEQ ID NO: 1679 - DNA, 1289 bp, Panicum virgatum
  misc_feature: Ceres CLONE 1769331
  misc_feature: Encodes the peptide sequence at SEQ ID NO. 1680
aggcaaccactgagccgagggggcggaggatatggcagcacttgccgcccaccaccaccaccgcctcctctccttctcctccgcagccgctccaacagctcgccgccgcctctcctcgctccccttctccccgcggccttcgtcccatggcggtttcagctccagcacgcgcgcctcgggcggcggcggcaccagcagcgcggcggccccactcgccgcggcggccacgtcggcgtcgctgtccctggaggagctgcgccggagctgcaccacctggacgtggcgcgggatgcgcgtgaactacctcgcccggggacagggcccgccagtcctgctcgtccacggcttcggcgcctccgtcgcgcactggcgcaggaacattggggtgctgtctgaatcccacaccgtctacgcgatcgatttgctggggttcggcgcctcggacaagcctgctgggttttcgtacacgatgaagacatgggctgagttgatactgaacttcttgaaggaggtcgtgaagaggccaacggtgctcgtcggcaactctgtcgggagccttgcatgcgtcatcgctgcttcagagtccaacagagacgttgtccgggggcttgtgctgctgaactgcgccggcggcatgaacaacaaggcgatcgtcgatgactggaggatcaagctggtcctgcctctgctctggctgatcgacttcctgctgaaccagcggccgatagcatcggcactctttaaccgcgtgaaaaacagggacaatctgaaggacatcttgctctctgtttacgggaacaaagacgccgtggacgacgaactagtagagatcataagggggccggccgacacggagggcgccctggacgcgttcgtgtcgacggtgaccgggccgccggggccgagcccgatagcgctgatgccgcggctggcggacgtgccggtgctggtgctgtggggcgaccgggaccccttcaccccgatcgacgggcccgtagggaagttcttctcgcggctgccgtcggagctccccaacgtgacgctccacatgctggagggcgtcggccactgcccgcacgacgaccgcccggacctcgtccatgacaggctgctcccgtgactcgacggcctcccgccgcccgcggccgccgccgctgcagcggtctagtcgcccatggccggtggtgacgacgagctgacgatggatgtaattatttattaattctgtaattttctctgctggtgctagtgtcgagaaaaagtttaacgaaaaaaaaaaaaaaaaaaaa

SEQ ID NO: 1680 - protein, 362 aa, Panicum virgatum
  misc_feature: Ceres CLONE 1769331
  misc_feature (1)..(240): Pfam Name: Abhydrolase_1 Pfam Description: alpha/beta hydrolase fold
MAALAAHHHHRLLSFSSAAAPTARRRLSSLPFSPRPSSHGGFSSSTRASGGGGTSSAAAPLAAAATSASLSLEELRRSCTTWTWRGMRVNYLARGQGPPVLLVHGFGASVAHWRRNIGVLSESHTVYAIDLLGFGASDKPAGFSYTMKTWAELILNFLKEVVKRPTVLVGNSVGSLACVIAASESNRDVVRGLVLLNCAGGMNNKAIVDDWRIKLVLPLLWLIDFLLNQRPIASALFNRVKNRDNLKDILLSVYGNKDAVDDELVEIIRGPADTEGALDAFVSTVTGPPGPSPIALMPRLADVPVLVLWGDRDPFTPIDGPVGKFFSRLPSELPNVTLHMLEGVGHCPHDDRPDLVHDRLLP

SEQ ID NO: 1681 - DNA, 1368 bp, Panicum virgatum
  misc_feature: Ceres CLONE 1769363
  misc_feature: Encodes the peptide sequence at SEQ ID NO. 1682
accaggcagcaagctgattgatccgtctaaccttatcccgcctgtcgcgcgtgggtcggagcgcacgccaacgatgtccgccaccacggaggccggcgcggccacgggcggcgacggctacgaccgccggcgcgaggagctgcaggcgttcgacgacaccaaggcgggcgtcaagggcctcgtcgacgccggcgtcacggcggtcccggccatcttccgccacccgccggacgccctgcgcgagctgccgcccacgccgtccccgcccccggccgacgcgcgcgccgccatcccggtcgtggacctctcggggggcgcgccgagggaggaggtggtcgcgcgggtgcggcgcgcggccgggacggcggggttctttcaggtgatcaaccacggcgtgccgggcgagctcacggccggcgtgctcgcggcggtgcggcggttccacgagggctcccccgaggcgaagcggcgggtgtacaccagggacgccgcccgcaaggtgaggttcagctccaacttcgacctcttccagtccgcggcggccggctggcgcgacaccctctcctgcgacctggcgccggacccgccgcggccggaggagctgcccgaggccgtcaggggcgtgctgctggagtatggcgccgcggcggcggagctggcgctgcgggtgctggagctgctgtcggagtcgctcgggctgggcggcggccacctgcgcgagatgggctgcgcgcagggctacaccgtggtgggacactactacccgccgtgcccggagccgcacctcaccctcggcaccagcaggcacacagacccgaagttcctcaccgtgctcctgcaggacggcatgggcggcctgcaggtgctcctcgatcgcggcggcgccgccggccggggctgggtggacgtccctcccctgcccggcgccctcatcgtcaacatcggcgaccttctccagctcgtcagcaacaaccggttcaggagcgtggagcaccgggtgctggcgaaccgggacgcggcgagggtctcggtggcgtgcttcttcaacacggacatgaagagatcgacgaggctgtacggccccatcacggagggcagcgacgacccgccgctctacaggagcgtcacggctcgagagttcatcgcgcacttctacaccaagggcctcgagggccgcccgctcgaccacttcaggttgcagcactagcatgattcgaccatgtcacatgagagtacgagaaatggctagtggagttggatgaacaatagatgtggatagggaactctgttaaataattagataattttggacacattttaattccaaaattaaatatattgttctattaaaaaaaaaaaaaaaaaaaa

SEQ ID NO: 1682 - protein, 377 aa, Panicum virgatum
  misc_feature: Ceres CLONE 1769363
  misc_feature (1)..(108): Pfam Name: 2OG-FeII_Oxy Pfam Description: 2OG-Fe(II) oxygenase superfamily
MSATTEAGAATGGDGYDRRREELQAFDDTKAGVKGLVDAGVTAVPAIFRHPPDALRELPPTPSPPPADARAAIPVVDLSGGAPREEVVARVRRAAGTAGFFQVINHGVPGELTAGVLAAVRRFHEGSPEAKRRVYTRDAARKVRFSSNFDLFQSAAAGWRDTLSCDLAPDPPRPEELPEAVRGVLLEYGAAAAELALRVLELLSESLGLGGGHLREMGCAQGYTVVGHYYPPCPEPHLTLGTSRHTDPKFLTVLLQDGMGGLQVLLDRGGAAGRGWVDVPPLPGALIVNIGDLLQLVSNNRFRSVEHRVLANRDAARVSVACFFNTDMKRSTRLYGPITEGSDDPPLYRSVTAREFIAHFYTKGLEGRPLDHFRLQH

SEQ ID NO: 1683 - DNA, 2250 bp, Panicum virgatum
  misc_feature: Ceres CLONE 1769368
  misc_feature: Encodes the peptide sequence at SEQ ID NO. 1684
atgccgctcaccatcagctcgatctccatcgatctctccctaccgccgtcggccgctaatcgatcgagcagcagctagcagcagcaatggccggcggccgccgtccccggcgcctctcccctgcgtgcctctttctcgccgccgccgtggccctcctcgccatgccgggcctcgccgccgcccgcacccgccgctacacgttcaatgtgacgatggcgacggtgacgcggctgtgcgtgaccaagagcatccccacggtgaacgggcggttcccggggcccaaggtcgtcgtgcgagagggcgaccgcctcgtcgtccaggtccacaacaacatcaacagcaacgtcaccttccactggcacggcgtccggcagctgcgcagcgggtgggcggacgggccgtcgtacatcacgcagtgcccgatccggccggggcagagctacgcctacgacttccggatcgtggggcagcgcggcacgctgtggtggcacgcccacttctcctggctccgcgccacgctctacggcccgctcgtcatcctcccgccgcgcggcgtcccctacccgttccccaagcccgaccgggaggcccccctcatgctcggcgagtggttcaacgccgacccggaggcggtcatcaagcaggcgctgcggaccggcgggggccccaacgtctccgacgcctacaccttcaacggcctgccgggccccacctacaactgctcggcggccgccggcgacgcgttccggctgcgggtgcggccggggcgcacgtacatgctgcgcctcgtcaacgcggcgctcaacgacgagctcttcttcgcggtggccaaccacacgctcacggtggtgggggcggacgccagctacgtcaagccgttcgcggccaccacgctggtcatctccccggggcagaccatggacgtgctgctcgccgcggcggccagcccgcccgcgcccgcgttcgccatcgtcgtcgcaccctataccaacaccgtcggcacgttcgacaacaccaccgccgtcgccgccctcgagtacgcgccgcagggcgccgccgcgctccggagcctccccgcgccggcgctcccgctgtacaacgacacgggcgccgtggccaacttctcggccaagttccggagcctcgcgagcgcgcggtacccggcgcgggtgccgcggtcggtggaccgcaggttcttcttcgccgtcgggctgggcgcggacccgtgccggagccgggtgaacgggacgtgccagggccccaacggcacccggttcgcggcgtccatgaacaacgtgtccttcaccatgcccaagacctccctcctccaggcacactaccagcggcggtacggcggcgtgctcacggccaacttccccgcggcgccgccggtgctgttcaactacaccggcgcgccgcccaacaacacgttcgtgacgcacggcaccagggtggtgccgctcggcttcaacaccaccgtcgaggtggtgctgcaggacaccagcatcctgggcgccgagagccacccggtgcacctccacggctacgacttcttcgtcgtcggccaggggttcgggaactacgacgccgccaacgacaccgccaggtacaacctcgtcgaccccgtgcagcggaacaccgtcagcgtgcccaccgccggctgggtcgccatccgcttcatcgccgacaaccccggtatctggatcatgcattgccacctagacgtgcacttgagctggggcctggccatggcgtggctcgtcaacgacgggccgctgccgaatcagaagctgccgcctccgccgtccgatatccccaagtgctgatcatgatacgctctccgcaacacttatctgtggcggttttgacccgtgcaacgctcgcgcgcatacacgcagtttctttttgtggcggtcgagcgcgatctcgaggaggtccctctctcaatcggttgtcccgtggacgcctcgcccgttttgtgatgctgcctgattttgttgcggaggcactgccctcggagacaaacaagaccgatgtgagaagtccattggatggcggcatggcgctgctgtgtgattcttgttgctatttcttgtccttttttttttttgctgttgaaagttgcttgttgctattctttgattccacttttcgttttttttcacgctgggcattgttgttagtgtgtacagtgtacactagtacggtataatacatgtatcaatcgaagcagctaatgattcttttact

SEQ ID NO: 1684 - protein, 579 aa, Panicum virgatum
  misc_feature: Ceres CLONE 1769368
  misc_feature (1)..(155): Pfam Name: Cu-oxidase Pfam Description: Multicopper oxidase
  misc_feature (1)..(135): Pfam Name: Cu-oxidase_2 Pfam Description: Multicopper oxidase
  misc_feature (1)..(117): Pfam Name: Cu-oxidase_3 Pfam Description: Multicopper oxidase
  misc_feature (15)..(579): SWISSPROT Homolog: EC 1.10.3.2 Laccase-17 precursor
  misc_feature (30)..(579): SWISSPROT Homolog: EC 1.10.3.2 Laccase-2 precursor
MAGGRRPRRLSPACLFLAAAVALLAMPGLAAARTRRYTFNVTMATVTRLCVTKSIPTVNGRFPGPKVVVREGDRLVVQVHNNINSNVTFHWHGVRQLRSGWADGPSYITQCPIRPGQSYAYDFRIVGQRGTLWWHAHFSWLRATLYGPLVILPPRGVPYPFPKPDREAPLMLGEWFNADPEAVIKQALRTGGGPNVSDAYTFNGLPGPTYNCSAAAGDAFRLRVRPGRTYMLRLVNAALNDELFFAVANHTLTVVGADASYVKPFAATTLVISPGQTMDVLLAAAASPPAPAFAIVVAPYTNTVGTFDNTTAVAALEYAPQGAAALRSLPAPALPLYNDTGAVANFSAKFRSLASARYPARVPRSVDRRFFFAVGLGADPCRSRVNGTCQGPNGTRFAASMNNVSFTMPKTSLLQAHYQRRYGGVLTANFPAAPPVLFNYTGAPPNNTFVTHGTRVVPLGFNTTVEVVLQDTSILGAESHPVHLHGYDFFVVGQGFGNYDAANDTARYNLVDPVQRNTVSVPTAGWVAIRFIADNPGIWIMHCHLDVHLSWGLAMAWLVNDGPLPNQKLPPPPSDIPKC

SEQ ID NO: 1685 - DNA, 2174 bp, Panicum virgatum
  misc_feature: Ceres CLONE 1769374
  misc_feature: Encodes the peptide sequence at SEQ ID NO. 1686
gccacccatcggaaaccaaaaccatccctttctctcttctccctctccctcctgcaatctcaagacgtgatggggactccgcagcgggtcctcctcgcgccgtgggcgctgctggcggtggtggcgctgcagctcgccggtgcctcgcatgtcatccactggagcctcgaggccgaggcggcgccgccgccgtcggtgccggcatccattgtcagccccctgctcaagacggggtaccatttccagccgcccaggaactggatcaacgatccgaacgctccgatgtactacaaggggtggtaccacctgttctaccagtacaaccccaagggcgcggtgtggggcaacatcgtgtgggcgcactcggtgtcgcgcgacctcatcaactggatcgcgctggagcccgccatctaccccagcatcccctccgaccagttcggctgctggtccggctcggcgacgctcctccccgacggcacgccggcgatcacctacacggggatcagccggtccgacatcaactaccaggtgcagaacgtcgcgttccccaagaacgcctccgacccgctgctccgggagtgggtgaagccggcggagctgaacccgatcgccgtgccggagggcggcatcaacgcgacgcagttccgcgacccgacgacggcgtggtacgccgacgggcactggcggatgctcgtcggcggcgtgcgcggcggcgcccgcgggctggcgttcgtgtaccggagccgggacttccggcggtggcgccgcgccaggaaaccgctgcactcggcggcgacggggatgtgggagtgcccggacttcttcccggtgtccggtgccgggctggagaacgggctcgacacctccgaggccggccccaagtacgtgctcaagaacagcctggacctcacccggtacgactactacaccgtgggcagctacgaccggcgcagggaccggtacgtgccggacgaccccgccggcgacgagcggcgccgccgctacgactacggcaacttctacgcgtccaagacgttctacgacccggcgaagcggcggcgcgtgctgctcggctgggccaacgagtccgacagcgtgcccgacgacaaggccaagggctgggccggcatccatgcgatcccgaggaagatctggctggaccccagcgggaagcagctgctgcagtggccggtcgaggaggtggagaagctcaggggcaagcccgtcagcgtcgccggcaaggtcgtcaagcccggccagcatttcgaggtcacgggcctcgcaacttaccaggctgacgtggaggtgagcttcgaggtgtcgagcctggacagggcggagcccttcgacgccgcgtacgccaacgacgcgcagaagctgtgcggcgtcaagggcgccgacgccaagggcggggtggggcccttcggcctgtgggtgctggcctctgccgacctgcaggagaagacggccgtcttcttcagagtcttcaaggacggatacggcaagcccaaggtgctcatgtgcaccgaccccacaaagtcgtctcttagtccagatctgtacaagccgacctttgcgggcttcgtcgacaccgacatttcgagcgggaagatcactctcaggagcttgatcgaccgatccgtggtggagagcttcggagcaggaggccggacttgcatcctctcaagagtctacccctccatcgctgtcggcaaagacgctcacctttacgtcttcaacaatggggaggcggacatcaaggtgtcgcacctgactgcctgggagatgaagaaaccgctcatgaacggcgcctgagaagtcactgatgggaacgacgtctgggagatgaagaaactactggtgatgaacggcgcctaagaaaccattgatgaccttattcgttttctttgacacggctgcttcgcagttgattgtcgttgttgacgtccttcattattgatcaagaagtgacagtttgggtcgttacttctgatagattcttcttcttcttatttgtgtatgtgtacacgtgggggggttttttcgtgctcagctgttgagggaaagggagaaattgattatgcttcttcttgtactatatgagttatcagatgatgaataacttgtatgatgaataaaagctgctaattttacaaaaaaaaaaaaaaaaaaaa

SEQ ID NO: 1686 - protein, 581 aa, Panicum virgatum
  misc_feature: Ceres CLONE 1769374
  misc_feature (1)..(321): Pfam Name: Glyco_hydro_32N Pfam Description: Glycosyl hydrolases family 32 N terminal
  misc_feature (1)..(581): SWISSPROT Homolog: EC 3.2.1.26 Beta-fructofuranosidase, cell wall isozyme precursor
  misc_feature (1)..(581): SWISSPROT Homolog: EC 3.2.1.26 Beta-fructofuranosidase, insoluble isoenzyme 1 precursor
MGTPQRVLLAPWALLAVVALQLAGASHVIHWSLEAEAAPPPSVPASIVSPLLKTGYHFQPPRNWINDPNAPMYYKGWYHLFYQYNPKGAVWGNIVWAHSVSRDLINWIALEPAIYPSIPSDQFGCWSGSATLLPDGTPAITYTGISRSDINYQVQNVAFPKNASDPLLREWVKPAELNPIAVPEGGINATQFRDPTTAWYADGHWRMLVGGVRGGARGLAFVYRSRDFRRWRRARKPLHSAATGMWECPDFFPVSGAGLENGLDTSEAGPKYVLKNSLDLTRYDYYTVGSYDRRRDRYVPDDPAGDERRRRYDYGNFYASKTFYDPAKRRRVLLGWANESDSVPDDKAKGWAGIHAIPRKIWLDPSGKQLLQWPVEEVEKLRGKPVSVAGKVVKPGQHFEVTGLATYQADVEVSFEVSSLDRAEPFDAAYANDAQKLCGVKGADAKGGVGPFGLWVLASADLQEKTAVFFRVFKDGYGKPKVLMCTDPTKSSLSPDLYKPTFAGFVDTDISSGKITLRSLIDRSVVESFGAGGRTCILSRVYPSIAVGKDAHLYVFNNGEADIKVSHLTAWEMKKPLMNGA

SEQ ID NO: 1687 - DNA, 1686 bp, Panicum virgatum
  misc_feature: Ceres CLONE 1769386
  misc_feature: Encodes the peptide sequence at SEQ ID NO. 1688
aaagccatcgccttttctgccggaaccccccgccctttccctccctcctctcttcgccacctccctccctctttcttctccccaatctccgagctcagtgagaggggggatcgggccacctcgagttacctgcgggttttccagtccctcggagctcgcgcttcctccgcggctccatttctgaactctcgggatccgatccggtacgcttcccggacggaagccggcgcgccgtctccaccgggggtccatcggctccgtgcttcgccatggggaactgctggggcgccaagatcagctccgacagcccgtcgcgcggcgccttctccccatcatcaggggcaacttccaagtttgccagtaggaatggggccgccctgagcagctccagcagccatgcgtcctcggcgtcaatgctgccaaccccacgtagcgaggatgagattctggaggcggcaaacgtcaaggcctttaccttcaatgagctcaggactgccaccagaaacttcagaccggacagtgtgctcggcgagggtgggtttgggtcggtcttcaagggttggatcgatgagaagacacttgccccgactagaccaggcacagggatggtcattgctgtcaagaagctgaaccaggaaggttaccagggccacaaggaatggctgactgaggtgaattaccttggaacgttgtcacacccatatcttgtacggctcgttggctactgtctcgaagatgaacagcggctccttgtctatgagttcatgccacgcgggagtttggagaatcatctgttcagaaggagctcccatttccagccacttccctggaacctacgaatgaaaattgcccttgttgcagctaaaggtcttgcctttctccacagtgataatgctaaagtcatctaccgtgatttcaagacctctaatattcttctagatgcgaatttcaatgcaaagctctctgatttcgggctggcgaaggatggtccaactggcgacaagagtcatgtctccaccagagtgatgggtactcatgggtatgcagctccggaataccttgcgacaggtcatctgacggccaagagtgacgtctacagctttggagtagtactcctagaaatgctgtcaggacggcgcgcactggacaagaaccgcccgcatggggagcacaacctggtggagtgggctaggccatacctgagaagcaagcgacgcatattccgtatcctggacccccggctgggcgggcagtactccctcgctagggcacagaaggctgcaactctggcactgcaatgcctctcggtggagtccaggcacaggcccagcatggatgaggtggtaacagcgttagaacagctccaggacgccaaggagggagggcaccattacctacaaaagaggccgagcagtcggagcttggacagcagtggcgtgaaagcgtccatgaaggggaagcctgcctcttcttcaagaccagtttgagtcgacagagtattttcctttttcttttgcaggtgtaggtaacataatataggttcacagagggatttgtaaagaggcaggagttctgaatgttttgtgtttatattgtagtttttacatctttgagtctttgtaaagtacactatgtacatacataattacatccagtttggagtgttaaaaaaaaaaaaaaaaaaaa

SEQ ID NO: 1688 - protein, 405 aa, Panicum virgatum
  misc_feature: Ceres CLONE 1769386
  misc_feature (1)..(387): SWISSPROT Homolog: EC 2.7.11.1 Protein kinase APK1A, chloroplast precursor
  misc_feature (1)..(390): SWISSPROT Homolog: EC 2.7.11.1 Protein kinase APK1B, chloroplast precursor
MGNCWGAKISSDSPSRGAFSPSSGATSKFASRNGAALSSSSSHASSASMLPTPRSEDEILEAANVKAFTFNELRTATRNFRPDSVLGEGGFGSVFKGWIDEKTLAPTRPGTGMVIAVKKLNQEGYQGHKEWLTEVNYLGTLSHPYLVRLVGYCLEDEQRLLVYEFMPRGSLENHLFRRSSHFQPLPWNLRMKIALVAAKGLAFLHSDNAKVIYRDFKTSNILLDANFNAKLSDFGLAKDGPTGDKSHVSTRVMGTHGYAAPEYLATGHLTAKSDVYSFGVVLLEMLSGRRALDKNRPHGEHNLVEWARPYLRSKRRIFRILDPRLGGQYSLARAQKAATLALQCLSVESRHRPSMDEVVTALEQLQDAKEGGHHYLQKRPSSRSLDSSGVKASMKGKPASSSRPV

SEQ ID NO: 1689 - DNA, 1964 bp, Panicum virgatum
  misc_feature: Ceres CLONE 1769414
  misc_feature: Encodes the peptide sequence at SEQ ID NO. 1690
gatcacacattcacaccccaaagcagcgcagccgcctcattcctcctctccatcctcctctctctctctcgcgcgcgccgctcttcccgttccgttccaggagagcagtgaggcgggtagtagtggtcggggaggggaggcaagatgttcatcgagagcttccgcgtggagagcccgaacgtgcggtacggcccgtcggagatcgagtcggagtaccggtacgacacgacggagctggtgcacgagggcaaggacggcgcctcccgctgggtcgtccgccccaagtccgtcaagtacaacttccggaccagcaccgccgtccccaagctcggggtgatgctcgtggggtggggcggcaacaacgggtccacgctgacggctggggtcatcgccaacagggaggggatctcatgggcgaccaaggacaaggtgcagcaagccaactacttcggctccctcactcaggcctccaccatcagggttggcagctacaacggggaggagatctacgcgccgttcaagagcctcctgcccatggtaaaccctgatgacattgtgttcggaggctgggacatcagcaacatgaacctggccgatgccatgacaagggccaaggtgctggacattgacctgcagaagcagctcaggccctacatgaagtccatggtgccactccccggcatctatgatccggacttcatcgcagcaaaccagggttctcgtgccaacaatgtcatcaagggcaccaagaaagagcaggttgaccagatcatcaaggacatcagggagttcaaggagaagaacaaggttgacaaggtagttgtgctttggactgcaaacactgaaaggtacagcaatgtctgtgctggtctcaacgacacagtggagaacctcctggcatctgtagacaagaacgaggcggagatctcaccgtcgacgttgtatgccattgcctgtgtcatggagggtgtaccattcatcaatggaagcccccagaacacctttgtgcctgggctgattgaccttgctatcaagaacaactgcttgattggaggtgatgatttcaagagtggacagaccaagatgaagtctgttttggttgacttccttgttggtgctggaattaagccaacctcaattgtgagctacaaccacttgggaaacaacgatggcatgaacctgtctgcccctcaaacattccggtccaaggagatctccaagagcaatgtagtggatgacatggtctcaagcaacgctatcctttatgagcccggcgagcatcctgatcacgttgttgtgatcaagtatgtgccgtacgttggggacagcaagagagccatggatgagtacacctctgagatcttcatgggcggcaagaacaccatcgttctgcacaacacctgcgaggactcgctcctcgccgcaccaatcattcttgatctggtgctcctggctgagctcagcaccaggattcagctaaaagctgagggagaggagaagttccactccttccacccagtggccaccatcctgagctacctcaccaaggcacccctggttccccccggcacgccggtggtgaatgccctggcgaagcagagggcgatgctggagaacatcatgagagcctgcatcgggctggcccccgagaacaacatgatcctggagtacaagtgagcgctgcggctatgcagcagggggcgcctactggaagggaacaagaaaggcgagactagctgtgggactggtgttggcttctcgtttgtttttttgcgttctttcctgctcattgttgtacacttttgtaagggtttgctcgtcaggtcgtgattatcagggctctgctattagcggcacgaaccctgaaactgtgtcgtatgataatgtgctgaggatgctagttgccctctgtattcctaagggattcctacaagtgttcgttgcaaaaaaaaaaaaaaaaaaaa

SEQ ID NO: 1690 - protein, 510 aa, Panicum virgatum
  misc_feature: Ceres CLONE 1769414
  misc_feature (1)..(448): Pfam Name: NAD_binding_5 Pfam Description: Myo-inositol-1-phosphate synthase
  misc_feature (1)..(510): SWISSPROT Homolog: EC 5.5.1.4 Inositol-3-phosphate synthase
MFIESFRVESPNVRYGPSEIESEYRYDTTELVHEGKDGASRWVVRPKSVKYNFRTSTAVPKLGVMLVGWGGNNGSTLTAGVIANREGISWATKDKVQQANYFGSLTQASTIRVGSYNGEEIYAPFKSLLPMVNPDDIVFGGWDISNMNLADAMTRAKVLDIDLQKQLRPYMKSMVPLPGIYDPDFIAANQGSRANNVIKGTKKEQVDQIIKDIREFKEKNKVDKVVVLWTANTERYSNVCAGLNDTVENLLASVDKNEAEISPSTLYAIACVMEGVPFINGSPQNTFVPGLIDLAIKNNCLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGKNTIVLHNTCEDSLLAAPIILDLVLLAELSTRIQLKAEGEEKFHSFHPVATILSYLTKAPLVPPGTPVVNALAKQRAMLENIMRACIGLAPENNMILEYK

SEQ ID NO: 1691 - DNA, 2478 bp, Panicum virgatum
  misc_feature: Ceres CLONE 1769419
  misc_feature: Encodes the peptide sequence at SEQ ID NO. 1692
gtaccgaaaccagtgtcgctctgccaactcgatctagctcgcgtttgccgcgcgcggtggatggccagcgtcctgccgaggttcggcccgttcggccctctgccgccgccgcacgatgagttcgggatcaaggagacgaggccccgtctcgccagcggccgggccggcgggtacgacctcgtggagcggatggagtacctgtacgtgcgcgtcgtcaaggcgcgggacctcaggtggggcggcggcgccatcgacccgttcgccgaggtgaagctcgggggctactcctgcgcgacgcggcacatcgagaagacggcgagccccgagtggaacgacgtgttcgccttctcgcgggagcggatccaggcgccgttcctggacgtggtggttcggggcaagggcttcgccaaggacgactacgtcgggcgctgccgcttcgacctgggcgacgcccccgggcgggtgccccccgacagcgcgctcgcgccgcagtggtaccacgtcttcgacgccaagggcgagcgcgcaggggaggtgatgctggccgtgtggttcggcacgcaggccgacgagtgcttcccgctggccgtgcacgcggacgccgcgctcgccgtggacgccaagctcgccgcgcacatccgctgcaagcagtacaccgtgccgcgcctctggtacgtgcgcgtcaacgtcatcgaggcccgcgacgtcgcgttcgcggacaaggcccgcgtcggcgaggtgttcgtgcgcaccaggatagccgggcaggtgcacaggaccaagacgtgcgtctcccgcctgccgtcgtacggctggaacgaggaccacctgtttgtcgccgccgagccgttcgaggaccacctcatcctctccgtcgaggaccgcgtcaaggtcgacaaggaggaggtcatcggccacgtccacattccgttcaaggaattcgaacgacggtgggacgctcgcccgattcgcccaagatggttcaatttggtgcggccagaaggcgccgctaagatcgagaagttctccgccaagataagcgtccggctctgcctcgaaggcgggtacagagtgctatcagagccggtccactacctgagcgacgtccggccggcggcgagggagctgtggcacaaccggccgcccatcggcctcatcgagctcggtatccacaacgcgttcggcctgagcgccatgcgcacgcgcgacggccgcggctcctgcaacgcctactgcgtcgccaagtacggcgtgaagtggttccgcacgcagaccgtcatcgacagcctcgcgccgcggttccaccagcagtgctactgggacgtgcacgaccactgcaccgtgctcaccgtcgccgtcttccacaactgccagatcggcgacaagggcggcctcgtgaccggcgaccccgtcaaggacgtcctcctcggcaaggtgcgcatccggctctccacgctcgagaccgggcgcatctacacgcacgcgtacccgctcatctccctccacggcggcggcatcaagaagatgggcgagctccagctcgccgtgcggttctcgagcacgtcgacgctgggcctgctccagacgtacgcgcagccgcacctgccgccgatgcactaccaccgcccgctgtccatcgtgcaccaggagacgctgcggcgcgaggccgtcgcgctcatcgcgcaccggctgggccggatggacccgccgctgcgccgggagtgcgtcgagcacctctgcgaggcgcactcgcaccggtggagcatgcggcgcagcaaggcccacttcttccgcctcatggcggcgctggcgcccgtgttcgcggcgctccggtggttcgtcgacgtctgccactggaagaacccggcgaccaccgtcgcggtgcacatcatctacgccatcctcgtgtgctgccccaacctcatcctgcccaccttcttcgtgtacaagttcctgctggggctgtggaactaccggtgccggccgaggcacccgtggcacgtcgacaccaaggtgtcgcacgccgagctggcgcacccggacgagctggacgaggagttcgacgagttcccgacggcgcggccgcacgaggtggtgcgcatgcgctacgaccgcctgcggagcctcggggcgcggatccaggagatggtcggcgacgtcgcagcgcacgccgagcgcgcccggtgcgcgatgacgtggcgggacccccgcgccacggccttgtacctcctgtggtgcctgttccttgcggtgaccaccttcctggcgccgttccaggcggtggcgctgctgacggggttctacgtgatgcggcacccggcgctccggcagaggctgcccgatctgccgaccaacttcttccggcgactgccctgcaaggtcgattgcctactttgataggggtcctggatgaaatgaagtttttactagtctgtaacgtgaaaaatttgtcttgctcaaaaaaaaaaaaaaaaaaaa

SEQ ID NO: 1692 - protein, 778 aa, Panicum virgatum
  misc_feature: Ceres CLONE 1769419
  misc_feature (1)..(156): Pfam Name: PRT_C Pfam Description: Plant phosphoribosyltransferase C-terminal
MASVLPRFGPFGPLPPPHDEFGIKETRPRLASGRAGGYDLVERMEYLYVRVVKARDLRWGGGAIDPFAEVKLGGYSCATRHIEKTASPEWNDVFAFSRERIQAPFLDVVVRGKGFAKDDYVGRCRFDLGDAPGRVPPDSALAPQWYHVFDAKGERAGEVMLAVWFGTQADECFPLAVHADAALAVDAKLAAHIRCKQYTVPRLWYVRVNVIEARDVAFADKARVGEVFVRTRIAGQVHRTKTCVSRLPSYGWNEDHLFVAAEPFEDHLILSVEDRVKVDKEEVIGHVHIPFKEFERRWDARPIRPRWFNLVRPEGAAKIEKFSAKISVRLCLEGGYRVLSEPVHYLSDVRPAARELWHNRPPIGLIELGIHNAFGLSAMRTRDGRGSCNAYCVAKYGVKWFRTQTVIDSLAPRFHQQCYWDVHDHCTVLTVAVFHNCQIGDKGGLVTGDPVKDVLLGKVRIRLSTLETGRIYTHAYPLISLHGGGIKKMGELQLAVRFSSTSTLGLLQTYAQPHLPPMHYHRPLSIVHQETLRREAVALIAHRLGRMDPPLRRECVEHLCEAHSHRWSMRRSKAHFFRLMAALAPVFAALRWFVDVCHWKNPATTVAVHIIYAILVCCPNLILPTFFVYKFLLGLWNYRCRPRHPWHVDTKVSHAELAHPDELDEEFDEFPTARPHEVVRMRYDRLRSLGARIQEMVGDVAAHAERARCAMTWRDPRATALYLLWCLFLAVTTFLAPFQAVALLTGFYVMRHPALRQRLPDLPTNFFRRLPCKVDCLL

SEQ ID NO: 1693 - DNA, 2144 bp, Panicum virgatum
  misc_feature: Ceres CLONE 1769439
  misc_feature: Encodes the peptide sequence at SEQ ID NO. 1694
aaagaaaaggagaggagtgccccctaacctttccttgctttccactgaaatctcctatctgcaaccatacagttgctcaattctggtctcagctgcagcccaatcattcattggtatataagtcactacaccctctgcattttccacccctttagccatcatcaatccttgaagaagcttcgtgctaccggaggtggtgttcgctgtgcacaattggaggctgtatacatccacagacctgtcagctccgtgagcttggagctcccaggttctgcattgcgctgagatggggaggcattcttgctgctacaagcaaaagttgagaaaggggctctggtctcctgaggaggatgagaagctcatgaatcacataacaaagcatggccatggctgctggagttctgttcccaaactcgcagggctccaaaggtgcggaaagagttgcaggctgagatggataaactatctgaggccagacctcaagagaggggcattctctcaagaggaagaagacctcatcgttgagctgcatgctgtccttgggaacaggtggtctcaaattgcagcacagctgcctggaaggactgacaacgagatcaagaatctatggaactcatgcatcaagaagaagctgaggcagaaaggcattgatcccaacacccacaagccgcttgctaaggctgatcgcaatggtgcagctcccaccatcagcaccgagaggacctcagggtccagcgacgtcaacccgtcgagcactggggctctggggaacttgagccacctcctcagtgagacggctcaatcatcaatgctgctgccagtatatgacaagaatcaatctgaagctccacatttggcacgccctaaggtgccaccaaaggagttgtttctggaccagcttactactggacacaagagcccatcaacctgccgctcatcaggccaaacgctgtacttcccattccaacagccattgggctacagcagcgagagtggcagtggtgatggtgcaagtatgaactcactctggttcaaccagaatgacttcaactgcagcacaatttccactgtgatgccgccagtttcaccatcagccctctcaacatcgatggggctgaatctcccaccagataatcctcgacatggaggcactggcattggaagtgcctcggtagattcattttactgggatggtacaaatcctagcagcagtagcagtactgggagcagaggaagcaacagtttgggatttgaaccacagagcacaagctcaattctggagaacagtgtgttcccatggacagatatcgcacaagaaaaagatacaagagctcacttaggagaggaacttaagtggcctgacttgctccatggaacctttgctgagacgaccatagccatgcaaaaccagagccaatcactctatgatgatgtgatcaaggcagagagccaattcagcatggacggaatgtgtgcttcttggtaccagaatcagcaaccacagcaacagctgcaggcagcaccagacatgtatgacaaagacttgcaaagaatgcaagtttcttttgagaatatctaggcattatgttccaccatatggaacagagcagaccagcagaagaagaaacttataattttcacagattcatgagcagaaatatgctgagccgcttacatagatatgtatcaatgtatgtaagttgatacagaaaccatccaccatagctgttcctcagtcgaagatcctgcagtatcatggaaagggcagtcctggccttaggagtggcagcggaatgcatagaaaagtatgttctagagtctccttttctttctcttcgcaattgtttttttttccttctgtacaagacaactcaacttttggacatttgagttttgttcactctctgtttattaaataaatataggaaagcatgggcaaaactgcatgtgtcggtagctctcataaaccatgcaagtagtcccaaacttttcaaccattgccatgcacgtccatgcagattaattattgcatgttgtattttcatttctacttttgagaagttgccaacaaacggcagttgtatatttgtaaaagaagaaatatggaatattgacctgagagctaaaaaaaaaaaaaaaaaaaa

SEQ ID NO: 1694 - protein, 430 aa, Panicum virgatum
  misc_feature: Ceres CLONE 1769439
  misc_feature (1)..(48): Pfam Name: Myb_DNA-binding Pfam Description: Myb-like DNA-binding domain
MGRHSCCYKQKLRKGLWSPEEDEKLMNHITKHGHGCWSSVPKLAGLQRCGKSCRLRWINYLRPDLKRGAFSQEEEDLIVELHAVLGNRWSQIAAQLPGRTDNEIKNLWNSCIKKKLRQKGIDPNTHKPLAKADRNGAAPTISTERTSGSSDVNPSSTGALGNLSHLLSETAQSSMLLPVYDKNQSEAPHLARPKVPPKELFLDQLTTGHKSPSTCRSSGQTLYFPFQQPLGYSSESGSGDGASMNSLWFNQNDFNCSTISTVMPPVSPSALSTSMGLNLPPDNPRHGGTGIGSASVDSFYWDGTNPSSSSSTGSRGSNSLGFEPQSTSSILENSVFPWTDIAQEKDTRAHLGEELKWPDLLHGTFAETTIAMQNQSQSLYDDVIKAESQFSMDGMCASWYQNQQPQQQLQAAPDMYDKDLQRMQVSFENI

SEQ ID NO: 1695 - DNA, 1947 bp, Panicum virgatum
  misc_feature: Ceres CLONE 1769440
  misc_feature: Encodes the peptide sequence at SEQ ID NO. 1696
agacctcggtgcaaacctgccgcgaaaatagcagccgcccgttcgctctctcccccttcctcccgcgatgagcgacccgcggggcggcgccgccgatcccagccgcgacgggggcgacccgcacgacctcccgctcgccgaggacgctgacggcgaggaagcgcggcaggcgtccgataaagaggcggttcccgtgtcggaagggacagccgcacggggtggggacacgaccccggacgccgaaccggagagcgacgacggagaggacggagtcggctccccggatcaggcggggcccaatgcgggcgaggagcgcgcagagcccgcggccgcggccgaggagcgggaggggatcgttggcgccgccaaggtggagacgaacggcgaggacgcaatcagccacgacgccgacggggaggaggacgatgacgacgacggagacgaggaggacgatgacgacgacgacgacgacgacgacgactccaccccggatgcgtcgccgagggccgaggtgaaggtggagggcgagagctccaccgggatggcccagagtggcgccagccaccgcgtggagccggagcctgacccgttcctcgacggcgatgactctgggacggaggaggagcaggccgcgttcatggcggagctggaacgcttccatagggagcacagcctcgagttcaagccgcccaagttctacggcaagggcctcaactgcctcaagttgtggaggcaggtcgcccacctcggaggccacgagcaggtaacgatttgtaaactatggcgtcaagttggagagactttcaggccgccgaagacctgcactactgtttcttggtcatttcgaattttctacgagaaggcacttcttgaatacgaaaaacacaaagttcggactggtcagcttcagataccaccccctggtctaccacagcctagtggtactgaccgcgaggtgaccgtgaatcaatcatcttccgccagagttagaagggatgctgcagcgcgtgctatgcagggttggcatgctcaccgccttcttgctaatggtacttatggagataacattttgaaggacaaagattcaatgccactttcaagtcgtgataaaaacctaaaaggctttggggtactcaagagaaagaaagcatctagtccagagtatgctctcaagtcatcccgcacgaaagtaaataagtcacaggaagattctatggtcattgatgttggagaaccagccgactgggtgaagatcaatgtacggcagactaaagattgttttgaagtctatgcactagttcctgggcttctacgggaggaggtgcatgttcagtcagatcctgccggtcgtctggttatcacgggggatccggagcagcctgataatccttgggggatcacaccattcaagaaggtggttaacctgccatcgagaattgatccccaccaaacatcagctgttgtcacgcttcatggtcagctatttgtgcgtgcaccatttggccaatctgatatgtagatacgtatcctgtttacttcagttcccgtcgactgtggtatctctttgccagttatattccttgagatttctagggtttattgcagttatattgaagaaataggatcttatctgagcagatacatgctgtcaagctgacatagtagaacttctgcagctggagtccggggttgatctgttatcatcttgtttatcattacagtattattagtcataagactagctggttcatgcgtgtatttcaaaatttatggtgagattttgtttagatagaaaggagagaagacgctggtgatagggctaacattatagcaacttgttattgtttattattttccttctatattatataaatgcctgtctggggcaccccaaggcgtcctatagcggcactccgtatttctgtgcaaaaaaaaaaaaaaaaaaaa

SEQ ID NO: 1696 - protein, 483 aa, Panicum virgatum
  misc_feature: Ceres CLONE 1769440
  misc_feature (1)..(103): Pfam Name: ARID Pfam Description: ARID/BRIGHT DNA binding domain
MSDPRGGAADPSRDGGDPHDLPLAEDADGEEARQASDKEAVPVSEGTAARGGDTTPDAEPESDDGEDGVGSPDQAGPNAGEERAEPAAAAEEREGIVGAAKVETNGEDAISHDADGEEDDDDDGDEEDDDDDDDDDDDSTPDASPRAEVKVEGESSTGMAQSGASHRVEPEPDPFLDGDDSGTEEEQAAFMAELERFHREHSLEFKPPKFYGKGLNCLKLWRQVAHLGGHEQVTICKLWRQVGETFRPPKTCTTVSWSFRIFYEKALLEYEKHKVRTGQLQIPPPGLPQPSGTDREVTVNQSSSARVRRDAAARAMQGWHAHRLLANGTYGDNILKDKDSMPLSSRDKNLKGFGVLKRKKASSPEYALKSSRTKVNKSQEDSMVIDVGEPADWVKINVRQTKDCFEVYALVPGLLREEVHVQSDPAGRLVITGDPEQPDNPWGITPFKKVVNLPSRIDPHQTSAVVTLHGQLFVRAPFGQSDM

SEQ ID NO: 1697 - DNA, 1479 bp, Panicum virgatum
  misc_feature: Ceres CLONE 1769444
  misc_feature: Encodes the peptide sequence at SEQ ID NO. 1698
attcccagcactgagcacacgcggacacgccactagctagcctcctcccggtctgagcagctcatcaacgccgccggcaagaagccccctcgagctcgccgccggcagccagccagccagccagccatgggctcgaccgccgccgacgtggccgcggccgcggacgaggaggcgtgcatgtacgcgctgcagctggcgtcgtcgtccatcctgccgatgacgctcaagaacgccatcgagctgggcctgctggaggtgctccagaaggaccccgcggcggcgctggcgccggaggaggtggtggcgcggctgcccgtggcgccggccaacccggacgcggcggccatggtcgaccgcatgctgcgcctgctcgcctcctacgacgtcgtcaggtgccggatggaggagggcaaggacggccggtactcgcgccggtactccgccgcgccggtgtgcaagtggctcacccccaacgaggacggcgtctccatggccgcgctcgcgctcatgaaccaggacaaggtcctcatggagagctggtactacctcaaggacgcggtgctggagggcggcatcccgttcaacaaggcgtacggcatgacggcgttcgagtaccacggcacggacccgcgcttcaaccgcgtgttcaacgagggcatgaagaaccactcggtgatcatcaccaagaagctgctcgagttctacgccggcttcgagggcgtcggcaccctggtcgacgtcggcggcggcgtcggcgccaccctgcacgccatcacctcccgctaccccggcatcaggggggtcaacttcgacctgccccacgtgatctccgaggcgccgccgttccccggcgtggagcacgtcggcggggacatgttcaaggccgtgcccgccggtgacgccatcctcatgaagtggatcctccacgactggagcgacgcccactgcgcggcgatcctcaagaactgctacgacgcgctccccgccggcggcaaggtgatcgccgtcgagtgcatcctgccggtgaacccggaggcgacgcccaaggcgcagggcgtgttccacgtcgacatgatcatgctcgcgcacaaccccggaggcaaggagcgctacgagagggagttcgaggagctcgccaagggcgccggcttcaccgggttcaaggccacctacatctacgccaacgcatgggccatcgagttcaccaagtagatctgttgtcgcgcatgtgcttgtgcttaatttgctttcttcatcatcatcttcatcctgctgctggcctgcctgccggcctccatggccggaccaccatcgatccttgttctggattccaaattctaatggttgtatgtgttgagatgtctctaccatgtaccattaataaataataacagccaatgtactcttatatatatacatattgtaacaccccagttgttaatcacttgtagttaaggtcaaaaaaaaaaaaaaaaaaaa

SEQ ID NO: 1698 - protein, 361 aa, Panicum virgatum
  misc_feature: Ceres CLONE 1769444
  misc_feature: Great-hit functional homolog of the protein sequence encoded by LOCUS At5g54160
  misc_feature (2)..(246): Pfam Name: Methyltransf_2 Pfam Description: O-methyltransferase
  misc_feature (1)..(361): SWISSPROT Homolog: EC 2.1.1.68 Caffeic acid 3-O-methyltransferase
  misc_feature: Useful for making plants with altered cell wall content and/or composition
MGSTAADVAAAADEEACMYALQLASSSILPMTLKNAIELGLLEVLQKDPAAALAPEEVVARLPVAPANPDAAAMVDRMLRLLASYDVVRCRMEEGKDGRYSRRYSAAPVCKWLTPNEDGVSMAALALMNQDKVLMESWYYLKDAVLEGGIPFNKAYGMTAFEYHGTDPRFNRVFNEGMKNHSVIITKKLLEFYAGFEGVGTLVDVGGGVGATLHAITSRYPGIRGVNFDLPHVISEAPPFPGVEHVGGDMFKAVPAGDAILMKWILHDWSDAHCAAILKNCYDALPAGGKVIAVECILPVNPEATPKAQGVFHVDMIMLAHNPGGKERYEREFEELAKGAGFTGFKATYIYANAWAIEFTK

SEQ ID NO: 1699 - DNA, 1252 bp, Panicum virgatum
  misc_feature: Ceres CLONE 1769445
  misc_feature: Encodes the peptide sequence at SEQ ID NO. 1700
acacgtacaccacagcctagctagctagtcctctgtcctctccatggcggcgtccgaggtcagctggctatctccggcgtcccgcctcccgtccgtcgccaacgcaccacctcgctttcacgccaggccgcctaagccagcagccgcctccctgctctctccctcatcccgcccaggcccagctgcagcggccctgctcgtgctgcaccgcaggggcagggtgaccaccgtccgccgccgtcttggcgccaccgagcagcaaggccaggttcaggagcaggaggacgaggtggtcgacggcaacgtcctcccctactgcagcatcgacaagaagcagaagaagacggtgggggagatggagcaggagttcctacaggctctccagtccttctactacgaccagaaggccatcatgtccaacgaggagttcgacaacctcaaggaggagctcatgtgggaagggagcagtgtcgtcatgctaagccctgatgagcaaaggcttttggaggcttccatggcctatgcggctggcaatcccatcatgtctgatgctgaatttgacgagttgaaactgagattgaagaaagacgggagtgacattgtgacggaaggtcccaggtgcagtctcaggagtcgtaaggtgtacagtgacctgtctgttgactacttaaagatgttcctgctaaatgttccagccaccgtagttgctctgggactgttcttcttcattgatgagttgactggctttgagatcaatgtgttccagctgccggagccttttggtttcattttcacatggtttgctgctttgccactaatattgttcttagcacaatcgttgactaaagccatagtccaggactttctaatcctgaaggggccatgtccaaattgtggcactgaaaatctttccttcttcgggacaatactgtcggtctctagtggcggtacaacaaacaacgtcaaatgtgcagattgcggtaccgagttggtatatgactcaaaatctcggctcatcacacctgcagaagcgtcaaaagcataagcctgccaacagtcgctagctctgtccatctctactttgtagggtcggcaataaattactcctaactagtctgtgtatgtatgtatgtatgtatgtatgtatgtatgtatgtatgtatgtatccaagagcttatgagatgtgtgtgtgtatttatatgtaatatatatgtatagtacgtacagctgcaaaaaaaaaaaaaaaaaaaa

SEQ ID NO: 1700 - protein, 333 aa, Panicum virgatum
  misc_feature: Ceres CLONE 1769445
  misc_feature: Great-hit functional homolog of the protein sequence given in SEQ ID NO 9367
  misc_feature: Useful for making plants with modulated nitrogen use efficiency
MAASEVSWLSPASRLPSVANAPPRFHARPPKPAAASLLSPSSRPGPAAAALLVLHRRGRVTTVRRRLGATEQQGQVQEQEDEVVDGNVLPYCSIDKKQKKTVGEMEQEFLQALQSFYYDQKAIMSNEEFDNLKEELMWEGSSVVMLSPDEQRLLEASMAYAAGNPIMSDAEFDELKLRLKKDGSDIVTEGPRCSLRSRKVYSDLSVDYLKMFLLNVPATVVALGLFFFIDELTGFEINVFQLPEPFGFIFTWFAALPLILFLAQSLTKAIVQDFLILKGPCPNCGTENLSFFGTILSVSSGGTTNNVKCADCGTELVYDSKSRLITPAEASKA

SEQ ID NO: 1701 - DNA, 1813 bp, Panicum virgatum
  misc_feature: Ceres CLONE 1769464
  misc_feature: Encodes the peptide sequence at SEQ ID NO. 1702
accgctgctccccaccccgtcatcccctccccttccgccctcgccccctcctcgccgccgccgccgctcccgcctcggcccccgcagccgccatggaccccgtggccacatggggtctgaccccgctcgccggcgccgacccggaggtctacgacctcctggagcgcgagaagcggcgccagcggcgcggcatcgaactcatcgcctccgagaacttcacctccttcgccgtcatggaggcgctcggctccccgctcaccaacaagtactccgagggcatgcccggcgcccgctactacggcggcaacgacgtcatcgacgagatcgagaacctctgccgctcccgcgccctcgccgccttccgcctcgacccggccgcctggggcgtcaacgtgcagccctactcgggctcccccgccaacttcgccgcctacaccgcgctgctcaacccgcacgaccggatcatgggcctcgacctcccctccggcggccacctcacccacgggtactacaccgccggcgggaagaagatctccgccacctcgatctacttcgagagcctgccgtacaaggtgagcgccaccaccggctacatcgactacgagaagctcgaggagaaggccctcgacttccgccccaagctcatcatctgcggtggcagcgcctaccccagggactgggactacgccaggctcagggccgtcgccgacaaggtcggggcgctgctcctctgcgacatggcgcacatcagcgggctcgtcgccgcgcaggaagctgcaaatccttttgagtattgtgatgtggttaccactaccacgcacaagtctcttcgcgggccaagggctggcatgattttctacaggaaaggacctaagcccccaaagaagggccagcctgagggtgctgtgtatgactacgaagacaagatcaactttgcggtgttcccatctctgcaaggtgggcctcacaaccaccagattgcggcacttgctgttgctctgcagcagactatgacacctggcttcaaagcctatgcaaagcaagtgaaggcgaatgctgttgccattggaaactatctcatgagcaagggctacaagatggtgactgatggaactgagaaccaccttgttctctgggatctccgccctcttggcttgactggaaacaaggttgaaaagctctgtgacctttgtcacatcacattgaacaagaatgctgtcttcggtgacagcagtgcattggctccgggtggtgtccgcattggtgcccccgcgatgacctcgaggggtctggtggagaaagactttgaacagattggtgagttccttcaccgggcggtgaccatctgcctgaacatccagaaggagtatggcaagctcctcaaggacttcaacaagggccttgtgaacaacaaggacattgagaacctcaaggctgaggtggagaagttcgctgactccttcgacatgcctgggttcacgctcgagagcatgaagtacaaggagtagattcctcctctgtgcgcctaggcaaggctctcctgtactgatgtctttcttcgcagctgtgtgagtgctatgatgccgcactgccatgctcgtgataatgatgatgccttatggattttgtctaccccgtcagcaggataggctcataagtgccccctgcgcctctggtttggttgccttccagtgtttcagttttttcttctaggagttgtttcgctcagaatcatatgggaatgtcaatcaggtgttttccaattgccaataataattcagtggtttttgctcaaaaaaaaaaaaaaaaaaaa

SEQ ID NO: 1702 - protein, 471 aa, Panicum virgatum
  misc_feature: Ceres CLONE 1769464
  misc_feature (5)..(398): Pfam Name: SHMT Pfam Description: Serine hydroxymethyltransferase
  misc_feature (11)..(470): SWISSPROT Homolog: EC 2.1.2.1 Serine hydroxymethyltransferase, mitochondrial precursor
  misc_feature (2)..(471): SWISSPROT Homolog: EC 2.1.2.1 Serine hydroxymethyltransferase, mitochondrial precursor
MDPVATWGLTPLAGADPEVYDLLEREKRRQRRGIELIASENFTSFAVMEALGSPLTNKYSEGMPGARYYGGNDVIDEIENLCRSRALAAFRLDPAAWGVNVQPYSGSPANFAAYTALLNPHDRIMGLDLPSGGHLTHGYYTAGGKKISATSIYFESLPYKVSATTGYIDYEKLEEKALDFRPKLIICGGSAYPRDWDYARLRAVADKVGALLLCDMAHISGLVAAQEAANPFEYCDVVTTTTHKSLRGPRAGMIFYRKGPKPPKKGQPEGAVYDYEDKINFAVFPSLQGGPHNHQIAALAVALQQTMTPGFKAYAKQVKANAVAIGNYLMSKGYKMVTDGTENHLVLWDLRPLGLTGNKVEKLCDLCHITLNKNAVFGDSSALAPGGVRIGAPAMTSRGLVEKDFEQIGEFLHRAVTICLNIQKEYGKLLKDFNKGLVNNKDIENLKAEVEKFADSFDMPGFTLESMKYKE

SEQ ID NO: 1703 - DNA, 610 bp, Panicum virgatum
  misc_feature: Ceres CLONE 1769483
  misc_feature: Encodes the peptide sequence at SEQ ID NO. 1704
tccgtccccactcgtgcgtggcgtgatcctagttcctagctagggttagtacccctcgtctcgccgctctcgcgatggacaagggcggcgtcgcggtggccccggccccggcgggctcctccgccgccgcggggaagaaggccaagcgcttcgacatcaagaagtggaacgccgtctccctctgggcctgggacatcgtggtggacaactgcgccatctgccgcaaccacatcatggacctctgtatcgagtgtcaggcgaaccaggcgagcgccaccagcgaggagtgcaccgtcgcttggggagtttgcaaccatgcattccatttccactgtatcagtcgttggctcaagactcgtcaagtgtgccctctagacaacagcgagtgggagttccagaagtatggtcactagacagtcgtggcttcgctgtggagttgcttcatgtttctcgtagtttagcagtaatggtaactgatgattctgaagaaggctatggatggttaatgtttcttaaacttggattttgggttgtaccttatgcatccttaagaaggggttcggcaactatttcctcccgtaaagttgtagatgaatatctcccttcgcag

SEQ ID NO: 1704 - protein, 112 aa, Panicum virgatum
  misc_feature: Ceres CLONE 1769483
  misc_feature (1)..(56): Pfam Name: zf-C3HC4 Pfam Description: Zinc finger, C3HC4 type (RING finger)
MDKGGVAVAPAPAGSSAAAGKKAKRFDIKKWNAVSLWAWDIVVDNCAICRNHIMDLCIECQANQASATSEECTVAWGVCNHAFHFHCISRWLKTRQVCPLDNSEWEFQKYGH

SEQ ID NO: 1705 - DNA, 1487 bp, Panicum virgatum
  misc_feature: Ceres CLONE 1769484
  misc_feature: Encodes the peptide sequence at SEQ ID NO. 1706
gctgaagcgaaagctcaagcaatcgaacaacagtcgcctaatccacactcaaatcaagccccaaacagcctccagatcccccgatagaggtcacccaccgcagcctctgcagcgagatggctcccgagattgccggcaagatgaccgctaaggccgccgccgccgccgccgccgccgccgccgcggtgaagcccgcgaccagggcgtacgtgacgttcctggcgggtgacggcgactactggaagggcgtggtgggtctggccaagggcctgcgcaaggtcggctcggcgtacccgctggtggtcgccgtgctgcccgacgtgccggaggcccaccgccggatcctcgtctcgcagggctgcatcgtccgcgagatcgagcccgtgtacccgccggagaaccagacgcagttcgccatggcctactacgtcatcaactactccaagctccgcatctgggaattcgtggagtacgagcggatggtgtacctggacgcggacatccaggtgttcgataacatcgacgagctgttcgagctcgagaagggccacttctacgcggtgatggactgcttctgcgagaagacgtggagccacaccccgcagtacaagatcggctactgccagcagtgccccgacaaggtcgcgtggcccaccgccgagctcggccccccgccggcgctctacttcaacgccggcatgttcgtgcacgagcccagcatggccaccgccaaggccctgctcgagacgctccgcgtgaccccacccacccccttcgcggagcaggacttcctgaacatgttcttccgggagcagtacaagccgatcccgctcgtgtacaaccttgtgctggccatgctgtggaggcaccccgagaacgtgcagctggagaaggtgaaggtggtgcactactgcgcggcggggtcgaagccctggaggtacacgggcaaggaggccaacatggaccgcgaggacatcaagatgctggtgaagaagtggtgggacatctacaacgacgagagcctggacttcaagggcctgcccgccgccgacgacgacgacgaggtggaggcggtggccaagaagccgatccgcgcggcgctggcggaggccggcacggtcaagtacgtcaccgcgccgtcggccgcgtgatccccgtgctgcggctggagtgttcatcactcatcagaacataagaaagatcttactacgatgcctttagtttttctttctttcacttcccgttttgtttcctgatgaattagggtgtctgaattccaatcagttccgttccactgtgggtgtggtgtgagcttactataccattccaagtgtaagggttcggtcaggattgggctttgtgaacacgccccctctggtcacagccagagtatttgtcctgtgccgagggattattatgtttagtatttcggttggtaacttaattatgaagatactattacataataaaaaaaaaaaaaaaaaaaa

SEQ ID NO: 1706 - protein, 344 aa, Panicum virgatum
  misc_feature: Ceres CLONE 1769484
  misc_feature: Great-hit functional homolog of the protein sequence encoded by LOCUS At2g47180
  misc_feature (1)..(246): Pfam Name: Glyco_transf_8 Pfam Description: Glycosyl transferase family 8
  misc_feature: Useful for making plants with altered cell wall content and/or composition
MAPEIAGKMTAKAAAAAAAAAAAVKPATRAYVTFLAGDGDYWKGVVGLAKGLRKVGSAYPLVVAVLPDVPEAHRRILVSQGCIVREIEPVYPPENQTQFAMAYYVINYSKLRIWEFVEYERMVYLDADIQVFDNIDELFELEKGHFYAVMDCFCEKTWSHTPQYKIGYCQQCPDKVAWPTAELGPPPALYFNAGMFVHEPSMATAKALLETLRVTPPTPFAEQDFLNMFFREQYKPIPLVYNLVLAMLWRHPENVQLEKVKVVHYCAAGSKPWRYTGKEANMDREDIKMLVKKWWDIYNDESLDFKGLPAADDDDEVEAVAKKPIRAALAEAGTVKYVTAPSAA

SEQ ID NO: 1707 - DNA, 1549 bp, Panicum virgatum
  misc_feature: Ceres CLONE 1769510
  misc_feature: Encodes the peptide sequence at SEQ ID NO. 1708
ctccctccactacgccgcgcgcgctccctcccacccctcccctccaccaccacaagcaccgcgtcgacaccacctgccatcgccgcgccgagctcagcctctagctagctgcgccaggagggcgcccgcctcgctccctccctgccgacgccagtgcgatggagctgcataagtactggggcgtggggggccggcggtgcggcgactgcgaggcggccccggcggcggtgcactgccgctcgtgccccgccaccgccgggggcgcgttcctctgcgctgcgtgcgacgcgcgcccggggcacgcgcggctgggccacgagcgcgtgtggatgtgcgaggtctgcgagctggcccccgccgccgtcacctgcaaggccgacgccgccgtgctctgcgccgcctgcgacgccgacatccacgacgccaacccgctggcgcgccgccatgcgcgcgtccccgtcgcgcccatcgggtccgaggccgccgcctccgccgtcgaggccatgctgttcgggaccggcgacggcgacccggccgcgcccgaggccgaggagccgcaggacgcggcggccgggcacgggcacgggcagctccagcaccaccaccagcacgcgctgaacctcaacgtggaggccaaggacatgaagctggactacctcttctccgacctggacccctacctcagcgtcgacatcccgcgcttccagcacgccgacagcgtcgtccccagcggcgtcggcgccggagccgccgccggcgccgtcgagctggacttcacgtgcggcatcggcgtcaagccctcctcgtacagctcctacacggcaacatccttcgcccacagcggctcctcctctgaggtcggcgtggtgccggaggccttctgcggcggcggcgccgggaccttcgagctcgacttcacccggcccaagcctcaagcctacatgccgtacaccgcgactcctcagagccacagcgtgtcgtcggtggacgtggaggtggcggcggcggagcggggggacatggcggcggcgaggccggtgccgctggtgggggagagccgggaggcgcggctgatgcgctaccgggagaagcggaagaaccggcggttcgagaagaccatccggtacgcgtcccggaaggcctacgccgagacgcggccgcggatcaagggccggttcgccaagcgcgccgaccacgacgccgacgacgccgaggccgaggccgccgtgccgtcgccggcgtcgtacgtgctcgacttcggctacggcgtcgtgcccagcttctgatcgatcgacgacggtccggcgggcggcggcgcgcctgacccggcactggcgcgcgcgccttgtgtacttgtatcgatgcatgatgtataggggaggaatagtaaatcccatgtactactctctttttggagctgtgctagccttgcgcacgctagtgatgtataatttgtatactacgcgctgctacttactactagcatgttcttgctggaattagccccggctatttttgaatcaaatctatgcaagaaatttgtaacggt

SEQ ID NO: 1708 - protein, 375 aa, Panicum virgatum
  misc_feature: Ceres CLONE 1769510
  misc_feature (1)..(48): Pfam Name: zf-B_box Pfam Description: B-box zinc finger
MELHKYWGVGGRRCGDCEAAPAAVHCRSCPATAGGAFLCAACDARPGHARLGHERVWMCEVCELAPAAVTCKADAAVLCAACDADIHDANPLARRHARVPVAPIGSEAAASAVEAMLFGTGDGDPAAPEAEEPQDAAAGHGHGQLQHHHQHALNLNVEAKDMKLDYLFSDLDPYLSVDIPRFQHADSVVPSGVGAGAAAGAVELDFTCGIGVKPSSYSSYTATSFAHSGSSSEVGVVPEAFCGGGAGTFELDFTRPKPQAYMPYTATPQSHSVSSVDVEVAAAERGDMAAARPVPLVGESREARLMRYREKRKNRRFEKTIRYASRKAYAETRPRIKGRFAKRADHDADDAEAEAAVPSPASYVLDFGYGVVPSF

SEQ ID NO: 1709 - DNA, 2416 bp, Panicum virgatum
  misc_feature: Ceres CLONE 1769512
  misc_feature: Encodes the peptide sequence at SEQ ID NO. 1710
ctctctgctccctcgtggtgctgggctgctctgctttgaccttgctggcttcatccgcctttccccaccgtttcttggatttctaggatccaagaaactcccccctgcacacagggagttcggtgatccgggcgggcttgggtttcttgtttcttgattcctccgggtgctgtcggattcgcgtagccgggggcgggggagatgacggtggaggaggtgaagctgcaggggaaggccaacggcgggcatggggccagggaccagttccccgtcggcatgcgcgtgctcgccgtcgacgacgaccccacctgcctcaaggtcctcgagaacctcctgcttcgctgccagtaccatgtgacaacaactggacaggcggccacggccctgaagctgttgagggagaagaaggaccagtttgaccttgtgatcagtgatgtccacatgccggacatggatggtttcaagctcctcgagcttgtgggcctcgagatggacctcccagtcattatgttgtctgcaaatggggagacacaaacagtcatgaagggtatcacccatggagcatgtgactacctgctgaaaccagtgcgtattgagcagttgaggacaatatggcaacatgtggttaggcggaagagttccgatgccaagaatcatggtaatgataacgatgattctggtaaaaagttgcagttggctagtgctgaaggtgacaatggcggtgttaatcgcaacaagagaacttcacgcaagggtagggatgataatggagacgaaggtgatgattctgatgatagtaatgagaatggagactcgtcgacccagaagaagccaagggttgtgtggtctgttgaattgcaccgaaagtttgtggctgctgtcaaccagcttggcattgacaaggctgttccaaagaaaatactggatctcatgaatgttgagaacatcacaagggagaacgttgcgagtcacttgcaaaagtaccggctgtatctgaaaagacttagtgctgatgcaagcaggcaggctaaccttactgctgcatttggaggaaggaatcctgcttatgttaacatgggactagaaaccttcaggcagtacaatgcatatgggagatatcggccagttccaacccctaaccattcacagtccaacaaccttcttgcaaggatgaactccccttctgcatttgggatgcatggtttgctgccttcgcagtcacttcagatcagacacacccagaataatctgaacacttccttgggcaatgttggtgggatgaacaatggtaacctgatcaggggtgctcatatgccactgcaggatagtagcaaatgctttcctactggtccttctggcaactcttttgcaaacatatcaaatggcacaacattggttccaacaaataacttgccactacattctcttgagccaagcaaccagcaacaccttggtcggatgcactcttcttctaccgacccgtttaactcatttgttggcgagtctccccagtttccagatcttggaagatgcaacaccacctggccaacagcagtttcatcatcaaacgttcatgaacttggtcagaaggacagcatgtcccaaccaaacctgcatgtgaatgcccccaagcttgagcctctctcaagctttacagaagcatccagtcagattcccttgctgggaaatgaaatgcagggccaagtagcatcactagcaagcaccggtcttccaatgccgttcaatcaggaagcagtgccgttcacatatggaagcagcgccaactcaagagagatgctgaataacaaccttgctcttagtaattcaggcatcaactcctcattgccgaaccttcgcatagacaattctgttgttccaaggcagacactggatggtggtaattcagggggtggtgttcctcctctccaagatggcaggattgatcagcaggctgttagtagtcagctaaactataacaacaatctcatggggacaagtaggctgcagagaggactcagcggtggtctggatgacattgttgttgacatgtttaggccggaccgtgcagacgacggtgtccccttcatcgatggggactgggagctggtctagcaggtttcagctccctacatcaagtcttggtgtgagattttccgcatttgtcggggtcggcggttgattggtccatgctaattgcctgctcaaagttgtttatatagtagcaagtttgcatcacaaaggccttttttgcatttggcttttcagtctagcagtcaggttccagtgttatgcctgagcatcgactatgtggtatttgctaccttaactcgtatggctatgtttaagtcaggtataactgtggttatcgtgatatatagcatggttatgagcgaagcaaaaaaaaaaaaaaaaaaaa

SEQ ID NO: 1710 - protein, 636 aa, Panicum virgatum
  misc_feature: Ceres CLONE 1769512
  misc_feature (1)..(51): Pfam Name: Myb_DNA-binding Pfam Description: Myb-like DNA-binding domain
  misc_feature: The sequence is a functional homolog of  SEQ ID NO 172 in the  10/666,642 US patent application
  misc_feature: The sequence is a functional homolog of  SEQ ID NO 2510 in the  10/374,780 US patent application
  misc_feature: The sequence is a functional homolog of  SEQ ID NO 686 in the  10/412,699 US patent application
  misc_feature: The sequence is a functional homolog of  SEQ ID NO 933 in the  10/666,642 US patent application
  misc_feature: The sequence is a functional homolog of  SEQ ID NO 934 in the  10/666,642 US patent application
  misc_feature: The sequence is a functional homolog of  SEQ ID NO 935 in the  10/666,642 US patent application
  misc_feature: The sequence is a functional homolog of  SEQ ID NO 936 in the  10/666,642 US patent application
  misc_feature: The sequence is a functional homolog of  SEQ ID NO 937 in the  10/666,642 US patent application
  misc_feature: The sequence is a functional homolog of  SEQ ID NO 976 in the  10/225,066 US patent application
  misc_feature: Useful for making plants with modulated growth and phenotype characteristics
MTVEEVKLQGKANGGHGARDQFPVGMRVLAVDDDPTCLKVLENLLLRCQYHVTTTGQAATALKLLREKKDQFDLVISDVHMPDMDGFKLLELVGLEMDLPVIMLSANGETQTVMKGITHGACDYLLKPVRIEQLRTIWQHVVRRKSSDAKNHGNDNDDSGKKLQLASAEGDNGGVNRNKRTSRKGRDDNGDEGDDSDDSNENGDSSTQKKPRVVWSVELHRKFVAAVNQLGIDKAVPKKILDLMNVENITRENVASHLQKYRLYLKRLSADASRQANLTAAFGGRNPAYVNMGLETFRQYNAYGRYRPVPTPNHSQSNNLLARMNSPSAFGMHGLLPSQSLQIRHTQNNLNTSLGNVGGMNNGNLIRGAHMPLQDSSKCFPTGPSGNSFANISNGTTLVPTNNLPLHSLEPSNQQHLGRMHSSSTDPFNSFVGESPQFPDLGRCNTTWPTAVSSSNVHELGQKDSMSQPNLHVNAPKLEPLSSFTEASSQIPLLGNEMQGQVASLASTGLPMPFNQEAVPFTYGSSANSREMLNNNLALSNSGINSSLPNLRIDNSVVPRQTLDGGNSGGGVPPLQDGRIDQQAVSSQLNYNNNLMGTSRLQRGLSGGLDDIVVDMFRPDRADDGVPFIDGDWELV

SEQ ID NO: 1711 - DNA, 1963 bp, Panicum virgatum
  misc_feature: Ceres CLONE 1769532
  misc_feature: Encodes the peptide sequence at SEQ ID NO. 1712
acatttcggtagctagctagcagagctcgggggacgaggcgacctgtatccatcctagcacatcgcagcgcatcgattaggaggatctcggagggaggcagccggacccgatgacaatcgcagcggcggtgaccgcgcccacgacggcgccagtgcacgtcgcgccgcgccacgctgcgcccgcggtccagccgcgcgcgccgccgcgccgggacccgtcgccgctgaacccgaacacgccggcgcaggcgctccactcggcgagctccgcgcccccctcgtcctcggcggcggcggacggagccagggcccacatcgccaacctcgacaaggtgctcgggaagccgccgaggcccgcgagccacgcggcggccaggcaggagcagcaggagcaggacggcgagcaggagccactcagcgtccgccacggcctgctcaacgcgctgaacctctccttcttcgtgcccatgcccgggatgcgggcgcgcacggccgccgacgagcacatgtcgccgcgcagcctcatgcacatgcagcagctgctctccgccgactccccgcgcgcgtccccgcgctccaccatcgcgccgcgctggcgcagcctccacggggaaggcggctgggcggggctcctcgacccgctcgactccgacctccgccgcgagctcctccgctacggcgacttcgtgcaggcggcctaccaggccttccactcgctgcccacggcgtcggcgaggcaccgcgggctcatgctccccgaccgctcctaccgccccacgcgcagcctcttcgccacctccgcgctatccatgccgccgtgggccaagcgccccaacacgcccgagtggctcacgcagcagtccaactggatcggctatgtcgccgtgtgcgagtcggagcgggaggtcgcccgcatgggccgccgcgacatcgccatcgtgctgcgcggcaccgccacctgcctcgagtgggcggagaacctccgcgcctcgctggtgcccctcgacggcaacagcagcgacggcgcggacgccggagaggaggagcccaaggtggcgcggggcttcctcagcctctacaagacggccggggagaaggtcaagagcctgtccgaggaggtcatggacgaggtgcgccgccttatggacaagtacaagggcgaggagctcagcatcacggtcgtcggccacagcctcggcgccgccctggcgctcctcgtcgccgacgaggtcgccacctccatccccgacgcgccgcccgtcgctgtggtctccttcggcgggcccaaggtgggcaacgccgcgttcgtggacaggctcggcagcagcggcaaggtcaacgtcctgcgcatcgtgaacgccggcgacgtggtcaccaaggtgcccggcgtggcgccgcggctgccgcacaacaaggggcagtaccagcacgtcggcgcggagctccggatcgacagcaagaactcgccgtgcctccgcccggacgcggggcccgcctgccggcacgacctggaggcgtacctgcacctcatcgacgggttcacggggacggggcggcccttccggcacgacgcccgccgcagcgtcatccggctgctgcagatgcagagggggaacgtcaagaaggagtacgtgaaccgcgcgcgcgagctcggcgtcgacccctccgcgccggcggacgtcggccggagcgtggtgtacggcagctgcgccgtcgcgagcccctcctcgtgaccggatcaaattaccgtcgggccatcttgtaaattttgtaggaggaagaagaattctttcgttagtggcggttgcgtcaagggaaatatctctcatttccgctctcttttctccgattaccaactagattaccaattaccatgcatgtacaggaaagactaagcaagcgcaagtgcgcagataaatcaatccagtgaaaacgtgacctggaaaaaaaaaaaaaaaaaaaa

SEQ ID NO: 1712 - protein, 540 aa, Panicum virgatum
  misc_feature: Ceres CLONE 1769532
  misc_feature (1)..(153): Pfam Name: Lipase_3 Pfam Description: Lipase (class 3)
MTIAAAVTAPTTAPVHVAPRHAAPAVQPRAPPRRDPSPLNPNTPAQALHSASSAPPSSSAAADGARAHIANLDKVLGKPPRPASHAAARQEQQEQDGEQEPLSVRHGLLNALNLSFFVPMPGMRARTAADEHMSPRSLMHMQQLLSADSPRASPRSTIAPRWRSLHGEGGWAGLLDPLDSDLRRELLRYGDFVQAAYQAFHSLPTASARHRGLMLPDRSYRPTRSLFATSALSMPPWAKRPNTPEWLTQQSNWIGYVAVCESEREVARMGRRDIAIVLRGTATCLEWAENLRASLVPLDGNSSDGADAGEEEPKVARGFLSLYKTAGEKVKSLSEEVMDEVRRLMDKYKGEELSITVVGHSLGAALALLVADEVATSIPDAPPVAVVSFGGPKVGNAAFVDRLGSSGKVNVLRIVNAGDVVTKVPGVAPRLPHNKGQYQHVGAELRIDSKNSPCLRPDAGPACRHDLEAYLHLIDGFTGTGRPFRHDARRSVIRLLQMQRGNVKKEYVNRARELGVDPSAPADVGRSVVYGSCAVASPSS

SEQ ID NO: 1713 - DNA, 1759 bp, Panicum virgatum
  misc_feature: Ceres CLONE 1769536
  misc_feature: Encodes the peptide sequence at SEQ ID NO. 1714
attcgcctcgcctgacctcgcatggattcccgctcgcttcccctccactccacgcgccgatctgccgccacctgccaggagagcgcgacgcgatccaattgaggcgcaggaggcgggggtgccctgcctgctgcctgcgtgctcccctccagtctccgtccggcctggccgcgctgccgctggacgccaccgcgcgcctgcacggcgtcttggggcggccgccgccacgcgggcgacccggcgaagaagcggtggccgagccgggggagcgcgatgctgtgggtgacgcgcctgtccggcttcttctccgccgccatggtgatggtggtgctatcgccgtcgctccagtccttcccacccgccgaggccatccggtcctcgcagttcgacggcagcgtccgcttcccgggccagatcgcgggcggcgccagggggatcgccttccgccgcgccccgtcgttccgcaatgccgccgattgcggcggcggcggcggcgcgggcaacggcaccgcggtcaatgtctgcgacccctcgctcgtccacatcgcgattacgctcgatgaggagtacctcaggggatccgtcgcggcggtccactcggtggttcagcacgccaggtgccccgagagcgtcttcttccacttcctcgtctccgacccgggcctcggggacctcgtccgcgccgtgttcccgcagctccgcttcaaagtctactacttcgaccccgaccgcgtccgggggctcatctccacgtcggtgcggcaagcgctggagcagccgctcaactatgcgcgcaactacctcgccgacctcctcgagccctgcgtgcgccgcgtcatctacctcgactccgacctcgtcctcgtcgacgacgtcgccaagctctggcgcaccgacctcggcggccgcaccgtcggcgcgcccgagtactgccacgccaacttcaccaagtacttcacaggccggttctggtcagaccagcggttcgccgggacgttcgcggggcggcggccgtgctacttcaacacgggggtcatggtgctcgatctcgagcggtggcggcaagcgagctacacgcagcgcatcgagcggtggatggagatacagaagtcgtcgccagggcgcatctacgagctggggtcgctgccgcccttcctgctggtgttcgcagggcacgtggcgccgatcgaacaccggtggaaccagcacggcctcggcggcgacaatgtcctgggcagctgccgcgacctccacccgggtccggtgagcctgctgcattggtccgggtccggcaagccgtgggcgcggctcggcgccgggcggccgtgcccgctcgatgcgctctgggcgcccttcgacctgtacggccccgccggcgccggcgccggcgccgaggagtcctggtaaccgctacactcgaaaaagaaagaaagattcttttccttctttggccgaccccgtacaaattctgagcttctaattcttggtctccattacctgttcaaacctatatgttttttcgtccctttttcttcttttttcccagttcagttcgattaaatgtttggtgctagattgttcatgtttgttcttagtgatctcttctcccacttttttatcattttattactaaaaacagaggtcatttgtttgtatcctactctacaggactgcaatcttgcagcctcaaacatcactataaataaaagcacagagaaatagactttgcactttgcagcaaaaaaaaaaaaaaaaaaaa

SEQ ID NO: 1714 - protein, 377 aa, Panicum virgatum
  misc_feature: Ceres CLONE 1769536
  misc_feature: Great-hit functional homolog of the protein sequence encoded by LOCUS At3g62660
  misc_feature (1)..(255): Pfam Name: Glyco_transf_8 Pfam Description: Glycosyl transferase family 8
  misc_feature: Useful for making plants with altered cell wall content and/or composition
MLWVTRLSGFFSAAMVMVVLSPSLQSFPPAEAIRSSQFDGSVRFPGQIAGGARGIAFRRAPSFRNAADCGGGGGAGNGTAVNVCDPSLVHIAITLDEEYLRGSVAAVHSVVQHARCPESVFFHFLVSDPGLGDLVRAVFPQLRFKVYYFDPDRVRGLISTSVRQALEQPLNYARNYLADLLEPCVRRVIYLDSDLVLVDDVAKLWRTDLGGRTVGAPEYCHANFTKYFTGRFWSDQRFAGTFAGRRPCYFNTGVMVLDLERWRQASYTQRIERWMEIQKSSPGRIYELGSLPPFLLVFAGHVAPIEHRWNQHGLGGDNVLGSCRDLHPGPVSLLHWSGSGKPWARLGAGRPCPLDALWAPFDLYGPAGAGAGAEESW

SEQ ID NO: 1715 - DNA, 1498 bp, Panicum virgatum
  misc_feature: Ceres CLONE 1769539
  misc_feature: Encodes the peptide sequence at SEQ ID NO. 1716
gaaaaagtaaaagggtggacggaggaggaggacaggaacggcgcagggaactaggaccagcggcgggcgacgaatggagaggggcggcgccggcgaggtgatgatgacgtcgggcgcgacgggccggatcgtgccggtgttccgctccgtgctgtcgcggcgcgcgctgctgcgcgccgccgtggcgctgcgcgcgctcttcctctggctgctggtcctcgcgggcgggctgcgccggcgccgcgaggccgcggaggtgtcgccggccgaggcgggggccggggccggggccggggcctggagggcgcggcggcggcggcaggccgcggaggaggaggacgtgcgccgccgcagggcgctcgcggaggaggtggccatggcggaggccgccggcgcggggcgggggaccaggtggggcacgttcctcgtcgccggggccaggaggaacgcgctcttctgccgcctctgggcgcccgccgccgactccgaggagatgaggggcattttggtcatcatacacggtctgaatgaacacagtggaaggtatttgcactttgctgaacagctgacagcatgtggctttggagtatatgccatggattggatagggcatggtggaagtgatggcctgcacggctatgtgccttcactagactatgttatcgaagacatagaagtgcttcttaacaaaattatgatggagaatcctggggtcccttgttttcttctcggtcactccactggcggagctgtggtcttgaaggcatctttgtaccctcatatcagagagaaactggaagggatcatcctgacatcaccagctctgcgtgtgaaacctgcccatcctattgttggggctgtggcaccgatattctctctagtagcacccaagttccagttcaaaggagcaaacaagaggggcatccccgtgtcccgcgacccagccgcgctgctggcaaaatactcggacccattggtctacacagggccgatcagggtccggactgggcacgagatcctgcgcatctcctcgtacctgctgcacaacctgaagaatgtcaccgtcccgttcatggtcctgcacggcacggcggaccgggtgacggacccgctggcttcgcaggacctccacagggaggccgcgtcgaggcacaaggacctgaggctgtacgacgggttcttgcacgacctgctcttcgagcccgagcgcgacgagatcggggccgagatcatcagctggatggacgggatgctccggcggcaggcggtgtgaatggcagctgcgcggtggctttcgcattcttgatcggtggtgtgtctctgaaagtggtttcaatgggttgggcgtggtgtggtgtgttgatcctgttttgaatttgcaagtgggaggagatgatttgtgtgcctagatggatgcaaatttgtgttctctctaaccatcagcagtataataataacgtaaagaggagtatgcattcaaaaaaaaaaaaaaaaaaaa

SEQ ID NO: 1716 - protein, 399 aa, Panicum virgatum
  misc_feature: Ceres CLONE 1769539
  misc_feature (1)..(218): Pfam Name: Abhydrolase_1 Pfam Description: alpha/beta hydrolase fold
MERGGAGEVMMTSGATGRIVPVFRSVLSRRALLRAAVALRALFLWLLVLAGGLRRRREAAEVSPAEAGAGAGAGAWRARRRRQAAEEEDVRRRRALAEEVAMAEAAGAGRGTRWGTFLVAGARRNALFCRLWAPAADSEEMRGILVIIHGLNEHSGRYLHFAEQLTACGFGVYAMDWIGHGGSDGLHGYVPSLDYVIEDIEVLLNKIMMENPGVPCFLLGHSTGGAVVLKASLYPHIREKLEGIILTSPALRVKPAHPIVGAVAPIFSLVAPKFQFKGANKRGIPVSRDPAALLAKYSDPLVYTGPIRVRTGHEILRISSYLLHNLKNVTVPFMVLHGTADRVTDPLASQDLHREAASRHKDLRLYDGFLHDLLFEPERDEIGAEIISWMDGMLRRQAV

SEQ ID NO: 1717 - DNA, 1504 bp, Panicum virgatum
  misc_feature: Ceres CLONE 1769554
  misc_feature: Encodes the peptide sequence at SEQ ID NO. 1718
gaggagcgccttgctatcctttcttcagaactctctcctccgaactgccaaacccgtccctctcctcgccgtccctcgcctcgcctcgcctcccgcggtcggatcaaaaccctagcaaacccttcctccctcgcggcccggtcggccggcgatggcttccgccgcgctcggaactcaggttgctgcagcagccttggcgcccgtcggctcggatggtttcctcaagggctcgtcgcgcaagagtaacaatcgtctaaacttccggagcaaaccatgggttgggaagagcttagcatgggaaaaaccccagcaatcaagacatttgaacaaggtcttctgtatgtctgttcaacaagcaagcaaaagcaaagttgctgttaagcctgttgaattggagaatgcaaatgagccgccgctcaacttatacaaaccaaaggaaccttacacagccacgattgtctcagttgagaggcttgtaggccctaaagcccctggtgaaacatgccacattgtcattgaccatggcggcaatgttccatactgggaaggacagagttatggtgtcattcctccaggggagaatccgaagaaacctggatctccaaatactgttaggctctattctattgcttctactaggtatggtgattcttttgatggaaagacggcaagcttatgtgttcgccgtgctgtttactatgatcctgaaactggaaaggaagacccctcaaagaaaggtatctgcagtaacttcctgtgtgattcaaaaccaggggacaaagttcagatcacaggcccctcgggcaaaattatgcttcttccagaggatgatccaaatgcaattcatatcatgattgccactggcaccggtgttgctccttaccgtggctacctgcgtcgtatgttcatggaagatgtcccaacttacaaatttggtggtctggcgtggctcttccttggtgttgctaactctgacagccttctgtatgacgaagagttcactacctaccttcagcagtacccagacaatttcaggtatgacaaagcactaagcagggagcagaagaacaagaacggcggcaagatgtacgtgcaggacaagattgaggagtacagtgatgaaatcttcaagctcctggacggcggagcgcacatctacttctgtggtttgaaggggatgatgccagggatccaggacacgctcaagagggtggccgagcagagaggagagagctgggaccagaagctgtcacagctgaaaaagaacaagcagtggcacgtggaggtttactaggttgtgaaaatgccacagattatgattgtttctcaacaaggtgagaaactggacatataattgaacgattcttgttgcaatgtaaaattgtggattttattcataagcttctgctccaaatgttgaataaaatgaagcacatgcttttgagttaaaaaaaaaaaaaaaaaaaaaaaaaaaaaaaaaaaacaaaaaaaaaaaaaaaaaaaa

SEQ ID NO: 1718 - protein, 380 aa, Panicum virgatum
  misc_feature: Ceres CLONE 1769554
  misc_feature (1)..(117): Pfam Name: NAD_binding_1 Pfam Description: Oxidoreductase NAD-binding domain
  misc_feature (1)..(380): SWISSPROT Homolog: EC 1.18.1.2 Ferredoxin--NADP reductase, embryo isozyme, chloroplast precursor
  misc_feature (3)..(380): SWISSPROT Homolog: EC 1.18.1.2 Ferredoxin--NADP reductase, root isozyme, chloroplast precursor
MASAALGTQVAAAALAPVGSDGFLKGSSRKSNNRLNFRSKPWVGKSLAWEKPQQSRHLNKVFCMSVQQASKSKVAVKPVELENANEPPLNLYKPKEPYTATIVSVERLVGPKAPGETCHIVIDHGGNVPYWEGQSYGVIPPGENPKKPGSPNTVRLYSIASTRYGDSFDGKTASLCVRRAVYYDPETGKEDPSKKGICSNFLCDSKPGDKVQITGPSGKIMLLPEDDPNAIHIMIATGTGVAPYRGYLRRMFMEDVPTYKFGGLAWLFLGVANSDSLLYDEEFTTYLQQYPDNFRYDKALSREQKNKNGGKMYVQDKIEEYSDEIFKLLDGGAHIYFCGLKGMMPGIQDTLKRVAEQRGESWDQKLSQLKKNKQWHVEVY

SEQ ID NO: 1719 - DNA, 1676 bp, Panicum virgatum
  misc_feature: Ceres CLONE 1769559
  misc_feature: Encodes the peptide sequence at SEQ ID NO. 1720
gttcccgtttttgttaagctctcgcttaacccaaccgccgggagcagcacaagtgttcgacgaaatgacgagcgccgccagatcggcaacgggcgccgcgctgggcgcgcgcacggcgcgctcctgcgacggctgcatgcgccggcgggcgcggtggcactgccccgccgacgacgccttcctgtgccaggcatgcgacgcctccgtccactcggccaaccctctcgcgcgccgccaccaccgcgtccgcctcccctcagcgtcctgctcctcccctccgcgcgaccccgacgcgcccgcgtggctccacggcctcaagcgccggccgcggacgccgcggtccaaaccaagggggagcagcaagcacgaggccacgctcgcatcgatcgccgcggccgtttcggcaacggtgcccgacctcgagacggaggagtctggctccggcatcgtgggcgacaacgacgacttccacgggttggacgacgacgacgaggatcttctgtaccgtgtccctgtgttggaccccatgctcgccgagctcgacaaccccgtggccgacgagggggagcagaagccggcggcctgcctgatcttgtcactcgcggagacgtcgccggagtttgcctccggctcggcggaggcggacgggctctccggattcgacgtcccggacatggagctcgctagcttcgccgcagacatggagagcctcctcatgggagtcgaggacgggtttgataatctggatttcttggacgaggagaagcctcaggtgaacgtggacctgggccgcatgaacctcgaggccatggcggcgccggcgccggcgccggaacgagatgagaagaaaaggaagcggccagagatgatactcaagctcaactacgagggagtcatcgcctcttgggtccgtgacggcgggtcgccgtggttccacggcgagcgtcgtcctcacctcgatccttacgacgagtcctggtcggacttcccggcggggtgcagcaggggcctcctcggcggcgccgtgacagcggtgaccggcggcgagcgggaggcgcgggtgtcgcggtaccgggagaagcggcggacgcggctgttcgccaagaagatccggtacgaggtgcgcaagctcaacgccgagaagcggccgcgcatgaagggccggttcgtgaagcgcagctcgctgccgccgctgccgaggcccccgccgccgccgcagcagcagccgaagcagccgccgcgggcgatgccgcatcacgtgggcatgatgctcgcgccgccagtgggcgcgcacgggcgcttccgtttttgagactagtcgcgcattgcaaagcatagtattatatatatagtgtgtgcatgatgcatcggtgcatctgcgcgtacacgtacatgtgatctacacaaggaaacacaacagacagtatcacgtagcatgttctttctactctacttgtaaatggggacgtacctagagttagttttgagcagaatccgtacagaaatattcgtatccacctgagcagattctaatgtgcaaagaagctaaggatcggtaagtatagatatgtaatgcatagctaggttgggtgcttctcttctgtttgtaaaggacctactaattacaagggcgagtagagtttgatgctcgatctcaaaaaaaaaaaaaaaaaaaa

SEQ ID NO: 1720 - protein, 415 aa, Panicum virgatum
  misc_feature: Ceres CLONE 1769559
  misc_feature (1)..(48): Pfam Name: zf-B_box Pfam Description: B-box zinc finger
  misc_feature: The sequence is a functional homolog of  SEQ ID NO 1522 in the  10/374,780 US patent application
  misc_feature: The sequence is a functional homolog of  SEQ ID NO 1593 in the  10/412,699 US patent application
  misc_feature: Useful for making plants with modulated growth and phenotype characteristics
MTSAARSATGAALGARTARSCDGCMRRRARWHCPADDAFLCQACDASVHSANPLARRHHRVRLPSASCSSPPRDPDAPAWLHGLKRRPRTPRSKPRGSSKHEATLASIAAAVSATVPDLETEESGSGIVGDNDDFHGLDDDDEDLLYRVPVLDPMLAELDNPVADEGEQKPAACLILSLAETSPEFASGSAEADGLSGFDVPDMELASFAADMESLLMGVEDGFDNLDFLDEEKPQVNVDLGRMNLEAMAAPAPAPERDEKKRKRPEMILKLNYEGVIASWVRDGGSPWFHGERRPHLDPYDESWSDFPAGCSRGLLGGAVTAVTGGEREARVSRYREKRRTRLFAKKIRYEVRKLNAEKRPRMKGRFVKRSSLPPLPRPPPPPQQQPKQPPRAMPHHVGMMLAPPVGAHGRFRF

SEQ ID NO: 1721 - DNA, 1658 bp, Panicum virgatum
  misc_feature: Ceres CLONE 1769597
  misc_feature: Encodes the peptide sequence at SEQ ID NO. 1722
atccgccactcagtttgcattgacttcctccgctcttcctgccgcccgtcgtctgtcccgtcctcgccgctgctcagctcacgagcaccaccgcagccaatcccagccgcgtcgtttcttaaatcgccagatcatttattataatgtggggtgagagaactcatcacaagcactggcatcaagggcatggtccacctggaagttccaaggacaaaaaacatgacaaacggcagcccaaatttataccagacaattatagctcggtggatgaggtcaccactgcactgagagaagctggtctcgaatcatcaaatctaattcttggtatcgacttcaccaaaagcaatgaatggtcaggtaggcattcctttggaagaaaatctctgcatgccattaatggcaacccaaatccatatgagcaagctatctctataatcgggcgaacactgtcaccttttgatgatgataacttaataccatgttttggatttggtgatgcttctacgcatgatcactccgtcttcagcttctaccaggatagtcgtccctgtcatggcttcgaggaggttcttgtaaggtatcgacaaattgttccacatttgaatctttcagggccaacttcttttgcacctctgatttatgcagcgatttctgttgttgaaaatagtaattggcaataccatgtccttgtaatcatagctgatggacaggtgactactgctaatacaaatgatggaagattaagtccacaggaacaggcaaccatacaagcaattgttgatgctagtcactatcctctttcaatactaatgattggggtgggtgatggaccgtgggatgcgatgcagcattttgatgactgtatccctgacagagcttttgacaatttccagtttgtgaacttcactgatattatgtcaacaagtaaggatatgtcaaagaaggaggctgcatttgcccttgcagctcttatggaaataccttctcagtataaagcaactcaaggcatccgatatcaagaaaagcaagcacaaaggattggctctcctaggattcttcctcctccaaataaagttcttgaacatgataatgcagcagcttcatatcctcctccaactgcaagctcccggtcaactggcattggcaaaaatgctgctgatgagcaggtatgccccatctgtttaaccaatccaaaggacatggcttttcagtgtggtcacctgacatgcaaggaatgtggtccaactctatcaacctgcccattgtgccgtgagccaattaccatgcgtgtgaggctctactcttaaaacggtgtggcattctgaagggaagggatcggacagttacatccatgggatgccagtcagtaaggagcaagaactcggaagcacagggctttgcgctgcattctcgaacgcgaatgtcataaaaaaaaaccatgtaaaaatgcttctccgtgcctattaagtaatgatgatggttgatgaataacttcatctattgcatgtaaaaatgtattgatatcatgcatcaacatcagggaatattgtgttcttgtgttcataccagagaatagatactttagatggatgttgtgcgctgttatgttcagaatggttaactcttgcacaagtttggaaaaaaaaaaaaaaaaaaaa

SEQ ID NO: 1722 - protein, 387 aa, Panicum virgatum
  misc_feature: Ceres CLONE 1769597
  misc_feature (1)..(33): Pfam Name: zf-C3HC4 Pfam Description: Zinc finger, C3HC4 type (RING finger)
MWGERTHHKHWHQGHGPPGSSKDKKHDKRQPKFIPDNYSSVDEVTTALREAGLESSNLILGIDFTKSNEWSGRHSFGRKSLHAINGNPNPYEQAISIIGRTLSPFDDDNLIPCFGFGDASTHDHSVFSFYQDSRPCHGFEEVLVRYRQIVPHLNLSGPTSFAPLIYAAISVVENSNWQYHVLVIIADGQVTTANTNDGRLSPQEQATIQAIVDASHYPLSILMIGVGDGPWDAMQHFDDCIPDRAFDNFQFVNFTDIMSTSKDMSKKEAAFALAALMEIPSQYKATQGIRYQEKQAQRIGSPRILPPPNKVLEHDNAAASYPPPTASSRSTGIGKNAADEQVCPICLTNPKDMAFQCGHLTCKECGPTLSTCPLCREPITMRVRLYS

SEQ ID NO: 1723 - DNA, 1837 bp, Panicum virgatum
  misc_feature: Ceres CLONE 1769599
  misc_feature: Encodes the peptide sequence at SEQ ID NO. 1724
acatccatatcgacacaacacaggaagcttcccatctgtccgttccccaccacctgcagtctgaactctgaagattactcatggcctagatgctgtcacgattcataaagaccccgccttcacggatcatccttgctacatccgaaagcgcgtgatattttgtggaattgggcttggaaattgcatcttatataggagagttcttggcccttgggggattggttctgcgttctggcgaggaggacgcgaaaggcgatgcctttcagcagcatgatccaggagatgaagggcgagatcggcgcaatctcgcgacgcggcttgctgcggtcgcggtcgcacagaacgggccgcgtccagcgagtggagccggacgaggcggcgatgcgggagagctcctgggcgcacgtccccccggagctcctgcgggtggtgctggcgaaggtcgaggcggtggaggcgcggtggccgggacgcggggccgtcgtggcgtgcgccggcgtctgccgggactggaggggcgccgtgaaggagatcgtgcgcgcgccggaggcgtctggaaggcttaccttccccatctctctcaagcagcctggcccaagggatgcccctcttaaatgtttcattaggaggaaccgggctactcagtcatattttctgtgcattggagtcactgatgcattagctgatgatgggaaattcctacttgctgcacgtaaataccgaaggccgtcatgcactgaatacctgatttcacttgacgcacgtgatacgtcaaaggggaatggtacttatattggcaagttaagatcaaacttcttgggcacaaaatttactgtctatgatgcccatccaccttgtgccggagctgtggcttcgaagggtccatctgcgcacgtgatcggttcagcccaagtttctcccatgaagcctctgcctgctgggaattatccagtttctcacatttcttacgaagtgaatgtattgggttctagagggccaagaaagatgaactgtgttatggattctatccatgtatcagcgattaaagaaggagggactgctcccacgcagactgaatttccatccattaactccacctcattcgcatcagttccattctttggatcgaaatcaggccgactggatagttcaggtgctcaattaaccactcagaatgaaagtaaggtgtcgctgaagaacaagtccccgaggtggcatgaacagcttcagtgctggtgcctcaatttccatggacgggtgatggttgcgtccgtaaagaacttccagctggtggcttcaaatgagagtgctccaactccaagtaaccaggaggaggatgacgttatactccagtttggcaagatagggaaggacctattcaccatggactaccgctatcccatatctgcatttcaggcatttgccatctgcctgagcagctttgacaccaaaattggttgtgaatgaattaaggtgttgggcatatcgataatcacagaaagtcgaatgaaagacagcaaggacaatccttactagttaagtttcaagatggcgagtttggtgaatggtggtgattgatagagctggatacttctattctataatgtcgtgatataaatagcaatatagctttagtgggttttgtaagtgttgggaagtctgaacgactgaacaccagagtgtcctctagtatttcgctttcgattcagcgtttaagttcagactaaaatggagaggtcatatattcatatttgcatctatgtatgcaacctgctatttcaaatgaccattctgagatgccagaaggctcgcagccgaaaaaaaaaaaaaaaaaaaa

SEQ ID NO: 1724 - protein, 403 aa, Panicum virgatum
  misc_feature: Ceres CLONE 1769599
  misc_feature: The sequence is a functional homolog of  SEQ ID NO 462 in the  10/666,642 US patent application
  misc_feature: Useful for making plants with modulated growth and phenotype characteristics
MPFSSMIQEMKGEIGAISRRGLLRSRSHRTGRVQRVEPDEAAMRESSWAHVPPELLRVVLAKVEAVEARWPGRGAVVACAGVCRDWRGAVKEIVRAPEASGRLTFPISLKQPGPRDAPLKCFIRRNRATQSYFLCIGVTDALADDGKFLLAARKYRRPSCTEYLISLDARDTSKGNGTYIGKLRSNFLGTKFTVYDAHPPCAGAVASKGPSAHVIGSAQVSPMKPLPAGNYPVSHISYEVNVLGSRGPRKMNCVMDSIHVSAIKEGGTAPTQTEFPSINSTSFASVPFFGSKSGRLDSSGAQLTTQNESKVSLKNKSPRWHEQLQCWCLNFHGRVMVASVKNFQLVASNESAPTPSNQEEDDVILQFGKIGKDLFTMDYRYPISAFQAFAICLSSFDTKIGCE

SEQ ID NO: 1725 - DNA, 1640 bp, Panicum virgatum
  misc_feature: Ceres CLONE 1769602
  misc_feature: Encodes the peptide sequence at SEQ ID NO. 1726
cctctgcctgccatctctctctgcctcctcccgcaagcgccgccgccgcctcgcccctcccgatctccgaggcaagctgcgacgccgccgccgcggccatggcgttcgagaagatcaaggtcgccaaccccatcgtcgagatggacggcgatgagatgaccagggtattctggcagtctatcaaggacaagcttatcttcccatttttggacttggacatcaagtactatgacttggggattctacaccgtgatgcaactgatgacaaggtcaccgtggaggctgcagaggctactctcaagtacaatgtggctattaagtgtgctaccattaccccagatgaaactcgggttaaggagttcaacctgaagcacatgtggaagagcccaaatggaacaattaggaacattataaatggtactgttttcagagagccaattatttgcaaaaatgttccaagacttgttccaggatggactaagcccatttgcatcggaaggcatgctttcggtgatcagtaccgggctactgatgctgttctgaaggggcctgggaagctcaagctagtttttgaggggaaggaagagcagatcgatctggaggtattcaacttcactggtgctggaggagttgccttgtctatgtacaacacggatgagtcaattcgagcttttgctgcggcttctatgacaactgcttatgagaagaaatggccgctctaccttagcaccaagaatacaatcctgaagaaatacgatgggaggtttaaggacattttccaggaggtctacgaagcagactggaaatccaaatttgaggctgctggaatatggtatgaacatcgtctgatcgatgacatggttgcatatgcgcttaagagtgaaggaggctatgtgtgggcttgcaagaactatgatggagatgtgcagagtgatttcttggctcaaggttttggctcgctgggtttgatgacatcagtgttggtgtgccctgatgggaaaaccatcgaagctgaagctgctcatggcacagttacccgccacttccgtgttcaccagaaaggaggtgaaaccagtacgaacagcatcgcttcaatctttgcttggacgagaggacttgcacacagggcaaagctcgatgacaatgataggctacttgactttgcactcaaactcgaggctgcctgtgttggaactgtggagtctgggaagatgacaaaagatcttgcacttcttgttcacggctcttccaacgtcacgagaagccattacttgaacactgaagagttcattgatgccgttgctgctgagctccaatcaaaactggcagccaattgagcttacaggaagcttttggcaaatttagtgcttcaccacccaccactactaagtcatttcggctacattagcattgttattcacgcttcgcaatggagtgaatgtgccttctgccatttggatgtaagctaattcaagatgctactagtgttatgcgcactctgaataaaggacatagagttggccagtgctgtgattaggttaccagcaataagctccatcgtatttgtggagatgtgtcttgttttctcctttgaattgcatggcttcttcgtcgttcaccaaaaaaaaaaaaaaaaaaaa

SEQ ID NO: 1726 - protein, 412 aa, Panicum virgatum
  misc_feature: Ceres CLONE 1769602
  misc_feature (13)..(379): Pfam Name: Iso_dh Pfam Description: Isocitrate/isopropylmalate dehydrogenase
  misc_feature (1)..(409): SWISSPROT Homolog: EC 1.1.1.42 Isocitrate dehydrogenase [NADP]
  misc_feature (2)..(411): SWISSPROT Homolog: EC 1.1.1.42 Isocitrate dehydrogenase [NADP]
MAFEKIKVANPIVEMDGDEMTRVFWQSIKDKLIFPFLDLDIKYYDLGILHRDATDDKVTVEAAEATLKYNVAIKCATITPDETRVKEFNLKHMWKSPNGTIRNIINGTVFREPIICKNVPRLVPGWTKPICIGRHAFGDQYRATDAVLKGPGKLKLVFEGKEEQIDLEVFNFTGAGGVALSMYNTDESIRAFAAASMTTAYEKKWPLYLSTKNTILKKYDGRFKDIFQEVYEADWKSKFEAAGIWYEHRLIDDMVAYALKSEGGYVWACKNYDGDVQSDFLAQGFGSLGLMTSVLVCPDGKTIEAEAAHGTVTRHFRVHQKGGETSTNSIASIFAWTRGLAHRAKLDDNDRLLDFALKLEAACVGTVESGKMTKDLALLVHGSSNVTRSHYLNTEEFIDAVAAELQSKLAAN

SEQ ID NO: 1727 - DNA, 1983 bp, Panicum virgatum
  misc_feature: Ceres CLONE 1769625
  misc_feature: Encodes the peptide sequence at SEQ ID NO. 1728
attccagaggtgtccgcgtcgggcccgcctccgcgtgcgccgccggcaaatagggtttcgccgtcgccgctctcgccggcgatggacccatcggcgggggcctcccccgatcgcaggggcaacggaccgggcgctggcgccgcaccctccgggcttcgccgctacggcctcaacttctcgccttccagcctcctccaggcctccctcgcggcgctcctcgagtactcgggcgtcgtcccctccggctccaccccgcaggcgccgcaccacccgtccgcggcgccctcttcgccgtcgtcggcgtccgaagtcgacggtctcctctccgccgcggccgccgtggacggggaggtctcgatccggatccagggcggcccgggtgattcggaggccgcgggcggggcggccgcgggaacctcgtccgaggactcgatcgaggcgacaaccggctcggaggttgaccaggcgtccgccgccgggaggggagcagacgctgcggacgcggagactaacggcggtgggggcgcatcggggaacgggggcggggaccgcgcgtaccagcggtacaacgtgcaccacgtggcgcggtggatcgagcagatattgccgttctcgctgctccttctcgtcgtcttcattcggcagcatctccaaggtttctttgtcacaatttggattgctgctgtaatgttcaagtcaaatgatatactgaggaaacaaactgctttgaagggcgagagaaagatatctgtactcattgggattacagtaatcttcactattcatgtgtttggtgtctattggtggtacaggaatgatgatattctcagacctttgttcatgcttcctccaaaagatataccaccattctggcatgcaattttcatcatcctggtcaatgatacaatggttcgccaagccgcaatggctgtcaagtgcatgctacttatgtactacaagaactgcagaggtcggaactaccgtaggcagggccaaatgctaacccttgtggagtaccttctgcttctttatcgtgccttgttgccaactcctgtttggtaccggttctttctgaacaaggaatatgggagtctcttctcttctttaaccaccggcctgtacctgactttcaagttgacttcagtagttgagaaggtccagtcattcttggctgcagtgaaagcactgtcacgtaaagatgtgcattatgggtcttatgcaactgcagaacaggtacttgctgctggtgatatgtgtgccatctgccaggagaagatgcatgtgcctgttctccttcgctgtaaacatattttctgtgaagactgtgtttcagaatggtttgagcgagaacggacctgccccttgtgtagagcactggtaaaacctgctgatattcggtcatttggtgatggttctacaagtctattcttccagttgttttagacttcaaatggcaaatttctaacataacaatgaagaaacaatggcatatggaatattcaaatggtcatttttctttacccatgagagacaatcttcctcagtgtagagattgatatgagaaggttcagcgtggtcacatgacagcacgatggtgatttttgtctatatggtaaagcaatagtttagagctgttcagttgcaacatgcggcaaaatatttcgagcaaactgcttctagagcctgtatgattctgctggacgttcctaatgtgggggcctattggggccgactgctggtggcttgctcgatgtaaaaagctggtaaattttgcacgtggatttatctgggtgtaactgaagcctgcaagttcgtattgcaggattgacttgcacaggcagcaagaattacctgtcgctggaaagtggtagaaaaaagtgtaacttgtaaagcatttgttacgtggaaaatgttgagaactgtatacaaaaaagtagcaccctttgcgaaaatagtaaatactactaggtacgatttatctgc

SEQ ID NO: 1728 - protein, 453 aa, Panicum virgatum
  misc_feature: Ceres CLONE 1769625
  misc_feature (1)..(38): Pfam Name: zf-C3HC4 Pfam Description: Zinc finger, C3HC4 type (RING finger)
MDPSAGASPDRRGNGPGAGAAPSGLRRYGLNFSPSSLLQASLAALLEYSGVVPSGSTPQAPHHPSAAPSSPSSASEVDGLLSAAAAVDGEVSIRIQGGPGDSEAAGGAAAGTSSEDSIEATTGSEVDQASAAGRGADAADAETNGGGGASGNGGGDRAYQRYNVHHVARWIEQILPFSLLLLVVFIRQHLQGFFVTIWIAAVMFKSNDILRKQTALKGERKISVLIGITVIFTIHVFGVYWWYRNDDILRPLFMLPPKDIPPFWHAIFIILVNDTMVRQAAMAVKCMLLMYYKNCRGRNYRRQGQMLTLVEYLLLLYRALLPTPVWYRFFLNKEYGSLFSSLTTGLYLTFKLTSVVEKVQSFLAAVKALSRKDVHYGSYATAEQVLAAGDMCAICQEKMHVPVLLRCKHIFCEDCVSEWFERERTCPLCRALVKPADIRSFGDGSTSLFFQLF

SEQ ID NO: 1729 - DNA, 1871 bp, Panicum virgatum
  misc_feature: Ceres CLONE 1769652
  misc_feature: Encodes the peptide sequence at SEQ ID NO. 1730
atccgcccccccctcctccctcctccacctcctctccccgtgcgcgtgggcgggcggcgggcggcctcgcaccactcgagctcactcgcgccggcatccgccaaaggcttgctcaagatccagcagcccctgcccgcctgccggcctgctgcccccagggccagggcaccgcccgtgacccgcgatcttgcctcacctactcctggattcgatcccatccggccccgtccctctcccctccctttccagatctcacccccgacccatgaccactagggcccgacgcccacgcgaggggagcaccaccaccaccaccacctcctccgctgccgcccatggccccgccccgctgcgctgaacggcttgccccgcgcgtccatggaggatctggccgccgttagctccgccgccgcggggctcacgctcttcgccgccgtcgccgacgtcatggaggaggccgccgcttccgccgccgcgttcgggatcggcgccgcgctgccgccgccccctcccccggtgcaaacggaccgcgggggcgacgacgcctccgcctgcgggagcccgagctccgtcaccagcgactgcagcagcgtcgccaccgccgatttcgagggctttgccgaggtcggctccgcactcgtgctcgacgacctcgtcgccgccgcagctgccgcggtgcctgaggccgcctccggccccaggatcgcgggggccggcgccaggagcgtcttcgcggttgactacgtgccgcgctgggggctcgagtccatatgcggtcgccgccccgagatggaggacgccgccgtcgtgctgccgcgattcttcgacgtgccgctctggatggtcgcgggcgacgcgccggtggacggcctcgaccgggcgtccttccgccttcccgcgcatttcttcggcgtctacgacggccacggtggcgttcaggttgccaattactgccgagagagaatccactccgtactgatagaggagctcagtaaggcagaggaattagtgtgtggcgctgacttaagtggcctggagtctaagaagcagtgggagaaggcctttgtggactgtttcaatcgggttgatgcagaggtgggaggaaatgcggcaactgccgccaagcctgtggctccagacaccgtggggtcaacagcggtagtcgcagtcgtatgctcatcacacataattgttgcgaattgcggcgactcacgagcagtgctctgccggggcaagcagcccttggcgctgtcggtggaccataaaccaaatagggaagatgagtatgcgaggattgaggcgcagggtggcaaggtcatccagtggaatggctatcgggttctcggtgttctcgccatgtcccgatccattggggaccggtacctgaaaccatatataatcccagtccctgaggtcacaattgttgcccgtgcaaaagacgatgagtgccttattcttgcaagtgatggcctctgggatgtaatgtccaatgaagaggtatgcgatgctgctcgcagacggatactgttatggcacaagaagaatgcagaggcgtcatcatcggcccagataagtggtgattctccggatcaagcagctcaagcagctgccgaatacttgtctaagctggctctccagaaggggagcaaggacaacataaccgtcgttgtagttgacctcaagtcgcataggaagttcaagagcaaaacataaccatggattcaggaagacatggacaataacaatactagttactaggatgctacaaatgtggggggaatgaccctgtttagtctgctgcacatgtaaatcggttagcccagcactgtctttttcaggttttccacaaccaaaaaaaaaaaaaaaaaaaa

SEQ ID NO: 1730 - protein, 444 aa, Panicum virgatum
  misc_feature: Ceres CLONE 1769652
  misc_feature (1)..(306): Pfam Name: PP2C Pfam Description: Protein phosphatase 2C
  misc_feature (114)..(444): SWISSPROT Homolog: EC 3.1.3.16 Protein phosphatase 2C ABI2
  misc_feature (174)..(443): SWISSPROT Homolog: EC 3.1.3.16 Protein phosphatase 2C ABI1
MEDLAAVSSAAAGLTLFAAVADVMEEAAASAAAFGIGAALPPPPPPVQTDRGGDDASACGSPSSVTSDCSSVATADFEGFAEVGSALVLDDLVAAAAAAVPEAASGPRIAGAGARSVFAVDYVPRWGLESICGRRPEMEDAAVVLPRFFDVPLWMVAGDAPVDGLDRASFRLPAHFFGVYDGHGGVQVANYCRERIHSVLIEELSKAEELVCGADLSGLESKKQWEKAFVDCFNRVDAEVGGNAATAAKPVAPDTVGSTAVVAVVCSSHIIVANCGDSRAVLCRGKQPLALSVDHKPNREDEYARIEAQGGKVIQWNGYRVLGVLAMSRSIGDRYLKPYIIPVPEVTIVARAKDDECLILASDGLWDVMSNEEVCDAARRRILLWHKKNAEASSSAQISGDSPDQAAQAAAEYLSKLALQKGSKDNITVVVVDLKSHRKFKSKT

SEQ ID NO: 1731 - DNA, 1860 bp, Panicum virgatum
  misc_feature: Ceres CLONE 1769659
  misc_feature: Encodes the peptide sequence at SEQ ID NO. 1732
tacaagcgaaggggttctccgcggcggcgacggcgagccatggagaactcgaagctctcgtcggcgctcttcgcgggcacccacttcaaccgcaagcgcttcgccgccgactttgcgcggttccatcagggcccgactccctcacccgccgccccctgcgcgccgtccccggagaagaagcggaagcgcaagagcggcaaggcgaaggcgaagaagaatcagaagaagcgagcggaagcggctatcgcctcgtcgtcggatgctgtggaggggttcaatgtgttcaagggattgacgggtagaaatgatgagctgcgttctgagaaggtggagacagggaaggatgaggattcggtggctgcgaggcggcggaaggagattgagagggaaatcgagagggctgcagttcttaggaagaggtttgacattcacattgccggacaaaatgttccagcaccacttgagagctttgaagaactgatttcaaggtatggttgtgattcctatctggttgggaacttgtcaaaacttgggtttcatgaacctacaccgatacaaaggcaggccattcccattcttctttcggggagggaatgctttgcttgtgcacctactggttctggcaagacactagctttcttgtttccacttcttatgaaaattaagccagggtctaaaggtggtattaaagctgtgattctttgcccaacgagggaattagctgcacaaactgtcagagaatgcaagaagttggctaaaggaagaaagtactatattaaattgatgaccaaagatctctccaaatcagggaatttcaaagatatgcactgtgatatccttgtttccaccccacttcgtttggaccatgctgtaaagaaaagagaccttgatttaagtagcgtggaataccttgtcttggatgaatctgataaactttttgagcttggatttgttgaagtgattgattcagttgttgaagcctgttccaatccttcaataattcagtctctgttcagtgccacattgcctgattcaattgaggctcttgcacgcactataatgcatgatgccattcgaatcattgttggaagaaagaattcagcctcctcactgattaagcaaaagttgatttttgctggaactgagagggggaaattgttagctcttcgccaaagctttcaagagtctctcaatccaccagtattgatctttgttcaaagcaaagagagggcaaaagagctttacaaagaactggcatttgacgatgttagggctgatgtgattcatgcagacctcaatgagcagcagcgtcaggatgctgttgacaacttgagagctggaaagacctgggtactgatagcaacagaagtcattgctcggggaatggacttcaaaggtgtaaactgtgtgataaactacgattttccggagtcagctgctgcctatattcacaggataggacgatctggaagagccggcagatctggggaggccatcacattcttcacagaggaggacaagccattcttgaggaatattgcgaacgtgctggtatcttcaggttgtgaagttccttcctggataatggcattgccgaagctcaagcgaaagaaacacagggtggatagggacccaatctccaccataccatatgaagattaagaatagcatttttgaggcaatacgttggctccagttgcccagagtggtattgtaaccatagcacattagcaccttgagatgacacgttggcttcagttttccctgtttgaatgcccagtgtatcgatttgtctactaaacagcaaccccagaggagcacatgcatatcttttgttattaaaaaaaaaaaaaaaaaaaa

SEQ ID NO: 1732 - protein, 540 aa, Panicum virgatum
  misc_feature: Ceres CLONE 1769659
  misc_feature (1)..(167): Pfam Name: DEAD Pfam Description: DEAD/DEAH box helicase
  misc_feature (1)..(77): Pfam Name: Helicase_C Pfam Description: Helicase conserved C-terminal domain
MENSKLSSALFAGTHFNRKRFAADFARFHQGPTPSPAAPCAPSPEKKRKRKSGKAKAKKNQKKRAEAAIASSSDAVEGFNVFKGLTGRNDELRSEKVETGKDEDSVAARRRKEIEREIERAAVLRKRFDIHIAGQNVPAPLESFEELISRYGCDSYLVGNLSKLGFHEPTPIQRQAIPILLSGRECFACAPTGSGKTLAFLFPLLMKIKPGSKGGIKAVILCPTRELAAQTVRECKKLAKGRKYYIKLMTKDLSKSGNFKDMHCDILVSTPLRLDHAVKKRDLDLSSVEYLVLDESDKLFELGFVEVIDSVVEACSNPSIIQSLFSATLPDSIEALARTIMHDAIRIIVGRKNSASSLIKQKLIFAGTERGKLLALRQSFQESLNPPVLIFVQSKERAKELYKELAFDDVRADVIHADLNEQQRQDAVDNLRAGKTWVLIATEVIARGMDFKGVNCVINYDFPESAAAYIHRIGRSGRAGRSGEAITFFTEEDKPFLRNIANVLVSSGCEVPSWIMALPKLKRKKHRVDRDPISTIPYED

SEQ ID NO: 1733 - DNA, 1766 bp, Panicum virgatum
  misc_feature: Ceres CLONE 1769681
  misc_feature: Encodes the peptide sequence at SEQ ID NO. 1734
accactccactctatccgcgccgcacgcagttgagtttcgcttcagcctggtggtacgtacagtggtgacaagatgaaattgtggccgttcctcgtgctgctcgtcacgctgctatctgcaaccgcctctcttccgtcagaggcgctcaacgtgagaggccacctgctcaagtccaagaccttcctgtccccgccgatcttcctgcgcccgggctccgtctccaacaagtggtacttcgacatcgccttccccagaggccacctcgcgctcaagagcttcaacgccgaggtcgtcgacgagcgcggcgtccctgtcccgctccacgagacctacctccaccactgggtcgcggagccctacttcgccgtgaaggaagccgccgccgccgccgccgccggcgaggcccagaagcgctccaagggaatcctgaacaggaactccggcgtgtgcaagaacacactgggacagtactacggccttggctccgagacccggcacacggcgacgtgggtgcctgatccctacggcatcgaggttggcaacccggaggcgccgccggaggggtacgaggagaaatggctgctcaacgtgcacgccatcgacaccaggggcgccgccgacaagctggggtgcaccgagtgcaggtgcgacctgtacaatgtgacgatcgatgagcacggccggcgcatccccgaggactacaccggcgggctgtactgctgctatgatgagacccggtgcaaggtgaaggaagggttctccgatggtgaggtgaggaaggtgttcctgcggtacaccgtgacgtggctcgactggagtgatgcggttttgccggtgaagatctacatcttcgatgtcactgacagagctctgcttgaggggaaatcagagcctgcttgcaaggtggaataccaggtcgaggcatgcagctcagagaaccgggccaacaacgactgcgtccatgttcaggcaaccaaacaaatcttgccgcggggaggcgacatcgtgttcggcgttgcgcaccagcattcaggtggcatcgccgcctctctgcacggcgaggacggccggctgctgtgtgaatcggtggcaacctacggcgaagggcaggaggccggaaacgaggcaggctacatcgtcggcatgtcgacctgctacccgaagccgggaagcgtgacggtgcgcgacggcgaggtgctgaccgtggtgtccaactacagcagcgagaggcagcacacgggcgtgatgggcctcttctacatcctcgtggccgagcacaagaaacagcaacagcagcagctgctgccggctgccgccggcaagcctggcctgtgcttcagcttcccggtctcatggtgcctcccgtcatggctgtcgagcaacatgtaaaaaaagtctagcatggtatcttaactgtgataagcgtggaagagttacgcctgaaggggaagaagatagctatcagatttataggtagataaatgcatacaggtacggtgttactgagttgtagtttgtgctgtcttgatgatccatcagttatcttcaatctgatggcctgcatacatgtattaagctgggtttagcagtattagtagcagaagaactgtactgtacgttctccaaataattacccttccacggattagtcgagagttactgtgtgagaactagatggacaatctcttgtacaaaaaagtgtgagattaatacacgtatagggtataataacccttccacggatcaaaaaaaaaaaaaaaaaaaa

SEQ ID NO: 1734 - protein, 438 aa, Panicum virgatum
  misc_feature: Ceres CLONE 1769681
  misc_feature (1)..(373): Pfam Name: SURNod19 Pfam Description: Stress up-regulated Nod 19
MKLWPFLVLLVTLLSATASLPSEALNVRGHLLKSKTFLSPPIFLRPGSVSNKWYFDIAFPRGHLALKSFNAEVVDERGVPVPLHETYLHHWVAEPYFAVKEAAAAAAAGEAQKRSKGILNRNSGVCKNTLGQYYGLGSETRHTATWVPDPYGIEVGNPEAPPEGYEEKWLLNVHAIDTRGAADKLGCTECRCDLYNVTIDEHGRRIPEDYTGGLYCCYDETRCKVKEGFSDGEVRKVFLRYTVTWLDWSDAVLPVKIYIFDVTDRALLEGKSEPACKVEYQVEACSSENRANNDCVHVQATKQILPRGGDIVFGVAHQHSGGIAASLHGEDGRLLCESVATYGEGQEAGNEAGYIVGMSTCYPKPGSVTVRDGEVLTVVSNYSSERQHTGVMGLFYILVAEHKKQQQQQLLPAAAGKPGLCFSFPVSWCLPSWLSSNM

SEQ ID NO: 1735 - DNA, 2473 bp, Panicum virgatum
  misc_feature: Ceres CLONE 1769706
  misc_feature: Encodes the peptide sequence at SEQ ID NO. 1736
acatccacgtcgccgccgccgccgccatgcttctcctttccttcaccgcgcggctccccctcgccgtctccgcccgcctccccagccctcccaccacccgcctcctcctcctcgccgccctccctccctcctccccgctccgcgccttctgcccgagggaacgcccctcccccgccacctgcgccgccttctcctcccccgcgatggccgccgacaaccccctcctcgccgccgacttcgacttcccgcccttcgaccgcgttgagcccagccacgtccgacccggcatccgcgagctcctcacgcgactcgagggcgagctcgaggagctcgagaagggagtcgagccctcgtgggggaagctggtcgagccgctcgagcgcgtcactgacaggctcgaggtcatctggggaatggtcgaccacctcaaggccgtcaaggactccgccgatctccgcgccgccgtcgaggaagtccagcctgacaaagtcaagtttcaactaaggctgggccagagcaagcctatctaccaagctttccaggccattagaaactcttctgactgggacagtctcactgatgctcgcaagcgtgtagtagaagctcaaataaaggaggctgttctcagtggagttgcacttgaggatgaacagagggagaaattcaaccaaatcgaacaagagcttgaaaagctgtcacaaaagtttagtgaaaatgtgcttgacgcaacaaagaaatttgagaaattaattactgataagaaagaaattgatgggctgcctgctacggcccttgggttagcagcacaaactgctgtgtctaagggtcatgaaaatgctacagctgaaaatggaccttgggtcatcacgttggacgcaccaagctatatcgctgttatgcaacacgctcgcagcagggctctccgtgaagaagtctatcgtgcttatctaacccgtgcctctagtggtgaacttgataacaccgatatcatcgctaaaattctgaagttaaggctagagaaggccaaaattcttggatacaaaaactatgctgaggtaagcatggctcagaagatggcaactgttgagcgggtcgaagagcttctcgagaagctgcgtgcggcttcctgggatcatgctgttaaagatatggaagatctaaaaatctttgcaaaagattctggttctccagatgctactgatttgactcactgggaccttacattctggagtgaacgactgagggagtctaaatatgatatcaatgaggaagcactgcgtccttattttgcactgcccaaggttatggatggcctcttcactctggcaaataagcttttcggggtgaacgttgaacctgcagatggactagctcctgtctggcacagtgatgtcaaattttactgtgtcaaagactcttccaatagccctgttgcttatttctactttgatccatattcaagaccatctgaaaagcgtggaggggcttggatgaatgtggtcttttctcgcagtcgcgtcctagctcgcaatggtttgcctgctaggctgcctgttgctcatatggtatgcaatcagacgcccccagttggtgataagcccagtctcatgaccttccgtgaggttgaaactgtgttccatgaatttggccatgctcttcagcatatgctcactaagcaagatgaaggctatgttgctggtattcgtggagttgaatgggatgctgtagagttaccctcccaattcatggaaaactggtgctatcacaaggatactctcttgagcattgcaaagcactacgaaaccggtgaaacacttccagaagaaatttatgcgaagcttgttgctgcaaagaatttccgtgctggcaccttcagcctgcgccagatacgttttgccagtgtagatatggaactgcatacaacttatgatccttatggctcactctccatatatgatgtcgaccgaagagttgcagaacgaacacaagttcttgctcctctgcctgaggacagattcctgtgcagctttagccatatatttgcaggtggctatgctgctggatactacagttacaagtgggctgaagtattgtcagctgatgcattctcagcttttgaagatgctggtttggataatgagaaggcaattgaggaaactggcagacgattcagagacacagttcttgcacttggaggtggaaagtctccacttgaggtgtttgtttcttttcgaggacgggagccttcacctgagccacttcttaggcacaacggcttgcttcctgttgctgcctagtgtgcccatttgccagtattgtcagaattcaaaggttttttctggggcatcagccgagcagaaataggtttattgctcgttctgcatcctggtgcaacatgaactgtgtgacgtgataacattatattataattgattgcacattgaattttaatcaaaaaaaaaaaaaaaaaaaa

SEQ ID NO: 1736 - protein, 756 aa, Panicum virgatum
  misc_feature: Ceres CLONE 1769706
  misc_feature (2)..(460): Pfam Name: Peptidase_M3 Pfam Description: Peptidase family M3
MLLLSFTARLPLAVSARLPSPPTTRLLLLAALPPSSPLRAFCPRERPSPATCAAFSSPAMAADNPLLAADFDFPPFDRVEPSHVRPGIRELLTRLEGELEELEKGVEPSWGKLVEPLERVTDRLEVIWGMVDHLKAVKDSADLRAAVEEVQPDKVKFQLRLGQSKPIYQAFQAIRNSSDWDSLTDARKRVVEAQIKEAVLSGVALEDEQREKFNQIEQELEKLSQKFSENVLDATKKFEKLITDKKEIDGLPATALGLAAQTAVSKGHENATAENGPWVITLDAPSYIAVMQHARSRALREEVYRAYLTRASSGELDNTDIIAKILKLRLEKAKILGYKNYAEVSMAQKMATVERVEELLEKLRAASWDHAVKDMEDLKIFAKDSGSPDATDLTHWDLTFWSERLRESKYDINEEALRPYFALPKVMDGLFTLANKLFGVNVEPADGLAPVWHSDVKFYCVKDSSNSPVAYFYFDPYSRPSEKRGGAWMNVVFSRSRVLARNGLPARLPVAHMVCNQTPPVGDKPSLMTFREVETVFHEFGHALQHMLTKQDEGYVAGIRGVEWDAVELPSQFMENWCYHKDTLLSIAKHYETGETLPEEIYAKLVAAKNFRAGTFSLRQIRFASVDMELHTTYDPYGSLSIYDVDRRVAERTQVLAPLPEDRFLCSFSHIFAGGYAAGYYSYKWAEVLSADAFSAFEDAGLDNEKAIEETGRRFRDTVLALGGGKSPLEVFVSFRGREPSPEPLLRHNGLLPVAA

SEQ ID NO: 1737 - DNA, 1538 bp, Panicum virgatum
  misc_feature: Ceres CLONE 1769709
  misc_feature: Encodes the peptide sequence at SEQ ID NO. 1738
aatcgacagcgccagcccagcagcacccacgcctcggcctctcgcgcgccgccccaatgcaggccgccgccgccgtccgccacccgcacctcctcgcgccgtgcgccggccgcccccgccgccggcccagcaccgtccgcatggcgctgcgcgaggacgggccctccgtggccatcgtgggcgccacgggcgcggtcgggcaggagttcctccgcgtcatcacggaccgggacttcccctaccgcagcctccgcctcctggccagcgagcggtccgcggggaagcacctcgccttcgaggatcgcgagtacaccgtccaggacctcgccgcgccaggggccttcgacggcgtcgacatcgcgctcttcagcgccggcgggggcgtcagccggaagtacggtcccgcggccgtcgccagcggcgccgtcgtcgtggacaacagctccgcgttccggatggaccccgaggtgccgctcgtcatccccgaggtcaacccggaggccatggccaacgtccggctggggcagggcgcgattgtggcgaatccgaattgctcgaccatcatctgcctcatggctgccaccccgctccatcaccacgccaaggtgttaaggatggttgtcagcacttaccaagctgcaagtggtgctggtgctgcagcaatggaagaacttaaactgcagactaaggaggtcttggaagggaaggcaccaacatgcaacattttcaaacaacagtatgcttttaatatattttcgcacaatgcaccagttcttgaaaatgggtataatgaggaagagatgaaaatggtgaaggaaaccagaaaaatctggaacgacaatgatgtgaaagttactgcgacctgcatacgggttcctgtgatgcgtgcgcacgctgaaagtgtcaatctacagtttgaaaagccacttgatgaggatactgccagagaaattctgagggctgctcctggtgttaccattgttgatgatcgtgcagctaatcgcttccctacacctctagaggtatcaaataaagatgatgtagtagtgggtaggattcgccaggacttgtcacaagatgataaccgagggttggatatatttgtttgtggtgatcagattcgtaaaggcgctgcgctcaatgctgttcagattgccgaaatgctactgaagtgaccacttcctgttcctagttagtctaattattgctgaatgtactctgtgcaataattatgagacgggcttgagtcatctgtggcgcacaaaagtgaattcggaagttgggaaataatgggccatccttattcagcatatcgatatctcagattttgattcagattcatataaaagtgtgttggtactcaatgcactgggtccattgttagtctgaattacaggttccaaaatgtcttgctggatttacactttcttgtgcaaaaataggtttgatgtaactttaatctagaaggccctgtcttaagggcagatggaaacatcttttgaaagaaagaatatgttgaaaaaaaaaaaaaaaaaaaa

SEQ ID NO: 1738 - protein, 372 aa, Panicum virgatum
  misc_feature: Ceres CLONE 1769709
  misc_feature (1)..(181): Pfam Name: Semialdhyde_dhC Pfam Description: Semialdehyde dehydrogenase, dimerisation domain
  misc_feature (34)..(371): SWISSPROT Homolog: EC 1.2.1.11 Aspartate-semialdehyde dehydrogenase
MQAAAAVRHPHLLAPCAGRPRRRPSTVRMALREDGPSVAIVGATGAVGQEFLRVITDRDFPYRSLRLLASERSAGKHLAFEDREYTVQDLAAPGAFDGVDIALFSAGGGVSRKYGPAAVASGAVVVDNSSAFRMDPEVPLVIPEVNPEAMANVRLGQGAIVANPNCSTIICLMAATPLHHHAKVLRMVVSTYQAASGAGAAAMEELKLQTKEVLEGKAPTCNIFKQQYAFNIFSHNAPVLENGYNEEEMKMVKETRKIWNDNDVKVTATCIRVPVMRAHAESVNLQFEKPLDEDTAREILRAAPGVTIVDDRAANRFPTPLEVSNKDDVVVGRIRQDLSQDDNRGLDIFVCGDQIRKGAALNAVQIAEMLLK

SEQ ID NO: 1739 - DNA, 2184 bp, Panicum virgatum
  misc_feature: Ceres CLONE 1769712
  misc_feature: Encodes the peptide sequence at SEQ ID NO. 1740
accgacacccccacgttgcacgcaggcagcggcggcggcttccttttaaaagcctcggcacatggctgcggagcttccgcatccccaccgcgtcctcctggtcctcgtagtcctcctgcctccccttctccgtccccgcgcggtcgcgatggcgccgactcccgccgccgggtccggcgacgagggcgccggcgcgctgctcgcgctcctgctccgggtgcagtcggaggcgctgcgcgcgctggggcccgacggcttcgaccccaagctctacgtcgacctgccgctggcagccgacgagcgcgccgcggcggccgcgctgcccggccagggccaggctccgctgtcgcgggccgagctcgagtcctacctcgcgcgctacttcgggacggccgggtccgacctcgtcgcggcggacccgccggacttcgaggcccacccgcgcgggttcctgccccgcgtcgagagccccgaggcgcgggcgtgggcgctggaggtgcacgcgctctggaaggacctcgcgcgccgggtagcgcccggcgtcgaggaccggccggaccggcacacgctgctgccgctgcccggcggggtcgtcgtgccgggctccaggttccgggaggtctactactgggactcctactgggtcgtcaggggattaatggtgagcaaaatgtacgacacagcaaagcatgttgtgctcaaccttgtatacctggtggaaaagtatggttttgttctgaacggtgcaagatcctactacactaaccgaagcgaaccaccacttttaagctcgatggttttggaagtatacagggcaactggtgatgtggagtttgttaagagagcattccagtttctgctgaaagagcatagcttctggatgtcagagattcataatgtagctattagggacaatcatggccaggttcataacttgtctcgataccaggcgaggtggaacaaacctaggccggaaagtgcgacaattgatgaggaacttgcttcgagtatcgattctatagccgataaggaaaaactttaccaccaaattgcttcaacagcagagtcaggatgggattttagctctcgatggatgagaaattctactgacatgacaacgttggcaacaacttacattatacctgtggacctgaacacattcatatttaagatggagcaggacatagctgcctttgctaaaatcattggagagaatgcaatctcggaaaagtttttggatgcttcaaaagcacgtcatattgcaattgactctattctgtggaactctgagatggagcaatggcttgactactggcttcctactgatggagattcccagcagggagtctaccaatggaagtctgactcacagaaccgcaaaatatttgcttccaatttctttccgttgtggttaaatgcttatcattcaggatcagcgaaatttgcagacactgcaaaatctgagagagtcatggcaagcctccagaaatctggattactctgtgctgcaggaatagcaacttctctaacgaacacaagccaacaatgggatttcccaaatgggtgggctccggtgcagcatctcatagccgaggggctgttgcattctggatcagaggaggcggtaaaattagctgaggacattgctacaaggtgggtgagaacaaactacgccgcctacaaagcaaccggcgcaatgcatgagaagtacgatgtggaggcctgtggaaaatctggaggcggtggtgaatacaagccccagactggttttggctggtccaatggtgtggtgttgtcattcttggaagaattcgggtggcctaagcacaaggaaataggttgctcacgacagggtgaagttggtctcgccgaagcgcagtctggttaggttacaactgtgcatgcacgagtacacgatcgagtggctgtaatgtaacacgtgggcgcgcgcatagccgcacaccgcatacatgcaagtatttgcattgcattatgcagtaagccggcaagtggttctttttgtgtgttctgttgtttgctcttggttgtaccacgaggtagcagaatgccagagtctccatgcatctgctgggacaatgtacattatgtatggtagtcccgagaccccgtgttaaagtgaaatatcctttttgccctcttgaataaaaaaaaaaaaaaaaaaaa

SEQ ID NO: 1740 - protein, 608 aa, Panicum virgatum
  misc_feature: Ceres CLONE 1769712
  misc_feature (4)..(517): Pfam Name: Trehalase Pfam Description: Trehalase
MAAELPHPHRVLLVLVVLLPPLLRPRAVAMAPTPAAGSGDEGAGALLALLLRVQSEALRALGPDGFDPKLYVDLPLAADERAAAAALPGQGQAPLSRAELESYLARYFGTAGSDLVAADPPDFEAHPRGFLPRVESPEARAWALEVHALWKDLARRVAPGVEDRPDRHTLLPLPGGVVVPGSRFREVYYWDSYWVVRGLMVSKMYDTAKHVVLNLVYLVEKYGFVLNGARSYYTNRSEPPLLSSMVLEVYRATGDVEFVKRAFQFLLKEHSFWMSEIHNVAIRDNHGQVHNLSRYQARWNKPRPESATIDEELASSIDSIADKEKLYHQIASTAESGWDFSSRWMRNSTDMTTLATTYIIPVDLNTFIFKMEQDIAAFAKIIGENAISEKFLDASKARHIAIDSILWNSEMEQWLDYWLPTDGDSQQGVYQWKSDSQNRKIFASNFFPLWLNAYHSGSAKFADTAKSERVMASLQKSGLLCAAGIATSLTNTSQQWDFPNGWAPVQHLIAEGLLHSGSEEAVKLAEDIATRWVRTNYAAYKATGAMHEKYDVEACGKSGGGGEYKPQTGFGWSNGVVLSFLEEFGWPKHKEIGCSRQGEVGLAEAQSG

SEQ ID NO: 1741 - DNA, 1424 bp, Panicum virgatum
  misc_feature: Ceres CLONE 1769717
  misc_feature: Encodes the peptide sequence at SEQ ID NO. 1742
tcctctttctccgtcctcgcaaaatcctcccagaagagctgaggcataaaggccgggagccggcgagggaagcgagaaaattttcttcccggggaggaaatcgggacggccccgggtcaaaatcgtctcctggcaagcaaagcctcggctccggttggtggtggtggtggtgctgctgctgctgctcctgctgtccgagacgagagcgggtaggaggagaccacgagctcaagaagaggggaaggggaaggagcttggctgaaggcaccagacgcgtgaagaagctccgagcaagggtagcaaggaatcaaatcgaagccatggactcgcagcattggatctcgcgcctcgccgccgccaagcggtactacgcggcgcagctcggccgcatcgacgatatgccggggatggggatggaggaggtggagatggagatggaggacgacggggacatggagatggaggtggcgctggagctcggggacgcgacgtggccggacgtcgcctgcccctactgctacgaggaccacgacgtcgcctccctctgcgtccacctcgaggaggaccacccctatgagccccacgccgcgccctgccccatttgctcccaaaggattacaagagatatgcttaaccatatcacaatgcaacatggttacttgttcaagaacggtcacaggtctcgcagatatattattcctgagaaccatggaatctctttattgagccgagatctacgtggtactcatttacaggctcttctaggcggtggtcatagccatagatcaagtagcacagcaaccacaaacatttccagcgatcctcttctatcatcatttggccttagcttcccaacatcggatgcaccagaaccatcaaaatcaatagcttctatcccaaatggtgcctcagtacataaggagacaccagctcagccttgggaatcaagtattgactcgtctctcacgagcgaagaaagggaacaaaagcgaaagcaggccactgccagagcaacctttgtgcaaggcctggtgctctcaactctattcggagactgagtgttcaaacagccataggttggtgctagatgggcgcttactcctgcctgatccgcatagtctgatagtgctccaccagggttggtgggtctactctctgatggcaggagaatgcacctggaaactcttgccgcattcttctttggttcagtagtgcgcggagttgattcggtcatgataccgcttaatttaaagctagctgttgtacctttctttatcaatttaccagccagcaatcccataactgtaactcattggtacattgttttgtgcctacatataatagctgtaacatttactatgaatgcaaatgatggcacttgtatgagagcagctgccaaagagcaaaaaaaaaaaaaaaaaaaa

SEQ ID NO: 1742 - protein, 245 aa, Panicum virgatum
  misc_feature: Ceres CLONE 1769717
  misc_feature (1)..(205): Pfam Name: Di19 Pfam Description: Drought induced 19 protein (Di19)
MDSQHWISRLAAAKRYYAAQLGRIDDMPGMGMEEVEMEMEDDGDMEMEVALELGDATWPDVACPYCYEDHDVASLCVHLEEDHPYEPHAAPCPICSQRITRDMLNHITMQHGYLFKNGHRSRRYIIPENHGISLLSRDLRGTHLQALLGGGHSHRSSSTATTNISSDPLLSSFGLSFPTSDAPEPSKSIASIPNGASVHKETPAQPWESSIDSSLTSEEREQKRKQATARATFVQGLVLSTLFGD

SEQ ID NO: 1743 - DNA, 2416 bp, Panicum virgatum
  misc_feature: Ceres CLONE 1769733
  misc_feature: Encodes the peptide sequence at SEQ ID NO. 1744
acaccgcttcactcgtttcgtttcgtttcgattcgattccaactccacaccgcttcctcggcgcacgtcgtcgtcgttgctccctcccgctgctctcgagttaacgatccccccccccccggccgcggcggagatggcggcgccgaacgggctcgcgcggatcgagacgcacgggaggacgaagcagcacgtgaacggcgtgtgccacgacgacagcgcggcgccggtgcgcgcgcagaccatcgacgagctgcactcgctgcagcggaagtggtcggcgcccaccacgcccatcaaggacggcgccgcctcacccttcgctgccgcgctctccgaggaggagcgccaccgccagcagctgcagtccatcagcgcgtcgttggcgtccctgacacgtgaaaccgggcccaaagtcgtcaagggcgacccggccaggaagggcgaggccgccgccaagggcgcgccgcagacgccgcagaagcaccaccagcaccaccaccccgccgcccccaccatcgccgtcagcgacagctccctcaagttcacccatgtcctctacaacctctccccagccgagctgtacgagcaggcgatcaagtacgagaagggctcgttcatcacgtccaccggcgcgctggccacgctgtccggcgccaagaccggccgctcgcccagggacaagcgcgtcgtcaaggacgaggccgccgcgcaggagctctggtggggcaagggctcgcccaacatcgagatggacgagcacacgttcctgaccaaccgggagcgggccgtggactacctcaactccctggacaaggtgttcgtgaacgaccagttcctcaactgggaccccgagaaccgcatcaaggtccgcatcatctccgccagggcgtaccactccctcttcatgcacaacatgtgcatccggcccacggacgaggagatggagagcttcggcacgccggacttcaccatctacaacgccgggcagttcccctgtaaccgttacacgcactacatgacgtcgtcgacgagcgtagacatcaacctcgctaggagggagatggtgatcctgggcacgcagtacgccggggagatgaagaaggggctcttcggcgtcatgcactacctcatgcccaagcgcggcatcctctcgctgcactccggctgcaacatgggcaaggacggtgacgtcgccctcttctttgggctctcaggtaccgggaagacgacgctgtcgacggatcacaacaggcttctgatcggtgacgatgagcactgctggagcgacaatggcgtctccaacatcgagggcggttgctacgccaagtgcatagacctgtcccaggagaaagagcctgatatttggaacgcaatcaagtttggaactgtgctggagaacgtcgtcttcgatgagcatactcgtgaagtcgactacaccgacaagtctgtcaccgagaacacccgggctgcctacccgatcgagtacatccccaacgccaagatcccgtgcgtcgggccgcaccccaagaacgtcatcctcctggcgtgcgacgcgttcggggtgctcccgccggtcagcaagctgaacctggcgcagaccatgtaccacttcatcagcggctacaccgccctggtcgccggcacggaggacggcatcaaagagccgcaggccacgttctcggcctgcttcggcgcggcgttcatcatgctccacccgaccaagtacgccgccatgctcgccgagaagatgcagaagtatggcgccaccgggtggcttgtcaacaccggctggtccgtcggcaggtacggtgtgggcaagaggatcaggctgccctacacccggaagatcatcgacgccatccactccggcgagctcctcaccgccaactacaagaagacggaggtctttgggctggagatccccaccgcgatcgacggcgtgccgtcggaaatcctcgacccgatcagcacctggacggacaaggccgcgtacaaggagacgctcctgaggctcgccggcctcttcaagaagaacttcgaggtgttcgccagctacaagatcggggacgacagcagcctgaccgacgagatcctcgccgcaggccccagcttctgattttcaagcagtggatccggaacggcgaggcgatggagtgggatcagaataaaacggtgttgggtgcgtgcgtgtgttgcgatgatgatgacgaaagaaagtgttggattgatgtgccaacacagtagactagtagccctgtaaggtatcatgtgggcatgcgtgtggctttgttacctgtaaggtttgttctgcctggtcctggtgtaagtctgtgcgtgcttgcatcttgcccgtgtactctctggtttcagaatttgaatatgaagtatcttgatttaaaaaaaaaaaaaaaaaaaa

SEQ ID NO: 1744 - protein, 660 aa, Panicum virgatum
  misc_feature: Ceres CLONE 1769733
  misc_feature (3)..(473): Pfam Name: PEPCK_ATP Pfam Description: Phosphoenolpyruvate carboxykinase
  misc_feature (1)..(660): SWISSPROT Homolog: EC 4.1.1.49 Phosphoenolpyruvate carboxykinase [ATP]
  misc_feature (4)..(660): SWISSPROT Homolog: EC 4.1.1.49 Phosphoenolpyruvate carboxykinase [ATP]
MAAPNGLARIETHGRTKQHVNGVCHDDSAAPVRAQTIDELHSLQRKWSAPTTPIKDGAASPFAAALSEEERHRQQLQSISASLASLTRETGPKVVKGDPARKGEAAAKGAPQTPQKHHQHHHPAAPTIAVSDSSLKFTHVLYNLSPAELYEQAIKYEKGSFITSTGALATLSGAKTGRSPRDKRVVKDEAAAQELWWGKGSPNIEMDEHTFLTNRERAVDYLNSLDKVFVNDQFLNWDPENRIKVRIISARAYHSLFMHNMCIRPTDEEMESFGTPDFTIYNAGQFPCNRYTHYMTSSTSVDINLARREMVILGTQYAGEMKKGLFGVMHYLMPKRGILSLHSGCNMGKDGDVALFFGLSGTGKTTLSTDHNRLLIGDDEHCWSDNGVSNIEGGCYAKCIDLSQEKEPDIWNAIKFGTVLENVVFDEHTREVDYTDKSVTENTRAAYPIEYIPNAKIPCVGPHPKNVILLACDAFGVLPPVSKLNLAQTMYHFISGYTALVAGTEDGIKEPQATFSACFGAAFIMLHPTKYAAMLAEKMQKYGATGWLVNTGWSVGRYGVGKRIRLPYTRKIIDAIHSGELLTANYKKTEVFGLEIPTAIDGVPSEILDPISTWTDKAAYKETLLRLAGLFKKNFEVFASYKIGDDSSLTDEILAAGPSF

SEQ ID NO: 1745 - DNA, 1985 bp, Panicum virgatum
  misc_feature: Ceres CLONE 1769746
  misc_feature: Encodes the peptide sequence at SEQ ID NO. 1746
gctgctgccgcagccgatccgaatcgcccccgccgaatatcccacccgcccccctcgtcctctctgcgtcctgctcttgagcagtggctcgcctcccgctgctatccatccacccgttccattccaatccccctctcccgctccgccccctcttcgtcctctcgctgcggccggcctcgctctcccgaggagcaccaaggagagccgcccgggcgccgagtgggggccctccttcgactctgggcaggcatctacatttttgaactgaaagagagaggattatgaaaatggcacatttgatcactcactgtagtttcagtgcatctcctgctgttaatacgttctccggatctcctggttattgctgcaatgttggccaattacagaactcaaaatcttcaaatctgtccctcaaatcttctttcaagagacaaaagaagccatatgttacttgtgctagtgctgctgtgcaaggacagacacaaacacctcttactggtagtcaggaagcttctgggcattcatcctccaagtctaaaaaagtaatggttattggtggagatggatactgtgggtgggcgacagctcttcatctctccaacaaaggttatgaggttgctattgtcgataaccttgttcggcgtctttttgatcaccaacttggtcttgattcccttacccccataacttccatccaaaaccgtgtccgtagatggaagtctctcactggcaagacaattcagctctttattggagacatatgtgattttgacttcctctcagaagctttcaagtcttttgagccagatgctgccgtccactttggtgagcaaagatccgcaccatactctatgattgatcgttcaagggcagtctacacacagcataacaatgtcattggaacacttaatgtcttgtttgccattaaggagtacagtgaagagtgccatctggttaagctcggaactatgggtgagtatggaacaccaaatattgacattgaagaggggtttatcactataactcacaatggaagaactgacaccttgccttacccgaagcaagcaagttccttctaccatctaagcaaagttcatgactcccacaacatagcatttacttgcaaggcttggggtataagagccacagatcttaaccaaggtgtagtctatggagtgagaacagatgaaactgcaatgcatgaagaactatccaacaggtttgactatgatggtgtctttgggacagcactaaataggttctgtgtccaggctgctgtagggcatccacttacagtttatggaaaaggtggtcagacccgtggatatctggacatcagggacactgtgcagtgtgtggagctagcaatagccaacccagccaaacccggcgagttcagagtcttcaaccagttcacagagcagttttccgtcaacgatctggccaagctcgtgactgctgcgggagccaagctcggtctggacgtgcagaccaagtcggtccctaacccacgggtcgaggccgaggagcactactacaatgccaagcacacgaagctgatcgagctgggcctggtgccccacctgctctcagactccctgctcgactcactgctcaacttcgcagtccagtacaaggacagggtcgacacggcccagatcatgcccagcgtgtcgtggaagaagatgggcgccaagccaaggacagtctccgtctagagcagagggaacgttcccctggcgtataatgtcaaccatgacattgacattattgacatacgtaatgtaataattacgcacatcagtgtgatgtgctagttagttactgtagctgttttgtttacgatattagatttagtttttgctaccccacggctggaacctgcgaagggcgcatgtgctgtttgattctgttcactcgagctctggacctgctgcaatagtggactgatggttaaggtttcacaaaaaaaaaaaaaaaaaaaa

SEQ ID NO: 1746 - protein, 478 aa, Panicum virgatum
  misc_feature: Ceres CLONE 1769746
  misc_feature (1)..(291): Pfam Name: Epimerase Pfam Description: NAD dependent epimerase/dehydratase family
  misc_feature (3)..(476): SWISSPROT Homolog: EC 3.13.1.1 UDP-sulfoquinovose synthase, chloroplast precursor
  misc_feature (3)..(477): SWISSPROT Homolog: EC 3.13.1.1 UDP-sulfoquinovose synthase, chloroplast precursor
MKMAHLITHCSFSASPAVNTFSGSPGYCCNVGQLQNSKSSNLSLKSSFKRQKKPYVTCASAAVQGQTQTPLTGSQEASGHSSSKSKKVMVIGGDGYCGWATALHLSNKGYEVAIVDNLVRRLFDHQLGLDSLTPITSIQNRVRRWKSLTGKTIQLFIGDICDFDFLSEAFKSFEPDAAVHFGEQRSAPYSMIDRSRAVYTQHNNVIGTLNVLFAIKEYSEECHLVKLGTMGEYGTPNIDIEEGFITITHNGRTDTLPYPKQASSFYHLSKVHDSHNIAFTCKAWGIRATDLNQGVVYGVRTDETAMHEELSNRFDYDGVFGTALNRFCVQAAVGHPLTVYGKGGQTRGYLDIRDTVQCVELAIANPAKPGEFRVFNQFTEQFSVNDLAKLVTAAGAKLGLDVQTKSVPNPRVEAEEHYYNAKHTKLIELGLVPHLLSDSLLDSLLNFAVQYKDRVDTAQIMPSVSWKKMGAKPRTVSV

SEQ ID NO: 1747 - DNA, 1447 bp, Panicum virgatum
  misc_feature: Ceres CLONE 1769752
  misc_feature: Encodes the peptide sequence at SEQ ID NO. 1748
aaagccaaacccgagcagcggtagccgccgaggcccaaccggagccaagatgctgtcgtcttccacctccaccctccgcctccaccaaccaacccgtccccaccgccgccacccgccggcgccggccgcgggaggcgccacccacctcggcccctcccgccggtggcgcgggcctcccctccgcgcgcggccccagcgcatccgggcgctggacgccgcccagccgttcgactacgagtcccgcgcggcggggctgctggaggagcggcagcgcctcaagatcgccatcgtcgggttcggcaacttcggccagttcctggcgcgcaccttcgcgcgccagggccacacgctgctcgcccactcgcggaccgaccactcggcgctcgccgccacgctcggcgcctccttcttcaccgacccgcacgacctctgcgagtgccacccggacgtggtgctcctcgccacctccatcctctccgccgaggccgtcctccgctcgctccccgtccaccgcctccgccgcaacaccctcttcgtcgacgtgctctccgtcaaggagttccccaagaacctcctcctcagctccctcccgccggacttcgacgtcatctgcacccaccccatgttcggcccggagtccgcgcgcgacggctgggacggcctccccttcgtcttcgacaaggtccgcgtcggcgactgccccgcgcgccgcgcccgcgccgaggccttcctcaacatcttcgagtgcgagggctgccggatggtcgagatgtcctgcgccgagcacgacgcgcacgccgccgagacccagttcctcacccacaccgtcgggaggatgctcgccatgctcgagctccgctccacgcccatcaacaccaagggctacgagacgctgctccgcctcgtggacaacacctgcagcgacagcttcgacctctacaacggcctcttcatgtacaacaagaactccaccgagctgctcaaccgcctcgaatgggccatggactccgtcaagaagaagctcttcgacggcctccacgacgtgctccggaagcagctcttcgagggctcggcgcaggcccccagcacctccaacgtccgcaagtaaccataccatggcgaattcgtctcagctaagctagtaattcatcagttcgtcgggcttgctgctcgtctcatctcatgttcgtcgagctatatacatttgcgttgtataagtctgtatctgtattctccccaatcgagatttgagaggggttcttcctccctttctctggaagaagaagaggaagaagaaccccatgtatattccttgtcaattctgctacattccaagtgtcccctctttgcggttggaaatgtggtaggttgacattgtgaaatttgttgtatggtgatgaagaaagtgaataaagcagccatctttcaaaaaaaaaaaaaaaaaaaa

SEQ ID NO: 1748 - protein, 352 aa, Panicum virgatum
  misc_feature: Ceres CLONE 1769752
  misc_feature (1)..(62): Pfam Name: F420_oxidored Pfam Description: NADP oxidoreductase coenzyme F420-dependent
  misc_feature (42)..(345): SWISSPROT Homolog: EC 1.3.1.78 Arogenate dehydrogenase 2, chloroplast precursor
  misc_feature (51)..(350): SWISSPROT Homolog: EC 1.3.1.78 Arogenate dehydrogenase 1, chloroplast precursor
MLSSSTSTLRLHQPTRPHRRHPPAPAAGGATHLGPSRRWRGPPLRARPQRIRALDAAQPFDYESRAAGLLEERQRLKIAIVGFGNFGQFLARTFARQGHTLLAHSRTDHSALAATLGASFFTDPHDLCECHPDVVLLATSILSAEAVLRSLPVHRLRRNTLFVDVLSVKEFPKNLLLSSLPPDFDVICTHPMFGPESARDGWDGLPFVFDKVRVGDCPARRARAEAFLNIFECEGCRMVEMSCAEHDAHAAETQFLTHTVGRMLAMLELRSTPINTKGYETLLRLVDNTCSDSFDLYNGLFMYNKNSTELLNRLEWAMDSVKKKLFDGLHDVLRKQLFEGSAQAPSTSNVRK

SEQ ID NO: 1749 - DNA, 1920 bp, Panicum virgatum
  misc_feature: Ceres CLONE 1769874
  misc_feature: Encodes the peptide sequence at SEQ ID NO. 1750
agggctttccgctccacgtcgcggcgcctccgcgcactcgctcgccgaccgatgccactgctgctgcgcggcgcctccctcctccgcatctaccactgtgggctccgaggtgcgaattttagttccagaaagtccgtgctgacaaatctgaacttcatgatggacggaatgcgagctacatattcacgcagaactgtctctaagaaaactgagatcaagaatgatgagaagtcagtcatagaggaggaagatgctgctggaagtgatttggagatggagcgagtgaggagtgaccctagccagctccaatcaatgacggtgaaagagctcagggagcttacaaggaggatgggtgtttctgggaaaggcaccaagaaagatttagtatcagcactgatggattctctaggggtggaaggaaatggtaaaggggggaagtcatcttctgagctggttagcccctcggaggaacctttaaaaagaaaaagtggtgcttcagttgtggttgaacaaaaactagaaagttctgaggttatatctgaaactcctagcaataaaagaagtagaacaaaacagaagttaatcaagaccactactcttgaggagaattctgtgagtaatggcaagattaataagacttcagtccagaaggaaacacttgttgttaaaggggccgttcctaaggcaggattaagtcctaatgacaattcagaaccttggactgtacttgtacataagaaaccacaagccgggtggattccttacaaccctaagactatgagacctccacctctaagcaaggctacacgggctctgaagattctgtcatggaatgtcaatggattgaaagcattgctcaaatcaagaggcttctctgtgcagcagttagcagagagggaggactttgatgtgctatgcctacaagagacaaaaatgcaggagaaggatgttgaagttattaaggatactctgcttgatggatacacaaatagtttctggacatgcagtgtgtcaaagcttggctattcaggaacagcaataatttcacgagtgaaacccctctcgatcaagtacgggcttggtgtaccagaccatgatactgaagggagggttgtgactgtggaatttgatgacttctacttgctaactgcttatgtgccgaattctggtgatggtctaagaagactgacttacagggtcacagagtgggatccatcccttggtaactacatgaaagaattggaaaaatcaaagcctgtcatactaactggtgatcttaactgtgcccatcaggagattgatatccacgatcctgctggcaatcgtaaaagtgctggcttcacaaacgaagaaagagaatcatttgagactaactttttgtccaaaggatttgttgacatgtttcggaaacagcatcccaatgttgttgcatatagttattggggttacaggcataatggccgtaaaacaaataaaggttggcgcctggattactttcttgtgtcggagtctattgcggaaaaggtgcacgattcatatattcttccggacatctctgccagtgatcacagcccccttggcctcgtactgaagctctaggctgcatcattggccatgccaaacactcaatttgaagctggggccttgaatttcggcagcaatgcttattcttcagggttttagtttgcgtggacctgtggcagagtcggcgatttttgcatccggccactagtgaagagacaccagctgatactgatgctgcgttttctgatgtaaataggccggccgatgaatagattgcatctttggtatcagttctgttgctcagtacggggagcttatttgtccggttatgaaacttataactgaatgaaagtatgcagtgggtaaaaacttgctgaaaaaaaaaaaaaaaaaaaa

SEQ ID NO: 1750 - protein, 515 aa, Panicum virgatum
  misc_feature: Ceres CLONE 1769874
  misc_feature: Great-hit functional homolog of the protein sequence given in SEQ ID NO 9606
  misc_feature (1)..(259): Pfam Name: Exo_endo_phos Pfam Description: Endonuclease/Exonuclease/phosphatase family
  misc_feature (50)..(515): SWISSPROT Homolog: DNA-(apurinic or apyrimidinic site Apurinic endonuclease-redox protein
  misc_feature: Useful for making plants with altered Lignin content
MPLLLRGASLLRIYHCGLRGANFSSRKSVLTNLNFMMDGMRATYSRRTVSKKTEIKNDEKSVIEEEDAAGSDLEMERVRSDPSQLQSMTVKELRELTRRMGVSGKGTKKDLVSALMDSLGVEGNGKGGKSSSELVSPSEEPLKRKSGASVVVEQKLESSEVISETPSNKRSRTKQKLIKTTTLEENSVSNGKINKTSVQKETLVVKGAVPKAGLSPNDNSEPWTVLVHKKPQAGWIPYNPKTMRPPPLSKATRALKILSWNVNGLKALLKSRGFSVQQLAEREDFDVLCLQETKMQEKDVEVIKDTLLDGYTNSFWTCSVSKLGYSGTAIISRVKPLSIKYGLGVPDHDTEGRVVTVEFDDFYLLTAYVPNSGDGLRRLTYRVTEWDPSLGNYMKELEKSKPVILTGDLNCAHQEIDIHDPAGNRKSAGFTNEERESFETNFLSKGFVDMFRKQHPNVVAYSYWGYRHNGRKTNKGWRLDYFLVSESIAEKVHDSYILPDISASDHSPLGLVLKL

SEQ ID NO: 1751 - DNA, 1086 bp, Panicum virgatum
  misc_feature: Ceres CLONE 1769884
  misc_feature: Encodes the peptide sequence at SEQ ID NO. 1752
accaaccaccagtccaccacgcgcgcgatcgggctggctgaattgctgcgtgcggcggggaggtggggagccggccaccgtgccgtgaagacgacgccgcgccatggaggtgccgccgctgccagcggcggctgcggcggcggaggaggagcggcgcggcgcggcgacggggtcgtgcctccccaggctggtctccggcgtcctctcgggggccctcaccggcctcttcgccgtcgctggaggcctgacgggggcgttcaccggcgcattggcggggagggcctccgacagcggcgtcctccggggagccgggctgggggcgtttgcgggggcggtgctctccatcgaggttctggaggcttcgcgcgcgtactggagcgcggaccgatcgagcccgcagagcacatcctccatgggcgatttcatagagcagctccttcatgctcgatttgtgcaagaccagtatgagccatcggcttatatggcttatcgttggcaggttggtattgcagacaatgatgatctgttcgacgtccttgaagaggttttatctgaagggctctcacaagataccctaaagaagttaccacatcacgtggtgactgatcagaagcaagaaccgattggtgaaaacttgtcttgccctatttgcctccaggatattgttgccggagagacagtgaggaagttgccgaggtgttcccacactttccaccagccttgcgtggacagatggttcactgaccacggttcatgccctgtatgtaggcaagatgtgtaggtagattgtgttcggctccgtgttctcatgcctttgtaaagtgcctactggcttcatgtagaaagaatcatacgtagacgtagtggtgtaaactaagccctacaacttgtttgtatcgtgaaaattggtcgtatacatacatcagagattgcgaggttcgtgttttttctagccacacatttttcatcttggccatgcaaaactggagagcttcttttgccgtcctattctacatgtatattgcaatataacgctgaattgtaatgcattacagtttacaggtttaaaaaaaaaaaaaaaaaaaa

SEQ ID NO: 1752 - protein, 225 aa, Panicum virgatum
  misc_feature: Ceres CLONE 1769884
  misc_feature (1)..(41): Pfam Name: zf-C3HC4 Pfam Description: Zinc finger, C3HC4 type (RING finger)
MEVPPLPAAAAAAEEERRGAATGSCLPRLVSGVLSGALTGLFAVAGGLTGAFTGALAGRASDSGVLRGAGLGAFAGAVLSIEVLEASRAYWSADRSSPQSTSSMGDFIEQLLHARFVQDQYEPSAYMAYRWQVGIADNDDLFDVLEEVLSEGLSQDTLKKLPHHVVTDQKQEPIGENLSCPICLQDIVAGETVRKLPRCSHTFHQPCVDRWFTDHGSCPVCRQDV

SEQ ID NO: 1753 - DNA, 2050 bp, Panicum virgatum
  misc_feature: Ceres CLONE 1769891
  misc_feature: Encodes the peptide sequence at SEQ ID NO. 1754
atcaccagaagccgcaagctgctctctcctaccaaggctccctcccacccaccagcccaaccagctactattggcctctagctaggagcacacaaggcacagctagcgtcgtctgatactcgctgatcgaaggtgcgctcagctctaagcacgccgtttcggttcactgagctagccctctttagttagccaaatggatggtgccaatggtgagctcctctcgaggatcgccgccggcgacggccacggcgagaactcgtcctatttcgacgggtggaaggcctacgacacgaaccctttcgatctgcaccacaaccccgacggcgtcatccagatgggcctcgccgagaaccaactgtcgctggacctgatcgaggagtggagcatcaagcacccggaggcgtccatctgcacggcgcagggcaggtcgcagttccggaggatagccaacttccaggactaccacggcctgccggagttcagagaggcgatggccaagttcatggggcaggtgaggggcgggaaggtgacgttcgaccccgaccgcgtcgtgatgagcggcggggccaccggcgcgcaggacacgctcgccttctgcctcgccgaccccggcgacgcctacctcgtgcccacgccgtactacccagctttcgaccgcgactgctgctggaggtctgggatcaagctgctgccgatcgagtgccacagctccaacaacttcgccctcaccagggaggcgctcgtgggggcgtacgacggcgcgcggagccagggcatccgcgtcaagggcatcctcgtcaccaacccctccaacccgctgggcaccaccatgggccgcggcacgctggcgatgctcgccgagttcgccacggagcaccgtgtccacctcatttgcgacgagatctacgccggctccgtgttcgccaagcccgacttcgtgagcatcgccgaggtcgtggagcgcgacgcccccggctgcgacagggacctcatccacatcgcctacagcctctccaaggactttggcctcccgggcttccgcgtcggcgtcatctactcgtacaacgacgccgtcgtggcctgcgcgcgcaagatgtccagcttcggcctcgtctcctcccagacgcagtacttcctggcgaggatgctctcggaccgcgagttcatggcgcgcttcctggcggagagcgcgcagcggctggcggcgcggcacgagcgcttcacctcgggcctccgcggcgtcggcatcaactgcctgcccggcaacgcggggctcttctcgtggatggacctgcggagcatgctccgggacaagacgcccgaggcggagctggagctgtggcgggtcatcattcacaaggtgaagctcaacgtgtcgcccggcacgtcgttccactgtggcgagcccgggtggttccgcgtctgccacgccaacatggacaacgagaccatggaggtcgccctcgaccgcatccgcagcttcgtgcagcaagagcacaaggccaaggccaagcgctgggccgccagggcccccctccgcctcagcttgccgcgccggggtggcgccgccgccgcttcgcacctcgcgctctccagccccctggcgttgatgtcgccgcagtcacccatggttcacgctagctaacaccgtgcactcgaattcggcaagggacggttggcagggtgcgccgtacattacatttgtacgtgcatccttttttgcgatcacatggctaagtacaagctagcttactatgtgattgtttgccgaaagagtacccaggcatgcaggggcgtagctagctagtttttacatagacgttgtacaggcgtcgggtatcggtaagcaggacgcattggtcctcgagtttttcgtatatatggtttgttttgatgttagttatagatgacagaataatgatcggggaacgggtaaataattgagtcctcccgatcaaatgttgtaaacttgtgacgacggacataacacattgtacaagtgtgtatactagatcatttttgcaaagtgtaaaaaaaaaaaaaaaaaaaa

SEQ ID NO: 1754 - protein, 483 aa, Panicum virgatum
  misc_feature: Ceres CLONE 1769891
  misc_feature (1)..(360): Pfam Name: Aminotran_1_2 Pfam Description: Aminotransferase class I and II
  misc_feature (1)..(483): SWISSPROT Homolog: EC 4.4.1.14 1-aminocyclopropane-1-carboxylate synthase
  misc_feature (5)..(482): SWISSPROT Homolog: EC 4.4.1.14 1-aminocyclopropane-1-carboxylate synthase
MDGANGELLSRIAAGDGHGENSSYFDGWKAYDTNPFDLHHNPDGVIQMGLAENQLSLDLIEEWSIKHPEASICTAQGRSQFRRIANFQDYHGLPEFREAMAKFMGQVRGGKVTFDPDRVVMSGGATGAQDTLAFCLADPGDAYLVPTPYYPAFDRDCCWRSGIKLLPIECHSSNNFALTREALVGAYDGARSQGIRVKGILVTNPSNPLGTTMGRGTLAMLAEFATEHRVHLICDEIYAGSVFAKPDFVSIAEVVERDAPGCDRDLIHIAYSLSKDFGLPGFRVGVIYSYNDAVVACARKMSSFGLVSSQTQYFLARMLSDREFMARFLAESAQRLAARHERFTSGLRGVGINCLPGNAGLFSWMDLRSMLRDKTPEAELELWRVIIHKVKLNVSPGTSFHCGEPGWFRVCHANMDNETMEVALDRIRSFVQQEHKAKAKRWAARAPLRLSLPRRGGAAAASHLALSSPLALMSPQSPMVHAS

SEQ ID NO: 1755 - DNA, 1040 bp, Panicum virgatum
  misc_feature: Ceres CLONE 1769895
  misc_feature: Encodes the peptide sequence at SEQ ID NO. 1756
ctaccggtagcacactacgctgctctacgctcgccggctagtcgatcttactgtgcgttccgcagtagcccagcccacccacacacacacccacaatggcggggcggcgcatcgccgtggcggcggcgttcctggcgctggcggcggtggttccggcggcgctggcgcaggcgccgggccccgcagcggcgccgagcgggccccccaacgtgacggcgatcctggagaagggcgggcaatacacgaccttcatccggctgatgaaggagacgcagcaggacacgcagctcaacagccagctcaacagctccttcggcaacaacggcggcggcggctacacggtgttcgcgcccaccgacaacgccttcaacaacctcaagcccagcacgctcaactccctcacccagcagcagcaggtgtcgctggtgcagggccacgtcctgcccaacttctacagcatggactccttccagaccgccagcaaccccgtccgcacccaggcctccggccgggacgggccctacacgctcaacatcacctccgacaccaacaaccaggtcaacgtctcctccggcgtcgtcgacgtccgcatcaacaacgcgctctacaacgccaagccgctcgccgtctactccgtcgacaaggtgctcctgcccatggagctcttcggggccaaggcccccgccgccgcgcccaccgcgtccgagggcaagcccaggaagggcggctcctccgacgcctcgtcgccggccggctccgaggatgctgagcccacaggcgccgccagcgccagggccgtcggctggagcgtcgctggcctcgccgccgttcttggctacctgttgtgagtctgagacaagaatgccaatgtccaccaaatccatctttgcctgagatagattgtcagtggtggtgtttccttccttccccttcttcctctctttgtttaaatttctctggtactgctagttgcttttttttattcttgttcttggcggtctgtaagattgggttaaattcaaaaaaaaaaaaaaaaaaaa

SEQ ID NO: 1756 - protein, 250 aa, Panicum virgatum
  misc_feature: Ceres CLONE 1769895
  misc_feature: Great-hit functional homolog of the protein sequence encoded by LOCUS At5g03170
  misc_feature: Useful for making plants with altered cell wall content and/or composition
MAGRRIAVAAAFLALAAVVPAALAQAPGPAAAPSGPPNVTAILEKGGQYTTFIRLMKETQQDTQLNSQLNSSFGNNGGGGYTVFAPTDNAFNNLKPSTLNSLTQQQQVSLVQGHVLPNFYSMDSFQTASNPVRTQASGRDGPYTLNITSDTNNQVNVSSGVVDVRINNALYNAKPLAVYSVDKVLLPMELFGAKAPAAAPTASEGKPRKGGSSDASSPAGSEDAEPTGAASARAVGWSVAGLAAVLGYLL

SEQ ID NO: 1757 - DNA, 1449 bp, Panicum virgatum
  misc_feature: Ceres CLONE 1769899
  misc_feature: Encodes the peptide sequence at SEQ ID NO. 1758
acaagcgtggcgtcgtcgcggcccatcgccccctcaccctcagatcaacccccgcagtagcagggtgctggagaagcatcccgaggccgagatggaggcggcggctcgcctccccctccccatcatctccgccctcctcctcctgctaatcctctcgccggcggcagcgagggtggcgccgtcgcgcatgcagccgctcgccacggccgcgctgcgcctcctctacgacacctccaactacggcaagctgcagctcaacaacggcctcgcgctcaccccgcagatggggtggaacagctggaatttcttcgcatgcaacatcaacgagacggtcatccgcgaaacagctgatgcgctggtgtcgacaggactggctaaattgggctacaactatttaaatattgatgattgctggtcctatgtgaaaagaagaaacaaggatcaattgctacctgatccaaagaatttcccttcaggcatcaaagctcttgcagactatgtgcacggaaaaggtttaaaacttggtatatactcagatgctgggatatttacttgtcaagttcgacctggatcgctctatcatgaaaatgatgatgccgcactctttgcttcatggggtgttgactacctgaagtatgacaactgctacaatctgggaataaagcctcagaaaagatatcctcctatgcgagatgctcttaattcaactgggcgccaaatattctactctttgtgtgagtgggggcaggatgatcccagcttgtgggctggcaaagtaggcaataagtggcgtacaacagatgacataacggatacatggaaaagcatgacagatattgctgataagaataacaagtgggcatcatatgctggacctggtggttggaatgacccagatatgctggagatagggaatggtggcatgacctttgctgagtatcgctcacattttagcatctgggctctcatgaaggcccctctattaattggctgtgatgtcagaaatatgacttcagaaacgatgaaaatattgagcaacaaagaagtaattcaagtaaaccaagatcctcttggagttcaaggaagaaaaattttgggagaaggaaaaaatggatgccgcgaggtgtgggctggccccctgtctggaaatcggcttgctgttgctttgtggaaccgatgttcggagattgctaatattacaatgaaattgccagcagtaggccttgatgaatcagctgcctattctgttagagacctttggaagcatgaatctctatcagaaaatgttgttggaacttttggcgctcaagttgacgtgcatgacacaaagatgtatattttttctccagccatcagtgtcgcttcaatttgattggacctggtgaactctggatggcagcatgttttatcccagtatataatggcaataaaatccatctgttttcccgt

SEQ ID NO: 1758 - protein, 426 aa, Panicum virgatum
  misc_feature: Ceres CLONE 1769899
  misc_feature (47)..(419): SWISSPROT Homolog: EC 3.2.1.22 Alpha-galactosidase precursor
MEAAARLPLPIISALLLLLILSPAAARVAPSRMQPLATAALRLLYDTSNYGKLQLNNGLALTPQMGWNSWNFFACNINETVIRETADALVSTGLAKLGYNYLNIDDCWSYVKRRNKDQLLPDPKNFPSGIKALADYVHGKGLKLGIYSDAGIFTCQVRPGSLYHENDDAALFASWGVDYLKYDNCYNLGIKPQKRYPPMRDALNSTGRQIFYSLCEWGQDDPSLWAGKVGNKWRTTDDITDTWKSMTDIADKNNKWASYAGPGGWNDPDMLEIGNGGMTFAEYRSHFSIWALMKAPLLIGCDVRNMTSETMKILSNKEVIQVNQDPLGVQGRKILGEGKNGCREVWAGPLSGNRLAVALWNRCSEIANITMKLPAVGLDESAAYSVRDLWKHESLSENVVGTFGAQVDVHDTKMYIFSPAISVASI

SEQ ID NO: 1759 - DNA, 2039 bp, Panicum virgatum
  misc_feature: Ceres CLONE 1769906
  misc_feature: Encodes the peptide sequence at SEQ ID NO. 1760
agtcagcccggtttcagacttccagttcaaaccatttgcccactgttcctcctggcctctccctctgctcctctcccttcgtctccccatctccggctagggtttgctcatcccaaccgcgcccgacgccctcctcgcccttgccacggccgggaccagtgatgtcgcaagagcaaggtggggaggatcctccgccgccgccgcaggcggaaggcgaggcaccgccggccgccgacgtccccatgggcgaagctgcggcggtggatgatgatgatgaggcggaacccgtcacgggggagggcgccgcggacggggcggccggcacctttggttccgtggaggcttcggtgaagcccgaagcagcgggtgcggaggagggggacggggaggagctgaacggtgacgcagcggcggattccgttggcgagggtgagaaattggagaacggggatgagcccgtgaaggtgggcagggagaagggaggctcgccggtgcgagatgctgcagatggcggtgatgataagggcgtggatggtcagaatcaggctgctgagaaccagcttgtgctggtgtcggctgaggaggacctggccatgtccaagctctcaaataattccttcatgttcgattactccactggtggtgatgactcggggactgaggaagagcaggctgccttcatgaaggagctcgagcggttctacagggagaagatgatggagttcaagcccccaaagttctacggcgaaggattgaattgccttaaattgtggagacaagttactggattgggtggctatgatcaggtgacatcatgcaaactgtggcgccaagtgggggagtcgttcaaacctccaaagacatgcacaacagtttcatggacgttccgtaacttctatgagaaggcactacttgaatatgagaaacacaaaattgaaaccggaaagttccaagtagcttcatctactttagcggatcgaattggttctgagagccaggtgggtggaagccatacatctggctctggaagggccagaagagaatctgcaactcgtgctatgcaaggctggcattctcagcgtctactaggaaatggtgaaattgctgatcctataattaaggataaaggcactattgtcttgaagaaggataaaactcctaaaagcagtggttctgccaagaggaaaaggactccatccttggaagatgacagggtgatgccatataaatccgataagctacaaaatgactctatggttatcgacatgggccctcccgctgattgggtgaagataaacgttaggagaaccaaagattgctatgaagtctatgcgttggttcctggccttctgcgggaagaggtacatgttcagtctgatcctgctggtcgtttgatagttactggagagcctgagcaactagataacccatggggtgttactccattcaagaagatcattagtttgccttcccgcattgatcctcaccaaacctccgcagttgtcactctccatgggcagctatttgtgcgtgcaccatttgagcaatcaaaataatgatgccacatgaagcacaataatacaaagtttgccttatgtgtgggattaggtgcttgtgacatgagcttagaagttcccaccctgatctttatcgaaaactagttctttgctgattctaatgcttcaagactccttccttgctagatctctcctgtatcaattaaactcattagttgacatagttctgtctgtattcagttgtctccattggctgtgatttgtagctaaagctaagttactaaaagccttttagtttagaatgttaatagcctgatgcccaacatgttccatgttttcttttcaatttaaccggcataaagtgtactgtttgtagcaatgtagcatgtagcttgttcccagtatttgagttatcagaacatgtagacatgttacaggtggattcattgtatgtaactgttgccttactcattgctattcaacatgtatggtcaaacagtccaaaaaaaaaaaaaaaaaaaa

SEQ ID NO: 1760 - protein, 464 aa, Panicum virgatum
  misc_feature: Ceres CLONE 1769906
  misc_feature (1)..(109): Pfam Name: ARID Pfam Description: ARID/BRIGHT DNA binding domain
MSQEQGGEDPPPPPQAEGEAPPAADVPMGEAAAVDDDDEAEPVTGEGAADGAAGTFGSVEASVKPEAAGAEEGDGEELNGDAAADSVGEGEKLENGDEPVKVGREKGGSPVRDAADGGDDKGVDGQNQAAENQLVLVSAEEDLAMSKLSNNSFMFDYSTGGDDSGTEEEQAAFMKELERFYREKMMEFKPPKFYGEGLNCLKLWRQVTGLGGYDQVTSCKLWRQVGESFKPPKTCTTVSWTFRNFYEKALLEYEKHKIETGKFQVASSTLADRIGSESQVGGSHTSGSGRARRESATRAMQGWHSQRLLGNGEIADPIIKDKGTIVLKKDKTPKSSGSAKRKRTPSLEDDRVMPYKSDKLQNDSMVIDMGPPADWVKINVRRTKDCYEVYALVPGLLREEVHVQSDPAGRLIVTGEPEQLDNPWGVTPFKKIISLPSRIDPHQTSAVVTLHGQLFVRAPFEQSK

SEQ ID NO: 1761 - DNA, 1772 bp, Panicum virgatum
  misc_feature: Ceres CLONE 1769912
  misc_feature: Encodes the peptide sequence at SEQ ID NO. 1762
aaggcacactcctctcctctcctctcctgctgcagtcccactagccatggatccaaccaagttccggccgtcgagcgcgcacgacggcggcgtgacgacgacgaacgccggcgcgccggtgtggaacgacaacgaggccctgacggtgggcccgcgcgggccgatcctgctggaggactaccacctgatcgagaaggtggcccacttcgcccgcgagcgcatcccggagcgcgtggtccacgcgcgcggcgcctccgccaagggcttcttcgagtgcacccacgacgtgtcggacctcacctgcgccgacttcctccgcgcccccggcgcccgcacgccggtgatcgtccgcttctccacggtgatccacgagcgcggcagcccggagacgatccgcgacccgcgcgggttcgccgtcaagttctacacccgggagggcaactgggacctgctgggcaacaacttccccgtcttcttcatccgcgacggcatcaagttccccgacgtgatccacgccttcaagcccaacccgcggtcgcacgtgcaggagtactggcgcgtcttcgacttcctctcgcaccacccggagagcctccacaccttcttcttcctcttcgacgacgtcggcgtgcccgccgactaccgccacatggagggcttcggcgtcaacacctacaccttcgtcagcgccgccggcaaggccagctacgtcaagttccactggaagcccgcctgcggggtgcgctgcatcctcaccgacgaggaggcggcgctcgtcggcgggcgcaaccacagccacgccacgcaggacctgtacgacgccatcgccgccggcagcttccccgagtggcagctgctggtgcaggtgatggacccggacacggaggaccggtacgacttcgacccgctggacgacaccaagacgtggcccgaggacctgctgccgctgcggccggtggggcggctggtgctggaccggaacgtggacaacttcttcaacgagaacgagcagctggccttcggccccgggctggtggtgcccgggatctactactcggacgacaagatgctgcagtgccgggtgttcgcgtacgccgacacgcagcgctaccggctggggcccaactacctgatgctgcccgtgaacgcgccgcgctgcgcgcaccacaacaaccactacgacggcgccatgaacttcatgcaccgggacgaggaggtggactactacccgtcgaggcacgcgccgctgcggcaggcgccgccggtgccggtgccggcgaggccgctggcggggaggagggagaaggccaccatcaggaagcccaacgacttccagcagcccggggagaggtaccgctcctgggacgccgacaggcaggagaggttcgtcaggaggttcgccgactcgctgggacaccccaaggtcagccaggagctcagatccatctggatcgacctgctctcgaagtgcgacgcgtcgctggggaagaagatcgccacccgcctcaacgtcaagccaagcatgtgatcgatccatctgcagacaaaggcaatagcttatatatcgagcgagcaataagacagacagacagacgatacgagccagcagctagcagtgtcgtctttgctgctggttaccacgtcgtcgtcgttactgtgtcagtcctatataggactatgtctcgtacccatgtcctactctactactacacacttgaattatatttatcgacgatggatgagttacatcacaaaaaaaaaaaaaaaaaaaa

SEQ ID NO: 1762 - protein, 493 aa, Panicum virgatum
  misc_feature: Ceres CLONE 1769912
  misc_feature (1)..(384): Pfam Name: Catalase Pfam Description: Catalase
  misc_feature (1)..(493): SWISSPROT Homolog: EC 1.11.1.6 Catalase isozyme 3
  misc_feature (1)..(493): SWISSPROT Homolog: EC 1.11.1.6 Catalase isozyme A
MDPTKFRPSSAHDGGVTTTNAGAPVWNDNEALTVGPRGPILLEDYHLIEKVAHFARERIPERVVHARGASAKGFFECTHDVSDLTCADFLRAPGARTPVIVRFSTVIHERGSPETIRDPRGFAVKFYTREGNWDLLGNNFPVFFIRDGIKFPDVIHAFKPNPRSHVQEYWRVFDFLSHHPESLHTFFFLFDDVGVPADYRHMEGFGVNTYTFVSAAGKASYVKFHWKPACGVRCILTDEEAALVGGRNHSHATQDLYDAIAAGSFPEWQLLVQVMDPDTEDRYDFDPLDDTKTWPEDLLPLRPVGRLVLDRNVDNFFNENEQLAFGPGLVVPGIYYSDDKMLQCRVFAYADTQRYRLGPNYLMLPVNAPRCAHHNNHYDGAMNFMHRDEEVDYYPSRHAPLRQAPPVPVPARPLAGRREKATIRKPNDFQQPGERYRSWDADRQERFVRRFADSLGHPKVSQELRSIWIDLLSKCDASLGKKIATRLNVKPSM

SEQ ID NO: 1763 - DNA, 1679 bp, Panicum virgatum
  misc_feature: Ceres CLONE 1769917
  misc_feature: Encodes the peptide sequence at SEQ ID NO. 1764
gctgcaagcgaaaaaccaccgaaaccgttcgtgacgcaccaaccgctccccccgcgccaccagcaactcccacccgcggcgggttccagaaccttccagaacccagggcctccgggggactggtggaagcggcccggagatctcggcggggcggcccatggcgggcccgtgctgagggcggcgcgcgccggtccggggggagggcggcgagctcgagatcccgatgcagatccgggaggggcccgcgcggcgtgcggcgccgtccgccgccggggcgctgcggttgccgatgtccgccatgatgctcgccatgttcgccaccatggcctccttctacatcgccggccgattgtggcaggatgctcagaacagagtttacctcattaaagagcttgacagacgaacaggccaggggcaatcggcaatatctgtggatgataccttgaaggttgttgcatgcaggcagcaagggaagaggttggcatcacttgagatggagctggctgcagcaaagcatgaaggatttgtagggaaatacacccctgagacaaatggaactcattctagaaagaagccactgattgttattggaataatgagtagtttcggccggaaaaactaccgtgatgctgtcaggaaatcatggcttccaacaggttcaatgctgaagaaactagaagaagaaaaaggcattgtagtacgtttcatagttggaagaagtgcaaatcgaggagatacatttgatagggagattgatgacgaaaataggagtaccaaggatttcttgatcttggatgatcatatagagtctgatgaagaactccctaagaagacaaaaagcttttttgctaatgccgcagagacttttgatgctgcattttacgctaaggtcaatgatgatatatacataaacgttgatactttgagtgcaatgcttgaaactcactgggacaaaccccgtgtctatataggctgtatgaaatctggcgaagttttttctgactcaacccacaagtggtatgaaccagactggtggaaatttggtgatgggaaatcgtacttccgacatgcttctggtgaaatgtttgtcatatcgagggctgtagctcagttcatttctataaacaggtctctgctccggacatatgcccatgatgatgttagtgtaggatcgtggatgattgggcttgctgtgaagcatgtaaacgaagctaaattgtgctgttcatcatggccctcaggtgcaatgtgttcggccctttgatgaacaactattgctgagaaagagttttgcaaacagcttgttaggctcactagtgtggtggacgattcatacagtatgcggagaagagatgggatcggcatgaagagaaaaatgtttttcttctgccacttttttgtggcatcctttggacgaagcttgtgctagttcataccaaatcagataccttgttttttctcaaaggaaaggtcttgcatattttctttgcaagaccacaatactagaatcatgagtgagttctaactaaaaccatctacagattgtatccttgttttgcttgccatttgtagatgcccacccttaccattctttctctgacagacactgccattttggagtgacagaaatgaatagcaattcaggaaattatttttgctaaaaaaaaaaaaaaaaaaaa

SEQ ID NO: 1764 - protein, 346 aa, Panicum virgatum
  misc_feature: Ceres CLONE 1769917
  misc_feature (1)..(199): Pfam Name: Galactosyl_T Pfam Description: Galactosyltransferase
MQIREGPARRAAPSAAGALRLPMSAMMLAMFATMASFYIAGRLWQDAQNRVYLIKELDRRTGQGQSAISVDDTLKVVACRQQGKRLASLEMELAAAKHEGFVGKYTPETNGTHSRKKPLIVIGIMSSFGRKNYRDAVRKSWLPTGSMLKKLEEEKGIVVRFIVGRSANRGDTFDREIDDENRSTKDFLILDDHIESDEELPKKTKSFFANAAETFDAAFYAKVNDDIYINVDTLSAMLETHWDKPRVYIGCMKSGEVFSDSTHKWYEPDWWKFGDGKSYFRHASGEMFVISRAVAQFISINRSLLRTYAHDDVSVGSWMIGLAVKHVNEAKLCCSSWPSGAMCSAL

SEQ ID NO: 1765 - DNA, 2400 bp, Panicum virgatum
  misc_feature: Ceres CLONE 1769933
  misc_feature: Encodes the peptide sequence at SEQ ID NO. 1766
aagctacgttcatacatgatatgtggcaagacagagctccctacgattccaattgtcatcttctcaggctagaagggatgcctttggaaatgccaaccttcatcatgagaagaacatggagatgacgacggcgtggcgaattctttgtacagaattacgtacaagtggtcaattgagtagcattagaggatatcgtttgacagagaatcaccggcgacggcgacagaattgcatggaaatgagaagggtgggccatctgcaatctagattcgggcctagtaacaacggcccatgaagagacggcccaaagtggatgtaagggccgagtgcaagttgaatggcccagaaaaccgcgtgctgctgctccatcgccggccgctcgccgttcgcccgcccgtccgacgacgtcagcggccgcgcctctcgcttcctcgagcccgctcctcgccggcgtccggcgctcgacaccaatcgatgcggggcggacggaagcggcggcgagacggctcggaggcgccctccatccacccgcggaaccgctacgccgccgccgcgccggacttcgccgcgctggcggagctctacccgtcattccgcccctacgtctccgtctccgagcgcggacgcgcgtccgtcgacttcaccgacttctccgccacgcgggagctcacgcgcgtgctcctcctccacgaccatggcgtcaactggtggattccagatgggcagctttgccctactgttccaaacaggtccaactacattcactggatcgaggatcttctctcctcaaatctgacaccaccaatatcaagctcaagtgggaggatgaggggctttgacataggaactggtgccaattgcatctaccctctccttggagcatctttattgggatggagctttgttgggtctgatgtgactgatgttgctcttgagtgggctaagaagaatgtggagaacaacccgcacctaacagagctaattgagatcagaaatgcaaatgcagcatccttatcctctgaatctgaagctattgtcagggaacctatcagggagaacgttttagagcccgtggaggatgcagcgatgcaaaagccacctgtccttgtgggtgttgtaaaggagagtgagagctttgacttctgtatgtgcaatcctccattctttgagagcatagaagaagctggtcttaacccaaaaacgtcatgtggtgggacagctgaagagatggtttgccctggtggtgagttggcctttgtaacacatattattgaagacagtgtttcccttaagaactctttcaggtggtttacatcgatggttggcagaaaagcaaacttaaagttattaatgtcaaaagctcgtaaagctggggcctcagttgtgaaaactactgaattcgtgcaaggtcaaacagctagatggggccttgcttggtcattcattgctccaagaaataaggtcctcagatctactactccagcaaaaaaccaccattcgttcatgcttcaggtcacgttgtcagatgagcagactgaagctgcaatattgcatggtgatgattatgccggatctctagaagagagctctgcaaagttacaaagtgttgttaagggagtatcctttcgtattacggtgtttgaacaaattcctgggaccctcctaattaaaggttcattattgaataaagcattatcaggtaccttctcatcattattctctgagctggaggatgcgttaaggatggaatgtctcagtaagacgcgatagttcaaggtccttaattatgagctttaatcagacgggtgtatcagttgcctctgcacggataagtcttttggatgccaaggaacgtgcgagaggaaatcatgagaccgcaacagcttaaccagaagccacaaacagagatactgagctttgatggaaacttgcacttgcactgctcacatcttttcttgttatgcgctgatagcaaggttgtgaaaataccagcagcagtgactggtgtgctggccttatttcttatctggatttggagaacgacttgacaccgccaacgatgagagtcttgctttcaagatccttcgacatcacgcacgataaaccctctgatcgctccgagtgaatgacaaaatagaacaacgatgattagtacaaaccagatatctgatacattgcattgcctgtggaaaattctccccttcatttgttgcacggcttcccaagtcaatgatctgtgaacgggacagtgatgatatgatagaaactgctgctatgagaaacatgtttgtagtacaacggttctatacctgctggcagcagcagtgtttactttaatgtaattgcccctacactaaggggcgcggcattgttcaactgtaaaaaaaaaaaaaaaaaaaa

SEQ ID NO: 1766 - protein, 492 aa, Panicum virgatum
  misc_feature: Ceres CLONE 1769933
  misc_feature (1)..(315): Pfam Name: Methyltransf_10 Pfam Description: Protein of unknown function (DUF890)
MKRRPKVDVRAECKLNGPENRVLLLHRRPLAVRPPVRRRQRPRLSLPRARSSPASGARHQSMRGGRKRRRDGSEAPSIHPRNRYAAAAPDFAALAELYPSFRPYVSVSERGRASVDFTDFSATRELTRVLLLHDHGVNWWIPDGQLCPTVPNRSNYIHWIEDLLSSNLTPPISSSSGRMRGFDIGTGANCIYPLLGASLLGWSFVGSDVTDVALEWAKKNVENNPHLTELIEIRNANAASLSSESEAIVREPIRENVLEPVEDAAMQKPPVLVGVVKESESFDFCMCNPPFFESIEEAGLNPKTSCGGTAEEMVCPGGELAFVTHIIEDSVSLKNSFRWFTSMVGRKANLKLLMSKARKAGASVVKTTEFVQGQTARWGLAWSFIAPRNKVLRSTTPAKNHHSFMLQVTLSDEQTEAAILHGDDYAGSLEESSAKLQSVVKGVSFRITVFEQIPGTLLIKGSLLNKALSGTFSSLFSELEDALRMECLSKTR

SEQ ID NO: 1767 - DNA, 1508 bp, Panicum virgatum
  misc_feature: Ceres CLONE 1769936
  misc_feature: Encodes the peptide sequence at SEQ ID NO. 1768
gcgcgaccagatggccgccgccccgtcctcctctgccgccgcctgcttcctttcctccccgtgccccctgcctcgccgcccgcgccatttccccaggcacctcgcgtgcgccgcggcctccaagcacgcgcccgccgcttcctcctcccgctcgctcgccctcccctctcccgcgccgtggccgcggccgcggcggctagccgagctggtccccgccgaggcggcgggccggctgctgtcgtcggccgcgggctccctcatcgtcgcgctcgcctccgcggcgctgatcctcggcgacgcaggcgcggcctccgcgttcgtggtcgccacgccgcggaagctgcaggcggacgagctcgccaccgtgcgcctcttccaggagaacacgccctccgtcgtctacatcaccaacctcgccgtgaggcaggacgcgttcacgctcgacgtgctcgaggtgccgcaggggtccgggtcggggtttgtctgggataagagtggccatatcgtcaccaatttccatgtcatccgtggcgcgtcggacctcagggtcacacttgctgatcagtcagtgtatgaagcacaagttgttggatttgatcaggacaaggacgttgctgttttgcgtatcaaagcaccaatggataaactaagacctataccagttggtgtgtcagcagacctactggttggtcagaaagtatatgccattggaaatccatttggccttgaccacactcttacaacaggtgttatcagtggactgcgtagagaaattaattcagctgccacaggacgtcctatacaagatgtgatacagactgatgctgctatcaaccctggtaacagtggtggtccactccttgatagttcaggaaacttgataggtgtaaacactgctatatactcaccctcaggagcatcatctggtgttggtttttccattccagttgatacagttggaggcattgtggatcaacttataaaatttggtaaggtgacaagacctattttgggaataaaatttgcccctgatcaatctgtagagcagcttggattaagtggagtgcttgtcttggatgctcctccaaatggaccagctggcaaagcaggtcttcaatcaaccaaacgagatgcctacggtcggcttgtcctgggggatataattacctctgtgaatggtgcgaaggtaacaaatggaagcgacttgtaccggatattggatcagtgtaaagttggggaaacggtgactgtggaagtcttgcgtggtgaccataaagaaaagatccctgtggtccttgaaccaaagcctgatgaatcataggagaaaccaggttcatctgtatcatatgctcagctgcttacttaggtgcagagatgcaaattacaaggccttagcatttcgcctaccacgggattcattgtacataattcatacttgtaaatcaaactatctctggtctggtggaaaaggttatccatgttggcctcaaaaaaaaaaaaaaaaaaaa

SEQ ID NO: 1768 - protein, 436 aa, Panicum virgatum
  misc_feature: Ceres CLONE 1769936
  misc_feature (1)..(169): Pfam Name: Trypsin Pfam Description: Trypsin
MAAAPSSSAAACFLSSPCPLPRRPRHFPRHLACAAASKHAPAASSSRSLALPSPAPWPRPRRLAELVPAEAAGRLLSSAAGSLIVALASAALILGDAGAASAFVVATPRKLQADELATVRLFQENTPSVVYITNLAVRQDAFTLDVLEVPQGSGSGFVWDKSGHIVTNFHVIRGASDLRVTLADQSVYEAQVVGFDQDKDVAVLRIKAPMDKLRPIPVGVSADLLVGQKVYAIGNPFGLDHTLTTGVISGLRREINSAATGRPIQDVIQTDAAINPGNSGGPLLDSSGNLIGVNTAIYSPSGASSGVGFSIPVDTVGGIVDQLIKFGKVTRPILGIKFAPDQSVEQLGLSGVLVLDAPPNGPAGKAGLQSTKRDAYGRLVLGDIITSVNGAKVTNGSDLYRILDQCKVGETVTVEVLRGDHKEKIPVVLEPKPDES

SEQ ID NO: 1769 - DNA, 1771 bp, Panicum virgatum
  misc_feature: Ceres CLONE 1769939
  misc_feature: Encodes the peptide sequence at SEQ ID NO. 1770
atcgcaccaaatggtcagtgttagctccctcaaccgcaggagtgcaaaggaaattactacaaccaaccctaacgggcctttccttccactgccgcactgcatttgcgagctagcttataaatcaattgtacctatagtggctactggctggacacttgcagtgagatgcttgcagtgtcgtcgccggtgagttgtgcccatatggaagagtgccgtggaggcgccggcgtggagatggaggagattggccatgggccggtgtcggacgacctgaatttcgatttcacggtcgatgagatagacttcggggacttcttcctcagactagaagatggagatgcgctgccggaccttgaagtcgatcctggcgagatcttcaccgacttcgaggcaatcgccaccggcagcgatggtgtcatggaccaggaggtgcccagtgtccagctcttagcagatgcggtgcagttagatgccgcggatccatgcagtagtgttctttgcaaagagagtacgacccgcgtcgatgtggaagaagagaaaggagagtactccaaccatgctgaggaggtggtaaccgggaataatggtgattttgggggcggcggtggaaccgtcatggctgaggagaagtcgccgtcttccacgacatcgtcatcgcaggaggctgagagccggcacaagtctaccagcaagcactcgtcacaagggaagaagaaagcaaaggtggattggacgccggaactccaccggagatttgttcaagcggtagagcagctgggcattgacaaggcagtgccgtccaggatactcgagatcatggggatcgactccctcacgcggcataatatagcgagtcatttgcagaagtaccggtctcacaggaagcacatgctagcaagggaggcggaggcagcgagctggacccagcggcggcagatgtacgctgccggaggagcccctgccgccgcgaagagacccgattattccaacgcatggactgtgccaaccatcggcttccctcctcctccaccacctcctcctcctcatccgatgcagcacttcggaagaccgttgcacgtgtggggccacccaacccctggggtggagtcgccccgcgtgccaatgtggccacggcacctcgtcccgcgcgccccgacgacgccgtgggctcctccgccgtctgacccggcgttctggcaccacccttacatgaggggacctacacatatgccgggccaagtggctccctgcgtggcagtgccaatgccagccgcgcgatttcctgctccaccggtgaggggtgttttgccgtgtccacctccaatgtacagacctctcgttcctccagaactaggcagcaagagtccgcaagatacgcagctccagctacagatacagccatcaagtgagagcatagatgcagcgatcggtgatgttttatcgaaaccatggctgccactgccccttggcctgaagccgccttcagtagacagtgtcatggtcgagttgcagaggcaaggtgtagcagatgttcctccagcttgtggatgatctctgcgagatggatgagtcctccatgatagctgctcgtcccctcagtccaacaaaaagaattcgttgacatgcctttttttcattttcacgaaccatctatggtggacaactctcttaacttgtccagcgttaagaaaaatgacttcagcctttcaccttggcgagaaattaattaacccgaggacatccatgcgaccaaaaaaaaaaaaaaaaaaaa

SEQ ID NO: 1770 - protein, 461 aa, Panicum virgatum
  misc_feature: Ceres CLONE 1769939
  misc_feature (1)..(51): Pfam Name: Myb_DNA-binding Pfam Description: Myb-like DNA-binding domain
MLAVSSPVSCAHMEECRGGAGVEMEEIGHGPVSDDLNFDFTVDEIDFGDFFLRLEDGDALPDLEVDPGEIFTDFEAIATGSDGVMDQEVPSVQLLADAVQLDAADPCSSVLCKESTTRVDVEEEKGEYSNHAEEVVTGNNGDFGGGGGTVMAEEKSPSSTTSSSQEAESRHKSTSKHSSQGKKKAKVDWTPELHRRFVQAVEQLGIDKAVPSRILEIMGIDSLTRHNIASHLQKYRSHRKHMLAREAEAASWTQRRQMYAAGGAPAAAKRPDYSNAWTVPTIGFPPPPPPPPPHPMQHFGRPLHVWGHPTPGVESPRVPMWPRHLVPRAPTTPWAPPPSDPAFWHHPYMRGPTHMPGQVAPCVAVPMPAARFPAPPVRGVLPCPPPMYRPLVPPELGSKSPQDTQLQLQIQPSSESIDAAIGDVLSKPWLPLPLGLKPPSVDSVMVELQRQGVADVPPACG

SEQ ID NO: 1771 - DNA, 1898 bp, Panicum virgatum
  misc_feature: Ceres CLONE 1769974
  misc_feature: Encodes the peptide sequence at SEQ ID NO. 1772
atatcgagctgttcaactcactccccactccgtccaccgcaagtccgcaactgcagctctctcttcttcctcactcgtcggcgtcctcctcatcgtccttatccccccgggactggagcggagcggggatccatccactgcctccttctattctctgaggtgtttcctcatctaacccccccgcatgaggggctccaggctcttgctgctactagtggcggcgtcatctctctgcctctatgctgtgatcgctgcgcaacagacttgccctgctgaccttgatagcaaatgcgagggtgccgcttcagatgattgggagggggagttcttccctggcatcccgaaaatcaagtatgagggcccgaccagcaagaaccctcttgcttataagtggtataatgcagaggaagtgattctcggaaagaagatgaaggattggatgcggttcagtgttgccttttggcacacattccgtggtactggtggtgatccttttggtgccccgacaaaggcttggccttgggaggacggcacaaattcattggccatggctaagagaagaatgagagctcactttgaattcatggagaagctgggagttgacagatggtgcttccatgatagagatattgccccagatggcaaaacacttgaagaaacaaatgctaacttggatgagatagtcgagctggcaaaacaactccagagtgagaccaatatcaagccattgtggggaaccgcacagctctttatgcatccacgttacatgcatggagctgctactagcccagaggttaaagtatatgcttatgcagctgcacaagttaagaaagctttggaggtcactcactacctaggtggtgaaaattatgtgttttggggtggaagagagggataccaaactcttttgaatactgacatgaagagagaacttgaccatctggctaactttcttcaagctgctgttgactacaagaagaagatcggatttaaagggacactgttgatagagcctaaaccacaggaaccaacaaaacaccagtatgactgggatgttgcaactgcattcgcttttctacagaagtatggtcttacaggagagttcaagattaatgttgagtgcaaccacgctactctatctggacatagctgccatcatgaactggagactgcacgaattaatgggttgcttggaaatatcgatgcaaacactggtgatccacaagtcggttgggacactgatcagttcatgacagacatcgcagaggctactttggttatgtcaagtgtagttaagaatggtggacttgcacctggtggattcaactttgatgccaaattgcggagggaaagtactgatgttgaggacatgtttcttgctcatatctcaggaatggacaccctagcccgtggcctccgcaacgtcgccaagttgcttgaggatggttccttggatgaacttgtccgcaagcgctaccagagctttgacagtgagattggtgccttgatcgaggctgggaaaggagactttgagacgctagaaaggaaggttctggagtggggcgaacccactgttccatccggcaagcaggagctggccgagatgctgttccagtctgctctgtagatgatgccacgtccgtagctccagggaataagcactagcgcacaccctcggtatgcgcagcggttgccaccggcaaaatggcctggttccatgccgtgaactctgtacaatatagcatggaacctaggaataaatagttgtaacttgtgaggactagcgggattgggtcctggctcccggtgtttgtcctctctgttccaaacagacagaatcgaactgaatctggttgctacttcgacaccctgcatctcaaaaaaaaaaaaaaaaaaaa

SEQ ID NO: 1772 - protein, 480 aa, Panicum virgatum
  misc_feature: Ceres CLONE 1769974
  misc_feature (1)..(200): Pfam Name: AP_endonuc_2 Pfam Description: Xylose isomerase-like TIM barrel
  misc_feature (1)..(480): SWISSPROT Homolog: EC 5.3.1.5 Xylose isomerase
  misc_feature (6)..(469): SWISSPROT Homolog: EC 5.3.1.5 Xylose isomerase
MRGSRLLLLLVAASSLCLYAVIAAQQTCPADLDSKCEGAASDDWEGEFFPGIPKIKYEGPTSKNPLAYKWYNAEEVILGKKMKDWMRFSVAFWHTFRGTGGDPFGAPTKAWPWEDGTNSLAMAKRRMRAHFEFMEKLGVDRWCFHDRDIAPDGKTLEETNANLDEIVELAKQLQSETNIKPLWGTAQLFMHPRYMHGAATSPEVKVYAYAAAQVKKALEVTHYLGGENYVFWGGREGYQTLLNTDMKRELDHLANFLQAAVDYKKKIGFKGTLLIEPKPQEPTKHQYDWDVATAFAFLQKYGLTGEFKINVECNHATLSGHSCHHELETARINGLLGNIDANTGDPQVGWDTDQFMTDIAEATLVMSSVVKNGGLAPGGFNFDAKLRRESTDVEDMFLAHISGMDTLARGLRNVAKLLEDGSLDELVRKRYQSFDSEIGALIEAGKGDFETLERKVLEWGEPTVPSGKQELAEMLFQSAL

SEQ ID NO: 1773 - DNA, 1501 bp, Panicum virgatum
  misc_feature: Ceres CLONE 1769976
  misc_feature: Encodes the peptide sequence at SEQ ID NO. 1774
accaccaccgcttcgccctctcctctcctccctctcccccaccgtgagctcgccgcccgctcctcgccgcggatcgcccccgctactccggtaaaaaatggctgacgctgaggatatccagcccctcgtctgcgacaatggaactggtatggtgaaggcggggttcgctggagacgatgcgcccagggccgtcttccccagcatcgtggggcgcccgcgccacaccggtgtcatggtcgggatggggcagaaggacgcctacgtcggtgacgaggcgcagtccaagaggggtatcctgaccctcaagtaccccatcgagcacggcatcgtcagcaactgggacgacatggagaagatctggcatcacaccttctacaacgagctccgtgtggctcccgaggagcaccccgtcctcctcactgaggcgcccctcaaccccaaggctaaccgtgagaagatgacccagatcatgttcgagaccttcaacacccccgctatgtacgtcgccatccaggccgtcctctcgctgtatgccagtggtcgtaccacaggtattgtgctcgactctggagatggtgtcagccacactgtccccatctatgagggatacgccctcccccacgccatccttcgtcttgacctggctggtcgtgatcttactgactacctgatgaagatcctgactgagcgcggctactccttcaccactactgctgagcgggaaattgtgagggacatgaaggagaagcttgcctacattgccctggactacgaccaggagatggagactgctaagaccagctcctctgttgagaagagctacgagcttcctgatgggcaggtcatcaccattggtgctgagcgcttccgctgccctgaggtcctcttccagccatccttcattgggatggaagctgctggtatccacgagactacctacaactccatcatgaagtgcgacgtggatattaggaaggatctatacggcaacattgtcctctctggtggtaccaccatgttccctggaattgctgacaggatgagcaaggaaatcactgccttggctcctagcagcatgaagatcaaggtggttgctcctccagaaaggaagtacagtgtctggattggaggatccatcttggcttccctcagcaccttccagcagatgtggatcgccaaggctgagtacgacgagtccggcccatccattgtgcacaggaaatgcttctaattcttcgggcccaagaaatgcaagccgagaggagccattatcgccagcctccagccctgtttctttctctttttgttgctgtttcttcattagcgtggacaaagttttcggcgggtctatcgtgatcgttttcttctattcatcaagactgtaatatctattgctacctatgcttctcacttgtgattttgaacacatatgttcggtttattcaattttattgagatgcctgatgaggcaactagcaaataaaaaaaaaaaaaaaaaaaa

SEQ ID NO: 1774 - protein, 377 aa, Panicum virgatum
  misc_feature: Ceres CLONE 1769976
  misc_feature: Great-hit functional homolog of the protein sequence given in SEQ ID NO 9451
  misc_feature: Great-hit functional homolog of the protein sequence given in SEQ ID NO 9534
  misc_feature: Great-hit functional homolog of the protein sequence given in SEQ ID NO 9536
  misc_feature (5)..(214): SWISSPROT Homolog: EC 2.7.10.2 Tyrosine-protein kinase transforming protein Fgr
  misc_feature: Useful for making plants with modulated biomass
  misc_feature: Useful for making plants with modulated flowering time
  misc_feature: The plant flowers significantly late compared to wild-type.
  misc_feature: The plant is abnormally small.
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDYLMKILTERGYSFTTTAEREIVRDMKEKLAYIALDYDQEMETAKTSSSVEKSYELPDGQVITIGAERFRCPEVLFQPSFIGMEAAGIHETTYNSIMKCDVDIRKDLYGNIVLSGGTTMFPGIADRMSKEITALAPSSMKIKVVAPPERKYSVWIGGSILASLSTFQQMWIAKAEYDESGPSIVHRKCF

SEQ ID NO: 1775 - DNA, 2247 bp, Panicum virgatum
  misc_feature: Ceres CLONE 1769996
  misc_feature: Encodes the peptide sequence at SEQ ID NO. 1776
gtccacttcctcctcctcatccccgtccttgcctgcgttttcgctgcggattggagcggcaagggctcacttcccgggcgggatccctccggctgcggcctgacgatgccggaggcaaatgcgggtgcgctggcgcacgcggagcagaggaagaagaattcaccagagatggatttcttcagtgaatatggcgataccaacagatacaaaattcaggaaataattggcaaaggaagctacggggttgtttgctcagctattgaccaacaaactggtgagaaggtagcgatcaagaaaatacagaatatctttgagcatctgtccgacgctgctaggatcctccgggagatcaagctcctccggcttctaaggcatcctgatattgttgagatcaaacatgtaatgttacctccatcgaggagggacttcagagatatttatgttgtttttgagctgatggataccgaccttcaccaagttattaaggctaatgatgacttaacaaaggagcaccatcagttctttctctatcagatgctgcgtgctttgaaatatattcatactgctaatgtttatcatcgtgacttaaagccaaaaaatatactagcaaatgctaactgcaaactcaagatatgtgatttcggattagcaagggttgcgtttaatgactctcctaccacagtcttctggacggactatgttgctactagatggtacagggctcctgagctgtgtgggtctttctttactaagtattcaccagctattgatatgtggagcattggttgcatttttgcggagattttgactgggaagcctttattccctggtaaaaatgtggttcaccaattggatttgatgactgatctcttgggcacaccatcagcagatactatttcacagatccgaaatgagaaagcgaggaggtaccttagcagtatgaggaagaaacagccaatacccttttcattgaagttccccaatgcagatccctcggcgctcaagctcttgcaaaggcttctagcatttgatcccaaggatcgaccaacagctgaagaggcattggctgatccctattttaaaggcattgcaaaagtggagagggaaccatcgtgccagccaatttcgaaaatggaatttgagtttgaacggagaaagtttactaaagaggatgtcaaggaacttatattccaggagatactggaataccaccctcaacttctaaaggattacaagaacggctctgaaaaaacaagctttctatatcccagtgctgttgacaatttccggaggcagtttgctagcttagaagaaaatggagggaggaatgccacagtcgacaggaagcatgtttctctcccaaggactacaaccgttcactctactccaattcctgcaaaggaaggtccggctgcaacatcccaggttcctcaaaggattccaacagtattaccattcgagaatgtaagtgctgtcgatcaacacatcacgcgacgggtggctaggaatccaggtgtacctccagcaaccaacaactcatcggtatatggctaccacctgaagtcggacagctcagacaggcaggatcatcagctagagcttgaaaaagaccagatgcaatataggccagggcagcatgccatggaagccaaggtagcacctgagttggcccgggacatgcggccatcgccgtactatgtctcgaggggtgtacccaaaactgatctaacagaaagggccgccctccaaaggagcatgctgcacaacgttgcttccttcaatggcatcacggctgtcgctggtgggtacagcaaggcaggcattctccactatggagtcacaagcttgtactagagcagtgtcactgggccctggaaggataataagatgggaacggagtgcggctacagctgccccttccccccagcttgaagttcggagcacggacgggaggttcatgcctgatcaacgatgcaggcgtccggaaaggattttcaggctgggaaaatggcgagcgccaccttttgttgctcttgtttagtgagcaatgggccactgatctcgcgccaatgttgtgatcttccaagaattacccgtcttaaaaaacgggggtggggggaaattgaggatatgtgtacagtacaacacttaattttgtatttaaccatttggaacgttcttcttccagttctgcacatttaaataatatcatgatgtttataggttcaaaaaaaaaaaaaaaaaaaa

SEQ ID NO: 1776 - protein, 582 aa, Panicum virgatum
  misc_feature: Ceres CLONE 1769996
  misc_feature (22)..(582): SWISSPROT Homolog: EC 2.7.11.24 Mitogen-activated protein kinase 7
  misc_feature (22)..(582): SWISSPROT Homolog: EC 2.7.11.24 Mitogen-activated protein kinase 8
MPEANAGALAHAEQRKKNSPEMDFFSEYGDTNRYKIQEIIGKGSYGVVCSAIDQQTGEKVAIKKIQNIFEHLSDAARILREIKLLRLLRHPDIVEIKHVMLPPSRRDFRDIYVVFELMDTDLHQVIKANDDLTKEHHQFFLYQMLRALKYIHTANVYHRDLKPKNILANANCKLKICDFGLARVAFNDSPTTVFWTDYVATRWYRAPELCGSFFTKYSPAIDMWSIGCIFAEILTGKPLFPGKNVVHQLDLMTDLLGTPSADTISQIRNEKARRYLSSMRKKQPIPFSLKFPNADPSALKLLQRLLAFDPKDRPTAEEALADPYFKGIAKVEREPSCQPISKMEFEFERRKFTKEDVKELIFQEILEYHPQLLKDYKNGSEKTSFLYPSAVDNFRRQFASLEENGGRNATVDRKHVSLPRTTTVHSTPIPAKEGPAATSQVPQRIPTVLPFENVSAVDQHITRRVARNPGVPPATNNSSVYGYHLKSDSSDRQDHQLELEKDQMQYRPGQHAMEAKVAPELARDMRPSPYYVSRGVPKTDLTERAALQRSMLHNVASFNGITAVAGGYSKAGILHYGVTSLY

SEQ ID NO: 1777 - DNA, 1665 bp, Panicum virgatum
  misc_feature: Ceres CLONE 1770004
  misc_feature: Encodes the peptide sequence at SEQ ID NO. 1778
accggatcgaacaatctctccgcctgccgcatcgccgccgccgccgccgccgcccatggccgccgtcgctcccgtcgtctccgaccttgtcgacttcctcaacgcgtcgcccactgccttccacgccgtcgacgaggcgaagcggcggctgaaggcggcggggttcgcgcagctctcggagcgggaggagtggtcggggctcgagcccggccgcaagtatttcttcacacgcaaccactccaccatcgttgccttcgccatcggcggcaaatacgttgctggcaatgggttccacgtcatcggtgcgcacactgacagcccttgcctcaagctcaagcccgtctccaaggtaaccaaagaaggttatcttgaggttggggtacaaacatatggtggtggattgtggtacacatggttcaaccgtgatcttactatagctggtagggtgatcacacgagagaagagggatggcggggtctcatatgcacataagcttgtacgggtgcaagagccaatcctaaggattcctactttggctattcaccttgacaggactatctcctcagaaggcctcaaaattaacaatcagagtcatcttgttccagtgctggctacatctatcaagaatgaaatgcagaaaatagtgggagaaaatggcccaaaggagtcatcggagaataagaacacgaagcaccatccattactgttgcagttgattgctaaagaggctaactgtgagcctgatgaaatatgcgacttcgaactgcaactttgtgatactcaaccaagtgctatagcaggtgccatgaaagagttcatcttttcaggacggcttgacaacctttgcatgtcattttgttcattgaaggccctaatcgactcaacttctgctgaacaatcacttgatcatgaatctggtgtgcgaatggtagctctctttgaccatgaggaagttgggtctgattctgctcagggagctggttcccctgccatgttagacgctttatcaagaatcacggggtcttttaactcttcaaattccaagttgctagaaaaagctattcagaggagctttctggtgtctgctgacatggcacatgctttacaccccaattatatggacaagcatgaggagaaccaccaaccaaaattgcacggaggacttgtgatcaagcataacgccaatcaacgttatgctacaaatgctgtgacagcatttattttccgagaaattgctgagaggcaccaactacccgtccaggatttcgttgttcgaaatgacatgggttgtggttcaacaattggcccaatacttgccagtggtgtgggtatccgtactgttgatattggtgcaccacaactatcaatgcacagcatcagagaaatgtgtgccactgacgatattagccacgcgtatgagcatttcaaggcatattttgaagaattcactgagttagatagcaaggtcaaggtggattattaaggtagtgaaacacaatagggtagctttgttgcacggtatttactacaaaatcaatgaataagtaaaaagacaaatcaggaggatgtattattgtgttctaaattttagcttagcactggcaagatatttcttaagaagcatttggcttgtggttgcatgcttaaaaaaaaaaaaaaaaaaaa

SEQ ID NO: 1778 - protein, 475 aa, Panicum virgatum
  misc_feature: Ceres CLONE 1770004
  misc_feature (1)..(440): Pfam Name: Peptidase_M18 Pfam Description: Aminopeptidase I zinc metalloprotease (M18)
  misc_feature (3)..(474): SWISSPROT Homolog: EC 3.4.11.21 Aspartyl aminopeptidase
MAAVAPVVSDLVDFLNASPTAFHAVDEAKRRLKAAGFAQLSEREEWSGLEPGRKYFFTRNHSTIVAFAIGGKYVAGNGFHVIGAHTDSPCLKLKPVSKVTKEGYLEVGVQTYGGGLWYTWFNRDLTIAGRVITREKRDGGVSYAHKLVRVQEPILRIPTLAIHLDRTISSEGLKINNQSHLVPVLATSIKNEMQKIVGENGPKESSENKNTKHHPLLLQLIAKEANCEPDEICDFELQLCDTQPSAIAGAMKEFIFSGRLDNLCMSFCSLKALIDSTSAEQSLDHESGVRMVALFDHEEVGSDSAQGAGSPAMLDALSRITGSFNSSNSKLLEKAIQRSFLVSADMAHALHPNYMDKHEENHQPKLHGGLVIKHNANQRYATNAVTAFIFREIAERHQLPVQDFVVRNDMGCGSTIGPILASGVGIRTVDIGAPQLSMHSIREMCATDDISHAYEHFKAYFEEFTELDSKVKVDY

SEQ ID NO: 1779 - DNA, 2045 bp, Panicum virgatum
  misc_feature: Ceres CLONE 1770005
  misc_feature: Encodes the peptide sequence at SEQ ID NO. 1780
aggaggcggccggcgagctagcaccaccgccaccagcaatacaatcatctccttcccgccgttagttgaaccaatcgcctactgcacagggtcaccaacccgattgacaggccagttcatccgagagcgagcttggtcgccggggagatgggttccgtggacgagtcggcggcggcggaggtggtgttccggtcgaagctgccggacatcgagatcaacaacagccagccgctgcacgcgtactgcttcggcaagatgcccgaggtggcggggcggccctgcctgatcgacgggcagaccggcgcgtcctacacctacgcggaggtggagtcgctgtcgcggcgcgccgcggcggggctccggcggatgggcgtgggcaagggcgacgtggtgatgagcctgctccgcaactgccccgagttcgccttcgcgttcctgggcgcggcgcggctgggcgccgccaccaccacggcgaacccgttctacacgccgcacgagatccaccggcaggcggaggcggccggcgccaagctcatcgtcaccgaggcctgcgccgtggacaaggtgcgggagttcgcggccgcgcggggcatccccgtggtcaccgtggacggacgcttcgacgggtgtgccgagttcgtcgaggtcatcgcagcggaggagctggaggccgacgccgacatccaccccgacgacgtcgtcgcgctgccctactcctccggaaccaccggcctcccgaagggcgtcatgctcacacaccgcagcctcatcaccagtgtcgcgcagcaggttgacggcgagaacccgaacctgaacttccgcacggacgacgtggtgctgtgcctgctgccgctgttccacatctactcgctcaactcggtgctcctggcggggctccgcgccggctgcgccatcgtgatcatgcgcaagttcgacctgggcgcgctcgtggacctggtgcgcgcgcacggcatcaccatcgcgcccttcgtgccgcccatcgtggtggagatcgccaagagcccccgggtcaccgccgccgacctcgcctccatccgcatggtcatgtccggcgccgcgcccatgggcaaggacctccaggacgccttcatggccaagatccccaacgccgtgctcggccagggctacgggatgacggaggccgggcccgtgctggccatgtgcctggccttcgccaaggagccgttccaggtcaagtccgggtcgtgcggcaccgtggtgcgcaacgccgagctcaagatcgtcgaccccgacaccggcgccgccctgggccggaaccagcccggcgagatctgcatccgcggcgagcagatcatgaaaggttacctgaacgaccccaagtccacgaagaacaccatcgacaaggacggctggctgcacaccggggacatcggctacgttgacgacgacgacgagatcttcatcgtcgacaggctcaaggagatcatcaagtacaaggggttccaggtaccgcctgcggagcttgaggccctcctcatcacgcacccggagatcaaggacgccgccgtcgtatcaatgaaggatgatctcaccggtgaaatcccggtcgccttcatcgtgcggacagaagggtctcaactcaccgaggatgagatcaagcaatttgttgccaaggaggtggttttctacaagaagatccacaaggtctttttcaccgactccatccccaagaacccttcaggcaagatcctaaggaaggacttgagagccaggctcgccgcaggcgtccactgaggccatatacagcagcgtttcagtcgaccacattgttgagaaaaggccatgcaatagatggtaccattgttcatgaaatggcagcaggagaagcacctaatcttgtgtaaacgtatatatgttgccgaaagaggttttggtttgtttgttggttggccttgtgtggtgtgatgtttataaatgatatatatagatgtatctagctatattattttttaccaaaaaaacaaggctgattacggcaattggaaaaaaaaaaaaaaaaaaaa

SEQ ID NO: 1780 - protein, 542 aa, Panicum virgatum
  misc_feature: Ceres CLONE 1770005
  misc_feature: Great-hit functional homolog of the protein sequence encoded by LOCUS At1g51680
  misc_feature: Great-hit functional homolog of the protein sequence encoded by LOCUS At3g21240
  misc_feature: Great-hit functional homolog of the protein sequence given in SEQ ID NO 9251
  misc_feature (4)..(541): SWISSPROT Homolog: EC 6.2.1.12 4-coumarate--CoA ligase 2
  misc_feature (8)..(537): SWISSPROT Homolog: EC 6.2.1.12 4-coumarate--CoA ligase 1
  misc_feature: Useful for making plants with altered cell wall content and/or composition
  misc_feature: Useful for making plants with altered lignin content
MGSVDESAAAEVVFRSKLPDIEINNSQPLHAYCFGKMPEVAGRPCLIDGQTGASYTYAEVESLSRRAAAGLRRMGVGKGDVVMSLLRNCPEFAFAFLGAARLGAATTTANPFYTPHEIHRQAEAAGAKLIVTEACAVDKVREFAAARGIPVVTVDGRFDGCAEFVEVIAAEELEADADIHPDDVVALPYSSGTTGLPKGVMLTHRSLITSVAQQVDGENPNLNFRTDDVVLCLLPLFHIYSLNSVLLAGLRAGCAIVIMRKFDLGALVDLVRAHGITIAPFVPPIVVEIAKSPRVTAADLASIRMVMSGAAPMGKDLQDAFMAKIPNAVLGQGYGMTEAGPVLAMCLAFAKEPFQVKSGSCGTVVRNAELKIVDPDTGAALGRNQPGEICIRGEQIMKGYLNDPKSTKNTIDKDGWLHTGDIGYVDDDDEIFIVDRLKEIIKYKGFQVPPAELEALLITHPEIKDAAVVSMKDDLTGEIPVAFIVRTEGSQLTEDEIKQFVAKEVVFYKKIHKVFFTDSIPKNPSGKILRKDLRARLAAGVH

SEQ ID NO: 1781 - DNA, 1543 bp, Panicum virgatum
  misc_feature: Ceres CLONE 1770028
  misc_feature: Encodes the peptide sequence at SEQ ID NO. 1782
ggcaacagcgcaactaatcataaacctcgcttcaatccaccggattaaaccctagccactggcgggtggcggctccgtatccgcgcactccccccatgccgctctgccactcccccacctccgccgccgtcgccgcggcggcatctcccatcgcggcgcgcagcgggggactcctccgccgctcgcgcccagcccccgctgtcgtgagatgtaaaaagcttgattctctgagggcaatcaatggatcaccaccatgcattccagtgcccgacaggtcactattgactcctgtaaccttgccagttttcccggatccaagcatgagaaacgacacaaggctgcgcatcttctcaggcacagccaatcattccctttcccaggagatagcaagctacttgggtctagaacttgggaagattaacataaaaaggttcgcagatggcgaaatatatgtccaattgcaagaaagtgtgcggggctgtgatgttttccttgtgcagccaacgtgccctccagcaaatgagaatctcatggaacttctgatcatgatcgatgcctgtaggagagcatctgctaagaatattactgcagtcatcccttattttggttatgcaagggctgacaggaagtctcaaggccgggaatctatagctgcaaagcttgtagctaatatgattacagaagctggtgcgaaccgtgtccttgtttgtgatcttcattccagtcaagcaatgggatacttcgacatcccagtagatcatgtttatggccagcctgttattcttgattatctcgccagcaagacaatatgttcaaatgacttggtggttgtatctcctgatgttggaggtgttgccagggcacgtgcttttgccaaaaaactttcagatgcacctctagctattgtagataaaaggaggcatggacacaatgttgctgaggtaatgaatcttattggagatgttagaggaaaagtggctgttatgatggacgatatgattgacacagcaggaactattgccaaaggagctgagctactgcatcaggaaggagctcgagaagtatatgcttgctgtacacatgctgtttttagcccacctgccattgaaaggttatcaagtggtttgtttcaagaagtaatcgtcacaaacactatccctcttaaggaggagaagacttttccgcagctgaccattctttcagttgctaacctcttaggtgaaacaatctggcgtgttcacgacgattgctcagttggtcatgagccatactccagcttggatattgactaatgcttaaggcgtattactcatgccgcgcccctcatgcctaggaatagttatggcagctcacaaccttttatctttttttttttttgcgggggcttcagttttttttgtgtgtgtgtgtgtaataagcggccctatgtcatgtgggattccattagcaaagaagcaaagaacctcaaccatgtatttgaatgacaatacatagttggaattttggattgtagatttgtagtgaaaaaaaaaaaaaaaaaaaa

SEQ ID NO: 1782 - protein, 398 aa, Panicum virgatum
  misc_feature: Ceres CLONE 1770028
  misc_feature (1)..(398): SWISSPROT Homolog: EC 2.7.6.1 Ribose-phosphate pyrophosphokinase 1
  misc_feature (73)..(387): SWISSPROT Homolog: EC 2.7.6.1 Ribose-phosphate pyrophosphokinase 1
MPLCHSPTSAAVAAAASPIAARSGGLLRRSRPAPAVVRCKKLDSLRAINGSPPCIPVPDRSLLTPVTLPVFPDPSMRNDTRLRIFSGTANHSLSQEIASYLGLELGKINIKRFADGEIYVQLQESVRGCDVFLVQPTCPPANENLMELLIMIDACRRASAKNITAVIPYFGYARADRKSQGRESIAAKLVANMITEAGANRVLVCDLHSSQAMGYFDIPVDHVYGQPVILDYLASKTICSNDLVVVSPDVGGVARARAFAKKLSDAPLAIVDKRRHGHNVAEVMNLIGDVRGKVAVMMDDMIDTAGTIAKGAELLHQEGAREVYACCTHAVFSPPAIERLSSGLFQEVIVTNTIPLKEEKTFPQLTILSVANLLGETIWRVHDDCSVGHEPYSSLDID

SEQ ID NO: 1783 - DNA, 1271 bp, Panicum virgatum
  misc_feature: Ceres CLONE 1770031
  misc_feature: Encodes the peptide sequence at SEQ ID NO. 1784
agcgagctcccggcgcgcgataatggagggtgacgagaagtcggcaggcggggccccggccccggcctactggggcctgggcgcgcggccctgcgacgcgtgcggcgacgaggcggcgaggctctactgccgcgcggacgcggcgttcctctgcgccgggtgcgacgcgcgcgcgcacggcgccgggtcgcgccacgcccgcgtctggctctgcgaggtctgcgagcacgcgccggccgcggtcacgtgccgcgcggacgccgccgcgctctgcgcctcgtgcgacgccgacatccactccgccaacccgctcgcgcgccgccacgagcgccaggccgtggcgcccttctacggcgcgctggccgacgcgcccaagcccttcgcctcgtcggcggccgtgcccaaagcggccgacgacgacgggagcaacgaggccgaggcggcgtcgtggctcctccccgagcccgaccacgggctcaaggaaggcgccacgacggaggtgttcttcgcggactccgacccgtacctcgacctcgacttcgcgcgcaccatggacgacatcaaggccatcggcgtccagaacggccccgccgagctcgacctcaccggcgccaagctcttctactccgaccactccatgaaccacagcgtgtcgtcatcggaggcagcagtggtgcccgacgcggcggcgggcgcggcgcccgtggttccagtggtgagcaggggtctggagcgggaggcccggctgatgcggtaccgggagaagcgcaagagccggcggttcgagaagacgatccggtacgcgtcccgcaaggcgtacgcggagacgcggccgcgcatcaagggccggttcgccaagcgcacccccgggcccggcggcgcggacggggaggacccgctggaggagcacgaggaggagatgtactcctccgccgcggcagccgtggccgcgctcatggtccccggcggcgccgacgccgactacggcgtcgtgcccacgtattgatcggcgccggcctgttgtaacactagccagcctcgacctcgccgccggggctgtaatttttgctgcatgccctgcatgcaaagctgccgtgtagcattaattacctgtaatatgattccacggaagccatcaggccggacttccaagctattcttcctccctaatcattccgccatgtatgtatattattatgagtaaattgcactcatcatacaataaattgacagatagatacaaattgatccaaaaaaaaaaaaaaaaaaaa

SEQ ID NO: 1784 - protein, 327 aa, Panicum virgatum
  misc_feature: Ceres CLONE 1770031
  misc_feature (1)..(45): Pfam Name: zf-B_box Pfam Description: B-box zinc finger
  misc_feature: The sequence is a functional homolog of  SEQ ID NO 1293 in the  11/479,226 US patent application
  misc_feature: The sequence is a functional homolog of  SEQ ID NO 598 in the  10/412,699 US patent application
  misc_feature: Useful for making plants with modulated growth and phenotype characteristics
MEGDEKSAGGAPAPAYWGLGARPCDACGDEAARLYCRADAAFLCAGCDARAHGAGSRHARVWLCEVCEHAPAAVTCRADAAALCASCDADIHSANPLARRHERQAVAPFYGALADAPKPFASSAAVPKAADDDGSNEAEAASWLLPEPDHGLKEGATTEVFFADSDPYLDLDFARTMDDIKAIGVQNGPAELDLTGAKLFYSDHSMNHSVSSSEAAVVPDAAAGAAPVVPVVSRGLEREARLMRYREKRKSRRFEKTIRYASRKAYAETRPRIKGRFAKRTPGPGGADGEDPLEEHEEEMYSSAAAAVAALMVPGGADADYGVVPTY

SEQ ID NO: 1785 - DNA, 1549 bp, Panicum virgatum
  misc_feature: Ceres CLONE 1770051
  misc_feature: Encodes the peptide sequence at SEQ ID NO. 1786
gaatcttctgacatgaatgcatttgcggaggaggtagagagtgaggaagaatacagcgattatgatgactctgatagtttgttcgataattgattgcttcgtatcaattgctatttgatgagcttgcatgcaggccttaacttgatgctctgatatatatgatgcagtcattagactgccaattttgaagcatgtgtgcttggtaaaccaaatgctttatacattcaaactgtagattagagttccagtagtatattcagatatcgttcaacgttgtatgtttaactgcataatgatgtacttgtcatctttcttactgaaatacttgtgtttctatgacaaacatacatctggtcatctttctcaaaaaaaaaaaaaaaaaaaaaaaaaaaaaaaaaarccggctgctgccaramwcggawaraatccgactccgaggccmacgcctccctcaaataarccaacgccttctcccttcgccttcctctcttcgctcgacccggaaaaatgctwcgactcttttcatgattcaacccakaattcctagtttcctcctataagttccattgaccccggtcacagtcacccttcggkgttttcttcctctctgsggctccgggcgttttcttcctctctggggttctgggcgttttgttcctcttagcggctccggagatggcgggcgtcggctcggcggggcggcggatctacctgggtgtgtacaattggatcgtcttcgccggatgggcgcaggtgctgtactacgcgattttggcgctgtggtcgagcggccatgagggtgtctacagcgctgtcgagcggccgctgcagttcgcgcaaacagccgccatcatggagattctgcatggacttgtaggtcttgtgaggtctccggtatctgctactcttccacaaattggatccaggttgttccttacatggggcatcttgtggagtttccctgagacccgtttccacattcttgtaactactctggtcataagctggtcgatcacagagatcattagatactctttttttgggatgaaggaagcacttggatttacaccttcatggctcctatggctgaggtatagcacctttatggtcttgtatcctactggtatctcaagcgaggttggcctgatttggattgccttaccatacataaagacatcggagaaatattgctttaggttgccgaacagatggaatttctcatatgattactactttacatccattcttgccctcatgatctatattccaggaagcccgcatatgttcacctacatgctctctcagcgcaagaaagctctatcgaaggctaaaactgcataatgctgctaggtgcttcgtaatagaatgcattgtgtgatgtctcaatgtgcctcaacagaagttagtgactggggattgttagaatagaactcttctcatgacttcacggggtgaatttccatgtcgatttgatgccttcgttaatccctcatacgtctgatacaaatgtctgttgttgtacctgaaatgccatgttaattcgatttcc

SEQ ID NO: 1786 - protein, 221 aa, Panicum virgatum
  misc_feature: Ceres CLONE 1770051
  misc_feature: Great-hit functional homolog of the protein sequence given in SEQ ID NO 9475
  misc_feature (1)..(165): Pfam Name: PTPLA Pfam Description: Protein tyrosine phosphatase-like protein, PTPLA
  misc_feature: Useful for making plants with modulated drought sensitivity
MAGVGSAGRRIYLGVYNWIVFAGWAQVLYYAILALWSSGHEGVYSAVERPLQFAQTAAIMEILHGLVGLVRSPVSATLPQIGSRLFLTWGILWSFPETRFHILVTTLVISWSITEIIRYSFFGMKEALGFTPSWLLWLRYSTFMVLYPTGISSEVGLIWIALPYIKTSEKYCFRLPNRWNFSYDYYFTSILALMIYIPGSPHMFTYMLSQRKKALSKAKTA

SEQ ID NO: 1787 - DNA, 1858 bp, Panicum virgatum
  misc_feature: Ceres CLONE 1770078
  misc_feature: Encodes the peptide sequence at SEQ ID NO. 1788
atccgccgcctcgcccgagctgcgccgcggtcggagcagctccgccccgcttccacgcgcccccgtccgccgccggcggccgccgcatcggcccctcccctcccctgctcctccgcagctccgtcccgccaccgcgcaccgctgccttgagcttcccgcctggacgcattgtggatctcccgttggagaccaacgtttttgggtggtgccctttcagccccactaggactcaatttgggttttgggtctccaccaccgttggagatagccttactgatcccatagtccagcaggcagcagcctcgacgagtcgacgccagcgccggagagggaatccaacaaaccccgaaacgcgccgccgtcgccctcgccgctcggctgccccctcttcacttcttcagttccctccgcagccggctcgcaagagcaccccgcggcggtggagaggtaaatctcctccgggcgccagcggcggcggatcagtcgagggtattggagaagaaatgggaagcagagaaaggcgagtggtgtttgtcaccgtaggaactacatgcttcgatgctcttgtcaaggcagtagattccgaggaagtgaaagaagccttactgcgtaagggttacaccgatctcctgattcaaatgggccgaggcacatacatgccatgtaaggactcaggaaattcaactcttcaagttgattatttcaccttttcaccaagcattgctgactacataagagaagcatccttagtcatcagtcatgcaggatccggaagcatatttgagaccctacgactgggaaaacctctaattgttgttgtgaatgaagatcttatggataatcaccagagcgagttagcagaagaacttgccgacaggaagcaccttttctgtgcccgtccacaaacactgcaagagactgttgagtcgatggacctgaataatctcctgccttacatgccaggagatgccaatcaagttgtctcactggtcaacaaatttcttggttttccagtcgactgattgtctccatcattgcttactcatcatggaaatagagggatcttgtgcgctagtgatttagtcagaaagtgctgggagaatgtcagctctaagctaagagcattggactgcgcactgctttcatttgatcatgataagctgaaatgaactggccaaagaaccatgctgatatgaaatggccagtatggtggatggatcaactgaccctaacccagggtacggtgtgatctgttcttttggttctacaatcctggctcctgggagcaattgatgtagcttggtggaatcagcaaccttacctattgtttctattttgatatccttcatctaactacttaccatctctcagtacaagggaaatgtttcccaaattgcatgaaatgtgcttccccttttctttggtattggagggtgcataggtagctgctctccacaggattgggatccacttgaaggcatggtttcagttgcgatatatgaactcagtgctgcatcggagagttggtgaaagcaaacccatacgggccctttgattggtatttgctacattccagaatgtaactgatgtgaggatccatgtcattaaacagaagcattgtggttttgaccttgattgagggaagccccgtttagcaatcttgctgggatcaatatgccatatgctaccattatttcactcctttttggactccctgaaagccatcttggtgatgatgtgtgttgtactcctgcgctaccatcgatttccaaatttcagctttgttttaggggacaaactattagtagtggatgtttgagggaaactcactttactccaaaaaaaaaaaaaaaaaaaa

SEQ ID NO: 1788 - protein, 172 aa, Panicum virgatum
  misc_feature: Ceres CLONE 1770078
  misc_feature: Great-hit functional homolog of the protein sequence given in SEQ ID NO 9271
  misc_feature (1)..(160): Pfam Name: Glyco_tran_28_C Pfam Description: Glycosyltransferase family 28 C-terminal domain
  misc_feature: Useful for making plants with altered oil content
MGSRERRVVFVTVGTTCFDALVKAVDSEEVKEALLRKGYTDLLIQMGRGTYMPCKDSGNSTLQVDYFTFSPSIADYIREASLVISHAGSGSIFETLRLGKPLIVVVNEDLMDNHQSELAEELADRKHLFCARPQTLQETVESMDLNNLLPYMPGDANQVVSLVNKFLGFPVD

SEQ ID NO: 1789 - DNA, 1357 bp, Panicum virgatum
  misc_feature: Ceres CLONE 1770082
  misc_feature: Encodes the peptide sequence at SEQ ID NO. 1790
gtcaggtccgccagcgggcagctagctttggtggaatcggacggagcgcgaggaagaatggcgatgcagagagccgccgcggccgtcctcctccctctcctcgcggcggcggcgcggacctccgccctgcccttcatcgtcctgcacgggattggggaccagtgcgccaaccatggcgtcgcccagttcacaaaacttctcgccgaatggtccggctccgacggccattgcctagaaatcgggagcggaacatgggactcttgggtcatgcctcttcaacaacaggctgacatcatctgcaataaggtcaaggaaatggagcagctgagaagcggctacaacatagttggtctgtctcaggggaacttgattggtcgagcagtggttgagtattgtgatgatggaccacctgtcaagaatttcatctctcttggaggtcctcatgctggtactgcttcagtgccgctttgtggttctggtattttttgcattattgtcgatgctctgattaaattggagatctactcagactatgtgcaggaacatcttgcacctagtggttacctcaaaatcccaactgacatggcagattatttgaagagttgcaagtttcttccaaaactgaataatgaaattccagataaaagaaatgctacctacaaggaaaggttcagcagcctagagaatttggtactgatcatgtttcagaatgatgcagttttgatacctcgggaaaccgcgtggtttggttactatcctgatggagcctttgatccagttttaccccctcagaagacaaaactgtatgaggaagactggattggtttgaagacgctggatgaagcagggcgagtaaaattcgtctctgtggcggggggtcaccttggtatctccaaaggtgacatgaagaagtacatcgtcccttacctggcagacaagtcatcggagaagaccctccagtggagcatttctgatctgctaggtgtggcttggcacagcgctagggaagcgctggggctgacagagggcgacagtgccgtgctttactcgccagcattgtgatggatcataatcatattatggtagtccctccctgctcttgtaggtggtgtatatggtggatttgcactctggtgtatggtggatttgccctctggtgcattccgtttcgagtccagtagtttattcatgggatggtggcatgatcactagtgccacgtatgattggagttctgccttgtatacgtgaaacaaacaagtgtatgatgcagcactacaagcagggggctttgggttgtgtaggccaccctgcaagaaaccttgtcatgcttccattcaaaaaaaaaaaaaaaaaaaa

SEQ ID NO: 1790 - protein, 334 aa, Panicum virgatum
  misc_feature: Ceres CLONE 1770082
  misc_feature (2)..(271): Pfam Name: Palm_thioest Pfam Description: Palmitoyl protein thioesterase
MAMQRAAAAVLLPLLAAAARTSALPFIVLHGIGDQCANHGVAQFTKLLAEWSGSDGHCLEIGSGTWDSWVMPLQQQADIICNKVKEMEQLRSGYNIVGLSQGNLIGRAVVEYCDDGPPVKNFISLGGPHAGTASVPLCGSGIFCIIVDALIKLEIYSDYVQEHLAPSGYLKIPTDMADYLKSCKFLPKLNNEIPDKRNATYKERFSSLENLVLIMFQNDAVLIPRETAWFGYYPDGAFDPVLPPQKTKLYEEDWIGLKTLDEAGRVKFVSVAGGHLGISKGDMKKYIVPYLADKSSEKTLQWSISDLLGVAWHSAREALGLTEGDSAVLYSPAL

SEQ ID NO: 1791 - DNA, 1464 bp, Panicum virgatum
  misc_feature: Ceres CLONE 1770091
  misc_feature: Encodes the peptide sequence at SEQ ID NO. 1792
aatggcgaccaggacactatccgtctcctcgctcacctccaccgccttcgcctccttccagcgaccccgcaggcccccatctgctcctcccctcccccgcctcctcggcccgcgcctccgcgcctcccctctctccactgccgccgccgctcccgatggcgatgacgacggcgtcgacaccgtcgagcagctcctcctcccccgcctgccgtccgcgtcagcccccggtgccccgcgcggtcggatcgaccgcctcatgaagctgcagcgccgcgccgacggcgacgcggtccccgggccggcggggcccggggggcggaggaggtggttcccgtacctggacacgttccggcccgcggcggggagcgcggacctgtccagccgggaggtggtcgaggtgctggagccgtacatcctcgaggcgcggcgtgatcgcatccggcgcgccgttgataatcggagctatgctgtttgccttgtggtggagggcctctccgacttcggcaacgtctcggcagcgttccgctccgccgacgcgctcggcgtgcagtctgtgcacgtcatctcctgcgatagcagcaaaaggtatagagacaacaggcatgtgagcatgggtgctgaaaaatggcttgacattgagatatgggattcaccagcagaatgtttcagtgcattaaaaaagcgtggctatcgcattgcaaccacttctttgggaacggattcggtttgtgtgtatgacatggattggtctcaaccaacggctattgttgtgggcaatgagctaaggggtataagtgatgatgctctagagttgtcagacttgcactgtagtgttcctatgaaaggcatggtggactcgtttaatgtatctgttgcagctggaatcctcatgcaccatgctgtttgtgatagagtttcccgcctcggtcatcacggtgatttgttaccagaagaaaatagaatattgcttgctgaattctatctgcgacatagggaaagcacatctaccatacttcatgaatatgccaaaaggaaagcggaaaattttatggccagactttgagagcatcctgaggccgacttatgcataggcgcaggtgatcaacctgaatgatttatttggcaatcagatgttggcttacccggtgcatctttctaacatcaaacaaattggtgggttctttagccataaggtcatttttcctggagagtaccgttgggctacttggtcttcaagagattcaagacagtgactcgcacaggattgccggcaagaatatgacctaaacccaaccattgtgcagagctgttaacagttactagtacgcacccggttttcagtgacgttgatctttgctccccaaatatagacattatgttgtatgctattgttagggttaagcacttgagcatgcatggtatctttccactcggaatctttcacaaaaaaaaaaaaaaaaaaaa

SEQ ID NO: 1792 - protein, 353 aa, Panicum virgatum
  misc_feature: Ceres CLONE 1770091
  misc_feature (1)..(143): Pfam Name: SpoU_methylase Pfam Description: SpoU rRNA Methylase family
MATRTLSVSSLTSTAFASFQRPRRPPSAPPLPRLLGPRLRASPLSTAAAAPDGDDDGVDTVEQLLLPRLPSASAPGAPRGRIDRLMKLQRRADGDAVPGPAGPGGRRRWFPYLDTFRPAAGSADLSSREVVEVLEPYILEARRDRIRRAVDNRSYAVCLVVEGLSDFGNVSAAFRSADALGVQSVHVISCDSSKRYRDNRHVSMGAEKWLDIEIWDSPAECFSALKKRGYRIATTSLGTDSVCVYDMDWSQPTAIVVGNELRGISDDALELSDLHCSVPMKGMVDSFNVSVAAGILMHHAVCDRVSRLGHHGDLLPEENRILLAEFYLRHRESTSTILHEYAKRKAENFMARL

SEQ ID NO: 1793 - DNA, 1588 bp, Panicum virgatum
  misc_feature: Ceres CLONE 1770099
  misc_feature: Encodes the peptide sequence at SEQ ID NO. 1794
gttcattcatagacactgccactcccccgctatagctgcttgctcgccagtcgccatggcggccaccaccatcctcctcgtcctcgtcctcgtcctcgccgctactgcggcctcggccgccgacctctccgtgtaccacaacgtgcacccgccgtccccgtccccgctcgagtccatcatcgcgctcgcgcgcgccgacgacgcgcgcctcctcttcctctcctccaaggccgccgcctcgcccggcgtcacctccgcgcccgtcgcctccggccaggccccgccctcgtacgtcgtccgagccgggctcggcaccccggtgcagcagaccctcctcgcgctcgacaccagcgccgacgccacctgggcgcactgcgccccatgcgacacgtgccccgcgggcagccgcttcatcccggccagctcttcctcgtacgcggcgctcccgtgcacctccgactggtgccccctcttccagggccagccgtgcccggcgaaccaggccgccagcttggcgctgcccgcgtgcgccttctccaagccgttcgccgacgcctccttccaggcgtcgctgggcagcgacacgctgcggctgggcaaggacgccatcgccaacttcgccttcgggtgcgtgggcgcggtgaccgggccgaccacgaacctgccgaagcaggggctcctcggcctcggccgtggccccatgtccctgctgtcccagaccgggagcaggtacaacggcgtcttctcctactgcctcccgagctacaagtcgtactacttctccggctcgctccggctgggcgccgccggccagcccaggaacgtccggtacacgccgctgctgagcaacccgcaccggccgtcgctctactacgtgaacgtgacggggctcagcgtggggcggacgtgggtgaaggtacccgcgggggcgttcgcgttcgacgccaacaccggcgccggcacggtgatcgactccggcacggtgatcacgcggtggacggcgcccgtgtacgcggcgctgcgggaggagttccggcggcaggtgggcgcgccgagcgggtacacgtcgctgggcgcgttcgacacgtgcttcaacacggacgaggtggcggcgggcggcgcgccggccgtgaccctgcacatggacggcggcgtggacctgacgctgccgatggagaacacgctgatccacagcagcgcgacgccgctggcgtgcctggccatggccgaggcgccgcagaacgtcaactccgtcgtcaacgtggtggccaatctgcagcagcagaacgtccgggtcgtcgtcgacgtcgccggctcgcgcgtcggcttcgccagggagccctgcaactgagccccaatccgccgcccgtagccgtgcatgtttccagttccagtgttgtgtgtgtgcaataagggacgtgacgtgacacgaagaagaattggttcgtcacgggtagctagaaagaccaacgtaagaatctgccatgccagagtgtgtatcgctgtcgttttttattattttggttgtttttgttttttgtatggatgtagctgttgcaagagaatagaaaaaaaaaaaaaaaaaaaa

SEQ ID NO: 1794 - protein, 431 aa, Panicum virgatum
  misc_feature: Ceres CLONE 1770099
  misc_feature (1)..(358): Pfam Name: Asp Pfam Description: Eukaryotic aspartyl protease
MAATTILLVLVLVLAATAASAADLSVYHNVHPPSPSPLESIIALARADDARLLFLSSKAAASPGVTSAPVASGQAPPSYVVRAGLGTPVQQTLLALDTSADATWAHCAPCDTCPAGSRFIPASSSSYAALPCTSDWCPLFQGQPCPANQAASLALPACAFSKPFADASFQASLGSDTLRLGKDAIANFAFGCVGAVTGPTTNLPKQGLLGLGRGPMSLLSQTGSRYNGVFSYCLPSYKSYYFSGSLRLGAAGQPRNVRYTPLLSNPHRPSLYYVNVTGLSVGRTWVKVPAGAFAFDANTGAGTVIDSGTVITRWTAPVYAALREEFRRQVGAPSGYTSLGAFDTCFNTDEVAAGGAPAVTLHMDGGVDLTLPMENTLIHSSATPLACLAMAEAPQNVNSVVNVVANLQQQNVRVVVDVAGSRVGFAREPCN

SEQ ID NO: 1795 - DNA, 1755 bp, Panicum virgatum
  misc_feature: Ceres CLONE 1770144
  misc_feature: Encodes the peptide sequence at SEQ ID NO. 1796
ggacgtgtggcagcgccgcgcctctctctcaccaccctccatccctctcccgactcccaacaagcgccaacggaattgggatcgcaacacatcccaccccacacccgccactccccatctccattccgcgccaccgcccttgctccgtcccgcctgcccgtccggatcctctcggcctcggatcgatctcttctctcgtcggttaccaaaatggataaactcaatggttctgctcgtcttatgattgtttcagatcttgaccatacaatggttgatcaccatgatgaggagaacttgtccttgcttaggtttgctgccctgtgggagtccatttactgtcaggattctctacttgtcttttcaactggacgatcgcctactctctacaaggaattgaggaaagagaagcctatgctgaccccagacatcactatcatgtctgtgggcactgagataacatatggcgaggcaatggttcctgatgatggttgggaagaatatctgaataataagtgggacagaaatattgtggtacaggaaactgcaaacttttccaaactgaagcttcagccagagacagaacagcgtccacacaaggtcagctttttggttgacaagaagagtgcccaggaagtgataaaatctgttgcggagaagttggagaaacgtgggttagatgcaaaaattatatatagtggtggccaggaccttgatatattacctcaaggggctgcaaagggccaggcacttgcatatcttcttaagaagctaagctcatgtggaaagccaccaaataatactcttgtttgcggtgattctggtaatgatgcagaattattcagtatccctggtgtacatggtgtcatggtcagcaatgcccaagaggaactgcttcagtggtaccaagaaaatgcgaaggataactctaagataattcatgcaagtgagagatgtgcagctggtattatacaagctattgggcacttcaagctaggacctaacgtttctcctagagatgtggattttccatatgcgaaggatacctcttttaaacctacagatgctgtagtgaagttctatgttctctatgagaaatggcgcagggctgaggttccaaaggctgactcagtagttatacagtacttcaaaaatatcactcatgcaaatggagtcatcatccatccagctgggctcgagtgctctctccatgcatccattgatgcactgggatcatgttatggtgacaaacaagggaaaaagtaccgagcatgggtggacaggctttttatcacacagactggttcagatagctggttggtgagatttgacttgtgggagtcagaaggtgatgtgcgagtgtgctctctatcaagtcttgccttgagtctaaagactgaatcccctgagggctttgtggtaacacacatccacaagacatggctaaacggttactcttcaggggttgagcaggcatctaagctttagaccgatttaccgcctctccgcaaatggaattttcttgaggatagaataatgtatctgcttatctgagaaaatcttattttcatgtttataatgttaacttcttaaccgcactggaggatgtccagggagaggatatggtgccctacttgtttggtatgtaagataaatgctccatctcatgacttccatgagaagccgaagtgattcatctttggtatatatacacacacactaatcttgatgaataatgaagtgctattttagcaattt

SEQ ID NO: 1796 - protein, 424 aa, Panicum virgatum
  misc_feature: Ceres CLONE 1770144
  misc_feature (1)..(254): Pfam Name: S6PP Pfam Description: Sucrose-6F-phosphate phosphohydrolase
  misc_feature (1)..(63): Pfam Name: Hydrolase_3 Pfam Description: haloacid dehalogenase-like hydrolase
MDKLNGSARLMIVSDLDHTMVDHHDEENLSLLRFAALWESIYCQDSLLVFSTGRSPTLYKELRKEKPMLTPDITIMSVGTEITYGEAMVPDDGWEEYLNNKWDRNIVVQETANFSKLKLQPETEQRPHKVSFLVDKKSAQEVIKSVAEKLEKRGLDAKIIYSGGQDLDILPQGAAKGQALAYLLKKLSSCGKPPNNTLVCGDSGNDAELFSIPGVHGVMVSNAQEELLQWYQENAKDNSKIIHASERCAAGIIQAIGHFKLGPNVSPRDVDFPYAKDTSFKPTDAVVKFYVLYEKWRRAEVPKADSVVIQYFKNITHANGVIIHPAGLECSLHASIDALGSCYGDKQGKKYRAWVDRLFITQTGSDSWLVRFDLWESEGDVRVCSLSSLALSLKTESPEGFVVTHIHKTWLNGYSSGVEQASKL

SEQ ID NO: 1797 - DNA, 2097 bp, Panicum virgatum
  misc_feature: Ceres CLONE 1770145
  misc_feature: Encodes the peptide sequence at SEQ ID NO. 1798
acccaccttgcttcgcccacggcatattcccccacaagccacaacccctcaaaccaaaccagatcagtgagacgaactctgctttccgatccgggacacatggcggcggcggcggcgacgtccaacggcggcgcggcggcggcagcgaacggtccgtcgcccgggcggctggcctccgtgtacagcgaggtgcagacgagccgccttctgcacgcgctgcccctcccctccgtcctccgctccgacttctccgtcgtcgacgggcccgccagctccgccgcggggaaccccgatgagatcgccaagctcttccccaacctcttcggccagccttcggcgttgctggtgccgtcggccgagcccgcggcgacaaggccgctcaaggtcggcgtcgtgctctccggtggacaggctccgggcgggcacaatgtgatctgcggcatcttcgattacctgcaggagcgtgctaaaggcagcactatgtatggattcaagggaggtccagctgggatcatgaagtgcaagtacgtggagctcaattctgactttgtatacccatacagaaaccagggaggatttgatatgatctgcagtggaagggacaaaattgaaacgccagagcagttcaagcaagctgaagacacagccaacaagcttgatttggacggacttgttgtcattggtggtgatgattcaaacaccaatgcctgcctccttgcagaatattttaggccaaaaaacatgaagactcgtgtcattggctgcccaaagactattgatggagatctgaaatgtaaggaggttcccataagctttggatttgacactgcttgcaagatatactctgaaatgatcggcaatgtcatgactgatgcaaggtcaactggaaaatactaccactttgtgaggcttatgggacgtgctgcttctcacattacattggagtgcgctttgcaaacacatcctaatgctgcactcattggtgaagaggttgctgcaaagaagcaaactctcaagaatgtcacagactaccttaccgatatcatctgcaagcgtgcagatcttggttacaactatggtgttatccttataccagagggcctgattgatttcattccagaggttcaaaaactcattgcggaattgaatgaaattttggcacatgatgttgttgatgaggcaggggcttggaaaagcaagcttgagccagaatccaggcagctgtttgactttttgcccaaaactattcaggagcaacttttgcttgaaagggatcctcatggcaatgttcaggttgcaaaaattgaaaccgagaaaatgcttattaccatggttgaaactgaattggagaagagaaaagctgaggggagataccatgcaagcttcagaggacaatctcacttctttggatatgaaggaagatgcggtcttcctacaaattttgattctagctattgttatgcattgggctatggatctggtgcccttctccaaagtgggaagacaggacttattacctcggttggcaacctcgctgctcctgttgaaaaatggactgttggtggaactgctttgacttcattgatggatgttgagaggaggcatggcaagttcaagccagtgattaagaaggccatggtggaacttgatggtgcacctttcaagaagtttgcatcaatgcgagatgagtgggccatcaagaacagatacatcagccctggccccatccagttcagcggacctggaagcgatgactcgaaccacactttgatgctggaactcggcgcacaggcttagagatgcgtcgacgtggcctgcgcctttaattcttttcgttcttacagttttggaagcggagactggaactcctctagagcagcctgcagtctccatgttgtgaaatgtcaaaaaataagagattttaccggtgtttgctgcgttaggcggatggatgtggtactaataaggactggttttagtttttgtacgtttcggttgcccccacttacaaacttgcctttggctctgattattactcttcggctgcaaccagccaacagtatttttttcccacactaaaaaaaaaaaaaaaaaaaa

SEQ ID NO: 1798 - protein, 565 aa, Panicum virgatum
  misc_feature: Ceres CLONE 1770145
  misc_feature (1)..(283): Pfam Name: PFK Pfam Description: Phosphofructokinase
  misc_feature (19)..(565): SWISSPROT Homolog: EC 2.7.1.90 Pyrophosphate- -fructose 6-phosphate 1-phosphotransferase subunit beta
  misc_feature (23)..(565): SWISSPROT Homolog: EC 2.7.1.90 Pyrophosphate- -fructose 6-phosphate 1-phosphotransferase subunit beta
MAAAAATSNGGAAAAANGPSPGRLASVYSEVQTSRLLHALPLPSVLRSDFSVVDGPASSAAGNPDEIAKLFPNLFGQPSALLVPSAEPAATRPLKVGVVLSGGQAPGGHNVICGIFDYLQERAKGSTMYGFKGGPAGIMKCKYVELNSDFVYPYRNQGGFDMICSGRDKIETPEQFKQAEDTANKLDLDGLVVIGGDDSNTNACLLAEYFRPKNMKTRVIGCPKTIDGDLKCKEVPISFGFDTACKIYSEMIGNVMTDARSTGKYYHFVRLMGRAASHITLECALQTHPNAALIGEEVAAKKQTLKNVTDYLTDIICKRADLGYNYGVILIPEGLIDFIPEVQKLIAELNEILAHDVVDEAGAWKSKLEPESRQLFDFLPKTIQEQLLLERDPHGNVQVAKIETEKMLITMVETELEKRKAEGRYHASFRGQSHFFGYEGRCGLPTNFDSSYCYALGYGSGALLQSGKTGLITSVGNLAAPVEKWTVGGTALTSLMDVERRHGKFKPVIKKAMVELDGAPFKKFASMRDEWAIKNRYISPGPIQFSGPGSDDSNHTLMLELGAQA

SEQ ID NO: 1799 - DNA, 1869 bp, Panicum virgatum
  misc_feature: Ceres CLONE 1770147
  misc_feature: Encodes the peptide sequence at SEQ ID NO. 1800
aaatcaaatcaagcagaacagagcacagccacacaccccacctaataccaacccggaggtcagagaggagggagggaggagctgagcgcctacgccgggcgatggacctcgtcctcctggagaaggcccttctgggcctgttcgcggcggcggtgctggccctcgccgtggcgaagctgacggggaagcggctccgcctgccccccggccccgccggcgcccccgtggtgggcaactggctgcaggtcggcgacgacctgaaccaccgcaacctgatggacctggcgaagcggttcggcgacatcttcctcctccgcatgggcgtgcgcaacctggtggtggtgtccacgcccgagctcgccaaggaggtgctccacacgcagggcgtggagttcggctcccgcacccgcaacgtcgtcttcgacatcttcaccggcaagggccaggacatggtgttcaccgtctacggcgaccactggcgcaagatgcggcgcatcatgaccgtccccttcttcaccaacaaggtggtggtgcagaaccgcgccgggtgggaggaggaggcccgcctcgtggtggaggacgtgcggagggaccccagggccgccgccgagggcgtcgtcatccgcaaacgcctccagctcatgatgtacaacgacatgttccgcatcatgttcgaccgccgcttcgagagcgagcaggactcgctcttcaacaagctcaaggcgctcaacgccgagcgcagccgcctctcccagagcttcgagtacaactacggcgacttcatccccgtcctccgccccttcctccgcggctacctcaaccgatgccacgacctcaagacccggcgcatgaaggtcttcgaggacaacttcgtccaggagcgcaagaaggtgatggcgcagactggcgagatccggtgcgccatggaccacatcctcgaggccgagaggaagggcgagatcaaccacgacaacgtcctctacatcgttgagaacatcaacgtggcagcgatcgagactaccttgtggtcgatcgagtggggcatcgctgagctggtgaaccacccaacgatccagtccaagctccgggaggagatcacctccgtgttgggtgccggcgtggcggtgacggagccggacctggagcgcctgccctacctgcaggccgtggtcaaggagaccctccgcctccgcatggccatcccgctgctggtcccgcacatgaacctcaacgacggcaagctccacggctacgacatccccgccgagtctaagatcctcgtcaacgcgtggttcctcgccaacgaccccaagcggtgggtgaagcccgaggaattccgccccgagaggttcctggaggaggagaaggccgtggaggcccacggcaacgacttccggttcgtgcccttcggcgtcggccggcggagctgccccgggatcatcctcgcgctgcccatcatcggcatcacgctgggcaggctggtacagaacttccagctgctgccgccgccggggcaggacaaggtcgacaccaccgagaagcccgggcagttcagcaaccagatcgccaagcacgccaccattgtctgcaagccgctcgaggcctagagtcccggaaacgcgcgttccagagcagaggccatcgaacaagcactatgtattttggttcttttatttttcttgtgttttttgtactaagaggatacgcatattcttgttcgtgttgggtgttgagtgatgcggggggggggggggggggtatgtggctgaggtacgtgaggtgttgtagattcacttggttatgttctcgcaaacttatccataatttatagtgctttaaacttgaattcaaaaaaaaaaaaaaaaaaaa

SEQ ID NO: 1800 - protein, 501 aa, Panicum virgatum
  misc_feature: Ceres CLONE 1770147
  misc_feature: Great-hit functional homolog of the protein sequence given in SEQ ID NO 9479
  misc_feature: Great-hit functional homolog of the protein sequence given in SEQ ID NO 9568
  misc_feature: Great-hit functional homolog of the protein sequence given in SEQ ID NO 9723
  misc_feature (1)..(498): SWISSPROT Homolog: EC 1.14.13.11 Trans-cinnamate 4-monooxygenase
  misc_feature: Useful for biocontainment applications
  misc_feature: Useful for making plants with altered Lignin content
  misc_feature: Useful for making plants with altered cell wall content and/or composition
  misc_feature: Useful for making plants with modulated biomass
  misc_feature: Useful for making plants with modulated flowering time
  misc_feature: The plant flowers significantly earllier than wild-type.
  misc_feature: The plant flowers significantly late compared to wild-type.
  misc_feature: The plant is abnormally small.
  misc_feature: The plant produces a reduced number of seeds.
  misc_feature: The plants are small.
MDLVLLEKALLGLFAAAVLALAVAKLTGKRLRLPPGPAGAPVVGNWLQVGDDLNHRNLMDLAKRFGDIFLLRMGVRNLVVVSTPELAKEVLHTQGVEFGSRTRNVVFDIFTGKGQDMVFTVYGDHWRKMRRIMTVPFFTNKVVVQNRAGWEEEARLVVEDVRRDPRAAAEGVVIRKRLQLMMYNDMFRIMFDRRFESEQDSLFNKLKALNAERSRLSQSFEYNYGDFIPVLRPFLRGYLNRCHDLKTRRMKVFEDNFVQERKKVMAQTGEIRCAMDHILEAERKGEINHDNVLYIVENINVAAIETTLWSIEWGIAELVNHPTIQSKLREEITSVLGAGVAVTEPDLERLPYLQAVVKETLRLRMAIPLLVPHMNLNDGKLHGYDIPAESKILVNAWFLANDPKRWVKPEEFRPERFLEEEKAVEAHGNDFRFVPFGVGRRSCPGIILALPIIGITLGRLVQNFQLLPPPGQDKVDTTEKPGQFSNQIAKHATIVCKPLEA

SEQ ID NO: 1801 - DNA, 1569 bp, Panicum virgatum
  misc_feature: Ceres CLONE 1770156
  misc_feature: Encodes the peptide sequence at SEQ ID NO. 1802
gcacccaagcaacacatcagagcacaaagactagggcaagaaagatacagagtgagtgagcaagagagaccagagaatggccgctgattctcggaccatcatagctcccactgatgctgagctgctgcaggcacaagccgacctatggcgccacagcctctactacctcacatccatggcgctcaagtgcgccgtcgagcttcacattccaactgctatccataaactcggaggggctgcctcgctgccagacttggtaaccgcactgtcccttcctcagactaagcttccattcctgcgccgcttgatgcggctgctcgtcacatcaggcatctttgcatctgaaagtggtgctgaggtggagacgtaccgcctcaatccactctcctggctccttgtagaaggtgtggaagcagaaaaccacacctaccagaaatactttgtgctcgccacagtctcgaggcattatcttgaggctgcatcgtctctagctgactggttcaagaaggatttgcctgtgccaacaccatcgccattcgaggaacagcatggtgtgccacttgtccatgagaaaacaaagctccttgacgaagagctagacaggattgtcaatgaaggtgtggctgcacatgacaacttggcaattggaaccattattcgggagtgcggtgacattttcaggggtgttcaatcactgactgattgcggtggtggtgatggcaccactgtgaggggaatcatcaaggcgttccctcacatcaagtgtactgtgctggaccttccaaaggttattgagaatgcaccacctcatgattctgttacctatgtcgcgggtgacatgttccactccatcccacctgctcaagctgtgatgataaagcttctactgcacttctttagcgatgaggattgtgtaaagatcctggagcagtgcaagaaggcaattccttcaaaagaagagggagggaaagtgattattatagaaatagtcgttgacccttctctagggccaataatgtatgaagcccaactcctgatggacttgctcatgatggtgaatatcagaggcaggcagcgagatgaaaatgattggcgtgagatctttatgaaagccggcttctcagactataagattgttaagaaaataggagctcgtggtgtcatcgaagtttacccgtaaattatgcccaatgtgtggttcagtatttaatggtccatgagctgcagtgaggatataaataaacgtagtgcctcatttcctatatgctgtggggacataaataaacggagcgcctcatttccaagataaagtttgatgggatctgaaagcagatgagctgaccagctttctggcctttagatccacatgtagctgctgtttgcaatgtactagagcactctttgtggttggtttccagcagtcaagtatgtatgttggtttgactttgatcatatatatattggattgttgtttgttgatatgtatgttatgtacaaccacgacaagttatgcaatgtgtaatttatcattatatatatcactacatagcaaaaaaaaaaaaaaaaaaa

SEQ ID NO: 1802 - protein, 367 aa, Panicum virgatum
  misc_feature: Ceres CLONE 1770156
  misc_feature (1)..(260): Pfam Name: Methyltransf_2 Pfam Description: O-methyltransferase
MAADSRTIIAPTDAELLQAQADLWRHSLYYLTSMALKCAVELHIPTAIHKLGGAASLPDLVTALSLPQTKLPFLRRLMRLLVTSGIFASESGAEVETYRLNPLSWLLVEGVEAENHTYQKYFVLATVSRHYLEAASSLADWFKKDLPVPTPSPFEEQHGVPLVHEKTKLLDEELDRIVNEGVAAHDNLAIGTIIRECGDIFRGVQSLTDCGGGDGTTVRGIIKAFPHIKCTVLDLPKVIENAPPHDSVTYVAGDMFHSIPPAQAVMIKLLLHFFSDEDCVKILEQCKKAIPSKEEGGKVIIIEIVVDPSLGPIMYEAQLLMDLLMMVNIRGRQRDENDWREIFMKAGFSDYKIVKKIGARGVIEVYP

SEQ ID NO: 1803 - DNA, 2973 bp, Panicum virgatum
  misc_feature: Ceres CLONE 1770179
  misc_feature: Encodes the peptide sequence at SEQ ID NO. 1804
acatccgcttgcccgaagtccccaacacttcgtcagattcgaactcggcagctcgccttaaaatactcgccactagcagggggaggcgcgcccgagcagcacgaagtcgacgccgtcccacccacatcccagtcctacgaggcgccccgctctcgggatttccagcgggccgcgtcgcgttaccggcggggtgcgccgccgtgccgggtacaaatggtggcggaggaggccagtcactgcagccgtcgccgcagctgaatcccccccgggaactgctcgcgggcgtttagttgactcgtcaatttattgagatattcgacttgcatgagctgattaaaaagccccattccctggttcacgatggagccatcttgcttgcgataccatgtcagtggttttggttctcgcatgatatggctatgctttttgctagtactcgttcttcagagttgcagcccggcactttcagattcaccatatttggttggtatgggaagctacgacataactggtcctgctgcagacgttaacatgatgggatatgcaaatgctgaacagatcgcatcaggaattcatttcaggctaaaggctcgtgcattcattgttgctgagcctaatgggaagcgtgttgtgtttgtgaatctggatgcttgcatggcatcgcagcttgttactataaaggtgcttgaaaggcttaaggcaaggtatggagatctttataatgagaacaatgtggctatcagtggaatccatacacatgcggggcctggtggttatctgcaatatgtagtttatattgtcacatctcttgggtttgttcgccaatcatttgatgtaattgtcaatggcattgagcagtgtattgttgaagctcacaacaacctccaccctgggaaaatctatgtgaataaaggtgacctccttgatgctggtgtgaatcgcagcccaagtgcatatctaaataaccctgctgaggagagaagcaagtatcagtataatgttgacaaagaaatgacccttatcaagtttgtagatgatgaactgggtccagttgggagtttcaattggtttgcaacgcatggaacatcaatgagtcgtacaaattcattgataagtggtgataacaaaggagcagctgcacgttttatggaagattgggcagaacaaaatggtatgccaaagcagggggctcatgtaactaaagatggtttagaatatttacacaagatatctggacttccgagaagagtttcttcaataattcctgaaccaaatgagataactgatgacttagtacagttggcatcatcctatgaggcctcaggtggcaggcgattatcaggttcaagtatcaccaggcgcattagaagcagtcaacaaaacaaacctaaatttgtttctgcattctgccagtcaaactgtggagatgttagtccaaatgtcctgggaacattttgtatagacactggtcttccctgtgacttcaatcatagtacatgtaatgggaagaatgaactatgctacggacgaggcccaggatatcctgatgaatttgaaagtacccgtatcattggcaataggcaatttctcaaggctttagatctttttaattcagcttctgaagaaatacaaggcagagttgactataggcatacttacctagatttctcgcaacttgaagttaatgttccttcaagtacaggaggagagcaggtggtgaaaacatgtcctgcagccatggggtttgcctttgctgctggaaccacagatggccctggagcttttgattttgaacaaggagatgtcaagggaaaccctttctggaggttagtaagaaacttacttaagacgccagggaaggagcaagttgaatgccaagctccaaaaccaatattgctagacaccggcgaaatgaaggaaccatatgactgggcaccttcgatacttccaattcagatcataagaatcggacagatggttatcttgtgtgtccctggagaattcacaacgatggctggcaggcggctaagagatgctgtcaaagaagtactaacaagtgatagtagtggtgaatttaatgatattcatgttgttcttgctgggctaacaaatacctattctcaatatatcacaacttttgaagaatatcagatccaaagatatgagggagcatcgacattgtatggccctcacaccttgagtgcctacatccaggagtttcagaaacttgctacagccatggttgcaaacaaagaggtcccaacaaatttccaacctccagatatgttggacaagcaaattggactgctcccaggcgtcatgtttgattcgacacctcctggtgtgaagtttggagatgtcagctctgatgttcctgcaagctcaaccttcgggaagggcagtacagtgaatgctacattctattcagcctgcccaaggaatgaccttctcactgacggtacatttgcgcttgttgagaagctagatggtagcaacaattgggttcctgcctatgacgatgatgactggtcgctgcgtttcaagtggtcaaggcctgcaaaacttagtccaaggagtttcgccacgctggaatggacaattcctgaagatgccccatctggtgtttacagattgaggcattttggtgcctccaagccgttgttggggtcgatcaaacattttacagggacctctcgcgcattcgcagtgcgttagatggtggtacaccgttgccttggacagtacagctatccgagtttacaccagtgaatttttcatactgaaatggttatcacagtatctagtatgttggtccgtgttttttttacatatgtttgatggcaacagcattgtcagattatgccgaactgcttgtatcttgtacgcatctttcccatgggaatgtgtagcttgtacataactacaaactcgatatatatctgaagttcatgcgaaaaaaaaaaaaaaaaaaaa

SEQ ID NO: 1804 - protein, 784 aa, Panicum virgatum
  misc_feature: Ceres CLONE 1770179
  misc_feature (18)..(690): Pfam Name: Ceramidase_alk Pfam Description: Neutral/alkaline non-lysosomal ceramidase
  misc_feature (19)..(783): SWISSPROT Homolog: EC 3.5.1.23 Neutral ceramidase precursor
MEPSCLRYHVSGFGSRMIWLCFLLVLVLQSCSPALSDSPYLVGMGSYDITGPAADVNMMGYANAEQIASGIHFRLKARAFIVAEPNGKRVVFVNLDACMASQLVTIKVLERLKARYGDLYNENNVAISGIHTHAGPGGYLQYVVYIVTSLGFVRQSFDVIVNGIEQCIVEAHNNLHPGKIYVNKGDLLDAGVNRSPSAYLNNPAEERSKYQYNVDKEMTLIKFVDDELGPVGSFNWFATHGTSMSRTNSLISGDNKGAAARFMEDWAEQNGMPKQGAHVTKDGLEYLHKISGLPRRVSSIIPEPNEITDDLVQLASSYEASGGRRLSGSSITRRIRSSQQNKPKFVSAFCQSNCGDVSPNVLGTFCIDTGLPCDFNHSTCNGKNELCYGRGPGYPDEFESTRIIGNRQFLKALDLFNSASEEIQGRVDYRHTYLDFSQLEVNVPSSTGGEQVVKTCPAAMGFAFAAGTTDGPGAFDFEQGDVKGNPFWRLVRNLLKTPGKEQVECQAPKPILLDTGEMKEPYDWAPSILPIQIIRIGQMVILCVPGEFTTMAGRRLRDAVKEVLTSDSSGEFNDIHVVLAGLTNTYSQYITTFEEYQIQRYEGASTLYGPHTLSAYIQEFQKLATAMVANKEVPTNFQPPDMLDKQIGLLPGVMFDSTPPGVKFGDVSSDVPASSTFGKGSTVNATFYSACPRNDLLTDGTFALVEKLDGSNNWVPAYDDDDWSLRFKWSRPAKLSPRSFATLEWTIPEDAPSGVYRLRHFGASKPLLGSIKHFTGTSRAFAVR

SEQ ID NO: 1805 - DNA, 2267 bp, Panicum virgatum
  misc_feature: Ceres CLONE 1770182
  misc_feature: Encodes the peptide sequence at SEQ ID NO. 1806
acctcgcggactcttccccccaaaactaaaccctctctggcgccgtcgacgcggcggatgtgcgtgagcccgtgaggcgaaccgtgcgaggggccaaccaccaccgccgccgcctcctgctgcgacgacgatggcgtccatctccggcgcggcggcgccgccctcgtccgccgcgtgccgcctgcggctgcggcggcacctcctgctccgcccctccgacctccgcctccgcgcgccccactccatcgccgacctctcccgctcctccaactcctcgaactccgccccgaccccggccgagccgctgggctccgcggcggcggcgaacggcagcggcggccgccgcgcggtggagaaggacccgatcaagctgtgggagcgctacgtcgagtggctctaccagcacaaggagctcggcctcttcgtcgacgtcagccgggtggggttcacggaggagttccttcagcagatggagccgcggatgcagcgcgccttcgccgacatgcgggagctcgagaagggcgccatcgccaaccccgacgagggccgcatggtggggcactactggctccgcgacccgtccctcgcacccaactccttcctccgcaacaagatcgagaccgcgctcgacagcgtcctcgccttctcccaagacatcgtctccggcaagattcaatcaccatctggtcgtttcacatcaatcctttctattggaattggagggtcagctttgggccctcaatttgtcgctgaggcacttgcacctgataaccctccattgaagataaggtttattgacaacaccgatcctgctgggattgatcatcaaattgctcaactaggacctgagctagcgactactcttgtaattgtcatttctaagagtggaggcacacctgaaacccgcaatggtctactggaagtacagaaagccttccgagatgcggggctggaattttcgaaacagggtgttgcaattactcaagaaaattctctgctggataacactgccagaatagagggatggttagctcgatttcctatgtttgactgggtcggtggcagaacttcggaaatgtcagctgtgggtttacttccagctgcattgcagggtattgatatcaaggaaatgctggttggcgcggctttaatggatgagcaaaccagggacactgtggttaaagaaaatccagcagcattgcttgcattatgttggtactgggcatcagaagggataggcaaaaaggatatggttgtgcttccttacaaagatagtttgctacttctgagtagatatttgcaacaacttgtcatggaatctcttgggaaagaattcgacctagatggcaacagggttaatcaagggctgactgtatatggcaacaaaggaagcactgaccagcacgcttacattcagcagctgagagatggtgtgcacaacttcttcgttacttttgttgaggtcttgcgtgacaggcctcctggtcatgattgggagcttgaacctggagtcacatgtggtgactatttgtttgggatgttacagggaacccgttctgctctttatgcaaatgaccgggaatccatctctgttactgttcaagaagtaactcctagaactgtcggagcactgattgctctttatgaacgtgctgtggggatttatgcttctttggtaaatataaacgcttatcaccagcctggtgttgaggctgggaaaaaggcagctggagaagtactggcacttcagaaaagggtgctgactgtattaaatgaggccgcttgcaaggaccctgctgagccattgaccctggatgaaattgcagatcgctgtcactgcccagaagatatcgagatgatctacaaaataatccagcacatggctgcgaatgacagagcgcttatagcagaaggcagctgtggttctcctcgcagcgtcaaggtgtatcttggagaatgcaatgtagatgaagacatgcaggctgcatagattcggggcagtcggaattggtgtaaaattgtgttggaataaaaagagcagcgccatggtgtggccatgcgtgcgtgttcctgatgtgccatcacccatttgtttcttgtttgaatgtggcacggttgctgcaacgatgtatcttttattccccttgggtctccctttgcatacaaaatacaaagggatgaagaaagatagctgcatcactcacgctcgtttaaacgcatcttcaattcgaatatgcttttggcatcaaaaaaaaaaaaaaaaaaaa

SEQ ID NO: 1806 - protein, 619 aa, Panicum virgatum
  misc_feature: Ceres CLONE 1770182
  misc_feature: Great-hit functional homolog of the protein sequence given in SEQ ID NO 9512
  misc_feature (1)..(450): Pfam Name: PGI Pfam Description: Phosphoglucose isomerase
  misc_feature (77)..(604): SWISSPROT Homolog: EC 5.3.1.9 Glucose-6-phosphate isomerase
  misc_feature (77)..(607): SWISSPROT Homolog: EC 5.3.1.9 Glucose-6-phosphate isomerase
  misc_feature: Useful for making plants with modulated flowering time
MASISGAAAPPSSAACRLRLRRHLLLRPSDLRLRAPHSIADLSRSSNSSNSAPTPAEPLGSAAAANGSGGRRAVEKDPIKLWERYVEWLYQHKELGLFVDVSRVGFTEEFLQQMEPRMQRAFADMRELEKGAIANPDEGRMVGHYWLRDPSLAPNSFLRNKIETALDSVLAFSQDIVSGKIQSPSGRFTSILSIGIGGSALGPQFVAEALAPDNPPLKIRFIDNTDPAGIDHQIAQLGPELATTLVIVISKSGGTPETRNGLLEVQKAFRDAGLEFSKQGVAITQENSLLDNTARIEGWLARFPMFDWVGGRTSEMSAVGLLPAALQGIDIKEMLVGAALMDEQTRDTVVKENPAALLALCWYWASEGIGKKDMVVLPYKDSLLLLSRYLQQLVMESLGKEFDLDGNRVNQGLTVYGNKGSTDQHAYIQQLRDGVHNFFVTFVEVLRDRPPGHDWELEPGVTCGDYLFGMLQGTRSALYANDRESISVTVQEVTPRTVGALIALYERAVGIYASLVNINAYHQPGVEAGKKAAGEVLALQKRVLTVLNEAACKDPAEPLTLDEIADRCHCPEDIEMIYKIIQHMAANDRALIAEGSCGSPRSVKVYLGECNVDEDMQAA

SEQ ID NO: 1807 - DNA, 1638 bp, Panicum virgatum
  misc_feature: Ceres CLONE 1770185
  misc_feature: Encodes the peptide sequence at SEQ ID NO. 1808
gcactgttcactgggagtggcgagatcacggggagtcggcagagtggggggagcagcgagtgtgagaacaaagccacccacccaccttcatggagtcgcctgtcgccgtggtggcggtgccgttcccggcgcagggccacctgaaccagctgctgcacctgtcgctgcacctcgcctcgcgcggcctgcccgtgcacttcgcggcgcccgcggagcacgtccgccaggccaaggcgcgcctccacggctggggcgccgacgccctccgcggcatccagttccacgagctcgccatctccgactacgaatccctgccccccgaccccgctgcggactcgccctacccctcccacctcctgcccctcttcgaggcgttcgtcgccgacgcgcctgccgcgctcgcggccctcctccgcgggatctccgcctcccaccgccgcgtcgtcgtcctctacgacgtcatcaccgccttcgccgcggaggaggccgcgctgctgcccaacggcgaggggttcgcgttccactgcaccgccgcgtcaatcctcgccaaggggttggattacgatggaaggttggggttccagcagcgaatgaccgattcgcacggcttcgccgacatcccagccccgggcttcgtgccgaacaagtatctggagttcgtcggcaagcacgccagatgccaccaaacgatcccgtccagcgccggcgtcatcatgaacacgtcccgcgcgctagagggtgagttcatcgacttcgtgacccagctgctcggcgccgccggcaagaaggtcttctcgatcgggccgctgaacccggtggtggacgcgaacgcgtccgagcaggtagcaaagcggcacgggtgccttgactggctcgacaagcagccggccgcatccgtgctctacgtgtcgttcggctcggtatcctcgctgcgcggagagcagatcgaggagctcgcggcggcgctgcgcgacagcaagcagcggttcatctgggttctgcgcgacgccgaccgcggcaacgtgttcgcggactccggcgagagccggcacgccaagttcatgtccgagttcaccaagcagacggagggaacagggctgctgatcaccgactgggcgccgcagctggagatccttgcccaccccgccacggcggcgttcctgagccactgcggctggaactccaccatggagagcatgagctacgggaagcccatcctggcgtggcccatgcactcggaccaggcgtgggacgccgagctggtgtgcaagtacctcaagaccggcttcctggtgaggccatgtgagaagcacgccgaggtgattccggcggcagacatacgggaggtgatcgagaagattttagtctccgaggaagggctcgcggtgcggcagcgtgcagtagcgctcggcgaggctgtccgcgcgtccgtggctacgggcgggtcatcccaaaaggaactcgaggacttcgttgctcacatcacaaggtaagaggtccaagaatggcaggaacgtttggtgtatcactttgaatttcaattctatttctttcctgaaaagaagctggagagtgttctgtacaagtggtaactagaaaataaacgattgtaccaaataaaaaaaaaaaaaaaaaaaa

SEQ ID NO: 1808 - protein, 467 aa, Panicum virgatum
  misc_feature: Ceres CLONE 1770185
  misc_feature (2)..(137): Pfam Name: UDPGT Pfam Description: UDP-glucoronosyl and UDP-glucosyl transferase
  misc_feature (1)..(467): SWISSPROT Homolog: EC 2.4.1.215 Cis-zeatin O-glucosyltransferase 1
  misc_feature (1)..(467): SWISSPROT Homolog: EC 2.4.1.215 Cis-zeatin O-glucosyltransferase 2
MESPVAVVAVPFPAQGHLNQLLHLSLHLASRGLPVHFAAPAEHVRQAKARLHGWGADALRGIQFHELAISDYESLPPDPAADSPYPSHLLPLFEAFVADAPAALAALLRGISASHRRVVVLYDVITAFAAEEAALLPNGEGFAFHCTAASILAKGLDYDGRLGFQQRMTDSHGFADIPAPGFVPNKYLEFVGKHARCHQTIPSSAGVIMNTSRALEGEFIDFVTQLLGAAGKKVFSIGPLNPVVDANASEQVAKRHGCLDWLDKQPAASVLYVSFGSVSSLRGEQIEELAAALRDSKQRFIWVLRDADRGNVFADSGESRHAKFMSEFTKQTEGTGLLITDWAPQLEILAHPATAAFLSHCGWNSTMESMSYGKPILAWPMHSDQAWDAELVCKYLKTGFLVRPCEKHAEVIPAADIREVIEKILVSEEGLAVRQRAVALGEAVRASVATGGSSQKELEDFVAHITR

SEQ ID NO: 1809 - DNA, 2040 bp, Panicum virgatum
  misc_feature: Ceres CLONE 1770209
  misc_feature: Encodes the peptide sequence at SEQ ID NO. 1810
attcccagctcggaagccttcagccgaaagccaccggccgagcggctcgatctcgggttccagctagcgctgcgcgaacgccgaagcacagcgacgctcgccatggcgtcgtcgtctccgtcgtcccggctgctcttcttcctctcgtgcctcgcgctcgcgctgctcgccggcgccgaagtgcaccaccatgagttcgttgtccaagagacgccggtgaagaggctgtgcaacacgcacaacatcatcacggtgaacgggcagttcccggggccgacgctggaggtcagggagggcgacacgctcgtcgtcaacgtcgtcaaccgggcgcagtacaacgtcaccatccactggcacggcatccggcagatcaggacggggtgggcggacgggccggagttcgtgacgcagtgccccatcaggcccggcggcagctacaagtaccggttcaccatccaggggcaggagggcacgctgtggtggcacgcgcacagctcctggctcagggccaccgtctacggcgcgctcatcatccgccccagggagaacaaggcctaccccttcggcaagccctcgcgtgaagtccccgtcatcctcggcgagtggtggaacgcgaacccgatcgatgtcatccgggaggcgcagaggacgggcggcggacccaacgtctccgacgcgttcaccatcaacggccagcccggtgacttctacaactgctcccaggaagagaccaccgccattccggtgaagcccggagagacggcgcttctgcggttcatcaacgccgcgctcaaccacgagctcttcgtcagcatcgcgcagcacaagatgacggtggtcgccgccgacgcgtcctacaccaagcccttcaccacctcggtgctcatgatcgcgccgggccagaccaccgacgtcctcgtcaccatggaccaggcgcccacccggtactacgtcgccgcgcgcgcctacgtctccggccagaacgtggccttcgacaacaccaccaccaccgccgtcatcgagtacgactgcggctgcgcctccgacttcggccccaagatccagccggcgttcccggccctcccggccttcaacgacaccgccgccgccgccgccttcgccgcggggatcaagagccccggcaaggtcaaggtccacgaggacgtcgacgagtacctcttcttcaccgtcggcctcggcctcttcaactgcgagcccggccagctctgcgccgggcccaacaacaacacccgcttcacggccagcatgaacaacgtctccttcgtcttcccgcagcacgactcgctcctccacgcgcactactacaagatccccggcgtcttcaccaccgacttcccggcctacccgccggtgcagttcgactacacggccaagaacgtgagccgggccctgtggcagccggtcccggggaccaagctgtacccgctcaggttcggctccgtcgtgcagctcgtcctgcaggacaccagcatcgtcacgccggagaaccaccccatccacatccacggctacgatttcttcatcctcgccgaggggtgcggcaacttcgaccccaagaaggacgtcgagaagttcaactacgtcgacccgccgcagcggaacaccgtggccgtgccggtgaacggctgggcggtcatccagttcgtcgccgacaacccgggggtgtggctcatgcactgccatctcgacgtgcacatcacctggggcctggccatggcgttcctggtggaggatgggtatggcaaactgcagtccctggagccgcccccaattgaccttccgatgtgctaatgaccaggagaagataccgttaccttgttgaggaattggaaggctgttcacgttgtatgttaattgttacttttttggggtcatttgtgatcttcaattctaggggagatgattttccagcttgttttgaactttttcccctgtaaatctgtgtaagtatcgatgacattctgcatattgttcgggaataaaattctttctttgcaccaaaaaaaaaaaaaaaaaaaa

SEQ ID NO: 1810 - protein, 569 aa, Panicum virgatum
  misc_feature: Ceres CLONE 1770209
  misc_feature: Great-hit functional homolog of the protein sequence encoded by LOCUS At5g05390
  misc_feature (1)..(153): Pfam Name: Cu-oxidase Pfam Description: Multicopper oxidase
  misc_feature (1)..(137): Pfam Name: Cu-oxidase_2 Pfam Description: Multicopper oxidase
  misc_feature (1)..(117): Pfam Name: Cu-oxidase_3 Pfam Description: Multicopper oxidase
  misc_feature (10)..(569): SWISSPROT Homolog: EC 1.10.3.2 Laccase-5 precursor
  misc_feature (8)..(569): SWISSPROT Homolog: EC 1.10.3.2 Laccase-12 precursor
  misc_feature: Useful for making plants with altered cell wall content and/or composition
MASSSPSSRLLFFLSCLALALLAGAEVHHHEFVVQETPVKRLCNTHNIITVNGQFPGPTLEVREGDTLVVNVVNRAQYNVTIHWHGIRQIRTGWADGPEFVTQCPIRPGGSYKYRFTIQGQEGTLWWHAHSSWLRATVYGALIIRPRENKAYPFGKPSREVPVILGEWWNANPIDVIREAQRTGGGPNVSDAFTINGQPGDFYNCSQEETTAIPVKPGETALLRFINAALNHELFVSIAQHKMTVVAADASYTKPFTTSVLMIAPGQTTDVLVTMDQAPTRYYVAARAYVSGQNVAFDNTTTTAVIEYDCGCASDFGPKIQPAFPALPAFNDTAAAAAFAAGIKSPGKVKVHEDVDEYLFFTVGLGLFNCEPGQLCAGPNNNTRFTASMNNVSFVFPQHDSLLHAHYYKIPGVFTTDFPAYPPVQFDYTAKNVSRALWQPVPGTKLYPLRFGSVVQLVLQDTSIVTPENHPIHIHGYDFFILAEGCGNFDPKKDVEKFNYVDPPQRNTVAVPVNGWAVIQFVADNPGVWLMHCHLDVHITWGLAMAFLVEDGYGKLQSLEPPPIDLPMC

SEQ ID NO: 1811 - DNA, 1216 bp, Panicum virgatum
  misc_feature: Ceres CLONE 1770230
  misc_feature: Encodes the peptide sequence at SEQ ID NO. 1812
cagaaggcagagatccatccactccacccagcctcgtcgtctcctctcctccacacgcgccccggccgcgcgagagcgaagagcttgtgcctgcacgtaagcacgtccatggccagcgcctgctcgtgtgctcttcgaagcttcggagccgctcgctcgcccgtagccgcagccgtccgggtttgaatcgaaggcctggagtgcggcgacaggcgttgtgttcaatttattccttggagcaggggggcagggcagagaggatcgccgagggagatgatggtggggaagagggagagggactgcaagaacccgatgcggcggaccacgagcatgacggagttcgcgccgccggacgtgctgacggcggtggcggaggacgaggaggcccagctgcccgacaacagcggaggccaggactggctgtccgcgttcggcgccggcgctgcggcgcaggaggactggctggcggcgtaccgcgcgcgcgcggtgccggcgcgggtgggcctgcgccggaactccgccgactactcggtcgtcgagaccgccgccttcctccgcgcctgcgggctctgccgccgccgcctcggccccggccgcgacaccttcatgtacaagggcgaggcggctttctgcagccttgagtgccgggagcggcacatcacgcaggaggagtggaaggacaagtgcgcggtgaagtccgtcaatagcaaggacgcggcagcgccgccggtcaccggccgccgcgccggctccggcaagcccggcgctggcggcacggtggccgcggcatgacggggcgcgcgcgaacgtactagtacgcaccacccgccgacgcaggccggccagctacacctgcctagctgtgcgcaggcttatcgatcgaccgatcactcgtcagcaactactctactggttatcaccagctcgattaatcgatttactagtttagttatctggaattttggatcgatctcgctgcatgcaagccgtagagaccgatactccaaccatcaatcgaccgatccatagatccgtgtaatatgtttcataaaaaaacaaagaaattcttgcagctcgctatgctaccatgcatagatgctggtgcgtgtatgctatcagtgtaccgatcgagcagcatgtaagcacaccctgtagaaatgggggaataaaattaaagtgggggagagaagtggccgatgcactgccattgttgatc

SEQ ID NO: 1812 - protein, 172 aa, Panicum virgatum
  misc_feature: Ceres CLONE 1770230
  misc_feature: Great-hit functional homolog of the protein sequence encoded by LOCUS At1g22160
  misc_feature: Useful for making plants with modulated nitrogen use efficiency
MMVGKRERDCKNPMRRTTSMTEFAPPDVLTAVAEDEEAQLPDNSGGQDWLSAFGAGAAAQEDWLAAYRARAVPARVGLRRNSADYSVVETAAFLRACGLCRRRLGPGRDTFMYKGEAAFCSLECRERHITQEEWKDKCAVKSVNSKDAAAPPVTGRRAGSGKPGAGGTVAAA

SEQ ID NO: 1813 - DNA, 1985 bp, Panicum virgatum
  misc_feature: Ceres CLONE 1770240
  misc_feature: Encodes the peptide sequence at SEQ ID NO. 1814
atacaaattcatgtcagtgaaaatacaaattcatgtcagtgttgttcacagtcgggcggcgtattgacgcgagccaaagctcggaccttaccaatgatctataaaaaagcggcacacgcaggcccagaacacgcaaaagccaagaaaatcaaccaccctttcctgccctttagccagcagattggcctcggtcggcgacgtcgtcagagggatgagtagccaaggacaagcagcggcgcccctcgcccggggagacgccggggacgatgccgccggcggtaccaaggcctcggcgcacttcgtgttcgtcccgcttaacgagcgcggccacctgatcccggccgccgacaccgcgctgctgctggccacccacggcgcggtctgcaccatagtcgggcccccgtcggcgacctcgaaggtacggcagaccgtcgagtccgcccagcagttcgggctgccggtccggctcgtcgacttccccctcgactacgccgcggccggcttgccggaaggtgcggacgacgcggaccgcatcgagcccaggtacatgatgaacttctaccgcgcgctggcgctcctccgcgcgccgatcgagcgctacctccgcgcgcacgacccgtacccgacctgcgtcgtctccgacatcttcaacccctgggcctcggagctcgcggcgggcctcggggtcccgcggctcagcttcttcagcatgtgcgctttctccgtcctgtgccagcacaacgtcgagcggttccacgcgtacgacggcgtcgaggacagcaacgcgccggtcgtcgtgccgggcatcgacagggaggtcgtggtgacgcgggcgcaggcgccgggcttcctccgcgggatcccgatccccgagtgggtggagctggccgactacatcgagcgcgcgcgcgccgaggccgacggcgtcatcatgaacacgttcctggagatggagcccgagtacgtcgccggctacgcggaggccagggggaggaaggtctggaccgtcgggccggtgtcgctgtaccaccagggcgccgcgacgctggcgtcgaggggggacagcgcccccgccatcggcgccgcggagtgcctccggtggctcgacggcagggagcccggctccgtcgtgtacgtcagcttcgggagcatcgcgcaggcggggccgaagcagctcgtggagctggccctcgggctggaggcgtcggggcaccccttcatctgggtggtccggaacgccggcggctacgacgaggcggtgcgcgccgtcctgggggagatggaggcgcgcgtggcggggcgcggcctgctcgtccgggggtgggcgccccaggcggtgatcctgtcccacgccgcggtgggcggcttcgtgacgcactgcggctggaactcgacgctggaagccatcacggcggggctgccggtggtgacgtggccgcacttcacggaccagttcctgaacgagaagatggccgtggaggtgctgggcatcggcgtcagcgtcggggtcaaggagcccctggcgttccaggccgcgaacaaggagatcctggtggggcgggacgtggtggagaaggccgtgagggacatcatgggcgccggggaggaggccgacgggaggaggcagcgggcgcgcgagctcgccgccaaggcgagggcggccgtgcaggagggcgggtcgtcgcacgccaacctgctggatctggtcaagcgtttccagaagcagggcgcagccgcgcctagtgacaagtctagcgcagcatgatcgagtaaccaaaccgggaggacggatgacggtgtgtgccaatgtcaccagagagaacttgccctctgttcaatgggtaaaaatgcggctgatgatttcggctaacccaacactgttctatgtgagagaataaatcgaaggctgaacaaaagactagccgaaataagctgaaagtagacaaatattggtgtcggcaaaccaaaaaaaaaaaaaaaaaaaa

SEQ ID NO: 1814 - protein, 517 aa, Panicum virgatum
  misc_feature: Ceres CLONE 1770240
  misc_feature (1)..(127): Pfam Name: UDPGT Pfam Description: UDP-glucoronosyl and UDP-glucosyl transferase
MSSQGQAAAPLARGDAGDDAAGGTKASAHFVFVPLNERGHLIPAADTALLLATHGAVCTIVGPPSATSKVRQTVESAQQFGLPVRLVDFPLDYAAAGLPEGADDADRIEPRYMMNFYRALALLRAPIERYLRAHDPYPTCVVSDIFNPWASELAAGLGVPRLSFFSMCAFSVLCQHNVERFHAYDGVEDSNAPVVVPGIDREVVVTRAQAPGFLRGIPIPEWVELADYIERARAEADGVIMNTFLEMEPEYVAGYAEARGRKVWTVGPVSLYHQGAATLASRGDSAPAIGAAECLRWLDGREPGSVVYVSFGSIAQAGPKQLVELALGLEASGHPFIWVVRNAGGYDEAVRAVLGEMEARVAGRGLLVRGWAPQAVILSHAAVGGFVTHCGWNSTLEAITAGLPVVTWPHFTDQFLNEKMAVEVLGIGVSVGVKEPLAFQAANKEILVGRDVVEKAVRDIMGAGEEADGRRQRARELAAKARAAVQEGGSSHANLLDLVKRFQKQGAAAPSDKSSAA

SEQ ID NO: 1815 - DNA, 1238 bp, Panicum virgatum
  misc_feature: Ceres CLONE 1770245
  misc_feature: Encodes the peptide sequence at SEQ ID NO. 1816
ctcgagcctcctcttcctcagcctccgacgacgctgttagctgagagctagggaggcctggtctccgccggccagccagtcatgctggtgcgctgcgacgtctgcggcgccgagccggccgccgtgctctgctgcgccgacgaggccgcgctctgctccgcctgcgaccgccgcgtccaccgcgccaacaagctcgccgacaagcaccgccgcatcccgctcacccacccctccgccgacgactccgccgccgccgcgccgctctgcgacgtctgcaaggagcggaggggcctggtgttctgcgtggaggaccgcgccatcctgtgcgccgactgcgacgaccccatccacagcgtcaacgacctcaccgccaagcacagccgcttcctcctcgtcggggcgaagctctccgccgggctcgtcgaccaggcgcccccctcccctgatgacgactgccggggcagcggctctgacgagccccacgacgtcgccgccatctgcgcgccgcaggcgcagggctcctgcacggccaagagcttggctcctgattgcagcaacagctacggcggcggcagcagcatctccgactacctcaccaacatctgccccggctggcgcgtcgacgacctcctcttcgacgacgccgcgttctccgccgcctcggagaccaggtgcgacgagcacgagcaggtcccgtccctggacgccgacctcttcgacgtgattgccggccggccggggaagcgcggcgtgctgggcctcgacaaggtgcctgctgctgctgctgcctccattgcggtcccgacggcggccaagcagcaggggcgcgtgagggagaggcactggaactgcgacagcgacaacgacgtgttcgcagtgccggagatctcgcagccgccgccggccaagaaggcgcggccaccggcgccgactttctggtgcttctgatcgagctgcaccattccggccgccgtgctagctcgatcgcgtgggcacttcttcgttactactgtgtaccaatgtgtgtgagcttgctgttactgtgctgtttacctcgtacttaccactactagcagtgcaccatcccagtcaaactcggtgcagtttatggccatgagagatatcgctatcgtactataaaaacttgtaattgtcatgtgtgcaacctagctagctacttggtcatgtcacaattaattgaatgtgttgatgatcgtgaaaaaaaaaaaaaaaaaaaa

SEQ ID NO: 1816 - protein, 288 aa, Panicum virgatum
  misc_feature: Ceres CLONE 1770245
  misc_feature (1)..(48): Pfam Name: zf-B_box Pfam Description: B-box zinc finger
  misc_feature: The sequence is a functional homolog of  SEQ ID NO 1024 in the  10/666,642 US patent application
  misc_feature: The sequence is a functional homolog of  SEQ ID NO 1646 in the  10/374,780 US patent application
  misc_feature: The sequence is a functional homolog of  SEQ ID NO 1672 in the  10/412,699 US patent application
  misc_feature: Useful for making plants with modulated growth and phenotype characteristics
MLVRCDVCGAEPAAVLCCADEAALCSACDRRVHRANKLADKHRRIPLTHPSADDSAAAAPLCDVCKERRGLVFCVEDRAILCADCDDPIHSVNDLTAKHSRFLLVGAKLSAGLVDQAPPSPDDDCRGSGSDEPHDVAAICAPQAQGSCTAKSLAPDCSNSYGGGSSISDYLTNICPGWRVDDLLFDDAAFSAASETRCDEHEQVPSLDADLFDVIAGRPGKRGVLGLDKVPAAAAASIAVPTAAKQQGRVRERHWNCDSDNDVFAVPEISQPPPAKKARPPAPTFWCF

SEQ ID NO: 1817 - DNA, 1750 bp, Panicum virgatum
  misc_feature: Ceres CLONE 1770271
  misc_feature: Encodes the peptide sequence at SEQ ID NO. 1818
aacttaattaaattagcccgacgagaaattccgcctccacctcgtcctcccccttccgcccgccgaaaccctagcccgtcccgcctcgccgccggcgatggccgccgcatgatcggcgcgccgccttgggaccgcctgccgaccggcatcgccaagcccgccgccgccgcggccgtcgtcgtcgcggcgctcgcgtcctccttcctcgccgtatcgcgcccgcgcgcagcctcggtcgccgcgggatccgggctcgccatgtcgaaggcgagggtctacgccgacatcaacgtcgtgcgccccaaggagtactgggactacgaggcgctcaccgtccaatggggtgagcaggatgactatgaagttgtcaggaaagttggaagaggtaaatatagtgaggtctttgaaggcatcaatgttaacaataatgagaaatgcatcattaagatccttaagcctgtcaagaaaaagaagatcaaaagggagatcaaaatacttcagaatctctgtggaggtccaaacattattaaactgcttgatattgtcagagatcagcattcgaagacccccagcttgatctttgaatatgtcaacaacacagacttcaaagttttgtaccccacgttgacagattatgacatccgttactacatatacgagctactcaaggctctagattattgccattctcaaggcattatgcatcgagatgtcaagccccacaatgtaatgatagaccatgaacttcgaaaacttcgcttgatagactggggcttggctgagttctatcatccaggcaaggaatataatgtccgtgttgcatcaaggtatttcaagggacctgaacttcttgttgatttacaagattatgattattctttggacatgtggagtcttggttgcatgtttgctggaatgatatttcgcaaggaaccgttcttctatggccatgacaatcatgaccaacttgtgaagattgcaaaggtgctcggaacagatgggctgaatgcttatttgaacaagtatcatattgaacttgaccctcaacttgaagctcttgttggaaggcatagtagaaaaccctggtcgaagtttattaatgctgataaccaacatctagtatcacctgaggccatagattttctggacaagctcctacgctacgatcatcaagataggcttactgcacgtgaagctatggcacatccctacttcctccaagtgagagccgcagagaacagcaggacacgaccacaataattatggtgcccgcccttgaaatggagctgaaaccactatgatgcacaccctacctcttactgagcatcatcagctgaaacaagattcagtaagcatcttgctccagatatctgtagcatgactccatgacagtggcaaaaataggagcttcatcatgtgggcgccgatggcagagcttgatattatctttaagcttgggatcaccatgcatataatcttgtgtaatgggagataaatcgtgtgatcttagactaattgaagaggacgatacagatttaataatattgcttgtattatggtgtgatattgtgtatgctgaaaatttatttctggtgattgtagtcatttcgatggaatacatttcaccacattagtggcctggtttgtagccttctccttttgtcgttcaattgctggacgattagtaagcccgagtttctgaatcagcaccaagtggtgccacagtttgtaaaaaaaaaaaaaaaaaaaa

SEQ ID NO: 1818 - protein, 383 aa, Panicum virgatum
  misc_feature: Ceres CLONE 1770271
  misc_feature (51)..(381): SWISSPROT Homolog: EC 2.7.11.1 Casein kinase II subunit alpha
  misc_feature (51)..(383): SWISSPROT Homolog: EC 2.7.11.1 Casein kinase II subunit alpha-2
MIGAPPWDRLPTGIAKPAAAAAVVVAALASSFLAVSRPRAASVAAGSGLAMSKARVYADINVVRPKEYWDYEALTVQWGEQDDYEVVRKVGRGKYSEVFEGINVNNNEKCIIKILKPVKKKKIKREIKILQNLCGGPNIIKLLDIVRDQHSKTPSLIFEYVNNTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIAKVLGTDGLNAYLNKYHIELDPQLEALVGRHSRKPWSKFINADNQHLVSPEAIDFLDKLLRYDHQDRLTAREAMAHPYFLQVRAAENSRTRPQ

SEQ ID NO: 1819 - DNA, 1874 bp, Panicum virgatum
  misc_feature: Ceres CLONE 1770281
  misc_feature: Encodes the peptide sequence at SEQ ID NO. 1820
aacctcaaataacccttcctgtcttaactgctgacaaccaagtaaggcagtaacaactcagagcacagcagcccggctcgcaggagatgggctctccgtcctaccgtctcgcggcggcgatcacggtcccctcgacgagcgagttcctcgtcgtccggcagccgcgcccgccgtccccgcccgcggaggagggggaggactaccggcgcttcgtcgacagcgacctctacaacctcccgtccgcgcctctcgagcccctcgcgggggagccccggacggaggtggccatcgccggcgcggtcgccggcctcgacctctcacgcttcgacgtgtccgccgccctcgatcagatttttgaccgatttggcttgccggatgggatgcgtggggagtggcggctcctgaagtacgtggaggaagcagagtttggcccggacgctggcgtcaacatggtgttcctcatcgggtcgctggtgtcgaaattggatgctctaccagagtcgtgtaaatggatgaccaaggagtgtgcattggtgctgctttctgaagcgaaacccggtaccgatcgcatagggcagtatgcatatattggacttctgaattcggagctgtcatcaaacagccgggctatccctgcgttgccctcccaggagtacccacctggaataactcttgtaccgatgaagagcaagacattacagccattccgcacaactaatcttgtggtagtacgagcaaccaatgttgctggtggatctatatgttctgactgttttgcttgtggggatgctctactgttagatcctgggtgcagctctcaggttcatgcagagcttgcagatctcgtcgattcccttccaaaaaagttattagtccttgtcacacatcatcatcatgatcacattgagggtctttccattgttcagagatgcaatcctgatgctgttcttctgactcaccaaaacacaatgaaccgcattgggaaaggaaattggcagattgactacactgcagtaactggtggtgaaaagatatgcataggtgaccaagaactagaagttatttttgctcctggtcacactgatggtcatgtggggcttctccatgttaataccaatacattaattgttggagatcattgcgtagggcatggaagtgcaacattggacagtagaagtggtggcaacatgaaggattactttgaaaccacatacaaattcttagacctatcaccacatgtcataattccaatgcatggaaggatcaacctatggcccaagcatatgctctgtggatacctcaggaatcgaaggtctagagaagcctccattctgcagtccataaagaatggagcgcaaactctatttgaagtagtttcgaagacttacagtgatgtagacagaaagttgtggattcctgcttctttcaatgttcgccttcatgttgatcatctgaactcccaacataaactgcccaaggacttctcattggagaattttaaggggagctgtggagtgcatttcatattccgttgggaggtggcgtatgtgcaatccaatagctccccagctatccttgcggcaagtgcccttgctggtggtctggcaattgcttgcgctctcagaaggaacagtggcaagcaatcatagattctgttggtcggtaatttccagccacatacacatcttttttttctctccctaagattctgctaccattatgtttagtccaatgctgaattgccaaaattgttggtctccgattgtgtgggtgaactttgccacatcttgacccaaccgagtcctgggattgattttcctctgcttttggatggtgtgatttcaacgtttctggaaaaaaaaaaaaaaaaaaaa

SEQ ID NO: 1820 - protein, 520 aa, Panicum virgatum
  misc_feature: Ceres CLONE 1770281
  misc_feature (1)..(165): Pfam Name: Lactamase_B Pfam Description: Metallo-beta-lactamase superfamily
MGSPSYRLAAAITVPSTSEFLVVRQPRPPSPPAEEGEDYRRFVDSDLYNLPSAPLEPLAGEPRTEVAIAGAVAGLDLSRFDVSAALDQIFDRFGLPDGMRGEWRLLKYVEEAEFGPDAGVNMVFLIGSLVSKLDALPESCKWMTKECALVLLSEAKPGTDRIGQYAYIGLLNSELSSNSRAIPALPSQEYPPGITLVPMKSKTLQPFRTTNLVVVRATNVAGGSICSDCFACGDALLLDPGCSSQVHAELADLVDSLPKKLLVLVTHHHHDHIEGLSIVQRCNPDAVLLTHQNTMNRIGKGNWQIDYTAVTGGEKICIGDQELEVIFAPGHTDGHVGLLHVNTNTLIVGDHCVGHGSATLDSRSGGNMKDYFETTYKFLDLSPHVIIPMHGRINLWPKHMLCGYLRNRRSREASILQSIKNGAQTLFEVVSKTYSDVDRKLWIPASFNVRLHVDHLNSQHKLPKDFSLENFKGSCGVHFIFRWEVAYVQSNSSPAILAASALAGGLAIACALRRNSGKQS

SEQ ID NO: 1821 - DNA, 2560 bp, Panicum virgatum
  misc_feature: Ceres CLONE 1770287
  misc_feature: Encodes the peptide sequence at SEQ ID NO. 1822
ggcgagttctagaagcaaagctgcacggcggcattaacacctccccctccaccgcgctccagttccacctgcccaacgccttctcctacgcgagcttcctggctcccccctgaggcagcttaatcggcaagctatacatctcggtgcgcgcgcgatcgcggccgcggccatggcgctgctctccgccacttccccggccaaggcgcacttctcggcgctcttcctctgccacgacaagccgcagcacgggctcgcgatcccgaccccgcacccgcagtgctcgggcgccgggaggcggcggcagcgggcgcgcagcaggctgtcggtgtcggcggcaatgcggcccccggacgccgcggccgccactcaggcggcgggcgaggcggggggcaagatgaaggggaggaagccccgggtgctggtggccggcggcgggatcggcgggctggtgctggcgctggcggcgcggcgcaaggggtacgaggtgacggtgttcgagcgcgacatgagcgcggtgcgcggggagggccagtaccgcgggcccatccagatccagagcaacgcgctcgccgcgctggaggccatcgacatgtccgtcgccgaggaggtcatgcgctccggctgcgtcaccggcgaccgcatcaacggcctcgtcgacggcatctccggctcctggtactgcaagtttgatacatttacccctgcagctgagcgggggctcccagtcacgagggtcattagccgcatgacgctgcaacagatcctagctcgtgcggttggcgatgatgctatattgaatgatagccatgtagtcgattttatagatgatggcagtaaggttactgccatattggaggatggtcggagatttgaaggtgatcttttggtcggtgctgatggaatatggtcaaaggtgaggaagacactatttgggcattcagaagccacttattcaggttacacatgctacactggaattgcagactttgtgcctcctgatattgacacagttgggtaccgggtatttcttggtcacaaacaatacttcgtctcttcagatgttggtgctggtaaaatgcaatggtatgcttttcataaagaagaggctggtggcactgaccctgaaaatggtaaaaagaaacgattgctcgagatattcagtggttggtgcgacaatgtcatagatctgattaatgcaactgaagaggaagcgattcttcgccgtgacatatatgaccgcccacctactatgaattggggaaaaggtcgtgtgaccttgcttggtgattctgtccatgctatgcagccaaatctgggtcaaggtggctgcatggctattgaggatggataccagctggctgtggagcttgagaatgcctggcaggagagtctcaagtccggaactcctatggacatagtttcctccttgaagcgttatgagaaggagagaaggctgcgtgttgctgttatacatggattggcaagaatgacagcaatcatggcaaccacttatagaccatatctgggtgttggtcttggacctttgtcgtttttgaccaagctgcggataccacatccgggaagagttggtggaagattcttcatcaagattggaatgcctgcaatgctgagctgggtgcttggtggcaacagttcaaagctagaagaaagacctctaagctgccggctttcggacaaggccaacgaccagcttcatcgatggtttgaggatgacgatgcattggaagaagctatgggcggagaatggtacctcttccccacaaatgaaggaaacagcaatagtttgcagcctgtccgtttaatcggggatgaacagaggacaatctctgttggaagtcgatcagatcccagtggctctgcatcttccttggcattgcccatgtcgcagatatcagaaaggcatgctaccatcacatgcaagaacaaggctttctatctgactgatcttggaagtgaacaaggcacatggattactgacaatgaaggtagacgttaccgtgtcccaccaaactttccggttcgtttccacccctctgatatcattgagtttggttccgataagaaggccatgttccgggtgaaggtgctgaacacggtcccatatgaatccgcaagaagagggaagcagcagcagcaagtccttcaggctgcatgaatggagacacgagccaccactcctatcatcagccacactgtactgtacagcattcagtaaacgcaacactgcatcaagggaaggatatagaagatacgtcaaaaataaagaagtgattcttgcatccatccagatgccaaataggattttgagtactagcacctaacggattgaaattgcagttctacgagaagaactgagttgtacaatgcaatagggataggcaatttatctgttgccggaccgtgtacattattgtaccatcaaagaaaatattgtacaccaagaaggcatattgtaatgaacacacgaacacagttacactgtgatcatgtaatgtatactgataccatagttatttagcaaaaaaaaaaaaaaaaaaaa

SEQ ID NO: 1822 - protein, 668 aa, Panicum virgatum
  misc_feature: Ceres CLONE 1770287
  misc_feature: Great-hit functional homolog of the protein sequence given in SEQ ID NO 9610
  misc_feature (1)..(31): Pfam Name: Pyr_redox_2 Pfam Description: Pyridine nucleotide-disulphide oxidoreductase
  misc_feature (1)..(31): Pfam Name: DAO Pfam Description: FAD dependent oxidoreductase
  misc_feature (50)..(668): SWISSPROT Homolog: EC 1.14.13.90 Zeaxanthin epoxidase, chloroplast precursor
  misc_feature (75)..(668): SWISSPROT Homolog: EC 1.14.13.90 Zeaxanthin epoxidase, chloroplast precursor
  misc_feature: Useful for making plants with altered alkaloid content
MALLSATSPAKAHFSALFLCHDKPQHGLAIPTPHPQCSGAGRRRQRARSRLSVSAAMRPPDAAAATQAAGEAGGKMKGRKPRVLVAGGGIGGLVLALAARRKGYEVTVFERDMSAVRGEGQYRGPIQIQSNALAALEAIDMSVAEEVMRSGCVTGDRINGLVDGISGSWYCKFDTFTPAAERGLPVTRVISRMTLQQILARAVGDDAILNDSHVVDFIDDGSKVTAILEDGRRFEGDLLVGADGIWSKVRKTLFGHSEATYSGYTCYTGIADFVPPDIDTVGYRVFLGHKQYFVSSDVGAGKMQWYAFHKEEAGGTDPENGKKKRLLEIFSGWCDNVIDLINATEEEAILRRDIYDRPPTMNWGKGRVTLLGDSVHAMQPNLGQGGCMAIEDGYQLAVELENAWQESLKSGTPMDIVSSLKRYEKERRLRVAVIHGLARMTAIMATTYRPYLGVGLGPLSFLTKLRIPHPGRVGGRFFIKIGMPAMLSWVLGGNSSKLEERPLSCRLSDKANDQLHRWFEDDDALEEAMGGEWYLFPTNEGNSNSLQPVRLIGDEQRTISVGSRSDPSGSASSLALPMSQISERHATITCKNKAFYLTDLGSEQGTWITDNEGRRYRVPPNFPVRFHPSDIIEFGSDKKAMFRVKVLNTVPYESARRGKQQQQVLQAA

SEQ ID NO: 1823 - DNA, 2051 bp, Panicum virgatum
  misc_feature: Ceres CLONE 1770292
  misc_feature: Encodes the peptide sequence at SEQ ID NO. 1824
atttttcggtagctagctactagcaaagctcgggggcgacctggtgagcaaagtctacagggtatacaataccagcacatcgcagcgcagcgcttcgattaggaggatctcggaaggaggcagacggacccgatgacaatcgcagcggcggtgaccgcgcccacgaccgcgccagtgcacgccgcgccgcgccacgccgcgcccgcggtccagccgcgcgcgccgccgcgccgggacccgtcgccgctgaacccgaacacgccggcgcaggcgctccgctcggcgagctccgcgcccccctcgtcctcggcggcggcggcggacggagccagggctcacatcgccaacctcgacaaggtgctcgggaagccgccgaggcccgcgagccacgccgccgcggcggccaggcaggagcaggagcaggagcaggagcaggagccgctcagcgtccgccacggcctgctcaacgcgctcaacctctccttcttcgtgcccatgcccgggatgcgggcgcgcacggccgccgacgagcacatgtcgccgcgcagcctcatgcacatgcagcagctgctctccgccgactccccgcgcgcgtccccgaggtccaccatcgcgccgcgctggcggagcctccacggggaaggcggctgggcggggctcctcgacccgctcgactccgacctccgccgcgagctcctccgctacggcgacttcgtgcaggcggcctaccaggccttccactcgctgcccacggcgtcggcgaggcaccgcgggctcatgctccccgaccgctcctaccgccccacgcgcagcctcttcgccacctccgcgctgtccatgccgccgtgggccaagcgccccaacacgcccgagtggctcacgcagcagtccaactggatcggctacgtcgccgtgtgcgagtccgagcgggaggtcgcccgcatgggccgccgcgacatcgccatcgtgctgcgcggcaccgccacctgcctcgagtgggcggagaacctccgcgcctcgctggtgcccctcgacggcgagagcagcgacggcgcggacaccggagcggaggagcccaaggtggcgcggggcttcctcagcctctacaagacggccggggagaaggtcaagagcctgtccgaggaggtcatggacgaggtccggcgcctcatggagaagtacaagggcgaggagctcagcatcacggtcgtcggccacagcctcggcgccgccctggcgctcctcgtcaccgacgaggtcgccacctccatccccgacgcgccgcccgtcgccgtggtctccttcggcgggcccaaggtgggcaacggcgcgttcgtggacaggctcagcagcagcggcaaggtcaacgtcctgcgcatcgtgaacgcgggcgacgtggtcaccaaggtgcccggggtggcgccgcggctgccgcacaagaaggagcagtaccagcacgtcggcgcggagctccggatcgacagcaagaactcgccgtgcctccgcccggacgcgggacccgcctgccggcacgacctggaggcgtacctgcacctcatcgacgggttcacggggacggggcggcccttccggcacgacgcccgccgcagcgtcatccggctgctgcagctgcagaggggaaacgtcaagaaggagtacgtgaaccgcgcgcgcgagctcggcgtcgaccccaccgcgccggcggacgtcggccggagcatggcgtacggcaactgcgccatcgcgagcccctcgtgacgggatcaaattacccgtctgcttcagtgggccgtcttgtaaaatgtaaattttgtaggaggaagaagaattctttcgttagtggccgttgcgagcggggaaatatctctcattttccgctctctttttttcgattaccaattaccatgcaggtacaggaaagactaagcaagcgcaagtgcgcagatcaatcaatccagtgaaaacgtgaccttgatgttttctttgcctcttaccgatgtcaatttctcattggttcagtttttctttctgaaaaaaaaaaaaaaaaaaaa

SEQ ID NO: 1824 - protein, 541 aa, Panicum virgatum
  misc_feature: Ceres CLONE 1770292
  misc_feature (1)..(153): Pfam Name: Lipase_3 Pfam Description: Lipase (class 3)
MTIAAAVTAPTTAPVHAAPRHAAPAVQPRAPPRRDPSPLNPNTPAQALRSASSAPPSSSAAAADGARAHIANLDKVLGKPPRPASHAAAAARQEQEQEQEQEPLSVRHGLLNALNLSFFVPMPGMRARTAADEHMSPRSLMHMQQLLSADSPRASPRSTIAPRWRSLHGEGGWAGLLDPLDSDLRRELLRYGDFVQAAYQAFHSLPTASARHRGLMLPDRSYRPTRSLFATSALSMPPWAKRPNTPEWLTQQSNWIGYVAVCESEREVARMGRRDIAIVLRGTATCLEWAENLRASLVPLDGESSDGADTGAEEPKVARGFLSLYKTAGEKVKSLSEEVMDEVRRLMEKYKGEELSITVVGHSLGAALALLVTDEVATSIPDAPPVAVVSFGGPKVGNGAFVDRLSSSGKVNVLRIVNAGDVVTKVPGVAPRLPHKKEQYQHVGAELRIDSKNSPCLRPDAGPACRHDLEAYLHLIDGFTGTGRPFRHDARRSVIRLLQLQRGNVKKEYVNRARELGVDPTAPADVGRSMAYGNCAIASPS

SEQ ID NO: 1825 - DNA, 1819 bp, Panicum virgatum
  misc_feature: Ceres CLONE 1770305
  misc_feature: Encodes the peptide sequence at SEQ ID NO. 1826
ggcgaagccaaatgtttgaactggcaaatcggaaaaagctcacctccaaactcccaacgcccgccgccgccgccgccgcaacgcgacgcgacgcgtagatccaaacccccagcccacgccacctccgccgccgtcgaaccgacccgtccgcgcgaccgccccagtttcaggcccccggcgttactcaggcaggaccgaagatggcgcgccgagggttgatggagcaggatctgagcaagctcgacgtcgccaagctggaccctctgtcgccagaggtgatttcgcgccaggcgacgatcaacatcggtaccattgggcacgtggcccatgggaagtctactgttgtcaaagcaatctcaggcgtgcagactgttcgtttcaagaatgaactggagcgcaatatcactataaagcttggttatgctaatgcaaaaatctataaatgtgaagatgatagatgcccacggccaatgtgctacaaggcttatggcagtggcaaagaagatagccctctctgtgacattccagggtttgaaaactgtaggatgaaactcctgagacatgtttcatttgttgattgcccggggcatgacattctcatggctacaatgcttaatggagcagctatcatggacggagcactacttctgattgcagccaatgagagctgtccccaaccccagacatcagagcatcttgcagctgttgaaattatgcgtcttcaacatattatcattctgcagaacaagattgatcttatccaggaaagtgcagcaatgaaccagcatgaagcaatccagaaatttatacagggaacaatagctcaaggtgctcctgtggtgccaatatctgcacagctgaagtacaatattgacgttatctgtgaatacatcgtgaaaaagatccccatcccagagaggaacttcatctctccacccaacatgattgttattcgttcttttgatgtgaacaaacctggttcggaggttaatgatatcaaggatggagtagcaggtggcagtatcctcaagggagtcctgagggtgaaccagaaaatcgaagttcgcccaggcatcgtgatgaaggatgagaatggcaaaattaaatgcacacccatctactcgaggattgtgtccctgtatgctgagcagaatgaactccagtttgccgttcctggagggcttattggagttggaaccaccatggacccgacactgactcgtgctgataggctggtcggtcaggtacttggtgaagttgggtcactccctgatgtttacatcgagttagaggtaaacttcttcctcctaaggaggctgctgggggtgaggacaagtggaacagaaagggcaagcagagtctcaaagctcgccaagggtgagatcctgatgcttaacattgggtcaatgtccactggagcccgtgttcaagccgtcaagaatgatctcgcaaagctgcagctgaccgcaccggtgtgcaccagcaagggtgagaagttggcccttagccggcgcatcgagaagcactggcgtctcattggctggggcacaatccaagccggcactacacttgacgtccctccctgcccgctttgaatcgtacaccacctgtttgacgcaaggcagagagcttttaggaactgtttttgtaaggtggaggagaaaacctgaaccaaaatgttaccagcttgggtttttgttcttccatttgcagttttgtattgttattgtgcgatggatgactaaaattgtagcatttacgtggggagcgtaatgataatcgtgaatattgaattgtgcaaaaaaaaaaaaaaaaaaaa

SEQ ID NO: 1826 - protein, 464 aa, Panicum virgatum
  misc_feature: Ceres CLONE 1770305
  misc_feature (4)..(81): SWISSPROT Homolog: var Histone-lysine N-methyltransferase Su
MARRGLMEQDLSKLDVAKLDPLSPEVISRQATINIGTIGHVAHGKSTVVKAISGVQTVRFKNELERNITIKLGYANAKIYKCEDDRCPRPMCYKAYGSGKEDSPLCDIPGFENCRMKLLRHVSFVDCPGHDILMATMLNGAAIMDGALLLIAANESCPQPQTSEHLAAVEIMRLQHIIILQNKIDLIQESAAMNQHEAIQKFIQGTIAQGAPVVPISAQLKYNIDVICEYIVKKIPIPERNFISPPNMIVIRSFDVNKPGSEVNDIKDGVAGGSILKGVLRVNQKIEVRPGIVMKDENGKIKCTPIYSRIVSLYAEQNELQFAVPGGLIGVGTTMDPTLTRADRLVGQVLGEVGSLPDVYIELEVNFFLLRRLLGVRTSGTERASRVSKLAKGEILMLNIGSMSTGARVQAVKNDLAKLQLTAPVCTSKGEKLALSRRIEKHWRLIGWGTIQAGTTLDVPPCPL

SEQ ID NO: 1827 - DNA, 1790 bp, Panicum virgatum
  misc_feature: Ceres CLONE 1770310
  misc_feature: Encodes the peptide sequence at SEQ ID NO. 1828
gtgctaataaaaaggatccaaagtgaagcctaaacaaacacggccggccaatagcttttgatctgtgtacagctcggtcagcacaggttattagtagcaactttgttggcgatgggtagcttgccactcgacgcgtcaccgcggccactagacccagaggccttctccggtgagtcacgcgccgtcgtcaacttcctcgccaagtactaccgtgacgtcgacaattacccggtccgggcagcggagcttgagccgggcctgctacgcaaactgctccccgaggcggcgccggaggacggcgagccgttggaggatgtactggaggatgtgcggcgggacatcctgccggggctcacccactggcagagccccagcttcttcgcctacttccccacgaacgccagcacggccgggttcgccggcgagatgctgtccgtcggcctcaacgtcgtcccattcgtgtgggcggcgtcgccggctgccgccgagctcgagtgcgtcgtggtggactggatagccaagctgctcggtctgccgcagcgcctactcttctcgggcggcggcggcggcgtcctgcaggggagcacctgtgaggccgtggtgtgcacgctcgccgccgcgcgggaccgtgctctggccaggctggggcacgagagcatcctgaagctggtggtctacgcctccgaccagacgcacgtcacgttccagaagggcgcgcggctcgtcggcatcccgccgcccaacttccgagtcatccggacgtcggcggcgtccgggtacggcctgaccgccgacgccgtccgcgccgcggtcaatcgcgacgtcgcgcgaggcctggtgcccctgtacctctgcgccaccgcgggcacgacggggctcggcgcggtcgaccccgtgcgcgagctcggggaggaagcgcggcgccgcggcatgtggctgcacgtcgacgccgcgtacgccgggagcgcagccatctgccaggagttccaggagcttctcgacggagtcgagctcgccgactcggtgagcatgaactcgcacaagtggtttctcaccaacatggactgctgctgcctgtgggtcgcgagcccccgtgctctaacctcggcgctggcaaccgacccggagtacctcaagaacgtgggcacagtcggtggcgcggccgcggtggactacaaggactggcagatctctctgtctcgccggttccgcgccatcaagctctgggtggtgctgcggcgctacggtgcggacggcctgcgtgcgcacattcgtcgacacgtcgcggcagccaaatggttcgagcgtgcggtgacggtggatgaacgcttcgaggtcgtggtgccgaggaagttgtccctggtatgcttccgcctccgggagaggttcccggaggacgacgccgtggacgacttgaaccgggagctccttgcggcggtgaatgagagcgggcaggcgttcatgacgcacttcgtggtggacggcaagttcgtgatccggctcgcggtcggcggagccatgaccgagatgaagcacgtcatggacgtgtgggagctgctgcagggcaaggccgaggaggttctacggcgtcatcaactttagagggctctcatcgtacagttgcgcgcaacagccagattgcacgtccacgcagacattattcttgttgtttactcctcgttacgtttgtgcccgtgtaagtgatgtgtgtcggtaattgtcaccacgtaaatctcctaatatgctagctcaatgagagttgttggtttccaaaaaaaaaaaaaaaaaaa

SEQ ID NO: 1828 - protein, 496 aa, Panicum virgatum
  misc_feature: Ceres CLONE 1770310
  misc_feature (1)..(388): Pfam Name: Pyridoxal_deC Pfam Description: Pyridoxal- dependent decarboxylase conserved domain
  misc_feature (13)..(491): SWISSPROT Homolog: EC 4.1.1.25 Tyrosine decarboxylase 2
  misc_feature (13)..(491): SWISSPROT Homolog: EC 4.1.1.25 Tyrosine decarboxylase 4
MGSLPLDASPRPLDPEAFSGESRAVVNFLAKYYRDVDNYPVRAAELEPGLLRKLLPEAAPEDGEPLEDVLEDVRRDILPGLTHWQSPSFFAYFPTNASTAGFAGEMLSVGLNVVPFVWAASPAAAELECVVVDWIAKLLGLPQRLLFSGGGGGVLQGSTCEAVVCTLAAARDRALARLGHESILKLVVYASDQTHVTFQKGARLVGIPPPNFRVIRTSAASGYGLTADAVRAAVNRDVARGLVPLYLCATAGTTGLGAVDPVRELGEEARRRGMWLHVDAAYAGSAAICQEFQELLDGVELADSVSMNSHKWFLTNMDCCCLWVASPRALTSALATDPEYLKNVGTVGGAAAVDYKDWQISLSRRFRAIKLWVVLRRYGADGLRAHIRRHVAAAKWFERAVTVDERFEVVVPRKLSLVCFRLRERFPEDDAVDDLNRELLAAVNESGQAFMTHFVVDGKFVIRLAVGGAMTEMKHVMDVWELLQGKAEEVLRRHQL

SEQ ID NO: 1829 - DNA, 1246 bp, Panicum virgatum
  misc_feature: Ceres CLONE 1770326
  misc_feature: Encodes the peptide sequence at SEQ ID NO. 1830
atcaaccactcgccgcccgcaagcatcatcagctgggcatccatccatggcgtcctccaccgctgcctctctccgcctcgccttccctccgctctccgccgccgccgccgtggcctcctccttctcctcccccaccaccctccgcttgcctctccgccgcgccccacgccccctcgccgtcgccgccttcaagaagctgtccgaggcgtcgcccgtgcccatccccccggagcccacccagcccctgctcgacgagggcgccctgccccccaagcccggggtatacggcgtctacgacgccgccggggacctgcagttcgtcgggatttcgcgcaacgtcagggccagcctcgagggccaccgccggaaggtccccgctgacctctgcgcctccgtcaaggttgcagtagcagatgaggagacacctgatcgagcggtccttagtaatgcctggaaatcatggatggaagaacatatagaatccacaggcaaggcgccaccagggaatgttgctggaaacagcacctgggtaggtgccccacagaggcctccggacttgcggttgacacctggtcgccatgttcagctaactgtcccactagaacagttgatagatcgtctggtgaaggagaacaaagtggtagccttcatcaaaggatcaaggagtgctccccagtgtggattctcacaaagggtggttggtatcttggaagcacatggagtggatttcgtaactgttgatgtgcttgatgaggaacacaaccatggactaagagaaaccctgaagacttacagcaactggccgacgtttcctcaagtttttgttggaggggagcttgtgggaggctgcgatattgtttcatccatggctgaaaaaggggagctgtctgccctatttcagaaatagtgctcatgtcatgtgttggaagttctagtatgctcgttggccatgtttactgttgtacttgagaactttgagcttctctctttccacattgcctcgttgtagcgcaaaattacttggcctaagaaaatggtcatttggattttcatgaggctgtaccgctgcagccctactgatgtgataataccaggatatttctgtgggaggcttagagtttgaggttatctgtatatttttcattgcttcagatcctgtacgacatgaacaatttgtagcttcatgttaaaagaatatgttttctagattgatggcagttaaatgcaaaaaaaaaaaaaaaaaaaa

SEQ ID NO: 1830 - protein, 286 aa, Panicum virgatum
  misc_feature: Ceres CLONE 1770326
  misc_feature (1)..(68): Pfam Name: Glutaredoxin Pfam Description: Glutaredoxin
MASSTAASLRLAFPPLSAAAAVASSFSSPTTLRLPLRRAPRPLAVAAFKKLSEASPVPIPPEPTQPLLDEGALPPKPGVYGVYDAAGDLQFVGISRNVRASLEGHRRKVPADLCASVKVAVADEETPDRAVLSNAWKSWMEEHIESTGKAPPGNVAGNSTWVGAPQRPPDLRLTPGRHVQLTVPLEQLIDRLVKENKVVAFIKGSRSAPQCGFSQRVVGILEAHGVDFVTVDVLDEEHNHGLRETLKTYSNWPTFPQVFVGGELVGGCDIVSSMAEKGELSALFQK

SEQ ID NO: 1831 - DNA, 1680 bp, Panicum virgatum
  misc_feature: Ceres CLONE 1770328
  misc_feature: Encodes the peptide sequence at SEQ ID NO. 1832
gttcctccgcgaccccgcgagccctccgccgccgtccgatctcccccacatcgccgccggtaccgcctcctccctccccctccttatcttcttcctcctctgccttgtgcgcctctcctccccttccccccacccacccaatcattgctcgagcgctgcgccccctgcgaatccgcaccagctcggcttatgcttcacctcgctgattgggtgctttgctgattagtccaatcccgtcgggagagcaggcggttcaggtggttgccccaacaattcgggggctccgggatctcggttcctgatcggtaggcgggcgggcgtcggatccaacggccgtcatcatggttgtcgatacggtcagcgcgagcacctccattattgcgccccacctgttcgaccagaggtccaggggcccccaccgccccctcagccggacgttacatgtcgtcgcctgccgccccctgggcaccgccttcgcgggccgccgcctcgtggcccgggtcgccaggcagccgtcgccgcggctcgcggactggccggtcaaggcgctggccatgggggtgaccaaggaggccagcccgcgcagggagtaccgggggatccccggggacggcggcgacatgggggatgttggggtcaccaacccggccccgtcctggcccccgcggaacagggcggatgaccccaagctgcacaacccgctgctccgcctcgagcggatgggctgcgggtggctcggcgtcatcttcgagtgggagggggtcattgtcgaggatgatgccgaattggaaaggcaggcgtggctgaccctggcgcaggaggaggggaagtcgccgcctccggctttcctattgaggagagtggaagggatgaagaacgagcaggcgatttccgaggttctctgctggtcacgggacccctcggagctcaggcgattggcctcgcgaaaggaggagatacacagcagccttcggggtggctctttctaccagatgaggaacggttcgcgggagttcatgagcacgctggccaattacaagatccctattgctgtggccaccacacgcccacggaaggttattgaagaagccatcgaagctgttggcgcgcggagtttctttgacgccgtcgtggcagcggaggatgtctatcgggggaagcctgaccccgaaatgtttctgtacgctgctcagctcctaagcctcattccggagaggtgcatcgtgttcgggaactccaactccgccgtggaagccgctcatgatgctcgcatgaagtgtgtcgcggttgcaagcaagcacagaatctatgagcttagtgctgcagatcttgtggtgaagcaactggatgagctatctgttgttgacttgaagaacctcactgatatcgagtctccggagtttggcatggaacctgaaccagagatggaggaagaagcgtccacaccatcgtcagcagtgggtgtagatttattctggtaagaggcccgattgtacatttgattgattcctctcctgcacagcatgtattattgtcaactgttgtagcgatcaggaagaagggcttatcatccttctaatcagtagaatgtgatatgtaaaaatgttgtttagagctcacaaactgtatatatactcagaaagaaagcagggaactgaataaaaaaaaaaaaaaaaaaaa

SEQ ID NO: 1832 - protein, 379 aa, Panicum virgatum
  misc_feature: Ceres CLONE 1770328
  misc_feature (1)..(189): Pfam Name: Hydrolase Pfam Description: haloacid dehalogenase-like hydrolase
MVVDTVSASTSIIAPHLFDQRSRGPHRPLSRTLHVVACRPLGTAFAGRRLVARVARQPSPRLADWPVKALAMGVTKEASPRREYRGIPGDGGDMGDVGVTNPAPSWPPRNRADDPKLHNPLLRLERMGCGWLGVIFEWEGVIVEDDAELERQAWLTLAQEEGKSPPPAFLLRRVEGMKNEQAISEVLCWSRDPSELRRLASRKEEIHSSLRGGSFYQMRNGSREFMSTLANYKIPIAVATTRPRKVIEEAIEAVGARSFFDAVVAAEDVYRGKPDPEMFLYAAQLLSLIPERCIVFGNSNSAVEAAHDARMKCVAVASKHRIYELSAADLVVKQLDELSVVDLKNLTDIESPEFGMEPEPEMEEEASTPSSAVGVDLFW

SEQ ID NO: 1833 - DNA, 1511 bp, Panicum virgatum
  misc_feature: Ceres CLONE 1770340
  misc_feature: Encodes the peptide sequence at SEQ ID NO. 1834
gtcagtctcactcctcgctctctctctcgcctcgccgccggcgacgagctcgagctcgagcttcttcctcgtctcgccgacgacggcggcgttatggagcccatgaacgtagacaacggcggctgcggcggccttgacgcgcagatcgagcagctgatgcagtgccgcccgctcgccgagcaggaggttaagtcgctgtgcgagaaggccaaggagatattgatggaggaaagcaatgttcagcctgtcaagagtccagtgacgatatgtggtgatatccatggacaatttcatgatcttgtagagctttttcggatcggcggaaagtgtccagataccaattacttatttatgggggattacgtggaccgtggctactattctgttgagactgtcactctgctagtagcactgaaagtgcgccacccacatcgaattacgatccttcgtgggaaccacgaaagtcggcagatcacacaggtgtatggattctacgacgaatgcctgcgaaagtatggcaatgcaaatgtatggaagacatttacagacctttttgattatttccctctgacggctctggtggaatctgagattttctgccttcatggtggtttatctccatcaattgaaaatcttgatagcgtacgtagcctagatcgtgtccaagaggttcctcatgagggacctatgtgcgatcttttatggtcagatccggatgatcgatgtggttggggcatatctcctcgtggtgctggctacacatttggccaggacatatcagagcagtttaatcacacgaacaatctcaaacttgtagctcgggcccatcagttagttatggaaggatataactgggctcatgaacaaaaagttgtcaccatattcagtgctccaaactattgctaccgatgtggcaatatggcatccattttggaagttgacgactgcaacagtcacactttcatacagtttgaaccagcccctaggagaggtgagccagatgtgacccgaagaacaccagattatttcctttaagttatcgaagttaccattttccaccatgtgctgtgagaatcgatgtgaacatctgctggatcaagggccatccaaaataacaagtgaatatcaaagcgctatgcaaaactcgaggtccccccattggtcaatgcaagagatgctgctatcctggaagaaagcaagtgtgccatgtaaaagccatgcccgagttttgaagcccttaaggtgatcgaagggccatctactttctactctcgccctccctttttaggcatatatatttttacagaggcgtgggcaaaagactgaacatcaatttgtacttttgtagcatagtaagcttgtaccaataggcctgtactaatttgtatcatcattcatcaatggcaaggcacaattaaactcctttcgtcagcagtaatctaaattttggtaaagatgtgcttatagtacatgagcatgactcctttccctaaaaaaaaaaaaaaaaaaaa

SEQ ID NO: 1834 - protein, 313 aa, Panicum virgatum
  misc_feature: Ceres CLONE 1770340
  misc_feature (1)..(196): Pfam Name: Metallophos Pfam Description: Calcineurin-like phosphoesterase
  misc_feature (12)..(313): SWISSPROT Homolog: EC 3.1.3.16 Serine/threonine-protein phosphatase PP2A-2 catalytic subunit
  misc_feature (2)..(313): SWISSPROT Homolog: EC 3.1.3.16 Serine/threonine-protein phosphatase PP2A-4 catalytic subunit
MEPMNVDNGGCGGLDAQIEQLMQCRPLAEQEVKSLCEKAKEILMEESNVQPVKSPVTICGDIHGQFHDLVELFRIGGKCPDTNYLFMGDYVDRGYYSVETVTLLVALKVRHPHRITILRGNHESRQITQVYGFYDECLRKYGNANVWKTFTDLFDYFPLTALVESEIFCLHGGLSPSIENLDSVRSLDRVQEVPHEGPMCDLLWSDPDDRCGWGISPRGAGYTFGQDISEQFNHTNNLKLVARAHQLVMEGYNWAHEQKVVTIFSAPNYCYRCGNMASILEVDDCNSHTFIQFEPAPRRGEPDVTRRTPDYFL

SEQ ID NO: 1835 - DNA, 2054 bp, Panicum virgatum
  misc_feature: Ceres CLONE 1770350
  misc_feature: Encodes the peptide sequence at SEQ ID NO. 1836
agcctttctttccgggagacggacggtacactgcggtgcggtcggaggccgtgacccggaggacttggggagacctgctggctggctgctgcaaatctaatccacattccgatcttctagaagcttcattcaaccccgccgctttggctcccctctctcccgtccccatttcgtcgcagcagtccaaaccctagtttattccccgcttccccttccttccgacgcggctccgagacagggtgagctgggagagaggactaggaggagggtatggatcggatcgtcggcagcaagtacaagctcgggcgcaagatcgggagcggctccttcggcgagatctacctagcgacgcacgtcgacacctacgagatcgtcgccgtcaaaatcgaaagcagcaaaaccaatcatccgcagttgctatatgaggctaaactgtacaatgctcttcagggagggactggtattgcaaacatcaaatggtgtggcattgatggtgatgaaaatattcttgtcattgatttgcttgggccaagccttgaagatctttttgtttattgtggccggaggttctcactgaagacagtcttgatgctcacagatcagatgataacaagaatagaatttatgcattctaaaggttatctgcacagagacatcaagcctgataacttcctcatgggtcttggtcgaaaagctaatcaggtttatgtcattgactttgggctcgccaagagatatcgtgactcaacaaccaatcgccatataccttatagagaaaataaaaacttgacaggcacagctcgctacgctagtcgcaacactcatcttgggattgagcaaagccgtagagatgatttggaatccattggatacgttcttctgtacttcctcaggggaagccttccttggcagagcttgaaagcagccacgaagaaacaaaagtatgacaaaataagtgagaagaagctttcgactcctattgaggctttatgtaaatcccatcctgtggaattcgcttcctatttccactattgccattctctgacatttgatcagcggcctgattatagtttcttgagacggctctttcgagatttgtttgaccgtgaaggctatcagtttgattatgtctacgactggactttgttaaagtgtaagcaatcccagaaggctaaggctcaacaaggatgctcacaagatgcgggtgcaagcagccgtccagttacaacgaatttggacaagcacaaagttaatgttgtacgcccggttgaagcttcaggtctggtagaagcagagcaacgcccggcaatcagaatgcaattgaagcccagtgctgaaaatagccgttcaaataatctgcatcatgatagattgagagtggctgctggtcctgataatgcattaaagcaatccacatcacttggccgtgttgatgctccgaggaacactgcgtctatctcaaaaacacatgggtctttcgatccacatactcgtggaagttacagtcctgggccctctaaccacatttgacctttggatcatttagttcctataaatgcatgggggacattcagtaaacagttgactttaagagatgattttgttcaccacccagacagccaatattttcctgggactttattggcatggtaacaacttggtccgcaatgtgctggggctgcctgatgtggtttttggaagaatcctggtcaaagttatatgtgtttattcctgatgcatgaagccattgctgaaaggaaattagctgtcaggtttttgtggggacatctgtattgcttgaggtgattactaccaaccagaaatattggttggtgctgattatgaattcagcatcagttgttgttctggtcttattattcttttccgtatgtggataatatggaacgtgcttagggatctcagcaatctattttgtattttatacaagtggatacattgtaacccctcatttgtctgggctcgttgattcagggtcctttccaaatataataatgatgcatgtattccatgcttaaaaaaaaaaaaaaaaaaaa

SEQ ID NO: 1836 - protein, 419 aa, Panicum virgatum
  misc_feature: Ceres CLONE 1770350
  misc_feature (1)..(325): SWISSPROT Homolog: EC 2.7.11.1 Casein kinase I isoform delta-like
  misc_feature (1)..(414): SWISSPROT Homolog: EC 2.7.11.1 Casein kinase I isoform delta
MDRIVGSKYKLGRKIGSGSFGEIYLATHVDTYEIVAVKIESSKTNHPQLLYEAKLYNALQGGTGIANIKWCGIDGDENILVIDLLGPSLEDLFVYCGRRFSLKTVLMLTDQMITRIEFMHSKGYLHRDIKPDNFLMGLGRKANQVYVIDFGLAKRYRDSTTNRHIPYRENKNLTGTARYASRNTHLGIEQSRRDDLESIGYVLLYFLRGSLPWQSLKAATKKQKYDKISEKKLSTPIEALCKSHPVEFASYFHYCHSLTFDQRPDYSFLRRLFRDLFDREGYQFDYVYDWTLLKCKQSQKAKAQQGCSQDAGASSRPVTTNLDKHKVNVVRPVEASGLVEAEQRPAIRMQLKPSAENSRSNNLHHDRLRVAAGPDNALKQSTSLGRVDAPRNTASISKTHGSFDPHTRGSYSPGPSNHI

SEQ ID NO: 1837 - DNA, 1806 bp, Panicum virgatum
  misc_feature: Ceres CLONE 1770375
  misc_feature: Encodes the peptide sequence at SEQ ID NO. 1838
ccttccattccgttcggacacaccgtcctcgtttctctctgccccctaccctcttctctcctccctcatctttctctctcctctcccctcccctcccctcccgtgcgagctcacgcccccaccccccgagctcctccgtcgcgagagaggcagcaggcggtgcgcctgggggaggcgtcgatggatctggagaggtcgccgccggcgtcgccggcggaggcggccggtggcggggccgggggcgcggcgtgctccatctgcctggatccggtgctcgccctcggcgggggacgctccgtcgccaagctgcaatgcggccacgagttccacctagactgtattggatctgcattcaatgcaaaaggagcaatgcaatgccctaattgtcggaagattgagaaaggtcgctggctttatgcaagcggacaccgcccttctgctgatattgatatgggtggctgggcgactagtgacaactatgatatcacctctgaccttccatttggatttcagtggtgcccctttagtggattcacgcagctagcttctgtgtttgaggagcgtgaagctgagccaacttcttatcacacaattggagatcactcaagtgcagcaagcagttcacttgtttgcccatatcttgctctgcgtggttttcttcatcctgtgcatgtgccttctacttctaattctggtgctgaaagcacttcgtttcatcggcattcaactggcttggaaggccatgcaactccagatttgagtaatgctcaagttttccatgctaccgagacaaggaatcatgacagtgagcacaggcatttgagtaatattcctgtatcaggaattcctgatcattctatgactccatttggtataggactaccaagatatgataccagcagccaacagagatccagatcatatgcacgtcatcatcccctaatccataggccaacacctcgcagtggaaacaatttggtggcaccattagggtcagttccagctgttgtggcagagactagaggccatggtcatggtgcaagaggccatatgtaccaacagtcaatgcactctatgcagagcagcccattccctcctaccactagaagggttaggccgagggccttgacaattacatctttcattgcggcagcatcctcagctgaggttggagggccccatggattttcagcccctggagctgtgaacaggagcattcctgatgctgagggcatcactagacccatcgaccgaccatatccatgggggcgagagggctttgcgccgttcccttggatccctgctgaaggcgagtctcactggtggggcaccttcaatcctatgcagaacccggcacatggaagttttaccaggaggcctgctggtgagcggatgccgcagaatcacccagaaaacggctatcagcctgtgcctcctccccagaggatgccgccattcttgtgattagtgaaggctattctgcaattattgtgtataaagtttatttggttctagacttgagagaacaggggcaagaagatcagctgtgctgcactgccgaaactggtcggttgaaggatctctgtgatgtttatgccgctggtattttagcgttttcggtccagcagcactcaagctttgttgagcgctgtagtttgtcctaactgatgtgttgttacattgagcagaattatttgaaaacatgagctaaactgcatctttggtcgccatgagtgaaaaacaagtgcagctatgaatacaagagagtgggtattcagttcatcacaaaaaaaaaaaaaaaaaaaa

SEQ ID NO: 1838 - protein, 427 aa, Panicum virgatum
  misc_feature: Ceres CLONE 1770375
  misc_feature (1)..(44): Pfam Name: zf-C3HC4 Pfam Description: Zinc finger, C3HC4 type (RING finger)
MDLERSPPASPAEAAGGGAGGAACSICLDPVLALGGGRSVAKLQCGHEFHLDCIGSAFNAKGAMQCPNCRKIEKGRWLYASGHRPSADIDMGGWATSDNYDITSDLPFGFQWCPFSGFTQLASVFEEREAEPTSYHTIGDHSSAASSSLVCPYLALRGFLHPVHVPSTSNSGAESTSFHRHSTGLEGHATPDLSNAQVFHATETRNHDSEHRHLSNIPVSGIPDHSMTPFGIGLPRYDTSSQQRSRSYARHHPLIHRPTPRSGNNLVAPLGSVPAVVAETRGHGHGARGHMYQQSMHSMQSSPFPPTTRRVRPRALTITSFIAAASSAEVGGPHGFSAPGAVNRSIPDAEGITRPIDRPYPWGREGFAPFPWIPAEGESHWWGTFNPMQNPAHGSFTRRPAGERMPQNHPENGYQPVPPPQRMPPFL

SEQ ID NO: 1839 - DNA, 1934 bp, Panicum virgatum
  misc_feature: Ceres CLONE 1770385
  misc_feature: Encodes the peptide sequence at SEQ ID NO. 1840
aaacgttgccactcgagactcggtgggaaggaagaattcgagctcacagatttggtaaaatttacccccattattattagcgcgctgggcgatgcttccgtgtttctatcatccctttcttattagcgcgctgccttgatccgagggtttggcacctgtcccttcccttccttcctcccccggcgcaatctttccttccgcgagctcgcccggcgatttttctttgcagttttctattgcaaatcttgggcgcgacctaagcatcgattcggctttaagcggccgaggcggtcggagtggaggtgcccgtggttgacccgttggtgagatgattgttgggtcgggaacttctttctcctcttccgaggtgatccttttcttttaggtggattggaggtaacttgctactgtcgttacgacagagcaaagcacattatcttgtaaaatgtgcatttcgctggctttatcttaaatcaaatcagctctgtttcttggaacaggaaccagtaatttcccatgcaatctcttggttgatggatgctcttcctgttgtatcagaaagagagagtcaaacagatagtcaccctttactcatggagcatgtgattggtatcccaagggatgatgtcccttcttctacacctcgtcgagataatcatgatggcatggatcaactgcctcgtgactcagaaagttcttctggaacaactgctgcatctaacactccgaacgctcctctagcaagaagagatgataatcgtggtcctcgtcggcgaagtcctctgaattctggcttctggatctcagttgaactagttgtaaatctcagccagattatagctgctatttgtgttctgtctgtatcaaggaatgaacatcctcatgctccattgtttgagtgggtcattggttatacaataggttgtattgcaactcttcctcatctttactggcgctatctccaccgcaaccacctggccactgtgcaagaatcagctaatcagaactacattccaaacaacatccctgaaagtaattcttctgaggaattttctgcccctcgagtgtctgaagctggtgttgtaacaggcacaaatggagtttcaagaaacaacgtggttactgtaaatccaagggcccaagcttttgctgatcacttcaaaatggctctggactgtttcttcgctgtatggttcgttgtgggaaatgtgtgggtgtttggtagacgttcttctgcccatgatgcgccaaacttgtacaggttgtgtatagccttcctcacattcagttgcatcggctatgctatgcccttcattctctgcgcactgatatgttgctgcctcccctgcataatttctgtaatgggcttccgagaagatttgaaccaaaatagaggtgctagttcagatgctatcaacgccttaggcacatataagtttaaattgaagaagcctcgtaatggagatggaaatggaaatgaaggtggcagtggggtgttggctgctggaacagacaaggaacgcgttgtttctgctgaagatgctgtttgctgtatctgcttggcaaggtacgtggacaatgacgaactccggttgctcccatgtgggcacttcttccacaaggactgtgtcgacaagtggctcaagataaatgcactgtgccccctctgcaaatctgagcttgacgttgtctcggcaactgctccagccattggctttgggcgccgccacagcgacaacagggtaggaaacgacattgaatcgcaacaatagctatggcagcttgtcccatgaggaggcaacatgcctttgatgcggctttccactagagcaatttgtaaattatatatagtgcagattgtacagtcgatcgatgagcccttatgtgacccaacaagttatttcctgactgaccaaaaaaaaaaaaaaaaaaaa

SEQ ID NO: 1840 - protein, 412 aa, Panicum virgatum
  misc_feature: Ceres CLONE 1770385
  misc_feature (1)..(41): Pfam Name: zf-C3HC4 Pfam Description: Zinc finger, C3HC4 type (RING finger)
MDALPVVSERESQTDSHPLLMEHVIGIPRDDVPSSTPRRDNHDGMDQLPRDSESSSGTTAASNTPNAPLARRDDNRGPRRRSPLNSGFWISVELVVNLSQIIAAICVLSVSRNEHPHAPLFEWVIGYTIGCIATLPHLYWRYLHRNHLATVQESANQNYIPNNIPESNSSEEFSAPRVSEAGVVTGTNGVSRNNVVTVNPRAQAFADHFKMALDCFFAVWFVVGNVWVFGRRSSAHDAPNLYRLCIAFLTFSCIGYAMPFILCALICCCLPCIISVMGFREDLNQNRGASSDAINALGTYKFKLKKPRNGDGNGNEGGSGVLAAGTDKERVVSAEDAVCCICLARYVDNDELRLLPCGHFFHKDCVDKWLKINALCPLCKSELDVVSATAPAIGFGRRHSDNRVGNDIESQQ

SEQ ID NO: 1841 - DNA, 1672 bp, Panicum virgatum
  misc_feature: Ceres CLONE 1770413
  misc_feature: Encodes the peptide sequence at SEQ ID NO. 1842
gagcgctgccccgccacttcgcaccaacgcgccaccagccagccagcagagagccgctgctccaatggtctccttctcctccctctccgccccctcctcctcctccaccccgtccttcaccgtccccaccaaaacctcccccggcgccgcctccgtctcattccccagggcgagggagccgcgcaagcgcggggccaggatggcgacggtgagggcggaggcggtggacgcgaccatcagcccgcgggtgagcgcgctccgcccgtccaagaccatggccatcaccgaccaggccaccgcgctgcgccaggctggcgtgcccgtcatcggcctcgccgccggggagcccgacttcgacacgccgaccgtgatcgccgaggctggaatgaatgctatcagggatggcgccacaagatacacgcccaatgctgggactctggagctgaggaaggctatctgcaaaaagcttcaggaggagaatggattatcctacacccctgatcaggtgctagtgagcaatggagccaagcagtgtatcacacaagctgtgcttgccgtatgctcacctggtgatgaagttttgatacctgctccatattgggtcagctaccctgagatggctagactggctggtgcaacgccagttattctccctacaagcatatcagacaattacctgctaaggccagagtcacttgcctcggtgatcaatgaaaattcaaggatcttgattctctgctctccatctaatccaacagggtctgtttatcctaaggagttgcttgaggagattgctgctatagtcaggaagtatcctaggctcctggttttatctgatgagatctatgagcatatcatctatcagcctgctaaacatacaagctttgcttcattgcctggaatgtgggaaagaacattaactgtaaatggtttttctaaggcttttgctatgaccggttggagacttggatatttagctgcccctaaacatttcgtctcagcctgtggaaagatccaaagccagtacacctctggggccagtagtatatcacagaaggcaggtcttgcagctttgaacctgggttatgccggtggtgaagcagtatcaaccatggtcaaagcattccaggagcgtcgtgattaccttgtaagaagctttggggagctgtcaggagtcaagatatcagaacctcagggagccttctatttgtttatcgatttcagctcctactatggttctgaggtggaaggttttggcactatcaaggactctgagtccctctgcatgtttctgctagaaaaggcacaggttgcacttgtccctggggatgcatttggagatgacaagggtgttcgcatttcatacgctgcagctatgtcaacgctgaaaactgcaatggggaagataaaagaagcgatggctctgctcaggccccctgttgccgtttaacgaaacgaacgtgttgctaggcatctgtggagtgtggaccaagaggcttctgcaatgttctatcatattaaatacattctattgacgtaaaataggatccattttcgtttcttcttggaaaaactgctttggctatcattcgactttgttttgttatctgtatctgaaaacttggaatttatacttgttacagtgaaatgaaccctctagtgtttttttttt

SEQ ID NO: 1842 - protein, 461 aa, Panicum virgatum
  misc_feature: Ceres CLONE 1770413
  misc_feature: Great-hit functional homolog of the protein sequence encoded by LOCUS At2g22250
  misc_feature (1)..(364): Pfam Name: Aminotran_1_2 Pfam Description: Aminotransferase class I and II
  misc_feature: Useful for making plants with modulated nitrogen use efficiency
MVSFSSLSAPSSSSTPSFTVPTKTSPGAASVSFPRAREPRKRGARMATVRAEAVDATISPRVSALRPSKTMAITDQATALRQAGVPVIGLAAGEPDFDTPTVIAEAGMNAIRDGATRYTPNAGTLELRKAICKKLQEENGLSYTPDQVLVSNGAKQCITQAVLAVCSPGDEVLIPAPYWVSYPEMARLAGATPVILPTSISDNYLLRPESLASVINENSRILILCSPSNPTGSVYPKELLEEIAAIVRKYPRLLVLSDEIYEHIIYQPAKHTSFASLPGMWERTLTVNGFSKAFAMTGWRLGYLAAPKHFVSACGKIQSQYTSGASSISQKAGLAALNLGYAGGEAVSTMVKAFQERRDYLVRSFGELSGVKISEPQGAFYLFIDFSSYYGSEVEGFGTIKDSESLCMFLLEKAQVALVPGDAFGDDKGVRISYAAAMSTLKTAMGKIKEAMALLRPPVAV

SEQ ID NO: 1843 - DNA, 1341 bp, Panicum virgatum
  misc_feature: Ceres CLONE 1770414
  misc_feature: Encodes the peptide sequence at SEQ ID NO. 1844
gacgaaccattgctctatggacgacactatactagcagctctccttgccgagctagagaaataagaagatggcttcggcggcggcaggtgagaagaggaagaagacggcgtgcgtgaccggagggaacgggtacatcgcctcgctgctcatcaagatgctgctggaggagggctacgccgtgaagacgacggtcaggcatcccgaggacaaggagagcaactcccacctggaggacctgcagaagctcggcagcttggaggtcttccgcgccgacctgagcgaagagggcagctacgacgacgccgttgccggctgcgactacgccttcctgctcgccgcgccggtcaactacacctccaagaaccccgagacagagctgatcgagctgggcgtccaaggcactctcaacgtcatgcgctcctgcgtgaaggccggcacggtgaagcgcgtcgtcctcacctcatcgacggccgccgtctccagcaggccgctggagggcaacggcaacgtgctgggcgaggactcctggtccgatgtcgactacctcacagccaagaggaccggcctctgggcgtacccggtgtccaaggtgctgatcgagagggcggcgaccgagttcgcggcggagaacggtgtgagcctggtgaccctgtgcccgtccgtcacggtgggcgaggcgccggaccggcaggtgtacaccaccgtccccgccatcctgtcgctgctgtccggcgacgaggaggagctcagcgtgctcaagggtatcgagagggcctccgggtcggttccgctggtgcacgtggaggacgtctgccgtgccgatatcttcgccgccgagacggccgccgacgggcggtacatcgtgaacggcctcgacacgaccatcgccgacatggcacggttcctggcggacaagtacccgcagtacaacgttgacaccaataacctctccggcgatgtccttgagaagccgatagcgctgctgccgtccacgaagctggagaaggaagggtttgagttcaagtacaagatgctggagaagttgtacgagaacatggtcgagtacggcaaggagctgggaatccttaccaactgatcgatctccttgtgtgcgtgcgcgcgcgcgtgcgcgctttttggatcggcccatcaagtacccgcgaaatcaactacctttgccacgtcagaaagccaaaaaaagctaattgcgtgtggtttgagtgtgtacctctctccatctctctcgcaaagtttggatgtactactgctcctgtgtgttccggcccttcgaaatgtaagataagatcaacaattttatctaaaaaaaaaaaaaaaaaaaa

SEQ ID NO: 1844 - protein, 342 aa, Panicum virgatum
  misc_feature: Ceres CLONE 1770414
  misc_feature (56)..(281): Pfam Name: Epimerase Pfam Description: NAD dependent epimerase/dehydratase family
MASAAAGEKRKKTACVTGGNGYIASLLIKMLLEEGYAVKTTVRHPEDKESNSHLEDLQKLGSLEVFRADLSEEGSYDDAVAGCDYAFLLAAPVNYTSKNPETELIELGVQGTLNVMRSCVKAGTVKRVVLTSSTAAVSSRPLEGNGNVLGEDSWSDVDYLTAKRTGLWAYPVSKVLIERAATEFAAENGVSLVTLCPSVTVGEAPDRQVYTTVPAILSLLSGDEEELSVLKGIERASGSVPLVHVEDVCRADIFAAETAADGRYIVNGLDTTIADMARFLADKYPQYNVDTNNLSGDVLEKPIALLPSTKLEKEGFEFKYKMLEKLYENMVEYGKELGILTN

SEQ ID NO: 1845 - DNA, 1981 bp, Panicum virgatum
  misc_feature: Ceres CLONE 1770420
  misc_feature: Encodes the peptide sequence at SEQ ID NO. 1846
agtgtcccgcctccacgccacgccacgagatataaccgccgcctgccagccccgcgacacccccacgcctccctccctgtccgtcccttcccgaggcggagacccgtgccgcgcctcgcctcgcctcgcctcgcctctgttccaccccgtgagccagcgccaggcgccctcctccggttgggtccggccgggtttcgggtctcgacgccgccgcagacgaccccccctgcccatctcggcgggcggcgaccacgagatggaaagccatagttcatcacatcctcagattgctgaagtgaaaatggacatctcaccgtcagcttctggagcagcagggaacaaaatctgcagaggtgctgcctgtgatttctctgattccagtaacagctcgaaagatgccaaggagagatccgcatccatgaggaagcttataattgccgtgatcctttgtatcatattcatgacagtggaagttgttggcggcatcaaagcaaacagtcttgcaatcttaactgatgcagctcatcttctttctgatgtggcagcttttgccatatcactattctctctttgggctgctggatgggaagcaacaccacaacagtcttacgggttctttcgtattgagattcttggtgcattggtctccattcagctcatatggttgcttgctggcatactcgtatatgaggctattgtaaggctcattaatgagagcggcgaggtgcagggctccctcatgtttgctgtatcagcttttggattatttgtcaacatcataatggctgtacttctggggcatgaccatggacacggccatggccacagccatggtcatggccatggacattcacatgatcatagccatggtgattcagatgatgaccatgaagaacaagagcagggccatgtgcatcgccacgagcacagccatggaagttctattactgtcacaacccatcaccaccaccacccaagcactggacaacatcgtgatgctgaggaaccattgcttaagcatgagggtacccagtctgctgccaaatctgctaagaaacaacgccgaaatatcaatgtacacagtgcttatcttcacgtgcttggagattcgatccagagcgtcggggtaatgattggtggggctatcatctggtacaagcctgagtggaagatcattgatctcatctgcaccctcatcttctctgtgattgtactgttcaccacaatcaggatgctgcgcaacatacttgaagtactgatggagagcactccccgtgagattgatgccaccaggctcgagatggggctctgcgagatggatggtgtggttgctgtccacgagcttcatatctgggccatcacagtagggaaggtgctcctagcatgccatgtgacaatagcaagggaagccgacgctgatcagatccttgacaaggtgatcagatacatcaagacagagtacaacatcagccatgtgaccattcagatcgagcgcgagtagggatatctttaggctgccagggcataaatggtgtctttgccggttatcttgttcatgtcggctaatactgctttttgcaccggggaaggcatcagacagtcaatcgagccacaatgcgctcacagctttgatgctgggtactatcatctattactagtctattaggtgaaggaattattcgggtggtgtagttgtcagtctgtgcattcacatggatgaatttttcggacatgttgttaacgccttgtgggttcatcgaactgcatctgtagtgagaaatagtttagcaccctgtgtcgtcacctttgtgtaagataatgtttctagcatgaaaggtatgaagttagtgagtggactatggccgtttgttttgagctctgttttgctttgttgcaattgaatggagcgagccggaaaggcacgctctcatctgaccactgaattctcggtggctgttaacaaaaaaaaaaaaaaaaaaaa

SEQ ID NO: 1846 - protein, 414 aa, Panicum virgatum
  misc_feature: Ceres CLONE 1770420
  misc_feature (1)..(364): Pfam Name: Cation_efflux Pfam Description: Cation efflux family
MESHSSSHPQIAEVKMDISPSASGAAGNKICRGAACDFSDSSNSSKDAKERSASMRKLIIAVILCIIFMTVEVVGGIKANSLAILTDAAHLLSDVAAFAISLFSLWAAGWEATPQQSYGFFRIEILGALVSIQLIWLLAGILVYEAIVRLINESGEVQGSLMFAVSAFGLFVNIIMAVLLGHDHGHGHGHSHGHGHGHSHDHSHGDSDDDHEEQEQGHVHRHEHSHGSSITVTTHHHHHPSTGQHRDAEEPLLKHEGTQSAAKSAKKQRRNINVHSAYLHVLGDSIQSVGVMIGGAIIWYKPEWKIIDLICTLIFSVIVLFTTIRMLRNILEVLMESTPREIDATRLEMGLCEMDGVVAVHELHIWAITVGKVLLACHVTIAREADADQILDKVIRYIKTEYNISHVTIQIERE

SEQ ID NO: 1847 - DNA, 770 bp, Panicum virgatum
  misc_feature: Ceres CLONE 1770473
  misc_feature: Encodes the peptide sequence at SEQ ID NO. 1848
ttccctcgtgacccgtgagttcgccgccggcagctgccgagggagagggggcgggatggggttcgtcggcgacacggtggagtcgatccgctccatgcagatccgccaagtgctcatgcagatcatcagcctgggtatgattgttacctcagcattgatcatatggaaggggttgatagttgtgacaggaagcgagtctccagttgtagtggttctctctggtagcatggagcctggatttaaaaggggtgatatcctatttttgcacatgagcaaagatcctatccgcacaggagaaatagttgttttcaatgttgacggccgtgagattccaattgttcaccgtgtgattaaggtccatgaacgtcaggatactgcagaagtggaaatcctcaccaaaggtgacaataactttggggatgaccgattattatatgcacatgggcagctttggctccagcaacaccacattatggggcgagctgtgggctatcttccatatgttggctgggttacaattatcatgactgagaaaccgtttattaagtacctgctaattggcgcgctgggcctgctggtcataacatcaaaagagtaaagaagttaaagcttccgcgccttatagattttgctcttggggcgcaacagcatagagcaatggcttgccgaatagtgttaagagaagctgttgtgttccaccatgtaccaaacgagaagatatctttgtctgttccgcaggcgcctaccctgtaattggattgtcagatctc

SEQ ID NO: 1848 - protein, 180 aa, Panicum virgatum
  misc_feature: Ceres CLONE 1770473
  misc_feature (1)..(79): Pfam Name: Peptidase_S24 Pfam Description: Peptidase S24-like
MGFVGDTVESIRSMQIRQVLMQIISLGMIVTSALIIWKGLIVVTGSESPVVVVLSGSMEPGFKRGDILFLHMSKDPIRTGEIVVFNVDGREIPIVHRVIKVHERQDTAEVEILTKGDNNFGDDRLLYAHGQLWLQQHHIMGRAVGYLPYVGWVTIIMTEKPFIKYLLIGALGLLVITSKE

SEQ ID NO: 1849 - DNA, 877 bp, Panicum virgatum
  misc_feature: Ceres CLONE 1770485
  misc_feature: Encodes the peptide sequence at SEQ ID NO. 1850
aggccatgctcttgtgagtcttgtccccttcttcaaccttccgctcgctgctgctgctagttcgggaagccgtgcgggaggatttcaggattcgcagcggaatggaggcagcggcgcggccatcgaatgccgctctcctcgcacgcctcagggagggcacggccaggttcgagctcctcgaggactccgcgccggcacctgcgccagcaccgtcttggccccggctccactgcttcgccaggattgccccctcgctgaggggcggttggtcggcggcgctgaacaaggtggagcattacggggttcagagggtcaccggtgatggccggtgcatgtttcgggcgttggctaaaggaatggcaaagaataaggggattcctttgaccccaagggaggaggtacaagatgcagatgatttacggatggcagtgaaagaaattatatgtgacagcgagactgagcggcagaagttcgaagaagctgttatagcaattactgtggaacaatccttgaaacgctactgccaaaggataaggcggccagacttctggggtggagagtcagaattcctggttttgtctagactgtgtcgtcagccaataattatttatattccagagcgcgagtaccatggtcgcggtaatggcttcatccccatagctgaatatggattggaattccccaaaaattcaaagaattggaagaaaaaggcacctgtaagacttttatacagcgggaggaatcactatgatttgctcatttgacatggttacatggctgttcagaggggggtgtgtgtgggttttgtaactctcttcttatattaatgcaataatacacagtcctcctgtgctatcaaaaaaaaaaaaaaaaaaaa

SEQ ID NO: 1850 - protein, 220 aa, Panicum virgatum
  misc_feature: Ceres CLONE 1770485
  misc_feature (1)..(122): Pfam Name: OTU Pfam Description: OTU-like cysteine protease
MEAAARPSNAALLARLREGTARFELLEDSAPAPAPAPSWPRLHCFARIAPSLRGGWSAALNKVEHYGVQRVTGDGRCMFRALAKGMAKNKGIPLTPREEVQDADDLRMAVKEIICDSETERQKFEEAVIAITVEQSLKRYCQRIRRPDFWGGESEFLVLSRLCRQPIIIYIPEREYHGRGNGFIPIAEYGLEFPKNSKNWKKKAPVRLLYSGRNHYDLLI

SEQ ID NO: 1851 - DNA, 1466 bp, Panicum virgatum
  misc_feature: Ceres CLONE 1770546
  misc_feature: Encodes the peptide sequence at SEQ ID NO. 1852
tgactcctgagtgcatagcttgctttgtgccaccaaaaagaatccgagatgtcaaatgccagttcagcagaaggtgcacgctggacatcccctgacaagctcaagttggtcaccatcctgagcatcgacggcggtggcatcagagggatcatcccggccaccatcctcgccttccttgaagcaaaactccaagaactggatgggccagatgctcggattgcagactacttcgatgtcgtcgctggcactagcaccggtggcctcctgactgcgatgcttgcagccccagacgctaatggacgaccactgttcgccgccaaggacctggcgcggttctacattacccactcccccaaaatcttccggcggaggaaccaaatccagtccaagatcgccaacaagctgaagatggtgtgcgggcccaagtacgatggcaagtacctccatgcgctgctccgtcggtatctcggcgacacgaggctggacaggacgctgaccaacgttgtcatcccgaccttcgacattgcatacatgcaaccaacgattttctccacctttgagttgaggcaccagccgtcgaaaaatgcgctcctgtcggacatatcaatgagtacctcggcggcaccaaccttcttcccgccacactacttcgagacgaaggacaaggatggcaggaggagggccttcaacctcgttgatggtggcctcgccgcgaacaaccctactctgtgcgcgatgaaccaggtgtcccaggacatcatcctggggaacgagcacttcttcccggtgaagccgacagactacggaaagttcatggtgatctccctcggctgcgggtcgaaccggaaccgcaggtactgcgccaaggccgcggccaggtggagcatcttcaactggctcatcaagggcggcactgcccccatcgtcgacatgttcaactcggccagcgccgacatggtcgacatccacctttgcgtcctcttccgcgccctgcgctccagccaaaactacctgcggattcagtacgatcaattgacgggcagcgcgggctctgtagacgactgctccaaggagaacatggatagactggtgtggattgggaagaggctcttggacatgaacgtctcccgggtagacctggagaccggccggatcaaggaggtgcctggcgtgggcaccaatgccgagcagctcaccaagtttgcaaagcagctctccgacgagcggcgccggcggcaggaagagcttatttattccgaagcaggattccaaaatcatgcttggtgacagttgaaatgcatgctggtcaatagattttcgacgttatctagctgtttgcgtttcgtgctttggcctatgtattccatttatcgtgtgatatgttattatcaacaagctaaacgtgttgttttacttcgttctcgaaagcaattctttggattccggaaaaaaaaaaaaaaaaaaaa

SEQ ID NO: 1852 - protein, 412 aa, Panicum virgatum
  misc_feature: Ceres CLONE 1770546
  misc_feature (1)..(207): Pfam Name: Patatin Pfam Description: Patatin-like phospholipase
MSNASSAEGARWTSPDKLKLVTILSIDGGGIRGIIPATILAFLEAKLQELDGPDARIADYFDVVAGTSTGGLLTAMLAAPDANGRPLFAAKDLARFYITHSPKIFRRRNQIQSKIANKLKMVCGPKYDGKYLHALLRRYLGDTRLDRTLTNVVIPTFDIAYMQPTIFSTFELRHQPSKNALLSDISMSTSAAPTFFPPHYFETKDKDGRRRAFNLVDGGLAANNPTLCAMNQVSQDIILGNEHFFPVKPTDYGKFMVISLGCGSNRNRRYCAKAAARWSIFNWLIKGGTAPIVDMFNSASADMVDIHLCVLFRALRSSQNYLRIQYDQLTGSAGSVDDCSKENMDRLVWIGKRLLDMNVSRVDLETGRIKEVPGVGTNAEQLTKFAKQLSDERRRRQEELIYSEAGFQNHAW

SEQ ID NO: 1853 - DNA, 629 bp, Panicum virgatum
  misc_feature: Ceres CLONE 1770550
  misc_feature: Encodes the peptide sequence at SEQ ID NO. 1854
actcgcattcgcattgccagtgcaacacgatggctctcaggctgtgggctagctcagcagccaatgcgctcaagctctccggagccagggctgccgcaccgtcctactccatctccagattcttctccacagttcatgatgggttgctgtacactacgactcatgagtggctcaaggaccatggggacggcgtcctctcggttggcatcacggaccatgctcagggtcaccttggagaggtggtgttcgtggagctgccggaacccggcgcgacggtcaccgcgggaggatccttcggcaacgtggagagtgtgaagaccaccagcgacgtcaactccccgatctccggagaggtcgtcgaggtcaactccaagctgtcggagacgcccggcctgatcaactcgagtccgtacgaggaggggtggatgatcaaggtgaagccgagcagcccggcggagggcctgctggacgcctccagctacaccaagcactgcgaggaggaagacgctcactagagccagcagatatatagatcatgcatgcacatgctgcgtttgctgcttatgatccacatatataaaatagtgtgttctattggttgtttcagtcaaaaaaaaaaaaaaaaaaaa

SEQ ID NO: 1854 - protein, 161 aa, Panicum virgatum
  misc_feature: Ceres CLONE 1770550
  misc_feature (1)..(121): Pfam Name: GCV_H Pfam Description: Glycine cleavage H-protein
MALRLWASSAANALKLSGARAAAPSYSISRFFSTVHDGLLYTTTHEWLKDHGDGVLSVGITDHAQGHLGEVVFVELPEPGATVTAGGSFGNVESVKTTSDVNSPISGEVVEVNSKLSETPGLINSSPYEEGWMIKVKPSSPAEGLLDASSYTKHCEEEDAH

SEQ ID NO: 1855 - DNA, 690 bp, Panicum virgatum
  misc_feature: Ceres CLONE 1770561
  misc_feature: Encodes the peptide sequence at SEQ ID NO. 1856
gtgagcttagcggagcacacctgaccgaccgcgcccctacgagtcttcgacgctcgggcccgccgccgaagccgacgcaggcgcagcaccaggagagatgagctgggggctggccgccgccgtggcgtccgccgctgccgtcgcggccgcgtccggcgccgagctcctcgcctgcgactgcgacgccgccgcgccgccggccgtcgggaggtgcgacggcctgctcctctcgcggcagcaccacgatgaggaggtccgcgaggggtcggcgtcgagggagaagcctcgcggcggaggcggcaacaggttcgcgccgcgcttggacgggctgcgcttcatcgagacgctcgtcacggcgcaccgctgaagaaaacgacgcatcgtccgctggtacttcccgccatgattcggcgatcgattgttggtggcgcataggcctcccaattttggtagggcagattcgggataccctttcccttcttcggttgtgttttcttcctcctatttgtcgagagagaaatttcaacgatgattactgtgtccatcactccgtgcgtttgtgtgtttgattgagagagaggatgaagactataagcggcatgtaaatttgagctcatactcttaatactatatgttccataattattcatcacctgatttgtttgtttgcaaaaaaaaaaaaaaaaaaaa

SEQ ID NO: 1856 - protein, 89 aa, Panicum virgatum
  misc_feature: Ceres CLONE 1770561
  misc_feature: Great-hit functional homolog of the protein sequence given in SEQ ID NO 9184
  misc_feature: Useful for making plants with modulated cold sensitivity
MSWGLAAAVASAAAVAAASGAELLACDCDAAAPPAVGRCDGLLLSRQHHDEEVREGSASREKPRGGGGNRFAPRLDGLRFIETLVTAHR

SEQ ID NO: 1857 - DNA, 996 bp, Panicum virgatum
  misc_feature: Ceres CLONE 1770660
  misc_feature: Encodes the peptide sequence at SEQ ID NO. 1858
aaaaatatcgaactcgagctcgcaagacaccaccgaggtcgtgcttgtctgtaggctcggcgggatctcaggctcggatcgatctcggctcaagatgccatcgaactcgagcttgaggtcgtaggctcgctgagatcggctcgttgatagccctcccgctcaggctcatctccccactttcctcctcccttggtgttcctttcccggcggcgaccaccgggccagcggcagcgccattcgttacgtattcgcccggccctttgccggcgaggagcatccaccagagaattcgttgaaatggcaagcacggcatgctttgtgatcgtgagtaagaatgacatcccaatctatgaggctgaagttggatctgctccaaaaaaagaagatttagcttatcagcatcagttcattttgcatgctgcattggatgttgttcaggaccttgcatggactaccaatgcaatgtttctgaggtcggttgatagattcaatgaccttgttgtgtctgtttatgtaactgctggtcatactagatttatgttgcttcatgactcgcggagtgatgatggaataaaaagtttctttcaggaggttcatgacctctacatcaagatattcctcaatccactctacttgcccggttctcggataacatcctcccattttgataccaaggtcagggctcttgcaaggaaatacctgtagcatacacactcctgtggaagatcctgtttggcagcacccttttctttccccccatgcctaatcttgttagtcagtaactgatatatactgaaagtctctgttctgctataccaaaacaatgctgctcaaaccacttttttctctctccccgatacatgtgatgtagaacgttgtacacaacaaatcttaagctgttctcgtcagtcaaggactgatatatcctaagatgcattataccaaaacaatgttgcccccaccagggctttgtttcaaaaaaaaaaaaaaaaaaaa

SEQ ID NO: 1858 - protein, 135 aa, Panicum virgatum
  misc_feature: Ceres CLONE 1770660
  misc_feature: Great-hit functional homolog of the protein sequence given in SEQ ID NO 9325
  misc_feature: Useful for biocontainment applications
MASTACFVIVSKNDIPIYEAEVGSAPKKEDLAYQHQFILHAALDVVQDLAWTTNAMFLRSVDRFNDLVVSVYVTAGHTRFMLLHDSRSDDGIKSFFQEVHDLYIKIFLNPLYLPGSRITSSHFDTKVRALARKYL

SEQ ID NO: 1859 - DNA, 854 bp, Panicum virgatum
  misc_feature: Ceres CLONE 1770680
  misc_feature: Encodes the peptide sequence at SEQ ID NO. 1860
aatcgagtcgagtccaatcgcatcgcagcaattccaactccggcgatctcgctccggtcggaagcagcaagatgtccggcgaggaggaggagaacgccgccgagctcaagatcggagaagagttcctcaaggccaagtgcctgatgaactgcgaggtggccatcatcctggagcacaagtacgagcagatccagcggcacgcgtcggactcggacccctcgtcgcaggtgtcgcaggtgttcgagaagtcgctgcagtacgtcaagcgcttcagccgctacaagaaccccgacgccgtgcgccaggtccgcgagacgctcagccgctacggcctcgccgagttcgagctctgcaccatcggcaacctctgccccgacaccagcggcgaggccaccgcgctcgtcccttccctcaagtccgggggcaggttcgacggcgacgccggcgacgagaagatcgagaagatgctcaacgacctctccctcatcaagaagttcgagtagccagctctagtgccatctgccgcagtcttgctatattgccatggccatgccttttgttcacttggaccgtcagttcccctggctgccctgccttgtcacatcaggctccatgctaatgatcagcaatgattcatctttgtaactctgaacaaaaagcctccatgctgcgaatttgagaactcaagagagggcctttgatgatgatgttgctttccctgttctttggacgtctcataaaagtagcagtgctacatctattactgctggtatgaacatgaagcttaaaagggaacattccagatgaagatgtacttgaatttcttatcaaaaaaaaaaaaaaaaaaaaaaaaa

SEQ ID NO: 1860 - protein, 143 aa, Panicum virgatum
  misc_feature: Ceres CLONE 1770680
  misc_feature: Great-hit functional homolog of the protein sequence given in SEQ ID NO 9365
  misc_feature (1)..(123): Pfam Name: RNA_pol_Rpb4 Pfam Description: RNA polymerase Rpb4
  misc_feature: Useful for making plants with modulated drought sensitivity
MSGEEEENAAELKIGEEFLKAKCLMNCEVAIILEHKYEQIQRHASDSDPSSQVSQVFEKSLQYVKRFSRYKNPDAVRQVRETLSRYGLAEFELCTIGNLCPDTSGEATALVPSLKSGGRFDGDAGDEKIEKMLNDLSLIKKFE

SEQ ID NO: 1861 - DNA, 688 bp, Panicum virgatum
  misc_feature: Ceres CLONE 1770769
  misc_feature: Encodes the peptide sequence at SEQ ID NO. 1862
ctgcagccgcgacgtcaaactcgaagcacgtcgggggaggagatgggggaagtaatgtaccaggcgatcccctacagcagcgcccggccgtggctcatgccggcgcccgaggcgggcgtcgtctccgtgaagccggaggcggcagcggcggccaccggcgcggaggagcccgcccggcccgacgccgcggcgggggacgacgacggcgggcgggcggaggtcgagagggccgtggccgagagcccggtgctggtggtggggcgccgcgggtgctgcctgagccacgtcgtgaagcggctgctgcaggggctcggggtgaacccggccgtgcacgaggtcgccgacgaggccgcgctcgccggggtcgtcccgcccggcggcgccgaggccgccgcgctgcccgcggtgttcgtcggcgggaagctcctgggcgggctcgaccggctcatggccgtccacatctccggcgagctcgtgcccatcctcaagaaggccggcgccctctggctctaattcaaccaggcgtgtttctttctgtttctgccttccagtctcacagaaaagggccgttggatcgagagtattacatcacaccgcggcggatgatgatcatgtgctgtgctaggactttgttcaatttttctcttgatttaggggaagcaagaaagaaaatgataattcctaattc

SEQ ID NO: 1862 - protein, 156 aa, Panicum virgatum
  misc_feature: Ceres CLONE 1770769
  misc_feature (1)..(60): Pfam Name: Glutaredoxin Pfam Description: Glutaredoxin
MGEVMYQAIPYSSARPWLMPAPEAGVVSVKPEAAAAATGAEEPARPDAAAGDDDGGRAEVERAVAESPVLVVGRRGCCLSHVVKRLLQGLGVNPAVHEVADEAALAGVVPPGGAEAAALPAVFVGGKLLGGLDRLMAVHISGELVPILKKAGALWL

SEQ ID NO: 1863 - DNA, 1051 bp, Panicum virgatum
  misc_feature: Ceres CLONE 1770793
  misc_feature: Encodes the peptide sequence at SEQ ID NO. 1864
acgcgctccggtctccggacaccaaccaactcttcggcgcaaccgcagctccgtcagttcgctgagcgcgcaaccgtcagccatgggcgccggcgaaggcaacggcccccggcctatggcgcaggacccgaagaccccgtgcaacgagggccacgtccatgttccgctcgacaaccctcttccgaagccgccgcccgccggcgcgggacggcatcaggtggccgacccgccgagctacgccgtcacgggcaggctcctgctcgccacggcgggggcgttcgcgggcgtcctcctggcgctcgtcgcgctgcacctctacaacggctcccgccgccgccgcctcgccgctggccggcgccgcctgctccggagcctggccatctccggcgccggcgacgaccgcgacggcgccgcgccctcgccgcgcgggctcgaccccgcggtgctcgccgcgatacccgtggtcgcggtcggcgcgggcccgggcaccggcgccggcgcgggcggggactgcgcggtctgcctcgccgagctcgagcccggggagaaggcccgcgcgctgccgcgctgcggccaccgcttccacgtcgagtgcatcgacgcctggttccgcggcaacgccacgtgcccgctctgccgcgccaacgtcgtcgtcgtcgacgccgcgccgtccgcgcccgccgaggacggggcgccgctggaggtgcgcatggacgtagccggagacgccgcgggccatcgttccgtcgcgccgccgacgatggcgaggctggcgagcggcacggatcttggcaaggcgaggcaggtcttcgcttccgcccgcttcgccgcttccttctgagaggctcattcagctcgcactggacttgggaagcttcctctgtttttcctacacggatctgcgggacacctttgctccgttgtttgggagcgtcctgccacggtacatagatttgttggagatgctgcgtgtatcatgatttggtgtacgattttggcagatgaatataattttttggatctattgacgtaaaaaaaaaaaaaaaaaaaa

SEQ ID NO: 1864 - protein, 252 aa, Panicum virgatum
  misc_feature: Ceres CLONE 1770793
  misc_feature (1)..(42): Pfam Name: zf-C3HC4 Pfam Description: Zinc finger, C3HC4 type (RING finger)
MGAGEGNGPRPMAQDPKTPCNEGHVHVPLDNPLPKPPPAGAGRHQVADPPSYAVTGRLLLATAGAFAGVLLALVALHLYNGSRRRRLAAGRRRLLRSLAISGAGDDRDGAAPSPRGLDPAVLAAIPVVAVGAGPGTGAGAGGDCAVCLAELEPGEKARALPRCGHRFHVECIDAWFRGNATCPLCRANVVVVDAAPSAPAEDGAPLEVRMDVAGDAAGHRSVAPPTMARLASGTDLGKARQVFASARFAASF

SEQ ID NO: 1865 - DNA, 620 bp, Panicum virgatum
  misc_feature: Ceres CLONE 1770831
  misc_feature: Encodes the peptide sequence at SEQ ID NO. 1866
gcggagctgattcagctgagtgtgctcgatcatcaagcaatcaacaaagcctcccaattatcctttcatccgatcatcttccttcttccaagatgtcttgcagctgcggatcaagctgcaactgcggctccaactgcaagtgcggcaagatgtaccctgaccttgaggagaagagcagcggcggcgctcaggccaccgtcgtcctcggcgtggccccggagaagaaggccggccagttcgaggcggcggcggagtccggcgagaccgcccacgcctgcaagtgcggtaacagctgcagctgcgacccctgcaactgctgatttcgatggggaacgtcagaacacacctgcatgcatgctagctactacctactactctgcttgtgtgtgacttgatgattgaacaagaataaggatgagcctgagccatcatgtctcatgtatcggtttggctccggcctcatcaagcatgcatgcgtcgtctgcccctctgtgtgctttgcgtccgtcctgtgtctgtatgtgttgatcattgcaaagaaaccatgcaggcatacatctctgcatgtgtctctgtaatgatcggtccagagtgatgaatatataaaactggtttgcttc

SEQ ID NO: 1866 - protein, 75 aa, Panicum virgatum
  misc_feature: Ceres CLONE 1770831
  misc_feature (1)..(74): Pfam Name: Metallothio_2 Pfam Description: Metallothionein
MSCSCGSSCNCGSNCKCGKMYPDLEEKSSGGAQATVVLGVAPEKKAGQFEAAAESGETAHACKCGNSCSCDPCNC

SEQ ID NO: 1867 - DNA, 921 bp, Panicum virgatum
  misc_feature: Ceres CLONE 1770929
  misc_feature: Encodes the peptide sequence at SEQ ID NO. 1868
ggaggcttcgttataattttcttccaaagaaaaagctgcgttgttataagtacagcgtggggctcccctcggacaagcccccggccgtctccatccccagattccgagagcgctccacaggccaggacccatcgcgccgcggcacccccggcacgcaccgcctctcccatcccgcccggtcgcctcgccgccgctgctgccgagatggggttcgtgtccttcgtcgggagagtgctcttcgtcgccgccttcctcctctccgcctaccaggagtttaatgaatttggaactgatggtgggccagcagcaaaggcccttcagcccaagttcaatgtgtttgtcaaaaatatctcttcccacttgggagttgccgtgcctcatattgagttgaagcatgtaattgctgccacaattgcgctcaagggccttggaggtcttctttttatcttgagctgctctcttggtgcctatctcctgttgttgtaccttgctattgtcacccctattgtgcatgacttctacaactacgacatggagaaggcagaatttgcacagatctttgggaagttcacccaggatctggcactcattggagcacttctcttcttcctgggcatgaagaactccatcccgaagcggcagtccaagaagaaggctcccaaggcgaagacaaactaaggctctctagatagtattgttgcaactgtaggggcctcaggcggtgtcaggagacggtctattttgaagcaaagctgcgatgcgaaaccaatgccatcgagctgcgctttcatatgtatcagattccattttgcagggcacggcccgaacggtgtgagtggcggattaggcgactagattgtaccattatgtactcgtgattggtttgttggactaggttgccaaaaaaaaaaaaaaaaaaaa

SEQ ID NO: 1868 - protein, 157 aa, Panicum virgatum
  misc_feature: Ceres CLONE 1770929
  misc_feature: Great-hit functional homolog of the protein sequence given in SEQ ID NO 9700
  misc_feature: Useful for making plants with modulated nitrogen use efficiency
MGFVSFVGRVLFVAAFLLSAYQEFNEFGTDGGPAAKALQPKFNVFVKNISSHLGVAVPHIELKHVIAATIALKGLGGLLFILSCSLGAYLLLLYLAIVTPIVHDFYNYDMEKAEFAQIFGKFTQDLALIGALLFFLGMKNSIPKRQSKKKAPKAKTN

SEQ ID NO: 1869 - DNA, 887 bp, Panicum virgatum
  misc_feature: Ceres CLONE 1770934
  misc_feature: Encodes the peptide sequence at SEQ ID NO. 1870
cttctagagtactgggtcctagcctcgcccggggttgcactgcactgcacgccaccgcccaccggaggtcgccgcgagcagagaaccagagccaagcaaagctagcctagtagtagccatggcggaggaggcgtcgtccgcgccagcgccggccggggggaagatgacgatggtggcgggggtggacgagagcgaccacagcttttacgcgctgcagtgggcgctccagcacttcttcccgccggcccagccgcagcagcagcggtaccgcctcgtcgtcgtcaccgccaagccctccgccgcgtccgccgtcggcctcgccggcccgggcgcggcggaggtgctgccgttcgtggaggcggacctcaagcgcgtcgcgctgcacgtcgtcgacaaggccagggagctctgcgccgccgcgcaggtggccgacgccgagttcgaggcgctcgagggcgacgccaggaacgtcctctgcgacgccgtcgagaggcaccacgccgagatgctcgttgtcggcagccacggctacggtgccatcaaaagggctgttcttggaagcgtgagcgattactgcgcccaccatgcgcgctgcaccgtgatgatcgtgaagaagcccaagcccaagcactaagtacccatcgatgcggcgatctgactcgtcagtattccacaagcaaacatctctatatgtattgtcaagctgcatgtgtgtctgtttgtgcataagcagaagatcaacgagcttcaaataaccggttacttggtcgagtaaccggatatatgcaatcctactacttacggattgacatgtacaaaataattgctgtgcagcacctcaaaaataatgttattttttcttcacggaaaaaaaaaaaaaaaaaaaa

SEQ ID NO: 1870 - protein, 171 aa, Panicum virgatum
  misc_feature: Ceres CLONE 1770934
  misc_feature (1)..(150): Pfam Name: Usp Pfam Description: Universal stress protein family
MAEEASSAPAPAGGKMTMVAGVDESDHSFYALQWALQHFFPPAQPQQQRYRLVVVTAKPSAASAVGLAGPGAAEVLPFVEADLKRVALHVVDKARELCAAAQVADAEFEALEGDARNVLCDAVERHHAEMLVVGSHGYGAIKRAVLGSVSDYCAHHARCTVMIVKKPKPKH

SEQ ID NO: 1871 - DNA, 847 bp, Panicum virgatum
  misc_feature: Ceres CLONE 1770964
  misc_feature: Encodes the peptide sequence at SEQ ID NO. 1872
gagcagcagctccgagcctccgagcatacacgtacacttgaagctagaggcctagagcccacagcatctgctcgagactctgccagccaagagagtctcgaggatctagctagctaggctgcgaggatgtcgctggtaaggctgttggacacgctggccccggagtcgtggaggaaccccttcagcatcttcggcacggcggtggccgccgacgcgtggctggcgagcgacacctcggcgttcgccaacacctacatcgagagccgggacacggcgagcgcgtacgtgttcagcgcggcgctgccgcccggcgtgaagaaggaggaggtgagggtggaggtggacgagggcaacgtgctggtcatcaccggggagcgcagcgtccgccgggaggagcgcagcgacaggtggcaccacatcgagcgcagctgcgccacgttcctcggcaggttccacctgcccggggacgccgccgtggacggcgtcagggccgccatggacgccggcgtgctcacggtcaccgtgcccaaggtcggggccatcgccgccgccgccgagccgacgatagccgcggaggccggcccctgctgatctgacgcgccggcgcgcgcgctcgatcacgggcggcgcggcacgcccctgttgaatgagcagtaaggtctctcgtccgtaccgtctgaagcgtccctctcctctggtttggtattgcatacttttccgtgtgatggatctgcctgcacgcatgtaacaggaagaaaaaagcctgcctgcacggctgcaccatgtctgttctgtgctcgataaatgaagagcaaacctaagcagctaaaaaaaaaaaaaaaaaaaa

SEQ ID NO: 1872 - protein, 154 aa, Panicum virgatum
  misc_feature: Ceres CLONE 1770964
  misc_feature (1)..(102): Pfam Name: HSP20 Pfam Description: Hsp20/alpha crystallin family
MSLVRLLDTLAPESWRNPFSIFGTAVAADAWLASDTSAFANTYIESRDTASAYVFSAALPPGVKKEEVRVEVDEGNVLVITGERSVRREERSDRWHHIERSCATFLGRFHLPGDAAVDGVRAAMDAGVLTVTVPKVGAIAAAAEPTIAAEAGPC

SEQ ID NO: 1873 - DNA, 572 bp, Panicum virgatum
  misc_feature: Ceres CLONE 1771211
  misc_feature: Encodes the peptide sequence at SEQ ID NO. 1874
atatctagctacctacatacaaccaacacacacaattgccaacacacaattcgatcacaaccgtatccctaaccagccagctagtagcaatataataactaataatacgatgggccaccaccaccaccaccacgtcgagaacaaggaggccgaggccgccgccggcgacgaccggcggcgcaaggaggagatgaagcaccacaagcacatggagcagctcgcccagctcggtgccgccgccgcgggggcctacgccatgcacgagaaacacaaggccaacaaggaccccgaccacgcgcgctcgcaccggatgaagcaggagatcgccgccaccatcgccgccgccagcgcgggcttcgccatccacgagcaccacaagaagaaagaggccaagaagcacgggcggcaccaccattaattagctagatacatccgtctatatatgtgtttgtttgtccttcatacattcattatttctctttctcagattgtacgtataaacagtattgcgttgtattcgagttttgtaaattaatattagccctgtattgtgctactaactttgttttcat

SEQ ID NO: 1874 - protein, 102 aa, Panicum virgatum
  misc_feature: Ceres CLONE 1771211
  misc_feature (2)..(54): Pfam Name: ABA_WDS Pfam Description: ABA/WDS induced protein
MGHHHHHHVENKEAEAAAGDDRRRKEEMKHHKHMEQLAQLGAAAAGAYAMHEKHKANKDPDHARSHRMKQEIAATIAAASAGFAIHEHHKKKEAKKHGRHHH

SEQ ID NO: 1875 - DNA, 1121 bp, Panicum virgatum
  misc_feature: Ceres CLONE 1771239
  misc_feature: Encodes the peptide sequence at SEQ ID NO. 1876
gcgccgccgccaccggagagaagatggtcgggccaggcctctacaccgagatcggcaagaagacctgggatctgctgtacagggactaccagaccgaccacaagttcaccctcaccacctacacctccaatggcgtcgctatcacagctactagcacaaagaaagctgacctaatttttggtgagatccaatcacagataaagaacaagaacgtcaccatagatgtgaaagcaaactcaggatcaaatgtcattactacggttactgttgatgagattgctacaccaggactgaagactatcttgagctttgctgttcctgatcagagatctggaaagtttgagcttcagtacttgcatgatcatgctggggttaatgcaagcattggtctgactgccaatcctgtagtcaacctctccggctcctttggaaccaaggctgtggcagttggtgcagatatctcacttgataccgcatctgggagcttaaccaaatacaatgctggactgagcatcactcatgaagaccttatcgcatccctgaacctgaacaacaagggagacagcctaactgcagcttactaccacaatgttaacctattgactagcacagctgttggggcagagctgacccacagcttctcaaccaacgagaacaccctcacctttggcacccagcacgctctggatccactgaccgtcgtgaaggcccgcttcaacaattctggcaaggccagcgcgctgatccagcatgagtggaggccaaagtcactggtgaccatctcggctgaggttgacaccaagaccattgagaagagctcgaaggttgggatcgccgtggccctcaagccctgattgttttaccaagtccctttttctctttctaaagctcccagcgtgtacttatttcccagctgaaattgggaccaggtcggcttgggaaaacaaaaaactttgggttcccggcatcttttggtcgttgcagcctattgatttcatgaactgcgatgtttccttgaggattttttttgcagtcgccggtgtagcactctgttaaatgagcaaccttcacaataattcaagctcggtagaattctgaaccaaaaaaaaaaaaaaaaaaaa

SEQ ID NO: 1876 - protein, 276 aa, Panicum virgatum
  misc_feature: Ceres CLONE 1771239
  misc_feature: Great-hit functional homolog of the protein sequence given in SEQ ID NO 9562
  misc_feature: Useful for making plants with modulated drought sensitivity
MVGPGLYTEIGKKTWDLLYRDYQTDHKFTLTTYTSNGVAITATSTKKADLIFGEIQSQIKNKNVTIDVKANSGSNVITTVTVDEIATPGLKTILSFAVPDQRSGKFELQYLHDHAGVNASIGLTANPVVNLSGSFGTKAVAVGADISLDTASGSLTKYNAGLSITHEDLIASLNLNNKGDSLTAAYYHNVNLLTSTAVGAELTHSFSTNENTLTFGTQHALDPLTVVKARFNNSGKASALIQHEWRPKSLVTISAEVDTKTIEKSSKVGIAVALKP

SEQ ID NO: 1877 - DNA, 691 bp, Panicum virgatum
  misc_feature: Ceres CLONE 1771261
  misc_feature: Encodes the peptide sequence at SEQ ID NO. 1878
acagacccaaattatctcagagagttcgcacacacacccacaccatcaatagcctagcactagcagccggccggccgcccagtttgctccggcgacgacatggccgccaccgccaccaccagggcatcgtcgtcgctgctggccgccgccctcctggtggccgccgtcgccgtgtcggcggcggcggtgtgcaacatgagcaacgagcagttcatgtcgtgccagccggcggcggcgaaggcgacggacccgcccgcgccgccgtcgcgggcgtgctgcgacgcgctggccggcgccgacctggggtgcctgtgcgggtacaagaactcgccctggatgggcgtgtacaacatcgaccccgagcgcgccatggagctgccggccaagtgcggcctcgccacgcccgccaactgctgatctgatctgagaggtcgatcgatctcgatcagagcttaattgttagcttgttcgttgcctcgtcctcgtgtgtgtcctcgatcgtgttcttcttgactcgtcgtgatgtgctctcgtgtgtacgtgggttgcgtcgtcggtgtgtgctttttgtgtgtgtgtgtgtcgtcgtatatatctatccatgtgctctccctcgtagctttatatatatgactgtgtggttttcctttcaaaaaaaaacgttgtggtttaaaaaaaaaaaaaaaaaaaa

SEQ ID NO: 1878 - protein, 105 aa, Panicum virgatum
  misc_feature: Ceres CLONE 1771261
  misc_feature (1)..(75): Pfam Name: Tryp_alpha_amyl Pfam Description: Protease inhibitor/seed storage/LTP family
MAATATTRASSSLLAAALLVAAVAVSAAAVCNMSNEQFMSCQPAAAKATDPPAPPSRACCDALAGADLGCLCGYKNSPWMGVYNIDPERAMELPAKCGLATPANC

SEQ ID NO: 1879 - DNA, 791 bp, Panicum virgatum
  misc_feature: Ceres CLONE 1771297
  misc_feature: Encodes the peptide sequence at SEQ ID NO. 1880
agatctccacaccacccgtcgcaagacaatcccccctctaccttctcgacccaatcccaagctcccacccatccggccatgtcgagacccctcctcctctttgccgccctcgccgtcgccgtcgccgcccccgccgtcgccgcccccgcccgcgtggggatgccgggcgggtggagcgcgatcccggacgtgagcgacccgcacatccaggagctgggcgggtgggcactggggcaggcgaagcggacgcggctggccggcgaggggctgcagttccgccgcgtggtgcgcggggagcagcaggtggtgtccgggatgaactaccgcctctacgtcgacgccgcggacgccgcggggcggagcgcgccctacgtcgccgtcgtgtacgagcaggtctggaccagcacccgcgagctcacctccttcagcaaggcgccccgcgccaactgaatcgtccgtccatgccatgatccaccccggtgaccccggatcggcggccgacgacgccggcgtcagcgccctctctttctctcctccatgttaattagtaattacatctagcgaacattactgctgctagtatatgctgccagtgaatgagtactgcgttttactactagttgctgttgtggggttaatctgtgacccagctatgtggatgaacatgcgcgtaatcgatcgaggctgtgtgctagaagtagaactatactgctggacttgtactataatgatgtaatcaagagtttgtgtgcctgtgttggctcttgtgtcaaaaaaaaaaaaaaaaaaaa

SEQ ID NO: 1880 - protein, 123 aa, Panicum virgatum
  misc_feature: Ceres CLONE 1771297
  misc_feature: Great-hit functional homolog of the protein sequence given in SEQ ID NO 9645
  misc_feature: Useful for making plants with modulated salt sensitivity
MSRPLLLFAALAVAVAAPAVAAPARVGMPGGWSAIPDVSDPHIQELGGWALGQAKRTRLAGEGLQFRRVVRGEQQVVSGMNYRLYVDAADAAGRSAPYVAVVYEQVWTSTRELTSFSKAPRAN

SEQ ID NO: 1881 - DNA, 882 bp, Panicum virgatum
  misc_feature: Ceres CLONE 1771592
  misc_feature: Encodes the peptide sequence at SEQ ID NO. 1882
gaggtaatgctacttgaccaaaaccccacggttctcggggtttcgatcgcctcactgtgctgctgctgcttcgcataatctgctctgctctccgattcctccggagcagctgcggttggatctcggatcggtgatcacattaacaatggtgaaggctgttgctgtgcttggtagcagcgagggtgtcaagggcaccatctacttcacccaagagggagatggccccaccactgtcaccggaagtgtctctggcctcaagcctggcttccatgggttccatgtgcatgcacttggtgacacaacaaatggctgcatgtcaactggaccgcattacaaccctgcgggcaaagagcatggagcaccagaagatgagaaccggcatgctggtgatctcggaaatgtcaccgccggagatgatggtgttgctaacttcactgttaccgacagccagatcccactgactgggccaaactcaatcattggcagagctgttgttgttcatgctgatcctgatgatcttggaaagggtgggcacgagctgagcaagagcactggaaacgctggtggccgtgttgcctgcgggatcatcggactccagagctgagagtgatcaccgaactcaagtgccgaaagtgtcgtcgtccccgctgtcaccactggaccagcctgagcatcctctggatatgtgaaataagagcgcctgatctataatcggcgtgtttgtgttctcgctcctgtagcacctaccgatgaactgaaacctgtgttggtgtaacgctgtttcacctggacctgtgtttcatacatttcgctttgagaacgcctggaccgatctgtggaaataagaaggcacttgttgcggaaaaaaaaaaaaaaaaaaaa

SEQ ID NO: 1882 - protein, 152 aa, Panicum virgatum
  misc_feature: Ceres CLONE 1771592
  misc_feature (1)..(150): Pfam Name: Sod_Cu Pfam Description: Copper/zinc superoxide dismutase (SODC)
  misc_feature (1)..(151): SWISSPROT Homolog: EC 1.15.1.1 Superoxide dismutase [Cu-Zn] 4A
  misc_feature (1)..(151): SWISSPROT Homolog: EC 1.15.1.1 Superoxide dismutase [Cu-Zn] 4AP
MVKAVAVLGSSEGVKGTIYFTQEGDGPTTVTGSVSGLKPGFHGFHVHALGDTTNGCMSTGPHYNPAGKEHGAPEDENRHAGDLGNVTAGDDGVANFTVTDSQIPLTGPNSIIGRAVVVHADPDDLGKGGHELSKSTGNAGGRVACGIIGLQS

SEQ ID NO: 1883 - DNA, 627 bp, Panicum virgatum
  misc_feature: Ceres CLONE 1771593
  misc_feature: Encodes the peptide sequence at SEQ ID NO. 1884
agcatcatacagatagcccaagcacgaacgatcgagctcgtcccaaacaagtagagtaactcgccactgatccttgcaaaagagaaacaaccatgaagccccaggtgctgctcgtcgcggtggccgtcctcgccgtcctcgcagctctgcccctcgccgaaagcaaagggcacgggatcggggagcacgcgacggcgagcgcgtggccgtgctgcgacacctgcggctcgtgcaccaggtccatcccgccgcagtgcctgtgcgaggacgaggcgccaggcgggtgccacccggagtgcaggaactgcgtcaagtccaccgacggcggcagcgacgtcttccgctgcgccgaccgcatcaccaacttctgcaagcgccgctgcacgccggccgcgtccgcgtgattggttggacgccgggatcctgctctgctgtcacctgaataataccatgccggcagctgccgatcgattagctccggcctgcctttggtttcagtcttccagtgttccctctgcatcctgctctggatggggagaagaaatcagttgtgttttttttttctaatgtctggtctggactcatggatttcttactgtttgtcgaataaagacccgtgttccacgc

SEQ ID NO: 1884 - protein, 103 aa, Panicum virgatum
  misc_feature: Ceres CLONE 1771593
  misc_feature (1)..(27): Pfam Name: Bowman-Birk_leg Pfam Description: Bowman-Birk serine protease inhibitor family
MKPQVLLVAVAVLAVLAALPLAESKGHGIGEHATASAWPCCDTCGSCTRSIPPQCLCEDEAPGGCHPECRNCVKSTDGGSDVFRCADRITNFCKRRCTPAASA

SEQ ID NO: 1885 - DNA, 854 bp, Panicum virgatum
  misc_feature: Ceres CLONE 1771630
  misc_feature: Encodes the peptide sequence at SEQ ID NO. 1886
agcgctttccgatcgagctcattctgcctgccccccgccgcgtctacgggagagcaggtgggtaagcgaggctgccagcgacagtgagagaaccgcaggccgcgcgacaagaggggttttgatccgagtccgatggccggcgccggggcggacggggagcgccggatcggcgtggcgatggactactcggacagctccaagaaggcgctggggtgggccgtcgacaacctgctccgccgcggggacaccctcgtcgtcgtccacgtcctgcaccacggcggggaggagaccaagcacgcgctctgggccaagtccggatccccgctgatccccctctccgagttccgggagcccgaggtgatgaagaactacggcgtgaaggccgacgccgaggtgctcgacatgatcgacacggcggcgcgccagaagcagctcaaggtggtggccaagctgtactggggcgacgccagggagaagctctgcgacggcgtcgaggagctcaagatcgactccctcgtcatgggcagccgcggcctcggcccgatcgagaggatcctgctgggaagtgtgacaaactacgtgctgtcgcacgcatcgtgccctgtgacagttgtcaaggggaagtaaggaccgggccagcctacagcgatatgattgaggatggtagcatgcagtttgtgagggttactgcattcgaataaagtgtggctttttattatttgtgatgctgcagcttccagaaaccctgtcgatctctagtctgtgaacgctagatgctaatgtgctcacctgcgtgcatcccttcttaattattcagatcgaatttgaggtttcaaaaaaaaaaaaaaaaaaaa

SEQ ID NO: 1886 - protein, 164 aa, Panicum virgatum
  misc_feature: Ceres CLONE 1771630
  misc_feature (1)..(154): Pfam Name: Usp Pfam Description: Universal stress protein family
MAGAGADGERRIGVAMDYSDSSKKALGWAVDNLLRRGDTLVVVHVLHHGGEETKHALWAKSGSPLIPLSEFREPEVMKNYGVKADAEVLDMIDTAARQKQLKVVAKLYWGDAREKLCDGVEELKIDSLVMGSRGLGPIERILLGSVTNYVLSHASCPVTVVKGK

SEQ ID NO: 1887 - DNA, 1005 bp, Panicum virgatum
  misc_feature: Ceres CLONE 1771639
  misc_feature: Encodes the peptide sequence at SEQ ID NO. 1888
aacccagatcattcgttcggaccgacatccctccatctccgttcgagaccgccgccggcaaccgattccgccagatttgagtcgacaatgaatcccgagtatgactaccttttcaagcttttgcttattggtgattctggtgttgggaagtcttgcttgcttctcagatttgcggatgattcatatctggacagctacatcagcacaatcggagttgattttaaaattcggacagtagagcaagatgggaagaccataaagcttcaaatctgggatactgctgggcaagagcgtttcaggacaatcactagcagttactaccgaggagctcatggaatcattattgtatatgatgttacagaccaagatagcttcaacaacgtgaagcagtggttgaacgaaattgaccgttatgcaagcgacaatgttaacaagcttcttgttgggaacaagagtgatctaactgccaacaaagttgtggcaactgagacagcgaaggcgtttgctgacgagatgggcatcccattcatggagacgagtgcaaaaaacgccatcaatgtcgagcaggctttcatggctatggccgcatccatcaaggacaggatggccagccaaccagccgcgtcaaacgcaaggccagcgaccgtgcagattcgcgggcagcctgtcaaccagaagacgtcatgctgctcgtcctaagatcacctgatttttttggttccctgtaaacgacacgctattacttaccgttcgctcattttgcgaaaaatgtatttgcattatttgttcagcaaacgcccttgctgatagcatctgttcgttggtcagatgattagagagctgcagatgtgtaagaacaccgttgtagagagaggacctgcagttctctctcaacctaaggagcaaacagcagcaatttcattaccttcattcttttctaccttacaaccacactgtttataaatcacgcgttgcatttgtgaacaaaaaaaaaaaaaaaaaaaa

SEQ ID NO: 1888 - protein, 203 aa, Panicum virgatum
  misc_feature: Ceres CLONE 1771639
  misc_feature: Great-hit functional homolog of the protein sequence given in SEQ ID NO 9286
  misc_feature: Useful for making plants with altered Lignin content
MNPEYDYLFKLLLIGDSGVGKSCLLLRFADDSYLDSYISTIGVDFKIRTVEQDGKTIKLQIWDTAGQERFRTITSSYYRGAHGIIIVYDVTDQDSFNNVKQWLNEIDRYASDNVNKLLVGNKSDLTANKVVATETAKAFADEMGIPFMETSAKNAINVEQAFMAMAASIKDRMASQPAASNARPATVQIRGQPVNQKTSCCSS

SEQ ID NO: 1889 - DNA, 952 bp, Panicum virgatum
  misc_feature: Ceres CLONE 1771756
  misc_feature: Encodes the peptide sequence at SEQ ID NO. 1890
agagaccttgaggcaccagctatggctggaggagatgagctgacgctgcttggcttctgggggagcccgttcgttctgcgagtgagactagctctcagcttcatgggtctgagctaccagtacctcgaggaggacctcaagaacaagagcgacctcctcctcagctccaacccggtgcacaagaaggtccccgtgctcatccacaacggcaagcccatctgcgagacccagatcatccttcagtacctcgacgaggtttatggtggcaacagttgtccctccctcctccctgctgacccgtacgaccgtgccatggctcgcttctgggctgcttacatcgacgacaagctgctgagctcgtttctgatgacgagcactgggaagacggacgaggaaagggcggaggggaggaggcaatcgtctgccgctgcggaggtcctcgagggggcactcaaggagtgctccaaggggaggccattcttcggaggcgatagcgtcggctacgtcgacatcgtgctcggaggcttcgtcccatggctgcgcctgatcgaccgctctacgggctcgaagcagtttgatgccggcaagaccccgctcctagcatcgtggctggagcacttcggctcgttggacgccgccaaagctgtcatgccggacttggagaggctggttgcgctcagcaagatgaatcaggcctagtaaacagcaaggaaactgaagttgcagagggtgtgggtatttgctgcttgcagtacacgattgctgttcgagggaaaaaaatgaagaatttatcattgcgcgtatacagaaaaaaaatcgagttttttttatacattttctcgtactaattacattgtcggtggttcccctaatgaaccgttgtatgcactattagttttctttcatgtcagcgtgatcctcctgtcccactcaaaaaaaaaaaaaaaaaaaa

SEQ ID NO: 1890 - protein, 225 aa, Panicum virgatum
  misc_feature: Ceres CLONE 1771756
  misc_feature (1)..(74): Pfam Name: GST_N Pfam Description: Glutathione S-transferase, N-terminal domain
  misc_feature (1)..(104): Pfam Name: GST_C Pfam Description: Glutathione S-transferase, C-terminal domain
MAGGDELTLLGFWGSPFVLRVRLALSFMGLSYQYLEEDLKNKSDLLLSSNPVHKKVPVLIHNGKPICETQIILQYLDEVYGGNSCPSLLPADPYDRAMARFWAAYIDDKLLSSFLMTSTGKTDEERAEGRRQSSAAAEVLEGALKECSKGRPFFGGDSVGYVDIVLGGFVPWLRLIDRSTGSKQFDAGKTPLLASWLEHFGSLDAAKAVMPDLERLVALSKMNQA

SEQ ID NO: 1891 - DNA, 887 bp, Panicum virgatum
  misc_feature: Ceres CLONE 1771792
  misc_feature: Encodes the peptide sequence at SEQ ID NO. 1892
accaagaccaacaggttagcttcattagctgtgcagtttcagacgttcagataaattaggcacacttcatctgaagaactagtcaggaactagtgcaaggacccaagatcgatggcgctgcggagaatcatcaaggagctcaaggacctgcagagggatccaccgacgtcctgcagcgcagggcccgtgtctgatgacatgttccactggcaagcgacgatcatgggcccgagcgacagcccctactctggaggcgtgttcctggtcaccatccacttccctccagattacccgttcaagccacccaaggtggtgttcaagacgaaggtgttccacccgaacatcaacagcaacggcaacatctgcctggacatcctcaaggatcagtggagcccggcgctgaccatctccaaggtgctgctctccatctgctcgctgctgacggacccaaacccggacgacccgctggtgccggagatcgcgcacatgtgcaagaccgaccgcctcaggtatgagtccacggcaaggggatggacgcacaagtacgccatgggctaggcctgaagcttttagcaggcagcaggggccaagatcgtgaatgtacccaacatcaatgaacaataagtttttgctctagttcaggatataacaggcctagagtttttttttctttttcttttgggaaccataacaggcctagagttgggagatctccgccgcgcataaaatcagcttcctccttcctcacacgaaggatgatagctaggaacaatcatatttgcagttttgattgatggccgtttcatgtctgaaaatccaatgctaaggatatgtacttgaatcacaatggtgaactagattttctataaaaaaaaaaaaaaaaaaaa

SEQ ID NO: 1892 - protein, 148 aa, Panicum virgatum
  misc_feature: Ceres CLONE 1771792
  misc_feature: Great-hit functional homolog of the protein sequence given in SEQ ID NO 9309
  misc_feature (1)..(148): SWISSPROT Homolog: EC 6.3.2.19 Ubiquitin-conjugating enzyme E2-17 kDa 10/12
  misc_feature (1)..(148): SWISSPROT Homolog: EC 6.3.2.19 Ubiquitin-conjugating enzyme E2-17 kDa 8
  misc_feature: Useful for biocontainment applications
  misc_feature: The plant produces a reduced number of seeds.
MALRRIIKELKDLQRDPPTSCSAGPVSDDMFHWQATIMGPSDSPYSGGVFLVTIHFPPDYPFKPPKVVFKTKVFHPNINSNGNICLDILKDQWSPALTISKVLLSICSLLTDPNPDDPLVPEIAHMCKTDRLRYESTARGWTHKYAMG

SEQ ID NO: 1893 - DNA, 911 bp, Panicum virgatum
  misc_feature: Ceres CLONE 1771823
  misc_feature: Encodes the peptide sequence at SEQ ID NO. 1894
atcgaaaatcgtatgcataatggagttctcttggacaaagcagccctaacctcccttccaagacaagagcgccgctacaacaccaggaccagggctgcccctcctctcctcccccaatagccgcctctcccccccaagtcgtgccctctcctcggatctctccgtccgcccccttcctccaactcgtcggcctcaaccaaaagatccccatggcggcgctagggtcgaagctggcgcagctgcagtccaaggcgtgcgaggcgacgaggttcgtggccaagcacggctgcgcgtaccacaagacgctcatggagaagaacaagcaccacgtcgtcgacccgcccaccatccagaagtgccaggagctctccaggcagctcttctacacccgcctcgcaagccttcctggtcgttacgaggcattctggaaggagcttgatagcgcgaagctattgtggaaaaacagaaacaacctgaaggttgaggatgctggcgtcgcggcgttgtttggcatcgagttgtatgcttggtcctgccttggtgagatcgtcgggagaggattcactcttacgggctaccatgtctgaagccttacctctagcatgaacaaccacattagtccacatttgccgacgaatactgtgtcggtggtcagttttactctgacatgaatcgcgtgatgcaaagttttgttattcttctcaaatactcttgaagccttgatgccgtagaactacattgatctcggtggaacgagaaatggtgagctaataatttgctgttatccggcccttttgtgcgccaggtctagcatatgcttgtgtaactgggcatgagattggtatgtcataaactcatttgcttatgatttgcttatatacgcaatgctataaaaaaaaaaaaaaaaaaaa

SEQ ID NO: 1894 - protein, 125 aa, Panicum virgatum
  misc_feature: Ceres CLONE 1771823
  misc_feature (1)..(115): Pfam Name: ATP-synt_G Pfam Description: Mitochondrial ATP synthase g subunit
MAALGSKLAQLQSKACEATRFVAKHGCAYHKTLMEKNKHHVVDPPTIQKCQELSRQLFYTRLASLPGRYEAFWKELDSAKLLWKNRNNLKVEDAGVAALFGIELYAWSCLGEIVGRGFTLTGYHV

SEQ ID NO: 1895 - DNA, 883 bp, Panicum virgatum
  misc_feature: Ceres CLONE 1771837
  misc_feature: Encodes the peptide sequence at SEQ ID NO. 1896
ataactgatgctgggatacaagcgtcagagaacacttcctcgagctcagtgctatcctaaactactgaagaaatggcaagcctgcagaatctgatttgctccgtatctaaacaactggttgcgccaaattttgcggtgactgccaaactgaatggggcttctcactctgttgtcccagcaagctcaagcggagcatcttcgcatgaaaagaatgtcacgaaaaggcagttagctttgcttggtgctggagcattagccaccggcctactgaagacaagctccgcatttgctgaagaagtacctaagaattacaagtcttacgtggatgcaaaagatggatattcgtatctttatccagccgagtggagggatttcgacttcttgggtcatgattcagcattcaaagatcgtaatctggctcttcagtgtgtccgtgtggggtttattcctactgataaaacagatattcgcgacctaggaccaatggatgaggccatcttcaatttggtaaacaacgtttacgctgccccaaatcaaaaaccgtcgatctatgacatgcaagagcgcacggtggacggcaagaactactggacgttcgagtacgatctggaggctccgggctacggcgtatccgcgttcgcgacagtcgccattggaaacggtcggtactacacgctgatcgtgaccgcgaacgaacgccggtggagcaggctccggaacaggctcaaagtcgtcgcggactctttcaagatctccgacctgaccgcgtgaccgccagcgttctcgttaactgtaatggacggtctcattcagtcatggtatatatacttacgcgcgccataatcgtgcgtgtttcatttgctaaaaaaaaaaaaaaaaaaaa

SEQ ID NO: 1896 - protein, 232 aa, Panicum virgatum
  misc_feature: Ceres CLONE 1771837
  misc_feature: Great-hit functional homolog of the protein sequence given in SEQ ID NO 9256
  misc_feature: Useful for making plants with modulated salt sensitivity
MASLQNLICSVSKQLVAPNFAVTAKLNGASHSVVPASSSGASSHEKNVTKRQLALLGAGALATGLLKTSSAFAEEVPKNYKSYVDAKDGYSYLYPAEWRDFDFLGHDSAFKDRNLALQCVRVGFIPTDKTDIRDLGPMDEAIFNLVNNVYAAPNQKPSIYDMQERTVDGKNYWTFEYDLEAPGYGVSAFATVAIGNGRYYTLIVTANERRWSRLRNRLKVVADSFKISDLTA

SEQ ID NO: 1897 - DNA, 895 bp, Panicum virgatum
  misc_feature: Ceres CLONE 1771840
  misc_feature: Encodes the peptide sequence at SEQ ID NO. 1898
aagcaagcaatcacatctactactactagtcaaagcattttatgagaagctcgctcgatcttctagctcgcctacatttcctcctcaactctttcaacaagttcccgtagaagatcacctttctgctcgatggaccgggtgacgaagctggcttctcagcgtgaggtggtgatcttcagcatgagctcctgctgcatgtgccacacggtgacgcgcctgttccgcgagctcggggtgaacccgacggtggtggagctagacgaggacccgcgggggaaggagatggagaaggcgctggcgaggctgctgggccgcagccccgccgtgccggcggtgttcctcggtggcaggctcgtcggctccaccgacaaggtcatgtcgctccaccttggcggcaacctcgtccggctgctgcgcaatgccggctcgctctgggtgtagcctggcgctggctgctctgggtcacctcacacactggagaataactgaagtgtgtgctttttatcaggagacggaggaaagtaactgagcaggccttttttctgcactgtaataatctatagaggggtgagtgttggatcagggcctttcgtgctctaacgacgcatgttttgatatgttctgcatctttttgtcgtccgtatcgaaagtttcgtcagagttagcagtttgatgtggaaaatagtatgaaactgcatactaaagtgccagagctaggattcctccgcacacaccttaattgtagcagtttattctacgccaataactactgctagactgaacagaattactattaaacttgtacagtagctcagtaatcgagacgatctattactactgaacattgatcagtaacttaataaatttagttcagtaaaaaaaaaaaaaaaaaaaa

SEQ ID NO: 1898 - protein, 103 aa, Panicum virgatum
  misc_feature: Ceres CLONE 1771840
  misc_feature (1)..(64): Pfam Name: Glutaredoxin Pfam Description: Glutaredoxin
MDRVTKLASQREVVIFSMSSCCMCHTVTRLFRELGVNPTVVELDEDPRGKEMEKALARLLGRSPAVPAVFLGGRLVGSTDKVMSLHLGGNLVRLLRNAGSLWV

SEQ ID NO: 1899 - DNA, 696 bp, Panicum virgatum
  misc_feature: Ceres CLONE 1771872
  misc_feature: Encodes the peptide sequence at SEQ ID NO. 1900
tagcgggagcaccaccaccaagcaactcgcagggcagccaggggagaggagaagcaccttccttcctcgccgcgatcgccctccgcccagcgcgaatggcgaatgcagcgtcagggatggccgtggacgacgagtgcaagctccggttcctggagttaaaggccaagaggacccatcgcttcatcatctacaagattgacgagaagaagaagatggtcgtggtagagaaggtcggcgagcccgtgctgaactacgatgatttcgctgcgaccctccctgcaaatgagtgcagatatgcaatcttcgactacgattttgtgactgaggagaactgccagaagagcaagattttcttcatcgcgtggtcccctgatacagcgcgtgtgaggagcaagatgatctacgcgagctccaaggagaggttcaagagggagctggacggcatccaggtggagcttcaggctaccgattccgccgaggttggtcttgacgtgatccaaggccgtgcaaactgatcatggccaataaccaactgcatctgcctgagtatgaacatcagacgaggacttagtgctcccctgaggcaaaggctgcctgtcatgtgctacttacgggactatgtaaactacatccattgcagccataaatctatctgttcggcgtgcttgttcgtcagaaaaaaaaaaaaaaaaaaaa

SEQ ID NO: 1900 - protein, 139 aa, Panicum virgatum
  misc_feature: Ceres CLONE 1771872
  misc_feature: Great-hit functional homolog of the protein sequence given in SEQ ID NO 9722
  misc_feature: Useful for making plants with modulated time to senescence
  misc_feature: The plant senesces significantly late compared to wild-type.
MANAASGMAVDDECKLRFLELKAKRTHRFIIYKIDEKKKMVVVEKVGEPVLNYDDFAATLPANECRYAIFDYDFVTEENCQKSKIFFIAWSPDTARVRSKMIYASSKERFKRELDGIQVELQATDSAEVGLDVIQGRAN

SEQ ID NO: 1901 - DNA, 633 bp, Panicum virgatum
  misc_feature: Ceres CLONE 1771894
  misc_feature: Encodes the peptide sequence at SEQ ID NO. 1902
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
tgctccatcaccaagcaaagcaacctcgctcgctctcccaatcatccttatcagatcatctttccaagatgtcttgcagctgcggatcaagctgcaactgcccctccagctgcaagtgcggcaagatgtaccctgaccttgaggagaagagcagcggcggtgctcaggccaccgtcgtcctcggcctggccccggaccccaacgccggccacttcgaggcggcggcggagtccggtgagaccgcccacgcctgcaagtgcggcaacagctgcacctgcgacccctgcaactgctgatttggatggggaacgtacacacctgcgtgcatgttttttactgcctactctgcttgtgtgtgacttgattgaacaagaataaggatgtttttttttccccccccccgnnnannngggttggctccggcctcagggggggggggggcgtcgtctgcccttatgtgtgctttgctacctccttattaccttgtgcttggcgtcagtcatgtatctgtatgtgtctgtatgtgttgatcattgcaaataaaccatgcaggcatgatgcatctctgcatgtgtctctgtaatgatcggtccagagtgatgaatatataaaactggtttgctttacctgcct

SEQ ID NO: 1902 - protein, 75 aa, Panicum virgatum
  misc_feature: Ceres CLONE 1771894
  misc_feature (1)..(73): Pfam Name: Metallothio_2 Pfam Description: Metallothionein
MSCSCGSSCNCPSSCKCGKMYPDLEEKSSGGAQATVVLGLAPDPNAGHFEAAAESGETAHACKCGNSCTCDPCNC

SEQ ID NO: 1903 - DNA, 874 bp, Panicum virgatum
  misc_feature: Ceres CLONE 1771944
  misc_feature: Encodes the peptide sequence at SEQ ID NO. 1904
aaaacttcacaaccgcgtcacgactcgcgagccgggcgaactagctatcccagcggggtctgtgtgtgagacagtgggacagggcgagcaagcgcaggagcgatgaaggtgctggtggcggtggacgacagcgacttcagccgccacgcgctggcctgggtgctcgaccacctcttcttcccgtccccggccgccgccgaccagccgccggcggcggagcctcgtcggcccgagctggtgctcgtccacgccctggagccgctccggcacgtcatgtacccggtcgggccagggtcggcggtgtacggcgcgccgtcgatggtggagtcggtgcgggcggcgcaggcggagaacgcgcgcggcttgctcgacagggccaagcggatctgccaccagcgaggggtgagcgcggaggcggtggtggtggaaggggagcccagggaggcgctgtgccgcgccgccgccgacatgggcgccgggctgctcgtcgtcggcagccgcggcctcggcgccatcaagagggcgttcctggggagcgtgagcgactactgcgcgcaccacgcgagctgcccgatcatagtcgtcaagccgcctcgcgacgacggccactgcgcccaccgggcggcgagctgatcgccggcgggagcaaagaaacatattgatcgcccaccagtcgacgacgctgccccgtgttgctcttctttcatgtcgaccgattcagatattctccaagcttaggatgtgaacgacgccgccaacaccttgatccttgatatgctgggatccatctttggttagacgatgtaaaaaaacaatcatgcactcggggtaagaaatgaatatgtgtaaatagcaaaaaaaaaaaaaaaaaaaa

SEQ ID NO: 1904 - protein, 176 aa, Panicum virgatum
  misc_feature: Ceres CLONE 1771944
  misc_feature (1)..(164): Pfam Name: Usp Pfam Description: Universal stress protein family
MKVLVAVDDSDFSRHALAWVLDHLFFPSPAAADQPPAAEPRRPELVLVHALEPLRHVMYPVGPGSAVYGAPSMVESVRAAQAENARGLLDRAKRICHQRGVSAEAVVVEGEPREALCRAAADMGAGLLVVGSRGLGAIKRAFLGSVSDYCAHHASCPIIVVKPPRDDGHCAHRAAS

SEQ ID NO: 1905 - DNA, 992 bp, Panicum virgatum
  misc_feature: Ceres CLONE 1771949
  misc_feature: Encodes the peptide sequence at SEQ ID NO. 1906
attcccccacacagcaccactgcaacacacacagcatttgcttaattagctaataagcacgaccctatcggtactaatggcggctttgatgatgaagaacaagaagcagatgccggcggtggtggcgttggccgttgtggtggcggcggcggcgctggtggcgtcggcgtcggcggccatcacgtgcgggcaggtgggttcggcgctggcgccgtgcatcccgtacgcgacggggaaggcgagcgcgctgccgtcgtcgtgctgcggcggcgtgcgcagcctcaacagcgcggcgcgcacgagctcggaccggcaggcggcatgccggtgcctcaagagcctggccagcaccgtcaagtcggtgaacatgggcaccgtcgccaccatccccggcaagtgcggcgtctccgtgccattccccatcagcatgtccactgactgcaacaagtacgtacagtactagcttctccatcatcaccatcatctatatatcgtcgtcttcttttttatttttatatatattaattatatcttttactgatctacttgtatacgtgcgtgcgtagggtcaactaataaattgtgcatcaatataataatcctaccatctgatgaggaagctcagctcgatccgctcagaagctagctgctagctagcgagctttcaggagaataaaataaagttgaggcatcatcagcagctaggggtggtaatgggccatggccctaatggcctcttcacagcccaataaagcccttaaaatttttagttcaaaaatacatatgtttagagcccggcccttttagggcccgatccttagattttctagttcaaaatgttgggccctttaccacccctatcagcagcacatcatctatatatattattgttgtactcgatctgtgtgtacgtgcgcgtacacatacatgcatgcttatacgatcgatgtatatatatgtgctgcttctctcaaaaaaaaaaaaaaaaaaaa

SEQ ID NO: 1906 - protein, 128 aa, Panicum virgatum
  misc_feature: Ceres CLONE 1771949
  misc_feature (1)..(86): Pfam Name: Tryp_alpha_amyl Pfam Description: Protease inhibitor/seed storage/LTP family
MAALMMKNKKQMPAVVALAVVVAAAALVASASAAITCGQVGSALAPCIPYATGKASALPSSCCGGVRSLNSAARTSSDRQAACRCLKSLASTVKSVNMGTVATIPGKCGVSVPFPISMSTDCNKYVQY

SEQ ID NO: 1907 - DNA, 811 bp, Panicum virgatum
  misc_feature: Ceres CLONE 1771974
  misc_feature: Encodes the peptide sequence at SEQ ID NO. 1908
gataagtagcacgccacagagagtgactgtgaaatggaggtcaggcgccggcgtgtctctcttctgctcctggcgatcttcgggtggtggtgtgcatgcttggtgggctgccgcgcgcagctcccggttccggcgaggacggacgggttcgtgtacgacgggaagccgccggcgtggggagagacggtggtggtagaggcgttcttcgacccggtctgccccgacagccgcgacgcgtggccggcgctcaaagaggccgtcgagcactacggctcccgcgtgtccgtcgtcgtgcacctcttcccgctcccttaccacagcaatgctttcgttgcttgccggtcaattcatacagtgaacaggctaaatccgtcgttcgtgtacccgctgcttgagaaattcttcaaataccaggaaggttattataatcagccaacctacaccaaatcaagagctgcagtagttgatgaaataaccaaaaaccttgtcgtgcccatcattggcgaaaccaatttgtccgcatacaaagcaggcttcaacaattcacagtctgatcaagctgcaaggatatctttcaagaacggttgtgcacgaggtgtggctgcgacaccctacttctttgtgaatggcataccaatcagcgattctggttcacctctcgagtacaagtattggatatccatccttgatccattggttggcaagatgtaaagatggagtttctccatctggcttggtcaaaaagtccaagctgaactaaataaaagtggaataagtaatgggatttttttaaaaaaaaaaaaaaaaaaaa

SEQ ID NO: 1908 - protein, 225 aa, Panicum virgatum
  misc_feature: Ceres CLONE 1771974
  misc_feature (1)..(159): Pfam Name: DSBA Pfam Description: DSBA-like thioredoxin domain
MEVRRRRVSLLLLAIFGWWCACLVGCRAQLPVPARTDGFVYDGKPPAWGETVVVEAFFDPVCPDSRDAWPALKEAVEHYGSRVSVVVHLFPLPYHSNAFVACRSIHTVNRLNPSFVYPLLEKFFKYQEGYYNQPTYTKSRAAVVDEITKNLVVPIIGETNLSAYKAGFNNSQSDQAARISFKNGCARGVAATPYFFVNGIPISDSGSPLEYKYWISILDPLVGKM

SEQ ID NO: 1909 - DNA, 931 bp, Panicum virgatum
  misc_feature: Ceres CLONE 1772041
  misc_feature: Encodes the peptide sequence at SEQ ID NO. 1910
gtgtgccacctccgtgtgccaagagcttcgagaagccgtcccccaaatccgcctacgcttccccctcctcctccacgaggtgaggaaaccctagcgaccgaccatggcgctgctcccgcgcacggcgcggctcgcgctcctctccaccccgcgggcgtactccgccgccgccgaggcgggcgcctcgaagacggccgagttcgtggtctccaaggtggacagcctgatgaactgggcgcgcaagggctcgatctggcccatgaccttcgggctcgcctgctgcgccgtggagatgatgcacgccggcgcggcccgctacgacttcgaccggttcggcgtcatcttccgcccctcgccgcgccagtctgattgcatgatcgtcgccggaacactcaccaacaagatggcgccagccctccgcaaggtttatgaccaaatgcctgaacctcgatgggttatctcgatgggcagctgtgctaatggtggtggatactaccactattcctactctgttgtccgcggatgcgaccgtattgttcccgttgacatctacgtccctggatgcccaccaaccgccgaggcactactgtacggtgtcctccagctccaaaagaagatcaacaggcgcaaggatttccttcactggtggaccaagtgaagcaattgtctgttgttgttgctcccgtgctatatttcttcgcatttgacctacttgtcatctgaaataaggacagcctcggtgcttggatttgcgaatttgttgttgtacctggaaggatgcatgcccaggttgtttgataagcatggaactcatgtacttaaaatcagttcaacagtaatggacataccagctgtgaatctgtatttttgctttccactgtaatgcgggagtatgccgtgtcttgtttgtgaaaaaaaaaaaaaaaaaaaa

SEQ ID NO: 1910 - protein, 184 aa, Panicum virgatum
  misc_feature: Ceres CLONE 1772041
  misc_feature (1)..(108): Pfam Name: Oxidored_q6 Pfam Description: NADH ubiquinone oxidoreductase, 20 Kd subunit
  misc_feature (2)..(184): SWISSPROT Homolog: EC 1.6.5.3 NADH-ubiquinone oxidoreductase 20 kDa subunit, mitochondrial precursor
MALLPRTARLALLSTPRAYSAAAEAGASKTAEFVVSKVDSLMNWARKGSIWPMTFGLACCAVEMMHAGAARYDFDRFGVIFRPSPRQSDCMIVAGTLTNKMAPALRKVYDQMPEPRWVISMGSCANGGGYYHYSYSVVRGCDRIVPVDIYVPGCPPTAEALLYGVLQLQKKINRRKDFLHWWTK

SEQ ID NO: 1911 - DNA, 512 bp, Panicum virgatum
  misc_feature: Ceres CLONE 1772058
  misc_feature: Encodes the peptide sequence at SEQ ID NO. 1912
aagcaggaagagccatccatcctccgcttcaacttgctcgccaagaagaaaacagcggcgatggcgaagcgtctgatcccgtcgctgaaccgggtgctggtggagaagctgctgcagcccaagaagagcgccggtggcatcctcctcccggagaccaccaagcagctgaatgctgccaaagtcatagctgttggcccaggtgatcgtgatagggatggaaagctgatccctgtatctttgagtgaaggtgacactgttctacttcctgagtacggtggaacagaagtgaagctcgctgagaaagagtaccttcttttcagagagcacgacatactgggaaagctagaggagtgatcctgggcttgtcaggatctgaaggatggagttgtgtttggaagtggagatgcatgagtgtagccacagctactcatttttacctttttgatgtctgtggaggacaaaaacaaagcccatccattgtttgagaattcgattgacctttgcctcgtccg

SEQ ID NO: 1912 - protein, 97 aa, Panicum virgatum
  misc_feature: Ceres CLONE 1772058
  misc_feature (1)..(93): Pfam Name: Cpn10 Pfam Description: Chaperonin 10 Kd subunit
MAKRLIPSLNRVLVEKLLQPKKSAGGILLPETTKQLNAAKVIAVGPGDRDRDGKLIPVSLSEGDTVLLPEYGGTEVKLAEKEYLLFREHDILGKLEE

SEQ ID NO: 1913 - DNA, 849 bp, Panicum virgatum
  misc_feature: Ceres CLONE 1772129
  misc_feature: Encodes the peptide sequence at SEQ ID NO. 1914
atactgcccaggaagccaagagccatccagccacccactaccaccagaccaggaccagcagcactccaaacaaagagcggagcgagctagctagcagctgatcggatggctccgagatccgcggcggcgctcctcctcgcggcggcgctgctgctctcgtcggcgggcgtcgccgtcgtccgcgggcagcagcagggcaacccgtgcccgacgaacgcgctggcggacctcaaggtgtgcgccgacgtgctcgtcctgctcaagctcaagatcaacgtgccgccgacccagcagtgctgcccgctgctggggaacctcgtcaacctcgacctggccgcctgcctctgcgccgctatcaggctcaacgtcctcggcatccccgtgaacctgccgctcgacgtgccactcgtgctcaactactgcggccggaacgcctcggccgtgccgggctccaactgctcctaagttaatttgtgttagtatagccgccggctggtcctgtggatcggatggatggatggatgctccatggcttcgggtttatggatgctccatggcttcaggtttatgcatgccactgacaagtgtgtgtgttttagggcttgggtgattggatgcgtatgtaggttagctatgcgtcgatgtagctgtcgctatatatatctatgcgtgtttatatatttgtatctacggcatatattgtaagtatgttatgttatttgtgtatcttcatttcaagcatttatatgtgtgacatgatgtacttgtatgtgcgaatgtacggaatatcatgtaccatatatagtgaagtactatgctatttatatgtaaaaaaaaaaaaaaaaaaaa

SEQ ID NO: 1914 - protein, 119 aa, Panicum virgatum
  misc_feature: Ceres CLONE 1772129
  misc_feature (1)..(84): Pfam Name: Tryp_alpha_amyl Pfam Description: Protease inhibitor/seed storage/LTP family
MAPRSAAALLLAAALLLSSAGVAVVRGQQQGNPCPTNALADLKVCADVLVLLKLKINVPPTQQCCPLLGNLVNLDLAACLCAAIRLNVLGIPVNLPLDVPLVLNYCGRNASAVPGSNCS

SEQ ID NO: 1915 - DNA, 902 bp, Panicum virgatum
  misc_feature: Ceres CLONE 1772243
  misc_feature: Encodes the peptide sequence at SEQ ID NO. 1916
aaaggaaaaattccacccctttcttccatctcagctcctccgagcgagacaagctcccgattcgatcggccgcaccccgttttctattcttctctgattcgatcggcggaggcgggggcggcctgggcgggggacgagggagatgaggaagcgcgagcgcgagaacccgtgcgggatctgcggccactaccacaagtacgaggagggggaggtgtgcggcgtctgcggccaccgcccgcccgcggcgccggcggcgggggcgaggcagcaggactccgcgttcccgtcggagatcctcaaggagttcctcttcctcggcagctacgacaacgcctcccgctccgagctcctcaagaccatcggggtctcgcacatcctcaatactgtaccattatgccaaaacctgtaccggaattcattcacttaccactgccttcaagaggacaaaactctgcagtttgatgacgcaatccagtttctagaacaatgtgagagggagaaagcacgtgtccttgtgcattgcatgtcagggaaaagtaggtcggccgcatttgttatagccttcttgatgaaatcaaggggttggagactggcacagtcttttcagtgggtcaaagaacggagaccacaagtacacctatctgatggtaacttcataacttatgcatgccttttctgatatctttgttctcagaaacttctgaaaggaaaacttctgtacttacttacagttatgataaactctatgttccaaaaaattgttatgtcctgtactgcattgatatgcctacaggtgtgcatgtgagaggtggcctgatcttactctgtaattcacaaacacattcatgatttgctttagtgatggatgaggtcacaagggataaaaaaaaaaaaaaaaaaaa

SEQ ID NO: 1916 - protein, 178 aa, Panicum virgatum
  misc_feature: Ceres CLONE 1772243
  misc_feature (1)..(122): Pfam Name: DSPc Pfam Description: Dual specificity phosphatase, catalytic domain
MRKRERENPCGICGHYHKYEEGEVCGVCGHRPPAAPAAGARQQDSAFPSEILKEFLFLGSYDNASRSELLKTIGVSHILNTVPLCQNLYRNSFTYHCLQEDKTLQFDDAIQFLEQCEREKARVLVHCMSGKSRSAAFVIAFLMKSRGWRLAQSFQWVKERRPQVHLSDGNFITYACLF

SEQ ID NO: 1917 - DNA, 553 bp, Panicum virgatum
  misc_feature: Ceres CLONE 1772296
  misc_feature: Encodes the peptide sequence at SEQ ID NO. 1918
ctccctcccctaatcaaaccaaacccctccagcccccctctcttttcttggtcgtcggcgcctcctctgctccgctcggtcgccgtggctgagcaactatcgccatggctgaaaaaggaagccccctgcctaagtttggggagtgggatgtcaacgaccctgcttcagctgagggatttactgtaatatttaacaaagctagagatgagaagaagactggaggaaattcacagggacaagatgagcaagataaaagtgaacagcaaccatctgggcaaggcttcgatgctcccaagaagaaatggttgtgctgctttcaacccagtgccgctgaatcctaaagttcccaagatagcgtctggatcgtggaagtgagctgtgcttccttgtcaaatttctgaagacattctgcgatatacagggagacatgttatcatgattctttttacagttgtgtgatgaaagatggtctgggaggcaagtaatgttactagtatgtctctggcatgtacattatttgcaacttatatatccgggtaaacatcggttgtgt

SEQ ID NO: 1918 - protein, 78 aa, Panicum virgatum
  misc_feature: Ceres CLONE 1772296
  misc_feature (3)..(74): Pfam Name: NOI Pfam Description: Nitrate-induced NOI protein
MAEKGSPLPKFGEWDVNDPASAEGFTVIFNKARDEKKTGGNSQGQDEQDKSEQQPSGQGFDAPKKKWLCCFQPSAAES

SEQ ID NO: 1919 - DNA, 714 bp, Panicum virgatum
  misc_feature: Ceres CLONE 1772368
  misc_feature: Encodes the peptide sequence at SEQ ID NO. 1920
acacggcacaccgtcctcgcgtgggttcctcccaaacccccaaccacctccccggcgccgctcttcgtcgtccccccggccttataaatacgagccggaagggggcgcagatgggaatcacctcctcttcgtcctcgcgcccggaatccagagctatggcgctcgccaaggccaaggaaatcgtcgcctccgcgcccatcgtcgtcttcagcaagtcttactgccctttctgcgtccgtgtgaagcagctgttcgagaagctgggagcaagcttcaaggccattgagatggatgtggaaagtgatggacctgagctccaggatgctctcaaggaatggactggccagaggaccgtcccaaatgtcttcatcaatgggaagcatattggtggctgcgatgataccatggcactgaacaatgatgggaagctggtggctctgctaactgaggctggagcaatcgcgggttctacctccaagaaaaccgccactgcttagctaaacctgagagttgtcccggttgacatgtttatactgttcccatggtatgaaataagggggctatgcttcgcaggtcctgaactttgtgctgtcaaagtgtcaagtactatcatgactgtttagtccccctgttgaactgctcagacatcaatctgagttgcatgcctgtgcttaatagtaatgacttcctaatcaaaaaaaaaaaaaaaaaaaa

SEQ ID NO: 1920 - protein, 128 aa, Panicum virgatum
  misc_feature: Ceres CLONE 1772368
  misc_feature (1)..(63): Pfam Name: Glutaredoxin Pfam Description: Glutaredoxin
MGITSSSSSRPESRAMALAKAKEIVASAPIVVFSKSYCPFCVRVKQLFEKLGASFKAIEMDVESDGPELQDALKEWTGQRTVPNVFINGKHIGGCDDTMALNNDGKLVALLTEAGAIAGSTSKKTATA

SEQ ID NO: 1921 - DNA, 1028 bp, Panicum virgatum
  misc_feature: Ceres CLONE 1772395
  misc_feature: Encodes the peptide sequence at SEQ ID NO. 1922
gcttcccctgcttcgccactttccccttcaccgcttcctctcgggagtcgaaactcgaaaccctagccaaccagctcgatggcctgggcggtggctacggctgcggcgctggtggttgcggcggcggtgctgtcgccggcctccgtggcgtcggcgtccaacgcggagggcgacgcgctgtacgcgctgcggcgcgcgctcaaggacccccggggcgtgctgcagagctgggaccccaccctcgtcaacccctgcacctggttccacgtcacctgcaaccgcgacaaccgcgtcacccgcgtggatttgggtaactccaatttgtcaggcaatcttgttcctgaactggggcaccttgagcacttgcaatatctagaactctacaaaaacaatattcagggcactatcccagctgagcttgggaatctgaagagccttatcagcttggacctgtataacaacaacattacagggaacataccaagggaacttggcatgatgaaatctttagtattcctgcgacttaatgacaaccatttgacgggtccagttccaagggaactgacaaaaatctctagcctcaaagtgatagacgtctcaaacaatgatctttgcggcacaatcccaactagtgggccttttgagcacataccattgagcaactttgacaataatccaagaatggaaggcccggagttgcaagggcttgcaacgtatgacacaaactgctgaaatggcaagcagctctcgtcgctcacacaacatagatgtcagcagatcaaaactttatcggagcatcttgtagagaagcatgtctgatagcttgtagcagtgcttgctcgtaaaaagcagggtggcccctcgctgtgtagatagtatttattagtagcttgtagcactgttgagacctcttgcactgacggtccaatgtactgtaaatgtcacgtactgtatggttggttgatgaactggaaccgtggaaatatttagttgccattttcaccgtttaaaaaaaaaaaaaaaaaaaa

SEQ ID NO: 1922 - protein, 217 aa, Panicum virgatum
  misc_feature: Ceres CLONE 1772395
  misc_feature (26)..(198): SWISSPROT Homolog: EC 2.7.11.1 BRASSINOSTEROID INSENSITIVE 1- associated receptor kinase 1 precursor
MAWAVATAAALVVAAAVLSPASVASASNAEGDALYALRRALKDPRGVLQSWDPTLVNPCTWFHVTCNRDNRVTRVDLGNSNLSGNLVPELGHLEHLQYLELYKNNIQGTIPAELGNLKSLISLDLYNNNITGNIPRELGMMKSLVFLRLNDNHLTGPVPRELTKISSLKVIDVSNNDLCGTIPTSGPFEHIPLSNFDNNPRMEGPELQGLATYDTNC

SEQ ID NO: 1923 - DNA, 629 bp, Panicum virgatum
  misc_feature: Ceres CLONE 1772453
  misc_feature: Encodes the peptide sequence at SEQ ID NO. 1924
atcctctctccctccgatcagcagcagcacagccagagccagcaccagcacagcggcgagcggtccaccatccacagcttcaattcaaatcgcacggccatggcgtcgcagcagcagcagcagcagcagcggcaggcggcggcggcggcacccgtggggttcgaggactacctgccggtgatggcggagcggctgggcgaggaggggctgatgcgggagctggcgagcgggttccggctgctcatggacccggcccgcgggctcatcaccttcgacagcctccgccgcagcgcgccgctgctgggcctgggcgccatgtccgacggcgacctccgcgggatgctcgccgagggcgacttcgacggcgacggcgcgctcagcgagatggagttctgcgtgctcatgctccgcctcagccccgagctaatggacgggccccgcaggtggctcgacgacgccgtctcgcaggcctcgcacttcctcttcaccagctaggcgggctgcctgctggagacggccgcgcgcgtaggaattgttcgttgagcttctctttcttttcgttgttcatagctggattaggaattcgttcaaaaaaaatagctggattagaaaaaaaaaaaaaaaaaaaa

SEQ ID NO: 1924 - protein, 131 aa, Panicum virgatum
  misc_feature: Ceres CLONE 1772453
  misc_feature: Great-hit functional homolog of the protein sequence given in SEQ ID NO 9669
  misc_feature: Useful for making plants with altered glycerol content
MASQQQQQQQRQAAAAAPVGFEDYLPVMAERLGEEGLMRELASGFRLLMDPARGLITFDSLRRSAPLLGLGAMSDGDLRGMLAEGDFDGDGALSEMEFCVLMLRLSPELMDGPRRWLDDAVSQASHFLFTS

SEQ ID NO: 1925 - DNA, 907 bp, Panicum virgatum
  misc_feature: Ceres CLONE 1772484
  misc_feature: Encodes the peptide sequence at SEQ ID NO. 1926
gcgtcgctgagcaagaggcggagaagaaagcaagcactcgatcgacgacacaggtagagcaatggcgacctccctcccgggcgcgctcctcctcgcccgtgcccccccggcccctaccaccaggtgcagcctccggcgtagtggcgccgccgcacgggctgcagctccgcctcgctccgtggccgccaggaggagctcgctccgcgccgtcggcgtcaggtctgggggcgacgaggcgctgcgccccgaggtggaggcggcggcggtgccgcgctccgtgcccgtgcgcgtcgcctacgagctccaccaggctggccaccggtacctcgacgtcagaaccgaggccgagttcagcgctgggcatccccaaggagctgtaaatatcccctacatgaacaagaccggctcagggatgacgaaaaacacccactttcttgagcaagtatcgaggatctttggcaaggatgatgagatcatcgttggatgccaaagtggcaagaggtctctcatggcagcaactgagctctgctctgctggtttcactgctgtgaccgacatcgctggcggattttcttcatggagggataatggattgcctaccacccagtgatctgagcttgccagcaattatatcttactgaagcccagtttcctgtcaaggcggcctagctcaaggattgtacatattgttcttctcggcttagaaaataacagcactgaataaatggagcctgctaaacagagtagtagcagaacagattgggggtttgtgtactcctttcgatgatgcatttcacataaatgtaaatggccataccggagctgagcagtattgtgtttcagaatcacagcacgaaaacaagttcagcatacttcatctcttttgcaaaaaaaaaaaaaaaaaaaa

SEQ ID NO: 1926 - protein, 182 aa, Panicum virgatum
  misc_feature: Ceres CLONE 1772484
  misc_feature (65)..(180): SWISSPROT Homolog: EC 2.8.1.1 Thiosulfate sulfurtransferase
MATSLPGALLLARAPPAPTTRCSLRRSGAAARAAAPPRSVAARRSSLRAVGVRSGGDEALRPEVEAAAVPRSVPVRVAYELHQAGHRYLDVRTEAEFSAGHPQGAVNIPYMNKTGSGMTKNTHFLEQVSRIFGKDDEIIVGCQSGKRSLMAATELCSAGFTAVTDIAGGFSSWRDNGLPTTQ

SEQ ID NO: 1927 - DNA, 762 bp, Panicum virgatum
  misc_feature: Ceres CLONE 1772566
  misc_feature: Encodes the peptide sequence at SEQ ID NO. 1928
ctggctatagcctgctccctctccctctccctctctctctctagtctagtccaccaccaaccattatggcctccctctcctctgccgccgtcaccgccccttccttcgcggcttcccggcccgcccacgccgctgccaagcgctctgctgccttcaccgtgcgcgcctcgctcggcaaggccgccggcaccgccgccgtggccgtggccgccagcgccctgctcgccggcggcgccatggcccaggaagtgctgctcggcgccaacggaggcgtcctcgtcttcgagcccagcgagttcaccgtcaaggccggcgaggccatcaccttcaagaacaacgccgggtaccctcacaacgtggtcttcgacgaggacgaggtgcccagcggcgtcgacgccgccaagatctcgcaggaggagtacctcaacgcgccgggcgagacctactccgtcacgctcaccgtgccgggaacctacggattctactgcgagccgcaccaaggagccgggatggtcggcaaggtcaccgtcaactgatgcgatgccatgccatgccatgatcgagtatatatattcaagcgtatctgcgtatgtacgtaccaggctataggctagctagctagagagcttagcttgccactcagatcagtcatcatctccatcttgtaccaagtggcatgcatgcatgcatgcatgctattacttcatcatatttatatcatcggcattgccttgcttcttttaaaaaaaaaaaaaaaaaaaa

SEQ ID NO: 1928 - protein, 156 aa, Panicum virgatum
  misc_feature: Ceres CLONE 1772566
  misc_feature: Great-hit functional homolog of the protein sequence given in SEQ ID NO 9425
  misc_feature: Useful for making plants with modulated nitrogen use efficiency
MASLSSAAVTAPSFAASRPAHAAAKRSAAFTVRASLGKAAGTAAVAVAASALLAGGAMAQEVLLGANGGVLVFEPSEFTVKAGEAITFKNNAGYPHNVVFDEDEVPSGVDAAKISQEEYLNAPGETYSVTLTVPGTYGFYCEPHQGAGMVGKVTVN

SEQ ID NO: 1929 - DNA, 903 bp, Panicum virgatum
  misc_feature: Ceres CLONE 1772570
  misc_feature: Encodes the peptide sequence at SEQ ID NO. 1930
aatggcatttccttctcaatcgctttcctttgccgtggtcgccgtgctcgtcatcctcccctccccgtccctctccggcgaccccgacttgctccaggacatctgcgtcgcggatctcacgtccaccgtgaaggtgaacgggttcgcgtgcaaggccaccgtgacagaggacgacttctactacaaaggcctggccacccccggtaacaccaacaacacctacggctccgtcgtcaccggcgccaatgtcgagaaggtgccgggcctcaacacgctcggcgtgtccatgtcgcgcatcgactacgctcccggcggcctgaacccgccccatacccaccctcgcgccactgagatggtgttcgtccttgagggcgccctggacgtcggcttcataaccaccgggaacaagctcgtcgccaagaccatcaccgccggcgacgtcttcgtcttcccgcgcggcctggtacacttccagaagaacaacggggacgcgcccgccgccgtcatatcggctttcaacagccagctgcccggcacgcagtccctcgccatgacgctgttcgcgaccacgccggaggtgcccaacaatgtgctcaccaaggcgttccaggttggcacgaaggaggtggagaagatcaagtccagggttgctcccaaaaagagctaagtgatgtcaaaagtttgcgcttctaatcgatgttccttttccggtgacttgttcggtccatgtatctttaccaatttgcaactttgcatcttgttcttctctgtaatgctgctctgcagcaggcacaaaaagcttagtcggcgttccttgcttgtaataagctgcagggtcggagcttgtttgttgactgcaaattcaatcatcatttgactgattaaaaaaaaaaaaaaaaaaaa

SEQ ID NO: 1930 - protein, 221 aa, Panicum virgatum
  misc_feature: Ceres CLONE 1772570
  misc_feature (6)..(220): SWISSPROT Homolog: EC 1.15.1.1 Nectarin-1 precursor
MAFPSQSLSFAVVAVLVILPSPSLSGDPDLLQDICVADLTSTVKVNGFACKATVTEDDFYYKGLATPGNTNNTYGSVVTGANVEKVPGLNTLGVSMSRIDYAPGGLNPPHTHPRATEMVFVLEGALDVGFITTGNKLVAKTITAGDVFVFPRGLVHFQKNNGDAPAAVISAFNSQLPGTQSLAMTLFATTPEVPNNVLTKAFQVGTKEVEKIKSRVAPKKS

SEQ ID NO: 1931 - DNA, 978 bp, Panicum virgatum
  misc_feature: Ceres CLONE 1772594
  misc_feature: Encodes the peptide sequence at SEQ ID NO. 1932
atgatgatatagccccggggctcatccgcaaccctgtggtcgccagcgacactgctagtaacctcgacctcccttcctccccagcaaccgatcctcatctccgcctgcagcagcagcagcagccatggcggcctccacggcactctccaccgccgccaaccccacccagctctgccgcccccgcgcctctcccaacaagccggccgtcaagggcctgggcctcgggacgggccgggaccgcttctcccagcggcggagcagcagcagcgtcacgtgccaggcggcgagcagcatccccgccgaccgcgtccccgacatggagaagcgcaagctgatgaacctcctcctcctgggcgccatctcgctgcccaccgccggcatgctcgtcccctacggctccttcttcatccccgccgggtccggcggcgccggcgacggcacgtacgccaaggacaagctgggcaacgacatcaagttggaggagtggctgcagacgcacgggcccaacgaccgcaccctggcgcaggggctcaagggcgacccgacgtacctggtggtggagcaggacaagacgctggcctcctacggcatcaacgccgtgtgcacccacctcggttgcgtcgtgccgtggaacggcgccgagaacaagttcatctgcccctgccacggatcccagtacaacaaccagggcaaggtcgtccgtggcccagcgcccctgtcgctggccctggtgcacgtcgacgtcgacgacggcaaggtgctcttcgtcccgtgggtggagaccgacttcaggaccggcgaggacccctggtggaaggcataagcggcggcgttgttcctgtctgccatctcagaggacgttacgttactgctggcttccagattatatatgtacacaacaggctgtatgaaacaagaacacatgcttctcatcagatctgcatatatataacctgaacaggtcatagcctgaactcc

SEQ ID NO: 1932 - protein, 232 aa, Panicum virgatum
  misc_feature: Ceres CLONE 1772594
  misc_feature (3)..(230): SWISSPROT Homolog: EC 1.10.99.1 Cytochrome b6-f complex iron-sulfur subunit, chloroplast precursor
MAASTALSTAANPTQLCRPRASPNKPAVKGLGLGTGRDRFSQRRSSSSVTCQAASSIPADRVPDMEKRKLMNLLLLGAISLPTAGMLVPYGSFFIPAGSGGAGDGTYAKDKLGNDIKLEEWLQTHGPNDRTLAQGLKGDPTYLVVEQDKTLASYGINAVCTHLGCVVPWNGAENKFICPCHGSQYNNQGKVVRGPAPLSLALVHVDVDDGKVLFVPWVETDFRTGEDPWWKA

SEQ ID NO: 1933 - DNA, 997 bp, Panicum virgatum
  misc_feature: Ceres CLONE 1772629
  misc_feature: Encodes the peptide sequence at SEQ ID NO. 1934
actccagcgccttcgcccagcgcaccaacacaacaaccgccgccaccgcccgcgcccgaacacttggcgcccactcgccccgccgcacgcttcgtcgctcgctctcccgctcctccggttccgccatggcgcccaagaacagcgctctcccaccctccagcgcggccaccgacggcatgatggagccgaggttccgcggcgtccgcaagcgcccctggggccggtacgcggcggagatccgggaccccaccaggaaggcccgcgtgtggctcggcaccttcgacaccgccgaggccgccgctcgcgcctacgacgccgccgcgctccacttccgcgggcccaaggccaagaccaacttccccgtcgcgttcgccgcggacgcgcacccgccgccgcccaagatgctggccgtcagccccagcagcagcaccgtggagtcctcctcccgggactcgccggccgcgtcccccgcggcggcccccgcgccgtcgctggacctgagcctcggcatcccgcccatggtggccgcccagccgttcctcttcctggacccgaggctcgcggtgaccgtggccgtgccggcgcccgtgccctgccggccggccgtcgtcgccggcgccagcaaggcgacctgccgtgaagacgagcatagcgacaccgggtcgtcgtcatccgtcgtggacgcctccccggcggtcgacgtggggttcgacctcaacatgccgccgccggccgaggtggcgtaggtggaccggcgccgcgcccgatgacacgacgactcctccccagagctcgcatagaagattagaacttgtattagtacgtaagaggttggttaatcgatcgtttaatttgccgcgatgggttactacttactaggtgtacataggatgttctttttgcacaggcggataggtatcacaagaactaccgccggtgttgccaaaatacaaagcgttttgtccttcgttgtaacgaaaaaaaaaaaaaaaaaaaa

SEQ ID NO: 1934 - protein, 206 aa, Panicum virgatum
  misc_feature: Ceres CLONE 1772629
  misc_feature (1)..(64): Pfam Name: AP2 Pfam Description: AP2 domain
MAPKNSALPPSSAATDGMMEPRFRGVRKRPWGRYAAEIRDPTRKARVWLGTFDTAEAAARAYDAAALHFRGPKAKTNFPVAFAADAHPPPPKMLAVSPSSSTVESSSRDSPAASPAAAPAPSLDLSLGIPPMVAAQPFLFLDPRLAVTVAVPAPVPCRPAVVAGASKATCREDEHSDTGSSSSVVDASPAVDVGFDLNMPPPAEVA

SEQ ID NO: 1935 - DNA, 807 bp, Panicum virgatum
  misc_feature: Ceres CLONE 1772638
  misc_feature: Encodes the peptide sequence at SEQ ID NO. 1936
agagctaaatcttctccactgagcaatggcggaagtggctaccaacagctcggaggtgctcgccgctccggcggccgtgccggcgccggcggcgttcaccggcctgaaggtgcaggtgacggtgcccgcagggcgcgccgaggaggcggtggccttctacaaggccgctttcgccgccgaggaggtgtcccgctccacccaccccaagcgcaagggcgacggcgaggaggcggcgctgctctgcgccgagctgaaggtcggggcggcaaccctgctcgtctgtgaccaggccggcgacgacgtccccgccgtgggcaaggagggcgccgccgctagcggcctcgtgctgcgcctggagaccgacgacgtgaatgctgccgcggtgcaggcggcggccgccggcggcgcgccgcagggggaggtcaccgaggacggctgcgggctgagcgccaccctcgtcgaccccttcggcgtcacctggatcctcgcctcctccacctccgccaagaagtgcgcctagaaggtcggtccccgggcaccgccgccagaatgatgcgctcctcaagcacttcatcaagagcggcgaaggatgatttcatgagaaattgagaataatctgtggactgtgatggcatggtagtagtgttgttacttgtttagtcagtgtagttgtggtcggtggatgctctaatcgtcgttaaatttcagcatggttttaagtatgggtcctggtgtctggacaatgatgtggaacttggaatattgatgggttaatgtaggtaattggaaaaaaaaaaaaaaaaaaaa

SEQ ID NO: 1936 - protein, 164 aa, Panicum virgatum
  misc_feature: Ceres CLONE 1772638
  misc_feature: Great-hit functional homolog of the protein sequence encoded by LOCUS At5g48480
  misc_feature: Useful for making plants with modulated drought sensitivity
MAEVATNSSEVLAAPAAVPAPAAFTGLKVQVTVPAGRAEEAVAFYKAAFAAEEVSRSTHPKRKGDGEEAALLCAELKVGAATLLVCDQAGDDVPAVGKEGAAASGLVLRLETDDVNAAAVQAAAAGGAPQGEVTEDGCGLSATLVDPFGVTWILASSTSAKKCA

SEQ ID NO: 1937 - DNA, 800 bp, Panicum virgatum
  misc_feature: Ceres CLONE 1772671
  misc_feature: Encodes the peptide sequence at SEQ ID NO. 1938
accagcgcttgcaacaactcatccatccagcaccgtatcgtgccctcatcacattcacgcacaatggctcgcgctcagcaggccgtggcgatcgccgtcgttgccgccgtcgtgctgctcgccgccgcggccacctccgaggccgccgtgacctgcgggcaggtcaactccgccatcggcccctgcatcacctacgcccgcgggtccggctccggcccctcctcagcctgctgcagcggagtcaggagcctcaactccgccgccagaaccaccgccgacaggcgcgccgcatgcaactgcctcaagtccgccgcaggcagggtgagcggcctcaacgccggcaacgccgccagcatcccgtccaagtgcggagtcagcatcccctacaccatcagcccatccgtcgactgctccaaggtggcttaatatcgtgatgagttggttggagcctgcatgctgccaagcacatccaccgagatatatatatctagctatcgtctatgatcgatcgagttctcgctagctcgctgatgaataaactctctccgccgtcgctcatcatgtgagagacacggccggatcggatgtgtcagtccctgctacgttttgtacgtgtctgcatgtacacttccatttccgttccagattctgtaccttgtccactaccttttactccctccgttcggaaatgatctacatattttgactagagaaagtcattcgaagtaaagtttgacttattaatcactcttagaatataatgtcaattacgaataactcaaaaaaaaaaaaaaaaaaaa

SEQ ID NO: 1938 - protein, 120 aa, Panicum virgatum
  misc_feature: Ceres CLONE 1772671
  misc_feature (1)..(85): Pfam Name: Tryp_alpha_amyl Pfam Description: Protease inhibitor/seed storage/LTP family
MARAQQAVAIAVVAAVVLLAAAATSEAAVTCGQVNSAIGPCITYARGSGSGPSSACCSGVRSLNSAARTTADRRAACNCLKSAAGRVSGLNAGNAASIPSKCGVSIPYTISPSVDCSKVA

SEQ ID NO: 1939 - DNA, 801 bp, Panicum virgatum
  misc_feature: Ceres CLONE 1772717
  misc_feature: Encodes the peptide sequence at SEQ ID NO. 1940
attcagctgagtgtgctcgatcatcaagcaatcaacaaagcctcccaattatcttttcatcagatcatcttccttcttccaagatgtcttgcagctgcggatcaagctgcaactgcggctccaactgcaagtgcaggtatgttacctattctatatatctatacctattactaaagtgagtaacgtttccacttcaaattttggtttggtcggtcttatgtagtctctttaatttgcggctagctgttacagcaaatataatcttgccttgactttgttgcagcaagatgtaccctgaccttgaggagaagagcagcggcggcgctcaggccaccatcgtcctcggcgtggccccggagaagaaggccggccagttcgaggcagcggcggagtccggcgagaccgcccacgcctgcaagtgcggtaacagctgcagctgcgacccctgcaactgctgatttcgatggggaacatcagaacacacctgcatgcatgctagctactacctactactctgcttgtgtgtgacgatgattgaacaagaataaggatgagcctgagccatcatgtctcatggatcggtttggctccggcctcatcgagcatgcatgcgtctgcccctgtgtgtgctttgctaccttcccttaccctgtgctgcttggcgtccgtcctgtgtctgtatgtgttgatcattgcaaataaaccatgcaggcatacatctctgcatgtgtctctgtaatgatcggtccagagtgatgaatatataaaactggtttgctttaaaaaaaaaaaaaaaaaaaa

SEQ ID NO: 1940 - protein, 56 aa, Panicum virgatum
  misc_feature: Ceres CLONE 1772717
  misc_feature (17)..(70): Pfam Name: Metallothio_2 Pfam Description: Metallothionein
MYPDLEEKSSGGAQATIVLGVAPEKKAGQFEAAAESGETAHACKCGNSCSCDPCNC

SEQ ID NO: 1941 - DNA, 733 bp, Panicum virgatum
  misc_feature: Ceres CLONE 1772747
  misc_feature: Encodes the peptide sequence at SEQ ID NO. 1942
atcgccgcgcttcccccaccaatcccttccgttgttgaatcgagtcgagtccaatcgcaggcagcagcaatccccaactccgtcgtcgtctccagcgatctcgctccgttcggaagcagcaagatgtccggcgaggaggaggagaacgccgccgagctcaagatcggagaagagttcctcaaggccaagtgcctgatgaactgcgaggtggccatcatcctggagcacaagttcgagcagatccagcagcacgcgtcggactcggacccctcgtcgcaggtgtcgcaggtgttcgagaagtcgctgcagtacgtgaagcgcttcagccgctacaagaaccccgacgccgtgcgccaggtccgcgagacgctcagccgctacggcctcgccgagttcgagctctgcaccatcggcaacctctgccccgacaccagcggcgaggccaccgcgctcgtcccttccctcaagtccgggggcaggttcgtcggcgaccaaggcgacgagaagatcgagaagatgctcaacgacctctccctcatcaagaagttcgagtagctgcctctagctgcttttgctattgtcatgacatggccgtgccttgttcagttggtccgtcaatttcccctagctgccttatatcttgtcacatcaggcgacaactcaagatcagtatgtaacttatttcctaatgattcatctttgtaactctcaacaaaaaaaaaaaaaaaaaaaa

SEQ ID NO: 1942 - protein, 143 aa, Panicum virgatum
  misc_feature: Ceres CLONE 1772747
  misc_feature: Great-hit functional homolog of the protein sequence given in SEQ ID NO 9365
  misc_feature (1)..(123): Pfam Name: RNA_pol_Rpb4 Pfam Description: RNA polymerase Rpb4
  misc_feature: Useful for making plants with modulated drought sensitivity
MSGEEEENAAELKIGEEFLKAKCLMNCEVAIILEHKFEQIQQHASDSDPSSQVSQVFEKSLQYVKRFSRYKNPDAVRQVRETLSRYGLAEFELCTIGNLCPDTSGEATALVPSLKSGGRFVGDQGDEKIEKMLNDLSLIKKFE

SEQ ID NO: 1943 - DNA, 942 bp, Panicum virgatum
  misc_feature: Ceres CLONE 1772776
  misc_feature: Encodes the peptide sequence at SEQ ID NO. 1944
atccatccatcgtcgtctccgtttccatccctgcgaagcaagctttttgcgtctccgagaatccatccctagccgcggggaccgaccgagctcgacccggccatggcggcgcgcctgcccctggcgatcctgctggccctggccgtcgccgggcgcgcggcggcgcaggactacgacttcttctacctcgtgctgcagtggcccgggtcctactgcgacaccaagcagagctgctgctacccctcgtccggcaagccggcggcggacttcggcatccacggcctctggcccaaccgcgacgacggctcctacccgcagaactgcaaccccgacgccgccttcaacccgtccaaggtgagcgacctgctgagcagcctgcgcgccaagtggccgacgctggcgtgcccgaccaacgacgggctccgcttctggggccacgagtgggagaagcacggcacctgcgccgccgacgtcttcgacgagcacggctacttccaggcggcgctccgcctccgcgaccagctcggcgtcctcgccgcgctcaccgccgccggcgtcaaccccgacggcggctactacacgctggaccagatcaagggcgccatccggcagggcaccgggttcgagccctacgtggagtgcaaccgcgacgaggccggcaacagccagctctaccagctctacttctgcgtcagcgccgccggcgacagcttcgtcgactgccccgtcctcccccgcggccggccctgcggcagcaggatcgagttcccggcgttctagtctagttttccccaattcatggttagttttgattgaataaaacaagtactcatgtgccaatataattcatgtatttgatttgaactgatggcttatcgcattcagagatcaattgatgagttcaggaaaagcattttttttcaaaaaaaaaaaaaaaaaaaa

SEQ ID NO: 1944 - protein, 225 aa, Panicum virgatum
  misc_feature: Ceres CLONE 1772776
  misc_feature (1)..(190): Pfam Name: Ribonuclease_T2 Pfam Description: Ribonuclease T2 family
  misc_feature (21)..(225): SWISSPROT Homolog: EC 3.1.27.1 Ribonuclease 3 precursor
  misc_feature (5)..(225): SWISSPROT Homolog: EC 3.1.27.1 Ribonuclease 1 precursor
MAARLPLAILLALAVAGRAAAQDYDFFYLVLQWPGSYCDTKQSCCYPSSGKPAADFGIHGLWPNRDDGSYPQNCNPDAAFNPSKVSDLLSSLRAKWPTLACPTNDGLRFWGHEWEKHGTCAADVFDEHGYFQAALRLRDQLGVLAALTAAGVNPDGGYYTLDQIKGAIRQGTGFEPYVECNRDEAGNSQLYQLYFCVSAAGDSFVDCPVLPRGRPCGSRIEFPAF

SEQ ID NO: 1945 - DNA, 604 bp, Panicum virgatum
  misc_feature: Ceres CLONE 1772842
  misc_feature: Encodes the peptide sequence at SEQ ID NO. 1946
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
ccnnnntccaactccatcgagcaagctcgtcgtcgatctctctaactcgaagccccatcagcaacatgtcggacaagtctcccaactgcgactgcgctgacaggagccagtgcacgaagggcaacagctatggcgtcgtcgtagtcgacaccgagagccgcgtcgagcgccgcgaggaggaggtcgctgccgccggcgagaacgacggcaagtgcaagtgcggcaccagctgcggctgcggcgccagctgcaactgcggccactgaagctcgccgcctacgatccatggccctgcacactccatttttttctacccagtacccaatcctgtacctgtacgtcgtcgatcacagcgtatataaatttttccgccccgcccgtgttgaatacgtacgtcgtgtcctatgtgtcctgcgtctctgctgctgtcatgtgaccagaaacctgtagctacctagcttgctacctgctgcctggctgtgtgacgtcctagctagctagcttatttggtgcaggcagggcgcgtatacgtgtcttgtgacgacgcatgcatgtacgtatatatctctgttgtgtgccatgaaatctactgtgtggcttgact

SEQ ID NO: 1946 - protein, 66 aa, Panicum virgatum
  misc_feature: Ceres CLONE 1772842
  misc_feature: Great-hit functional homolog of the protein sequence given in SEQ ID NO 9522
  misc_feature (1)..(62): Pfam Name: Metallothio_2 Pfam Description: Metallothionein
  misc_feature: Useful for making plants with modulated nitrogen use efficiency
MSDKSPNCDCADRSQCTKGNSYGVVVVDTESRVERREEEVAAAGENDGKCKCGTSCGCGASCNCGH

SEQ ID NO: 1947 - DNA, 784 bp, Panicum virgatum
  misc_feature: Ceres CLONE 1772869
  misc_feature: Encodes the peptide sequence at SEQ ID NO. 1948
ctcctgcggcggccgctggactcgccttgccttctcctccacctcctttccccacctccctctctctctctctctctctctctctccaaacagctcacgtactctctccaagcaagaaacagagcaaggccgtctcgatcggcaggatcaatccaggatcagatgatggattctgccgagcacaaggtgatcgggatcgccgcggcggcggcggcggagcccgggaggccctgctgcgtcgagtgccgcaccaccgcgacgcccatgtggcgcggcgggccgacggggcccaggtcgctttgcaatgcgtgcgggatccggtacaggaagaagaggaggcaagagctaggtcttgacaacaacaagaaaccgcagcaaaaccagcagcagccgcagccgccgcaacagccacagcaacatcaagatctcagtcatgcaccgagtgcagtcagtgacaacaaaagtagcggcctgcaagtggtgaagaaacggagggtcctgatgggagtggaggaggccgcaatcctgctcatggccttgtcctcctcatccaggtccacactgctacatggctaggatctcaacaccacccaaaggctgctgctcaatgtgtacatacaaaacctgatacaggacacaaagcacaacacagggccacccaatggtttccaagccaaccatgtaactttctcggattatcaggatggaaggcctctttcgggatgaagctgatgttgaaagggctggatttgttttttggattcaaaaaaaaaaaaaaaaaaaa

SEQ ID NO: 1948 - protein, 137 aa, Panicum virgatum
  misc_feature: Ceres CLONE 1772869
  misc_feature (1)..(36): Pfam Name: GATA Pfam Description: GATA zinc finger
MMDSAEHKVIGIAAAAAAEPGRPCCVECRTTATPMWRGGPTGPRSLCNACGIRYRKKRRQELGLDNNKKPQQNQQQPQPPQQPQQHQDLSHAPSAVSDNKSSGLQVVKKRRVLMGVEEAAILLMALSSSSRSTLLHG

SEQ ID NO: 1949 - DNA, 842 bp, Panicum virgatum
  misc_feature: Ceres CLONE 1772894
  misc_feature: Encodes the peptide sequence at SEQ ID NO. 1950
ccagctccggctccaccggcaagccatgaagcgcctgctgaggcggctgtcccgcaccgtcgcggcggccgaggacggcggcgccccggccgcggcgcaccgccgggtccgggcgaagaagaagggcaagggggtgccggagggccacgtccccgtgtgcgtcggcgaggagggcgggcccgtggagcgcttcgccgtgcgcgccgagctgctgggcgagccggccttcgcggcgctcctccgcgccgccgcgcaggagtacgggtacgcccacccgggcgcgctccgcatcccctgcaccgccgccgagttccgccgcctcctgctgcacctctccgacggcgacgaccccgccgccgccgccagctgctagccttgctaggcgaggcgcaccgcccgccgccccgcccctcccctgcctccgccgccgcggtattgcggccttgccgtctccgtttttaccggtttacccctgcgtagaatgtacagaggccgaggcagggcggagggcagcacggggatttggctcctggtactcttggatttttttaccactagctagtgctatactactagcagcactgtagcactgtagcactgtagcagtagctgcttgatggtggaactacgggtgtcctttttttaccccttctagttctaggactcgcagtgtgtgtgtctagtgtgctagggattccggggaattcactattaaccatacatgtaatcctcgattgaggctagtctcatgccatattatggaggtagtagtttttctcactacattgtaaagatctctctccgttttcgacctccgactagaaaaaaaaaaaaaaaaaaaa

SEQ ID NO: 1950 - protein, 115 aa, Panicum virgatum
  misc_feature: Ceres CLONE 1772894
  misc_feature (3)..(96): Pfam Name: Auxin_inducible Pfam Description: Auxin responsive protein
MKRLLRRLSRTVAAAEDGGAPAAAHRRVRAKKKGKGVPEGHVPVCVGEEGGPVERFAVRAELLGEPAFAALLRAAAQEYGYAHPGALRIPCTAAEFRRLLLHLSDGDDPAAAASC

SEQ ID NO: 1951 - DNA, 739 bp, Panicum virgatum
  misc_feature: Ceres CLONE 1772898
  misc_feature: Encodes the peptide sequence at SEQ ID NO. 1952
ctctcctctcctcctcctcccgcccttccttccccaacccctcgcgccggcacccagcctctctagggttttgtcgggcggcggcggcggcggcggcgagatggtgcagcgcctcacctaccgaaagcgtcacagctacgcgaccaagtccaaccagacccgggtcgtcaagaccccaggtgggaggcttgtgtaccagtacaccaagaagagggcgagcgggcccaagtgccccgtcaccgggaagaagatccaggggatcccccacttaaggcctgctgagtacaagaggtccaggttgtctaggaatcgcaggactgtgaaccgtccttatggtggagtgctctctggaactgctgttagggagaggatcatccgtgctttcttggttgaggagcagaagatcgtcaagaaggtcctgaaaatacagaaaaccaaggacaagacagccacaaagtagagctcctggaatggaagcgtagctgttttgtacactgcgaaaagtatttttggtggatggaaaatctagttgccttttgtgtgaaatgtttagcatgtgagagacatacctgtcaagtttagagcatctgcagactggagccattttcacctttcattgtctgaatattgggacatctgtaccccttgttgctttgttttgaattcagatcatatctgggcaccatcagcttattgaatttgccttctggtttgtagccaaaaaaaaaaaaaaaaaaaa

SEQ ID NO: 1952 - protein, 119 aa, Panicum virgatum
  misc_feature: Ceres CLONE 1772898
  misc_feature: Great-hit functional homolog of the protein sequence given in SEQ ID NO 9667
  misc_feature: Useful for making plants with modulated nitrogen use efficiency
MVQRLTYRKRHSYATKSNQTRVVKTPGGRLVYQYTKKRASGPKCPVTGKKIQGIPHLRPAEYKRSRLSRNRRTVNRPYGGVLSGTAVRERIIRAFLVEEQKIVKKVLKIQKTKDKTATK

SEQ ID NO: 1953 - DNA, 792 bp, Panicum virgatum
  misc_feature: Ceres CLONE 1772918
  misc_feature: Encodes the peptide sequence at SEQ ID NO. 1954
ctctcctaacgccgctcgcgtcccctctcgccctcgcgccgccgccgccgctgcagctgcagcaagaccccgccccgccgtcgccgaagacaaacccccagccgccgccatggggcgtatgcacagccgcgggaagggtatctcgtcgtcggcgctgccgtacaagaggactcccccgacctggctcaagatcgccgccaacgatgtggaggagatgatcaccaaggccgcgaagaagggccagatgccgtcgcagattggcgtcctcctccgtgaccagcacggtatcccgctcgtcaagagcgtcactggtagcaagatcctccgcatcctcaaagcccatgggctcgcacccgagatcccggaggacctttacttcctgattaagaaggcggtggcgattaggaagcatctggagaggaacaggaaggacaaggactccaaattcaggctcattcttgttgagagcaggatccaccgccttgcccgttactacaagcgcaccaagaagctcccgccaacctggaagtatgagtcgactactgccagcactctggtggcctaagtgatcccatcagatggtgtggtccttaccttctttgagattggcttgttctagatatgaaatttatgtaatgcttaatgagtctggagcgggttagatggacaaggaacctcaactttttctatgtttacttggagaatcccataaaccatttttggtttctcgaatctgtctgttaaacgtaacatgcatccatgttttgtccctaaaaaaaaaaaaaaaaaaaa

SEQ ID NO: 1954 - protein, 151 aa, Panicum virgatum
  misc_feature: Ceres CLONE 1772918
  misc_feature: Great-hit functional homolog of the protein sequence given in SEQ ID NO 9202
  misc_feature: Useful for making plants with modulated nitrogen use efficiency
MGRMHSRGKGISSSALPYKRTPPTWLKIAANDVEEMITKAAKKGQMPSQIGVLLRDQHGIPLVKSVTGSKILRILKAHGLAPEIPEDLYFLIKKAVAIRKHLERNRKDKDSKFRLILVESRIHRLARYYKRTKKLPPTWKYESTTASTLVA

SEQ ID NO: 1955 - DNA, 825 bp, Panicum virgatum
  misc_feature: Ceres CLONE 1772926
  misc_feature: Encodes the peptide sequence at SEQ ID NO. 1956
cccccgagccctatcctccacccccccccccccccccccgggtctcccctaccccccactcctatcctctcctcccctcgcccgcgccgccgccgccgccgcggcttcccttcctcacccgagccaagatgaatgttgacaagctcaagaagatggcaggtgccgtgcgcaccggtggaaagggtagcatgcgcaggaagaagaaggcagtccacaagactacaaccacagatgacaaaaggcttcagagcaccctgaaaagagtaggagtgaacactatccctggtattgaagaggtcaacatcttcaaggatgatgttgttattcagtttgtgaatcctaaagtgcaagcttctattggtgctaatacatgggtgatcagtggaactccacagacaaagaagctgcaagatctgcttccgtcgattatcaatcagcttggtcctgacaacttggacaacctgcggatgcttgcggagcaattccagaagcaggtccctggagcttcaagcgctgaggctggtgctagcacaggtgctgctcaggatgacgatgatgacgtccctgagcttgtccctggagagacatttgaggaggctgctgaagagaaaaaggagtcgtcataattttgctgcgtgcctgcagttgtgaagggtttataagtcaagctttgccattagaaaagacatactgttgagggacctctgaccctaccttatttgtgcctgtggtccggttttgtcatgtacgagaatccggtcggatgtgttggtgggatttcacatgaagtacgcctctttttgctaaaaaaaaaaaaaaaaaaaa

SEQ ID NO: 1956 - protein, 165 aa, Panicum virgatum
  misc_feature: Ceres CLONE 1772926
  misc_feature: Great-hit functional homolog of the protein sequence given in SEQ ID NO 9453
  misc_feature: The sequence is a functional homolog of  SEQ ID NO 1614 in the  11/479,226 US patent application
  misc_feature: The sequence is a functional homolog of  SEQ ID NO 1617 in the  11/479,226 US patent application
  misc_feature: The sequence is a functional homolog of  SEQ ID NO 784 in the  10/412,699 US patent application
  misc_feature: The sequence is a functional homolog of  SEQ ID NO 786 in the  10/412,699 US patent application
  misc_feature: Useful for making plants with modulated biomass
  misc_feature: The plant is abnormally large.
  misc_feature: Useful for making plants with modulated growth and phenotype characteristics
MNVDKLKKMAGAVRTGGKGSMRRKKKAVHKTTTTDDKRLQSTLKRVGVNTIPGIEEVNIFKDDVVIQFVNPKVQASIGANTWVISGTPQTKKLQDLLPSIINQLGPDNLDNLRMLAEQFQKQVPGASSAEAGASTGAAQDDDDDVPELVPGETFEEAAEEKKESS

SEQ ID NO: 1957 - DNA, 847 bp, Panicum virgatum
  misc_feature: Ceres CLONE 1772931
  misc_feature: Encodes the peptide sequence at SEQ ID NO. 1958
cgccgccgcctttcgcagaccaaacacccttcaccacccagccaccgccccctgcccccctcacacagtcctccagcagagcaccaccgcacaacgagccggcctgcagaaggagagggaggaggagaaggaggagttgaggagatggccgacgccgggggcgagaggtgggtggggctggcgacggacttctccgaggggagccgcgccgcgctgcggtgggcggcggacaacctgctgcgcgccggcgaccagctggtgctgctgcacgtcatcaaggaggccgactacgagcagagcgaggccatcctctgggaatccaccggatccccgttgattcccctctcggagttctctaatcctattactgccaagaaatatggggcaaagcccgatgctgaaaccttggatctcctcaacaccgttgccagggagaaggaggttatggtggttgtcaaagtcctctggggagatccccgggagaagctatcccaggctatcaatgacatgcccttgagctgcttggtcataggaagcagaggcttgggaaagcttaagagggtgctcctgggaagcgtcagtgactacattgtgaacaacgcgacctgccctgtcacggtcgtcaagcccaatgacggctgatcttatcaccaaaatgacagaatgtgctgctgtaataaggggatgattggcctgttgaagaacatgcactagtttccagctagctgaaacatgttgaaccaggcagttttattgtaataataggcaaatgaccttttgaaggacatggacaagtaatagttctgttttcctgattaactgaacgcctgaaccatgcacttgtttc

SEQ ID NO: 1958 - protein, 165 aa, Panicum virgatum
  misc_feature: Ceres CLONE 1772931
  misc_feature (1)..(155): Pfam Name: Usp Pfam Description: Universal stress protein family
MADAGGERWVGLATDFSEGSRAALRWAADNLLRAGDQLVLLHVIKEADYEQSEAILWESTGSPLIPLSEFSNPITAKKYGAKPDAETLDLLNTVAREKEVMVVVKVLWGDPREKLSQAINDMPLSCLVIGSRGLGKLKRVLLGSVSDYIVNNATCPVTVVKPNDG

SEQ ID NO: 1959 - DNA, 665 bp, Panicum virgatum
  misc_feature: Ceres CLONE 1773032
  misc_feature: Encodes the peptide sequence at SEQ ID NO. 1960
atcagtccatcagcaagctaagcactacacctagtagctgaaacgccacctgagacaaaggttatctgaacattcagccaggaaagcatcagaagcaaccatggtcagtgccaagagacttgttcaaatggcgaagaagtggcaaagaatggcggccctcgcgaggagaaggatcacgtcgccggcgaaagagaccgaagggtcgtcgtgcagcacttcgtcggtggccggcaagggccactgcgttgtgtactcggccgacggccggcggttcgaggtcccgctggcgtaccttgacacggcgatcttcggcgagctcctgagcctgtcgcaggaggagttcgggttcgccggcgacgacggcaggatcacactgccctgtgaagctgccgtgatggagtacgtcatgtgcttgctccggagaaacgcatcagaggaggtcgaggcggctttcctgacctccatagcgaggccgtgccactatggaagcagcttggcgcaatccattggagttagccagcaacttgctgtttctagcttctgaagaacacagcatttagcttgtcttctccttctagctccagcacgatgtatgtaaattgttacatggggagattggaaatagaatagagatgatttttccccaaaaaaaaaaaaaaaaaaaa

SEQ ID NO: 1960 - protein, 147 aa, Panicum virgatum
  misc_feature: Ceres CLONE 1773032
  misc_feature (1)..(103): Pfam Name: Auxin_inducible Pfam Description: Auxin responsive protein
MVSAKRLVQMAKKWQRMAALARRRITSPAKETEGSSCSTSSVAGKGHCVVYSADGRRFEVPLAYLDTAIFGELLSLSQEEFGFAGDDGRITLPCEAAVMEYVMCLLRRNASEEVEAAFLTSIARPCHYGSSLAQSIGVSQQLAVSSF

SEQ ID NO: 1961 - DNA, 784 bp, Panicum virgatum
  misc_feature: Ceres CLONE 1773081
  misc_feature: Encodes the peptide sequence at SEQ ID NO. 1962
ccttacccaccgctcccgtctctccgccgctgccttggcagaataagaaaccctcatccgcaaacccaatccgggcccggagcagtttcgccgcctccaaccgattccgtcgcgtccctacgaaatccgacccgactcgcaggaaggagcgtgatggccaagaccagctcgttcaagctcgagcaccccctcgagaagaggcaatctgaggctgaccggatcagagagaagtaccctgacagaattcctgtgattgttgagaaggctgagagaagtgatattcctgacatcgacaagaaaaagtacctcgtccctgctgatcttacagttggacagttcgtctacgttgttaggaagagaatcaagctcagtgctgagaaggctatcttcatctttgtgaagaacactcttccaccaacagctgctctgatgtcttctatctatgaagagaacaaggacgaggacgggttcctctatatgacttacagtggcgagaacaccttcgggctgctctagatggcaccacagctcacctcaaccgggtcggcaccacagctcacctcaaccgggtcggcccaccctggcttccctactaatgtctcctgtaaataagacctgccaagcaactgtgtatatcctgttttccacatcgcatgtaattgcactcatctagtactaaacacctatcatcagctgtccttgatacacatcgcttaaatcaagtaatcgacaggctatgaaacctgtcagtgtgttgatgtgccaaaaaaaaaaaaaaaaaaaa

SEQ ID NO: 1962 - protein, 120 aa, Panicum virgatum
  misc_feature: Ceres CLONE 1773081
  misc_feature: Great-hit functional homolog of the protein sequence given in SEQ ID NO 9436
  misc_feature: Useful for making plants with modulated nitrogen use efficiency
MAKTSSFKLEHPLEKRQSEADRIREKYPDRIPVIVEKAERSDIPDIDKKKYLVPADLTVGQFVYVVRKRIKLSAEKAIFIFVKNTLPPTAALMSSIYEENKDEDGFLYMTYSGENTFGLL

SEQ ID NO: 1963 - DNA, 982 bp, Panicum virgatum
  misc_feature: Ceres CLONE 1773115
  misc_feature: Encodes the peptide sequence at SEQ ID NO. 1964
atgcagcacacacacatcgaactatccaaactttcaccagcgtagtaagtcgttgccatggccaagacggtgttgctccccgtgctcctctccttcctcctcctccccttcgcctccctcgctctgacgcaggacttctgcgtcgctgacctctcctgcagcgacacgccgtccggctacccgtgcaagtctagcgtcaccgccaacgacttctactaccacggcctggctgccaaaggcaaaatcaacgacctcatcaaggccgccgtgacgcctgccttcgtcggtcagttcccgggcgtcaacgggctcggcatctccgcggccaggctcgacttggaggtgagtggcgtcgtgcctctgcacacccacccggccggctccgagctcctctttgtcacccagggcaccgtcgccgctggcttcatcagctccggagcgaacaccccctacaccaagacgctgtaccccggcgacatcatggtgttcccacaaggattgctccactaccagtacaacgccggcactggccctgcagtggcgctcgttgccttcagcagccctaaccccggcctgcagatcaccgacttcgcgctcttcgccaacaacctcccgtcggccgtcgtcgagaaggtcaccttcttggatgacgcgacggtgaagaagctcaagagtgtgctcggcggcagcggctaagttgctcaagagttgagcaagctcgtcaactgatcgtggtcttggtcgtcgcttgtgcgtgtatgcatgatcgaacatgtcgtcatttcatcaaagtcatgtggtcttttcaagttattctttactctttgttcatgttatcttcattatccaaggttgtcttcaattagcatagttgtaattgttgaaggatgaacgactgatttgtggtaaatcaccaagaatcagagattttcagtggtattgtagtatccgtcagccccaataaaaaaaaaaaaaaaaaaaa

SEQ ID NO: 1964 - protein, 212 aa, Panicum virgatum
  misc_feature: Ceres CLONE 1773115
  misc_feature: Great-hit functional homolog of the protein sequence given in SEQ ID NO 9514
  misc_feature: Useful for making plants with modulated nitrogen use efficiency
MAKTVLLPVLLSFLLLPFASLALTQDFCVADLSCSDTPSGYPCKSSVTANDFYYHGLAAKGKINDLIKAAVTPAFVGQFPGVNGLGISAARLDLEVSGVVPLHTHPAGSELLFVTQGTVAAGFISSGANTPYTKTLYPGDIMVFPQGLLHYQYNAGTGPAVALVAFSSPNPGLQITDFALFANNLPSAVVEKVTFLDDATVKKLKSVLGGSG

SEQ ID NO: 1965 - DNA, 788 bp, Panicum virgatum
  misc_feature: Ceres CLONE 1773180
  misc_feature: Encodes the peptide sequence at SEQ ID NO. 1966
aaccctcgctaaccctagcccccgcctcccacctgctccccgccgccgccgcaagtagtaccagccaggatgccggccggccacgggctgcgctcgcggacgcgcgacctcttcgcgcgtcccttccgcaagaaggggtacatcccgctcaccacctacctccgcaccttcaagatcggcgactacgtcgacgtcaaggtgaacggcgccgtccacaaggggatgccgcacaagttctaccacggccgcaccggccgcgtgtggaacgtcactaagcgcgccatcggcgttgagatcaacaagcaggttaatggccgcatcatcaggaagcgtatccatgtccgtgtggagcatgtgcagcagtcccgctgcactgaggagttccgccagaggaaggcaaagaatgaccacctgaaagcagatgccaaggcacgcggtgaggtcatcagcaccaagaggcagccgttgggtcccaagcctggcttcatggttgaaggtgctaccatcgagaccgtgacccccatcccatatgatgttgtcaacgatctcaagggcggttactaggttgctcggtctatctagcggcactaccagttctatatctgtattactctagtgggtacaattttgctctgtccgagcagtagtctggacctattctgtgtgtttctgttgaaagattttccattctaggtgcaaacctgagttcggcagaacgctcgatactgttatgtttgcttctgtgaacgaagatgtgctttttttttcaaaaaaaaaaaaaaaaaaaa

SEQ ID NO: 1966 - protein, 164 aa, Panicum virgatum
  misc_feature: Ceres CLONE 1773180
  misc_feature: Great-hit functional homolog of the protein sequence given in SEQ ID NO 9311
  misc_feature: Useful for making plants with modulated flowering time
MPAGHGLRSRTRDLFARPFRKKGYIPLTTYLRTFKIGDYVDVKVNGAVHKGMPHKFYHGRTGRVWNVTKRAIGVEINKQVNGRIIRKRIHVRVEHVQQSRCTEEFRQRKAKNDHLKADAKARGEVISTKRQPLGPKPGFMVEGATIETVTPIPYDVVNDLKGGY

SEQ ID NO: 1967 - DNA, 1055 bp, Panicum virgatum
  misc_feature: Ceres CLONE 1773251
  misc_feature: Encodes the peptide sequence at SEQ ID NO. 1968
gcaaccagagcagcaaacagccttttgtcgttgcaaaaatatagtgtagcggcggcagagacgatggcacgtagaacaattgtgttgagcctcatccttggcttgctggctgctgccaatgccgtgccctttgatttctattaccttatcctcatgtggcctggagcgtactgcgaggacagcgacaacggctgctgcgtgcccaagtacggctacccggcggaggatttcttcgtcgagagcttccagaccttcgacctgtccatcaacaagcccatcgtcaggtgcagcaacggcaaacccttcgacgctaacaagctggacaagatcgagaacagcatcaaccactactggagcaagctcaagtgcccgcccaccgacggcgtgaacaactggaagagcgcgtggaacagctacggcgtctgctcgggcctggagcagctggactacttcaaggccgccctcaacctgcggaagcaggcggacatcctcggcgcgctggccgagcaggacatcaggcccgactacaagctctacgccacggagaagatcaggtgggcggtggaacggaagctgggcgtcgcgccggggctgcagtgccgggacgggcccttcggcaagaagcagctgtacctggtctacctctgcgtggacacggacgccaagaccttcatcgagtgccccaagctgccggcgacgctgagctgccccgcgtcggtcgtcttccacccgttctacacctggatgctcaactccaccgccgcctccgcctccgccttcggatccaagctcctgctcctcaccgagaccatgctcaagtgaacggaccggatcgatcgatcgattccaagagctagcttgcttgcttggcaagcgcgcaggtggtcgtggaaaataaatcgtatcgtacttcctgaggaagaagcttatcaatctatgtactctgttcaaaccggtcgacggagagcacaccgtaccgtacctaccgctctcgctcgctgagaataaaatcactcgctttttttttactgccctaaaaaaaaaaaaaaaaaaaa

SEQ ID NO: 1968 - protein, 252 aa, Panicum virgatum
  misc_feature: Ceres CLONE 1773251
  misc_feature (1)..(188): Pfam Name: Ribonuclease_T2 Pfam Description: Ribonuclease T2 family
MARRTIVLSLILGLLAAANAVPFDFYYLILMWPGAYCEDSDNGCCVPKYGYPAEDFFVESFQTFDLSINKPIVRCSNGKPFDANKLDKIENSINHYWSKLKCPPTDGVNNWKSAWNSYGVCSGLEQLDYFKAALNLRKQADILGALAEQDIRPDYKLYATEKIRWAVERKLGVAPGLQCRDGPFGKKQLYLVYLCVDTDAKTFIECPKLPATLSCPASVVFHPFYTWMLNSTAASASAFGSKLLLLTETMLK

SEQ ID NO: 1969 - DNA, 892 bp, Panicum virgatum
  misc_feature: Ceres CLONE 1773266
  misc_feature: Encodes the peptide sequence at SEQ ID NO. 1970
cacgagagagagagagagagaggaatagtatccgttccatccgtccatggctctccgtaccctggcgtcgaagaagaccctgtccctcgccctcggcggcgcccggccgctggcggcggcggccaggggggtaacgacggtagccctccccgacctctcctacgacttcggcgctcttgagccggccatctccggtgagatcatgcgcctgcaccaccagaagcaccacgccacctacgtcgccaactacaacaaggcgctcgagcagctcgacgccgccatcgccaagggcgacgcctccgccgtcgtccagctccagggcgccatcaagttcaacggcggcggccatgtgaaccattcaatcttttggaagaacctcaagcctattagcgaaggtggtggggagtcaccacatggaaaacttggctgggccattgatgaggattttggttcatttgaagcacttgtaaagaagatgaatgcagaaggtgctgctttacaaggatctggatgggtgtggcttgctttggataaagaggcaaaaaagctatcagttgaaactactgctaatcaggaccctctggtgactaaaggagcaagcttggttcctttgttggggattgatgtctgggagcatgcatactacctccagtacaagaatgttaggcctgattacctgaacaacatctggaaggtggtgaactggaaatatgccggagaggtgtacgacaatgtgcttgcctgatttgtcttgaggggatactcatctgcgttggctatcaagctgttttgactcatgtgaaataaaaatgggcctgtctagctactggaccttgtacatttcgttaaaatatactgatgcaatagctgttaaaaaaaaaaaaaaaaaaaa

SEQ ID NO: 1970 - protein, 232 aa, Panicum virgatum
  misc_feature: Ceres CLONE 1773266
  misc_feature (1)..(110): Pfam Name: Sod_Fe_C Pfam Description: Iron/manganese superoxide dismutases, C-terminal domain
  misc_feature (1)..(232): SWISSPROT Homolog: EC 1.15.1.1 Superoxide dismutase [Mn] 3.1, mitochondrial precursor
  misc_feature (1)..(232): SWISSPROT Homolog: EC 1.15.1.1 Superoxide dismutase [Mn] 3.4, mitochondrial precursor
MALRTLASKKTLSLALGGARPLAAAARGVTTVALPDLSYDFGALEPAISGEIMRLHHQKHHATYVANYNKALEQLDAAIAKGDASAVVQLQGAIKFNGGGHVNHSIFWKNLKPISEGGGESPHGKLGWAIDEDFGSFEALVKKMNAEGAALQGSGWVWLALDKEAKKLSVETTANQDPLVTKGASLVPLLGIDVWEHAYYLQYKNVRPDYLNNIWKVVNWKYAGEVYDNVLA

SEQ ID NO: 1971 - DNA, 716 bp, Panicum virgatum
  misc_feature: Ceres CLONE 1773380
  misc_feature: Encodes the peptide sequence at SEQ ID NO. 1972
atcatgtgatgctcgcggggtaggaaagttcttttctcttccacaccagcccagccatggccaaggtagctccctccctcctcgccgtcggcagcggcgctgccttcactgcccagccaagcggcgctgccttcactgcccagccatcgcccaggaaaggtgccagtttgttccgtgatcgcgtcatcagcaggcgtgccaggatatcagctaagcttggtggagatggggagctgaagcctccaggcaagaagaagttcatcaccagggatgaggagcctgaacagtactggcagactgcaggggagagggagggtgagaaccccatgaagacgcccctgccctacatcatcatcttcggcatgtccacccccttcgtcatcctcgccatcgcctttgccaatggctggatcaaggtccctgtacgatgaaaccatgtcatcgcgatcagattttcgaagcttccagcaaaacaccttagcacttcctgcatcctctccagtgagagccctgcaagtttttaccttcatagagatgaagagtcaatgctttgtaatcttccgttcttcacacaagacgaggtttgtaccatcagcagttgacaggaacagtcacatgtccaactatgtcttggtttccggtagacctcaactgattctactatacaaatagcatatactgtatctaaaataagccaaaaaaaaaaaaaaaaaaaa

SEQ ID NO: 1972 - protein, 124 aa, Panicum virgatum
  misc_feature: Ceres CLONE 1773380
  misc_feature: Great-hit functional homolog of the protein sequence given in SEQ ID NO 9634
  misc_feature: Useful for making plants with modulated biomass
  misc_feature: The plant is abnormally small.
MAKVAPSLLAVGSGAAFTAQPSGAAFTAQPSPRKGASLFRDRVISRRARISAKLGGDGELKPPGKKKFITRDEEPEQYWQTAGEREGENPMKTPLPYIIIFGMSTPFVILAIAFANGWIKVPVR

SEQ ID NO: 1973 - DNA, 1392 bp, Panicum virgatum
  misc_feature: Ceres CLONE 1773394
  misc_feature: Encodes the peptide sequence at SEQ ID NO. 1974
acgcccctgctcgcgagcgtccggggggcaccaccacacccgcgagagcaatggagaccgtcgcggcggcgagctacgccggcgcggccgccggcgcggccaccggcgccacgcgctccccggcctgctgcgccgccatgtccttctcgcagtcgtacaggcccaaggcgtccaggccgccgacggcgttctacggcgagtcggtgcgggtgaacacggcgcggccgctcgcggcgaggcagaccaaggcggcgagccgcgcggcgctcagcgcgcggtgcgagatcggcgacagcctggaggagttcctgaccaaggcgacgccggacaagagcctcatcaggctgctcacctgcatgggggaggccatgaggacgatcgcgttcaaggtccggacggcgtcctgcggcggcacggcctgcgtcaactccttcggcgacgagcagctcgccgtcgacatgctcgccaacaagctcctcttcgatgctctggagtactcccatgtgtgcaagtatgcgtgctctgaggaagtccccgagctgcaagacatgggtggcccagttgacggtggcttcagcgttgcgttcgatccccttgacggttccagcattgtcgacacgaacttcaccgtcggaaccatcttcggtgtctggcccggcgacaagctgacgggcgtcaccggcggcgaccaggtcgccgctgcgatgggcatctacgggccccgcacgacctacgttatcgccctcaaggactgccccgggacacacgagttcctcctcctcgacgaaggtaaatggcagcatgtcaaggacaccacctccattggggaggggaagatgttctctcctggtaatttgagggcaacatttgacaaccctgagtacgacaagctcatcaactactacgtcaaggagaagtacacattgcgttacactggaggaatggttccagatgtcaaccagatcatagtgaaggagaagggcatcttcaccaacgtgacgtccccgtccgccaaggccaagctgcggctcctcttcgaggtggcgccgctggggctcctgatcgagaaggccggcgggcacagcagcgacggcaagcagtcggtgctggacaaggtgatcaacgagctcgacgagcgcacccaggtggcctacggctccaagagcgagatcatccggttcgaggagaccctctacggctcgtccaggctcgccgccggcgccaccgtcggcgcggccgcctgagtttttgctgcgatgcgtgcaagccgtgtgccgccattttgaatccatttggtggtgatgcctatacagatgagcttgtagaactctcctgcaaagtaatttttgtatacagtttgtgtgcatgcatccatgcatggcatggcaaccg

SEQ ID NO: 1974 - protein, 397 aa, Panicum virgatum
  misc_feature: Ceres CLONE 1773394
  misc_feature: Great-hit functional homolog of the protein sequence given in SEQ ID NO 9301
  misc_feature (5)..(313): Pfam Name: FBPase Pfam Description: Fructose-1-6-bisphosphatase
  misc_feature (1)..(397): SWISSPROT Homolog: EC 3.1.3.37 Sedoheptulose-1,7-bisphosphatase, chloroplast precursor
  misc_feature: Useful for making plants with modulated light quality response
METVAAASYAGAAAGAATGATRSPACCAAMSFSQSYRPKASRPPTAFYGESVRVNTARPLAARQTKAASRAALSARCEIGDSLEEFLTKATPDKSLIRLLTCMGEAMRTIAFKVRTASCGGTACVNSFGDEQLAVDMLANKLLFDALEYSHVCKYACSEEVPELQDMGGPVDGGFSVAFDPLDGSSIVDTNFTVGTIFGVWPGDKLTGVTGGDQVAAAMGIYGPRTTYVIALKDCPGTHEFLLLDEGKWQHVKDTTSIGEGKMFSPGNLRATFDNPEYDKLINYYVKEKYTLRYTGGMVPDVNQIIVKEKGIFTNVTSPSAKAKLRLLFEVAPLGLLIEKAGGHSSDGKQSVLDKVINELDERTQVAYGSKSEIIRFEETLYGSSRLAAGATVGAAA

SEQ ID NO: 1975 - DNA, 448 bp, Panicum virgatum
  misc_feature: Ceres CLONE 1773430
  misc_feature: Encodes the peptide sequence at SEQ ID NO. 1976
accagcgcttgcaacaactcatccatccagcaccgtatcgtgccctcatcacattcacgcacaatggctcgcgctcagcaggtcgtggcgatcgccgtcgttgccgccgtcgtgctgctcgccgccgcggccacctccgaggccgccgtgacctgcgggcaggtcaactccgccatcggcccctgcatcgcctacgcccgcgggtccggctccggcccctcctcagcctgctgcagcggagtcaggagcctcaactccgccgccaggagcaccgccgacaggcgcgccgcatgcaactgcctcaagtccgccgcaggcagggtgagcggcctcaacgccggcaacgccgccagcatcccgtccaagtgcggagtcagcatcccctacaccatcagcccatccgtcgactgctccaagtaattattacatataaaaattcttgcctgac

SEQ ID NO: 1976 - protein, 118 aa, Panicum virgatum
  misc_feature: Ceres CLONE 1773430
  misc_feature (1)..(85): Pfam Name: Tryp_alpha_amyl Pfam Description: Protease inhibitor/seed storage/LTP family
MARAQQVVAIAVVAAVVLLAAAATSEAAVTCGQVNSAIGPCIAYARGSGSGPSSACCSGVRSLNSAARSTADRRAACNCLKSAAGRVSGLNAGNAASIPSKCGVSIPYTISPSVDCSK

SEQ ID NO: 1977 - DNA, 568 bp, Panicum virgatum
  misc_feature: Ceres CLONE 1773455
  misc_feature: Encodes the peptide sequence at SEQ ID NO. 1978
atgtttatcctggccaaggactcacagatacagaggccattataggggttgaagccagctcaaaatagcctcaccgttccaggtgacaactggcccctctaatggatagcagcagcggcagcagaagcagcagccgggacaagaagtccaaagataacgatcttcatgaagcaaaagaagctaatagcactgcacagaattttgttgacttcacagaagcagaggaagatcttgtttccagaatgcacaggcttgtgggaaacagatgggagcttatagcaggaagaattccaggaaggacagcagaagaagttgagatgttttggtccaaaaaacaccagggaaaatgaaaacggggccattactttatattgatctataaactatgtattaatatcacttgaaaatgtgcttataaataatgttaaccatgcaaagatgaaaaaagccatatagtattatgagctcactcgaggagcgatgtggattggcacttcaagttaagttagcagtgttatctgtgttcattttgtaattgcatcttgttataacatgatgtcaattttac

SEQ ID NO: 1978 - protein, 82 aa, Panicum virgatum
  misc_feature: Ceres CLONE 1773455
  misc_feature (1)..(46): Pfam Name: Myb_DNA-binding Pfam Description: Myb-like DNA-binding domain
  misc_feature: The sequence is a functional homolog of  SEQ ID NO 1049 in the  10/412,699 US patent application
  misc_feature: The sequence is a functional homolog of  SEQ ID NO 1050 in the  10/412,699 US patent application
  misc_feature: The sequence is a functional homolog of  SEQ ID NO 1064 in the  10/666,642 US patent application
  misc_feature: The sequence is a functional homolog of  SEQ ID NO 1065 in the  10/666,642 US patent application
  misc_feature: The sequence is a functional homolog of  SEQ ID NO 1071 in the  11/479,226 US patent application
  misc_feature: The sequence is a functional homolog of  SEQ ID NO 1081 in the  10/374,780 US patent application
  misc_feature: The sequence is a functional homolog of  SEQ ID NO 1082 in the  10/374,780 US patent application
  misc_feature: The sequence is a functional homolog of  SEQ ID NO 1087 in the  10/374,780 US patent application
  misc_feature: The sequence is a functional homolog of  SEQ ID NO 1088 in the  10/374,780 US patent application
  misc_feature: The sequence is a functional homolog of  SEQ ID NO 1089 in the  10/374,780 US patent application
  misc_feature: The sequence is a functional homolog of  SEQ ID NO 1090 in the  10/374,780 US patent application
  misc_feature: The sequence is a functional homolog of  SEQ ID NO 1408 in the  10/666,642 US patent application
  misc_feature: The sequence is a functional homolog of  SEQ ID NO 148 in the  10/374,780 US patent application
  misc_feature: The sequence is a functional homolog of  SEQ ID NO 1808 in the  10/412,699 US patent application
  misc_feature: The sequence is a functional homolog of  SEQ ID NO 2131 in the  10/666,642 US patent application
  misc_feature: The sequence is a functional homolog of  SEQ ID NO 2133 in the  10/666,642 US patent application
  misc_feature: The sequence is a functional homolog of  SEQ ID NO 2147 in the  10/666,642 US patent application
  misc_feature: The sequence is a functional homolog of  SEQ ID NO 2157 in the  10/666,642 US patent application
  misc_feature: The sequence is a functional homolog of  SEQ ID NO 2165 in the  10/666,642 US patent application
  misc_feature: The sequence is a functional homolog of  SEQ ID NO 2167 in the  10/666,642 US patent application
  misc_feature: The sequence is a functional homolog of  SEQ ID NO 234 in the  10/714,887 US patent application
  misc_feature: The sequence is a functional homolog of  SEQ ID NO 234 in the  11/435,388 US patent application
  misc_feature: The sequence is a functional homolog of  SEQ ID NO 286 in the  10/714,887 US patent application
  misc_feature: The sequence is a functional homolog of  SEQ ID NO 326 in the  11/435,388 US patent application
  misc_feature: The sequence is a functional homolog of  SEQ ID NO 328 in the  10/714,887 US patent application
  misc_feature: The sequence is a functional homolog of  SEQ ID NO 328 in the  11/435,388 US patent application
  misc_feature: The sequence is a functional homolog of  SEQ ID NO 330 in the  10/714,887 US patent application
  misc_feature: The sequence is a functional homolog of  SEQ ID NO 360 in the  11/435,388 US patent application
  misc_feature: The sequence is a functional homolog of  SEQ ID NO 362 in the  10/714,887 US patent application
  misc_feature: The sequence is a functional homolog of  SEQ ID NO 370 in the  11/435,388 US patent application
  misc_feature: The sequence is a functional homolog of  SEQ ID NO 372 in the  10/714,887 US patent application
  misc_feature: The sequence is a functional homolog of  SEQ ID NO 378 in the  11/435,388 US patent application
  misc_feature: The sequence is a functional homolog of  SEQ ID NO 380 in the  10/714,887 US patent application
  misc_feature: The sequence is a functional homolog of  SEQ ID NO 380 in the  11/435,388 US patent application
  misc_feature: The sequence is a functional homolog of  SEQ ID NO 382 in the  10/714,887 US patent application
  misc_feature: The sequence is a functional homolog of  SEQ ID NO 42 in the  10/225,068 US patent application
  misc_feature: The sequence is a functional homolog of  SEQ ID NO 468 in the  10/412,699 US patent application
  misc_feature: The sequence is a functional homolog of  SEQ ID NO 558 in the  10/374,780 US patent application
  misc_feature: The sequence is a functional homolog of  SEQ ID NO 559 in the  10/374,780 US patent application
  misc_feature: The sequence is a functional homolog of  SEQ ID NO 758 in the  10/225,066 US patent application
  misc_feature: Useful for making plants with modulated growth and phenotype characteristics
MDSSSGSRSSSRDKKSKDNDLHEAKEANSTAQNFVDFTEAEEDLVSRMHRLVGNRWELIAGRIPGRTAEEVEMFWSKKHQGK

SEQ ID NO: 1979 - DNA, 726 bp, Panicum virgatum
  misc_feature: Ceres CLONE 1773476
  misc_feature: Encodes the peptide sequence at SEQ ID NO. 1980
aaaaaaaaaaaaaattcgcacacccgctcgcgccgccgccgccgccgccgcattactctgcgaacctagacccccaccgcggcggcttcgagcttccccagccatgacgttcaagcggaggaatggcgggcgcaacaagcacgggcgtggccacgtcaagtatatccggtgctccaactgcgctaagtgctgccccaaggataaagccatcaagcggttcttggtgaggaacattgttgagcaggctgcggtgagagatgtgcaggaggcttgtgtgcatgatggatatgttcttcccaagctgtacgcaaaggttcatcactgtgtctcatgcgcaatccatgcacacattgttcgtgttcgttctcgtgagaacaggaggaaccgtgagcctccgcagcgcttcaggcgcagggatgatggcccgaggccaggccaaggtccgccccgcccaggtggtggcgcacctcccgcagcggctcctgctgctcctcgcacctaagttgaggaatgtgtttcagggcttagttttgtcaccgatgggataatacactatccctgttttgagataagcaatgttgctgtatccggttcattttgtttagcacaatttttgtctgctctcaccattgttcatccatatgttcgtgatgacactgatatattgcaatatgaagctgttggttttgccggtttcaaatgtgacaaaaaaaaaaaaaaaaaaaa

SEQ ID NO: 1980 - protein, 132 aa, Panicum virgatum
  misc_feature: Ceres CLONE 1773476
  misc_feature: Great-hit functional homolog of the protein sequence given in SEQ ID NO 9225
  misc_feature: Useful for making plants with modulated nitrogen use efficiency
MTFKRRNGGRNKHGRGHVKYIRCSNCAKCCPKDKAIKRFLVRNIVEQAAVRDVQEACVHDGYVLPKLYAKVHHCVSCAIHAHIVRVRSRENRRNREPPQRFRRRDDGPRPGQGPPRPGGGAPPAAAPAAPRT

SEQ ID NO: 1981 - DNA, 737 bp, Panicum virgatum
  misc_feature: Ceres CLONE 1773489
  misc_feature: Encodes the peptide sequence at SEQ ID NO. 1982
agccttgacgtagcaggctcgctcgagctaggctcagtggggtcggggctcatctcctccctctgtttctcgagcaaacctttcccttctcttggacagcgacgactcgactgggcgagcggcggcgccgtctgtcacgtcttcgcccagctctttgccggcgacgagcgcatcctccagcttcaagcggaaggcgccgcttcttcaagatgccgagggccacgagcgatgcaaagcttctgatccagtccctgagcaaggcgtatgctgccacaccaacaaatcttaagattatcgacctgtatgtcatttgtgctgtcgctaccgccgtgattcaggttgcatacatgggattggttgggtcattccctttcaactccttcctctcaggtgtcctttcatgcataggaactgcagtacttactgtttgcctccgcattcaagtgaacaaagacaacaaggaatttaaggatcttcccccagaaagggcctttgctgacttcgttctgtgcaacctggtgctccacctggtgatcatgaacttccttggataagcaaccgctgtacaccgagtggttaagattttgtagccccagattgtgtacgctgatcagtgtgtttaaatctttggaactgtcataatgccgagtatccatatgacttgtcacagattacctatgtaaagacagaattcttgagtccagtgttgacaatgtcaaaaaaaaaaaaaaaaaaaa

SEQ ID NO: 1982 - protein, 114 aa, Panicum virgatum
  misc_feature: Ceres CLONE 1773489
  misc_feature: Great-hit functional homolog of the protein sequence given in SEQ ID NO 9749
  misc_feature (1)..(114): SWISSPROT Homolog: EC 2.4.1.119 Dolichyl- diphosphooligosaccharide--protein glycosyltransferase subunit DAD1
  misc_feature: Useful for making plants with modulated flowering time
  misc_feature: The plant flowers significantly late compared to wild-type.
MPRATSDAKLLIQSLSKAYAATPTNLKIIDLYVICAVATAVIQVAYMGLVGSFPFNSFLSGVLSCIGTAVLTVCLRIQVNKDNKEFKDLPPERAFADFVLCNLVLHLVIMNFLG

SEQ ID NO: 1983 - DNA, 659 bp, Panicum virgatum
  misc_feature: Ceres CLONE 1773593
  misc_feature: Encodes the peptide sequence at SEQ ID NO. 1984
atatagcctcagaccaagaaacgcttgatggcggaggtgaccctgcgccgcttcaagctctccgacgtggacgccatgatggtgtgggcgtcggacccgcaggtggccgccttctgccggtgggagccctacgagtccagggagcccctgctggcgttcctccgcgacaccgtgctcccgcacccatggttccgcgccgtgtgcgcccccggctccggcgcggtgtccgtggcgccgacggcggagcggtgctgcggggagctcggctacgtggtggcccgcgcgcactggggcaagggcgtggcgaccgcggccgtgcggcgagcgctgcgggacgtgttcgcagaggtggaggggctgcggcgcgtggaggcgctggtggacgtggacaacccggcgtcgctgcgcgtcgcggagaaggccgggctccgccgcgagggcgtcctgcggcggcactactggcacaagggccgcgccagggacatggtcatgtacagcttcctcgcctccgacccgctccccggatgatctgatctcgcatcggcggcggtgtttggaggatgaagatgacagcaatcaggtagctctggatgaatctgtgttcttttggatggtgtctcactgtctctggatgattcagctctcggttgtcacttgtc

SEQ ID NO: 1984 - protein, 166 aa, Panicum virgatum
  misc_feature: Ceres CLONE 1773593
  misc_feature (9)..(80): Pfam Name: Acetyltransf_1 Pfam Description: Acetyltransferase (GNAT) family
MAEVTLRRFKLSDVDAMMVWASDPQVAAFCRWEPYESREPLLAFLRDTVLPHPWFRAVCAPGSGAVSVAPTAERCCGELGYVVARAHWGKGVATAAVRRALRDVFAEVEGLRRVEALVDVDNPASLRVAEKAGLRREGVLRRHYWHKGRARDMVMYSFLASDPLPG

SEQ ID NO: 1985 - DNA, 745 bp, Panicum virgatum
  misc_feature: Ceres CLONE 1773631
  misc_feature: Encodes the peptide sequence at SEQ ID NO. 1986
gtgctctctcagaggtgggttggcttctcctccccctcttaccaagtcctcggctctagggttttagtgggaagggagatggcggcggcggatgtggagtaccgctgcttcgtcggcggcctcgcctgggccaccgacaacgcgtccctccagcaggccttcgcctcctacggtgacgtcctcgactccaaggtcatcaccgaccgtgagacggggaggtcccgcgggttcggcttcgtcaccttctcctccgagcagtcgatgctggacgccatcgaagccatgaacggcaaggatctcgacggccgcaacatcaccgtcaaccaggctcagtcccgcggcggcggcggcggcggctacagcggcggtcgtcagggtggctacggcggcggcggcggcggctacggaggcggtggtggctacggcggtggtcgccgtgagggcggctacggcggaggcggtggcggcggtcgccgcgagggcggctacggtggtggtggctacggcagccgcggtgactccggtggtaactggaggaactgatggggtggccctcccgtgctggcagccaagttatcctatatatctattagtgttcgtgtcactgtttgatccgagttacccctgagttttgtccgtgtgttaccgttcgattaggtgttggttcccatgtttaccgttcccgagttgtttccgcaatgaaatgagaagaaaagagtgtccgcaaaaaaaaaaaaaaaaaaaa

SEQ ID NO: 1986 - protein, 154 aa, Panicum virgatum
  misc_feature: Ceres CLONE 1773631
  misc_feature: Great-hit functional homolog of the protein sequence given in SEQ ID NO 9183
  misc_feature: Great-hit functional homolog of the protein sequence given in SEQ ID NO 9185
  misc_feature: Great-hit functional homolog of the protein sequence given in SEQ ID NO 9703
  misc_feature: Useful for making plants with altered Lignin content
  misc_feature: Useful for making plants with altered alkaloid content
  misc_feature: Useful for making plants with modulated biomass
  misc_feature: Useful for making plants with modulated nitrogen use efficiency
  misc_feature: Useful for making plants with modulated nitrogen use efficiency
  misc_feature: The plant is abnormally small.
MAAADVEYRCFVGGLAWATDNASLQQAFASYGDVLDSKVITDRETGRSRGFGFVTFSSEQSMLDAIEAMNGKDLDGRNITVNQAQSRGGGGGGYSGGRQGGYGGGGGGYGGGGGYGGGRREGGYGGGGGGGRREGGYGGGGYGSRGDSGGNWRN

SEQ ID NO: 1987 - DNA, 827 bp, Panicum virgatum
  misc_feature: Ceres CLONE 1773647
  misc_feature: Encodes the peptide sequence at SEQ ID NO. 1988
gggagcgcaccgccggctcgctgtctccgctctgccgcgccgccgcagatggccggagccacctcgccggcagcgcgcgcgcttgtcagccgctggatggctccactcatcctcctcttcctctacgggtgctgcagctgtggagctgtcgagagggagagaacccttgcgatgatcaagccggatggtttgtctgggaactacactgaaaagatcaaggcggccatcttggattctggatttcatattgtcaaagagacccaggtccagcttgatgctgagagggcatctctcttctatgcggagcattctgggagaagcttctttgacagcctagtcaagtatataacgagtggcccagttcttgctatggttctggaaagacctgatgccattgcacaatggcgtgctttgattgggccaactgatgcaagaaaggctaaaactactcatccaaacagcattagagcaatgtgtgggttggactcggagaaaaactgtgtgcatggttcagattcaccggaatctgcagccagagagatttcatttttctttggagatggcgattctgaaactgtggaacatgatgagctatagacactagactggaatcagtcaaggcagtaaattgaaacttgatgactcctatgaactcatagttgatgaaaacttgggtgaatcagacaagtctactctgatagcacattacaattcttgacatggtaacttaatatacagagttctgaaagaactgatctgcagattgtgattgctgaagattacgatggtttaacagaaaccttcactaaaaaaaaaaaaaaaaaaaa

SEQ ID NO: 1988 - protein, 182 aa, Panicum virgatum
  misc_feature: Ceres CLONE 1773647
  misc_feature (1)..(135): Pfam Name: NDK Pfam Description: Nucleoside diphosphate kinase
MAGATSPAARALVSRWMAPLILLFLYGCCSCGAVERERTLAMIKPDGLSGNYTEKIKAAILDSGFHIVKETQVQLDAERASLFYAEHSGRSFFDSLVKYITSGPVLAMVLERPDAIAQWRALIGPTDARKAKTTHPNSIRAMCGLDSEKNCVHGSDSPESAAREISFFFGDGDSETVEHDEL

SEQ ID NO: 1989 - DNA, 615 bp, Panicum virgatum
  misc_feature: Ceres CLONE 1773653
  misc_feature: Encodes the peptide sequence at SEQ ID NO. 1990
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
attcagctgagtgtgctcgatcatccctcaaacaacccagccccccannnatcctttcatcagatcatcttccttcttccaagatgtcttgcagctgccgtttcagaagccccccccgctcccactgcaagtgcggcaagatgtaccctgaccttgaggagaagagcagcggcggcgctcaggccaccatcgtcctcggcgtggccccggagaagaaggccggccagttcgaggcggcggcagagtccggcgagaccgcccacgcctgcaagtgcggtaacagctgcagctgcgacccctgcaactgctgatttcgatggggaacgttttaacacacctgcatgcatgcatgctagctactacctactactctgcttgtgtgtgactttatgattgaacaagaataaggatgagcctgagccatcatgtctcatgtatcggtttggctccggcctcatcaagcatgcatgcgtcgtctgcccctctgtgtgctttgcgtccgtcctgtgtctgtatgtgttgatcattgcaaagaaaccatgcaggcatacatctttgcatgtgtctctgtaatgatcggtccagagtgatgaatatataaaactggtttgcttt

SEQ ID NO: 1990 - protein, 75 aa, Panicum virgatum
  misc_feature: Ceres CLONE 1773653
  misc_feature (1)..(74): Pfam Name: Metallothio_2 Pfam Description: Metallothionein
MSCSCRFRSPPRSHCKCGKMYPDLEEKSSGGAQATIVLGVAPEKKAGQFEAAAESGETAHACKCGNSCSCDPCNC

SEQ ID NO: 1991 - DNA, 695 bp, Panicum virgatum
  misc_feature: Ceres CLONE 1773741
  misc_feature: Encodes the peptide sequence at SEQ ID NO. 1992
atcctgaatctgagcccctttcgtcttgcccagcctcgagcacgtcccccttcccctcctctaccctccctccattcgattcgagcttatcgctagggttcctgaccccgctccaccttctcccatggcggacgaagccaaccgaacggcgttcatggagctgcaggcccggatgttcgataccaccgggaagatcaagcagttacaaacccaaatgcgttctaaagagggggaaaagaagcgtgcttacctcactctgaaggaactccgccaattgccagatgacactaacacctacaagactgttggaaaagtgtttattttggagccaaaatcagttcttttgaacgagcaagagcaaaaatttaatgaaagtgagagcgcgatagcatcaatgcagacttcgaaggaataccttgagaaacaggtgggaggagtggagaacaacatcagagagctgcttcaacaggacccgggccttgcacgccagattctctcgatgactgtccaatgagagttgtttacgctgcatttgcatatgatcaggtgtaattttacaatttgatctgtctgcaaactctgctttccccttgccgtactgtgagttgtgggtggtgttttgctgcaatggtccgttccatgtatgaacaaaagaatttgcagttgcttccctgcatagttttagtttgttgact

SEQ ID NO: 1992 - protein, 129 aa, Panicum virgatum
  misc_feature: Ceres CLONE 1773741
  misc_feature: Great-hit functional homolog of the protein sequence given in SEQ ID NO 9498
  misc_feature: Useful for making plants with altered terpenoid content
MADEANRTAFMELQARMFDTTGKIKQLQTQMRSKEGEKKRAYLTLKELRQLPDDTNTYKTVGKVFILEPKSVLLNEQEQKFNESESAIASMQTSKEYLEKQVGGVENNIRELLQQDPGLARQILSMTVQ

SEQ ID NO: 1993 - DNA, 567 bp, Panicum virgatum
  misc_feature: Ceres CLONE 1773801
  misc_feature: Encodes the peptide sequence at SEQ ID NO. 1994
aaacagtaaagcccccggagaagcagcaagagcccgccccccccgccgcttccacttgctccccaagaagaaaacagcggcggagatggcgaagcgtctgatcccgtcgctgaaccgggtgctggtggagaagctgctgccgcccaagaagagcgccggcggcctcctcctcccggagaccaccaagcagctgaatgctgcgaaagtcatagctgttggaccgggtgatcgtgatagggatggcaagctgatccctgtatctttgagtgaaggtgacactgttctacttcctgagtacggtggaacagaagtgaagctcgctgagaaagagtaccttcttttcagagagcacgacatactgggaaagctagaggagtaatcctgggctgccaggatctctgaaggatagagttgtttggaagtggagatgcaggagtgtagccactgctactgagttttttctttttttggtgtctgtggaggacaaatgaaaagcccatccattgtttgagtattcgatgacattgccttatcctaaacttttttgaattggaatggttgccgctg

SEQ ID NO: 1994 - protein, 97 aa, Panicum virgatum
  misc_feature: Ceres CLONE 1773801
  misc_feature (1)..(93): Pfam Name: Cpn10 Pfam Description: Chaperonin 10 Kd subunit
MAKRLIPSLNRVLVEKLLPPKKSAGGLLLPETTKQLNAAKVIAVGPGDRDRDGKLIPVSLSEGDTVLLPEYGGTEVKLAEKEYLLFREHDILGKLEE

SEQ ID NO: 1995 - DNA, 824 bp, Panicum virgatum
  misc_feature: Ceres CLONE 1773805
  misc_feature: Encodes the peptide sequence at SEQ ID NO. 1996
gttgacacctatcgccgcttccagagtcgccggcggcctgtgttctcccacgcttctcctgcggccagggcggcgaggcggcgggacgtgaggatgatgggcagcaacagcggcggagggggcggaggccctggcgggggcatgggtccgggcatgggcgggcccgtgagtggaggcggggacgggcggcacgacgacgaagccgcgctcaccgagttcctctcctcgctcatggactacacccccacgattcccgatgagcttgtggagcactacctcggacgcagcggattccactgccctgacctccgcttaacgagattggttgctgtagctgcccagaagttcctttcggacattgcaagcgattctcttcagcactgcaaggccagggtagtagcaccaatcaaagacaataagagcaaacagcctaaggatagacgtcttgtactaactatggatgatctttcgaaagccttgcgtgagcatggtgtgaacttgaaacacgcggagtacttcgcagacagcccttctgcaggaatggctcctgcaacaagggaggaatagattggattgagccaacctgtatcaagtgtctaagtggaactgggtatactgggatcatgtcaatgagtagcctgtccacattcttgcccaattcgatgtaatggtgtactagcatagcctccaaagtgtggactccattgctattcgtgctgtattagtattgaccattagggtgtgatttctacttactaagattgtgttatcaatgctgattagtctctctcggttaagattatcaaaaaaaaaaaaaaaaaaaa

SEQ ID NO: 1996 - protein, 157 aa, Panicum virgatum
  misc_feature: Ceres CLONE 1773805
  misc_feature: Great-hit functional homolog of the protein sequence given in SEQ ID NO 9359
  misc_feature: Great-hit functional homolog of the protein sequence given in SEQ ID NO 9415
  misc_feature: Useful for making plants with altered Lignin content
  misc_feature: Useful for making plants with altered terpenoid content
MMGSNSGGGGGGPGGGMGPGMGGPVSGGGDGRHDDEAALTEFLSSLMDYTPTIPDELVEHYLGRSGFHCPDLRLTRLVAVAAQKFLSDIASDSLQHCKARVVAPIKDNKSKQPKDRRLVLTMDDLSKALREHGVNLKHAEYFADSPSAGMAPATREE

SEQ ID NO: 1997 - DNA, 1021 bp, Panicum virgatum
  misc_feature: Ceres CLONE 1773850
  misc_feature: Encodes the peptide sequence at SEQ ID NO. 1998
agatcagaatcagaccaacacagccgcaggcagcagctacactacttgcttgctttgcttgtaactacccacagctacttgcattggcctgcgttagcgttatggccaacaacaagctccccgcccttcccctcgccgccgtcctcctggcgctcgccgcgtcctcactcgccggcgaccccgacatgctccaggacatctgcgtcgccgactacaagtccctcaacggccctctgaggctgaacgggttcccgtgcaagaggctggagaacgtgacggccgacgacttcttctccggcctgctcgcgatccccggcgacacgggcaacgcggcggggtcggcggtgacggcggcgaacgtggagaggctcccggggctcaacaccctgggcgtgtccatggcgcggatcgacttcgcgccgtggggcgtcaacccgccgcacacgcacccgcgcgccaccgaggtcatcttcgtgctccagggctccctcgacgtggggttcgtcaccaccgccaacaggctctacgcccgcaccgtctgcaggggcgaggtcttcgtcttcccgcgcggcctcgtccactaccagaggaacaacggcggcacccccgccgcggtcatgtcggcattcaacagccagctgccgggcacgcaggccgtcgtccagaccctcttcggcgcctcgcctgcagtgcccaccgacgtgctggccagggcgttccagatcgacggcggcctcgtggaggccatcaagtccaagttcccgcccaagtaagcaccgcacgcggggcgtacatatgctgccatgaattgaatgaaattggtggtccatgtcattcgataccattacgggtttcgtttgatgcgctagccagcagtacatcatcacgttgtatgctacgttgggttgtttcgtgtggtcatgcatggcctcaacacttcactgttgctgcttttcatctttggcgtaaaccatttgtgtaattaagatggtatgtatatgtcaccgccggcattgtctcc

SEQ ID NO: 1998 - protein, 223 aa, Panicum virgatum
  misc_feature: Ceres CLONE 1773850
  misc_feature (3)..(222): SWISSPROT Homolog: EC 1.15.1.1 Nectarin-1 precursor
MANNKLPALPLAAVLLALAASSLAGDPDMLQDICVADYKSLNGPLRLNGFPCKRLENVTADDFFSGLLAIPGDTGNAAGSAVTAANVERLPGLNTLGVSMARIDFAPWGVNPPHTHPRATEVIFVLQGSLDVGFVTTANRLYARTVCRGEVFVFPRGLVHYQRNNGGTPAAVMSAFNSQLPGTQAVVQTLFGASPAVPTDVLARAFQIDGGLVEAIKSKFPPK

SEQ ID NO: 1999 - DNA, 731 bp, Panicum virgatum
  misc_feature: Ceres CLONE 1773871
  misc_feature: Encodes the peptide sequence at SEQ ID NO. 2000
gtccgctcctcgcctcgtcccctcctctccgaattccgccgaaccctagccttttccttctctctcctcctcccagccgccgccgcagcgagcacgcggacgcagccatgtccgggaggaggaagacgcgggagcccaaggaggagaacgtgacgctcggccccaccgtccgcgagggcgagtacgtcttcggcgtcgcgcacatcttcgcctccttcaacgacaccttcatccatatcactgatctgtctgggagggagacgctcgtccgcatcactggtggcatgaaggtcaaagctgaccgtgatgagtcatccccttacgcagccatgcttgcagctcaggatgttgcccagagatgcaaggagcttggaatcactgctctgcacattaagctccgtgctaccggtggaaacaagacaaagtctccaggtcctggtgctcagtctgcgcttagggctcttgcacgttctggcatgaagattggacgcattgaggatgtgactccagtcccaactgacagcacacggaggaagggtggtaggaggggaaggaggctgtaatttcgtgccgaaccggatccaactggccgtgcaagctgttttgtgcttttgttcgtggtgctagcatcagatttcatggatttataagttttgagctaccttgtgtatcttaacattttgaaccgaattgctggcgtactttggctgcaaaaaaaaaaaaaaaaaaaa

SEQ ID NO: 2000 - protein, 151 aa, Panicum virgatum
  misc_feature: Ceres CLONE 1773871
  misc_feature: Great-hit functional homolog of the protein sequence given in SEQ ID NO 9712
  misc_feature: Useful for making plants with modulated biomass
  misc_feature: The plant is abnormally large.
MSGRRKTREPKEENVTLGPTVREGEYVFGVAHIFASFNDTFIHITDLSGRETLVRITGGMKVKADRDESSPYAAMLAAQDVAQRCKELGITALHIKLRATGGNKTKSPGPGAQSALRALARSGMKIGRIEDVTPVPTDSTRRKGGRRGRRL

SEQ ID NO: 2001 - DNA, 1166 bp, Panicum virgatum
  misc_feature: Ceres CLONE 1773924
  misc_feature: Encodes the peptide sequence at SEQ ID NO. 2002
cctccttcctccaccaccttccagcaagcgagccttatcttcttcttcgtccatccgtcctggcattggctagtaggtgtcgcgagacagggagggtagcagcgagctgagaggttcacggtgggggcggcggcggcggccatgaagatccagtgcgacgcgtgcgaggccgcggcggccacggtggtgtgctgcgccgacgaggcggcgctgtgcgcgcgctgcgacgtcgagatccacgccgccaacaagctcgccagcaagcaccagcgcctcccgctcgaggcgctctccgccaagctcccccgctgcgacgtctgccaggagaagacggccttcatcttctgtgtggaggaccgggcgctcttctgccgggactgcgacgagcccatccacgtccccggcacgctctccggcaaccaccagcgctacctcgccaccggcatccgcgtcggcctcgcctccgcggcctccgcgtgcggcgacgccggcgacgcccacgactcggaccaccaccccccgcccaaggccgcagtcgagccgccgccgcagcccgccgtctccgccgcagcggcgcagcaggtgccctcgccgccgccgttcctgccgcagggctgggccgtcgacgagctcctccagttctccgactacgagtccggcgacaagctgcagaaggagtcgccgctcgggttcaaggagctcgagtggttcgccgacatcgacctcttccacgaccaggcgccgcccaaggccggcagagcgctggcggaggtgcccgagcttttcggatcccaggcggcaagcgacgcggcgtactacaggccgagcaaagccggcgccggcgccggcgccggggtgcgccagagcaagaaggcccggatcgaggtcaccgacgacgaagaggactacctcatcgtccctgaccttggctgaaagaaagagcgcgagaattttggttcttcgcctgttgtggtgttgtataccagaagaattctactgtgtacaggctagtgtcatgtgttgtgcatcttgactgtactgtagtattgctcagctgtgaacatgataattctagccactgtgtgtaacagcctgtgtgacattttgatggttttaatatggcttttgtctcgaaacagttgaagcaaaaaaaaaaaaaaaaaaaa

SEQ ID NO: 2002 - protein, 263 aa, Panicum virgatum
  misc_feature: Ceres CLONE 1773924
  misc_feature (1)..(48): Pfam Name: zf-B_box Pfam Description: B-box zinc finger
  misc_feature: The sequence is a functional homolog of  SEQ ID NO 1961 in the  11/479,226 US patent application
  misc_feature: The sequence is a functional homolog of  SEQ ID NO 465 in the  11/479,226 US patent application
  misc_feature: Useful for making plants with modulated growth and phenotype characteristics
MKIQCDACEAAAATVVCCADEAALCARCDVEIHAANKLASKHQRLPLEALSAKLPRCDVCQEKTAFIFCVEDRALFCRDCDEPIHVPGTLSGNHQRYLATGIRVGLASAASACGDAGDAHDSDHHPPPKAAVEPPPQPAVSAAAAQQVPSPPPFLPQGWAVDELLQFSDYESGDKLQKESPLGFKELEWFADIDLFHDQAPPKAGRALAEVPELFGSQAASDAAYYRPSKAGAGAGAGVRQSKKARIEVTDDEEDYLIVPDLG

SEQ ID NO: 2003 - DNA, 812 bp, Panicum virgatum
  misc_feature: Ceres CLONE 1773938
  misc_feature: Encodes the peptide sequence at SEQ ID NO. 2004
gcgtacggtccagttacttgttcaggccctttcttcctttctcctcctcgctgacggcaagcgaatccggtaggcggctatggcgacggcggcggcggcggcggcgttcggctgctcctcggcggcggcgctgccgcccttctcggctctcccgggaagcctatgctcgcgccagtcgcgaccccctccccgcgtgtccctcatcgcctcctcgaagctcggggcgacggcgctcgggttgagagtttcgtgccgtagaaggaagctagttgtctctgcttgctcctccagtgagtccagttcggacgcggcggcgtcccggacggaagccactgttgatataaagcttccaagaagaagcttgcttgtccaatttacatgtaaggcatgtggtgaaaggacccagcggttaataaacagagtagcctatgaaagaggaacagtttttcttcagtgtgcagggtgccaggtgtaccacaagtttgtggacaatcttggtctagttgttgaatacgatctgcgagaagaaaatgtgctacaagaagacaatgtggtgaacacatattctgaagattgataatatcttgagaagccatgtcggtatgcaaactgttgtctgtagatttcaacaatatttattgtttgggtactgtacacatatttatattaaatgcaagttaaaattgctgcatatactcatgtgagttaacctgggcccatatgtactttacaatgtggtatctgatttaaagaggaaaataaagtaccataataccagagttctctagttccaaaaaaaaaaaaaaaaaaaa

SEQ ID NO: 2004 - protein, 165 aa, Panicum virgatum
  misc_feature: Ceres CLONE 1773938
  misc_feature (1)..(64): Pfam Name: zf-DNL Pfam Description: DNL zinc finger
MATAAAAAAFGCSSAAALPPFSALPGSLCSRQSRPPPRVSLIASSKLGATALGLRVSCRRRKLVVSACSSSESSSDAAASRTEATVDIKLPRRSLLVQFTCKACGERTQRLINRVAYERGTVFLQCAGCQVYHKFVDNLGLVVEYDLREENVLQEDNVVNTYSED

SEQ ID NO: 2005 - DNA, 1083 bp, Panicum virgatum
  misc_feature: Ceres CLONE 1773984
  misc_feature: Encodes the peptide sequence at SEQ ID NO. 2006
atcccattcccatcacccctcacctccaacgtttgcccgggcacgacgtgagacgacgagcggcgtcgggcgacccagctagctgccgcgccgcagcgttccagttcgttcaggcaggcggggtccggagatgagccacgagaacggagccgccgcccacggcgaggagcaggacgtgatggcggtggagccgaagcgccgggcgccgcggctcaacgagcggatcctctcctcgctgtcgcggaggtccgtcgccgcgcacccctggcacgacctcgagatcggtcctgaagctccggcggtcttcaacgtggtcgtggagatcaccaaggggagcaaggtcaagtacgagctggacaagaagacggggctcatcaaggtggaccgggtcctctactcctccgtcgtgtacccgcacaactacggcttcatcccccggtcgctctgcgaggacaatgaccccatggacgtcctcgtcctcatgcaggaaccagttcttcccggcgccttcctccgggcccgggcgatcggcctcatgcctatgatagatcagggtgagaaggacgacaagatcatagccgtctgcgccgacgatcccgagtaccgccactacaacgacatcagcgagctctcccctcaccgcctccaggagatccggcgcttcttcgaagactacaagaagaacgagaacaaggaggtggccgtcaacgagttcctccccgctgaagctgcccgcgaagccatccagtactccatggatctgtacgggcagtacattatgcagaccttgaggcggtagtgcgtgacccctgtctttcctctccctaccgaatcttatgcgatctgaagcaaaagcaccatatatcatcacaacatttggaatctgatgaacagacaagtcacatgagttgtcatgcttgttgatcatctttttccacagatattttagtgtgtatcttgctctttattagtgttctggaacttgtccacagtgtggtttgatctatgtactcctcttctacatttcttacaggacgaataaataaaattaatagtgtatcagaaaaaaaaaaaaaaaaaaaa

SEQ ID NO: 2006 - protein, 222 aa, Panicum virgatum
  misc_feature: Ceres CLONE 1773984
  misc_feature: Great-hit functional homolog of the protein sequence given in SEQ ID NO 9627
  misc_feature (1)..(155): Pfam Name: Pyrophosphatase Pfam Description: Inorganic pyrophosphatase
  misc_feature (12)..(222): SWISSPROT Homolog: EC 3.6.1.1 Soluble inorganic pyrophosphatase
  misc_feature: Useful for making plants with modulated nitrogen use efficiency
MSHENGAAAHGEEQDVMAVEPKRRAPRLNERILSSLSRRSVAAHPWHDLEIGPEAPAVFNVVVEITKGSKVKYELDKKTGLIKVDRVLYSSVVYPHNYGFIPRSLCEDNDPMDVLVLMQEPVLPGAFLRARAIGLMPMIDQGEKDDKIIAVCADDPEYRHYNDISELSPHRLQEIRRFFEDYKKNENKEVAVNEFLPAEAAREAIQYSMDLYGQYIMQTLRR

SEQ ID NO: 2007 - DNA, 953 bp, Panicum virgatum
  misc_feature: Ceres CLONE 1774155
  misc_feature: Encodes the peptide sequence at SEQ ID NO. 2008
ctctcggcgagcaccagggacacacgaagcttaagcttaagcagcagcacgcagcgccaccgcctcttcggctaaccgggcgctagccgctagctcctaaaagtttccagatggcgatggtgccgcggttgcttgtggcggcggcggccgtggcgctggcgttcgcgatggcggcggcgcagggcccggcggcggccccggggccggcgcccgggatcagcgacgagtgcctgaacgcggtgctcaacatgtcggactgcctgacgtacgtgacgaacgggagcacggtgcggcacccggacaaggcctgctgcccggagctggcggggctgctcgagtcccaccccatctgcctctgccagctgctcgccggcggcgccgactcctacggcgtcagcgtcgactacaagcgcgcgctcgcgctccccggcatctgccgcctcaccgcgccgcccgtcagcgcgtgcgcagcgttcggagtccctatccctgcaggactggcgcctactgcagcgccctcgcccatgtcatcatcaggcctctctccttacatcggcccagaagtgcctgcgaacacgccggccggctcggccgcgaagtcgtcgaaccacgccccgcgccgcgtcaccaccggcggcctcgccgccctcgccgcgctgcccctcgccgtcgcggccgccgccgggatgctctagaccgccgctggagctcgcgagcaccagcgttttagccctgtgatttctttctccattcttaccgcacatatggttgtgcattactatgaattactagacacctacgtacagacagttgcttccacgcgcgagattcttccgggtttgttgtttgtttgttttttccgtgtaataattcgttcctttcggtgtactgtaatttgctagagattgtgaccctgtgtcgggatcattttccaaaaaaaaaaaaaaaaaaaa

SEQ ID NO: 2008 - protein, 194 aa, Panicum virgatum
  misc_feature: Ceres CLONE 1774155
  misc_feature (1)..(80): Pfam Name: Tryp_alpha_amyl Pfam Description: Protease inhibitor/seed storage/LTP family
MAMVPRLLVAAAAVALAFAMAAAQGPAAAPGPAPGISDECLNAVLNMSDCLTYVTNGSTVRHPDKACCPELAGLLESHPICLCQLLAGGADSYGVSVDYKRALALPGICRLTAPPVSACAAFGVPIPAGLAPTAAPSPMSSSGLSPYIGPEVPANTPAGSAAKSSNHAPRRVTTGGLAALAALPLAVAAAAGML

SEQ ID NO: 2009 - DNA, 755 bp, Panicum virgatum
  misc_feature: Ceres CLONE 1774199
  misc_feature: Encodes the peptide sequence at SEQ ID NO. 2010
gtcgactcgccgtcgtctctgagccagtcttacttggaagtagggttttggtctctccaatccaatccgatccacctcgcggccgccgatggggaaggactcgaaggcgaaggacgcgaagggcaagggcaaggccgcatcctccggcggcgacgacgccggcggcaaggggggcaagggcaagggaggcaagtccgcagatggcctcggcacctgcacctatgtcaaagctaggcacgtattgtgtgagaagcaggggaaaatcaatgaggcttataagaagttgcaggatggatggctggacaatggggacaaggttcctcctgctgagttcgctaaggtagcccaggagttttctgaatgcccatcagggaagaaaggtggagatcttggctggttcccacgtggcaagatggctggccctttccaggaggttgcgttcaacacacctgtgggagctgttagcgcaccgttcaagtccacgcacggataccactttatcctctgtgaaggaagaaagaactgatctggaagcatgctcgggattggggagacctcatcaagcaatatgagacgcaatgcaaacacctcctcttctctgttggcttaataagcgctggacatgtgtattttgtgtttggctattggcatgctaaggaattgccaaaacaaaagaaagtgtgctttgctgtaactagctatgatgctgatatgccatatctatcagtattggttaaaaaaaaaaaaaaaaaaaa

SEQ ID NO: 2010 - protein, 145 aa, Panicum virgatum
  misc_feature: Ceres CLONE 1774199
  misc_feature (1)..(93): Pfam Name: Rotamase Pfam Description: PPIC-type PPIASE domain
MGKDSKAKDAKGKGKAASSGGDDAGGKGGKGKGGKSADGLGTCTYVKARHVLCEKQGKINEAYKKLQDGWLDNGDKVPPAEFAKVAQEFSECPSGKKGGDLGWFPRGKMAGPFQEVAFNTPVGAVSAPFKSTHGYHFILCEGRKN

SEQ ID NO: 2011 - DNA, 808 bp, Panicum virgatum
  misc_feature: Ceres CLONE 1774210
  misc_feature: Encodes the peptide sequence at SEQ ID NO. 2012
acagataagcagcagctcgagtccaaccaaacaacaaccggaagagaagagaaggcaagaagagactcacccgtcgctacgaacaccaattcttgcagagaggaggcatgagaacccaagtgttcttcctcacattcgccttgctcgctgtgctcgggcaatcgagcaacaggcaccaccaccaccaccaccactcccatgttcagagcaaagggcatggagggggaggaggaggaggggagctagcgagccgggggaaggcggcggcgcgggcgtggccgtgctgcgacaactgcggcgggtgcaccaagtcgaacccggcgcagtgccggtgccttgacgcggcgccccgcgggtgccacccggcctgccgggactgcgtcaagtccagcctcagcgccgacccgccggtgtaccagtgcatggaccgcgtccccaacttctgctcccgccgctgctccgccgccgccgcccactgaccggccggctgagcggacgacaacgagtcgacgactcgttctgattgctactgttgacccaccaactgtccaacccaacccacccacccgcccgcaattcctaccttctgaaggcaagctgtggattatagatttttgtgtgtagagagatgaggaatctgttcatcagatgagcaaaccaaaccaagcttggattttttttcctttttttttgtcttttgacttgacactgctctgtaattgctggctactactgcttgggctgtgttcagttcccacaaaatttccaaactttctaaacttttcattaaaaaaaaaaaaaaaaaaaa

SEQ ID NO: 2012 - protein, 123 aa, Panicum virgatum
  misc_feature: Ceres CLONE 1774210
  misc_feature (1)..(27): Pfam Name: Bowman-Birk_leg Pfam Description: Bowman-Birk serine protease inhibitor family
MRTQVFFLTFALLAVLGQSSNRHHHHHHHSHVQSKGHGGGGGGGELASRGKAAARAWPCCDNCGGCTKSNPAQCRCLDAAPRGCHPACRDCVKSSLSADPPVYQCMDRVPNFCSRRCSAAAAH

SEQ ID NO: 2013 - DNA, 682 bp, Panicum virgatum
  misc_feature: Ceres CLONE 1774240
  misc_feature: Encodes the peptide sequence at SEQ ID NO. 2014
acacttcggcggcgtgcgcgaggcgatcggatcggagcacaccatcccgacgaggcgacgaggaggaaggccggccggcgacccgggggaagaaggatggggaagactccggtgcggatgaaggcggtggtgtacgcgctgtcgccgttccagcagaaggtgatgccggggctgtggaaggacatcaccaccaagatccaccacaaggtcaccgagaactggatctccgccacgctcctcctcggccccgtcgtcagcacctaccaatatgcgatgtggtacaaggagcaggagaagctatcccacagatactaaatgagaggtcgtccaagttgactgccacagcagctggatttttcatgatggattatatatccttcaaggatgattaacatttgttggatgaattttggttgtactccttttcaccttcccatgcagataagacatctgtgccttgcaaacttgttgaggcttgctccatttggtggcatcttctgtccctgaagttgttaaataaatcaaattaactgcctgcttcgttttattttccctttttagcgattggtaactgcctcactgggtttatcagttggttcacttgcacttgtttgtttttgagttgatgtgatctgttgatcaatgccaccagccattggaccaaaaaaaaaaaaaaaaaaaa

SEQ ID NO: 2014 - protein, 72 aa, Panicum virgatum
  misc_feature: Ceres CLONE 1774240
  misc_feature: Great-hit functional homolog of the protein sequence given in SEQ ID NO 9358
  misc_feature (1)..(72): SWISSPROT Homolog: EC 1.10.2.2 Ubiquinol- cytochrome c reductase complex ubiquinone-binding protein QP-C
  misc_feature: Useful for making plants with modulated nitrogen use efficiency
MGKTPVRMKAVVYALSPFQQKVMPGLWKDITTKIHHKVTENWISATLLLGPVVSTYQYAMWYKEQEKLSHRY

SEQ ID NO: 2015 - DNA, 1035 bp, Panicum virgatum
  misc_feature: Ceres CLONE 1774339
  misc_feature: Encodes the peptide sequence at SEQ ID NO. 2016
taggacgacgtcaccttccgctcagctcgcctcgctcgagcgtcgagcccggaagaacgcgaagcagaggaagcgagccggcggaggcggcggagatgtcggcggggctggtgaccgacgaggcgaccatgggccggctctaccggatccggcggacggtgatgcagatgctgcgcgaccgcgggtacctggtgggtgagcacgagctcgccaccagccgccgcgacttcctccgcaagttcggcgagtccttccaccgcgaggacctcctcatcaacaagtacaagaagaacgacccctccgaccagatatatgttttcttccccaacgatgacaaggtggggatgaaacacatcaagaagtatgttgaaatgatgacacatgagaacgtctccaaagctgtggtggttcttcagcagaatctaactccatttgccaagtcatttctcatagaattagagccaaagatccacttggaagttttccaggaggctgagttgcttataaacatcaaggagcatgttcttgttcctgagcatcaggtgctcacaaatgaggagaagaagacactattggagcggtacaccttaaaggagactcagcttccaagaatacagatttcggatcccattgcaaggtactatggcctgagacgaggtcaggtggtgaagatcatcaggcccagtgagacggccggcagatacgtcacataccgctacgttgtatgagacaacgtcgtgaaactcagaacacaagtgaactgaagaagagaaccatagatatggtaatttttgaagttataaacacatacaccccatgtgcttggagaaatcagtatcgctttgtagcagacactgtcagcgatcgaacagtggatgccgtttaagtgaatttgaataagccgagtatataggacacacatgaattctcacgctgtacactttttgatgaatgatctgtataaacactactacataataacagaagcttgttttcggagcgattgaagctcctgaaaaaaaaaaaaaaaaaaaa

SEQ ID NO: 2016 - protein, 210 aa, Panicum virgatum
  misc_feature: Ceres CLONE 1774339
  misc_feature: Great-hit functional homolog of the protein sequence given in SEQ ID NO 9647
  misc_feature (1)..(89): Pfam Name: RNA_pol_Rpb5_N Pfam Description: RNA polymerase Rpb5, N-terminal domain
  misc_feature (1)..(74): Pfam Name: RNA_pol_Rpb5_C Pfam Description: RNA polymerase Rpb5, C-terminal domain
  misc_feature (8)..(209): SWISSPROT Homolog: EC 2.7.7.6 DNA-directed RNA polymerase II 23 kDa polypeptide
  misc_feature: Useful for making plants with modulated drought sensitivity
MSAGLVTDEATMGRLYRIRRTVMQMLRDRGYLVGEHELATSRRDFLRKFGESFHREDLLINKYKKNDPSDQIYVFFPNDDKVGMKHIKKYVEMMTHENVSKAVVVLQQNLTPFAKSFLIELEPKIHLEVFQEAELLINIKEHVLVPEHQVLTNEEKKTLLERYTLKETQLPRIQISDPIARYYGLRRGQVVKIIRPSETAGRYVTYRYVV

SEQ ID NO: 2017 - DNA, 864 bp, Panicum virgatum
  misc_feature: Ceres CLONE 1774379
  misc_feature: Encodes the peptide sequence at SEQ ID NO. 2018
agagacgccatcgtcgcgggacaagtcatccccttcctctctcgcgcgcgctcgggagttgccggagccctcccccccgccgccgccatggaggaggcgcaggttgtgcagtcaaaggatggaaccatctcggtggccgctgcatttgctggtcatcaggaagccgtacaggacagggaccacaaattcttgacaaaagcagtggaagaagcctatcggggagtcgattgcggtgatggaggtccgtttggtgcggtggttgtccgtaatgatgaagtagtagttagctgccataacatggttctgaagcacactgatccaacagctcatgctgaagtaactgcaataagagaggcttgcaaaaagctagggaaaattgagctgtccgactgtgaaatttatgcctcctgcgagccatgcccaatgtgcttcggtgcagttcatctttctcggatcaagaggctagtttatggagctaaggcggaggctgccattgccattggattcgatgacttcatcgctgatgctctgagaggcactgggttctaccagaaggccaacctggagatcaagaaggctgagggcaacggagcgctgatcgctgagcaggtcttcgagaagaccaaggagaagttccagatgtactgatgtttagcagaaaaacaaatctcatatttgtacaatgctcattcagaaggaataataggatgcccagatttccattgcttcagaaaactatctgtccaaatgtgttacatgccgaggatatcccaatgtcatgtaaacttacaaggtggttctttgctgtagcttaatgcgcagttaatggaattcagttgctgtcaaaaaaaaaaaaaaaaaaaa

SEQ ID NO: 2018 - protein, 186 aa, Panicum virgatum
  misc_feature: Ceres CLONE 1774379
  misc_feature (1)..(103): Pfam Name: dCMP_cyt_deam_1 Pfam Description: Cytidine and deoxycytidylate deaminase zinc- binding region
  misc_feature (31)..(144): SWISSPROT Homolog: EC 3.5.4.3 Guanine deaminase
MEEAQVVQSKDGTISVAAAFAGHQEAVQDRDHKFLTKAVEEAYRGVDCGDGGPFGAVVVRNDEVVVSCHNMVLKHTDPTAHAEVTAIREACKKLGKIELSDCEIYASCEPCPMCFGAVHLSRIKRLVYGAKAEAAIAIGFDDFIADALRGTGFYQKANLEIKKAEGNGALIAEQVFEKTKEKFQMY

SEQ ID NO: 2019 - DNA, 866 bp, Panicum virgatum
  misc_feature: Ceres CLONE 1774620
  misc_feature: Encodes the peptide sequence at SEQ ID NO. 2020
agagagagagagagagagagagagagagagagaggagacagcaacaccggctgcttaatctcttcttttcctcggcttatctccaagggcgcatctccagaagcggaagggaggaacggagcggcgaattcttgttttcgcgcaagatgtcttccccaagcaagcgccgggagatggacctcatgaagctgatgatgagcgactacaaggtggagatggtgaacgatgggatgcaggagttctttgttgacttccgtgggcctaacgaaagcatttatcaaggaggcgtgtggaaggttagagtagaactgccagatgcatatccatacaaatccccgtcgattggtttcatcaataagatatatcacccaaatgtcgatgaaatgtctggttcagtctgtttggatgtcatcaaccaaacatggagcccaatgtttgatcttgtcaatgtgtttgaggtcttcctcccacaacttctactatatccaaatccttctgatccattgaatggagatgctgctgcattgatgatgcgtgatcggcctgcttatgaacaaaaagtgaaagagtactgcgaaaaatatgccaaaccagaggatgctggggtagtcccagaggacaagtccagtgacgaagagctgagtgaggaagaagatgactccggtgacgaggagatactggggaaaccagatccgtagacaagttgtaaccttttcctctggctaatcagcacgccacgtttattgcagcaactgcaatgaaacagtctctgaacccttcccgtgcagcctgaatgtcgtgtaaataaactgcagtgtcatgttccctaatgttatttccaccctgaaaaaaaaaaaaaaaaaaaa

SEQ ID NO: 2020 - protein, 183 aa, Panicum virgatum
  misc_feature: Ceres CLONE 1774620
  misc_feature (1)..(183): SWISSPROT Homolog: EC 6.3.2.19 Ubiquitin-conjugating enzyme E2-21 kDa 1
  misc_feature (1)..(183): SWISSPROT Homolog: EC 6.3.2.19 Ubiquitin-conjugating enzyme E2-23 kDa
MSSPSKRREMDLMKLMMSDYKVEMVNDGMQEFFVDFRGPNESIYQGGVWKVRVELPDAYPYKSPSIGFINKIYHPNVDEMSGSVCLDVINQTWSPMFDLVNVFEVFLPQLLLYPNPSDPLNGDAAALMMRDRPAYEQKVKEYCEKYAKPEDAGVVPEDKSSDEELSEEEDDSGDEEILGKPDP

SEQ ID NO: 2021 - DNA, 633 bp, Panicum virgatum
  misc_feature: Ceres CLONE 1774672
  misc_feature: Encodes the peptide sequence at SEQ ID NO. 2022
atcctgccagctgccgcggccaagattcaagaactcgcgccccacgcacggacagggccggagcccggagatcgagagagtgaccgacagtcccaggcgccatgaacgtggaggaggaggtcgggaagctcaaggaggagatccagaggctcggccagaagcagcccgatggctcctacaaggtcaagttcggtgtactcttcaatgatgatcgctgtgccaacatttttgaagcactagtcggcaccttgagggccgctaagaagaggaaaattttgacatatgatggcgagctgcttctgcagggtgttcatgacaatgtggagataaccctattgccgcctcctgcagttgctgccgcctgaggcacaccgatccagcagtcccctattctgtactgttgatatgctagtactttgttgtgtctatgtatttcatgaaccatttggtattcccagaagactgctgttgggtgatgtacgaagttgtgatgcttaaaaaattggcttgtttgcatatggttgtgttgtaacattctagatgattttgttcatcttcagaaattaaagttctctttttagttccaaaaaaaaaaaaaaaaaaaaaaaaaaataaaaaaaaaaaaaaaaaaaa

SEQ ID NO: 2022 - protein, 87 aa, Panicum virgatum
  misc_feature: Ceres CLONE 1774672
  misc_feature: Great-hit functional homolog of the protein sequence given in SEQ ID NO 9394
  misc_feature: Useful for making plants with modulated nitrogen use efficiency
MNVEEEVGKLKEEIQRLGQKQPDGSYKVKFGVLFNDDRCANIFEALVGTLRAAKKRKILTYDGELLLQGVHDNVEITLLPPPAVAAA

SEQ ID NO: 2023 - DNA, 720 bp, Panicum virgatum
  misc_feature: Ceres CLONE 1774761
  misc_feature: Encodes the peptide sequence at SEQ ID NO. 2024
atgcacagacgacagcgagccaagtgtactactcccagtgaagccgcactagctagccacaccagcagcttgacaagctagctagctagctaggccgcagccatgtcggaggagaagcaccaccacttcttccaccaccacaagaaggaggagaaggagcacaagcacaagcagcacctcggcgaggccggcgccgtcgccgccggcgccttcgcgctctacgagaagcacgaggcgaagaaggacccggagcacgcgcaccggcacaagatcacggaggagatcgccgccacggcggccgtcggcgccggcggctacgccttccacgagcaccacgagaagaagaaggaccacaaggacgccgaggaggccagcggcgagaagaagcaccaccacctcttcggctgacccgccggcgagcgagctccggcccggccgccgcgcacccgcctgcttgctccaataattgtggccatgatttcacaataagtcccttccggacccttagcttgcttgcttgtgtgagactgagaggtggggcccgcgcgtcgaggtgtgttccggcctgtacgtgcttgatttttctttgcgtccgtaattgcgttgaataaccgggagcgatgcacgtgtggctcccagtctgtctgtctgtggttgagtgtctgtatcctgatgatcaactcgtggaagtttttacaccaaaaaaaaaaaaaaaaaaaa

SEQ ID NO: 2024 - protein, 101 aa, Panicum virgatum
  misc_feature: Ceres CLONE 1774761
  misc_feature (1)..(54): Pfam Name: ABA_WDS Pfam Description: ABA/WDS induced protein
MSEEKHHHFFHHHKKEEKEHKHKQHLGEAGAVAAGAFALYEKHEAKKDPEHAHRHKITEEIAATAAVGAGGYAFHEHHEKKKDHKDAEEASGEKKHHHLFG

SEQ ID NO: 2025 - DNA, 948 bp, Panicum virgatum
  misc_feature: Ceres CLONE 1774936
  misc_feature: Encodes the peptide sequence at SEQ ID NO. 2026
gaatcaactcgccattcccggagtctgtctgcctgcctgccttggagagggagagaaagccgaagatgaggcggcgccaccaccaccaccaccttcccctgctcgcctgcctcttggtcctcgcctcggccgcggcatcgccggcgaaggccaagcccccttctgcctccgcggtcgccccggccatcgcggtggacttcgtgcgccgctcgtgccgctcgacgcggtacccgcgcgtgtgcgagagcaccctggtgccctgcgcgcccaccgtggggcgcagcccgcggcgcctggcgcgggcggcgctggtggtgggcgccgaccgcgcgcacaactgctccgcctacatccgggccggcaagggcgccatggaggactacgccgagctggcgcgcgacgccgaggagcggctgcggcggtcggcggcggagatggagcggatggggcgcgcgggcaccccgcgcttcgcgtggtcgctcgccaacgtgcagacctgggccagcgccgcgctcaccgacaccgacacctgcctcgactcgctcgcccaggcccgcggcaaggtggacggcggcgccgtcaagaggcgggtggtggccgtcgcggaggccaccagcaacgcgctcgcgctcgtcaacaggctcgacccggcgccgcaccgcctgctgctgtagctccatgacgaaatctttccttcttcagccctcctcctccatgtccgatccgatcgcccgtatctgcaatctgtatgattgatggatcggtctcagtgatgatgatggttgatgacgattaaaagctagagggcgcccaatttaatttcctgcttctttgttcctgtctgtgaggaactttttttttggctgtttatccgcttatggttgctgaaataatccaagctgtgattaatctaaatatcttggcattgaaaaaaaaaaaaaaaaaaaa

SEQ ID NO: 2026 - protein, 202 aa, Panicum virgatum
  misc_feature: Ceres CLONE 1774936
  misc_feature (1)..(165): Pfam Name: PMEI Pfam Description: Plant invertase/pectin methylesterase inhibitor
MRRRHHHHHLPLLACLLVLASAAASPAKAKPPSASAVAPAIAVDFVRRSCRSTRYPRVCESTLVPCAPTVGRSPRRLARAALVVGADRAHNCSAYIRAGKGAMEDYAELARDAEERLRRSAAEMERMGRAGTPRFAWSLANVQTWASAALTDTDTCLDSLAQARGKVDGGAVKRRVVAVAEATSNALALVNRLDPAPHRLLL

SEQ ID NO: 2027 - DNA, 548 bp, Panicum virgatum
  misc_feature: Ceres CLONE 1774939
  misc_feature: Encodes the peptide sequence at SEQ ID NO. 2028
attcagctgagtgtgctcgatcatcaagcaatcaacaaagcctcccaattatcctttcatcagatcatcttccttcttccaagatgtcttgcagctgcggatcaagctgcaactgcggctccaactgcaagtgcggcaagatgtaccctgaccttgaggagaagagcagcggcggcgctcaggccaccatcgtcctcggcgtggccccggagaagaagactggccagttcgaggcggcagcggagtccagcgagaccgcccacgcctgcaagtgcggtaacagctgcagctgcgacccctgcaactgctgatttcgatgggggaacgtcagaacacacctgcatgcatgcatgctagctactacctactactctgcttgtgtgtgacttgatgattgaacaagaatcagcttgggggtgtctgtctgtaatctagcctgcagctttgatgtccaatataatgcttggttcatgtaacaatgctactacggctctccatacttttgggacagttattatattaattacttgatgctacatatttagatt

SEQ ID NO: 2028 - protein, 75 aa, Panicum virgatum
  misc_feature: Ceres CLONE 1774939
  misc_feature (1)..(73): Pfam Name: Metallothio_2 Pfam Description: Metallothionein
MSCSCGSSCNCGSNCKCGKMYPDLEEKSSGGAQATIVLGVAPEKKTGQFEAAAESSETAHACKCGNSCSCDPCNC

SEQ ID NO: 2029 - DNA, 818 bp, Panicum virgatum
  misc_feature: Ceres CLONE 1774967
  misc_feature: Encodes the peptide sequence at SEQ ID NO. 2030
accagcgcttgcaacaactcatccatccagcaccgtatcgtgccctcatcacattcacgcacaatggctcgcgctcagcaggccgtggcgatcgccgtcgttgccgccgtcgtgctgctcgccgccgcggccacctccgaggccgccgtgacctgcgggcaggtcaactccgccatcggcccctgcatcacctacgcccgcgggtccggctccggcccctcctcagcctgctgcagcggagtcaggagcctcaactccgccgccagaaccaccgccgacaggcgcgccgcatgcaactgcctcaagtccgccgcaggcagggtgagcggcctcaacgccggcaacgccgccagcatcccgtcgctcatcatgtgagagacacggccggatcggatgtgtcagtccctgctacgttttgtacgtgtctgcatgtacacttccatttccgttccagattctgtaccttgtccactaccttttactccctccgttcggaaatgatctacatattttgactagagaaagtcattcgaagtaaagtttgacttattaatcactcttagaatataatgtcaattacgaataactcaatgtcatctcaaaacctctttgaatacatatgtattgacataaattttataaactaattatacatataatttaactaattattagtcaaagtttataaagtttgacttttcctagtcaaaatacgtagatcatttccggacggagggagtaatacatacgccactttttggtatatatatgtatgctccgatccatgggtttatttcgaaaaaaaaaaaaaaaaaaaa

SEQ ID NO: 2030 - protein, 103 aa, Panicum virgatum
  misc_feature: Ceres CLONE 1774967
  misc_feature (1)..(70): Pfam Name: Tryp_alpha_amyl Pfam Description: Protease inhibitor/seed storage/LTP family
MARAQQAVAIAVVAAVVLLAAAATSEAAVTCGQVNSAIGPCITYARGSGSGPSSACCSGVRSLNSAARTTADRRAACNCLKSAAGRVSGLNAGNAASIPSLIM

SEQ ID NO: 2031 - DNA, 804 bp, Panicum virgatum
  misc_feature: Ceres CLONE 1774969
  misc_feature: Encodes the peptide sequence at SEQ ID NO. 2032
aaaaatcctcgagaggcaacgcccaacaaaaccctagccgcctccctccccctcgtttcttaaaccccaagccgcgcctccaccgctcactcttcccctattccaccacctctcctggtctggtcgcctcgacccatcccaatcttgaggtctagtgttcaatggcagccttcaacaagcttggcagccttctaaggcacagtgctctgacaagcggtgcccctgccagctcgtctcctgctttgttcaatgttgctcggctaatgtccaccaagcttttcgttggtggtctttcctggggtactgatgagcagactttgagacaagcatttagcagcttcggagaggttaccgaagcaaggatcatcacagacagggatactggaaaatcaagaggctttggctttgtgaatttcagcaacagtgatgatgccaaggaggctatgagccaaatggatggtcaggaacttgaagggcggagtgtccgtgtgaacttcgctaatgacaggcctgcagggaaccgtggtggtggtggcggctttggtggaggtggctatggtagtggcggctatggtggcggcggctttggtggaggcaaccaaagctatggttctggagggggcccggatggcttttaaaagttcgctaactataagaagtatttgaaataatggacttaagtacctgatgaacagcttatgtgaggctgtaatcatgttttactattttgtgttctgaagtcgagtcgttgaactagtgcaattcaggagccacagaattttgcaaaaaaaaaaaaaaaaaaaa

SEQ ID NO: 2032 - protein, 158 aa, Panicum virgatum
  misc_feature: Ceres CLONE 1774969
  misc_feature: Great-hit functional homolog of the protein sequence given in SEQ ID NO 9668
  misc_feature: Useful for making plants with modulated biomass
  misc_feature: The plant is abnormally small.
MAAFNKLGSLLRHSALTSGAPASSSPALFNVARLMSTKLFVGGLSWGTDEQTLRQAFSSFGEVTEARIITDRDTGKSRGFGFVNFSNSDDAKEAMSQMDGQELEGRSVRVNFANDRPAGNRGGGGGFGGGGYGSGGYGGGGFGGGNQSYGSGGGPDGF

SEQ ID NO: 2033 - DNA, 750 bp, Panicum virgatum
  misc_feature: Ceres CLONE 1775009
  misc_feature: Encodes the peptide sequence at SEQ ID NO. 2034
gttcctcaacgacagcagagcagcaccgagtcttcttcaacccattctcgctccccaacgaattcggtcagagatcttcgtgcttggccctcctgtcctgcacatggcatccgccgctgcccccgccgacgccgccgccggagccgggcgccgccgcatcgtggtggccgtggacgagggcgaggagagcgcgcacgcgctcgcctggtgcctcgccaacgtcgtctccccggcgggcggcgacacgctcgtgctcgtgcacgcgcgccgcccgccccccgtctacgccgccatggacagcgcagggtacatgctgacctcggacgtgcttgcgagcgtggagcggcacgccagcgccgtctcggcggcggccgtcgacaaggccaggcgcctctgcgccgggcacccgcacgtggcggtggagacgctggtggagagcggggacccgcgggatgtgatctgcgacgccgccgacaaggtgggcgccgacctgctcgtcatgggcagccatgggtacggcttcatccagagggcgttcctgggcagcgtcagcaaccactgcgcgcagaactgcaaatgcccggtcctcatcgtcaagaggcccaaggagtagaacggtccttgcaaatgctgcatcttgccagcctgtagcatcatatatgtaaatatttttttttaacgtccgatggcactggtttcttgttcgagaacatgatcagagcattgcagttaaaaaaaaaaaaaaaaaaa

SEQ ID NO: 2034 - protein, 169 aa, Panicum virgatum
  misc_feature: Ceres CLONE 1775009
  misc_feature (2)..(150): Pfam Name: Usp Pfam Description: Universal stress protein family
MASAAAPADAAAGAGRRRIVVAVDEGEESAHALAWCLANVVSPAGGDTLVLVHARRPPPVYAAMDSAGYMLTSDVLASVERHASAVSAAAVDKARRLCAGHPHVAVETLVESGDPRDVICDAADKVGADLLVMGSHGYGFIQRAFLGSVSNHCAQNCKCPVLIVKRPKE

SEQ ID NO: 2035 - DNA, 1035 bp, Panicum virgatum
  misc_feature: Ceres CLONE 1775028
  misc_feature: Encodes the peptide sequence at SEQ ID NO. 2036
gaagccaccggcaaagaggaagagagcctctgctgattcagtagcaattctctggttggttgttctctgctgctgctgtgtgtgtgtgtgtctgcgaagaaacgaggagagggagagatggcttgccctgcgcagtacatgctctcggccagcggctgcattttcctggggagcagcaagcctcaggcgagccttgtccgaggcgccgtcatcggcggcgttagcggcagcaggccgttcctgctcacttgcagcgcctcgtcgtctccgtctccttcctcgccggcgccggcgcaggaggactccgactgcaacgaggaggagtgcgccccggagaaggaggtcgggagcctgagcgccgagtggctggcggaggagcggaccagggtcgtcggaaccttcccgcccaggaagagagggtggaccggcctcgtcgagaaggacaccgccggccagaccaacatctactccgtcgagccgacggtgtacgtggcggagagcgccgtcagctccggcacggcgggcacgtcggcggagggggccgagaacacggccgccatcgcggcggggctggtcctcatcaccgtcgccgcggcctcgtccatcctcatccaggtgagcaagaagcagccgcaggtgcccgaggccgcctacagcggcccgccgctcagctactacgtcgccaagttccagcccgcggcggaggcgccggcgccggcggagcccctcgaggcccccgcccccgcggaggcggcggtcgtcgcccaggacagccccgccgtcgaggcagccgccccggaggcgctggaagcagagcagctgtcctcgtgagctgatgttgtagtcaagattcagctttgtggctgcttacagatgagcttgtagtgcacgatggtgggagataatacacatggtaatcgtgagcatttgctaattgtaaaagttgcgtgtgtatatacaatgcattcagcatgcctatatgcttatatgaaagcccacgacactcgcacaaaccaaaaaaaaaaaaaaaaaaaa

SEQ ID NO: 2036 - protein, 237 aa, Panicum virgatum
  misc_feature: Ceres CLONE 1775028
  misc_feature: Great-hit functional homolog of the protein sequence given in SEQ ID NO 9318
  misc_feature: Useful for making plants with modulated flowering time
  misc_feature: The plant flowers significantly late compared to wild-type.
MACPAQYMLSASGCIFLGSSKPQASLVRGAVIGGVSGSRPFLLTCSASSSPSPSSPAPAQEDSDCNEEECAPEKEVGSLSAEWLAEERTRVVGTFPPRKRGWTGLVEKDTAGQTNIYSVEPTVYVAESAVSSGTAGTSAEGAENTAAIAAGLVLITVAAASSILIQVSKKQPQVPEAAYSGPPLSYYVAKFQPAAEAPAPAEPLEAPAPAEAAVVAQDSPAVEAAAPEALEAEQLSS

SEQ ID NO: 2037 - DNA, 793 bp, Panicum virgatum
  misc_feature: Ceres CLONE 1775029
  misc_feature: Encodes the peptide sequence at SEQ ID NO. 2038
actccactccgctcctccccccccccccctcaagccgagcgccgccgcagccatggtcctgaccgcccgcgcctccgccgtggcgtgccttctcctcgcgctcgccgcctccgccgcgggcgcgggagcgggctcccactcccctgccccggcgccggcggtcgactgcttcgcggcggccacgagcctgatcgactgcatgggctacgtctcccccgggagcacggagaagaccccgtccaaggcctgctgcggggaggtcaagaccgccgtcgccaaccccaccaccgtcggctgcctctgcaccctcgccggctccaaggacctccccgtgcccatcgacatgaaacgcgtgctcgcgctccccggcgcctgcggcgcgtccaacgccgccttcagcaagtgccacatttccgcgggttctccgaccgaagcaccaacgccgtctgctcccggaggatcatcgagcggcgaggcgaccacgacaccgccaccgcaaccagcggcggcgaggagctccatggtgacggcgaccgccctcgcggccgcggcggcggcgccgctgctcgcctacggctacctcctctgagctgacgaggatgtatcttcgctctgatgattgagctgcgcgccgcgctggctgagtgaccgcccttttattgtcgagctgcgccgtgattcagttacttctgttgtcgagactgctgttacttgagctgtttttttttttgaaacagacttgagctgttttatatgggagtatttgatgacgtaaaaaaaaaaaaaaaaaaaa

SEQ ID NO: 2038 - protein, 178 aa, Panicum virgatum
  misc_feature: Ceres CLONE 1775029
  misc_feature (1)..(81): Pfam Name: Tryp_alpha_amyl Pfam Description: Protease inhibitor/seed storage/LTP family
MVLTARASAVACLLLALAASAAGAGAGSHSPAPAPAVDCFAAATSLIDCMGYVSPGSTEKTPSKACCGEVKTAVANPTTVGCLCTLAGSKDLPVPIDMKRVLALPGACGASNAAFSKCHISAGSPTEAPTPSAPGGSSSGEATTTPPPQPAAARSSMVTATALAAAAAAPLLAYGYLL

SEQ ID NO: 2039 - DNA, 532 bp, Panicum virgatum
  misc_feature: Ceres CLONE 1775117
  misc_feature: Encodes the peptide sequence at SEQ ID NO. 2040
cctcatcgatcgagccagccatccagccagtcgcctatcctcgcctgctgcgcgcgtctctctgctctcctagggagatctcgcgcagcgcggtaacccaccttcccacctcgtcgccgtcgcagatggccggcctcaggatgaagctcgtcgccgccgccgccgtggccgccgcgctcgtggcgtccgccgccgccgccaccgaggcccccgccccggcgcccgcctccgacgccgccgccgcggtgcccctcgccgcggcgtccctcgccgccgccgccttcggctacctcttctgctagatccgccgcccgttccccgtgggtcctgctgatatgatgattcgttctggcgtggcgtgagtcgagtccgtgtggggaggatgtcggtgggcgtgtgtatgtacgagttcggctgcggtgtgcgagcggtggttgcgtgcgtcgacgcgccgttctctatggcgccgatcatgtactcactccgtttctggttattgatgagatcatttatttgattctttccatcttat

SEQ ID NO: 2040 - protein, 58 aa, Panicum virgatum
  misc_feature: Ceres CLONE 1775117
  misc_feature: Great-hit functional homolog of the protein sequence encoded by LOCUS At3g13520
  misc_feature: Useful for making plants with altered cell wall content and/or composition
MAGLRMKLVAAAAVAAALVASAAAATEAPAPAPASDAAAAVPLAAASLAAAAFGYLFC

SEQ ID NO: 2041 - DNA, 840 bp, Panicum virgatum
  misc_feature: Ceres CLONE 1775129
  misc_feature: Encodes the peptide sequence at SEQ ID NO. 2042
gtgagcttagcgagtcttgggactccagaaggttcccacctccgcctccatatcttcttcttggtcctccgcctccaccacttcgcgtgctcttacgtttccgtgttgagagagagacagagagagaggacacgcgagaggctgccgtgtgggggccggagagtcaacgacagcgagggggagagaaggcgatggcggggatcgggccgatcaggcaggactgggagccggtggtggtgcggaagaaggcgcccaccgccgccgccaagaaggatgagaaggccgtcaacgccgcgcgccgctccggcgccgagatcgagaccatgaagaagtacaacgctgggacgaacaaggccgcgtccagcggcacatcgctcaacaccaagcgactcgatgacgacactgagaatctagcccatgagcgtgtcccaagtgacctgaagaaaaacctcatgcaagcaaggctggataagaagatgacccaggcacagcttgctcagatgatcaatgagaagccacaggtgatccaggagtatgagtcgggcaaggcgatccctaaccagcagattattagcaagcttgagagggcactgggaacaaagctgcgcgggaagaaataactttaaaacttgtgccccggagcagcatgaagctgaagaagacaaggcagtctgtctgcttgttatctaatgcttggtttttaatgtcatgcagattgtttctgtgtttggtacatgagtgaataacagtgtcgtggtggaccttgtaatgccttgctgcttttatgtgtcatatgacccctggtacgtaagagttgcgcgaaaaaaaaaaaaaaaaaaa

SEQ ID NO: 2042 - protein, 142 aa, Panicum virgatum
  misc_feature: Ceres CLONE 1775129
  misc_feature: Great-hit functional homolog of the protein sequence given in SEQ ID NO 9320
  misc_feature: Great-hit functional homolog of the protein sequence given in SEQ ID NO 9583
  misc_feature: Useful for making plants with altered Lignin content
  misc_feature: Useful for making plants with modulated heat sensitivity
MAGIGPIRQDWEPVVVRKKAPTAAAKKDEKAVNAARRSGAEIETMKKYNAGTNKAASSGTSLNTKRLDDDTENLAHERVPSDLKKNLMQARLDKKMTQAQLAQMINEKPQVIQEYESGKAIPNQQIISKLERALGTKLRGKK

SEQ ID NO: 2043 - DNA, 614 bp, Panicum virgatum
  misc_feature: Ceres CLONE 1775154
  misc_feature: Encodes the peptide sequence at SEQ ID NO. 2044
acgactacatcatgtgatgctcataaggtaggagagttcttttctcttccacaccagcccaaccatggccaaggtagctccctccctcctcgccgtcggcagcggcgctgccttcactgcccagccatcgcccaggaaaggtgccagtttgttccgtgatcgcgtcatcagcaggcgtgccaggatatcagctaagcttggtggagatggggagctgaagcctccaggcaagaagaagttcatcaccagggatgaggagcccgaacagtactggcagactgcaggggagagggagggtgagaaccccatgaagacgcccctgccctacatcatcatcttcggcatgtccacccccttcgtcatcctcgtcatcgcctttgccaatggctggatcaaggtccctgtacgatgaaaccatgtcaccgcgaagcttccagcaaaacaccttggcacttcctgcatcctctccagcgagagcactgcgagtttttaccttcatagagatgaagagtcaatgctttgtaatcttccgttcttcacacaagacgaggtttgtactaccagcagttgacaggaacagtcacatgtccaactaaaaaaaaaaaaaaaaaaaa

SEQ ID NO: 2044 - protein, 115 aa, Panicum virgatum
  misc_feature: Ceres CLONE 1775154
  misc_feature: Great-hit functional homolog of the protein sequence given in SEQ ID NO 9634
  misc_feature: Useful for making plants with modulated biomass
  misc_feature: The plant is abnormally small.
MAKVAPSLLAVGSGAAFTAQPSPRKGASLFRDRVISRRARISAKLGGDGELKPPGKKKFITRDEEPEQYWQTAGEREGENPMKTPLPYIIIFGMSTPFVILVIAFANGWIKVPVR

SEQ ID NO: 2045 - DNA, 749 bp, Panicum virgatum
  misc_feature: Ceres CLONE 1775248
  misc_feature: Encodes the peptide sequence at SEQ ID NO. 2046
gtccttctccctcgctctctttcccctccgaagcaagaatcaccacaggagccccggccccggaccccgaaccaacggcggccatggcgtactacggcgaccggcggccggagtcgtcgatcgtggaggcgttcacgctgtcgccgctgccgtacccggtgatcctgatcctgctcatggtctcgctcctcctgggcgtctcgtggttcttcacctacgaggacttcatcgaggaggcggcggagcagttcagctgggcgctgctggtcgtgcccatcgcgctcgtgctcctcatccgctggatctcctccgtcgactccttcgacggctacttcttcggcttctaccccagcgagcgccgctggaggcccggctacgggggcgcccccgccgagggcagctcgccctggggcgtcgccatgctcgtcctgctcctcatcgtgctcgccagcttccacgagaccatccgggacatgtggcggccatgatcgatcgaatccatcatccggcctcgtctcgtctatcctgatgatgaacacgtacgcgtgattcggtctgctgtccaccacacctctagtgctcgatttctcatgctttttcttgcgcgcttgcattggctgatcgctgatcctatatatttctacgcgcgcatgcatgtttgcgcttgtacttcttgttccatcgaatcgatgctgtacatactgcataatacggattctgcaactggctaaaaaaaaaaaaaaaaaaaa

SEQ ID NO: 2046 - protein, 134 aa, Panicum virgatum
  misc_feature: Ceres CLONE 1775248
  misc_feature: Great-hit functional homolog of the protein sequence given in SEQ ID NO 9396
  misc_feature: Useful for making plants with modulated nitrogen use efficiency
MAYYGDRRPESSIVEAFTLSPLPYPVILILLMVSLLLGVSWFFTYEDFIEEAAEQFSWALLVVPIALVLLIRWISSVDSFDGYFFGFYPSERRWRPGYGGAPAEGSSPWGVAMLVLLLIVLASFHETIRDMWRP

SEQ ID NO: 2047 - DNA, 1048 bp, Panicum virgatum
  misc_feature: Ceres CLONE 1775299
  misc_feature: Encodes the peptide sequence at SEQ ID NO. 2048
ggctggctgcgtcttcgccgctctctcttccgctgctcttgctgttctctgtgctatccgctagggtttatctactcgagcaatggcgacggtgcagctctccagcgcgagggtcggggcggcggcgttcgctgcgaaggggaaggcctccctcgaaccgctccggcttccggcgagggtgaccgtcggcgaggcccgccccgcgcggcgggcgtttcgcggcctcgtcgtcagggccgccaccgtcgtcgcccccaagtatacaacgcttaagcccttggctgatagagtgcttgtaaagattaagtcttctgaggagaagacaaccggtggaattttgctccctacgactgctcagtccagacctcagggtggtgaggttgttgccgttggagaaggcaagaccattggggataagaaagttgatatcagcattcaggttggagctcaagttatatattcgaagtatgctggaactgaagttgagctgaatgattacaaccatctagttctaaaagaggatgacattataggtatcttagaaactgatgatgtgaaagacatgaagcctctgaatgaccgtgtactaatcaaggttgctgaagctgaagataaaactccaggtggtctattgcttaccgaaactaccaaggagaagccatctattggaacggtcgtagccgttggcccaggccccctggatgaggaaggcaacaggattccgttgtccgtctctgcaggcagcaccgtcctctactccaagtacgcgagcaacgagttcaaggtcgccgatggtaccaactacatcgtgctaagggtgtcggatctgatagccgtcctctcctgagaagtgggttttcaacagttacctccaaagcttcgaccattctgttgtagcattgtcgccattttgtgggaacaaccaaggttccctggcaatcctctagactttctcgcggcttcccgttctctttggtcaatgctagtattcttactctgtgatgaataaacattagaagttaggtcgcaaaaaaaaaaaaaaaaaaaa

SEQ ID NO: 2048 - protein, 254 aa, Panicum virgatum
  misc_feature: Ceres CLONE 1775299
  misc_feature (1)..(94): Pfam Name: Cpn10 Pfam Description: Chaperonin 10 Kd subunit
MATVQLSSARVGAAAFAAKGKASLEPLRLPARVTVGEARPARRAFRGLVVRAATVVAPKYTTLKPLADRVLVKIKSSEEKTTGGILLPTTAQSRPQGGEVVAVGEGKTIGDKKVDISIQVGAQVIYSKYAGTEVELNDYNHLVLKEDDIIGILETDDVKDMKPLNDRVLIKVAEAEDKTPGGLLLTETTKEKPSIGTVVAVGPGPLDEEGNRIPLSVSAGSTVLYSKYASNEFKVADGTNYIVLRVSDLIAVLS

SEQ ID NO: 2049 - DNA, 794 bp, Panicum virgatum
  misc_feature: Ceres CLONE 1775396
  misc_feature: Encodes the peptide sequence at SEQ ID NO. 2050
aggtaacgctacttcaccaaaaccccaggattctcggggttcggtcgcctcactgtgctgccgcttcgcataatctactctggtctccggttcctcagcagctgcggttggatctcagatcggtgatcacataaacaatggtgaaggctgttgctgtgcttggtagcagcgagggtgtcaagggcaccatcaacttcacccaagagggtgatagccccaccactgtcactggaagtgtctctggcctcaagcctggcctccatgggttccatgtgcatgcacttggtgacacaacaaatggctgcatgtcaactggaccgcattacaaccctgcgggcaaggagcatggagcaccagaagatgagaaccgccatgctggtgacctcggaaatatcacggtcggagatgacggtgttactaacttcactattactgacagccagatcccactgactgggccaaactcaatcattggcagagctgttgttgttcatgctgatcctgatgatcttggaaagggtgggcacgagctgagcaagagcactggaaacgctggtggccgtgtcgcctgcgggatcatcggactccagggctgagagtgatcaccagactcgagtgccgaaagcgtcgtcgtcgtcgccccccgccgtcaccactggaccagcctaagcatcctttggatacgtgaaataagagcgcctgatctatgatcggcgtgtttgtgttcgctcctgtagcacctaccgatgaactgaatgaaacctgtgttggtctaaaaaaaaaaaaaaaaaaaa

SEQ ID NO: 2050 - protein, 152 aa, Panicum virgatum
  misc_feature: Ceres CLONE 1775396
  misc_feature (1)..(151): Pfam Name: Sod_Cu Pfam Description: Copper/zinc superoxide dismutase (SODC)
  misc_feature (1)..(152): SWISSPROT Homolog: EC 1.15.1.1 Superoxide dismutase [Cu-Zn] 4A
  misc_feature (1)..(152): SWISSPROT Homolog: EC 1.15.1.1 Superoxide dismutase [Cu-Zn] 4AP
MVKAVAVLGSSEGVKGTINFTQEGDSPTTVTGSVSGLKPGLHGFHVHALGDTTNGCMSTGPHYNPAGKEHGAPEDENRHAGDLGNITVGDDGVTNFTITDSQIPLTGPNSIIGRAVVVHADPDDLGKGGHELSKSTGNAGGRVACGIIGLQG

SEQ ID NO: 2051 - DNA, 1033 bp, Panicum virgatum
  misc_feature: Ceres CLONE 1775423
  misc_feature: Encodes the peptide sequence at SEQ ID NO. 2052
attaaccatcccgacctccgagaccgggacctccctttccgtcctctcgccgctccatttttacggaaacgccccccaaccaccgccgccggcgatgccctggccgtcgccgccggcgtattcgcggcgcctcctccaggccggcagcggcagcgacagcgccggtgccaaccccaaccgcatcccgggcatcccgcccgccgacccgcccgcgggcgtcaactccgatgtcgtcgtcatcctcgccgccctgctctgcgcgctcatctgcgtcgtgggcctcgccgccgtcgcccgctgcgcccgctcccgccgcaacaggggcgccggggccgccggcggcggcccgtcgtccccgacgagcaacccgggcgacgcggcggggcacttcgacggcggcggcgggcaccaagcgagcgcgaccacgacgaccacggccaccaccaaggggctgaagaagaaggcgctcaaggcgctgccgaagctggcgtacgcggacgcggtggcggcggccgcggcggcgcggggcgcggcgccggcggcggagggggaggaggaggcgaaggcggaggagctgctagcggagtgcgccatctgcctgacggagttcggcgagcgggaggaggtgcgcgtgatgccgcagtgcgggcacgggttccacgtcgcgtgcgtcgacacctggctgcgctccaactcctcctgcccgtcctgccgccgccccatcgtgctcgacgacccggccccgcccaagcggtgccgcaagtgcgaggccgtcgtcctggaggccgtcctcgcctcctcctcctcctcgtcctccgccgccgccgccgccgccgccgctgctggcaccggccggggccgcggcggcggcggccccgggggattcttgccgtagcatcagcattctgcagtagttggccggttgattgattgctgacgagcgggcccatggtcggtccggtagttgagctgcccccatctccccgggcccacatgccagtagcgcagcgaagacccccctctaaagcaatgc

SEQ ID NO: 2052 - protein, 266 aa, Panicum virgatum
  misc_feature: Ceres CLONE 1775423
  misc_feature (1)..(42): Pfam Name: zf-C3HC4 Pfam Description: Zinc finger, C3HC4 type (RING finger)
MPWPSPPAYSRRLLQAGSGSDSAGANPNRIPGIPPADPPAGVNSDVVVILAALLCALICVVGLAAVARCARSRRNRGAGAAGGGPSSPTSNPGDAAGHFDGGGGHQASATTTTTATTKGLKKKALKALPKLAYADAVAAAAAARGAAPAAEGEEEAKAEELLAECAICLTEFGEREEVRVMPQCGHGFHVACVDTWLRSNSSCPSCRRPIVLDDPAPPKRCRKCEAVVLEAVLASSSSSSSAAAAAAAAAGTGRGRGGGGPGGFLP

SEQ ID NO: 2053 - DNA, 622 bp, Panicum virgatum
  misc_feature: Ceres CLONE 1775492
  misc_feature: Encodes the peptide sequence at SEQ ID NO. 2054
ctctttcccccagcctcccaccaaggtttatccaccggcggcgtgcgcggcggcgacaagatggtgcagcgtctgacctaccggaagcggcacagctataccaccaagtccaaccagacccgggtcgtcaagaccccaggtggcaagctcgtgtaccagtacaccaagaagagagccagcgggcccaagtgccccgtcaccgggaagaagatccaggggattccccacctcaggcctgctgagtacaagaggtccaggttgtctaggaaccgcagaactgtgaaccgtccctatggtggagtgctctctggaactgctgttagagaaaggatcatccgtgccttcctggtggaagagcagaagattgtaaagaaggtgttgaaaattcagaagaccaaagacaagactgcctcaaagtaactctgaaatggaactggagagataattttgtcaatggtgtcttagtctcttctagctactagccaaatgttctagtgtgtcgtggtgacagctgtttctaggattcttgatgtcctgtctgccattgtgatgttgaaggttatgagacaacgatgatccccccattgcttttgttcacatcgccaaacaccaaatcaaattc

SEQ ID NO: 2054 - protein, 119 aa, Panicum virgatum
  misc_feature: Ceres CLONE 1775492
  misc_feature: Great-hit functional homolog of the protein sequence given in SEQ ID NO 9667
  misc_feature: Useful for making plants with modulated nitrogen use efficiency
MVQRLTYRKRHSYTTKSNQTRVVKTPGGKLVYQYTKKRASGPKCPVTGKKIQGIPHLRPAEYKRSRLSRNRRTVNRPYGGVLSGTAVRERIIRAFLVEEQKIVKKVLKIQKTKDKTASK

SEQ ID NO: 2055 - DNA, 716 bp, Panicum virgatum
  misc_feature: Ceres CLONE 1775544
  misc_feature: Encodes the peptide sequence at SEQ ID NO. 2056
acccacagcacacagcagctatccagactcacactactgtcgcgcacacactactgcagcatttgctttgtttagctcgaccgccgatcgataataatactacaacaataatggcggctctgatgatgaagaacaagaagcagatgcaggcggtggtggccttggccgttgtggtggcggcggcggcgctggtggcgtcagcgtcggcggccatcacctgcgggcaggtgggttcggcgctggcgccgtgcatcccgtacgcgacggggaaggcgagcgtgctgccgccgtcgtgctgcggcggcgtgcgcagcctcaacagcgcggcgcgcacgagcgcggaccggcaggcggcgtgccggtgcctcaagagcctggccagcaccgtcaagtcggtgaacatgggcaccgtcgccaccatccccggcaagtgcggcgtctccgtgccattccccatcagcaagtccactgactgcaacaaagtcaactaaattaatcttacatcagatatgctgctacctgatggtgagaagcttggtccttcagaagatagcaacgagctatttattaggacaataaaacaaagttgttaaggcatcatcatcagcatcatctatactattttgtagtaataattaattaattaaatgctgtactcaatctgtgtgtacgtgcgcgtatacatacatgcatgctgatactatcgatgtatatat

SEQ ID NO: 2056 - protein, 126 aa, Panicum virgatum
  misc_feature: Ceres CLONE 1775544
  misc_feature (1)..(86): Pfam Name: Tryp_alpha_amyl Pfam Description: Protease inhibitor/seed storage/LTP family
MAALMMKNKKQMQAVVALAVVVAAAALVASASAAITCGQVGSALAPCIPYATGKASVLPPSCCGGVRSLNSAARTSADRQAACRCLKSLASTVKSVNMGTVATIPGKCGVSVPFPISKSTDCNKVN

SEQ ID NO: 2057 - DNA, 853 bp, Panicum virgatum
  misc_feature: Ceres CLONE 1775550
  misc_feature: Encodes the peptide sequence at SEQ ID NO. 2058
ccaggccaccagcgtgcggagcgcatcaccaccacctacacggcaacactagacagctcgtagcgcaggagtaggtagagctcaggtgtgcaagctacaatggcgtccaagaccgagctggtggtggacgtgaagtccccggcggacaagctgtgggcggcgctgcgcgactccacggagctgttccccaggatcttcccccagcagtaccgaagcatcgaaaccgtcgagggcgacggcaagtccgccggcaccgtccgcctcctcaagtacaccgagggggtgccgatgctgacgttcgccaaggagaaggtggagctggcggacgacgagaacaaggtggtgtcgtacagcgtggtggacggcgaactggtgagcttctacaagaacatgaagatcacgctgaaggtgtcccccgccgccaaggagggcgaggccggcgccgtcgtcaactggtccatggagttcgacaaggccaacgaccaggtgcccgacccggacgtcatcaaggagaccgccaccaagacgttccacgacctcgacgactacctcctcaagaactagcaggcggccggcgcgcggcgggggtcgtccgaccgccgaggcatcggcgatcggtcgcggtcgttgagcacgctagctagtgcatgtcgttggtggtggtgtccgagtccgtgttcgtgttggtgttggtgtcatagctacggcgggctgtgtcctcgaattgtctccggttgatgttgctgcggcgatcatgtgcgtctgcactctgcagatggcaatctagtcccagtcaataataaagctatacgtgtgtcatcgtgcacccgatgaaaaaaaaaaaaaaaaaaaa

SEQ ID NO: 2058 - protein, 154 aa, Panicum virgatum
  misc_feature: Ceres CLONE 1775550
  misc_feature (1)..(154): Pfam Name: Bet_v_I Pfam Description: Pathogenesis-related protein Bet v I family
MASKTELVVDVKSPADKLWAALRDSTELFPRIFPQQYRSIETVEGDGKSAGTVRLLKYTEGVPMLTFAKEKVELADDENKVVSYSVVDGELVSFYKNMKITLKVSPAAKEGEAGAVVNWSMEFDKANDQVPDPDVIKETATKTFHDLDDYLLKN

SEQ ID NO: 2059 - DNA, 885 bp, Panicum virgatum
  misc_feature: Ceres CLONE 1775575
  misc_feature: Encodes the peptide sequence at SEQ ID NO. 2060
ctccctccgcctttacagccgccggctcgccgccccccccctggcgccgccgtgacaagcctagctagcaaggcgcgagccatggcgacctcgggacggatcgaactggacaagctgagcgtggagcagctcaaggggctcaaggagcagacggatctggaggtcaacctcctccacgacagcctcaacaagatccgcacggccatcactcgcctcgagagcgcctccgcggcgctgcaggacctatccctccgcccccacgggaagaagatgcttgtgccgctcacggcgtccctctacgtgcccggctcgcttgacgacgccgagaaggtcctcgtcgacgtcggcactggttacttcatcgagaaaaccatggctcaagggaaagaatactgtgaaagaaaaattaatttgttgaagtcaaatttagatgaactggctgaggtggctacgaaaaagaaagccatagcagatcagatgggtctgctgctacatgccaagctgaggcaaggatcgcctggcccaagttcatgaaagctctggatgcatgtcttgtctccaccttgttggatgaatggatggtttagtttgtagcattagggaagcacagggaaacgatagttgcctttgtcatgtgtgcaaagctacgggtcacggataatttgctgaaccaacctgccacatcaaacatcatcgagttattttgaagttggttctgaacaaacgttgagtaattttgaagctagtgttgaacttgctgtgtagattggtttttttgttctctcacacaatgaagccaacgcttatggccatcactgttatgtttgttgcacctcaatggttaatttggtttttattgttgcccaaaaaaaaaaaaaaaaaaaa

SEQ ID NO: 2060 - protein, 150 aa, Panicum virgatum
  misc_feature: Ceres CLONE 1775575
  misc_feature: Great-hit functional homolog of the protein sequence given in SEQ ID NO 9448
  misc_feature: Useful for making plants with modulated heat sensitivity
MATSGRIELDKLSVEQLKGLKEQTDLEVNLLHDSLNKIRTAITRLESASAALQDLSLRPHGKKMLVPLTASLYVPGSLDDAEKVLVDVGTGYFIEKTMAQGKEYCERKINLLKSNLDELAEVATKKKAIADQMGLLLHAKLRQGSPGPSS

SEQ ID NO: 2061 - DNA, 1467 bp, Panicum virgatum
  misc_feature: Ceres CLONE 1775632
  misc_feature: Encodes the peptide sequence at SEQ ID NO. 2062
cgagtgagcttagcggagctgacacaaccacacaattcaattcaattcagacacaagcttcaacatctcttgctagcaagtagcaagtccggtctagctagagaaatcaagaagaagacggcggcgatggcggagagggtgtcaaggctgtcaacggagaaggcggtggtgatcttcacgaggagccagtgcccgatgtgccacacggtgttgagcctcttctccgagctcgacgtgtgcgcagtggtgcacgagctggacaaggacccgcgcggccgcgacatggagcgggagctcgcccgccgcctcggccgcgcgccgccggtccctgccgtcttcgtcggcggcaacctcattggctccaccgacaaggtcatgtcgctgcacctcgccagcaagctggtgcccatgctcaaagccgccggcgccatatggctctgaatctccatccatccatccatccatgacgacaacacgccgtaaattttgctgggtttataaaaaaaaaaatcacaccttattagcttgcctagagggaaactaactaattgcaggcatctaaattaagacttaagttcccctcaaaaaataaagtaagactaaatgatacactacagaatatgttcacaagtcatagatatatatgactatgaggcgcctttgtgggccgtccgatcgaaatggaggtggttaagattataggatataaaccaaatatgtgagaggtttttttttccgctggtgtaactgcagggctaaaaagggtgcaaagggacttgtagcctcccctttccagtttttccaatgagatatgaattttgagttaaaaaaaaaaaaaaaaaaaactcgaagaggtctcgaattcgagtgagcttagcggagctgacgaacacagacctcggcatcgatctcatcgtctccctcgtccctccccaatcagctcggcgcggcgcagaaggctggccctggtggcggcgcggacaccagtggcggtgcgtcgcggccaccaggggcggctcagcgcgcccacctaggggcggctcgcggcggccaccagggtgaacgccaacacggcctgcctcgggttcgtcaaggcggccagcggccaggcgccggaggtggtgctcggtggggtccagatggagaatcgcctgctggtgctcgacgaggagcagcagcagctcggcttcaccttgttcctcaacgcggttgggccttcctgcagcaacttcaatttcactcttgccgcatagttgtgtactggtgtggtgaatctcgaagccagttgtgtacttcaatttcactcttgcgaagctgggacacagggacacagggagcgacgcggccacggcacccgcggcggcgcggcctgccgggcaccgggcggcggggtaattttttttatgttttcagaaattgttcgtcgagtgccacacagaaaacacttgacgaagcgccgtcaccgtc

SEQ ID NO: 2062 - protein, 104 aa, Panicum virgatum
  misc_feature: Ceres CLONE 1775632
  misc_feature (1)..(65): Pfam Name: Glutaredoxin Pfam Description: Glutaredoxin
MAERVSRLSTEKAVVIFTRSQCPMCHTVLSLFSELDVCAVVHELDKDPRGRDMERELARRLGRAPPVPAVFVGGNLIGSTDKVMSLHLASKLVPMLKAAGAIWL

SEQ ID NO: 2063 - DNA, 783 bp, Panicum virgatum
  misc_feature: Ceres CLONE 1775633
  misc_feature: Encodes the peptide sequence at SEQ ID NO. 2064
acgcagagcaagcgagcgcagcagcagctgtagctagcttgtacgtgcacaaggagctcgctcggtcgcgatggcagctagagcggcgctcctcctggccgtgagcctggtcctggccgccgtggcgagcgcgaccaactgcccgccgccgccggccccgacgccgccgacgccgacgccgccgacgccgacgccgacgccgccgccggccccgacgccgccgacgccgacgccgacgcccagcggcggcggccaccactgccccagggacgcgctgaagctgggcgtgtgcgccaacgtgctgggcctcgtcaaggccaagatcggctcgccgccgtacctgccctgctgctcgctgctggacgggctcgtggacctggaggccgccgtctgcctctgcaccgccatcaaggccaacatcctcggcatcaaactcaacctccccatcgacctcagcctcatcctcaacaactgcggcaagagctgccccaacgacttccactgcgcatagatcgcccactgatcgaccgtcctcgctcctccatcgccggcggccgcggtcgtccatcggattctgtcattccgtggcggctctgtggttgatctcatcatcaactcgctgtcagttcgagcttgtttgtttttattcgtttcgttatacaaattaatgagtgggtttttcacttgtacgtagccccctcccccgcaaaagtcaccacgtatgttattctcttgatctgtttctatatatggtttgtcccgtaaaaaaaaaaaaaaaaaaaa

SEQ ID NO: 2064 - protein, 146 aa, Panicum virgatum
  misc_feature: Ceres CLONE 1775633
  misc_feature (15)..(47): Pfam Name: Cellulase Pfam Description: Cellulase (glycosyl hydrolase family 5)
  misc_feature (465)..(505): Pfam Name: Peptidase_M10_C Pfam Description: Peptidase M10 serralysin C terminal
  misc_feature (1)..(83): Pfam Name: Tryp_alpha_amyl Pfam Description: Protease inhibitor/seed storage/LTP family
  misc_feature (19)..(61): SWISSPROT Homolog: EC 3.2.1.4 Endoglucanase/exoglucanase B precursor [Includes: Endoglucanase
  misc_feature (20)..(60): SWISSPROT Homolog: EC 3.2.1.4 Endoglucanase A precursor
MAARAALLLAVSLVLAAVASATNCPPPPAPTPPTPTPPTPTPTPPPAPTPPTPTPTPSGGGHHCPRDALKLGVCANVLGLVKAKIGSPPYLPCCSLLDGLVDLEAAVCLCTAIKANILGIKLNLPIDLSLILNNCGKSCPNDFHCA

SEQ ID NO: 2065 - DNA, 886 bp, Panicum virgatum
  misc_feature: Ceres CLONE 1775690
  misc_feature: Encodes the peptide sequence at SEQ ID NO. 2066
cctcgtggcctcccttccccttccccttggtctcctcccgtcttctccacaattcgattccctcccttccccaagaacccagccccccacccccatgacgagctcctcctctccttcccgaaaggcgctgagcaagatcgcttgcaatcgactgcagaaggagctagccgagtggcagctcagcccccccgccgggttcaagcacaaggtctcagataatctccaaaggtgggtgattgaggttaccggagcggcaggcaccctatatgccggcgaaacctaccagttgcaggttgacttccccgagcattatcccatggaggcacctcaggtcatttttctcaatcctgcgcccatgcatccacacatttacagcaacggccacatctgcttagatatcttgtatgactcgtggtcaccagcgatgactgtgagttccgtgtgtatcagtatactgtctatgttgtctagttcgccagcaaagcaacgtccggcagacaacgaccgctatgttaggaactgccgcaatgggaggtcgccgaaggagaccagatggtggttccatgatgacacagtatgacgagcatctttggcattgcctgccagccttcattaccgtgatatatctcttccaaggggagatgagatgatttaggcgtattcctaagcacccctctattggactgcgagtcttaccttgctgtggtggtatgtaaatgagttgcacacgtgtcagtctgaaaatatactatcaccaccaatgatatatatatatagaataagcaagagtgtaccgtgcctgaataactgaaaacgagctcaaaaggaatatgcagatttactatgtgatttgctaatgtgcctctaaaaaaaaaaaaaaaaaaaa

SEQ ID NO: 2066 - protein, 161 aa, Panicum virgatum
  misc_feature: Ceres CLONE 1775690
  misc_feature: Great-hit functional homolog of the protein sequence given in SEQ ID NO 9434
  misc_feature (1)..(161): SWISSPROT Homolog: EC 6.3.2.19 Ubiquitin-conjugating enzyme E2-18 kDa
  misc_feature: Useful for making plants with modulated oxidative stress sensitivity
MTSSSSPSRKALSKIACNRLQKELAEWQLSPPAGFKHKVSDNLQRWVIEVTGAAGTLYAGETYQLQVDFPEHYPMEAPQVIFLNPAPMHPHIYSNGHICLDILYDSWSPAMTVSSVCISILSMLSSSPAKQRPADNDRYVRNCRNGRSPKETRWWFHDDTV

SEQ ID NO: 2067 - DNA, 999 bp, Panicum virgatum
  misc_feature: Ceres CLONE 1775820
  misc_feature: Encodes the peptide sequence at SEQ ID NO. 2068
atcgccagcgcgcgcgccggccgatctgggggcgggctccgctccacccgaggctcgccgttgacggggtccgcgtccatcggtagcaatggcacaagagagctggaaacaagagtccgaggagactagagtccacgcgcctgaggcccctattctctgcataaacaactgtggtttctttggcagcagcatgacgaacaatatgtgctcgaagtgctatagggacttcatcaagttgatggaagctcctgtggtggaaaagaaggtgaccacatcagcatcttcttccacagcaccactggagacaaagcgagatgatgcgcctgccgctgctgccactgaagctgtggctgagaagcaagcagagcaagagcccccaaagccacccagcaaccggtgtctgacttgccgcaagaaggtcgggctgaccggcttcctctgccgttgcggggacaccttctgctccacgcaccgctacaccgactcccaccagtgcacctttgactataagaaggtggcacgggagcagatagccaagcagaatccagttgtgatggccgagaagataaacaagatctaatgaatggttgtgaagggattcatgcctgggttcctgagtcctcaagttcactataatcgataggttccttcgggtggtggtctgggttagcgtggtagtagggggtctcaattgtgtctatccttctcctttatcatggttccattctctgccggaaagatgcagtggttttgcgtcgtcacttcctctggaagtagtttaagtcgagaagataagattgcacatcaggtattgcttattctggtcctggagggccaagtgttgtatcgacatgtcattggttttgtatcgttgtatgttatcacgtgtgctggaaatcacagcaagtatgaagcttatctgatcctgctaccatcatgtttatgtgatcagatgaagttatagataagcatacatatcaaaaaaaaaaaaaaaaaaaa

SEQ ID NO: 2068 - protein, 163 aa, Panicum virgatum
  misc_feature: Ceres CLONE 1775820
  misc_feature: Great-hit functional homolog of the protein sequence given in SEQ ID NO 9336
  misc_feature (1)..(39): Pfam Name: zf-AN1 Pfam Description: AN1-like Zinc finger
  misc_feature: Useful for making plants with modulated nitrogen use efficiency
MAQESWKQESEETRVHAPEAPILCINNCGFFGSSMTNNMCSKCYRDFIKLMEAPVVEKKVTTSASSSTAPLETKRDDAPAAAATEAVAEKQAEQEPPKPPSNRCLTCRKKVGLTGFLCRCGDTFCSTHRYTDSHQCTFDYKKVAREQIAKQNPVVMAEKINKI

SEQ ID NO: 2069 - DNA, 609 bp, Panicum virgatum
  misc_feature: Ceres CLONE 1775834
  misc_feature: Encodes the peptide sequence at SEQ ID NO. 2070
agggttttgctttttgctcccctactctactcgcccgccgccccagcgccgtatcgccaccagccgtgccggcacatatcctcttcgacggagagcgcgcggtcaccgaccaccgatcgcccgcgcaggacttggagcgcaagaaaggcgggtgcgcggccatggactccttctcgtcgtcgtcgtcaggttccagccccaacccggaggccgttatggagcagatcaaggcgcagctcgcccaggcgtacgcgcaggagtttctcgagaccctggggaacaagtgctttgaaaagtgcgtgaccaagccaggatcaagcttgagcggaagcgagagcagctgcatatcacgttgtgttgaccgctacattgaggccaccggtattgtgagccgagccttgttcagccagcgctaagagcacattatgattccaatgatccctcctgagagtgatgtacccttgagaattttgacttgtcaggatacaataacagttgatgcttggttgttcaagcagcgattgctctaaagactcggaggctcttttgtaagccttttctgctttagtagaagtaaccggctctatcaagcggcgcagatgttcaatt

SEQ ID NO: 2070 - protein, 84 aa, Panicum virgatum
  misc_feature: Ceres CLONE 1775834
  misc_feature: Great-hit functional homolog of the protein sequence given in SEQ ID NO 9363
  misc_feature: Useful for making plants with altered alkaloid content
  misc_feature: Useful for making plants with altered terpenoid content
MDSFSSSSSGSSPNPEAVMEQIKAQLAQAYAQEFLETLGNKCFEKCVTKPGSSLSGSESSCISRCVDRYIEATGIVSRALFSQR

SEQ ID NO: 2071 - DNA, 879 bp, Panicum virgatum
  misc_feature: Ceres CLONE 1775856
  misc_feature: Encodes the peptide sequence at SEQ ID NO. 2072
agagggcccagctaagtgacagacgcggcattggcctccactcttcttcctcgcgacaaaaacgcacgggacctcagccgccggaactccaccccaccctccaccgccgaccaccgctgccggagattcccccttccaccaccaaggaacattctcattgcagatactaaagtatggcatcaagacgcaatgttcgttacacacctctgcctgtagaggatggggagtacaacaatcttactaaagaagatgttgatcttcggttcgcttacactccaaaatcctacaggaggatcccctggaagtcaattgccctggcattgttcctcctactccttggatcttcacttctcttcctttcatacttcatattcacaggtcacatggagggtgatagttctcaggcatatggtctcttattcctgggcttccttgccttccttcctggcttttacgaaactcgagttgcttactattcatggcgaggagcaccagggtacacctttgcatccataccagattattagcctctcagttcttgccgccattggtgcagttaagcggcaagcgagcggcctggaacttcactgggaaccaatttgagcgagcatgtagatgtagtgattctgctcattgttgtgttaatatagtactgtattactccatcggcccgcgaaagaataatccttgttctattgtaaagcgcaaacgctgattttgcagttgatattttctatgcccactgctgttgcacagctacatcaggaacatgttgtaagtccagtatgtgcttatctgacatgcattggtcgcatttgggactttaattcgtttgagcttgttgaagagagaagcatataaaaaaaaaaaaaaaaaaaa

SEQ ID NO: 2072 - protein, 117 aa, Panicum virgatum
  misc_feature: Ceres CLONE 1775856
  misc_feature: Great-hit functional homolog of the protein sequence given in SEQ ID NO 9241
  misc_feature: Useful for making plants with altered protein content
MASRRNVRYTPLPVEDGEYNNLTKEDVDLRFAYTPKSYRRIPWKSIALALFLLLLGSSLLFLSYFIFTGHMEGDSSQAYGLLFLGFLAFLPGFYETRVAYYSWRGAPGYTFASIPDY

SEQ ID NO: 2073 - DNA, 663 bp, Panicum virgatum
  misc_feature: Ceres CLONE 1775942
  misc_feature: Encodes the peptide sequence at SEQ ID NO. 2074
acaagccacacaggccaagcgagcgatcaagagccagccatcagctctcgcgcgctcagtttagctagctgcttcttctgagagaaattaaagatacatatagctagtaggagatagatggcgtcgatgtcaatgagatcgtcgagggcgcagtggacgaagaagcaggacaagctgttcgagcaggcgctggcggtgtacgacaaggacacgccggaccggtggcacaacatcgcgcgcgccgtggggggcaagtcggcggaggaggtcaggcgctactacgagctgctggaagaggacgtcaagcgcatcgaggccggcaaggtgcccttccccgtctataggtgcccgccggcgccgcccccaattactagctaggcccacaggctgaagcaccagaagatctacgtacgtacttcggcaacaatcatgacatacagtgggtttggctacaaaacagtaactcaaccaagtggccggagcatccgtgcacatatatgaataactaccgctacctctagttaccgcagatcaatcgatctcccatgtatgtagtagtatacgtgttcatctggattctcaatttctcatgtaagatcatctctgtatttgtattatgtatcttgagaaaaagtgaagtaaaaaagtccttcatttcccctt

SEQ ID NO: 2074 - protein, 86 aa, Panicum virgatum
  misc_feature: Ceres CLONE 1775942
  misc_feature: Great-hit functional homolog of the protein sequence given in SEQ ID NO 9276
  misc_feature: Great-hit functional homolog of the protein sequence given in SEQ ID NO 9484
  misc_feature (1)..(51): Pfam Name: Myb_DNA-binding Pfam Description: Myb-like DNA-binding domain
  misc_feature: The sequence is a functional homolog of  SEQ ID NO 510 in the  10/666,642 US patent application
  misc_feature: The sequence is a functional homolog of  SEQ ID NO 976 in the  11/435,388 US patent application
  misc_feature: Useful for making plants with altered Lignin content
  misc_feature: Useful for making plants with modulated low light sensitivity
  misc_feature: Useful for making plants with modulated growth and phenotype characteristics
MASMSMRSSRAQWTKKQDKLFEQALAVYDKDTPDRWHNIARAVGGKSAEEVRRYYELLEEDVKRIEAGKVPFPVYRCPPAPPPITS

SEQ ID NO: 2075 - DNA, 906 bp, Panicum virgatum
  misc_feature: Ceres CLONE 1776051
  misc_feature: Encodes the peptide sequence at SEQ ID NO. 2076
ctagtcagtcctccagcagcccaccaccgcacaacgagccgggtagctgtaggagaggccagggaggagaagaaggagctgaggagatggccggcgccgggggcgagaggtgggtggggctggcgacggacttctccgaggggagccgcgccgcgctgcggtgggcggcggacaacctgctgcgcgccggcgaccagctgctgctgctgcacgtcatcaaggaggccgactacgagcagagcgaggccatcctctgggaatccaccggctccccgttgattcccctctcggagttctctaatcctattactgccaagaaatatggggcaaagcctgatgctgaaaccttagatctcctcaactccatagcccaggagaaggaggttatggtggttatcaaagtcctctggggagatccccgggagaagctaagccacgctatcaacgacatgcccttgagctgcttggtcataggtagcagaggcctgggaaagctcaagagggtgctcttgggaagcgtcagcgactacatcgtgaacaacgcgacctgccctgtcacagtcgtcaagcccaatgacggctgatcttatcatcgaaatgaccgaatgtgttgctgttataagatgatcggcctgttgaagaacatgcactagattccagctagctgaaacatgttgaaccaggcagttttattgtaataataggcaaatgaccttttgaaggacatggacatgtaatagttctgttttcctgattagctggacgatgcttttgttactgaatgagtggtgtttatagcttcgtaggtctgaaaaattgggtcactattctattgtgcttctgctgatcaatgcgatgtctatgcttgcacatcatacatgttatcaaaaaaaaaaaaaaaaaaaa

SEQ ID NO: 2076 - protein, 165 aa, Panicum virgatum
  misc_feature: Ceres CLONE 1776051
  misc_feature (1)..(155): Pfam Name: Usp Pfam Description: Universal stress protein family
MAGAGGERWVGLATDFSEGSRAALRWAADNLLRAGDQLLLLHVIKEADYEQSEAILWESTGSPLIPLSEFSNPITAKKYGAKPDAETLDLLNSIAQEKEVMVVIKVLWGDPREKLSHAINDMPLSCLVIGSRGLGKLKRVLLGSVSDYIVNNATCPVTVVKPNDG

SEQ ID NO: 2077 - DNA, 632 bp, Panicum virgatum
  misc_feature: Ceres CLONE 1776074
  misc_feature: Encodes the peptide sequence at SEQ ID NO. 2078
ctcctttcggttccgcccggctcgcaaaagccatcgaggttgacccgaccggagaagccaagtggtgccatcgcctgacctccccacctccaccgcgcgacgccgacggggacccgccgccatctccagcccccctccgcgccacgatggccgagattgagataaaaacagcacctgcggacttccgtttccctacgacaaaccagacaaggcattgttttactcgctacgttgagtaccacaggtgtgtgaatgccaaaggggacgatgctggtgactgtgacaaattcgccaagtactacaggtccctttgccctggagaatgggttgagaagtggaacgagcagagggagaacgggacctttccaggacctctctgaatctactgcctgagacctgccctctggactcgtcaacacgttggccagtcgcactgttccattctgaattcctgctttcagaatcgtcaatgcctttgtcccttgctcttcaaccagtcgctacaaaactgttagtgatgctctcgttatgctgttctaataattggctacagtggcctcacatgctgccttgtgttgtgtggacctcattttattcgcgtataaacgtatgaattggaacttgcattgttt

SEQ ID NO: 2078 - protein, 77 aa, Panicum virgatum
  misc_feature: Ceres CLONE 1776074
  misc_feature (1)..(74): Pfam Name: COX6B Pfam Description: Cytochrome oxidase c subunit VIb
  misc_feature (13)..(77): SWISSPROT Homolog: EC 1.9.3.1 Cytochrome c oxidase polypeptide VIb
MAEIEIKTAPADFRFPTTNQTRHCFTRYVEYHRCVNAKGDDAGDCDKFAKYYRSLCPGEWVEKWNEQRENGTFPGPL

SEQ ID NO: 2079 - DNA, 863 bp, Panicum virgatum
  misc_feature: Ceres CLONE 1776111
  misc_feature: Encodes the peptide sequence at SEQ ID NO. 2080
gacacaccgaaaatcacaaaaagcgcaagagcaatccacagatcaagaaaccaagaaagcccagagcgattcagtcgagaggagagaccctagagagcgacatggatgcgatgatgttcgggctgcagattccccggatggcagcgctgcagcacctgatggacatccccgacggcgacgccggcgcgggcggcgacaaggcgggcgcggcggcgagcggccctacgcgcacctacgtccgcgacgcgcgcgccatggcggcgaccccggccgacgtcaaggagcttcccggtgcctactcgttcgtggtggacatgccggggctgggcaccggcgacatcaaggtgcaggtggaggacgagcgggtgctggtgatcagcggcgagcggcgcctggaggagcgcgaggacgccaaatacctgcggatggagcgccggatgggcaagttcatgcgcaagttcgtgctgccggacaacgccaacatggacaagatctccgccgtgtgcaaggacggcgtgctcacggtgaacgtggagaagctgccgccgccggagccaaagaagcccaagaccatcgaggtcaaggtcgcctgaactgttgagcgaggatcgatcgaacctaataaagggagttcagggcagtgccagcgagttgtggcgaggatgagagcagtgatgtgggcagtagtgactagctaatgagtgtgttcatgaacattagcgtgttcatgagtgttcagttcttttatgccgtgctctgtttgtggcttttgtgctacgaaacgcagaagctgagctgatgtgagctgctttctgaataattaaatccgtatcttgttcgttgaaaaaaaaaaaaaaaaaaaa

SEQ ID NO: 2080 - protein, 163 aa, Panicum virgatum
  misc_feature: Ceres CLONE 1776111
  misc_feature: Great-hit functional homolog of the protein sequence given in SEQ ID NO 9388
  misc_feature: Great-hit functional homolog of the protein sequence given in SEQ ID NO 9432
  misc_feature (1)..(104): Pfam Name: HSP20 Pfam Description: Hsp20/alpha crystallin family
  misc_feature: Useful for making plants with modulated drought sensitivity
  misc_feature: Useful for making plants with modulated heat sensitivity
MDAMMFGLQIPRMAALQHLMDIPDGDAGAGGDKAGAAASGPTRTYVRDARAMAATPADVKELPGAYSFVVDMPGLGTGDIKVQVEDERVLVISGERRLEEREDAKYLRMERRMGKFMRKFVLPDNANMDKISAVCKDGVLTVNVEKLPPPEPKKPKTIEVKVA

SEQ ID NO: 2081 - DNA, 736 bp, Panicum virgatum
  misc_feature: Ceres CLONE 1776131
  misc_feature: Encodes the peptide sequence at SEQ ID NO. 2082
agccctaacctcccctccaagacaagagcgccgctacaacaccaggaccgggccttgcccctcgtctcctcccctcgtccccaatagccgcctctcccggtctcccccaactcgtaccctctcctcggatctctccgtcggccacaaccaaaagatccccatggcggcgctggggtcgaagctggcgcagctgcagtccaaggcgtgcgaggcgacgaggttcgtggcaaagcacggctgcgcgtaccacaagacgctcatggagaagaacaagcaccacgtcgtcgacccgcccaccatccagaagtgccaggagctctccaagcagctcttctacacccgcctcgcgagccttcctggtcgttccgaggcattctggaaggagcttgatagcgcaaagctcttgtggaaaaacagaaacaacctgaaggttgaggatgttggcgtcgcagcattgtttggcatcgagttgtatgcttggtcctgcctcggtgagatcgttgggagaggatttactcttacgggctaccatgtctgaagccttacctctagcatgaacaatcacattagtccacatttgccgacgaatactgtgtcggtggtcagttttactctgacatgaatcctgtgatgcaaagttttggtattctcaaatactcttgaaccttgatgccgtagaactacattgatctcggtggaaagagaaatgatgagctaaaaaaaaaaaaaaaaaaaa

SEQ ID NO: 2082 - protein, 125 aa, Panicum virgatum
  misc_feature: Ceres CLONE 1776131
  misc_feature (1)..(115): Pfam Name: ATP-synt_G Pfam Description: Mitochondrial ATP synthase g subunit
MAALGSKLAQLQSKACEATRFVAKHGCAYHKTLMEKNKHHVVDPPTIQKCQELSKQLFYTRLASLPGRSEAFWKELDSAKLLWKNRNNLKVEDVGVAALFGIELYAWSCLGEIVGRGFTLTGYHV

SEQ ID NO: 2083 - DNA, 1816 bp, Panicum virgatum
  misc_feature: Ceres CLONE 1776208
  misc_feature: Encodes the peptide sequence at SEQ ID NO. 2084
cccaactgccaccgatttgtttgacgccgcctccggtcctccctccacactcgccggtcgctgctcccgacctccgctgccgatctccgtcctgccgtgccggcgagaggagtcatggcgggggaaggggaggaggtgtacgtggcggccatcgaccagggcaccaccagcacccggttcatcatctacgaccgccacgccaagcccgtcgcgtcgcaccagctcgagttcaagcagcactacccggaggcagggtgggttgagcatgatcctatggagattatagagactgtgaaggtgtgtatgaaggaggcagttgacaaaaccaaagatggtaaatacaatgtggttgctggcttgaaggccattgggatcacaaatcagagagaaaccactgttatgtggagtgagtccactggccttccactgtacaatgccattgtgtggatggatgctcgcacaagccctgtttgcaggagattggaaagtgagctctcaggaggtagaacccacttcgtggagacatgtgggctgccaatcagcacctatttcagtgctctgaagttattatggttgatggagaatgtggatgctgtcaaggatgcagtccagactggtgacgcgttatttggcacaatcgacacctggttgatctggaaccttacaggaggcgtccatggtgggcagcatgtcacagactgctcaaacgcatcacgtacaatgcttatgaatctaaaggcacttgattgggataagccaacacttgatgcattgggaattcctgccaagattttgccaaagattataagtaactcagagaaaatcggtgtggttgctgatgggtttcccttgacaggtacccccatctcggggtgtctaggagatcagcatgctgctatgcttgggcagctatgccaaaagggtgaagcaaaaagcacttatggaactggtgccttcatccttctcaacacaggggaagaagttactcagtcttcccatggtcttcttagcaccattgcgtacaagcttggcccaaacactcccactaattatgcactagaaggctccattgcaattgcaggtgcagctgttcagtggttgagggacagccttggaattattcagacagcagctgaaattgaaaagttagctgaaaccgtgccagattcaggtggagtatactttgtgccagcattcaatgggttatttgcaccatggtggagggacgacgcaagggggatctgcattggaatcacaaggttcacaaataaggggcatattgctcgagcggtgcttgagagtatgtgctttcaggtgaatgatgtcctcagctccatgcacaaggatgctggagaggcaggagaagtaaagagtgcagaaggggacttcctgttgcgcgttgatggtggcgctactgttaataatcttctcatgcagatccaggctgatctattgggtagcccagttgtcagacccgctgacatcgagacaacagcccttggagctgcatatgctgctggattagctgctggattatggactaaggaccaagtatttgctggcctgcacaaaaacaacaccacagtcttccgcccaaaattggacgatgcccacaggaagaagagagcagactcctggtacaaggctgtttcaagatcattcaatttagctgatctttctctgtaaatttatattgtttcaagcataattcagtcagtctgtggtcctcttatcggtggtgtatctgttttcagaagccgcaaatgaataaagtggtcttcaccgaggttattattaaaaaaaaaaaaaaaaaaaa

SEQ ID NO: 2084 - protein, 523 aa, Panicum virgatum
  misc_feature: Ceres CLONE 1776208
  misc_feature (1)..(265): Pfam Name: FGGY_N Pfam Description: FGGY family of carbohydrate kinases, N-terminal domain
  misc_feature (10)..(515): SWISSPROT Homolog: EC 2.7.1.30 Glycerol kinase
  misc_feature (9)..(520): SWISSPROT Homolog: EC 2.7.1.30 Glycerol kinase
MAGEGEEVYVAAIDQGTTSTRFIIYDRHAKPVASHQLEFKQHYPEAGWVEHDPMEIIETVKVCMKEAVDKTKDGKYNVVAGLKAIGITNQRETTVMWSESTGLPLYNAIVWMDARTSPVCRRLESELSGGRTHFVETCGLPISTYFSALKLLWLMENVDAVKDAVQTGDALFGTIDTWLIWNLTGGVHGGQHVTDCSNASRTMLMNLKALDWDKPTLDALGIPAKILPKIISNSEKIGVVADGFPLTGTPISGCLGDQHAAMLGQLCQKGEAKSTYGTGAFILLNTGEEVTQSSHGLLSTIAYKLGPNTPTNYALEGSIAIAGAAVQWLRDSLGIIQTAAEIEKLAETVPDSGGVYFVPAFNGLFAPWWRDDARGICIGITRFTNKGHIARAVLESMCFQVNDVLSSMHKDAGEAGEVKSAEGDFLLRVDGGATVNNLLMQIQADLLGSPVVRPADIETTALGAAYAAGLAAGLWTKDQVFAGLHKNNTTVFRPKLDDAHRKKRADSWYKAVSRSFNLADLSL

SEQ ID NO: 2085 - DNA, 2263 bp, Panicum virgatum
  misc_feature: Ceres CLONE 1776253
  misc_feature: Encodes the peptide sequence at SEQ ID NO. 2086
aaggcgcaacgcctctcccatttgctcatcggcgacaagtcaacccaacaacctcagctcagcctcaggtgctccgtgctcagagcagctcacgcctcccgcctccccaaagcgctctagtgctccactctccatcggcgatgccgacggacaccccggcgccgccgcagcgcgcggcgtcgctgtccgacgacgaccgcctgctcgtcgcgcactgcgccgagctctccttccctccctcctcccccgccccggccgccgcctccgcccgctccttccaggtgcaccacgcgtcccacccctacccctgcgccgccttcgccttcgcgccctcctggtccgccaccgactgggccgcgccctccaccgcggagggcgcccgccagccgttcggggacgcggaggtggacgcggcgctgttcccgtcgctccgagccgtcgggagcggcgtccccgcgcgcgccaacgccgccttcctcgccgccttccgcggcctgctcgacggatcgccgctccagtccgaggtatccagagctgtggctgaagagaaacgtatagtattcacaggccattcatcaggaggttcaatagccacccttgctgctatatggtttcttgagaagtgcaccagacagggaagtgttaatcaagcacacccattctgcgtgacctttggggctcctcttattggagacaatatcttcaaccatgctgttagaagagagggctggtcacaatgtattttgcatttcctacgtccactagacattgtcccacgtataccattgactccacttgcatccttcagagaagaaattcaagctgttctggaatggttgtctcctcagacaccaaacaactcacctgctgggaggtctcttgtcatacctgagtactatgaaactttactcagaagcacactatctattgccagctatgaagcctgttctttcatgggatgcactagctcaatccttggaacattgacctcctttattgacctctccccttacagaccctgtgggacgtattatttcttcacaagtagcgaacagctgattgttctcacaaattcagatgctgtactgcagttgttattttactgccttcagttggatccccagcagcaattgcttgatgctgctgctagaagtttaagtgctcactggcagtatgaaccaattaaacagtgcatgccggatatagtttgcgtggactacctgggagctatctcatcaaccgctcctgggaggcagacagacagagcggcaattggaaacattgaactgagcaaggaagctttactgcacctttctgcagctgcgcaatgggagaagcaaagacagagaaaccaaacgaagattgaccaaagctgccaaaagatccaggaagccctcagatccctaaacgactacaaaagaacatgcgaactccgtggcgtaagctactacgattccttcaagctccaacgggaggtgcatgacttcaacgccaacgtgcggaggctggagctggccggcctctgggacgagatcatcgagatgctccggaggcgcgaactgccggatggctttgaggcgcgcgaggagtgggtgcgcctgggcacactgtttcgccgcctggtcgagccgctggacatcgccaactactaccggcactccaagaacgaggacaccggctcctacctctccaaggggcggccgcggcggtacaagtacacccagaagtggcacgagcagctgcagcgcgcccccgtcgggtccagcctcgagtcctgcttctgggcggtggtcgaggagctccaggccgagatggtcgacggcatggcgttcgaggacctgagggatagggtggtcaagctcgagagcgacgcgcatggatggtatagttctggaagtctgggcaaggacgtctttctggggagctcgtcttttgtggcgtggtggaggacgctccccgagcagcacaagtcggcgtcctgcatcgccaaacttgtgtccttgtaggcctagtttggaagccacttcccggcgcgtttttttattttttttatttttgaaaatcgttttttatagaaatatattttcagtttcacaatttacagttttatacccctgccgtcccctgccgggcggcaggggcttatatgtaattaaaatttatgttttatcgcatagaggctcttaccgcccggcaggggggcggtaggctccccccaatataaaagccgaggtcccctccccaaaaaaaaaaaaaaaaaaaa

SEQ ID NO: 2086 - protein, 621 aa, Panicum virgatum
  misc_feature: Ceres CLONE 1776253
  misc_feature (1)..(143): Pfam Name: Lipase_3 Pfam Description: Lipase (class 3)
MPTDTPAPPQRAASLSDDDRLLVAHCAELSFPPSSPAPAAASARSFQVHHASHPYPCAAFAFAPSWSATDWAAPSTAEGARQPFGDAEVDAALFPSLRAVGSGVPARANAAFLAAFRGLLDGSPLQSEVSRAVAEEKRIVFTGHSSGGSIATLAAIWFLEKCTRQGSVNQAHPFCVTFGAPLIGDNIFNHAVRREGWSQCILHFLRPLDIVPRIPLTPLASFREEIQAVLEWLSPQTPNNSPAGRSLVIPEYYETLLRSTLSIASYEACSFMGCTSSILGTLTSFIDLSPYRPCGTYYFFTSSEQLIVLTNSDAVLQLLFYCLQLDPQQQLLDAAARSLSAHWQYEPIKQCMPDIVCVDYLGAISSTAPGRQTDRAAIGNIELSKEALLHLSAAAQWEKQRQRNQTKIDQSCQKIQEALRSLNDYKRTCELRGVSYYDSFKLQREVHDFNANVRRLELAGLWDEIIEMLRRRELPDGFEAREEWVRLGTLFRRLVEPLDIANYYRHSKNEDTGSYLSKGRPRRYKYTQKWHEQLQRAPVGSSLESCFWAVVEELQAEMVDGMAFEDLRDRVVKLESDAHGWYSSGSLGKDVFLGSSSFVAWWRTLPEQHKSASCIAKLVSL

SEQ ID NO: 2087 - DNA, 2273 bp, Panicum virgatum
  misc_feature: Ceres CLONE 1776256
  misc_feature: Encodes the peptide sequence at SEQ ID NO. 2088
ataagactcgatcccattccagatcgtcgcggcagcggaaccccggggtcccggaccgactccatttccggccaagaggccaagatccatttcgttccgccattctttttttttccttcttggtgatctgatctagtcgcgcccgttcgcgtccattaatcctagcagcggcggacctcagcgagcgagcctgttgtcatctcctcgtactaccgccagccgttacagcgtgcaatggcgctcaacctcgcgcaccagcccggcgcggcggcggccgtgacggcggcaccggcggcgccgcgctcggcggttgtcgcggcggcctccaccgtggcgccgtccgcgacggcgccctcgtcggcgcccgcgctccaggcgcagacggtgacggtggacccggcgccggcgcaggcggcggcggactcggtgaagccggacctcgccatggtgtgccaggcgcttgtggacggcggcaagccggaggcggagcacgcggacgtggccgccgaggtgaagagcaaggagggcgtgccggtgttcgtgatgatgccgctcgacacggtgcgcaaggacggcaacagcctgaaccggcggagggcggtggaggccagcctggcggcgctcaagagcgccggcgtcgagggcatcatggtggacgtgtggtggggtatcgccgaggccgagggccccggccagtacaacttcaacggctacatggagctcatggagatggccaggaagaacgggctcaaggtgcaggccgtcatgtccttccaccagtgcggcggcaacgtcggcgactcagtcaccataccacttccgaaatgggttttggaggagatggacaaggaccaggacctggcctacaccgaccggagcgggcggcggaactacgagtacgtctcgctggggtgcgacgcgctgcccgtgctcaaggggcgcacccccatccagtgctacgccgacttcatgcgcgccttccgcgaccacttcgccacctacatgggcaacaccatcgtggagatccaggtcggcatgggccccgccggcgagctccgctacccgtcctacccggagagcaacggcacctggtgcttcccgggcatcggcgagttccagtgctacgacaggtacatgcttagcagcttgaaggcggcggctgaggccgtgggcaagccggagtggggcaacgccgggccgagccactccggcagctacaagaactggcccgaggacacccccttcttccggcgcgagggcgggtggaacaccgagtacgggcagttcttcatgagctggtactcgcagatgctcctggagcacggcgagcgcatcctgtcggcggccaccggcgtgttcacggcctccccgggcgtcaagatctccgtcaaggtggccggcatccactggcactacggcacccgctcccacgcggcggagctgacggcggggtactacaacacccggcaccacgacgggtaccagccgatcgcgcgcatgctggggcgccacggcgccgtgctcaacttcacgtgcgtggagatgcgcgaccacgagcagccgcaggacgcgcagtgccggcccgaggggctggtgcagcaggtggccgcggcggcgcgggaggccggcatcgggctcgccggcgagaacgcgctgccccgctacgacgagacggcgcacgaccaggtggtggccacggcggccgagaaggccgaggaggaccggatggtggccttcacctacctccgcatgggccccgacctgttccagcccgacaactggcgccgcttcgccgccttcgtcaagcgcatgtccggcgccggcaagcgggacatgtgccgggagcaggtggagcgggaggcctccggagtcgcgcacgccacccagccgctcgtgcacgaggccgccgtcgcgctcaccaactagtggatccatcatccatccactactggatacgctactactactactgtacgatcgagtcgtaggctgctgcggcgccggccgtgccgtgtgcccgtgccggcgcgtgtaccgctcacaagggtgaagaagctacgaggttaggggtggggtgactgggtaatgctggtacgtagttgccacgtttcaagcttggtggcagggagatacgatcgagtctgaagctctgctgctgcatgctacagttgatacctactaaaaagagtgtggatatactactcatgatttgtactgctacgatttcacgaagaaagaaacaaaactttctgcaaaaaaaaaaaaaaaaaaaa

SEQ ID NO: 2088 - protein, 563 aa, Panicum virgatum
  misc_feature: Ceres CLONE 1776256
  misc_feature (1)..(415): Pfam Name: Glyco_hydro_14 Pfam Description: Glycosyl hydrolase family 14
  misc_feature (99)..(526): SWISSPROT Homolog: EC 3.2.1.2 Beta-amylase
MALNLAHQPGAAAAVTAAPAAPRSAVVAAASTVAPSATAPSSAPALQAQTVTVDPAPAQAAADSVKPDLAMVCQALVDGGKPEAEHADVAAEVKSKEGVPVFVMMPLDTVRKDGNSLNRRRAVEASLAALKSAGVEGIMVDVWWGIAEAEGPGQYNFNGYMELMEMARKNGLKVQAVMSFHQCGGNVGDSVTIPLPKWVLEEMDKDQDLAYTDRSGRRNYEYVSLGCDALPVLKGRTPIQCYADFMRAFRDHFATYMGNTIVEIQVGMGPAGELRYPSYPESNGTWCFPGIGEFQCYDRYMLSSLKAAAEAVGKPEWGNAGPSHSGSYKNWPEDTPFFRREGGWNTEYGQFFMSWYSQMLLEHGERILSAATGVFTASPGVKISVKVAGIHWHYGTRSHAAELTAGYYNTRHHDGYQPIARMLGRHGAVLNFTCVEMRDHEQPQDAQCRPEGLVQQVAAAAREAGIGLAGENALPRYDETAHDQVVATAAEKAEEDRMVAFTYLRMGPDLFQPDNWRRFAAFVKRMSGAGKRDMCREQVEREASGVAHATQPLVHEAAVALTN

SEQ ID NO: 2089 - DNA, 1885 bp, Panicum virgatum
  misc_feature: Ceres CLONE 1776262
  misc_feature: Encodes the peptide sequence at SEQ ID NO. 2090
gctgaaccgacgcccagagcccaagccgcagggcagcattcaacgcggcaaaagcttccctgcgaagccgcggtcttcagccggatcccacagcttcggcgtgagcgcagccttcataccttcctttcttccccagctccgagcctccgtgcagcggaatcgagcaaagcatccgtacccgcaccgcgtcacgcttcccggcttcataatactcgctctccttcggccccaggctcagcccctcggtttccgaagcaaccccgccgctccggcctccgcctccccccgcctccaatggcgctgccctacctggaggccgtgctgtgctttatgattctcatgtacatatttgagacatatcttgacatccgtcagcatagagccctcaagttgccaactttgccgaaacccctggtgggagtaattagtgatgaaaaattcaaacgttccagagattatagccttgacaaaagctacttccattttgttcatgaggctgtgactatattaatggatactgcaatactgtactataaagttcttccctggttttggaagagatctggagaattagttacaaaggttggtttgaatgctgagaatgagataatacacacccttgcattcttagctggtgccatggtttggtcacagattacagacttgccattctctctttattcaacttttgtcatagaggctcgccatggttttaacaagcaaactatatggctcttcattagggatatggtcaaaggaattttactatccatgatattgggcccaccaatcgtggctgctatcatctacatagtacagattggaggaccttacctggccatatatctctggggttttatgtttgtattagctctcctgatgatgacaatataccccattgtgattgctcctttgttcaacaagttcacacctcttcctgaaggagtactcagggagaaaatagagaagttggcagcttccctcaaatttcctttgaaaaagcttttcgtggtagatgggtctaccagatcaagccacagtaatgcttacatgtatggttttttcaagaacaaacgcatagtactctacgacacgttaattcagcagtgcagtaatgaggatgagatagtttctgttattgcacatgaacttgggcactggaaactcaatcatactgcctattcctttatagctgtccagctgcttatgtttctgcaatttggaggatatactctagtaaggaactccaaagatctctttgagagttttggttttgaggatcagccaataataattggattaatcattttccagcacaccataatacctcttcaacaccttctgagcttttgcctgaatcttgtcagtagagcatttgaattccaggccgacgcctttgccaagaaccttggatatgcccctcagctccgagcggcccttgttaaactacaggaggagaacttgtctgcaatgaacaccgatccatggtattctgcatatcactactcccacccaccccttgtggaacggctgcaggctctggatgatccggacagcaaaaaagaagactaattggaacccatcagagcttacgttgttcttgagcaaaaccctgacccctgtgtgaggttttccatatggatttccctgccacgcacaaggcaccgattcagcgtttggatgttgaggtgtttgatacaggggagtattgtcgaagttctgtaaaagcgttcggcacaagcgtgcatacagggtatcaggggacacatagaggtgttgctattcatcaatcgacttcctagatgctctgatgtattagtgtttcgaatattgagaactataagcaaatcagctattcaaacactaaaaaaaaaaaaaaaaaaaa

SEQ ID NO: 2090 - protein, 425 aa, Panicum virgatum
  misc_feature: Ceres CLONE 1776262
  misc_feature (1)..(199): Pfam Name: Peptidase_M48 Pfam Description: Peptidase family M48
MALPYLEAVLCFMILMYIFETYLDIRQHRALKLPTLPKPLVGVISDEKFKRSRDYSLDKSYFHFVHEAVTILMDTAILYYKVLPWFWKRSGELVTKVGLNAENEIIHTLAFLAGAMVWSQITDLPFSLYSTFVIEARHGFNKQTIWLFIRDMVKGILLSMILGPPIVAAIIYIVQIGGPYLAIYLWGFMFVLALLMMTIYPIVIAPLFNKFTPLPEGVLREKIEKLAASLKFPLKKLFVVDGSTRSSHSNAYMYGFFKNKRIVLYDTLIQQCSNEDEIVSVIAHELGHWKLNHTAYSFIAVQLLMFLQFGGYTLVRNSKDLFESFGFEDQPIIIGLIIFQHTIIPLQHLLSFCLNLVSRAFEFQADAFAKNLGYAPQLRAALVKLQEENLSAMNTDPWYSAYHYSHPPLVERLQALDDPDSKKED

SEQ ID NO: 2091 - DNA, 2458 bp, Panicum virgatum
  misc_feature: Ceres CLONE 1776298
  misc_feature: Encodes the peptide sequence at SEQ ID NO. 2092
gccttcgcggcccccttcccctgccactagcccactactactagttgccttgctcgcttcccacccctctcctctctctcaccccagcctcgcttccgcctcccctccccctcttcccttccctttccttccccactcccacttcccaaccctggatccaaatcccaagctatcccagaaccgaaaccgaggcgcgcaagcaattattagctggctagctaggagcgtacagtagctccgagatcatgaagcgcgagtaccaagacgccggcgggagcggcggcgacatgggctcctccaaggacaagatgatggcggcggcggcgggggagcaggatgaggaggtggacgagctgctggccgcgctcgggtacaaggtgcgctcgtccgacatggcggacgtcgcgcagaagctggagcagctcgagatggccatgggaatgggcggcgtgggcggcgccgccacagccgtcgatgacgggtttgtctcgcacctcgccacggacacagtgcactacaacccctccaacctgtcgtcctgggtcgagagcatgctgtccgagctcaacgcgccgccgccgccgctccccacagcgccgccggctccgcggctcgcgtccacctcgtccaccgtcacgggtggcgccgccgccggtggagggtactttgatctcccgcccgccgtcgactcgtccagcagcacgtacgctctgaagccgatcccctcgccggtggcggcgtcggcggacccgtcaacggactcgacgcgggagcccaagcggatgcgaactggcggcggcagcacgtcgtcttcctcttcctcgtcgtcttccctggacggcggccgcaccaggagctccgtggtcgaggcggccccgccggcgacgcaagcgtccgcggcggccaacgcgcccgcggtgccggtggtggtggtggacacgcaggaggccgggatccggctcgtgcacgcgctgctggcctgcgcggaggccgtgcagcaggagaacttcaccgccgcggaggcgctggtcaagcaaatccccatgctggcatcgtcgcagggcggcgccatgcgcaaggtcgccgcctacttcggcgaggcgctcgctcgccgcgtgtaccgcttccgccctgccccggacagctccctcctcgacgctgccttcgccgacctcctccacgcgcacttctacgagtcctgcccctacctcaagttcgcccacttcaccgcgaaccaggccatcctggaggcgttcgccggctgccgccgcgtccatgtcgtcgatttcggcatcaagcaggggatgcagtggccggctcttctccaggctcttgccctccgtcctggcggccccccatcgttccgcctcaccggcgtcggcccgccgcagccggacgagaccgacgctttgcagcaggttggttggaagcttgcccagttcgcgcacacaatccgcgtcgacttccagtaccgcggcctcgtcgccgccacgctcgctgaccttgagccgttcatgctgcaaccggacggcgaggatacggatgacgagcccgaggtgatcgccgtcaactcggtgttcgagctgcatcggctgctggcgcagcccggcgccctggagaaggtcctgggcacggtgcgcgcagtgcggccgaggatcgtgaccgtggtcgagcaggaggccaaccacaactccgtctcattcctggaccgcttcacggagtcgctgcactactactccaccatgttcgattccctcgagggcgccggctccggccaatccgccgatgccgccccggccgcggccggcggcacggaccaggtcatgtccgaggtgtacctcggccggcagatctgtaacgtcgtggcgtgcgagggtgcggagcgcaccgagcggcacgagacgctggggcagtggcgcaaccgcctgggcggcgccgggttcgagcccgtccacctgggctccaatgcctacaagcaggcgagcacgctactggcgctgttcgccggcggcgacgggtacagggtggaggaaaaggacgggtgcctgaccctggggtggcacacgcgcccgctcatcgccacctcggcatggcgcgtcgccgcgccgtgatcgggcgggtgcggttttggacgctgatcaggatgcacgtccccgggcatggcgcaccccctccacccagctcgccggcacagctgaagctagacgtcaacgaacgctgaattgcagtgagcgaccgggccacggttcactccggcgtgatgagatggacacttggactccgaccggaccggcctgtgttcgttcttgttcccgatcccccctctcatcacctccctccaatccgtagcctattgttatgtttaaatgtctattattatgtgtaattcctccaatcgctcatatcccaataaggacgaaccggatttgtttagctcgaaaaaaaaaaaaaaaaaaaa

SEQ ID NO: 2092 - protein, 621 aa, Panicum virgatum
  misc_feature: Ceres CLONE 1776298
  misc_feature (1)..(300): Pfam Name: GRAS Pfam Description: GRAS family transcription factor
  misc_feature: The sequence is a functional homolog of  SEQ ID NO 216 in the  10/412,699 US patent application
  misc_feature: The sequence is a functional homolog of  SEQ ID NO 435 in the  11/479,226 US patent application
  misc_feature: The sequence is a functional homolog of  SEQ ID NO 68 in the  10/666,642 US patent application
  misc_feature: Useful for making plants with modulated growth and phenotype characteristics
MKREYQDAGGSGGDMGSSKDKMMAAAAGEQDEEVDELLAALGYKVRSSDMADVAQKLEQLEMAMGMGGVGGAATAVDDGFVSHLATDTVHYNPSNLSSWVESMLSELNAPPPPLPTAPPAPRLASTSSTVTGGAAAGGGYFDLPPAVDSSSSTYALKPIPSPVAASADPSTDSTREPKRMRTGGGSTSSSSSSSSSLDGGRTRSSVVEAAPPATQASAAANAPAVPVVVVDTQEAGIRLVHALLACAEAVQQENFTAAEALVKQIPMLASSQGGAMRKVAAYFGEALARRVYRFRPAPDSSLLDAAFADLLHAHFYESCPYLKFAHFTANQAILEAFAGCRRVHVVDFGIKQGMQWPALLQALALRPGGPPSFRLTGVGPPQPDETDALQQVGWKLAQFAHTIRVDFQYRGLVAATLADLEPFMLQPDGEDTDDEPEVIAVNSVFELHRLLAQPGALEKVLGTVRAVRPRIVTVVEQEANHNSVSFLDRFTESLHYYSTMFDSLEGAGSGQSADAAPAAAGGTDQVMSEVYLGRQICNVVACEGAERTERHETLGQWRNRLGGAGFEPVHLGSNAYKQASTLLALFAGGDGYRVEEKDGCLTLGWHTRPLIATSAWRVAAP

SEQ ID NO: 2093 - DNA, 1055 bp, Panicum virgatum
  misc_feature: Ceres CLONE 1776322
  misc_feature: Encodes the peptide sequence at SEQ ID NO. 2094
tcttcggtactcgcgcgcgccagctcactccctctcttcttccctcccctgccccccagataatcccagatctcccccggccccgagcccggagctccggatccccagcgccgccgcgggtgccaaggccgcgggcgtcgccatgggcatcgtgttcacgcggctcttctcgtcgctcttcggcaaccgcgaggcccgcatcctggtcctcggcctcgacaatgccggcaagaccaccatactctatcggctgcagatgggggaggtcgtctccacgatcccaacgatcgggttcaacgtggagacggtgcagtacaataacatcaagttccaagtatgggatctcggtggtcaaacaagcatcaggccatactggcggtgctactttccaaacacccaggctatcatatacgttgttgactcaagcgatacagataggcttgtaacagcaaaggaagaattccatgccatccttgaggaggatgagctgaaaggtgctgttgtccttgtatatgcaaataagcaggatcttccaggtgctctcgatgatgctgccataacagagtcattagaactccacaagatcaagagccgccaatgggcgattttcaaaacatctgccataaagggagaggggcttttcgaaggtttggactggctcagtaacacactcaaatccggaagcagctaatgtaggagcctccttcaccatgaaccattgctggatggtaaacaatagagccggtggtgcccatttcctcgcaagacagcgtgaaaatccccactctctttgttttaactccagaagctccacaccaccgtcgattttctgtaaagtgcttgctaaagttttcatatactacattagatgtaccctcatattgagatgaagaataggtctgtagaagatgatgagcaaactgtgcccgtgtctttgcgtaaatcccgtggactgtgacatttttcttcaatgattaaacgcaccacatttctaccttgtcgatccaatgatgagacgcaccacatttgtaccttaaaaaaaaaaaaaaaaaaaa

SEQ ID NO: 2094 - protein, 182 aa, Panicum virgatum
  misc_feature: Ceres CLONE 1776322
  misc_feature: Great-hit functional homolog of the protein sequence given in SEQ ID NO 9385
  misc_feature (1)..(174): Pfam Name: Arf Pfam Description: ADP-ribosylation factor family
  misc_feature: Useful for making plants with modulated nitrogen use efficiency
MGIVFTRLFSSLFGNREARILVLGLDNAGKTTILYRLQMGEVVSTIPTIGFNVETVQYNNIKFQVWDLGGQTSIRPYWRCYFPNTQAIIYVVDSSDTDRLVTAKEEFHAILEEDELKGAVVLVYANKQDLPGALDDAAITESLELHKIKSRQWAIFKTSAIKGEGLFEGLDWLSNTLKSGSS

SEQ ID NO: 2095 - DNA, 2159 bp, Panicum virgatum
  misc_feature: Ceres CLONE 1776334
  misc_feature: Encodes the peptide sequence at SEQ ID NO. 2096
atccccgcattcgagtacttgtccacgcgaccaacgaagggggcagacaagtgcttcaggagcaagcaggcgactgagcgagcagcgccgagccgccgaaagatggcagggctggccgtggcggcgtccgcagcaacggtggcgtccttccagttccagccctcgctgtcggcatcgcgcttcgccccggttttagcacctgctgccagtttcagaacacaagcttgtggattgaggtgctggattgctgcaaagttgaagctccggaaggcattgaaaaggcatggatggcaacttcaaagaaacctagatgctcgaaggaatgatagaattcctgatcacttggaggctgcattgttgactgaaaacagaactcatcgaaacatacatcatgcttatgattctggaggtgaaatggccagtgcaagctctgatcttttgggtagttcaaccgtttcaaaaaattcattgcaacagggacccaatccatctgaaatccgttctcctgttcaagatgaagagtcttccatgtccaatggccattacgatggtgaaccatctctttgcattgctgtaattggagctactggtgaactggcaagaaataaagttttcccagcactatttgctctgtattacagtggttttcttcctcggaatgtgggtatatttgggtattctaggaagaaaataacagatgaagatttaagagctataattgaagccaattttacctgccgggttgatcaccatgaaaactgcgacgacaagttaaatgagttcctcaaaaggacgtattacatagatgccggacatgacaacaaagttgggatgtcaagattaaattctaagatggcacagatagagggtactcgtgcagcaaacagaatattctaccttgctgttccccaagagtcacttcttgatgtagcattgccactggctgacggtgcccaaactaagaaagggtggaataggataattattgagaaaccatttggctttactggtttgtcctcacaacgggtaacacaatctctactgtcaagatttgaggagaagcaaatctacagaattgatcaccttttggggaaggatctgatcgaaaatcttactgtcttgagattttctaatttggtgtttgaaccattgtggagcagaacttacatacggaatgtgcaggttattttttctgaagaaacagcaactgaaatacaagggaggtacttcggaaattatgggataattcgtgacatagttcacagtcacattcttcaaacaatagcgctatttgctatggaaccacctgtaagtcttgatggagaggacatccgagatgaaaaggtgaaggtgctcagatcaattcggaaagtggaccttgaggatgttgttcttggtcaactcaaggacacttctggtaaagttgacagatatacaaaatccatgacaccaacctattttgctgctgctatgtacattgacaatgcacggtgggatggggtaccatttttgatcaagacaggcattgggcttatgaagaatagagctgagattcgaattcagtttcgccatgtccctggtaatatctaccgtgaacgttttggccacgacatagatcttgacacaaatgagctggttctacgcgatcaacctgaagaagcgatcctgctgaaagttaacaacaaggtcccagggcttgggctccaactggatgcttcagaactcaacctgctttaccgggataagtacgacaccgaggttccagattcatatgagcatcttctcctggatgtgctagatggagacagtcatctattcatgcgcagcgacgaactagcggctgcatggaacgtgctgactccggtaatccatgagatcgatcagaacagagtggctcctgagctctacgaggctggagataaagggcctatcaatgcttactatctcgctgctaaacatggcgtgcgatgggatgacgactggtgagccaacccggcacagatgctcgatgtatgagatctacctccaatttttgttgttgtatcgtatcgcagtcaatgatgtaaatgccttatgttgtaaacggcctggtcaccgactttcgatgagaaatgcaaaactagcatctttcctggccgcaaaaaaaaaaaaaaaaaaaa

SEQ ID NO: 2096 - protein, 627 aa, Panicum virgatum
  misc_feature: Ceres CLONE 1776334
  misc_feature (1)..(288): Pfam Name: G6PD_C Pfam Description: Glucose-6-phosphate dehydrogenase, C-terminal domain
  misc_feature (136)..(625): SWISSPROT Homolog: EC 1.1.1.49 Glucose-6-phosphate 1-dehydrogenase, chloroplast precursor
  misc_feature (63)..(626): SWISSPROT Homolog: EC 1.1.1.49 Glucose-6-phosphate 1-dehydrogenase 4, chloroplast precursor
MAGLAVAASAATVASFQFQPSLSASRFAPVLAPAASFRTQACGLRCWIAAKLKLRKALKRHGWQLQRNLDARRNDRIPDHLEAALLTENRTHRNIHHAYDSGGEMASASSDLLGSSTVSKNSLQQGPNPSEIRSPVQDEESSMSNGHYDGEPSLCIAVIGATGELARNKVFPALFALYYSGFLPRNVGIFGYSRKKITDEDLRAIIEANFTCRVDHHENCDDKLNEFLKRTYYIDAGHDNKVGMSRLNSKMAQIEGTRAANRIFYLAVPQESLLDVALPLADGAQTKKGWNRIIIEKPFGFTGLSSQRVTQSLLSRFEEKQIYRIDHLLGKDLIENLTVLRFSNLVFEPLWSRTYIRNVQVIFSEETATEIQGRYFGNYGIIRDIVHSHILQTIALFAMEPPVSLDGEDIRDEKVKVLRSIRKVDLEDVVLGQLKDTSGKVDRYTKSMTPTYFAAAMYIDNARWDGVPFLIKTGIGLMKNRAEIRIQFRHVPGNIYRERFGHDIDLDTNELVLRDQPEEAILLKVNNKVPGLGLQLDASELNLLYRDKYDTEVPDSYEHLLLDVLDGDSHLFMRSDELAAAWNVLTPVIHEIDQNRVAPELYEAGDKGPINAYYLAAKHGVRWDDDW

SEQ ID NO: 2097 - DNA, 1797 bp, Panicum virgatum
  misc_feature: Ceres CLONE 1776335
  misc_feature: Encodes the peptide sequence at SEQ ID NO. 2098
aaaaaaaatatccgcaggagccgccagcgtcccacatcaggctctaagctctgaaggtgcagctcaaggactccgtctccgtgcagtcgtagatagcacgaccagcgcagacacggtggccgcgactgcctccatggccgctgcggctgctcctccccgtcctcgtgtcatggtgctgcccttccctgcgcagggccatgtcatgccgctcatggagctgtcccgccgcctcgtcgaccatggcttcgaggtcgacttcgtgaacacagagtacaaccaagcccgcgtcctcgcggccttggagacagcgggaggagagaccggagctgctgtccatgccgggatccatttggtctccatcccggacggcatgggtgctgactgcgaccgcaccgacgtcgttaagctgggccagggcttgccggcggcgatgcttagccgcctcgaggagctgatcagagctaggaacactcgatgggtggtggccgacgtctccatgagctgggtgctggatctggtcgccacggtgagcgtgcgcgtcgccttgttcttgacctattccgctgccatcttcgcgctgagggcgcacgttcccaagctgatagaggatggcatcgttgacgaaaatgggaatgtgaagaggaatgagaggatccagctgagccccaagatgccggccatcacagcagccgagctcccatggactggtgttggtactagccctgaggcacgaagagcagtaatacagggcgcgatcaagtacaccccatacacgctcgctgacaccatcctctgcaacacgtttcaagagatcgagtccgaagcgctggccctcctccccaaggagccactggccatcggtccccttgtggcatccaagccgacgtcagccggccatttctggcctcaagacctgacctcccttgcctggctagacgcgcaggcccccagctcagttgtctatgtggcattcggaagctttacagtcttcgacactacaaggctccaggagcttgccgacgggctggtgctcaccggacggcagttcctgtgggtgatccggccgaacttcaccaatggtgtcgatgaaggctggctggacgagttcagatgccgtgttggaggcaaggggctggttgtcggctgggctccccagcagcgcgtgctctcgcacccctcggtggcatgcttcatctcgcactgtggatggaactcgaccatggaaggggtgtgtcatggtgtcccgttcctgtgctggccatacttcgctgaccagttcttgaaccagagctacatctgcgacatgtggggtaccggcttgaggatctgcacagacgaacaggggatcgtcaccaaggaggagatcagggacaaggtcgcccggctgcttggagatgaggggatcaaggcgagggcgttgtccttgaagagcaaggcgtgcatgagcatcgcagatggagggccctcaaatcaggatctgctcgagtttgtgaacctgctgagtgcctgagagagcaataatctttagttcgtcagatctttcttttctcgttcagaggtcagttggctggataaacagtattgcaagtcgcactcgaagttggatagaaagccatagagtgtaatgaaatactacaagacaactagattagaatctatgtcagtgtcactagacagcaaatgccaaatgcaatttgtcctcgtggtgttttggtcgctgctatgggccatgtactgaaggtgatacctggcagcatcttaagaaattgtttttttcaaaaaaaaaaaaaaaaaaaa

SEQ ID NO: 2098 - protein, 458 aa, Panicum virgatum
  misc_feature: Ceres CLONE 1776335
  misc_feature (2)..(160): Pfam Name: UDPGT Pfam Description: UDP-glucoronosyl and UDP-glucosyl transferase
MAAAAAPPRPRVMVLPFPAQGHVMPLMELSRRLVDHGFEVDFVNTEYNQARVLAALETAGGETGAAVHAGIHLVSIPDGMGADCDRTDVVKLGQGLPAAMLSRLEELIRARNTRWVVADVSMSWVLDLVATVSVRVALFLTYSAAIFALRAHVPKLIEDGIVDENGNVKRNERIQLSPKMPAITAAELPWTGVGTSPEARRAVIQGAIKYTPYTLADTILCNTFQEIESEALALLPKEPLAIGPLVASKPTSAGHFWPQDLTSLAWLDAQAPSSVVYVAFGSFTVFDTTRLQELADGLVLTGRQFLWVIRPNFTNGVDEGWLDEFRCRVGGKGLVVGWAPQQRVLSHPSVACFISHCGWNSTMEGVCHGVPFLCWPYFADQFLNQSYICDMWGTGLRICTDEQGIVTKEEIRDKVARLLGDEGIKARALSLKSKACMSIADGGPSNQDLLEFVNLLSA

SEQ ID NO: 2099 - DNA, 1543 bp, Panicum virgatum
  misc_feature: Ceres CLONE 1776336
  misc_feature: Encodes the peptide sequence at SEQ ID NO. 2100
atcgagaagttctccgttgcacctgtccacccacttcctcgtaaggacggagggaagaaacgagaccgcaactccgcgcgagcaagagccaccacccacctcacgttgcggccaccacctccagtcctccacccgcctgggcacccccggaataggcagcagccgcagccagccggccattggggaggctcatgcggcgggggcagggggaagggtagaatgggcaacgtcacgtcgtcggtggcggcgcggctggccttcttccctccggagccgccgacgtacggcgtcgagcccgcccaggacggcgccggcgccggcgggctgctgcggatgacgggggtgtcgtcggacgcgggcgtcgaggtgcgcgcgctgcccaccagggccggcacgcgcgtcgtctcggccttctggcgccacccctccgcgcgcctcacgctgctctactcccacggcaacgccgcggacctcgggcagatgctcgggctcttcctcgagctccgcgcacacctccgcgtcaacatcatgagctatgattactcgggctatggtgcttctacaggaaaaccatcagagtacaacacatactatgatatagaggctgtttatgattgcttgaaaaaggagtatgggatagaagaagaggaattaatcctgtatgggcaatcagttggaagtggaccaacattgcatttggcctcacgtttggaaaagttaagaggggttgtccttcacagcggtatactctctggcatacgggttctctatccagtgaaagtcacactttggtttgatatcttcaagaacattgacaaaataaagcaggtcgactgccctgtgttagtcatacatgggacagctgatgacatcgtcgacttcgcccatggcaagcggctgtgggagctagcaaaggagaagtacgagcccctatgggtgaaaggcgggggtcactgcaacctggaaacttaccccgaatacatcaggcacttgcgcaagttcataaacgcgatggagaagctggcgaaagataaagcacccaagacatcccaggtgccgccttcgtcgagcatggccgacggaaaacacaagtgcttgagattcgggaagaagtgagtcgacactaccgcaggctgtcaactgaactaaccatgtcgctgcctggtcatgttcatacatgcaagcggaagcaatggcaggagggaggtcatcagccaagtggcagggactcctttatttcttgcattggtgactctgaccatgcacccctggaaatcgcaatgcggcaaccctagcttgtgatccgtgtgagttgaggttattgttaggcagatggatcgacccgtggctgcagcagtgtgctggctggagagatgcctttgtttttctactgggcgccacaaaattagcctgttcctaggtcatgttttcttttcttttctttggtttttcctacttgtattgtagtcatcgtgcgaaagaattcgttctaattattacttgttgacttgaaagtttgcaacgaaaaaaaaaaaaaaaaaaa

SEQ ID NO: 2100 - protein, 298 aa, Panicum virgatum
  misc_feature: Ceres CLONE 1776336
  misc_feature (3)..(204): Pfam Name: Abhydrolase_2 Pfam Description: Phospholipase/Carboxylesterase
  misc_feature (1)..(97): Pfam Name: Abhydrolase_1 Pfam Description: alpha/beta hydrolase fold
MGNVTSSVAARLAFFPPEPPTYGVEPAQDGAGAGGLLRMTGVSSDAGVEVRALPTRAGTRVVSAFWRHPSARLTLLYSHGNAADLGQMLGLFLELRAHLRVNIMSYDYSGYGASTGKPSEYNTYYDIEAVYDCLKKEYGIEEEELILYGQSVGSGPTLHLASRLEKLRGVVLHSGILSGIRVLYPVKVTLWFDIFKNIDKIKQVDCPVLVIHGTADDIVDFAHGKRLWELAKEKYEPLWVKGGGHCNLETYPEYIRHLRKFINAMEKLAKDKAPKTSQVPPSSSMADGKHKCLRFGKK

SEQ ID NO: 2101 - DNA, 1615 bp, Panicum virgatum
  misc_feature: Ceres CLONE 1776346
  misc_feature: Encodes the peptide sequence at SEQ ID NO. 2102
agatcctctccccctcagcatcatcccctgccatctcaacatcccactgttcggttgccgtgaagcagccatgccagcgcttctcgtgaacaccaccatatcggtctcccccgccagcccatggctactctcctcgcggcccaccacgacacggcgagctagcagtggcactagcagtcgccacaggtgccgagcccaggcatccggcagcggcaccaaaggcgacggctacaagccggggggcgtccgcgggtcgtgggtctccgactacgacctgtacgagctgctgggcgtggagcgctcctcgccgcagtcggagatcaaggcggcgtaccggtcgctgcagaagcggtgccacccggacgtggccggcgccgccgagggccacgacatggccatcgtcctcaacgaggtctacgcgctgctctccgacccggccgcgcgcctcgcctacgaccaggagcaggcgcgccgctccgagttcgccggctacacgggccgcccgctctactcgtcctggctcggcgccgaggccgagcgccgcgcggtcttcgtcgacgaggtgcgctgcgtcggctgcctcaagtgcgcgctccacgcgtccaggaccttcgccgtcgagtccgtctacggccgcgcccgcgtcgtcgcgcagtgggccgacgacgaggacaagatcatcgacgccatcagcacgtgccccgtcgactgcatctcgatggttgagaggtcggacctggcggctctcgagttcctcatgtccaagcagccgcgcggcagagtccgcgtctccgaaggcaacgccgtgggagctcgcgcgccaaacatcttcaacgagatctccaagttccagaaaagattcgaggagatgaagcacacatccgcaacaagagaatcccaggagtcagagacagtcaagcaatccaggacttcagccgtgcacaccatcagatccatgtcaaaccggtggtactggcgcccattcgggtcatcggcgccggccaccatcgtcctcgcttcgcgcctcctgccgctgccgtcggcggcatcttcttctaaagccgctgaccccgtggcggacagactcgaagaagctgtcgccgcccggcgtaaaacggaaggcgcggcgaccgcagccgcggcgcacgcccaccgcgacgactactggacgccgcagctgaacctgccatcgtctgcctctccaccaatcattcaccagaggggaagggacgctccgcaagggcacagccgcaggcgacgagttgctgccggtgaagcgaccgccgggccagcgacgaagggtgcaagcatcgacctgacggcgccgttgctgctgggcatcacctcggcggggtttgtgggttacaacggcgaggagatggccggaagcggcagcggcggcattcaggagcactttggaggcgccattgctcttggaatcgtgaacagcttcgaaatgaaggtcatgttggccggggtgacctggttcatcatcggcgctgctattgccggtgtgatccaggtgcttggaagaagacaagaggacatctgaaagtaaacgagcaatgagcatgctcgaaacgaatgaattcatgaaaaaaaaaaaaaaaaaaaa

SEQ ID NO: 2102 - protein, 493 aa, Panicum virgatum
  misc_feature: Ceres CLONE 1776346
  misc_feature (1)..(61): Pfam Name: DnaJ Pfam Description: DnaJ domain
MPALLVNTTISVSPASPWLLSSRPTTTRRASSGTSSRHRCRAQASGSGTKGDGYKPGGVRGSWVSDYDLYELLGVERSSPQSEIKAAYRSLQKRCHPDVAGAAEGHDMAIVLNEVYALLSDPAARLAYDQEQARRSEFAGYTGRPLYSSWLGAEAERRAVFVDEVRCVGCLKCALHASRTFAVESVYGRARVVAQWADDEDKIIDAISTCPVDCISMVERSDLAALEFLMSKQPRGRVRVSEGNAVGARAPNIFNEISKFQKRFEEMKHTSATRESQESETVKQSRTSAVHTIRSMSNRWYWRPFGSSAPATIVLASRLLPLPSAASSSKAADPVADRLEEAVAARRKTEGAATAAAAHAHRDDYWTPQLNLPSSASPPIIHQRGRDAPQGHSRRRRVAAGEATAGPATKGASIDLTAPLLLGITSAGFVGYNGEEMAGSGSGGIQEHFGGAIALGIVNSFEMKVMLAGVTWFIIGAAIAGVIQVLGRRQEDI

SEQ ID NO: 2103 - DNA, 1788 bp, Panicum virgatum
  misc_feature: Ceres CLONE 1776350
  misc_feature: Encodes the peptide sequence at SEQ ID NO. 2104
gagacggggcacgcgggggcggggggctcggctagtgcatttgcttggcaacaccaaccaactggtcaggcagtccagttgcggcacctcgtgcgccgccgcgccaactgacaagggagagtgcgacgtgcggctcgaagcgcggcgcggcgcgccaagctcgccggctcctagggttcgggaatggctgcggcggcgggggcggacggaggagagggggaggagctcctcctgctctcggccgtggaggctggtaacggcggcggcggcgcgcccgccgcggtgggggagtcgtggcggctcaacttcgaggggttccgcccgccggaggggcaccagcaggacaggccgccggccggcgcgctccaccactgcctcggcgtcctagctcaaggtcctgaggatgttgttgctgagtactaccaacaacaagtagagatgctggagggttttaatgagatggatacgcttacagaccatggtttccttcctgaaatgtccaaggaagagcgtgaaaaggttgctaggagtgagacattagcaatacggctgtctaacattgcaaacatgatcctttttgctgcaaaagtgtatgcttcagtacgcagtggctcacttgctattattgcttcaacattggattctcttctagatttactgtcagggtttatcttgtggtttactgccttttcaatgcaaactccaaacccctacagatacccaattggtaaaaagcgcatgcagccactgggaatacttgtttttgcttctgttatggcaactcttggcctccagatcattctggaatcaatgcgctcactggtgtctgataaagatgaattcagcttaacaagcgagcaggaaaagtgggttgtggacatcatgctctcggtgacattagtgaaacttgccctggtgatatattgccgctcgttcaccaacgaaattgtcaaggcatatgctcaggatcacttttttgatgtcatcaccaatgtcattggtctggttgctgcactacttgcgaattatattgaaggctggattgatccagttggtgcaataattcttgcaatctacacaatcagaacatggtcgatgacggtgctggagaacgtgcactccctggtggggcagtcggcctcgccagagtacctccagaagctgacgtacctgtgctggaaccaccacaaggccgtgcggcacatcgacacggtgcgcgcctacacgtttggctcccactacttcgtggaggtggacatcgtgctgccgtcagacatgccactgcgggaggcgcacgacatcggtgaggccctgcaggagaagctggagcggctgccagagatcgagcgcgccttcgtgcaccttgactacgagttcacccaccggcccgagcacgcgctgtcccacgagaagtagcctgcaagtgtcgagcgggcgcaagaggtggaaggactcatagggttcattgctgaaaccatttatgagtagccgcaggaagcaaagcaagtttcagagacctggtgctcgtctcgtcagccgtcgttataaaccattggggtacgtacgatgggagctgtgcattctagagtgcctgcagcggcgatgccctggtagactgcagtatcatttttagtagaagatgagggcctcttttgtaccggtcttcagctcttttgctgtgttatctggttgcctgagggccgataactgagctgtgtatttctgattttctggaagatcatgtatacatacagcatcactttagtcgaaaaaaaaaaaaaaaaaaaa

SEQ ID NO: 2104 - protein, 410 aa, Panicum virgatum
  misc_feature: Ceres CLONE 1776350
  misc_feature (1)..(281): Pfam Name: Cation_efflux Pfam Description: Cation efflux family
MAAAAGADGGEGEELLLLSAVEAGNGGGGAPAAVGESWRLNFEGFRPPEGHQQDRPPAGALHHCLGVLAQGPEDVVAEYYQQQVEMLEGFNEMDTLTDHGFLPEMSKEEREKVARSETLAIRLSNIANMILFAAKVYASVRSGSLAIIASTLDSLLDLLSGFILWFTAFSMQTPNPYRYPIGKKRMQPLGILVFASVMATLGLQIILESMRSLVSDKDEFSLTSEQEKWVVDIMLSVTLVKLALVIYCRSFTNEIVKAYAQDHFFDVITNVIGLVAALLANYIEGWIDPVGAIILAIYTIRTWSMTVLENVHSLVGQSASPEYLQKLTYLCWNHHKAVRHIDTVRAYTFGSHYFVEVDIVLPSDMPLREAHDIGEALQEKLERLPEIERAFVHLDYEFTHRPEHALSHEK

SEQ ID NO: 2105 - DNA, 1788 bp, Panicum virgatum
  misc_feature: Ceres CLONE 1776355
  misc_feature: Encodes the peptide sequence at SEQ ID NO. 2106
gttttcctccccatctgccatttccctctcttctctccccgtgacccatcgagttcacccgccaccaccggaggagcggcggcggcggcggagggagaggtattgacggcagcgacacaagatggcgaggaagccgctggactacgatcagctgaacgagaatgtcaagaaggtgcagtacgcggtgcgcggggagctctacctccgcgcctccgagctccagaaggagggcaagaagatcatcttcaccaacgtcggcaacccgcacgccctcggacagaagccgctcaccttcccccgccaggtggtggctctctgtcaggctccgttcctgctcgatgatcccaacgtcggcctcttgttcccggcggatgccatcgcgcgggccaagcactacctctccctggctcccggcggtttaggtgcttacagtgattcccgtggtatccctggaattaggaaggaggttgctgacttcatccagaggcgtgatggatatccgagtgatccagaactcatttacttgacagatggtgctagcaaaggtgtgatgcagatgttgaatgccattatcagaaacgagagagatgggattttggtccctgttcctcaatacccactttattctgctgccatttccctctttggtggctccctggtcccgtactacttggaagaagaggctaactggggccttgactttgtcagtatccgacagacagtggcggaggcacggtcaaagggaatcactgttcgagcaatggtgatcatcaatccgggaaatcccactggccaatgccttagtgaagcaaatataaaggaacttctgcaattttgctaccatgaaaacttagctctgcttgcagatgaagtgtatcaacagaacatttatcaagatgagcgcccgtttataagcgcaagaaaggttttgtttgacatgggtccaccactaagcagggaagttcagcttgtttctttccacactgtgtccaaggggttctggggagaatgtggacaacgtggtggatactttgaaatgacaaatcttcccccaaagacagtagacgagatctacaaggttgcatcaatagcactgagcccgaatgttcctgggcaaatttttatgggagtgatggttaaccctccaaaacctggtgatatctcttacctgaagtttgctgctgaaagcaagtccatcctagagtctatgaggaggagagcacgcatgatgacagatggtttcaacagttgccgaaatgtcgtgtgtaatttcacagaaggagctatgtactctttcccccaaatacgcctgccaccaagagcgattgaggcagcgaaaagagccggcaaagtaccagatgttttctactgcctcaagcttctggaagcaaccggaatttccactgttccgggttctggttttggtcagaaggaaggggtgttccacctccggacaactatccttcctgctgaggaagacttccctgccatcatgtcgagcttcaagaagttcaacgactcattcatggagcaatacgagagctactccaggatgtgaagaggaacatagtgcataataaaaggaagcatcggctgtcagattcttggtttcagtctgaaccgtgatcgagcatttccaaggacattattaattgaaagttaattagttgtaactctcttaaagaaacaatttctgcctttgatatgtatagggaaccaaagttttgcgggaaatatatccgctatttactggtaccatcgtatatataaaaaaaaaaaaaaaaaaaa

SEQ ID NO: 2106 - protein, 478 aa, Panicum virgatum
  misc_feature: Ceres CLONE 1776355
  misc_feature: Great-hit functional homolog of the protein sequence encoded by LOCUS At1g23310
  misc_feature: Great-hit functional homolog of the protein sequence given in SEQ ID NO 9239
  misc_feature (1)..(358): Pfam Name: Aminotran_1_2 Pfam Description: Aminotransferase class I and II
  misc_feature (9)..(472): SWISSPROT Homolog: EC 2.6.1.2 Alanine aminotransferase 2
  misc_feature: Useful for making plants with modulated nitrogen use efficiency
MARKPLDYDQLNENVKKVQYAVRGELYLRASELQKEGKKIIFTNVGNPHALGQKPLTFPRQVVALCQAPFLLDDPNVGLLFPADAIARAKHYLSLAPGGLGAYSDSRGIPGIRKEVADFIQRRDGYPSDPELIYLTDGASKGVMQMLNAIIRNERDGILVPVPQYPLYSAAISLFGGSLVPYYLEEEANWGLDFVSIRQTVAEARSKGITVRAMVIINPGNPTGQCLSEANIKELLQFCYHENLALLADEVYQQNIYQDERPFISARKVLFDMGPPLSREVQLVSFHTVSKGFWGECGQRGGYFEMTNLPPKTVDEIYKVASIALSPNVPGQIFMGVMVNPPKPGDISYLKFAAESKSILESMRRRARMMTDGFNSCRNVVCNFTEGAMYSFPQIRLPPRAIEAAKRAGKVPDVFYCLKLLEATGISTVPGSGFGQKEGVFHLRTTILPAEEDFPAIMSSFKKFNDSFMEQYESYSRM

SEQ ID NO: 2107 - DNA, 1946 bp, Panicum virgatum
  misc_feature: Ceres CLONE 1776366
  misc_feature: Encodes the peptide sequence at SEQ ID NO. 2108
aaaaagggaggaagaagaattggcgcaagaaaccaaaccgcgccacccgcccgcctccaaccgcgcttaaatgcgcgccctttcttcttccccggaggcccggagttaaaccctcgcggacgcctccgtcccccgctattacaaaagggaagctccccctgcgcctcagctggtagtttgctagctagctgagtttcctgagcccgagcgcgcgcggccgcccgccgtcgtcggttgcgctttgccgccggtcgcccgccgaggtcgatcgggagctagctagctagccggccggggagcaatgcacattgccacctgcgtgtggcaggagaaggcggcggcggcggcgggcatggggggaggaggcggcggcatcggtggtggttggaagaagaagaagcgggagtgggcgtcggtggcggcggcggcggggggcgcgctcaactgcgcggtgagcttcgtggtgttctcggcgctggacgtgctggacgtggtgctgtgcctggtgtacaagctggtggactacgccgtggaggcggagtggaaggcgtgctactgcacggcggcggcggcgcgcggggacgccggcggcccgcggatcctcgcgccgccggggcccaaggtggtgcggctgtcggcgtcgtcgtccaagatgcagctggaggacgtgtccgacacgctgtacgtgcgcccctcgctgctggccgacgccaccaagaaggccggccccgcgccgcccgcgctcaccgtcagccccgccatcgccgagatgatccgcggcaagatcgaccgcccgccgcgcccgcccccgccggcgccgtgctggtccgactgcgactgcaaggtctgccacgcctggagcgccgcgccgcgctccgcgtcgctcctctacgtccacgtccaggcgccgccgccgccggccgaggcggccgaggacgtggtgttcatccacgggttcatctcgtcgtcggtgttctggacggagacggtgttcccggcgttcagcgcggcggcgcgcggccggtaccggatgttcgcggtggacctcctcgggttcgggcgcagccccaagccggcggagtcgctctacacgctgcgggagcacgtggagatgatcgagcgctccgtgctccagcgcttccgcctcggctccttccacgtcgtcgcccactccctcggctccgtcctcgccctcgccctcgccgtcaagtaccccgccgccgtcaagtcgctcaccctcctcgcgccgccctacttcccggtgccggagtcggaggccggcgcggcgacgcagtacgtgatgcggcgggtggcgccgcggcgagtgtggccgccgatcgcgttcgggacgtccatggcgtgctggtacgagcacgtgagccgcaccatctgcctcaccatctgccggcaccaccgcgtctgggaccggctcttcaggatcctcaccaggaacagggtccggacgttcctgatcgaggcgttcatgtgccacacccacaacgcggcgtggcacaccctgcacaacatcatctgcggcagcgcggcccggatggacgcgtacctggacgtcctggcgtcgcagctgtcgtgcaaggtggccgtcttccacggccgcgacgacgagctgctccccgtcgagtgcgcgctggccgtcggcgcccgcgtgccgcgcgcccgcgtcaccgtctacgaccgcaaggaccacatcaccatcatcgtcggccaggaggaccgcttcgccgccgagctcgaggccatctggaggagcgccgccgccgactagctggctgcggctggtggttgactgatcgcccgacaacagggcacagaggtggagacgaccctgcctgcaagatttcatggcctgtcaagaagatgcaataacgtcgatgctaattccctgcagtctgcagattgcaatgcagcaaaaaaaaaaaaaaaaaaaa

SEQ ID NO: 2108 - protein, 493 aa, Panicum virgatum
  misc_feature: Ceres CLONE 1776366
  misc_feature (1)..(243): Pfam Name: Abhydrolase_1 Pfam Description: alpha/beta hydrolase fold
MHIATCVWQEKAAAAAGMGGGGGGIGGGWKKKKREWASVAAAAGGALNCAVSFVVFSALDVLDVVLCLVYKLVDYAVEAEWKACYCTAAAARGDAGGPRILAPPGPKVVRLSASSSKMQLEDVSDTLYVRPSLLADATKKAGPAPPALTVSPAIAEMIRGKIDRPPRPPPPAPCWSDCDCKVCHAWSAAPRSASLLYVHVQAPPPPAEAAEDVVFIHGFISSSVFWTETVFPAFSAAARGRYRMFAVDLLGFGRSPKPAESLYTLREHVEMIERSVLQRFRLGSFHVVAHSLGSVLALALAVKYPAAVKSLTLLAPPYFPVPESEAGAATQYVMRRVAPRRVWPPIAFGTSMACWYEHVSRTICLTICRHHRVWDRLFRILTRNRVRTFLIEAFMCHTHNAAWHTLHNIICGSAARMDAYLDVLASQLSCKVAVFHGRDDELLPVECALAVGARVPRARVTVYDRKDHITIIVGQEDRFAAELEAIWRSAAAD

SEQ ID NO: 2109 - DNA, 1600 bp, Panicum virgatum
  misc_feature: Ceres CLONE 1776405
  misc_feature: Encodes the peptide sequence at SEQ ID NO. 2110
aggagcctgccagtggcggcccagcgttgctcacgcccacgcctccggctccggttctcaagctctcccacgccatcgccgcctaaaccttccccaccgcccccacgcgcctctctcctcgccgccggtcgccggcgagtagcaggatacccgatggtttctccttatcaactgagcttctattaactggggagagtatataagcagtgtgaggagcaaggtgaagcagggaggtgggtatggcggaggaggtgcatctaggtctgcctggtccctgggcggcggactaccgggagaaggccgaccactacaccactaagatcggtggagtccccgattggccagctggtgatatgggcattaagcctgaaatgcttcagtgcagcttatgtggagccaagctttgtctcgttgctcaggtatatgcacctgtggtgaagctaaacattgaggagagggtaatctatgtgcttgtttgcccgacaccagaatgtgggcctaaacctcaaagttggaaggtcctaagagttcaaaaatgccgtaatattgagaaaacagcaggtggcaacgatgaattaggtcaagcaactggaccttcttctacaagtgtcccagaagaacagattgataaaaataagagtcctgatatcaacgatgatgatttcgatctagatgcattggctgaagcacttgagcaagctgcgacattggcatctaactcgaagaagaagaataaatcaaagcgtgctaatgcccctataaaacgccctgtattaaagaaaacagatgatctgagcataccagttcttccttgtttttacatatattatgataaggaacaataccggggaaaaggtactatgggttcaagtagcaatgagttggttttggacaaagaaataacagatgcaacaaatgatgaagaagaaaaatgggaaggagaaaagtatgagtatgataaagctattggtgccgacagaactttcttaaaattcaagaagcggttggatgcatatcctgagcaatgctttaggtattcttatggtggcaagccattgttggctgcaacaaagttacaagatgctggcacttgtaggttgtgtggctcaccacgccagtatgaattgcaactgatgtctccattatcatattttctccatgaagctagtgatggttccacaaattatgcacccagcagctggacttggctgactcttatcatctacacttgctcaaagagctgctgcccgtcgtcatgtggtggaaagccttgcaggtgttgcgggggtgtagctgaggaggagataatgattcaggaggatgaagctgtctagcaactgatctgttgattcctggtaactgttgaggaggtcatgatccaggaggatgaagtcctatctgatctaatctgctgagaaacaccgatcctggtttgagtgtgtgatacacggttcctgttgccgttttccattgttagagttataatttgtaaagctatctgcaattttgtgctacttttgtgtagatccttttgttgcactatatagtatcctgcaaagtgtcaaaaaccatttacgatcaaaaaaaaaaaaaaaaaaaa

SEQ ID NO: 2110 - protein, 364 aa, Panicum virgatum
  misc_feature: Ceres CLONE 1776405
  misc_feature (2)..(177): Pfam Name: PDCD2_C Pfam Description: Programmed cell death protein 2, C-terminal putative domain
MAEEVHLGLPGPWAADYREKADHYTTKIGGVPDWPAGDMGIKPEMLQCSLCGAKLCLVAQVYAPVVKLNIEERVIYVLVCPTPECGPKPQSWKVLRVQKCRNIEKTAGGNDELGQATGPSSTSVPEEQIDKNKSPDINDDDFDLDALAEALEQAATLASNSKKKNKSKRANAPIKRPVLKKTDDLSIPVLPCFYIYYDKEQYRGKGTMGSSSNELVLDKEITDATNDEEEKWEGEKYEYDKAIGADRTFLKFKKRLDAYPEQCFRYSYGGKPLLAATKLQDAGTCRLCGSPRQYELQLMSPLSYFLHEASDGSTNYAPSSWTWLTLIIYTCSKSCCPSSCGGKPCRCCGGVAEEEIMIQEDEAV

SEQ ID NO: 2111 - DNA, 1584 bp, Panicum virgatum
  misc_feature: Ceres CLONE 1776411
  misc_feature: Encodes the peptide sequence at SEQ ID NO. 2112
attccattctccctcctctttctcttgaagtcccacccataaggcttggagggaagaagagaaagcttagcccagaacaaaggccggcaagcaaaaatggcgatctgcagcacgcacaccaccacctccctgcactccccatgcacaacagtctcaaacgcaggcttcaggcagaagcaagtcatcttcttcaccagcaacaggagaagcggcagaaggcatggaggggcaagaacctttcaggtttcatgctccgtcgagaagccagtggtgatcggcctggcggcagactcaggatgcgggaagagtaccttcatgcgccgtctcaccagtgtgtttggtggtgctgcagagccacccaagggtggcaacccggactccaacaccctcatcagtgacaccacgacagtgatatgccttgatgactaccactccttggacagaaccgggagaaaggagaagggtgtgaccgccctcgacccaagggccaacaactttgatctcatgtatgagcaggtgaaggcaatcaaagaaggccagacaattgagaagccgatctacaaccatgtcactggcctcctcgacccaccggaggttatcaagcccccaaagatttttgtcattgagggcttgcacccaatgtttgatgagcgtgtgagagacctcctagacttcagtatctacttggacatcagcgatgaggttaagtttgcatggaaaattcagcgggacatggcagagcgcgggcacagccttgaaagcatccaggctagtatcgaagctaggaaaccagattttgatgccttcattgatccgcagaagcaatatgctgatgctgtgattgaagttctgccgacacagttgattcccgatgacaatgaaggaaaggtgctgcgtgttaaattgatcatgaaagaaggcgtgaagcacttcaacccagtttacctcttcgatgagggatcaagtatcagctgggtgccttgcggaagaaagctcacatgctcttaccctggcatcaaatttgcctatggcccagacacttacttcggccacgaggtatcagtgttggagatggatgggcaattcgacagactagatgagctcatatatgtggagagccatctaagcaatctctcaactaaattctatggagaagtgacacagcaaatgctaaagcatgcagatttcccaggaagcaacaacggaacagatctcttccagaccatcgttggactgaagattagagatctctatgagcagatagttgccgaaagggctggtgcaccagctgaaacagcaaaagtttaatgatctgcacattcagatttcctacacctcttcaaactcaatgagaacgagaatcctcgaaattcttgtaattagttcggatacatcacggctagaaggcggtagaaatgtcattgcagtactcaggaaaacatgcgatgaaatttctagaaatacctcgccatgggggtgctcttacatctcttctgcgcatgtttaaatgcatatcttcatccatgcttttatgcggaaagaaatacagctgcctgctactacgaaaaaaaaaaaaaaaaaaaa

SEQ ID NO: 2112 - protein, 403 aa, Panicum virgatum
  misc_feature: Ceres CLONE 1776411
  misc_feature: Great-hit functional homolog of the protein sequence given in SEQ ID NO 9495
  misc_feature (1)..(200): Pfam Name: PRK Pfam Description: Phosphoribulokinase / Uridine kinase family
  misc_feature (1)..(403): SWISSPROT Homolog: EC 2.7.1.19 Phosphoribulokinase, chloroplast precursor
  misc_feature (18)..(402): SWISSPROT Homolog: EC 2.7.1.19 Phosphoribulokinase, chloroplast precursor
  misc_feature: Useful for making plants with altered Lignin content
MAICSTHTTTSLHSPCTTVSNAGFRQKQVIFFTSNRRSGRRHGGARTFQVSCSVEKPVVIGLAADSGCGKSTFMRRLTSVFGGAAEPPKGGNPDSNTLISDTTTVICLDDYHSLDRTGRKEKGVTALDPRANNFDLMYEQVKAIKEGQTIEKPIYNHVTGLLDPPEVIKPPKIFVIEGLHPMFDERVRDLLDFSIYLDISDEVKFAWKIQRDMAERGHSLESIQASIEARKPDFDAFIDPQKQYADAVIEVLPTQLIPDDNEGKVLRVKLIMKEGVKHFNPVYLFDEGSSISWVPCGRKLTCSYPGIKFAYGPDTYFGHEVSVLEMDGQFDRLDELIYVESHLSNLSTKFYGEVTQQMLKHADFPGSNNGTDLFQTIVGLKIRDLYEQIVAERAGAPAETAKV

SEQ ID NO: 2113 - DNA, 1768 bp, Panicum virgatum
  misc_feature: Ceres CLONE 1776426
  misc_feature: Encodes the peptide sequence at SEQ ID NO. 2114
aaatccggcacgccacgtcgccacgggacggctcggttcggccccggcgtggcgccccaccccccgatggcgctcgcctccgccactaccgccgccgccgcggcctcctccccctcccgcctcttccgccgcttctcttcctccgcacctcctccctcgctcctccccctcgccgcgcgcccaggagccgggagctccccgcgcgcctgcagctaccaccagttcgtggtgcgatggaagggcagggcgcgggcgctcctcggggggttctcggacgccggcggcagcgagagcgacgacgatgaggaggacgccctgcgaaggggccagcgggagggagagggcgaggacgccgtcgagcccgccgcggcggccgccgggcctgagagatgggacgtgctcggcctcggccaggccatggttgatttctcagggatggtggacgatgagttcctcgagagattaggcatagagaagggcacgaggaaggttgtaaaccatgaggagagaggacaggtcttgcgcgccatggatgggtgcagctacaaggctgcagccggaggctccctgtccaactcacttgtggccctggccaggcttggaagtagccggtctgctgggtaccctgagcttaaaattgcgatggctggcagtgtgggcagtgacccactaggtagtttttacagggcgaaattgcgtcgtgctaatgtgcatttcttgtctaagccggtcaaagatgggactaccggaactatcattgttctaacaacaccagatgcgcagcgaactatgcttgcgtatcagggtacatcgtcaactctgagttatgattcagacttggccgatttagtgtccaaatcaaatgtactaattgtggaaggttatctgtttgagctacctcacacaattgaagctatcaagcaagcgtgtgaagatgctcacaagaatggtgcactcattgctgttacagcatcagatgtatcttgcatcaagcgttgctacaacgattttcgggatattgtaggaaactatgctgacatactgttcgccaatgccaacgaagcaagggcgttctgcaagctaccctcaacagacagccccatgtcagccacaagatacttaagccactctgttcccctagtatctgtgaccgacggcgtgcacggctcctacattggggtgaaaggtgaagcaatatacatccctccaccaccctgcatacctgtggacacctgtggcgccggcgatgcatacacttctgggattctgtatggcatcctccggggtgcttcagacctgaaaggcatcggcttgctggcctcgcaggtggctgctgttgtcgtcgggcagcaaggcacacgcctacgggttcaggacgctgatagactggctgaatgtttcgctcatcacctggatagcttggagttctgttcagatgtttgaatatgacgttgcaaacatctgattgtttctggtttagtccaaaccctagacatctatatgtacatacaatcacttccctttttagtaggtctagtacatttgttcaatgcaggcagccgagctgaagctgggaaaggcctgtcagcccatttggtatcccttaccatcattgcccataattggaattaaacagatttcattggacattgaaaatacagtagtatagttgatgtctttttttcgttcaaagggattagatgaatgctatgttgacttttaggtcagtaaacaagaatatgcattccaaaaaaaaaaaaaaaaaaaa

SEQ ID NO: 2114 - protein, 458 aa, Panicum virgatum
  misc_feature: Ceres CLONE 1776426
  misc_feature (1)..(251): Pfam Name: PfkB Pfam Description: pfkB family carbohydrate kinase
MALASATTAAAAASSPSRLFRRFSSSAPPPSLLPLAARPGAGSSPRACSYHQFVVRWKGRARALLGGFSDAGGSESDDDEEDALRRGQREGEGEDAVEPAAAAAGPERWDVLGLGQAMVDFSGMVDDEFLERLGIEKGTRKVVNHEERGQVLRAMDGCSYKAAAGGSLSNSLVALARLGSSRSAGYPELKIAMAGSVGSDPLGSFYRAKLRRANVHFLSKPVKDGTTGTIIVLTTPDAQRTMLAYQGTSSTLSYDSDLADLVSKSNVLIVEGYLFELPHTIEAIKQACEDAHKNGALIAVTASDVSCIKRCYNDFRDIVGNYADILFANANEARAFCKLPSTDSPMSATRYLSHSVPLVSVTDGVHGSYIGVKGEAIYIPPPPCIPVDTCGAGDAYTSGILYGILRGASDLKGIGLLASQVAAVVVGQQGTRLRVQDADRLAECFAHHLDSLEFCSDV

SEQ ID NO: 2115 - DNA, 1419 bp, Panicum virgatum
  misc_feature: Ceres CLONE 1776444
  misc_feature: Encodes the peptide sequence at SEQ ID NO. 2116
attaatttcctccgcttccgctccctttctccactaaataaacccccgaagagcaggagaggcgagcccgcggaggaggaagcctagggttaggttcaccgctcccccgtcgcctgggcgagtggcgagatggccgcccctggccccgctggcgccgccgcctcaccgtcgccgcagccgccacagctgccgtcgccgttcgcggagctcgtcaagagcccctccggcctcgagaaggtcgtgctccgcggctctcgcaactgctgcgtcgaggtctatctttatggaggtcaagtaacatcatggaagaatgacaacggggaagagttgctttttctcagcagcaaggctattttcaaacctccaaaagccattcgtggtggtatacccatctgctttccccaatttggaactcatggaaatcttgagcaacatgggtttgcaaggaaccggttttggaccattgacaacgacccacctcctttaccagcaaaccctgctattaaagcttatgttgatctgattctgaggccttctgaagaagatttaaagatctggcctcatagttttgagtttcgcttgagagttgctcttggaccttctggagatttgagtctcacatctcgaatcaggaataccaacactgatggaagacctttctcttacacattcgcataccacacatacttctctgtttctgacataagtgaggtgcgtgttgaagggctggaaacaatggactaccttgacaacttgaaggcaaaggagcgtttcacagagcaaggagatgctattgtttttgaatcgaagattgataaagtttatcttgccgcaccctcaaaaattgcaataattgatcatgagaagaaaaaaacatttgttgtgacaaaagaagggcttccagattctgttgtttggaacccttgggacaagaaggctaaagctatgcaagattttggggatgcagaatacaagaacatgttgtgtgtggaacctgcttctgttgagaagcctattactctgaagcctggtgaagagtggaaaggaagacttgccctctcagctgtcccttccagttactgtagtggacaattggatccattgaaggtgcttcagggctgagaaacctcattttctgcgtcttgtacaggagaacttcattgcccttcttatttgatgctgggctggcgtcaacgccgcttcgtcctttcgccattttcatcccccatatttctgtccttttttgtatctagaatttgagtggtaggttacttctgaataacagactatgccagctgctttgagcttataatgggatctcacctcgtcggtgagtgatatcggtggacacaatactggcatcagtgtcgtagtttcataaatcattgctgtgctgcgtaaaaaaaaaaaaaaaaaaaa

SEQ ID NO: 2116 - protein, 330 aa, Panicum virgatum
  misc_feature: Ceres CLONE 1776444
  misc_feature (1)..(277): Pfam Name: Aldose_epim Pfam Description: Aldose 1-epimerase
MAAPGPAGAAASPSPQPPQLPSPFAELVKSPSGLEKVVLRGSRNCCVEVYLYGGQVTSWKNDNGEELLFLSSKAIFKPPKAIRGGIPICFPQFGTHGNLEQHGFARNRFWTIDNDPPPLPANPAIKAYVDLILRPSEEDLKIWPHSFEFRLRVALGPSGDLSLTSRIRNTNTDGRPFSYTFAYHTYFSVSDISEVRVEGLETMDYLDNLKAKERFTEQGDAIVFESKIDKVYLAAPSKIAIIDHEKKKTFVVTKEGLPDSVVWNPWDKKAKAMQDFGDAEYKNMLCVEPASVEKPITLKPGEEWKGRLALSAVPSSYCSGQLDPLKVLQG

SEQ ID NO: 2117 - DNA, 1681 bp, Panicum virgatum
  misc_feature: Ceres CLONE 1776457
  misc_feature: Encodes the peptide sequence at SEQ ID NO. 2118
gctgagatcccgcgcgcccagcaccaaccgtccggttcctgctcccctccctccctccctcctctcggtcgttgccccgcccccggcttccgcacccgcgtgcgcgccgcctgccgcccccgccgccgggcgggctggggtttgactgccgcgccggccggcgcaggggaatatatagagtaaccatgagcacggacgtagtaggtgccgaggcacctcaagtcaaggggaggttccttggtatacttatctgctggcttttggggaatggaagccttttcgcgtggaacagtatgctcaccatcgaagattactacgtccatctcttcccggattaccacccaacaagaatcctcacactagcttaccagccttttgcctttggaataaccctcatcatgacatactatgaagcgaagatgaacacaagacggagaaatcttgcaggattttcccttttctttctcggttcttttgcattgatcattctggatattgccactaaaggacggggtgggcttggagtgttcgttggtgtatgcataatcagcgccatatttgggatagctgatgcgaattgtcaaggcgcattggttggtgacctatccttaatgtgcccagagttcgttcagtccttcatggcgggcttggctgcgtcaggggttctaacatcagccttgagattaatcactaaagcagcttttgagagctcaaaagatggtcttcgcattggagctatactgttcttttcaatcacttgcctgttcgagctgctgtgccttctcttatacacgttcgtcttcgccaaactacccatcgtgaagtactaccgctcgaaggccgcctccgaaggcagcaagactgttgctagcgacctggctgctgcagggatcatctctgaccaacaggcacaaatcgaggaggacccacagaaatacaagcgcctgaccacaaaagagctactgatggagaacatagactacgcgtttgatatctacttgatatacgtcctgacgctgtcgatcttcccaggatttttgtctgaagacaccggagaacacagcctgggatcatggtacgcgcttgtgctgatcgccatgtacaacgtgtgggacctgatcgggaggtacgtgccactgatccagtgcctcaagctgacctcccggaagggcatgatggcggccatcctggcgcggttcttgttcatcccggccttctacttcacggccaagtacggcgaccagggttacatgatcttcctgacctccttcctggggctaaccaacgggtacctcaccgtgtgcgtgctcatggaagcccccaaggggtacaagggccccgagcagaacgcgctcgggaacgtgctcgtcgtctgcctcctcggtggcctcttctccggcgtcgtgctcgactggctgtggctcatcggcaagggctggtgattccgtctcctgcgcgtaggtcaattagattttattagatctctgttcctccctgctctgggtcgctctacaacctgcacttatttccatttcaatttctctttaggtagctagtcaagaacatggatggtgtaatttggctccatttgaatctctctttcaagtgcaatcactcattttctttcttgttggaaatcatatatttgatgtgtaatgtggaaaaaaaaaaaaaaaaaaaa

SEQ ID NO: 2118 - protein, 418 aa, Panicum virgatum
  misc_feature: Ceres CLONE 1776457
  misc_feature (1)..(300): Pfam Name: Nucleoside_tran Pfam Description: Nucleoside transporter
MSTDVVGAEAPQVKGRFLGILICWLLGNGSLFAWNSMLTIEDYYVHLFPDYHPTRILTLAYQPFAFGITLIMTYYEAKMNTRRRNLAGFSLFFLGSFALIILDIATKGRGGLGVFVGVCIISAIFGIADANCQGALVGDLSLMCPEFVQSFMAGLAASGVLTSALRLITKAAFESSKDGLRIGAILFFSITCLFELLCLLLYTFVFAKLPIVKYYRSKAASEGSKTVASDLAAAGIISDQQAQIEEDPQKYKRLTTKELLMENIDYAFDIYLIYVLTLSIFPGFLSEDTGEHSLGSWYALVLIAMYNVWDLIGRYVPLIQCLKLTSRKGMMAAILARFLFIPAFYFTAKYGDQGYMIFLTSFLGLTNGYLTVCVLMEAPKGYKGPEQNALGNVLVVCLLGGLFSGVVLDWLWLIGKGW

SEQ ID NO: 2119 - DNA, 1623 bp, Panicum virgatum
  misc_feature: Ceres CLONE 1776477
  misc_feature: Encodes the peptide sequence at SEQ ID NO. 2120
gttcatacaccctgcctgccactcccccgctagccagtagcttgctcgccagtggccatggcggccaccaccaccatctttctcctcctcctcctcgccgccagtagtgcggcctcggccgccgacctctccgtgtaccacaacgtgcacccgccgtccccgtccccgctcgagtccatcatcgcgctcgcgcgcgccgacgacgcgcgcctcctcttcctctcctccaaggccgccgcctcgcccggcgtcacctccgctcccgtcgcctccggccaggccccgccctcgtacgtcgtccgtgccgggctcggcacccccgtgcagcagaccctcctcgcgctcgacaccagcgccgacgccacctgggcgcactgcgccccctgcgacacgtgccccgccggcagccgcttcatcccggccagctcctcctcgtacgccgcgctcccctgcgcctccgactggtgcccgctcttccagggccagccgtgcccggcgaaccagcaggccgcgctgccggcgtgcgccttctccaagctcttcgccgacgcctccttccaggcgtcgctgggcagcgacacgctgcggctgggcaaggacgccgtcgccaacttcgccttcgggtgcgtgggcgcggtgaccgggccgacggcgaacctgcccaagcaggggctactcggcctcggccgtggccccatgtccctgctgtcccagaccgggagcaggtacggcggcgtcttctcctactgccttccgagctacaagtcctactacttctccggctcgctccggctgggcgccgctggccagcccaagaacgtccggtacacgccgctgctgagcaacccgcaccggccgtcgctgtactacgtgaacgtgacggggctcagcgtggggcgggcgtgggtgaaggtgcccgcgggggcgttcgcgttcgacgccggcaccggcgccggcacggtgattgactccggcacggtgatcacgcggtggacggcgcccgtgtacgcggcgttgcgggaggagttccggcggcaggtgggcgcgccgagcgggtacacgtcgctgggagccttcgacacgtgcttcaacacggacgaggtggcggcgggcggcgcgccgaccgtgaccctgcacatggacggcggcgtggacctgacgctgcccatggagaacacgctgatccacagcagcgcgacgccgctggcgtgcctggccatggccgaggcgccgcagaacgtcaactccgtcgtcaacgtggtggccaacctgcagcagcagaacgtccgggtcgtcgtcgacgtcgccgcctcgcgcgtcggctttgccagggagccctgcaactgagctgagccccaatccgccgccgcccgtagccgtgcattatgtttccagttccagtgttgtggtgctgtgcaataagggacgtgacgtgacacgaacaagaattggttcgtttcgtcacgggtagctagaaagaccaacgtactagtgtgtgtattatttctgtcgttttttttttggttttgttgtttttgtttgactgttgctgttgcaagagattaccataatttgcgaaaatccgatggggcacttgtacgtcaaaaaaaaaaaaaaaaaaaa

SEQ ID NO: 2120 - protein, 429 aa, Panicum virgatum
  misc_feature: Ceres CLONE 1776477
  misc_feature (1)..(358): Pfam Name: Asp Pfam Description: Eukaryotic aspartyl protease
MAATTTIFLLLLLAASSAASAADLSVYHNVHPPSPSPLESIIALARADDARLLFLSSKAAASPGVTSAPVASGQAPPSYVVRAGLGTPVQQTLLALDTSADATWAHCAPCDTCPAGSRFIPASSSSYAALPCASDWCPLFQGQPCPANQQAALPACAFSKLFADASFQASLGSDTLRLGKDAVANFAFGCVGAVTGPTANLPKQGLLGLGRGPMSLLSQTGSRYGGVFSYCLPSYKSYYFSGSLRLGAAGQPKNVRYTPLLSNPHRPSLYYVNVTGLSVGRAWVKVPAGAFAFDAGTGAGTVIDSGTVITRWTAPVYAALREEFRRQVGAPSGYTSLGAFDTCFNTDEVAAGGAPTVTLHMDGGVDLTLPMENTLIHSSATPLACLAMAEAPQNVNSVVNVVANLQQQNVRVVVDVAASRVGFAREPCN

SEQ ID NO: 2121 - DNA, 2547 bp, Panicum virgatum
  misc_feature: Ceres CLONE 1776480
  misc_feature: Encodes the peptide sequence at SEQ ID NO. 2122
ggcgctatatcaattcgttcctccgggcggatttcttcgtcacgagggcgaggagaggaggagggaggaaaaggtgccccatttcttgctctactccgttgcagttgcggagatccaatcgattcaagaaacggcatttttgtgcttccgttaggttgctcgccgagagattcccccccaaagtttgttgcttggagtcgatttgggccaagaaagggccaaaaggcgccgcaaatccgttaccgtcccagaaaatcccaaaacgccgcgtcgtatttgatcgctggcgacctggctcgatccatctgagccaagggggcagcaggaggagggggagagggggaggagaggagagggcgtcctcctcgagcagccgcattgcccgcctgtcgatgagtgagcgctgcctccgatgctgtcggggtgctcggtgtccagtctcgcggcgcggttcgccttcttcccgccggagccggcgacgtacgccgtccggaaggacgaggccaccggccgcgtcgtcgcctccggcgtgccgcgggacaacgctctcgacgtgctgctcgtcgacaccaggagggggaacaaggtggtggccttctacttccggaacccctgcgcgcgcctcaccctgctctactcgcacggcaacgccgccgacctcggccagctctacgacctctttgtgcagctcaaggtcaatctcaagatcaatctgatgggatatgactactctggctatggcgcatctactggcaagccgagtgaagaaaatacatatgcagacattgaagcagtttaccaatgcttagaaaccgagtatgggatcagccaggaggatattatcttgtatggacaatctgtgggcagtgggccaacattacatttagcctcccgcctgcctagattgcgcggggtggttctccacagcgctatactgtcaggcctccgtgttgtttgccatgtgaactttactttctgctttgacatttacaaaaatgtcaagaaaataaaaaaggtcaaatgcccagtgcttgttattcatgggacggacgatgatgttgtgaactggtcacatggcaaggagctgtggaaactggcaagggagccttacgatcctctctggatcaaagggggaggtcactgcaacctggagctgtaccctgacttcatccgccacctctcccgtttcatccgtgaaatggagaccatcacaacgaaaatccgactcaagaagattaggcagtccctccagcccagaaagaaggcccaccgcgtgagcacggccacaacaacaaccttcaccactaactgctgctgccgcattcgagttcgcaaaccgacctgccccagctgcaacttcagctgtggctgctgcgagctgaggaactgcttcacattctgtttcatcaggtgctgcccttcctgcttctcctgcggcagctgctgctcctgccggagctgcttcaagtgctgctgttgtggagatgcgcgttaatgcttccgatctttgtgcgcgcgcatgtatagtaaagaggaatggtcctgagatatctgctaaccctttaaatgccgtaggactaaaaactagacttgagttaactgaacattgtgcaacagatagactcctgtacttgtccatggtatccggttctacctgccctcctttgtagttgcatgtcagattcatctaattattgacataacccgttcgctgttgagtttagaacctgaactgaatcttcgttccttcaatgtttaggttgttccgacctgattgctcgagacatcatagtctggtctgtctgttagactggcgggtgacaaccaacccaaccgaatgttttgagatactatcagcactctaccagcaactactcagaacaactcaaggtggttctcgtgccactgtttctgttcctattgtcgaaatgtactgttgctgcccggcaatcggatccaatgtgcaccatccgatcaatgttgaagacaatggaaggttaaagcttgccagtccgtgcagtacaccggcgttcagatggaccacttgcagtaccattttgtaccaacctgaaacaaaccatggggcctctcccatagtcccattcatgcgtgcagattcagaaactggcgcccattattcatacagctgtgtagcatcatactgaagccagctactagtcattctgtacaaggccggccatgtgaggggcattgaattgaaatctcccttagaaaatgcgcgactaaaagaacacatcagtcggtggattattggagctcatggaacctggcattcagctgatcgggttgcctgaattcccctgaactcatcggcaaaccgaaagctggtccgggtagttgaaccgtagctcttgctcttgcggttaaggggccggtcaccggacttctcatcggaggatcggaggcgacaatgtaggcgaggatggatggatggtgcaccatatatggtacctagctggtacgagtaggacaatggtatgtatgtgatgtggcatggtcttgttgcaaaaaaaaaaaaaaaaaaaa

SEQ ID NO: 2122 - protein, 360 aa, Panicum virgatum
  misc_feature: Ceres CLONE 1776480
  misc_feature (1)..(83): Pfam Name: Abhydrolase_1 Pfam Description: alpha/beta hydrolase fold
  misc_feature (1)..(204): Pfam Name: Abhydrolase_2 Pfam Description: Phospholipase/Carboxylesterase
MLSGCSVSSLAARFAFFPPEPATYAVRKDEATGRVVASGVPRDNALDVLLVDTRRGNKVVAFYFRNPCARLTLLYSHGNAADLGQLYDLFVQLKVNLKINLMGYDYSGYGASTGKPSEENTYADIEAVYQCLETEYGISQEDIILYGQSVGSGPTLHLASRLPRLRGVVLHSAILSGLRVVCHVNFTFCFDIYKNVKKIKKVKCPVLVIHGTDDDVVNWSHGKELWKLAREPYDPLWIKGGGHCNLELYPDFIRHLSRFIREMETITTKIRLKKIRQSLQPRKKAHRVSTATTTTFTTNCCCRIRVRKPTCPSCNFSCGCCELRNCFTFCFIRCCPSCFSCGSCCSCRSCFKCCCCGDAR

SEQ ID NO: 2123 - DNA, 1624 bp, Panicum virgatum
  misc_feature: Ceres CLONE 1776483
  misc_feature: Encodes the peptide sequence at SEQ ID NO. 2124
aaatccaatttccttcccgtccccaaattctacgctcctctcatcccgcacagccggcctcaccgccggcgtccttccgccccagtcctccctcccttcgccgccgccttcaaaaccctctctgctggggctcggctgggcgcggggtccaggacgcgagatccgcccgggcctggactgatcccctcctccctcggggtaagatcgtgaagctctgcatcatcttcgtagggtcactttgataatccaacaaagggcacctagttactctccttgattgtcccctgacaatgaagacgcatgagcgagctgccaatttggcccttgccgctttgagcttggcaccgcttgtggttaaagtaaacccaaatctgaatgtggtattgacagcatgccttactgtctatgtgggttgttaccgttctgtcaagccaaccccaccctctgagacaatgtccaaggagcatgctatgcgtttccccttagtgggaagtgctatgctcctgtcactgttccttctattcaagtttctttcaaaagacttggtcaatgctgtgctcactgcttacttcttcattcttggaattgttgctctctctgcaacattgcttccttctataaaacgttttcttccaaaagaatggaatgataatctcattgtatggcgggctccacttatccactcactctcggtggagttcacaaagtcacagattgttgcttctgtgccgggatttttcttttgcatgtggtatgcatctaagaagcattggttggcaaataatgttctgggaatcgctttctgtattcaggggattgagatgctgtcattgggatcgtttaaaactggagccattctcttggctggactttttgtgtatgacattttctgggtgttcttcactccagttatggtcagtgtggctaaatcttttgatgccccaataaagcttctgtttccaactgcagatgctgcacgtccattctctatgcttggccttggtgacattgtgatacctggcatctttgttgcacttgccctgcgttttgatgtctcaagaggtatcaagaaccgttacttcaacagtgcatttttgggatacactgtgggtttgacggtgaccatcattgtaatgaactggtttcaagctgcacagcctgctctactgtacattgttcctggtgtgatcggtttcgttgctgttcactgtttgtggaatggagaagtaaaacagctactggagtttgacgagtcaaaagctgaagcagaggaagcaggtgaagaagagcaagatgataaatccaaagagaacaagaagggggactagcgttctagctagatttaggtcatgatgcggagaaaatggaacacaagttttcgtgtaaggttgtcagcagctaaaatgggcttgacgacctctgataccggctcacttaaagaacttagaaatgattcacatgatacaactttttttttgcttatttggttcggagagttgaattgaagaaggaaaaagatggtgtgacttcgatgttctgacctacttctgttttccttactgacttcatcttggttaatgattcagcggaactctgttttggccaaaaaaaaaaaaaaaaaaaa

SEQ ID NO: 2124 - protein, 345 aa, Panicum virgatum
  misc_feature: Ceres CLONE 1776483
  misc_feature (1)..(275): Pfam Name: Peptidase_A22B Pfam Description: Signal peptide peptidase
MKTHERAANLALAALSLAPLVVKVNPNLNVVLTACLTVYVGCYRSVKPTPPSETMSKEHAMRFPLVGSAMLLSLFLLFKFLSKDLVNAVLTAYFFILGIVALSATLLPSIKRFLPKEWNDNLIVWRAPLIHSLSVEFTKSQIVASVPGFFFCMWYASKKHWLANNVLGIAFCIQGIEMLSLGSFKTGAILLAGLFVYDIFWVFFTPVMVSVAKSFDAPIKLLFPTADAARPFSMLGLGDIVIPGIFVALALRFDVSRGIKNRYFNSAFLGYTVGLTVTIIVMNWFQAAQPALLYIVPGVIGFVAVHCLWNGEVKQLLEFDESKAEAEEAGEEEQDDKSKENKKGD

SEQ ID NO: 2125 - DNA, 1322 bp, Panicum virgatum
  misc_feature: Ceres CLONE 1776501
  misc_feature: Encodes the peptide sequence at SEQ ID NO. 2126
atccagctcggttcacacccggcgcatgaaaaagccaccctcctttccagcccgtttagctcgctataggtagcagtagagacagacagcgcgaggaacagggagcgcgcggctcagtgcagcagcagagcttgcggagagcagtagttgtgcagctcaatggcttgttccaccatggctttcttggccgtcttcgttgcggcggcggcggggtcgtgcctgccagcggccgccgcgggcgggcctctccccccggcgggaacgcccctctccttccgggagggctacacgcagctgttcggcgactccaacctcgcgctccacggcgacgggaggagggtgcacatctccctcgacgagcgaacaggcgccgggttcgcgtcgcagggcgcgtacctccacgggctcttcagcgcccgcatcaagctccccgccaaccacaccgccagcgtcgtcgtcgccttctacatgtcgaacggggacgtgtacgagcggacgcacgacgagctggacttcgagttcctggggaacgtgcgggggcgggagtggcgggtgcagaccaacgtgtacggcaacggcaacacggcggccggccgggaggagcgctacggcctctggttcgaccccacggaggacttccaccgctacgccatcctctggagccgcgacaggatcatattctacgtcgatgagacgccgatcagggaggtggtgcggacggagtccatgggcgcgcagttcccgtccaagcccatgtcgctgtacgccaccatctgggacggctccagctgggccacctcgggcggccgctacaaggtggactacaagtacgcgccctacgtcgccgagttcgccgacctcgcgctccgcggctgcgcggtgggcggtcgggcgtgcgaggagccaggcggcggcaccgccgcaccggcgatgtcgccggcgcagcggtcggcgatggaggcgttccgggcgcagcacatgacgtacggctactgctacgaccgcctccggtaccccgcgccgttgccggagtgcagcgtcggtccggaggccgcggcgttcctcccgtcgggggatgcgagggcggcactgcgtaggcgtggcaggcgccaccagacgcgcggcggcgcggactcggctgtctgatcggcggcgctgatggtgccagtgttcccaagtgtgcctgtatcgactgtggtgtggtctgatctatgattagggtcccttgattcctcctgacgggcaccaccattggtaacagtaaccggagttccactgattataagcctcttcacttgtactaaaaaaaaaaaaaaaaaaaa

SEQ ID NO: 2126 - protein, 328 aa, Panicum virgatum
  misc_feature: Ceres CLONE 1776501
  misc_feature: Great-hit functional homolog of the protein sequence encoded by LOCUS At1g14720
  misc_feature (1)..(186): Pfam Name: Glyco_hydro_16 Pfam Description: Glycosyl hydrolases family 16
  misc_feature: Useful for making plants with altered cell wall content and/or composition
MACSTMAFLAVFVAAAAGSCLPAAAAGGPLPPAGTPLSFREGYTQLFGDSNLALHGDGRRVHISLDERTGAGFASQGAYLHGLFSARIKLPANHTASVVVAFYMSNGDVYERTHDELDFEFLGNVRGREWRVQTNVYGNGNTAAGREERYGLWFDPTEDFHRYAILWSRDRIIFYVDETPIREVVRTESMGAQFPSKPMSLYATIWDGSSWATSGGRYKVDYKYAPYVAEFADLALRGCAVGGRACEEPGGGTAAPAMSPAQRSAMEAFRAQHMTYGYCYDRLRYPAPLPECSVGPEAAAFLPSGDARAALRRRGRRHQTRGGADSAV

SEQ ID NO: 2127 - DNA, 1489 bp, Panicum virgatum
  misc_feature: Ceres CLONE 1776512
  misc_feature: Encodes the peptide sequence at SEQ ID NO. 2128
ggattccaatttccagccggaagccgctatggccgaccgcttcttccccaacgacatgcccgggtacgtcgaggaagaagccgcgcccgctccggccgccgaactctcatcctcgtcctcgctccacacactcctatccctcccctaccccgtcctcgccgcccgcttcctccacgccgcgctccaactcaagcagaaggttgtgcacgagagttgggagatgcggcagcgagcggcgggggacatcacgctctacaccggcgcgcttggcactgcgctcctgctcttcagggcctattcggtcaccggagaccgcgccgacctcgccacctgcgccgagatcgtggccgcttgcgacgcggcgtctgcacctgcgggcgaggagttcgtgacgttcatatgcggacgggctgggatctgtgcgctcggtgcggtggtggcgaagcacgccggaaacgtggccaccgtcgcgcgttacctgaactcgtttaagcagatcaaaatttctagtaaattccctgatgagctcttatatggaaaaactggatatttgtgggcctgctccttcctaaacaaacaccttggtgaaaacacgatacagccaaccaccacagacatggttgtgagagagattatcaaagatggtagaaggttgtctacaaaaagctgcccattgatgtatgaatggtatggtgaaaaatattggggtgctgctcatggtcttgcagggattatgcatgttttgctagacatggacttgacagaaaatgacaaggaatacgtgaagggaactttgcgatacatgattcagaaccgcttgcctagtgggaattacccttgcaccgaaggtgataattatgattgccttgtgcactggtgccatggcgctcctggtgtttccctcaccttagcaaaggcttctcaggtgttcccagaagagcgatttttggaggcagcggcagatgcagctgaggtcgtttggaatcgggggcttctcaaaagagttgggatatgtcatggaataagtgggaatgcctacacatttctgtcactttaccgccttacgaagaaaaaggagtacctctaccgtgctaaagcttttgcttgttttctccttgaccgagctatcaagctaattgcagaaggcatcatgcacggtggtgatgagccatattcgctatttgaaggacaagctggaatggcatatctgttactagacatgattaacccccttgaatctgggtttccagcttatgaactttgaactgcacatgctcagttattcaatgccctaacgcatcagtttacatgtatgtcaaattatatttgtagaaactgcaaaccaaaggtatgttgttgttgtaaactgcaaaccaaagggtgaagtaacccaaggtatgcgtttgtgggtagacctgtttggtgttttgcatcaaatcctaattctgtcgtcctcttgtgacggctctaaaaaaaaaaaaaaaaaaaa

SEQ ID NO: 2128 - protein, 411 aa, Panicum virgatum
  misc_feature: Ceres CLONE 1776512
  misc_feature (1)..(341): Pfam Name: LANC_like Pfam Description: Lanthionine synthetase C-like protein
MADRFFPNDMPGYVEEEAAPAPAAELSSSSSLHTLLSLPYPVLAARFLHAALQLKQKVVHESWEMRQRAAGDITLYTGALGTALLLFRAYSVTGDRADLATCAEIVAACDAASAPAGEEFVTFICGRAGICALGAVVAKHAGNVATVARYLNSFKQIKISSKFPDELLYGKTGYLWACSFLNKHLGENTIQPTTTDMVVREIIKDGRRLSTKSCPLMYEWYGEKYWGAAHGLAGIMHVLLDMDLTENDKEYVKGTLRYMIQNRLPSGNYPCTEGDNYDCLVHWCHGAPGVSLTLAKASQVFPEERFLEAAADAAEVVWNRGLLKRVGICHGISGNAYTFLSLYRLTKKKEYLYRAKAFACFLLDRAIKLIAEGIMHGGDEPYSLFEGQAGMAYLLLDMINPLESGFPAYEL

SEQ ID NO: 2129 - DNA, 2093 bp, Panicum virgatum
  misc_feature: Ceres CLONE 1776517
  misc_feature: Encodes the peptide sequence at SEQ ID NO. 2130
gcagagcaggatgctggccgtcgcatccagaacccgcgacaaatcggcccccaccatcctctcccttgctatgccattcctcctcaccaccgctaccggcaccgccaccagcccccgccctctcatcccctcctcccctcgccgccaaaaccctaccaccccccacctccgccctccgcctccagcccgccgcctccccggcttccccgccgccgagccgggcgcccccttcctcccccgcccgccgaggcgaggcatggcgtcgctggcggcgacggcggccgcggccgccgccgcggaagtgacgcacctcacgcagcgcgacgcggcggagatcgacgagcagctcatgggcccgctcgggttcagcgtcgaccagctcatggagctcgctgggttgagcgtcgcggcggccgttgcggaagtttacaagttgagtgaagaacatacaagggtccttattatctgtggtccagggaataatggcggtgatggtctggtagctgctcgtcatctttatcactttggatataggccctctgtttgctacccgaagcgtacgcccaagcctctgtattctggccttgttactcagcttgaatcactgtcgatcccattcatacctgctgaagacctacctcatgacttgtcaagggaatttgatattattgttgatgcaatgtttggtttctcgttccatggaacacctagaccaccctttgatgatcttatccaaaggcttatttcattgagtgttattggaaattcagataaaaaaccagcaattgtttctgttgatattccttctggatggcatgttgaagagggagatgttgatggaggagggattaaacctgatatgctggtgtcactgactgccccgaagctctgtgcaaaaaagttcactggcccacaccattttcttggaggtaggtttgttcccccacctattttgaacaaatatggacttaagcttccaccataccctggcacatcgatgtgcgcgagaattcgaaaagctccatctgttgacatttcatctctcagggagaactatatttccccagaacttcttgagagtcaagtgatgcctgatccatttgatcagttccttagatggtttgatgaagcagtcacggctggcctgcgtgagcccaatgctatggctttaacaactgtcaacaaggagggaaaaccttcttcaagaatggttcttttaaagggagttgataagcagacatttgtttggtacacaaattatggcagccggaaggcacatgacttatctgaaaatcctaatgcagcactccttttctattggaatgagatgaaccgtcaggtaagagttgaaggatcagttgagaaggttccagaagaagaatcagagaaatatttccatagccgcccacgaggaagtcagcttggtgccatagtcagcaagcagagtactgtcattgctggaagggaggtccttcaacaggcgtacaaggaattggagcacaaatattctgatggtagcttgatcccaaaacctgaatactggggcggctacagattgacaccaacactttttgagttctggcaaggccaacagtctcggttgcatgaccggctacaatactcacagcgagaagtagatgggaatacagcgtggcacatcgagaggttgtccccttgactgttaacctgccagcactttggttataggcttcatcttatcaccagtactcaaatcttctccagctgcaagatgtgcgaattgccccatgatgtcagcattgcgattaggtcccgtgtttgagtgccagaagctctgtttacatgccaggttcatgattaggtcccttgtttatcatggcagggtgtgaactgaatgagtggatgtgctttgtaaagcaggccattctttctttaacccctttcatattgttttttctttcgtaaatggtattcgtcaaccaggtatgtaaatctcatcgacggtcgtattgtttatatcggaataatgctcttgggagtggctttgttagcatggagctgattgatgaataaagctggcgtcatgaaaacatcaaaaaaaaaaaaaaaaaaaa

SEQ ID NO: 2130 - protein, 555 aa, Panicum virgatum
  misc_feature: Ceres CLONE 1776517
  misc_feature (1)..(87): Pfam Name: Pyridox_oxidase Pfam Description: Pyridoxamine 5'-phosphate oxidase
  misc_feature (342)..(555): SWISSPROT Homolog: EC 1.4.3.5 Pyridoxamine 5'-phosphate oxidase
MLAVASRTRDKSAPTILSLAMPFLLTTATGTATSPRPLIPSSPRRQNPTTPHLRPPPPARRLPGFPAAEPGAPFLPRPPRRGMASLAATAAAAAAAEVTHLTQRDAAEIDEQLMGPLGFSVDQLMELAGLSVAAAVAEVYKLSEEHTRVLIICGPGNNGGDGLVAARHLYHFGYRPSVCYPKRTPKPLYSGLVTQLESLSIPFIPAEDLPHDLSREFDIIVDAMFGFSFHGTPRPPFDDLIQRLISLSVIGNSDKKPAIVSVDIPSGWHVEEGDVDGGGIKPDMLVSLTAPKLCAKKFTGPHHFLGGRFVPPPILNKYGLKLPPYPGTSMCARIRKAPSVDISSLRENYISPELLESQVMPDPFDQFLRWFDEAVTAGLREPNAMALTTVNKEGKPSSRMVLLKGVDKQTFVWYTNYGSRKAHDLSENPNAALLFYWNEMNRQVRVEGSVEKVPEEESEKYFHSRPRGSQLGAIVSKQSTVIAGREVLQQAYKELEHKYSDGSLIPKPEYWGGYRLTPTLFEFWQGQQSRLHDRLQYSQREVDGNTAWHIERLSP

SEQ ID NO: 2131 - DNA, 1645 bp, Panicum virgatum
  misc_feature: Ceres CLONE 1776523
  misc_feature: Encodes the peptide sequence at SEQ ID NO. 2132
gttaccttcccccctcgcatcgcatcgcatcatccagcctcgcctcagatctcgccccaactgctagcttccacacggcctacctccccgcccgatcgccgtcgagctcccacacgtttggctggcggcttggctgaccccatcaacgctgcaaggattggtggacagggcggggcggtggcgacgcgcccagctacccacccgcggcttcctctgaactggccgcagctgttcttggcccagctgctctcttcttgtcgagggatggtccagcgcttcgagaagcccccgcgccgacattgagctgccgattcgtggtggctctttggatagtacagtggaggtgggtgtccgatgggctgcacggggtccaggcacgctttgcgcggcggcggccggaagccgtacgcgcggagctgctccgggccggtcaccgggggcgtgcaccacaccgtcgcgctcaggtcatccacactcgggtcgctcagcctcgaccgggacgaggatatgatgaagtggcgcgacgacggcgtcgtcggtgcggcgaggacgccgccgctgaagcagcagcagctggtccggcggcacaaacaggtgccgggctcgccggccaagacgccggtccgggagccggaggtgatcaacgtgtgggagctcatggatggcctcgacgacaaggaagaggaggaggaggagggcgacgccggcggcgaggaccgccaggggaagtcggcgccgggatcgccggagttcgatccggacatcatcgcggcgttcaggaaggcacttgatgagatgcccccgccgccggacgacccgggcaacgacgagtgcgccaagaagcctgacgacccggtcggcgacgaggcgagcgtcaagaagcacgagatacagaggttcccgggcatcgtgcgcgcgcgggtcagcgcgttccagcagaggatcgacgcgaagctcgccaagctggcgccgccgaagccgccggctcccccgcccccgccggacagcgcccggaaggtggtgctgtacctgaccagcctccgcggcatccgcaagacgtacgaggactgctggtccacccggtccatcctccacggctacggcgtgcgcgtcgacgagcgcgacctgtcgatgcacgccgggttcaaggacgagctccacgccgcgctgggcggccccgcgggcaggctcccgcaggtgttcgcggacggcaggcacctgggcggcgccgaggagatccgacggatgcacgaggccggcgagctgtcgagggcgctggaggcctgcgagatggcgcccctgccgagcgccggcggcaagggcattgccctggacgcgtgctccggctgcggcggcgtgcggttcgtgccctgcgaggagtgctccggcagctgcaaggtgttcctcgaggaggtgggcaccttcaggcggtgccccgagtgcaacgagaacgggctcgtgcggtgtcctctctgctccctgtgaaaaatctcagagctggcttgttgttttccaggattgatgaggagtgcttgtcgttttagttcagggtttgtacagaagttacacgcatttgtaactttaggactgatgaagagcaacagatgacctgtatttatgtttcgaaaaaaaaaaaaaaaaaaaa

SEQ ID NO: 2132 - protein, 376 aa, Panicum virgatum
  misc_feature: Ceres CLONE 1776523
  misc_feature (1)..(66): Pfam Name: Glutaredoxin Pfam Description: Glutaredoxin
MGCTGSRHALRGGGRKPYARSCSGPVTGGVHHTVALRSSTLGSLSLDRDEDMMKWRDDGVVGAARTPPLKQQQLVRRHKQVPGSPAKTPVREPEVINVWELMDGLDDKEEEEEEGDAGGEDRQGKSAPGSPEFDPDIIAAFRKALDEMPPPPDDPGNDECAKKPDDPVGDEASVKKHEIQRFPGIVRARVSAFQQRIDAKLAKLAPPKPPAPPPPPDSARKVVLYLTSLRGIRKTYEDCWSTRSILHGYGVRVDERDLSMHAGFKDELHAALGGPAGRLPQVFADGRHLGGAEEIRRMHEAGELSRALEACEMAPLPSAGGKGIALDACSGCGGVRFVPCEECSGSCKVFLEEVGTFRRCPECNENGLVRCPLCSL

SEQ ID NO: 2133 - DNA, 1911 bp, Panicum virgatum
  misc_feature: Ceres CLONE 1776533
  misc_feature: Encodes the peptide sequence at SEQ ID NO. 2134
gggttcgccgctgtgctctgctcgagtgctagacgaagacgacccacccggccggttcgatcgatcgaatcgatccctcgcgcggccgcagaaaaggagaggaaaaccccaggccgcaacctgcatccgcgcccggcgtcctctacccccgccgcctccacccgcttctctttcttcttcccgtctcatcccgctgccagcgcgcgaaggtggtgcgggcgatggcgggcggcggggcggtgagggaggtggggtccaaggcggagctggacgcggcggtggccggcgcgcgcgcggccgccgtgcacttctgggcggggtggtgcgaggcgtccaagcagatggacgaggtcttcgcccacctcgccgtcgacttcccccacgccgccttcctcaggattgaagctgaagaacaacctgaaatatcagaggcgtatggagtcacagcggtgccatattttgttttctgcaaggaaggtaaaactgttgatactctggagggagcaaatccagctagcctggccaataaggttgcaaaaattgccgggcctgccagtgttgctgagtccgctgtacctgctagccttggagtggctgctgggcctgctgtacttgaaaaagtccaagaattggctcagcggaatggatcttctgctgctgagggcacaaactccgacagcctgccagattcactgaataagcgtttggagcagcttgtcaattcccatcctgtatttctgtttatgaaggggacccctgagcaaccaaggtgtggtttcagccgtaaagtggttgacattttgaagcaggaaggagtcaactttgggagctttgatattctcacagacaatgatgtgcgtgaaggaatgaagaagttctccaactggcccactttccctcagctctactgcaaaggtgagctacttggtggatgtgatattgttattgctatgcatgacagtgctgaattgaaggatgtttttgaggagcacaatattcccctcaaaccacacggaagcaaaagtgttgaagcagtggaacctgaggctccatctgaaaaagctggtgcagtttctgaaccagttgggcttactgatgcacagaaagctcgtttggcaagccttgttaattccagccctgtgatggtatttatcaaagggtcacctgaggtgccaaagtgtgggttcagtgggaagttgattcacatccttgagcaagagaacattcctttctccagttttgatattctgtcagatgatgaggttagacagggtctaaaggttttctcaaactggcctagttaccctcagctatacataaaaggtgaactaattggtggttctgacatagtgatggagatgcataagagtggtgaactgaagaaggtcctgtctgagaaaggggttatagcaaaggaaactctcgaggacagacttaaggccctgatttcttcagctccagtgatgctgttcatgaagggcaccccagatgctcctcgttgcgggttcagttcgaaggttgtgaatgcactgaagaaggaagggatcagctttgggtcctttgacatcttatccgatgaggaagttagacaaggtctgaaggcatactccaattggcctactttccctcaactgtactacaaatcggagctgataggtggttgcgatatcattcttgagatggagaagagcggagagctgaagtcgaccctgtcagagtaggcgcattgcgtttgtctcgctggcgtatctagtgtctggccagagttgaattgtgcttagattgcatttatgccgatgtattcatagatccacgtttgagacatctgcccgtgccacattactagaattgtgacatctgcagaaggaataacatgaaacggatttggtacaaaaaaaaaaaaaaaaaaaa

SEQ ID NO: 2134 - protein, 499 aa, Panicum virgatum
  misc_feature: Ceres CLONE 1776533
  misc_feature (1)..(65): Pfam Name: Glutaredoxin Pfam Description: Glutaredoxin
MAGGGAVREVGSKAELDAAVAGARAAAVHFWAGWCEASKQMDEVFAHLAVDFPHAAFLRIEAEEQPEISEAYGVTAVPYFVFCKEGKTVDTLEGANPASLANKVAKIAGPASVAESAVPASLGVAAGPAVLEKVQELAQRNGSSAAEGTNSDSLPDSLNKRLEQLVNSHPVFLFMKGTPEQPRCGFSRKVVDILKQEGVNFGSFDILTDNDVREGMKKFSNWPTFPQLYCKGELLGGCDIVIAMHDSAELKDVFEEHNIPLKPHGSKSVEAVEPEAPSEKAGAVSEPVGLTDAQKARLASLVNSSPVMVFIKGSPEVPKCGFSGKLIHILEQENIPFSSFDILSDDEVRQGLKVFSNWPSYPQLYIKGELIGGSDIVMEMHKSGELKKVLSEKGVIAKETLEDRLKALISSAPVMLFMKGTPDAPRCGFSSKVVNALKKEGISFGSFDILSDEEVRQGLKAYSNWPTFPQLYYKSELIGGCDIILEMEKSGELKSTLSE

SEQ ID NO: 2135 - DNA, 2180 bp, Panicum virgatum
  misc_feature: Ceres CLONE 1776560
  misc_feature: Encodes the peptide sequence at SEQ ID NO. 2136
ctgcatcactcgccatatttttggaatcgcctttggatctgcaggtgattcccagtgccccaccctcactggctgcctgatttgaattttccaatcggattacaacttatataacccgcaccgtccccattcgcttcctccgactccgagcgcgaaatcgctagattgaaattggacgccgcatcggctggtggtgcggaagccacccgctagcgcaatggaatccgtagcagccgcctcctccgtgttctccccgtcccgcgtcgccgccccggcggcgggggccctggttagggccggggcggtggcagcagccaggaggagggggaggagcggcggcctgcggtgccgcgccgtcgtgacgccgcagccgagcgcggtggcgagcaggagggccgtggcggaggaggacaagaggcggttcttcgaggcggcggcgcgggggagcgggaagggcaacctggtgcccatgtgggagtgcatcgtgtcggaccacctcacccccgtgctcgcctaccgctgcctcgtcccggaggacaacgtcgacgccccgagcttcctcttcgagtccgtcgagcaggggccgcagggcaccaccaacgtcggccgctacagcatggtgggagcccacccggtgatggagatagtggccaaggagcacaaggtcacgatcatggaccacgagaagggccaggtgacggagcaggtcgtggacgatcctatgcaggtgcccaggagcatgatggagggatggcacccacagcagatcgacgacctccctgaatccttctcaggcggatgggttggtttcttttcctatgatacggttcggtatgttgagaagaagaagctacccttctctggtgctcctcaggatgataggaaccttcctgatgtgcacttggggctctacgatgatgttcttgtcttcgacaatgttgagaagaaagtgtatgtcatccattgggtaaatgtggaccgctacgcatcaattgaggaagcataccaagatggcagatcccggctggatctgttgctatccaaagtgcacaattctaatgtccccacactctctcctggatttgtgaagctacacactcgccagtttggtacacctttgaataagtcgaccatgacaagtgatcagtacaagaaggctgttatgcaggctaaggagcatattatggctggggacatcttccagattgttttaagccagaggttcgagaggcgaacatatgccaacccgtttgaggtttaccgagcattacgaattgtgaatcctagcccatacatggcttatgtacaggcacgaggttgtgtcctagttgcatctagccctgaaattcttacacgagtcagtaagggcaagattattaatcggccacttgctgggactgttcgaaggggcaagacagagaaggaagatcaaatgcaagagcaacagctactaagtgatgaaaaacagtgtgccgagcacattatgcttgtagacttaggaagaaatgatgttggcaaggtctccaaatctggatcagtaaaggtggaaaagttaatgaacattgagcgatactcccatgttatgcacattagctccacggttagtggacagttggatgatcatctccagagctgggatgccctgagagctgcattgcctgtgggaacagtcagtggagcaccaaaggtgaaagccatggagttgatagatgagttggaagtcacaaggagaggaccatacagtggtggtttaggagggatatcgtttgatggtgatatgcaaatcgcattggctctccgcaccattgtattctcaacagcgccaagccacaacacgatgtactcatacaaagctgctgataggcgccgggaatgggttgctcatcttcaggctggagcaggcattgttgctgacagtagcccggatgatgaacagcgtgaatgcgagaataaggctgccgcattagctcgggctatcgatcttgcggagtcagcttttgtagacaaagaatagtgtgtcaagagaattattttttaattctagctcatgtttgtttacccactttctgttaagaaaggtgccattagtgggtggagaaaagcaataagcatattatgctctcctgcaaatcaaataatctgagaacttttttttaactatagatatgagaactgtggtt

SEQ ID NO: 2136 - protein, 598 aa, Panicum virgatum
  misc_feature: Ceres CLONE 1776560
  misc_feature (3)..(597): SWISSPROT Homolog: EC 4.1.3.27 Anthranilate synthase component I-1, chloroplast precursor
  misc_feature (70)..(596): SWISSPROT Homolog: EC 4.1.3.27 Anthranilate synthase component I-2, chloroplast precursor
MESVAAASSVFSPSRVAAPAAGALVRAGAVAAARRRGRSGGLRCRAVVTPQPSAVASRRAVAEEDKRRFFEAAARGSGKGNLVPMWECIVSDHLTPVLAYRCLVPEDNVDAPSFLFESVEQGPQGTTNVGRYSMVGAHPVMEIVAKEHKVTIMDHEKGQVTEQVVDDPMQVPRSMMEGWHPQQIDDLPESFSGGWVGFFSYDTVRYVEKKKLPFSGAPQDDRNLPDVHLGLYDDVLVFDNVEKKVYVIHWVNVDRYASIEEAYQDGRSRLDLLLSKVHNSNVPTLSPGFVKLHTRQFGTPLNKSTMTSDQYKKAVMQAKEHIMAGDIFQIVLSQRFERRTYANPFEVYRALRIVNPSPYMAYVQARGCVLVASSPEILTRVSKGKIINRPLAGTVRRGKTEKEDQMQEQQLLSDEKQCAEHIMLVDLGRNDVGKVSKSGSVKVEKLMNIERYSHVMHISSTVSGQLDDHLQSWDALRAALPVGTVSGAPKVKAMELIDELEVTRRGPYSGGLGGISFDGDMQIALALRTIVFSTAPSHNTMYSYKAADRRREWVAHLQAGAGIVADSSPDDEQRECENKAAALARAIDLAESAFVDKE

SEQ ID NO: 2137 - DNA, 2138 bp, Panicum virgatum
  misc_feature: Ceres CLONE 1776563
  misc_feature: Encodes the peptide sequence at SEQ ID NO. 2138
aaccaaaccctcccccgtcccctcgcatcccgactcgttcgccgccggcggcaggagcagcagcagccatggcgccggtcgatccccactcctacaccgacggcgcgcacccggtggtatcgcacgccgcgcttgccttctacctcgacttcgccgcctccaccatccacgcctctgcgctgctcaccctctccgcgccgcactccggcgacctcctcctcgacacccgcgcccttgccgtccactccgtctccactgccgccaaaccgccggagcccatccccttctccctcgccgcgacccccgaccccgtcctcggctcggcgctgaccctcaccctgccccccgacaccacctccttccggctcaccttctccacctcccccggcgcctccgcgctgcagtggctggccccgccgcagaccgcctccgggcatcccttcgtcttctcgcagtgccactccatccacgcccgctccatcttcccctgccacgacacccccgccgcgcgcatcaccttctcgctcctcctcaacgtcccctcgcagctctccgccgtcgccgccgcgcgccacgtcgcccaccgggacccgctgccatccgaccaccgcggtgcgtgcgacgacgagctgtggtgcgcacccggccgcatcgttgaggagttccagatggagcagtccgtgccgccctacctcttcgcgtttgccgccggcgggatcgggttcagggacctcggcccgaggacgcgggtgtacgctgagggaggggacaaggtgctggacgaggcggcgagggagtttgccggggtggaggagatggtcaaggtcggggagtcgctgttcggaccgtacgaatgggagaggttcgatctgctcgtgctgcctccgagcttcccttatggaggcatggagaaccccaggatggtgttcctcactcctacagtgatcaaggggaatgctgcaggggctcaggtagtggcgcatgagctcgcgcatagctggactggcaatctgattactaacaagaccaatgaagatttctggctaaatgagggattcacaacatatgctgagaggaggattgttgaggtggtgcaaggggaggagcgggcagcattaaacatgggaattggatggagggggttgaacagaatgatggagaggtttaaggataacatggagttcaccaaattgaagccgaagatggcagggattgaccctgatgatgtgtactctgaagtgccctatgagaaagggttccagttcctttggcgcatcgagcgccagattggccggcctgcttttgacgagttcttaaagaagtacattgccacgtttaagtttcaatcaatagacacagagacatttcttcaattcctgaaaaagaacgtacctgggatagaaaaccaaattgaccttcaactttgggttgaggggactggtatacctcctgatgccatggaaccagattcagctacttacaaaaagatctgcgccttagctgcagaattcaagtcaggaaaacttccaagcgaagatgaggtggcagactggagtgggcgagaatgggagctttacttagaaaatctacccacagatgttgaagcctcacaggttactgctcttgatgagcggtacaagctatctgaaagccgtgactacgaggtcaaagtggcgttcctccagcttgcgattcccaccgggtgcaagtgctacttcaacgaggttgagaaatgcttgaagcaggtgggaaggatgaagtaccttcgcccgctttacagctcactagccaagtgctccagtgaggaaaagatgctagcccagaggatcttctcggaggctcaagaattttaccacccaatagctcgtagtgttgtggaggccattttgtcaaagcatagctaagatagctgctgctgttaagtgaatccatcatccatggcctggttcatggttagggagcaatggaacatctgtttgctcagtcgctctttttgcataaaattatcgcccatccaggagctaacttaggaaaaactggaaaccttgatacttcaacctgataatatgtggactcataacatattattacctaagtactgtatcttttggacttgccaaaaaaaaaaaaaaaaaaaa

SEQ ID NO: 2138 - protein, 611 aa, Panicum virgatum
  misc_feature: Ceres CLONE 1776563
  misc_feature (1)..(383): Pfam Name: Peptidase_M1 Pfam Description: Peptidase family M1
MAPVDPHSYTDGAHPVVSHAALAFYLDFAASTIHASALLTLSAPHSGDLLLDTRALAVHSVSTAAKPPEPIPFSLAATPDPVLGSALTLTLPPDTTSFRLTFSTSPGASALQWLAPPQTASGHPFVFSQCHSIHARSIFPCHDTPAARITFSLLLNVPSQLSAVAAARHVAHRDPLPSDHRGACDDELWCAPGRIVEEFQMEQSVPPYLFAFAAGGIGFRDLGPRTRVYAEGGDKVLDEAAREFAGVEEMVKVGESLFGPYEWERFDLLVLPPSFPYGGMENPRMVFLTPTVIKGNAAGAQVVAHELAHSWTGNLITNKTNEDFWLNEGFTTYAERRIVEVVQGEERAALNMGIGWRGLNRMMERFKDNMEFTKLKPKMAGIDPDDVYSEVPYEKGFQFLWRIERQIGRPAFDEFLKKYIATFKFQSIDTETFLQFLKKNVPGIENQIDLQLWVEGTGIPPDAMEPDSATYKKICALAAEFKSGKLPSEDEVADWSGREWELYLENLPTDVEASQVTALDERYKLSESRDYEVKVAFLQLAIPTGCKCYFNEVEKCLKQVGRMKYLRPLYSSLAKCSSEEKMLAQRIFSEAQEFYHPIARSVVEAILSKHS

SEQ ID NO: 2139 - DNA, 1005 bp, Panicum virgatum
  misc_feature: Ceres CLONE 1776719
  misc_feature: Encodes the peptide sequence at SEQ ID NO. 2140
accaatcccttcttcgcctgcacgccgcctccctccctccctccctcctctccgcccgacgcccgtatttatacgagctgatcccctctcgcttcctccttcctgcttctcgatcggattgggttgggggttctgggtaggtgtggtgtacacgggagttggggcttcttcgttgctttgcttcgctcgtgcgcaagggagagagaagaggaaggagaagtaggcggggaggcagatggcatcgaagcggatcctcaaggagctcaaggacctgcagaaggatcctcccacctcctgcagcgcaggcccagtcgcggaagatatgttccactggcaagcgacgattatgggtccatcagatagcccatactttggcgacgtctttttggtcacaattcacttccctccagactacccattcaaaccgcctaaggttgcattcaagacaaaggtcttccatccgaatatcaacagcaatgggagcatctgtcttgatatcttgaaggaacaatggagcccagcattgacagtttctaaggtactactctcaatttgctcccttttgacggacccaaaccctgatgacccattggttccggagattgctcacatgtacaagagtgatcgggcgaaatatgagtccactgctaggagctggacccagaaatacgcaatgggctgacgttgccggctaccgggaagatgatgacctagcaatatgctcgtgttatgtgcctttgttccagttctaatgtattgccttctgtcgttcgtgcatcgaacaatctctataatggaaggtgaaacattgattgtgttctccccgggtgtgatgcaatttgttgttggcaacttgtttgatggttatgtcactgatgattcacgtgaccgatgcattaggatcttctgctgctggtggcgccggacatggtccgaaattgtcattttcaattccaaattcaatgatttggatttctgctgccggaaaaaaaaaaaaaaaaaaaa

SEQ ID NO: 2140 - protein, 148 aa, Panicum virgatum
  misc_feature: Ceres CLONE 1776719
  misc_feature: Great-hit functional homolog of the protein sequence given in SEQ ID NO 9309
  misc_feature (1)..(148): SWISSPROT Homolog: EC 6.3.2.19 Ubiquitin-conjugating enzyme E2-17 kDa
  misc_feature (1)..(148): SWISSPROT Homolog: EC 6.3.2.19 Ubiquitin-conjugating enzyme E2-17 kDa 10/12
  misc_feature: Useful for biocontainment applications
  misc_feature: The plant produces a reduced number of seeds.
MASKRILKELKDLQKDPPTSCSAGPVAEDMFHWQATIMGPSDSPYFGDVFLVTIHFPPDYPFKPPKVAFKTKVFHPNINSNGSICLDILKEQWSPALTVSKVLLSICSLLTDPNPDDPLVPEIAHMYKSDRAKYESTARSWTQKYAMG

SEQ ID NO: 2141 - DNA, 928 bp, Panicum virgatum
  misc_feature: Ceres CLONE 1776751
  misc_feature: Encodes the peptide sequence at SEQ ID NO. 2142
ccagcaccagcagcaaccaggcgacctctcctctctctctcttgacgccgcagcagtcgtcgcctcgcggacggcggaccaggaggcggcggcggcgtcaatggggcacccctacgcgccggcggagctgcagctgccgggcttcgtgccgctgcagctgtcgcagggccagatcctcgcgccctacctgggcacctcgctgttcgtcctcgtcgccatctggctcatctccgggagatgccggggactatccaagaccgaccgtctgctcatgtgctggtgggcgttcaccggcctcactcacatcgtcatcgaggggaccttcgtcttcgcccccgggttcttcaagaacgagaaccccagctacttcgacgaactttggaaagagtacagcaaaggggattccagatatgtcgccagagacaccgcaaccgtcacagttgaagggataacagctgtgttggaaggccctgcatctctgcttgcagtttatgccattgcatcccgcaagtcctacagccatattctccagttcactgtctgcttgggccagctctacgggtgcttggtttacttcatcaccgcatacttggatggcttcaacttctgggtcagtccattctacttctgggcatatttcattggcgcgaacagtttctggacttggataccaacgctcatcgccatgaggagttggaagaagatttgtgcagcaattcgagcagaaaaggtgaagactaagtaatgctacattagccacggtttggctggaactaaaacgaactgtcatgtggccaaataatttgttgccggtaccaggactgttgtgtttttgtttaaagtctccttgtaaacctcattgtcttggcaactgtggtctttttctccattcaagagcctatctctttcaaaaaaaaaaaaaaaaaaa

SEQ ID NO: 2142 - protein, 214 aa, Panicum virgatum
  misc_feature: Ceres CLONE 1776751
  misc_feature: Great-hit functional homolog of the protein sequence given in SEQ ID NO 9427
  misc_feature: Useful for making plants with altered sterol content
  misc_feature: Useful for making plants with modulated nitrogen use efficiency
MGHPYAPAELQLPGFVPLQLSQGQILAPYLGTSLFVLVAIWLISGRCRGLSKTDRLLMCWWAFTGLTHIVIEGTFVFAPGFFKNENPSYFDELWKEYSKGDSRYVARDTATVTVEGITAVLEGPASLLAVYAIASRKSYSHILQFTVCLGQLYGCLVYFITAYLDGFNFWVSPFYFWAYFIGANSFWTWIPTLIAMRSWKKICAAIRAEKVKTK

SEQ ID NO: 2143 - DNA, 808 bp, Panicum virgatum
  misc_feature: Ceres CLONE 1776896
  misc_feature: Encodes the peptide sequence at SEQ ID NO. 2144
accagcacttgcttgtcattcccaagcaaacgcattcatccagcaccggccgcactcagctcgtcaagctaagttcacattcacgcacaatccaaggattccaagcaatggctcgcgctcatcaggtggtggctatcgccgtcgttgccgccgtcgtgctgctcgccgccgcggcgacgaccaccgaggccgccgtgacctgcgggcaggtgagctcggccatcagcccctgcatcgcctacgcccgcggcaccggctccggcccctccgcagcctgctgcagcggcgtgaggagcctcaactcggcggccaggagcaccgccgacaggcgcgccgcatgcaactgcctcaagtccgccgccggcagggtgagtggcctcaaccttggaaacgccgcaagcatcccgtccaagtgcggagtcagcatcccctacaccatcagcccaaacgtcgactgctccagggtgagctaaacgacgaccagtaccgtcgctacctatctacttaattatcgtctatgatcgagttcgacgatgatgaataaaaatctctccgccgtcgcgtgcactgtcgtcatgcgctagctcagctcgcgttgtacgtcgtcgctcagcatgtgatgagcgatcgagagacggagtcctctccgatccttgtgtccttttgcatgcttcgtacgttttgcatctgcatctgcatagtagtgtgtcctccatttccgtttggaggagacccactctgtaccttgtccactataccttttaatacatcatacaccacttttttgcaaaaaaaaaaaaaaaaaaaa

SEQ ID NO: 2144 - protein, 121 aa, Panicum virgatum
  misc_feature: Ceres CLONE 1776896
  misc_feature (1)..(85): Pfam Name: Tryp_alpha_amyl Pfam Description: Protease inhibitor/seed storage/LTP family
MARAHQVVAIAVVAAVVLLAAAATTTEAAVTCGQVSSAISPCIAYARGTGSGPSAACCSGVRSLNSAARSTADRRAACNCLKSAAGRVSGLNLGNAASIPSKCGVSIPYTISPNVDCSRVS

SEQ ID NO: 2145 - DNA, 750 bp, Panicum virgatum
  misc_feature: Ceres CLONE 1776906
  misc_feature: Encodes the peptide sequence at SEQ ID NO. 2146
aaaccaaacaaacaccctccacctccagctcctttgcccccaaggccccaatcgaatcgaaggctcccgagacctagcgcgatgtccgccatggagaccgacatcaacgcgccgccgccgcccgcacccgccggcgagggctcctccgcggccggcccgtcctcatcctcctcccgcaagcccaacaagcgcttcgagatcaagaagtggaacgccgtcgcgctctgggcatgggatatcgtcgtcgataactgcgccatctgccgcaaccacatcatggatctatgcatcgagtgccaggcgaaccaggccagcgccaccagcgaggagtgcactgtcgcttggggtgtctgtaatcatgcttttcacttccactgcatcagcaggtggcttaagactcgccaagtgtgcccattagacaacagtgagtgggagttccagaaatatggccactagagcctgggtcacccgcatgtgccgttggagcttgtttctggctactgctgctgcaatctaagtgttttgtctgccaaacagctcgttcttttgctgctttcaatgcctgcatctatcgcccgtcaattatcactggtagtgcgtccatcctgggcttgtatttggatgattcattgaggaccatattatagtagttccttatcaatgttatgtggatctgcataagtgagcttgaattgtgctgtggtacatttctaaagtctggtgcttttacaaaaaaaaaaaaaaaaaaaa

SEQ ID NO: 2146 - protein, 124 aa, Panicum virgatum; identical to SEQ ID NO: 82
  misc_feature: Ceres CLONE 1776906
  misc_feature (1)..(56): Pfam Name: zf-C3HC4 Pfam Description: Zinc finger, C3HC4 type (RING finger)

SEQ ID NO: 2147 - DNA, 734 bp, Panicum virgatum
  misc_feature: Ceres CLONE 1776948
  misc_feature: Encodes the peptide sequence at SEQ ID NO. 2148
acaccgcaaaccagccaatcacaggccatcttcttcttcttctcgtacgagtagtgaccgagggagagagcaggcagcagcaggcatggctggaccgaggctcgcgacgctggcgctggccgtgctcctggcggcggccgtggcggctcccccggcggcggtgcgcgcggccatttcgtgcagcaccgtgtacaacaccctgatgccgtgcctgccgtacgtgcagatgggcggcgcgatgcccccgcagccgtgctgcggcggcatccgcagcctgctggcgcaggccaacaacacccccgaccgccgcgccatctgcggatgcctcaagaacgtcgccaacggcgcctccggcgggccctacgtcacccgcgccgccgcgctgcccagcaagtgtggcgtctccctgccctacaagatcagcaccgacgtcaactgcaacacgattaactgaggcgtccggtgcgaggaaattcatggcggagaataaataaaatgatgctagtatttaagaagatagaacggatggactagtggatcgaggtgtgcttgtctctagtcttcgtcgttgatggtgtttaggaatcgtctgaagaagtcccccctcctggtgcgtcgtggatgttcccgcgagcagattagtcatgaacctgcgtgtgtgcttctgtgtaccatggctatgtatttcctcgtcaaagtacctattgttgcagtaaaaaaaaaaaaaaaaaaaa

SEQ ID NO: 2148 - protein, 122 aa, Panicum virgatum
  misc_feature: Ceres CLONE 1776948
  misc_feature (1)..(86): Pfam Name: Tryp_alpha_amyl Pfam Description: Protease inhibitor/seed storage/LTP family
MAGPRLATLALAVLLAAAVAAPPAAVRAAISCSTVYNTLMPCLPYVQMGGAMPPQPCCGGIRSLLAQANNTPDRRAICGCLKNVANGASGGPYVTRAAALPSKCGVSLPYKISTDVNCNTIN

SEQ ID NO: 2149 - DNA, 1693 bp, Panicum virgatum
  misc_feature: Ceres CLONE 1776961
  misc_feature: Encodes the peptide sequence at SEQ ID NO. 2150
gcaacccatttcctctcccttcgctcccccagcggccgccgctcgccacgcggtcggcccgtgcgccgcgccgccgccctccacgctcccctgcccagctgcaggtcgagtccggctggtgcggcagcaccctcccttcccacgacttctctgttctttctctcggcctctgtcttccttcctagcggcgacgaccgggcgagttgcgctgcccgttgttcgtcaagggacgggcacttcgccggcgacgaatatcagacaggggtatgcctgcctattcccctcccttcccatcctgctgcgcgaaatcaaacgcccaaacccctaacatatggtatttgtattcggatctgaccatgatttgtattcggatctgaccatgtcctatactggttccgcccctgcccatgccccacgttaaggccgtcactgctaccttgggtgccagtgcaatgcccggcggatcttcagctgctgatggtgaagtggaggcaggatttgcaaagctccagggcgaagatttcgagtactacatgcagacatattcaatcatgctgggccgcaacagcaagaagtcgacagtggatgtggatctctcgagcctcggcgggggtatgaacatctcccgccaccatgcccggatattctacgatttccagcgtcgtcggtttgccctcgatgttattggcaagaatggatgccttgttgagggtgttctgcacctccctggaaacccacctgttaagcttgattcgcaggatctgctgcagattggggacaaaaagttttactttctgctgccaacgcgatctatctttgcctcagctgctgctgctcgacatgctcccattattcctccaccgctcccaccaccatcatatgcacgtccaggccgccctcgtttgtctgattttcacgaccgctcctttgaaggtgattatggcagggaagtggatgacattgggactggtatcagtgaaagtggggtgaggggaaagttgataaagagaaacaagaagtcctctggagagttggacatctatggtgggcaccgaatcaatgttgaagcaataggaaccctaggtgaagacagtagatcagaaataagatcaaggggtgacagggatattgacaatcaacaaatccttcaagcagaagagaaggaagtcgtgtcatctgttgccacagtgttatctgacctctgcggtcctggagaatggatgcccatggcaaaactccatacagagcttcttgaacagtttggcaacgtgtggcaccccagcagggtccgaaagtacctaacaacagatgactggtcaccaacggagacgaagggcaggccttggtttggccttctggccctgctcagaaagtacccagagcattttgtcatcaacacaagatcgaaaggcagagtgacttcgaagtttgtttcgctggtctccttgctctcctagaggggaaacgaggggggctagctgtcctgccgaggaaataacaggcgtttcagtctgttcagaagggtaggaggtgtctctctcatttgcctcttctgttttgaaccctacgtatggtatcaactgtgtttgaacagccgtaatgactggatcattatcatctctgtactgttgacttgtatatgtactatggaagcatgagttttaaccaatgctaaaaaaaaaaaaaaaaaaaa

SEQ ID NO: 2150 - protein, 349 aa, Panicum virgatum
  misc_feature: Ceres CLONE 1776961
  misc_feature: Great-hit functional homolog of the protein sequence given in SEQ ID NO 9440
  misc_feature: Great-hit functional homolog of the protein sequence given in SEQ ID NO 9615
  misc_feature: Useful for making plants with altered Lignin content
  misc_feature: Useful for making plants with altered alkaloid content
MPHVKAVTATLGASAMPGGSSAADGEVEAGFAKLQGEDFEYYMQTYSIMLGRNSKKSTVDVDLSSLGGGMNISRHHARIFYDFQRRRFALDVIGKNGCLVEGVLHLPGNPPVKLDSQDLLQIGDKKFYFLLPTRSIFASAAAARHAPIIPPPLPPPSYARPGRPRLSDFHDRSFEGDYGREVDDIGTGISESGVRGKLIKRNKKSSGELDIYGGHRINVEAIGTLGEDSRSEIRSRGDRDIDNQQILQAEEKEVVSSVATVLSDLCGPGEWMPMAKLHTELLEQFGNVWHPSRVRKYLTTDDWSPTETKGRPWFGLLALLRKYPEHFVINTRSKGRVTSKFVSLVSLLS

SEQ ID NO: 2151 - DNA, 1851 bp, Panicum virgatum
  misc_feature: Ceres CLONE 1776965
  misc_feature: Encodes the peptide sequence at SEQ ID NO. 2152
cccgaacccagaggcaaaaccccccacctcccgagcactgctcccaatttcctctcgccgcctgccttccctccctccggcgccatgatggccgctcgcctccgcgtcgcactgctgctctcggtctgcctgtgcgccgcgcgggcgcggcccaacctcgagccgaccatccgcctcccgtcggagcgcgcggcggcgggggcggccgaggaggggacggacgacgccgtcgggacccggtgggccgtgctcatcgccggctccaacggctactacaactaccgccaccaggcggacatctgccatgcctaccagatcatgaaaaagggcggactcaaggacgaaaacatcatcgtcttcatgtacgacgatatcgctcacagcccggaaaatccgaggcctggtgtcatcatcaaccatccccagggtggcgatgtctatgctggggttccaaaggattacactgggagggaggtcaatgtcaacaatttcttcgctgttctgcttggcaacaaaacagctgtcagtggtgggagcggcaaggttgtgaacagtggccccaatgatcatatttttgtttactacagtgaccatgggggtcccggtgtccttgggatgcctacctacccatacctctacggtgatgacctcgtaaatgttctgaagaagaagcatgctgcggggacgtacaaaagcctggtcttttaccttgaagcatgtgaatctgggagcatatttgagggtctcctgccgaacgacatcaatgtgtacgctaccactgcttcaaatgcagacgagagcagctggggaacttactgccctggcgagcaccctagccctccgccagagtatgacacctgcttgggagacttgtatagtattgcttggatggaagacagtgatttccacaatttgcgaactgagtctctcaagcagcaatacaatttggtcaaggataggacatcggctcacaatacttacacctatggttcccatgtgatgcaatacggctcactgaacctgaatgtgcaacatttatcttcgtacattggcacaaaccctgctaacgatggcaacaagtttgtggaaggcaattccttgccatcattcacaagagctgttaatcagcgtgatgctgatcttgtttacttctggcagaagtaccggaaattggctgagggctcacctgggaaaaatgatgcccggaaggaattacttgaagtgatggcccaccgatctcatgttgacaacagtgttgagctgattggaagccttctctttggctcagaggatggtccaagggttctgaaggctgttcgtgcagctggtgatcctttggttgatgactggagctgcctcaagtccatggttcgtgcatttgaggcgcagtgtgggtcgttggcgcagtatggaatgaagcacatgaggtcctttgcaaacatctgcaatgccggcatccttcctgaagcagtgttgaaggtcgctgctcaggcttgcaccagcattccttccaacccctggagctccatccacaaggggattagtgcctaaatgatgcacaggtgaagcaaaatatttcagccgctccatcataccaaactacattatagtcctcaggggtgttagtgcttgaaccataggtgaagcagacttatgccattattctgttccaccgcatcaggttaccatagttatgcccgatttccggtgtacatacatagtcggaaagttgtttggcaatataatttctcgttgttgtacatattcccgatagcttgttagcagatgtgtgtaacttgtacttccaattaatgatgaacacattgctaccaaaaaaaaaaaaaaaaaaaa

SEQ ID NO: 2152 - protein, 488 aa, Panicum virgatum
  misc_feature: Ceres CLONE 1776965
  misc_feature (4)..(424): Pfam Name: Peptidase_C13 Pfam Description: Peptidase C13 family
  misc_feature (10)..(471): SWISSPROT Homolog: EC 3.4.22.34 Legumain precursor
MMAARLRVALLLSVCLCAARARPNLEPTIRLPSERAAAGAAEEGTDDAVGTRWAVLIAGSNGYYNYRHQADICHAYQIMKKGGLKDENIIVFMYDDIAHSPENPRPGVIINHPQGGDVYAGVPKDYTGREVNVNNFFAVLLGNKTAVSGGSGKVVNSGPNDHIFVYYSDHGGPGVLGMPTYPYLYGDDLVNVLKKKHAAGTYKSLVFYLEACESGSIFEGLLPNDINVYATTASNADESSWGTYCPGEHPSPPPEYDTCLGDLYSIAWMEDSDFHNLRTESLKQQYNLVKDRTSAHNTYTYGSHVMQYGSLNLNVQHLSSYIGTNPANDGNKFVEGNSLPSFTRAVNQRDADLVYFWQKYRKLAEGSPGKNDARKELLEVMAHRSHVDNSVELIGSLLFGSEDGPRVLKAVRAAGDPLVDDWSCLKSMVRAFEAQCGSLAQYGMKHMRSFANICNAGILPEAVLKVAAQACTSIPSNPWSSIHKGISA

SEQ ID NO: 2153 - DNA, 1748 bp, Panicum virgatum
  misc_feature: Ceres CLONE 1776978
  misc_feature: Encodes the peptide sequence at SEQ ID NO. 2154
gtgccatccagaacggcgctcttcatcagagccaatagaacacgctgctgtctgccatggaagccgggaggggcaaaaggacacacgtataatcctcctgtacgttcggggtccggccagagaggcggaaaagcagaaccgtgttctatgcttccaaggtccctgggatcagcggcgcggcgcctgggcctggtcgcggcggctcccgccacagcccccgcgcgcgcgtcctcggcttccgcggcgcggcggccgtgcccgccgtccgacggcgacgaggccggggaggatgatgagcctctacctcttcggacgccccacgggccgccggcgccggaggagcggcggtggcctcgccgcggagagcagcgtcggagagaattctcatttatcacaacagccgccaaagatcattctgtcttgacccggcagcttctagattcgcgacatgatacagtagacgaggtaggtacagaacatgatccgttcattgagttgaaagcgaggttcatggacttcaaacagcgaaactatgtggaaaatttttcaaattaccaaagtttggcgcaacagcaaacaccaaagttcatggtgattgcttgtgctgactccagggtctgccctaccagtattttggggtttcagcctggggaagcatttacagttcgtaatgtggcaaatttggtaccaccatatgagcatgggggttcagagactagtgcagcactagagtttgctgtcaatacactccaggtagaaaatgtattggtggtaggtcacagccgatgtggtggcatccaggcactaatgagtatgaaagatgactcgacctctggaagctttattaagaactgggtttccatcgggaagagcgcaaggttaagcacaaaagctgcagctggaaacttgaattttgaaatgcaatgcacacattgtgaaaaggaatcaataaatagctctcttttgaacttgttaacatacccatggatagagaaaagggtgaatgaaggtactctgaaccttcatggaggctactacaactttgtagattgcacatttgaaaaatggacattagtgtaccgtgaaggactcaatggcggaagcaagtatgctataaagaacaggtcatcctggtcttgaccaatgaaggccttatttacttgggtaaatttcactctgccccctgcagttcagcatggttttgctttgccgctacgttgttcatttccattgcaccttgctccgttgtggtattgatgttctgccgaagggagtccctgtatcaaggaattgttacatggatggctgttgacgtcgcccattgtcatgcatggcactgtggccactagcatgatacgcttgaactgtatgttgcattgcagacgaatatagatgcatccacattgtggcagttatttgatacagagacttgcgaccctagacaaaaccacaatggagtgaggtgcaacacaatgaacaatattaatgtggtagcaaagtgaaagtctgtcgaactgctggggacgaagtgaatcttttccaacaatttgtatgttgttttctgtttgaaaacattgagttatgaataagctgcaaggtcgatcatagcacaaatgcatgtatagtcatcgccacatttggcgttaccgtgtgttattgtaacatttttaccatttgttgtatcattgtaactgggagatatatagcatctgtatctgttactctgttaaaaaaaaaaaaaaaaaaaa

SEQ ID NO: 2154 - protein, 330 aa, Panicum virgatum
  misc_feature: Ceres CLONE 1776978
  misc_feature (1)..(171): Pfam Name: Pro_CA Pfam Description: Carbonic anhydrase
MLPRSLGSAARRLGLVAAAPATAPARASSASAARRPCPPSDGDEAGEDDEPLPLRTPHGPPAPEERRWPRRGEQRRREFSFITTAAKDHSVLTRQLLDSRHDTVDEVGTEHDPFIELKARFMDFKQRNYVENFSNYQSLAQQQTPKFMVIACADSRVCPTSILGFQPGEAFTVRNVANLVPPYEHGGSETSAALEFAVNTLQVENVLVVGHSRCGGIQALMSMKDDSTSGSFIKNWVSIGKSARLSTKAAAGNLNFEMQCTHCEKESINSSLLNLLTYPWIEKRVNEGTLNLHGGYYNFVDCTFEKWTLVYREGLNGGSKYAIKNRSSWS

SEQ ID NO: 2155 - DNA, 1784 bp, Panicum virgatum
  misc_feature: Ceres CLONE 1776992
  misc_feature: Encodes the peptide sequence at SEQ ID NO. 2156
agagagagagagagagagagcgaactcgagcaaggttgtagggaggctgccgacggccatggcggcgcggctgctacggagaacgctgcgagcaaccgaggtagcacttcgatttctatctgcttctcatggtttggtacagcgagctgcatacacatctggaggaatagtcgatattggccaaccgacgccccagtcacaccctgagttattagctgatggagagatcacaccaggcatcacgaatgaggagtacatatctagaagaaaaaagcttttggaggtgctgccagagaagagcttggccattattgcctctgctgagcagcagatgatgaccgatgtagtgccatatccattcagacagaatggtgattacttgtacattactggctgtacgcaacctggtggcatagcagttttgagtgaagaaactggactatgcatgttcacgcctgataaaaataaggaggatgtagtttggcaaggtcaaactgctggagttgacgcagctgtggaattctttaaagcggataaagcatttccactgagtcagatgcaaaagatccttcctgaaatgatcgagcgatcaaagggggtatatcacaatgtaaagacatcatcatcttcttacaagaacttggatgccttccgtcgggcatcactcaacaataaagtaaaagatcttacatattacactgatgaattacggtggatcaagtcaaaatctgaaattaagctgatgagggaatcagcatctattgtttctcagtctcttttacaaacaatgttggtatcgaggacccacagggaggaaagccagctggcagctaagattgaatatgagtgcaaaatgagaggtgcccaaagaatggcgttccatcctgtagttggtgaaggtgcaaatgccagtgttatacactactcaagaaacgatagaaaaatcaaaacaggtgatcttcttctcatggatgttggctgcgagtatcatggctaccttagcgacctgactcggacatggccaccctgtggcagattttcgcctgctcaggaagagctgtacagcctaatactggagacgaataaggagtgcataaagctctgtaaaccaggtgccagcataaacgagatacacaatcattcagtgaagctgctgataaagggattccaagagctgggggtcctggagaaggggaaatccatccaatacaactacctgaacccgaccgcgataggtcactcgttaggcatggacattcatgactcggtgacactccccaaggacaagcccttggagcccggcgtcgtgatgacgatcgagcccggggtgtacatcccggcgtccccggtcctgaacgagcgcgcgccggagcggttccgcagcgtcgggatccgcatcgaggacgaggtcctcgtcaccgaggacggtcacgaggtgctgacggcgtcggtgcccaaggagatcccgcacctgaccaccctgatgagcatgggcggggaggccgcggcggacgggcatgaactgcgcgcagcctcgagcggctgatcgatcgcgggggcgcgtcggcgacgggcgtgcccatgctgccagcatcgccgccgccgcggcacgttggcattcatgggtgccggagctcggccatgctccggagcggacgggtgcccgctgcgtgcactgatgctgtctgtatggttcacgggggccatcaagtgttaacagcctgctcgtcttttttctcgtacatccaaattctttttttttctaaaaaaaaaaaaaaaaaaaa

SEQ ID NO: 2156 - protein, 495 aa, Panicum virgatum
  misc_feature: Ceres CLONE 1776992
  misc_feature (2)..(237): Pfam Name: Peptidase_M24 Pfam Description: metallopeptidase family M24
MAARLLRRTLRATEVALRFLSASHGLVQRAAYTSGGIVDIGQPTPQSHPELLADGEITPGITNEEYISRRKKLLEVLPEKSLAIIASAEQQMMTDVVPYPFRQNGDYLYITGCTQPGGIAVLSEETGLCMFTPDKNKEDVVWQGQTAGVDAAVEFFKADKAFPLSQMQKILPEMIERSKGVYHNVKTSSSSYKNLDAFRRASLNNKVKDLTYYTDELRWIKSKSEIKLMRESASIVSQSLLQTMLVSRTHREESQLAAKIEYECKMRGAQRMAFHPVVGEGANASVIHYSRNDRKIKTGDLLLMDVGCEYHGYLSDLTRTWPPCGRFSPAQEELYSLILETNKECIKLCKPGASINEIHNHSVKLLIKGFQELGVLEKGKSIQYNYLNPTAIGHSLGMDIHDSVTLPKDKPLEPGVVMTIEPGVYIPASPVLNERAPERFRSVGIRIEDEVLVTEDGHEVLTASVPKEIPHLTTLMSMGGEAAADGHELRAASSG

SEQ ID NO: 2157 - DNA, 1296 bp, Panicum virgatum
  misc_feature: Ceres CLONE 1776993
  misc_feature: Encodes the peptide sequence at SEQ ID NO. 2158
aatccctctccaccctccggctcgccgcgccgcctccgccgcctccgccgggatggccgcgcgcagcccctacttcgccgccgaggagtccgcccgcggcatccgcccgggggagtccccggctgcggcgctccgccggatcctcgccacgcccggcgcgcaccaggcgccctgctgcttcgacgcgctcggcgcgcgcctcgtcgagcgcgccggattccccgtcggcttcatgggcggtttctgtgtttctgcggcacggcttgccttgcctgatgttggcctcatctcctatggagaaatggtagaccaagggcgtctaatcaatgaagctgtgtcgatcccagtgattggtgatggagataatggttacggaaactctatgaacatcaagagaaccatcaaagggtatatgaatgctggttttgctggaatcatgcttgaagaccaggtggcacctaaagcatgcggacatactgaaggaaggaaagtcatctcaagggaggaagccatcatgcacataaaagctgctgttgatgctaggaaggagagtgcctctgacattgttattgtggcaaggacagattcccgtcaagccatttcacttgatgaagcattatggagagtaaaagcttttgctgatgccggtgctgatgttctgtttattgatgcccttgcttcagtggaagagatgaaggcattctgcgcagttgcaccagaagttccaaagatggcaaacatgttagaaggtggtggtaaaactccaatattgagccctgcagaacttgagaaaattggcttcagcctcgtggtttatccgttatccttagttggcgtatcaatgcgtgcaatgcaggatgctttagttgcaataaaagatggaggtgtacctccccctagcgcgttgccatcttttcaggagatcaaggatactctagggttcaaccgctactacaaagaagagaaacaatatcaagtggacaagtgaaagatgccacagctctagagccgcagatcgacagtaatctatcatagtttggcggttgcggattctattggatatgctatcaaggtgcccatggcttaagtaccaccagagatttatgtcaaagctgtaaccgtagctgcatagtttaacatatgtcggagacttaatatctgggtggcttgtagtcttttcttttgctgtttttcgttggctaccctgttgtggtctcaattatcctgaatttgtggttccaatttcaataaaacaggcctactgggatgtggatacaaaaaaaaaaaaaaaaaaaa

SEQ ID NO: 2158 - protein, 311 aa, Panicum virgatum
  misc_feature: Ceres CLONE 1776993
  misc_feature (1)..(83): Pfam Name: ICL Pfam Description: Isocitrate lyase family
MAARSPYFAAEESARGIRPGESPAAALRRILATPGAHQAPCCFDALGARLVERAGFPVGFMGGFCVSAARLALPDVGLISYGEMVDQGRLINEAVSIPVIGDGDNGYGNSMNIKRTIKGYMNAGFAGIMLEDQVAPKACGHTEGRKVISREEAIMHIKAAVDARKESASDIVIVARTDSRQAISLDEALWRVKAFADAGADVLFIDALASVEEMKAFCAVAPEVPKMANMLEGGGKTPILSPAELEKIGFSLVVYPLSLVGVSMRAMQDALVAIKDGGVPPPSALPSFQEIKDTLGFNRYYKEEKQYQVDK

SEQ ID NO: 2159 - DNA, 1641 bp, Panicum virgatum
  misc_feature: Ceres CLONE 1776995
  misc_feature: Encodes the peptide sequence at SEQ ID NO. 2160
acaaaagctcgagtgcataggagaatgaggaggcttcgtggagctcttgctctgctgctgctcctctgcatccatggcggccgtcaaggagcagaggccgggcgggacgggttcgtgagggtccagggcacccacttcgtgctgaacggcaacccgttcttcgctaacggattcaacgcctattggctcatgtccttcggcgccgaccccgcccggaggggcaaggtcacctccgcgctgggccaggccgccgccgccgggctctccgtggccaggacgtgggcgttcagcgacggcggcagcaatgccctgcagtactcccccggccgctacaacgagaacaccttccaggggttggatttcgtgctgtctgaggccaggaagcatgggattaagatgatactgagcctcgtgaacagctacgacagctttggagggaggaagcagtacgtgcagtgggcaagagagcaggggcagagcattggatctgacgatgagttcttcactaaccctgttgtcaagggcttctacaaaaaccatatcaaaactgtgctgacgcgggtgaacacgatcacgggcgtggcgtacaaggacgacccgacgatcatggcgtgggagctgatgaacgagccccggtgccagtcggacctctccggccggaccctccagtcgtggatcgctgagatggcggcgcacgtcaagtccatcgacgctgcccacctgctggaggccggcctggagggcttctacggcgcgtcgacgccgtcccgcgccgccgccgcgaacccgtcggggtaccagctgggcaccgacttcgtcgccaacaaccgggcgcccgggatcgacttcgccaccgtgcacgcgtacccggaccagtggctgcccggcctcgacgcgccgtcgcagctccggttcctgggcgcctggctcgacgcccacgtcgccgacgcgcgggacgcgctgcggaagccgctgctggtggcggagttcggcaggtcgcgccgggaccccgggtacagcggcgaccagcgggacgcggtgttcggcacggtgtacggcaaggtctacgagtcggcgcgcgccggcgggcccgcggcgggggcgctcttctggcagctgctggcggaggggatggaatcgtacggggacggctacgaggtggtgctgggtcaggcgtcgtccaccgccggcgtcatcgcgacgcagagccggaggctgcaggggctcgccagggcgttcgcgcgcgcgcgcaagccaaagcagggacagacgggccagggcggcaactgaaggcgatggacagctgctaataacgttaatgtcagggtgatttgcagcaggaatgctttttctctctctctctctcatacgtttgggttttgtgtgtgtgtgtgtggtgagctaaaagggtgtgtgcgcgtcgatgtctcgagatgatttgaagattcatccgggaggcgggagcgaagtggcgtcctcctccgtgtcttagagggcatgcttttaagtgttcttgtggatcacgagaggagcgaagttatggtgcaaggctgtggaagaagcagcctgtgttagtaaggttgtcatttgtttatgatttgtatgaagggatctttggtccaaaaaaaaaaaaaaaaaaaa

SEQ ID NO: 2160 - protein, 421 aa, Panicum virgatum
  misc_feature: Ceres CLONE 1776995
  misc_feature (1)..(340): Pfam Name: Cellulase Pfam Description: Cellulase (glycosyl hydrolase family 5)
  misc_feature (3)..(420): SWISSPROT Homolog: EC 3.2.1.78 Mannan endo-1,4-beta-mannosidase 1 precursor
  misc_feature (8)..(421): SWISSPROT Homolog: EC 3.2.1.78 Mannan endo-1,4-beta-mannosidase 7 precursor
MRRLRGALALLLLLCIHGGRQGAEAGRDGFVRVQGTHFVLNGNPFFANGFNAYWLMSFGADPARRGKVTSALGQAAAAGLSVARTWAFSDGGSNALQYSPGRYNENTFQGLDFVLSEARKHGIKMILSLVNSYDSFGGRKQYVQWAREQGQSIGSDDEFFTNPVVKGFYKNHIKTVLTRVNTITGVAYKDDPTIMAWELMNEPRCQSDLSGRTLQSWIAEMAAHVKSIDAAHLLEAGLEGFYGASTPSRAAAANPSGYQLGTDFVANNRAPGIDFATVHAYPDQWLPGLDAPSQLRFLGAWLDAHVADARDALRKPLLVAEFGRSRRDPGYSGDQRDAVFGTVYGKVYESARAGGPAAGALFWQLLAEGMESYGDGYEVVLGQASSTAGVIATQSRRLQGLARAFARARKPKQGQTGQGGN

SEQ ID NO: 2161 - DNA, 2167 bp, Panicum virgatum
  misc_feature: Ceres CLONE 1777002
  misc_feature: Encodes the peptide sequence at SEQ ID NO. 2162
gctgctctctctctctgcttttgcctcagcctgctgcaagcttttgctttggtttaggtgcttcttttccactcctttactgttcccccacttttgcttgctttgtcacgcacacgaaaagctcctgcctttaccttctcggaccttatctccgctcccgtagtgggatttggtgggagctgcgctgcttgcccctcgcgtttctttgctcaattggggtcgcagctcgcgggtgcgcgtgctcgtgctcggaattcgggttctttgggtggggattgcgcggtaccttgggcgattgcggacgctcgctgcagatctttgcgcaattccggcgagacggagatgaactgtgggccgcccgaccagctgccgccggcgtcggcgccgtcgtgcttcctcaacctcaactgggaccagtccatggccgccgccgctgccggtgaccacctcgacccggcgctcagctcgatggtctcctccccggcgtccaactcgacggccgccgcggcgattgatggcctcgctctgcacgggatctcgccgcagccgcagtacggcggcacgcctctcagctcaccccctaagctcaacctctccatgatgggccagttccaccactaccagccgccgcaagtcggtggcgccggacccggcggcttgccaatcctggagaacttgatgccgatgggccacctggaccagttcctcgccgaccccggcttcgccgagcgcgcggcgaggctttccggctttgatggccgccccggtggaagcgactatggcggcgccgtgccgggacagttcggcctcccggacgccggccccgtcggtgcattgaaggagctggagctcgggaacggccgggatgagtcatcggtgtccgatccggcgtcggccagcgcggagatggcgttgaaaggtccttccgacggcaatgcaaagaagcggaaggccagcgggaaggggaaaggcaaggacggccccgggtccaccgccgcaaaggatcccgccaaggaggaatccagtgggaagcggtgcaaatcggcggacgagagcaatggcgcggaggacaactccggcaaggggaaggccgcgcagagcaacagcgagaatggtggcaagaagcagggaaaggacacatcgaagccccccgagccgcccaaggactatatccatgtccgggcgaggcgcggtgaggcgacagacagccacagccttgctgagagggtgagaagggaaaagatcagccagaggatgaagctgctgcaggatcttgtacccggttgcaacaaggtggttggcaaggcagtcatgctcgatgaaatcataaactatgtgcagtccttgcaacggcaagtcgagttcctgtccatgaaattggctactgtgaatccccagctggacttcaacaatttgcctaacctccttcctaaagatatacaccagtcctgcggcccgatgcagagctcgcattttccactggagacctcaggtgcaccgctgccataccttaaccagtctcaccaggggagccctctaggttgcagcctaaccaatggcatggacaaccaaagtaatatgcacccacttgacccggcattttgccggcagatgaattctcaacatccttttctcaacggagttagcgatgcggcctcgcaggttgggactttctggcaagatgatcttcaaagtgttgttcatatggatatcggccaaggtcaggagattgcggccacctcttcgaacagctacaatggttcgttgcaaacagtccacatgaaaatggagctttgacatagctgaaattcagtccaaagcttgacgcctgtgtatataaagacgagagatcagcttgcagcggaagcactctgagattcaacctaacaacgttgggccctagcagtgttttagcttctaattttcctcttggtgtaatcattctttgaacaaaatgtgaagagcaccatgcatgacggttagttacgcctttgcttgtttagctgcaatatcgcacgcaacgaaatgcggtgcctgccgtacatgctcaatcagacccttatcctctcaagcgagagggaagacctgtaatatcatttgtattgccattatatttgtagctgataaatataaatatttaagatcccaaaaaaaaaaaaaaaaaaaa

SEQ ID NO: 2162 - protein, 484 aa, Panicum virgatum
  misc_feature: Ceres CLONE 1777002
  misc_feature (1)..(51): Pfam Name: HLH Pfam Description: Helix-loop-helix DNA-binding domain
MNCGPPDQLPPASAPSCFLNLNWDQSMAAAAAGDHLDPALSSMVSSPASNSTAAAAIDGLALHGISPQPQYGGTPLSSPPKLNLSMMGQFHHYQPPQVGGAGPGGLPILENLMPMGHLDQFLADPGFAERAARLSGFDGRPGGSDYGGAVPGQFGLPDAGPVGALKELELGNGRDESSVSDPASASAEMALKGPSDGNAKKRKASGKGKGKDGPGSTAAKDPAKEESSGKRCKSADESNGAEDNSGKGKAAQSNSENGGKKQGKDTSKPPEPPKDYIHVRARRGEATDSHSLAERVRREKISQRMKLLQDLVPGCNKVVGKAVMLDEIINYVQSLQRQVEFLSMKLATVNPQLDFNNLPNLLPKDIHQSCGPMQSSHFPLETSGAPLPYLNQSHQGSPLGCSLTNGMDNQSNMHPLDPAFCRQMNSQHPFLNGVSDAASQVGTFWQDDLQSVVHMDIGQGQEIAATSSNSYNGSLQTVHMKMEL

SEQ ID NO: 2163 - DNA, 1962 bp, Panicum virgatum
  misc_feature: Ceres CLONE 1777012
  misc_feature: Encodes the peptide sequence at SEQ ID NO. 2164
cagccgcggccgcacctaccccgcgtccctaatcagcccccaacccccgacgtcgccggaggcttcgccggagcagcgtcgacggttgcctaatcacgaggagcatggcctcgcttgcgcctccgtcttcctccgtctccgccatcacccaccagccggcgcggttcttgaaagggtgccgtgtcaccaaagagacaaagggctcggtttgcaacctcctcactccaaattcaaataatgccaaagtaaaatcagtgggcttgagaatatcatcatccttgaaaagggatggtggctatccagccggtggtgcctctgggaacggcgacatacgtggccaggaccattcgtttgctgaccctttgctcccaacagattccatggttgcgccagaaatcctctctgctaatctggcacgtgttgcagacaagttcgcagatgaagacatggacactgaacttgatttggatagcccgacagagggcttcacatctattgccgatgccattgaggatatacgacaaggaaaacctgtgattgttgttgatgacgagtcaagggaaaatgaaggagaccttataatggctgcttccttggttacctcagaggctatggcttttatagtaaagcatgggactggaattgtgtgtgtcagcatgaaagaagaagatctggaaagactgaaccttccattgatggttaccgcgaaagaaaatgaggagaagctatgcactgctttcactgtcacagtggatgcgaaagagagcacaacaactggggtatctgccaaggacagggcaaaaacagtcatgactcttgcatctcctgactctaagcctgaggatttcaatcgccctggtcatattttccctttgaaatacagagaaggaggtgttctgaaacgagctggacacaccgaggcttctgttgaccttgccatgctggctggattacctcctgttgccgtcctttgtgagattgtggatgatgcagatggctccatggctcgcataccaaaactacgtgtgtttgctgaaagggagaatttgaagattatatctattgctgacttgattagatataggaggaaaagtgacaggctaattgaacgtgcttctgttgcacgcttgcctttgagatggggcaatgttcgtgcctattgctacagatctgtcattgatggaattgaacatattgcaatggtgaaaggtgagattggtgatggtcaagatattttggtgagggttcactctgagtgcctcactggagacatttttggatctgcaaggtgcgattgtggtgaccagcttgccatgtcaatgaaaatgattgagaaggctggaagaggtgtattagtttaccttcgtggacatgaaggaaggggtattggtctgggtcacaagctccgtgcttacaacttgcaagatgacggacgtgacactgtggaagctaacgaggagctagggcttcctgttgattcacgggaatatgggattggtgcacagatattaagggatctaggagtccgttcaatgaagttgatgaccaataaccctgcaaagtatagcggcctcaagggttacggattaagcattgcgggcagggtgcccttgctgacgccaataaccagtgagaataggaagtacatggagaccaaaagaaaaaagatggggcatgtatatggacaggctaaccaagcaaatgatagcaacagcgcaggagagaagcactaagcccgtggttgttgaggcggtaaagcgtcctatggtgcgtctaaggcgcgaggtgaggcgacttcatagacatataagtaaggtgaataaaaacatacaagtattctgttaaacttgaacttgatgtaatattatttcagtaagaactctgtgatgtgaaatcctggaatgttgtaaactctgggctcgccttcgtgcgggtatttcggaaaaaaaaaaaaaaaaaaaa

SEQ ID NO: 2164 - protein, 542 aa, Panicum virgatum
  misc_feature: Ceres CLONE 1777012
  misc_feature (1)..(170): Pfam Name: GTP_cyclohydro2 Pfam Description: GTP cyclohydrolase II
  misc_feature (1)..(199): Pfam Name: DHBP_synthase Pfam Description: 3,4-dihydroxy-2-butanone 4-phosphate synthase
  misc_feature (1)..(527): SWISSPROT Homolog: EC 3.5.4.25 Riboflavin biosynthesis protein ribAB, chloroplast precursor [Includes: GTP cyclohydrolase-2
  misc_feature (128)..(526): SWISSPROT Homolog: EC 3.5.4.25 Riboflavin biosynthesis protein ribAB [ Includes: GTP cyclohydrolase-2
MASLAPPSSSVSAITHQPARFLKGCRVTKETKGSVCNLLTPNSNNAKVKSVGLRISSSLKRDGGYPAGGASGNGDIRGQDHSFADPLLPTDSMVAPEILSANLARVADKFADEDMDTELDLDSPTEGFTSIADAIEDIRQGKPVIVVDDESRENEGDLIMAASLVTSEAMAFIVKHGTGIVCVSMKEEDLERLNLPLMVTAKENEEKLCTAFTVTVDAKESTTTGVSAKDRAKTVMTLASPDSKPEDFNRPGHIFPLKYREGGVLKRAGHTEASVDLAMLAGLPPVAVLCEIVDDADGSMARIPKLRVFAERENLKIISIADLIRYRRKSDRLIERASVARLPLRWGNVRAYCYRSVIDGIEHIAMVKGEIGDGQDILVRVHSECLTGDIFGSARCDCGDQLAMSMKMIEKAGRGVLVYLRGHEGRGIGLGHKLRAYNLQDDGRDTVEANEELGLPVDSREYGIGAQILRDLGVRSMKLMTNNPAKYSGLKGYGLSIAGRVPLLTPITSENRKYMETKRKKMGHVYGQANQANDSNSAGEKH

SEQ ID NO: 2165 - DNA, 1559 bp, Panicum virgatum
  misc_feature: Ceres CLONE 1777015
  misc_feature: Encodes the peptide sequence at SEQ ID NO. 2166
aagttgcgcctcttcgcctcacgctgtcccgcgggcccgcacgtcagcaacagccgcccgaggtttagctgttccgcctcaatcccttccgcgccgccggcgagcaagggcgaagagatctgcttcgcgggagcgggaccatggcggcggcggacgccgtgaaggagaaggaggagcaggagcaggtggtgagcccgtgggaggtgtcggcggggaagggcggcatcgactacgacaagctcgtggaccagttcgggtgccagcgcctcgacgccgcgatcgtcgaccgcgtcgcgcgcctcaccggccgcccgccgcacgtcttcctccgccggggcctcttcttcgcccaccgggattttaacgagatactggaactgtatgagaagagggagaaattctacctgtacacggggagggggccctcgtcggaggcgctgcacctcggccacctcatccctttcatgttcaccaaatatctgcaggaggctttcaaggtgcccttagttatacagctaactgacgatgagaagttctactggaagaacttgactgttgaggaaagcaaaaggcttgctcgtgaaaatgctaaagacattatagcatgcggttttgatgttgacagaactttcattttcacggatttcggttatgtcggaggcgccttttatgaaaatatggctaaagttgccagatgtgtgacatacaataaggctgtaggaatatttagattctcacctgaggatcacataggaaagtgtagctttcctccagtgcaagcagttccatcctttccttcttcgtttccccatctctttgctggcaaggaccaactgcgctgccttatcccatgtgccattgaccaggatccttattttaggatgactcgtgatgttgctcccagaattggttatcagaaaccatcactgattgaatcaagatttttccctgctcttcagggggagaacacaaaaatgtcagccagtgacgcaaattccgcgatatatgttacagatagtgttaaagaaataaagacaaaggtgaataaatatgccttctcaggtggacaggactcgatagagctccacagaaaacttggagctaaccttgatgtggatgttccaatcaagtacttaaacttctttcttgaagatgatgacgagcttgagcacataaagaaggagtacaaggaaggaaggatgttgactggtgaagtgaagcagagactcatcgcagttctatctgagctggttgccaggcatcaaagagctagagctcaagtgactgatgagatggttgatgcattcatggcagtcaggccgcttcccaaaatgtttggctgatgacaagctgggaagaacatttttgttcttagggagaatttatgggatttgtagaactctgtggctagtgtgtccccttattatacccttggatctatctatgcgatcttggccatctgtcctgttcaaacaggttgagttttatattattataaatcaatagttcaatacatgatcttacttaagtttgcatctcaaaaaaaaaaaaaaaaaaaa

SEQ ID NO: 2166 - protein, 400 aa, Panicum virgatum
  misc_feature: Ceres CLONE 1777015
  misc_feature (11)..(395): SWISSPROT Homolog: EC 6.1.1.2 Tryptophanyl-tRNA synthetase, cytoplasmic
MAAADAVKEKEEQEQVVSPWEVSAGKGGIDYDKLVDQFGCQRLDAAIVDRVARLTGRPPHVFLRRGLFFAHRDFNEILELYEKREKFYLYTGRGPSSEALHLGHLIPFMFTKYLQEAFKVPLVIQLTDDEKFYWKNLTVEESKRLARENAKDIIACGFDVDRTFIFTDFGYVGGAFYENMAKVARCVTYNKAVGIFRFSPEDHIGKCSFPPVQAVPSFPSSFPHLFAGKDQLRCLIPCAIDQDPYFRMTRDVAPRIGYQKPSLIESRFFPALQGENTKMSASDANSAIYVTDSVKEIKTKVNKYAFSGGQDSIELHRKLGANLDVDVPIKYLNFFLEDDDELEHIKKEYKEGRMLTGEVKQRLIAVLSELVARHQRARAQVTDEMVDAFMAVRPLPKMFG

SEQ ID NO: 2167 - DNA, 1626 bp, Panicum virgatum
  misc_feature: Ceres CLONE 1777031
  misc_feature: Encodes the peptide sequence at SEQ ID NO. 2168
aagcaaacccctctagcggagccaaaggccccgactttactgacacggtggactccagctcgactcctctcgcccgcaaccccccacttctctccctccgtctctccctccgcgagttcgattccaaacggcggcggcgagatgaaggtcacggtgatgaccaccgacgagcagattctctccctcgacgtagaccccgacgaatccgtggagaatctaaaggcgcttctcgaggtggagactcgtgtaccgttacgacagcagcagcttcacttcaatgggaaggagatgcagaactccgacaagctcagctccattggggtccatgatggtgatcttgtcatgatgctcccctcgaacgaaagggcctctcaggatgttctaaagttaaatcctgacggaactgctgctaatcctcaagcttttcaacaacatgttcgaggtgattcacaacttatggcacagcttcttcagagtgatccgcaactagcacaagctattcttggagacaacatcaatgaactacagaatatactgcgctcccgccacctacagaaaatggaactgaaacgcaaacaagaagaagagcttgctttattgtatgctgatccttttgatgtcgaagctcagaagaaaattgaagctgcaattcggcagaaaggcatcgatgaaaattgggaggctgccctagagcacaatcctgaagcatttggtcgagtggtaatgctgtatgtggatatggaggtcaatggggtgcccttgaaggcctttgttgacagtggagcacagtcgaccatcatatcaaaaagttgtgctgaacgttgcgggttgttgaggctacttgatcaacggttccgaggagttgctgttggagttggtcaatcagagatactgggaagaatacatgtagctccaataaagattgggcatctcttctatccttgttctttcactgtattggatgcccccaatatggaattcctatttgggctcgatatgctgcgaaaacatcagtgcatgattgacctaaaagacaatgttcttagagtgggaggtggtgaggtttcagtgcccttcttacaagagaaagacatccctgcacatatacgagatgaagagaaactatctaagctagcatcttctctcggccaagcaactggagaatcatcaaaggcacgtgaggggactcctgatttaccgcaacaaactcctgcaggagctccagttgcgaatcctccacaggcaggagatttcgaagcaaaaatcacgaagctcatagaacttggattcgaccgagcatctgtagtacaagcactcaagctgtttaacgggaatgaggagcaggctgctgccttcctctttggtggttagaatcctgggagcagccattcccggctttctgtttgctcaaccctttcccagggttgaatattgattgatacaaaagtgattaggagatggggtttctctttggaaaattgcttggccaatgcaaaggcttgcatttatagacgctccatattttctcttgtttctgtgaacaaacgttctttctttctgtacctgatacagtgactgatagacacctgaatgcaaactgatttgtaaaaaaaaaaaaaaaaaaaa

SEQ ID NO: 2168 - protein, 409 aa, Panicum virgatum
  misc_feature: Ceres CLONE 1777031
  misc_feature (2)..(105): Pfam Name: RVP Pfam Description: Retroviral aspartyl protease
MKVTVMTTDEQILSLDVDPDESVENLKALLEVETRVPLRQQQLHFNGKEMQNSDKLSSIGVHDGDLVMMLPSNERASQDVLKLNPDGTAANPQAFQQHVRGDSQLMAQLLQSDPQLAQAILGDNINELQNILRSRHLQKMELKRKQEEELALLYADPFDVEAQKKIEAAIRQKGIDENWEAALEHNPEAFGRVVMLYVDMEVNGVPLKAFVDSGAQSTIISKSCAERCGLLRLLDQRFRGVAVGVGQSEILGRIHVAPIKIGHLFYPCSFTVLDAPNMEFLFGLDMLRKHQCMIDLKDNVLRVGGGEVSVPFLQEKDIPAHIRDEEKLSKLASSLGQATGESSKAREGTPDLPQQTPAGAPVANPPQAGDFEAKITKLIELGFDRASVVQALKLFNGNEEQAAAFLFGG

SEQ ID NO: 2169 - DNA, 1888 bp, Panicum virgatum
  misc_feature: Ceres CLONE 1777046
  misc_feature: Encodes the peptide sequence at SEQ ID NO. 2170
atactccaaaccaaacacgtcaattataaacatcgaggtgcgcgaagccaaagcgtccaagcaaccgcttcctgctcctctgccctgctgctcctcctcgctccgccctcttccaccgcccgattcgatcccgcgccgccgcgccatggaccgcgcggacttctcgcggggccgcctcgccgtgctctcctcccacctcgccgccggcgccggggaggcggcggggctggagaggtcgccggtgtccgcggcggcccccgggccccgcgccggcgcgctcgccgtggtggacgggaggaccgggaagcggcacgaggtcaaggtctccgaggacggcaccgtgcgcgccaccgacttcaaaaagataaccaccggaaaggatgacaaaggtcttaagatttatgatccgggttatctcaatacagctccagttcgttcatccatctgctacattgatggggatgagggaatccttcgctacagaggatatccaattgaagagttggctgaaagcagttcatttgtagaggtggcatacctcttaatgtatgggaatctacctactcagagccaactggcgagttgggaattcgcaatttcacagcactctgctgttccccaaggacttctggatatcgtacaatcgatgcctcatgatgctcaccccatgggtgttcttgccagtgcaatgagtaccctttctgtctttcatcctgatgcaaaccctgctcttagaggtcaagatctttacaagtcgaagcaggtgagggataagcaaatcgtgcgagtacttgggaaggccccaacgatagcagctgctgcctacttgagattagctggaaggcctcccattcttcctacgaatactctttcttattcagagaacttcttgtacatgctggactctttgggtaacaaattatataaaccaaatcctcgacttgcgcgggctctagatatcctatttattctgcatgctgaacatgaaatgaactgctccactgctgcggttaggcaccttgcttcaagtggtgttgatgtcttcactgctctttctggtggtgttggagctctatatggtccactgcatggtggtgcaaatgaggcagtacttaaaatgctaaatgagattggaagtgtggaaaatattccagatttcattgaaggagtaaagaacaggaagaggaagatgtccggttttggccaccgtgtgtataagaactatgatcctcgtgctaaagtcatccggaaattggcagaggaggttttctcaattgtggggcgggatccacttattgaggttgccattgctctagagaaggcagcgctgtcggatgaatattttatcaagaggaagctgtatcccaatgtggatttctactctggactaatttatagggcaatgggattccctacagaatttttccctgttctgtttgccattccaagaatggctggttggctagcacattggaaagagtcacttgatgatcccgatactaagattatgaggccccaacaggtatacacaggcatttggctgaggcattacacccctgtcagagaacgagtgccgccaaaccagagtgaggaacttggccagattgccacctcaaacgcgacaagacgccgccgtgcaggttctgccctgtagaagagctgcaacatgcaacggccagcatacacaataaacaaggggccccttttgggccccaaaaaagggccagggcacctgaacttagttggaggtgtatactttctgttgtcaagtttataggcaataataaactgtatcgttactttgcaaaaactgtcacgaattttccctaggataaatgaagagatacgaccagttcccggtttttgccaaaaaaaaaaaaaaaaaaaa

SEQ ID NO: 2170 - protein, 502 aa, Panicum virgatum
  misc_feature: Ceres CLONE 1777046
  misc_feature (1)..(369): Pfam Name: Citrate_synt Pfam Description: Citrate synthase
  misc_feature (1)..(502): SWISSPROT Homolog: EC 2.3.3.1 Citrate synthase 3, peroxisomal precursor
  misc_feature (4)..(502): SWISSPROT Homolog: EC 2.3.3.1 Citrate synthase, glyoxysomal precursor
MDRADFSRGRLAVLSSHLAAGAGEAAGLERSPVSAAAPGPRAGALAVVDGRTGKRHEVKVSEDGTVRATDFKKITTGKDDKGLKIYDPGYLNTAPVRSSICYIDGDEGILRYRGYPIEELAESSSFVEVAYLLMYGNLPTQSQLASWEFAISQHSAVPQGLLDIVQSMPHDAHPMGVLASAMSTLSVFHPDANPALRGQDLYKSKQVRDKQIVRVLGKAPTIAAAAYLRLAGRPPILPTNTLSYSENFLYMLDSLGNKLYKPNPRLARALDILFILHAEHEMNCSTAAVRHLASSGVDVFTALSGGVGALYGPLHGGANEAVLKMLNEIGSVENIPDFIEGVKNRKRKMSGFGHRVYKNYDPRAKVIRKLAEEVFSIVGRDPLIEVAIALEKAALSDEYFIKRKLYPNVDFYSGLIYRAMGFPTEFFPVLFAIPRMAGWLAHWKESLDDPDTKIMRPQQVYTGIWLRHYTPVRERVPPNQSEELGQIATSNATRRRRAGSAL

SEQ ID NO: 2171 - DNA, 1923 bp, Panicum virgatum
  misc_feature: Ceres CLONE 1777048
  misc_feature: Encodes the peptide sequence at SEQ ID NO. 2172
accaacaaacctacaagcagcaaaaccaaagatcagcaagagaaataatacaagttaataaggctgacggcgagaagatggcgctgacgcctccagtttgctctgtcaatgatgttcatcacgggcagcggaaggatcggccgaccttccatccgagtctgtggggtgattttttcctgacataccagccgccaactgcacctaagcgtgcatacatgacagaaagggcagaagtgttacaagaagaagttaggaagatggtgaagggtgcaaacgaaataccagatatcttagatctaataatcacgctacagcggcttggactggataattactacgagaatgagattgatgataagttgctctttgtttatgattctgagtacgatgacaaagatctgaatttagtctcactacgattttatcttctacggaaaaatggttatgatgtgccatctgatgtcttcaaaagtttcaaagataataaaggaaaatttgttgcggataatacaaaaactctcttgagtttatataatgcagcacaccttaggacccatggggacaaagtacttgatgaagccattatattcactaaaagccaacttgaagctgtattagattctttggaatcaacattagcagatgaagtatctcatgcccttcaaacacctctcttccgaaggattagaatactagaaacaagaacctatatcccaatttacgaaaaggaggctgcacgaaatgaagtcatattagagtttgcaaaattgaatttcaaccttcttcaacttctttactgtgaggagttaaaagccgtcacactgtggtggaagcagcttaatgtggagacaaacttatgctttattcgagatagaatagtagaaatgcatttctggatgacaggagcatgctccgagccacagtattctcttacacgagtcataactacaaagatgacagcttatatcaccatactagatgatataatggatacctacagtacaactgaggaggccatactgcttgccgaagcaatatacagatgggaagagaatgcagcagaactacttccagagtacatgaaggatttgtacttgcacttattgaagacattcgattcttgtgaggatgaactaggaccaaataaaagcttccgagtgttttaccttaaagaattgttaaaggtgttggtccaagcatactgtcaagagataaaatggcgtgacgaacattatgttccaaaaacaatcaatgaacatttagaaatatcaagagcaactgttggaggtttccaagtagcatgttcttcatttgttgggatgggtgatgacatcataacgaaggaaattcttgactggcttttgacatatccagaacttctcaagtgtttctcaataatagcacggctgtccaatgatattaaatcaacagagcgagagcaaattggggcgcaccatgcgtctactatagaatgttatatgctgcagcataggacaacaatgaatgatgcatatgagaggataaaagatttaattgaagatgcatggaaggatatgatgaaactcttccttacaccaacagaacagccaaagctcatcgcgaaaacagttgttgattttgcaaggactgcagactacatatacaagaaaacagatgcattcactttttcccacacaattaaagataagatcacaatgctctatgtggagccaatattattttgaagaccaaaaaagagaaaatgtacccttttcccatctatattatactccaaaaccccttcagttgtatattgaataaagtagcatccacaagacttgtgtttacaaattacaaaagtcaactgtttaaaggtagagtaaaaatgttgtaatgagtaaagtataaacgtgttatgaagtagaaaaaaaaaaaaaaaaaaaa

SEQ ID NO: 2172 - protein, 548 aa, Panicum virgatum
  misc_feature: Ceres CLONE 1777048
  misc_feature (2)..(270): Pfam Name: Terpene_synth_C Pfam Description: Terpene synthase family, metal binding domain
MALTPPVCSVNDVHHGQRKDRPTFHPSLWGDFFLTYQPPTAPKRAYMTERAEVLQEEVRKMVKGANEIPDILDLIITLQRLGLDNYYENEIDDKLLFVYDSEYDDKDLNLVSLRFYLLRKNGYDVPSDVFKSFKDNKGKFVADNTKTLLSLYNAAHLRTHGDKVLDEAIIFTKSQLEAVLDSLESTLADEVSHALQTPLFRRIRILETRTYIPIYEKEAARNEVILEFAKLNFNLLQLLYCEELKAVTLWWKQLNVETNLCFIRDRIVEMHFWMTGACSEPQYSLTRVITTKMTAYITILDDIMDTYSTTEEAILLAEAIYRWEENAAELLPEYMKDLYLHLLKTFDSCEDELGPNKSFRVFYLKELLKVLVQAYCQEIKWRDEHYVPKTINEHLEISRATVGGFQVACSSFVGMGDDIITKEILDWLLTYPELLKCFSIIARLSNDIKSTEREQIGAHHASTIECYMLQHRTTMNDAYERIKDLIEDAWKDMMKLFLTPTEQPKLIAKTVVDFARTADYIYKKTDAFTFSHTIKDKITMLYVEPILF

SEQ ID NO: 2173 - DNA, 1119 bp, Panicum virgatum
  misc_feature: Ceres CLONE 1777056
  misc_feature: Encodes the peptide sequence at SEQ ID NO. 2174
cgttccccgtttcataagctttctggtgccatatgcaatagagcccctggtcgcccaggtcgtcttctccttgagctaagttcctgctcccttcttttgtttcatcaaggtcctcgtagtttcttttccttcagagtcgcctcctcctttctggagaaactctcgcagacagcccccttaggtttttcgaattcttgttggccggcccctcctgtgtagatccggggaacctgcggccgcccccatgtttacctaccagtttctctaacgtccgccgtcccccgatgaagctgaacgtgctccgcatccgccgttcccactccttctccgtcgccttcctgtactggttctacgtcttctcatgaacaaatcgccctctctcaagaacgccagcatctcttccggtctctaggttgttagatttcttttagtttcttgaatctttggtttttgccccccacttccttccaaaaaagtcccttttttagccgagtctgtccaagaagaggaacaatgtcgtcgcgccggagctcgagccctgagagcaacaccgacagcggcagcggcggcgggggattcgccgccgacgagcgcaagcgcaagcggatgctgtccaacagggagtccgcgcgccgctcccgcgcgcggaagcagcagcggctggaggagctggtcgccgaggtggcccgcctccaggccgagaacgcgcaggtgcagtctcgcatcgcgacgttcgaccgcgagttcagcaaggtggacggcgagaacgccgtgctgcgcgcccgccacggcgagctagccgggcggctggagtcgctgggcagcgtcctggaggtgctccagatggccggcgcccccgtggacatcccggagatccccgacccgctgctccgcccatggcagccgccgttcccgatgcagcccatcgctgccgacgccttccagttctgagctggcgcccggcggcgtcaatggccgcctcgactaccaagacatggccgtggcgttgccatggtcacctactactactactatgattactgcttactcatgtactaggtctggttgtgatgttcttaatcatggtttgcttggtgttaaaaaaaaaaaaaaaaaaaa

SEQ ID NO: 2174 - protein, 145 aa, Panicum virgatum
  misc_feature: Ceres CLONE 1777056
  misc_feature: Great-hit functional homolog of the protein sequence given in SEQ ID NO 9444
  misc_feature (2)..(65): Pfam Name: bZIP_1 Pfam Description: bZIP transcription factor
  misc_feature (3)..(55): Pfam Name: bZIP_2 Pfam Description: Basic region leucine zipper
  misc_feature: Useful for making plants with altered Lignin content
MSSRRSSSPESNTDSGSGGGGFAADERKRKRMLSNRESARRSRARKQQRLEELVAEVARLQAENAQVQSRIATFDREFSKVDGENAVLRARHGELAGRLESLGSVLEVLQMAGAPVDIPEIPDPLLRPWQPPFPMQPIAADAFQF

SEQ ID NO: 2175 - DNA, 1616 bp, Panicum virgatum
  misc_feature: Ceres CLONE 1777063
  misc_feature: Encodes the peptide sequence at SEQ ID NO. 2176
ccctccctagcgtgctttcccacccattcctcttccgccatcccgcgaggccgcgacgttgtcgtcgtcgcggaggcggggcgccccacccactggcgtgattcgctttcgaaccgcactcacttcctctcctgttctctccctctcctccgcggcctctcgcccccctctgcttttccccctccccctttctccagcctcccctccccgctccgctccccatccatggcctcggcggatcgctccccgccggcggcggacgagcggagtccgtgcccgcgcccgtccctcttctcgccgtaccagacgccccgcttccgcctcgcccaccgggtggtgctggcgccgatgaccaggtgcagggcgccccgcgcggtcccggggcccgcgctcgcggagtactacgctcagcggtccacggagggcggcctgctcatctcagagggcaccatcatctcgccggccggccctggcttccctcgtgtccctgggatatacaaccaagagcagattgatgcatggaaaaaggtagttgatgctgttcacgccaagggagccatctttatctgccaactgtggcatgtaggcagggcttctcatcaagtatatcagccagatggcgatgctccaatatcctcaaccgataagccaatatcatcaaggtggaggatactgatgcctgatggctcctatggcaagtatccaacgcctcggcgccttgccacatctgagatacctgaaatagttgaacaataccgtcaggctgcggttaacgccatcaaagcaggtttcgatggcattgagatccacggcgcccatggctacctaatcgatcagttcctcaaggacggcatcaatgaccggaccgacgagtacggtggctcgctctccaaccgctgccggttcctcctggaagtgacccgtgccgtggtctccgccatcggggcagaccgtgtcgccgtccgggtgtcaccggccatcgaccacctcgacgcctacgattccaaccccatgcagctcggcctggccgtggtggagcgtctcaacgccctgcagcaggaggccgggcggctggcctacctccacgtgacgcagccgcggtacacggcgtacgggcagacggagtcgggccagcacgggagcgccgaggaggagagccggatgatgcgcgctctccgcggcgcataccggggcaccttcatgtgcagcggcgggtacacgcgggagctcggggtggaggccgtggagtccggggacgccgacctcgtgtcgtttgggcggctgttcatcgccaacccggacctggtagagcggttccggcgcgacgcgccgctgaacaagtacgtgaggaagacgttctacacgccggaccccgtcgtcgggtacacggactacccgttcctcggccagcctaaggcgcgcatgtgataagtagatggaaatggtaattataagagatgcattgttgattgtgtaatgtgacttgagaaaataagataacgtcttcgtagccgtgattattcgccaatatctagtgcaaaaaactgtaagatatcgtaatgaggaaaacggtggtgttattcatgctttgttctcaaaaaaaaaaaaaaaaaaaa

SEQ ID NO: 2176 - protein, 400 aa, Panicum virgatum
  misc_feature: Ceres CLONE 1777063
  misc_feature (1)..(353): Pfam Name: Oxidored_FMN Pfam Description: NADH:flavin oxidoreductase / NADH oxidase family
  misc_feature (21)..(400): SWISSPROT Homolog: EC 1.3.1.42 12-oxophytodienoate reductase 3
  misc_feature (22)..(393): SWISSPROT Homolog: EC 1.3.1.42 12-oxophytodienoate reductase 3
MASADRSPPAADERSPCPRPSLFSPYQTPRFRLAHRVVLAPMTRCRAPRAVPGPALAEYYAQRSTEGGLLISEGTIISPAGPGFPRVPGIYNQEQIDAWKKVVDAVHAKGAIFICQLWHVGRASHQVYQPDGDAPISSTDKPISSRWRILMPDGSYGKYPTPRRLATSEIPEIVEQYRQAAVNAIKAGFDGIEIHGAHGYLIDQFLKDGINDRTDEYGGSLSNRCRFLLEVTRAVVSAIGADRVAVRVSPAIDHLDAYDSNPMQLGLAVVERLNALQQEAGRLAYLHVTQPRYTAYGQTESGQHGSAEEESRMMRALRGAYRGTFMCSGGYTRELGVEAVESGDADLVSFGRLFIANPDLVERFRRDAPLNKYVRKTFYTPDPVVGYTDYPFLGQPKARM

SEQ ID NO: 2177 - DNA, 1761 bp, Panicum virgatum
  misc_feature: Ceres CLONE 1777067
  misc_feature: Encodes the peptide sequence at SEQ ID NO. 2178
acgttgcttaaggagttcgatcgagagctgagtcatcgagctgctgcagctccgagaaggccgacggcgaccaagaagatcgaggccgatccgaccctgagagctcgcgcgcacagtgcgcggccatgggtgaggaagcggcggccgtgccccatgccgtggcggcggcggcgagcgccccgccgcacctggtgctgatatgcttcccggggcagggccacgtgaaccccatgctccgcctggccaagcgcgtcgcggccaagggcctcctcgtgaccttctcctcgctggccagcgtggacgcgaggctggccgccgccgcgggggtgtcggccggcggcgacggcgtgcccgtgggccggggccgcgtgcggttcgagttcctggaggacggcgaccccgggcccgacctggacgacctcatgcggcacctcgacacggccggcccgccggcgttcgcggcgctgctgcggcgccaggcggaggagggccggcccgtggcgtgcgtggtggcgaacccgttcatgccgtgggcgagcgacgtcgccgccggcgaggggatcctgacggcggtgctgtgggtgcagtcgtgcacggtgttctcgctctactaccaccacgtgcacggcctggtggagttcccgcccgaggacgacccggaggcgcggttccggctgccgggcctgccggagatgttggccgccgacgtgccgtcgttcctgctcccgtccaacccgttcaagctcctcgccgacgcgatcatcacgcagttccgcaccatcgggcgggcctcgtgggtgctggtgaactcgttcgcggagctggagggggacgtggtggccgcgctccccggcgtgacgccgcgcccgccggagctcatccccgtgggcccgctcatcgagctccagcagcaggcgggccaggaggaggaggacgcggtgcgcgggaacctgatcaaggccgccgacgactgcgtggagtggctggacgcgcagccgccgcggtccgtggtgtacgcgtcggtgggcagcgtggtgctgctgtcccccggcgaggtcgcggagatggcgcacgggctggtgtcgacggggcggccgttcctgtgggtggtgcggctggacacgcagccgcacctgccggcggggttcgtggagtccgtgtccgggcgcggcgcggtggtggcgtggagcccgcaggagcgcgtgctggcgcacccgtcgacggcgtgcttcctgacgcactgcgggtggaactcgacgctggagacggtggcggcgggggtgcccgtggtggcgttcccgcagtggggggaccagtgcacggacgcgcgcttcctggtggaggagctcggcatgggcgtgcgcctgcggggcgcccggcgggaggccgtgcgagaggccgtggaggccgccgtggcggggccccgcgcgggggagatgctcgcgagcgccaggcggtggagcgccgcggccagggccgccgtggcgcccggcggttcctcggacgcccacgtccaggcgttcgtggacgaggtggcgcgccgggcgcgtggcggcggagcggctaaggccgaggcccaggcggcccagcctcctcccgccgtcgccacagaggcctcctagcgtcgagacgtgatctccagaggcagagagggtgctagtgctagctagggtaaatggcggtaaaaaaaagggaacagtaaataattaatcgtgcggctaccgcgaatttgatttcgtttaaaaaaaaaaaaaaaaaaaa

SEQ ID NO: 2178 - protein, 498 aa, Panicum virgatum
  misc_feature: Ceres CLONE 1777067
  misc_feature (1)..(105): Pfam Name: UDPGT Pfam Description: UDP-glucoronosyl and UDP-glucosyl transferase
MGEEAAAVPHAVAAAASAPPHLVLICFPGQGHVNPMLRLAKRVAAKGLLVTFSSLASVDARLAAAAGVSAGGDGVPVGRGRVRFEFLEDGDPGPDLDDLMRHLDTAGPPAFAALLRRQAEEGRPVACVVANPFMPWASDVAAGEGILTAVLWVQSCTVFSLYYHHVHGLVEFPPEDDPEARFRLPGLPEMLAADVPSFLLPSNPFKLLADAIITQFRTIGRASWVLVNSFAELEGDVVAALPGVTPRPPELIPVGPLIELQQQAGQEEEDAVRGNLIKAADDCVEWLDAQPPRSVVYASVGSVVLLSPGEVAEMAHGLVSTGRPFLWVVRLDTQPHLPAGFVESVSGRGAVVAWSPQERVLAHPSTACFLTHCGWNSTLETVAAGVPVVAFPQWGDQCTDARFLVEELGMGVRLRGARREAVREAVEAAVAGPRAGEMLASARRWSAAARAAVAPGGSSDAHVQAFVDEVARRARGGGAAKAEAQAAQPPPAVATEAS

SEQ ID NO: 2179 - DNA, 1625 bp, Panicum virgatum
  misc_feature: Ceres CLONE 1777072
  misc_feature: Encodes the peptide sequence at SEQ ID NO. 2180
cccacccgctgcgcttctccctcctctgcccccgcctccgcccttccctcgctcgcctcgcctcgcctcgcctctcctctctcctagtcctctctccacaaaccacccccacccccaccaccgtccagggacaccgaccgatcgccaggatgagggagatcctgcacatccagggcggccagtgcggcaaccagatcggcgccaagttctgggaggtgatctgcggggagcacgccgtcgactccacgggccgctactcggggtcctccgcgcagcagctcgagcggatcaacgtctactacaacgaggccgggggcggccgctacgtgccccgcgccgtgctcatggacctcgagcccggcaccatggagtccatccgcgccggccccttcggcggcatcttccgccccgacaacttcgtctacggccagtccggcgccggcaacaactgggccaagggccactacaccgagggcgccgagctcatcgacgccgtcctcgacgtcgtgcgcaaggaggccgagaactgcgactgcctccaagggttccaagtatgccactccctgggtggaggcacgggatccggcatgggcaccctgctcatctccaagatccgcgaggagtaccccgaccgcatgatgctcaccttctccgtgttcccgtcgcccaaggtgtcggacaccgtggtggagccctacaacgcgacgctgtccgtgcaccagctggtggagaacgcggacgagtgcatggtcctcgacaacgaggcgctctacgacatctgcttccgcaccctcaagctcaccaacccttcgtttggtgacctgaaccatctgatctcggcgacgatgagcggcgtgacgtgctgccttcggttccccgggcagctgaactcggacctccggaagctggccgtgaacctgatcccgttcccgcggctgcacttcttcatggtggggttcgcgcccctgacgtcgcgcgggtcgcagcagtaccgcgcgctgacggtgccggagctgacgcagcagatgtgggacgccaagaacatgatgtgcgcggcggacccgcgtcacgggcgctacctgacggcgtcggccatgttccggggcaagatgagcaccaaggaggtggacgagcagatgatcaacgtgcagaacaagaactcgtcctacttcgtcgagtggatccccaacaacgtcaagtcgagcgtctgtgacatcccgcccgtcggcctgtccatggcctccaccttcgtcggcaactccacctccatccaggagatgttccggcgcgtcagcgagcagttcacggccatgttccgccgcaaggccttcctgcactggtacaccagcgagggcatggacgagatggagttcaccgaggccgagagcaacatgaacgacctcgtcgccgagtaccagcagtaccaggacgccaccgccgaggagtacgacgacgaggaggtcgacggcgaagaggaccacgcctgatgcttgaccggacgtccaagatcttgatcgagcttctctccttcgctatgccgatcgagaggcgctctctctatatatatacatacatcccaacaaccacctaaagtattgtacgtacaaaaaaaaaaaaaaaaaaaa

SEQ ID NO: 2180 - protein, 445 aa, Panicum virgatum
  misc_feature: Ceres CLONE 1777072
  misc_feature: Great-hit functional homolog of the protein sequence given in SEQ ID NO 9198
  misc_feature: Useful for making plants with modulated flowering time
  misc_feature: The plant flowers significantly late compared to wild-type.
MREILHIQGGQCGNQIGAKFWEVICGEHAVDSTGRYSGSSAQQLERINVYYNEAGGGRYVPRAVLMDLEPGTMESIRAGPFGGIFRPDNFVYGQSGAGNNWAKGHYTEGAELIDAVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLTNPSFGDLNHLISATMSGVTCCLRFPGQLNSDLRKLAVNLIPFPRLHFFMVGFAPLTSRGSQQYRALTVPELTQQMWDAKNMMCAADPRHGRYLTASAMFRGKMSTKEVDEQMINVQNKNSSYFVEWIPNNVKSSVCDIPPVGLSMASTFVGNSTSIQEMFRRVSEQFTAMFRRKAFLHWYTSEGMDEMEFTEAESNMNDLVAEYQQYQDATAEEYDDEEVDGEEDHA

SEQ ID NO: 2181 - DNA, 1845 bp, Panicum virgatum
  misc_feature: Ceres CLONE 1777089
  misc_feature: Encodes the peptide sequence at SEQ ID NO. 2182
tctcgcatcgcaaacactttgccccctcgcgtccgtcgactactcgcgcccccgaccttttgcgcttccgcccccggcgccctcacgaaatccccgaacgcgcggcgccaggagaggagtcgagacccggaccgagacgcgcagcacgcggaaccctcgagggccaggacgcgaaaagggaggacacgcacagccacgcgtctgcggcggcaggccggcggcgaggcgagggctctgctcccggcggcgttcggggcgagggcggaggagccgatcgcgcgcgccattgggggcggccacgcggtgccgtgttgacccccgctccgcgaccggcgcgcgcggttcgtgcggcgcttggcccctccccggggaaaggctgctgatttccccttctcgccgtcctcggcgcgatggaggccggctactgcaaccgcaagaagacggacatctgcgagggcgtctgcgacaccgagtatggttcaaagtcagttctgagcatgtcaaggctgaagtgtacactgcggggatttgatttgagggctctcttgatcctactgattggtattcctattatgatcttcgtcatatacgtacatggacagaaggtcacttacttcctccgcccgatctgggaaaagcctccaaagcccttcacaatacatcctcactactatcatgagaatgtctctatggataacctctgcaagttgcatggatggaaagtcagggagtctcctcgccgtgtctttgatgctgtgctcttcagcaacgagcttgacattcttgacatccgttggcacgagctgagtccgtatgtagatgaatttgtgctgcttgagtccaattcaaccttcactggcataaagaaggaacttcacttcaaggaaaaccgccagcggtttgagtttgctgagtcacggttgacctacggtatgataggaggaaggtttgtgaagggagaaaacccatttgttgaagagtcatatcaaagggttgctctcgaccagcttattaagattgcgggcatcacagatgatgacctgttgatcatgtctgatgttgatgagatcccaagtgggcatacgataaacctcttgcgatggtgtgatgacattcctgagattcttcatctccagctcaggaactacctctactcattccagttcttacttgatgacaagagctggagggcttcagtacaccgatacagagctggaaagaccaggtatgcgcatttccggcaaacagatgatcttctggctgattcagggtggcactgcagcttttgctttcgctacataaatgatttcatcttcaagatgaaagcctacagccatgtggatcggatcagattcaagtacttcctgaacccaaagaggattcagcatgtgatttgcgaagggtccgatcttttcgacatgcttcctgaagaatacactttccaagagatcattgccaagctaggacctattccaagtacatactctgctgttcatctcccggcctatttgctggagcaaactgatcggtacagatatcttcttccaggcaactgcatgagagagagtggctaggcagctactacggtctgcatcatgacctgaggagcagggacatccctggccgttgtccccctggaggaacaccctgcccttgcggggttgtatctgatacgattggctgacttagttgagtgatcacttggctgctggttgagttcatatgagattctgtaccgtgtaattcaaaccttggaaggccatgacagcagcattgctgcgttcttgttttgcggaggagctctgcagtgtgtgtgcttatttataaaaaaaaaaaaaaaaaaaa

SEQ ID NO: 2182 - protein, 387 aa, Panicum virgatum
  misc_feature: Ceres CLONE 1777089
  misc_feature (3)..(360): Pfam Name: Glyco_transf_17 Pfam Description: Glycosyltransferase family 17
MEAGYCNRKKTDICEGVCDTEYGSKSVLSMSRLKCTLRGFDLRALLILLIGIPIMIFVIYVHGQKVTYFLRPIWEKPPKPFTIHPHYYHENVSMDNLCKLHGWKVRESPRRVFDAVLFSNELDILDIRWHELSPYVDEFVLLESNSTFTGIKKELHFKENRQRFEFAESRLTYGMIGGRFVKGENPFVEESYQRVALDQLIKIAGITDDDLLIMSDVDEIPSGHTINLLRWCDDIPEILHLQLRNYLYSFQFLLDDKSWRASVHRYRAGKTRYAHFRQTDDLLADSGWHCSFCFRYINDFIFKMKAYSHVDRIRFKYFLNPKRIQHVICEGSDLFDMLPEEYTFQEIIAKLGPIPSTYSAVHLPAYLLEQTDRYRYLLPGNCMRESG

SEQ ID NO: 2183 - DNA, 1738 bp, Panicum virgatum
  misc_feature: Ceres CLONE 1777093
  misc_feature: Encodes the peptide sequence at SEQ ID NO. 2184
attttttttcttcttcccctctccttcctcgtcgtcgtcctcttcagatcaagaaaccgtgtcctagaaaccatcgagatcgcccttcccacccctcagatcgtccaaagacggcggctttcggagcttcccgtgctttttccggcacgacgggtggttcagtttccggatcgggctgctcttccttttctggttgccggcgagcaggcggcggcggccgtccttggatcgggagttgtttagcttgttaaggtgcggagatggtggccgaggcggaggtgatgcatcaggcgcccgtgcccgtgctggaggtgcagcaccaccggtgcgtgaccaagggggtcgatgaggtcgtcgggatgtctgcggcggcggcggcggtggccacgccgacggaggttgaggtcgaggtcgaggtcgccgtcgaggtgcctcgcatgggactggagcagcctgatgctgcaccgagtgtatctgtggagatgctacagtttgtgcccaacatccggtctggtagctttgctgatattgggcctaggaggtacatggaagatgaacatatccggatagatgatctttctgctcatcttggctcgctgttggtctgcccgttgccgagcgccttctatggagtttttgatggacatggaggtccagatgctgcagcctacatgaaaaggcatgcaatgaggttcctgttcgaggacagtgagttcccacaagcatcacgagtcgatgagttgtaccttcagtctgtcgagaactctgttcgaagagctttcctgcaggctgatcttgctctggctgatgatttggacatcagccgctcttctggaaccacagcgctcaccgcattagtctttggaaggcaactgttggttgcgaatgctggggactgccgggcagtcctatgccggaaaggtgtagccatggagatgtcccgagatcacagggctaactatgtcgaggagtgtgaaagggttgcggcgtctggtggatacatcgaggatggctacctcaacggcgtcctgtccgtaacccgggcccttggggactgggacatgaagacccctgatgcctcagcatccccactcattgcggagccagagttccaacaggccactctcactgaggatgacgagttcctcatcatgggttgtgacgggatctgggatgtgatgacaagccagcacgcggtgagcctcgtgcggcagggcctgcggcaacacgatgaccctgcacggtgcgcaagggagcttgtcatggaggcgaagcggctagagacagccgacaatctgaccgttgttgtcgtctgcttcgtgtcggagctgggcgcgcagcagcaggagcagccagcgaggccgaggggctataagagcctgtcaacagaggcgctgtgcaacctgaggagctggcttgagaccgaccaccgctagaggaagagggttagcatggagaaaggacggattggtttgggatgtgtaaatacaactcgctgacaacattggttgacggatcatgaggcgctgggttctagtttcccatttgttgagaggctgctgccgagtaggcaggtcagctgcagcagcagccagcagttttgtaggttatttttcactttgtttttttttcctttcgtttacccctcagtagccgttgctgttattgttaacacttgacacctctctgttgtacatatatctattgaagttgttgccaaaaaaaaaaaaaaaaaaaa

SEQ ID NO: 2184 - protein, 391 aa, Panicum virgatum
  misc_feature: Ceres CLONE 1777093
  misc_feature (1)..(265): Pfam Name: PP2C Pfam Description: Protein phosphatase 2C
MVAEAEVMHQAPVPVLEVQHHRCVTKGVDEVVGMSAAAAAVATPTEVEVEVEVAVEVPRMGLEQPDAAPSVSVEMLQFVPNIRSGSFADIGPRRYMEDEHIRIDDLSAHLGSLLVCPLPSAFYGVFDGHGGPDAAAYMKRHAMRFLFEDSEFPQASRVDELYLQSVENSVRRAFLQADLALADDLDISRSSGTTALTALVFGRQLLVANAGDCRAVLCRKGVAMEMSRDHRANYVEECERVAASGGYIEDGYLNGVLSVTRALGDWDMKTPDASASPLIAEPEFQQATLTEDDEFLIMGCDGIWDVMTSQHAVSLVRQGLRQHDDPARCARELVMEAKRLETADNLTVVVVCFVSELGAQQQEQPARPRGYKSLSTEALCNLRSWLETDHR

SEQ ID NO: 2185 - DNA, 1714 bp, Panicum virgatum
  misc_feature: Ceres CLONE 1777123
  misc_feature: Encodes the peptide sequence at SEQ ID NO. 2186
aacacatggggcgcactcgcactcgcactcgattgcattgcagcgcaacatcgcattcacacggcgcccaaattagcaagtgatcgaagcaccaagcaagcaagcaagccgggcggcatggcggaccagctcatctccacggccgtgcacgaccagctgccggagaactacgcccggccggagacgcagcgcccgcgcctccacgaggtcgtctccgacgcgcagatccccgtcgtggacctcgccgaccccgacctcgccgccgtcgtcgcccggatcggcgaggcctgcgccacccacggcttctttcaggtgctcaaccatggggtgcccgtggagctgatggacgccatgctggcggtggcgtacgacttcttccggctcccgccggaggagaaggcgaagctctactccgacgacccggccaagaagatgcgcctgtccaccagcttcaacgtgcgcaaggagacggtgcacaactggcgcgactacctccgcctccactgccacccgctcgagcagttcgtccccgactggccggccaatccgccgtccttcagggagatcgtgagcgcctactgccgagaggtccgggggctcgggttccggctgtacgcggccatctccgcgagcctgggcctggaggaggagtacgtgaagaaggcgctgggcgagcaggagcagcacatggcggtgaacttctaccccaagtgcccggcgccggacctcaccttcgggctccccgcgcacacggaccccaacgccctcaccatcctgctcatggaccagcaggtgcccggcctgcaggtgctcaaggaaggccgctggatcgccgtcaacccacgccccaacgcgcttgtcatcaacatcggggaccagctgcaggcgctgagcaacggcaggtacaagagcgtgtggcaccgcgcggtggtcaacgccgacaggccgaggatgtcggtggcgtcgttcctgtgcccgtgcaacgacgtgctcatcggccccgccgcgaagctcgtcggcgacggctcgccggccgtctacagggactacacctacgccgagtactacagcaagttctggagcaggaacctggaccaggagcactgcctcgagctcttcagaacctagagcgacagagatgtttccatccagtggcggagccacgtatcggccatactgggccatggccccccttacctcagatgaaattatgtaggtctagttgttctggtcttcaggagcccaccaagcaatcgaggagtccacggtccagccatctggtccaggaaaagcagcggcaacgagttcctgaatgcggccgtagcttgctgcctcgctgcccgcggcctcggcggtcggcgcgcagcaacgcggcaagccagactgctagaaggttggtcccggtcatcgctgccgctgtgacttccgcggctccgcgctagtcggcggctccgcgctctccggctatccgacggtgcagacatgctcgtgctggtgctgtagtctgccccctggtaggattcctggctccgccactgtttttatccatcgcatcgggatgggaagacagaaaaaaaaggtcaattacttatgtatcattataaaaagttcactttccctgtgtaccattagaaaggccgtgtttggttgtctcccataaaatttttcaaaatgcatctttctacatttgaaataaaaaaaaaaaaaaaaaaaa

SEQ ID NO: 2186 - protein, 336 aa, Panicum virgatum
  misc_feature: Ceres CLONE 1777123
  misc_feature (1)..(101): Pfam Name: 2OG-FeII_Oxy Pfam Description: 2OG-Fe(II) oxygenase superfamily
MADQLISTAVHDQLPENYARPETQRPRLHEVVSDAQIPVVDLADPDLAAVVARIGEACATHGFFQVLNHGVPVELMDAMLAVAYDFFRLPPEEKAKLYSDDPAKKMRLSTSFNVRKETVHNWRDYLRLHCHPLEQFVPDWPANPPSFREIVSAYCREVRGLGFRLYAAISASLGLEEEYVKKALGEQEQHMAVNFYPKCPAPDLTFGLPAHTDPNALTILLMDQQVPGLQVLKEGRWIAVNPRPNALVINIGDQLQALSNGRYKSVWHRAVVNADRPRMSVASFLCPCNDVLIGPAAKLVGDGSPAVYRDYTYAEYYSKFWSRNLDQEHCLELFRT

SEQ ID NO: 2187 - DNA, 1129 bp, Panicum virgatum
  misc_feature: Ceres CLONE 1777131
  misc_feature: Encodes the peptide sequence at SEQ ID NO. 2188
gctttacggctccccaccccgaaagaatccaccgcagaccgcacacagtcacctagtgcggcggccgccggcaatggcggcggtggcggcgcatggcggcgactacctgcggcgcttcgtcgcggagacggagtggtacaacgagctcgtcctcagcgcggtggcgcccggcaactggtggcgcggcctgccgcacccgttgcagtcgtggatgcgcaacatggtcggcggctacctcctctactacctctcgggcttcctctggtgcttcgtcatctactactggaagcgcaacgcctacatccccaaagattccgtccctacaaatgaagctatgaggaagcaaataattgtcgcatcgaaggctatgcctttgtattgtgcacttccagctttatctgagtacatgattgagagcggatggacacggtgtttctttaatatcagtgaagttggtgtgcccatgtacttaattaatttggctttatatctcatctttgtggagtttggaatttactggatgcacagagagttgcatgacataaagccattatacaaatatctacatgcaacccaccatatttacaacaaggaaaatactctgtctccttttgccgggctcgcgtttcatccagtggatgggattttgcaagcaataccacatgtgtttgccctcttcattttcccaacacacttcaggacgcacattgctctcatattcttggaggccgtgtggacggcaaacatccacgactgcattcatggcaaggtatggcctgtcatgggtgccggctaccataccattcaccacacaacttaccgccacaactatggccactacaccatctggatggactggatgtttggcacgctccgtgagccagtagatatcctcaagaacgagtaagatgtgtgttatcccatgcgttgtgtggggtttttaatctgctcggcctgcttgggcagtctgtcgcctgaagcatcggtgtgtttacttcagtatgctaggtgcatgtcatgttgtgttccccccgtaattttagctctgttcctcgtgatgcagtggagtccaggacgaataaaagtttgctagatgcattctgggttccaaaaaaaaaaaaaaaaaaaa

SEQ ID NO: 2188 - protein, 277 aa, Panicum virgatum
  misc_feature: Ceres CLONE 1777131
  misc_feature (2)..(212): Pfam Name: Sterol_desat Pfam Description: Sterol desaturase
  misc_feature (10)..(272): SWISSPROT Homolog: EC 1.14.21.6 Delta(7)-sterol-C5(6)-desaturase
MAAVAAHGGDYLRRFVAETEWYNELVLSAVAPGNWWRGLPHPLQSWMRNMVGGYLLYYLSGFLWCFVIYYWKRNAYIPKDSVPTNEAMRKQIIVASKAMPLYCALPALSEYMIESGWTRCFFNISEVGVPMYLINLALYLIFVEFGIYWMHRELHDIKPLYKYLHATHHIYNKENTLSPFAGLAFHPVDGILQAIPHVFALFIFPTHFRTHIALIFLEAVWTANIHDCIHGKVWPVMGAGYHTIHHTTYRHNYGHYTIWMDWMFGTLREPVDILKNE

SEQ ID NO: 2189 - DNA, 2363 bp, Panicum virgatum
  misc_feature: Ceres CLONE 1777153
  misc_feature: Encodes the peptide sequence at SEQ ID NO. 2190
aagaaatcctcctcccccctttctgcatctttctttccccgacccccgtctccgcttctcttctcgagagcgcccgccgcacgcgagatcgggaggaggagccgcggcggaggagccagcgccccgcatccctgaacccgtccccgccgggtgctgttgcggccgctcccccacccgcgtcggcggcgcggcctcgcggacgcagcgccacccctgatcccctcggccccacgcgcggcttctttggtggggcagcgaatgccgtgtgctgccgcgtagggtccggtggttgcgagggctggtgttgagtgctgcagaagggagggaagcggtgcttgggccgttgggcggcggttcggtgggagatccggtgagcggggatgcagcaggagcagcggaagaagagttcagcagaggccgagttcttcacggagtatggagatgcaaaccggtacaagatccaagaagtcattggtaagggaagctatggtgttgtgtgctcggccattgatctgcacactcgacagagagtggccataaagaagatacacaatatatttgagcacgtctctgatgctgcaaggatccttcgggagatcaagcttctcagactactaaggcatcctgacattgttgagatcaagcacattatgttacctccctcgagaaaggacttcaaggatatttatgttgttttcgaacttatggagtctgatctccaccaagttataaaggccaacgatgacttgacgaaggagcattaccagttctttctctatcaactactccgggctctcaaatacattcatactgctaatgtttatcatcgtgacctaaagcccaagaatattttagcgaactctaactgcaaactgaaaatatgtgactttggactagcacgagttgcattcaatgataccccaacaacagtattctggacggattatgtcgcaacaagatggtacagagctcctgagctttgtggatccttcttctccaagtatacgccagctattgatatttggagcattggatgcatcttcgctgaggtgttgacagggaagccattatttcctggtaaaaatgttgtccatcagttagacttgatgaccgatcttctaggcacaccatcaatggatacaatttctcgggttcggaatgagaaagcaaggaggtacttgagcagcatgagaaaaaaagacccagttccgttttctcagaagtttcccaatgcagatcctttggcacttaaactattggaaaagctattagcgtttgacccaaaggaccgtccaactgcagaagaggcattgcgtgatccatacttcaaaggtcttgccagggttgaaagggagccatcctgtcagccaatcaaaaaagtggaatttgactttgagcacaaaagaatgtcaaaggaggagataaggaagttgatattccgcgagatattggaatatcacccgcagttactgaatagctacacaaacggcacagagaggacaacctttctctacccaagtgctgttgatcaatttaagaagcagttttctcatcttgaagaaagcggtggtaatggcccatctgttccaatggatagaaaacatgcatcccttcccaggactaccattgttcactcaaatccaattcctgccaaggaacaacctcttgctgcctcatcgagggttagaccagtctctgatgattcatgcaagaatccttgggagaaagaaagaggtcctgcaaatgttcccagggcatctctacccccacaagggctgcaagcacaagcaggaccaggaagagttaatggctcagtgatgaattcagggtatccttcccatcagcaaatcccacaagcgtacggttaccatcaaatgcctgcaagattggacagtaccaaccaatcacaagccatgggtggttatacactgcattcgcaggcccaagcttgtgcaaacagcaaaggcacggccgatgttgctgtaaacatgagagcgcccccattccatgttccagctggccccaagaataacccgctagatagaataacatcagggactgacatatacacacgatctcttaacggcattgttgctgccgcagcagcatcagttggcactggtactggtactcacagaaatgttggtgttgtgccctccggcatgtcaaggatgtattagcttgctgcagtggttgcaaatcttagctatatgggtcacagcttcatcaggactagcctggaagaagtggcatatgctataagcaattcataagaggtgacccctagagtcttggactcctgttctcttttacccgttgttggtaagccatctaatcaggcggaaaaaaaaaaaaaaaaaaaa

SEQ ID NO: 2190 - protein, 599 aa, Panicum virgatum
  misc_feature: Ceres CLONE 1777153
  misc_feature: Great-hit functional homolog of the protein sequence encoded by LOCUS At2g42880
  misc_feature (1)..(599): SWISSPROT Homolog: EC 2.7.11.24 Mitogen-activated protein kinase 10
  misc_feature (7)..(479): SWISSPROT Homolog: EC 2.7.11.24 Mitogen-activated protein kinase 9
  misc_feature: Useful for making plants with altered cell wall content and/or composition
MQQEQRKKSSAEAEFFTEYGDANRYKIQEVIGKGSYGVVCSAIDLHTRQRVAIKKIHNIFEHVSDAARILREIKLLRLLRHPDIVEIKHIMLPPSRKDFKDIYVVFELMESDLHQVIKANDDLTKEHYQFFLYQLLRALKYIHTANVYHRDLKPKNILANSNCKLKICDFGLARVAFNDTPTTVFWTDYVATRWYRAPELCGSFFSKYTPAIDIWSIGCIFAEVLTGKPLFPGKNVVHQLDLMTDLLGTPSMDTISRVRNEKARRYLSSMRKKDPVPFSQKFPNADPLALKLLEKLLAFDPKDRPTAEEALRDPYFKGLARVEREPSCQPIKKVEFDFEHKRMSKEEIRKLIFREILEYHPQLLNSYTNGTERTTFLYPSAVDQFKKQFSHLEESGGNGPSVPMDRKHASLPRTTIVHSNPIPAKEQPLAASSRVRPVSDDSCKNPWEKERGPANVPRASLPPQGLQAQAGPGRVNGSVMNSGYPSHQQIPQAYGYHQMPARLDSTNQSQAMGGYTLHSQAQACANSKGTADVAVNMRAPPFHVPAGPKNNPLDRITSGTDIYTRSLNGIVAAAAASVGTGTGTHRNVGVVPSGMSRMY

SEQ ID NO: 2191 - DNA, 1922 bp, Panicum virgatum
  misc_feature: Ceres CLONE 1777157
  misc_feature: Encodes the peptide sequence at SEQ ID NO. 2192
agggacctccagctcgttgcgtctataaaaggtagaggcatagcagccgggactgagagtgcagcagcaaatcctgggccaggccggggtcgaggacggagccaaccgtccgttccggcactagctttggggatgggtgcccggaccggaatggcggcgaagcggctcctgtcctctgtgctcctcgtcgcagctctcgcctgcgacggcacgcatgccaagttcagcaggcacagcttccccaaggacttcatcttcggcaccggctccgcggcgtaccagtacgagggagcatacaaggaaggaggcaaagggcttagcatatgggacaagttcacccacatcccaggaaaaatcttgaacaacgataacggcgacgtggcacttgacatgtaccatcgatacaagggggatgtgcaactcctcaaggacatgaacatggactccttccggttctccattgcttggagcaggatcttgccaaatggttccctaagtggaggaatcaacaaagagggcgtggccttctacaacaacctcatcaacgaagtcatcgccaaaggactgcggccattcgtcaccatcttccactgggacacgcccctggccttggaggagaagtacggaggcttcctcagtgagaacatcatcaaggactacgtggacttctccgaggtctgcttcatggagttcggcgaccgcgtcaaggactggaccaccttcaacgagccctggacgtacgcggagcgtggctactccgcgggggccttcgcccccggccgctgctcgccgcacgtctccacgtcctgcttccccggcgactcggcgcgggagccctacgtcgtgacgcaccacatcctcctcgcccacgcccaggccgtggcgctctaccgcgcccggtaccagaaggcgcagcgcgggcagatcggcatcaccgtggtctcccactggttcgtccccgccaccaactcctccgccgaccgcgctgccgtgcgccgcagcctcgacttcatgctcggctggttcctcgaccccatcgtgcacggcgcgtacccggccaccatggccgggtacctcggtgcccggctgccccggttcacgccggagcaggcgcggctcgtcaggggctcctacgacttcatcggcgtcaactactacaccacctacttcactaccgccgtgccgccggccaacaagctccggcagtcgtacgacaccgacgtccgcgccaacacctccggcttccgcaacggcgtgcccatcggcaagccggagttcgtgtccatcttcttcaactaccccgccggcctccgggagctcctgctctacaccagccggcggtacggcaacccggtgttgtacgtcacggagaacggcatcgccgaggggaacaacgcgacgctgccgctcgcggaggcgctcaaggacgggcacaggatcgagttccacgccaagcacctgcagttcgtgaaccacgccatcagggacggcgccaacgtcaagggctacttcatgtggaccttcatggactgcttcgagtggggcgacggctacctcgatcgattcggcctcatcttcatcgaccgcatcaatggcctcaagcgctaccggaaggagtcaagctactggatcgagaacttcctcaagcggtagacagatccttttctggtctggagagtccatccacatcgatcgacctcttgtttcaaaggctgggtgttgccatggcatgagctggctgtatttgtttgcagagagatttattttgcgcattgggtgcctggggtgtctcgcagataaagggggaataaagctcactgcggagagctatgtatctgtcagtcaaacgtcgtgtattgtagttcagttaatcagttcctcaatcagaataaaccaaataaagttgtgaaaggttttgaacg

SEQ ID NO: 2192 - protein, 506 aa, Panicum virgatum
  misc_feature: Ceres CLONE 1777157
  misc_feature: Great-hit functional homolog of the protein sequence encoded by LOCUS At5g24540
  misc_feature: Great-hit functional homolog of the protein sequence encoded by LOCUS At5g24550
  misc_feature: Great-hit functional homolog of the protein sequence given in SEQ ID NO 9260
  misc_feature: Great-hit functional homolog of the protein sequence given in SEQ ID NO 9651
  misc_feature (6)..(479): Pfam Name: Glyco_hydro_1 Pfam Description: Glycosyl hydrolase family 1
  misc_feature: Useful for making plants with altered cell wall content and/or composition
  misc_feature: Useful for making plants with altered oil content
  misc_feature: Useful for making plants with modulated biomass
  misc_feature: The plant is abnormally small.
MGARTGMAAKRLLSSVLLVAALACDGTHAKFSRHSFPKDFIFGTGSAAYQYEGAYKEGGKGLSIWDKFTHIPGKILNNDNGDVALDMYHRYKGDVQLLKDMNMDSFRFSIAWSRILPNGSLSGGINKEGVAFYNNLINEVIAKGLRPFVTIFHWDTPLALEEKYGGFLSENIIKDYVDFSEVCFMEFGDRVKDWTTFNEPWTYAERGYSAGAFAPGRCSPHVSTSCFPGDSAREPYVVTHHILLAHAQAVALYRARYQKAQRGQIGITVVSHWFVPATNSSADRAAVRRSLDFMLGWFLDPIVHGAYPATMAGYLGARLPRFTPEQARLVRGSYDFIGVNYYTTYFTTAVPPANKLRQSYDTDVRANTSGFRNGVPIGKPEFVSIFFNYPAGLRELLLYTSRRYGNPVLYVTENGIAEGNNATLPLAEALKDGHRIEFHAKHLQFVNHAIRDGANVKGYFMWTFMDCFEWGDGYLDRFGLIFIDRINGLKRYRKESSYWIENFLKR

SEQ ID NO: 2193 - DNA, 1282 bp, Panicum virgatum
  misc_feature: Ceres CLONE 1777168
  misc_feature: Encodes the peptide sequence at SEQ ID NO. 2194
aggccacagcagagcagagggagcgcgccccgcacacgcttcctgtgcccctcgcgtgagccgtgagctgcggcgagagagagagagagagagagagagagagagagagagagagagagagagagaggcatgcacgctagcctggcctcgtacgcggcggcggccatgccgaatctggacctccgccccgagatggcgcacgcgcaccagcccgccatgtcgccctcgcaccacgcctgggacggcaatggcaccgccgtcgcgcccacccccatgcccaagaggctggaggggaaggtggccattgtgaccggcggcgcgcgggggatcggcgaggccatcgtgcggctgttcgtcaagcacggggcccgggtggtgatcgcggacatcgacggcgcggcgggcgaggcgctggcgtcggcgctgggcccgcaggccagcttcgtgcgctgcgacgtgtccgtggaggaggacgtccagcgcgccgtggactgggcgctgtcgcgccacggcggccgcctcgacgtctactgcaacaacgccggggtgctgggccgccagacgcgcgccgccaagagcatcctatccttcgacgcgggcgaattcgaccgcgtcctccgcgtcaacgcgctgggcgccgcgctcgggatgaagcacgcggcgctcgccatggcgccccgccgcgcggggagcatcgtctccgtcgccagcgtcgccggcgtgctcggcggcttggggccccacgcctacaccgcctccaagcacgccatcgtcggcctcaccaagaacgccgcctgcgagctcggcgcgcacggcatccgcgtcaactgcgtctcccccttcggcgtcgccacggccatgctcatcaacgcctggcgccagggccacggcgacgacggcgacgccgacctcgacctcgacatcaccgttcccatcgacgaggaggtggaaaagatggaggaggtggtcaggggactcgccacgctcaagggcaccacgctgagacccagggacatcgccgaggcggtcctcttcctggccagcgacgagtccagatacatctccggccacaacctcgtcgtggacggcggcgtcaccacctcgagaaacctcatcggattgtgaacgcgatttcatcccattgcagagctaattagttcttagagagagaaaaaaagattgttaatttaggagccggtgcagctgtactcgaagtgatttcgtttggttgattgattcatcaacaaatgtcgagcttgaacaaaaaaaaaaaaaaaaaaaa

SEQ ID NO: 2194 - protein, 331 aa, Panicum virgatum
  misc_feature: Ceres CLONE 1777168
  misc_feature (1)..(171): Pfam Name: adh_short Pfam Description: short chain dehydrogenase
MHASLASYAAAAMPNLDLRPEMAHAHQPAMSPSHHAWDGNGTAVAPTPMPKRLEGKVAIVTGGARGIGEAIVRLFVKHGARVVIADIDGAAGEALASALGPQASFVRCDVSVEEDVQRAVDWALSRHGGRLDVYCNNAGVLGRQTRAAKSILSFDAGEFDRVLRVNALGAALGMKHAALAMAPRRAGSIVSVASVAGVLGGLGPHAYTASKHAIVGLTKNAACELGAHGIRVNCVSPFGVATAMLINAWRQGHGDDGDADLDLDITVPIDEEVEKMEEVVRGLATLKGTTLRPRDIAEAVLFLASDESRYISGHNLVVDGGVTTSRNLIGL

SEQ ID NO: 2195 - DNA, 1521 bp, Panicum virgatum
  misc_feature: Ceres CLONE 1777172
  misc_feature: Encodes the peptide sequence at SEQ ID NO. 2196
gaaatcctaggggctagggttaccctccaccccaatcccatcgtccgttccgatccggttcgatcccccgccgcccaagccttcgccgctcatccatgtcccaccacgacggcagcaagccttaccagccgcgccgggggcccgagcggcccccgcagccggcggacgaggtcgccgcgccgccccccgccaccgctgccccggctgtggaccacctcgccgcggtggccgccgaggcggaggcgctgaaccgctacaccgagcatcagcagcagcagcagcagcttcaggggcacgagcaggttagggaggaagaggacgacgatgacgaggaggaagatgagatggaggacgacgaggacgagcaggaggggcaggacggcggcgtcggcggggagcacgtccccatggacgcggatgctgctgccgctgccgcggctgctgccggcgctcagatggacccgcacgcggcgatggtgcctggggccgtgccgcccatggcgcccaaccagctcaccctctctttccagggcgaggtctacgtgtttgattccgtctcgcctgataaggttcaagccgttctcttactgcttggaggaagggagctgaacaacccaggactgggcaacgcgtcgtcctctggagcatacagtaagaggttgaattatcctcatcgggtggcatcgttgatgaggtttagggagaagcggaaggagcggaactttgataagaagatccggtactctgtaaggaaggaagttgcacttaggatgcagcgcaatcgaggtcagtttacatcttcaaaaccaaagcctgatgaaatatcagcatcagaaataacgactgcagatggctccccgaattgggggtcagtggaaggccgacctccatccgctgccgaatgccatcactgtggtactagtgcaacagctacacctatgatgcgtcgtggacctgacggacctagaacgttatgcaatgcttgtggcctcatgtgggcaaataagggtctgctgagggacttgtcaaaaggtcctgggcctcttcaagctgtgcaatcagcacctgttctagatggtggtaatggaagtgtcatagggaatcctggtggtggtgggctagagaatcctgcatcagcgatggccaatggccatgagtcatcaatgtgaccggagaagctgtgcatattcagcgatgggttaaaaccatgaggatcatccttgagcgatctctgcagtgggcggtcagctgttgtactataacttgaatgggaaccttcttagttatggaataccttttattttccatctgtgtaggttttaagtgctgcggcaatgttttatctcgtgggatcatgtttgcagctgttgttgtggctatagcgaatgtgtttttcctctcttgaggcgcgactgttaagaactgatgaagtaaattgcttcagtgtgaacacttggaagtgcctgtagttgtatgtagatttcaaagcagatgtttgaccaaaaaaaaaaaaaaaaaaaa

SEQ ID NO: 2196 - protein, 357 aa, Panicum virgatum
  misc_feature: Ceres CLONE 1777172
  misc_feature: Great-hit functional homolog of the protein sequence given in SEQ ID NO 9229
  misc_feature (1)..(38): Pfam Name: GATA Pfam Description: GATA zinc finger
  misc_feature: Useful for making plants with altered terpenoid content
MSHHDGSKPYQPRRGPERPPQPADEVAAPPPATAAPAVDHLAAVAAEAEALNRYTEHQQQQQQLQGHEQVREEEDDDDEEEDEMEDDEDEQEGQDGGVGGEHVPMDADAAAAAAAAAGAQMDPHAAMVPGAVPPMAPNQLTLSFQGEVYVFDSVSPDKVQAVLLLLGGRELNNPGLGNASSSGAYSKRLNYPHRVASLMRFREKRKERNFDKKIRYSVRKEVALRMQRNRGQFTSSKPKPDEISASEITTADGSPNWGSVEGRPPSAAECHHCGTSATATPMMRRGPDGPRTLCNACGLMWANKGLLRDLSKGPGPLQAVQSAPVLDGGNGSVIGNPGGGGLENPASAMANGHESSM

SEQ ID NO: 2197 - DNA, 1756 bp, Panicum virgatum
  misc_feature: Ceres CLONE 1777179
  misc_feature: Encodes the peptide sequence at SEQ ID NO. 2198
ggtggccccgtctcgtcttcgtctccgccttccccacgagtcgcaggcgcacggccaactaatctcccgtctcacctcgccgcgctttaaactcttcagatttttttttgtccgcgtcctactccgcccctcgaccgcagccgccttcgctgctccggtgccaccccgccacccgccgctactgccgccggcgatggatcgtgaagaagtgaccgagttcctggggcaggtgcccctcctgcagtgcctcccgggctcctccctccgcaggatcgccgaggccgtccaggtcaagcgctacgaacctggtgactatgtcgcccgcgaaggtgaacctgtagatggcctttacatcatattggacggtcaggctgaagtttctgcatctgcgaatgcagaagaagcaaaccgcccagactatgtgttaaataagtatgactactttggttatggaacaaatagttccgatcatcaagttaatgttgtagcactatcaaagctgacctgcttcatattgcccaatcaatatggatatttgttacaaccaaaaacaatttggaatgcggaggagacacctgaacattctttgctggaaaaaattttgcatttagaaccactagaggtcgatatcttccgtgggtttactttaccagaaggtccaatgtttaggcaagtttttggaggacaattgattggacaggcactaacagctgcatccaagactgttgattgtctaaaaatggtgcatagtttgcatgcaattttccttgtcgctggagacaataacatgccaataatatatcaagttcatcgggcgcgtgatggatccagctttgcaaccagaaaagtagaggcgaagcagaaaggcctagttatattcactttgattgcttctttccagaaggaagaagtaggctttgagcatcaggctgcaatcatgcctgatgttcctcctccagaacagctccttaatctggaggagatacgagaaagacggcttactgacccgcgcttcccaacgcaatataggaacttggcagctaaaaagaagttcacaccttggcccatagaaatgagattctgtgaagactcagcatctcaacataaaccaagcttaaactactggtttagagctcgaggaaagctttcagatgatcaagctctacatagatgtgttgtagcatatgcttcggatctactttattctggtgtcagcctgaatcctcaccgggagaagggtttgaagacatactcactcagtctcgatcactcgatctggttccacaaacctgtgaaggctgatgactggttgctgtacgtgattgagagcccatctgcgcatggtggccgcggtttcgtcactggacgcatgttcaacaggcaaggagagcttatcatgtcgctgacccaagaggcactgattaggagggagaagacacgaggaccaaacccaaggccaaagctttgaaaggtgtagaagagtctgtagtaggctcctctcgttcaatttggtttagatacttacgaattcatagcacgaaatcaggcaacgaattcatagcacgaaatcaggcagtatataaggaaaaagatatactttgtcgtgagctggatatatatctataacttagtgtggacaggcctagttgaatattggtgagggttgggaaaataaaatcactttacatcccttaagttgtaactaatttcgatggcatgggcatacttcggcttccaaaaaaaaaaaaaaaaaaaa

SEQ ID NO: 2198 - protein, 424 aa, Panicum virgatum
  misc_feature: Ceres CLONE 1777179
  misc_feature (1)..(128): Pfam Name: Acyl_CoA_thio Pfam Description: Acyl-CoA thioesterase
MDREEVTEFLGQVPLLQCLPGSSLRRIAEAVQVKRYEPGDYVAREGEPVDGLYIILDGQAEVSASANAEEANRPDYVLNKYDYFGYGTNSSDHQVNVVALSKLTCFILPNQYGYLLQPKTIWNAEETPEHSLLEKILHLEPLEVDIFRGFTLPEGPMFRQVFGGQLIGQALTAASKTVDCLKMVHSLHAIFLVAGDNNMPIIYQVHRARDGSSFATRKVEAKQKGLVIFTLIASFQKEEVGFEHQAAIMPDVPPPEQLLNLEEIRERRLTDPRFPTQYRNLAAKKKFTPWPIEMRFCEDSASQHKPSLNYWFRARGKLSDDQALHRCVVAYASDLLYSGVSLNPHREKGLKTYSLSLDHSIWFHKPVKADDWLLYVIESPSAHGGRGFVTGRMFNRQGELIMSLTQEALIRREKTRGPNPRPKL

SEQ ID NO: 2199 - DNA, 1769 bp, Panicum virgatum
  misc_feature: Ceres CLONE 1777194
  misc_feature: Encodes the peptide sequence at SEQ ID NO. 2200
agcattaaccagcagctcgcagcctcgcacacgcacacacgcgccacggccgctccgtgaggccgcccccccgcccgcccgcgcagcgcgagagagaaccgccgggcatgcagcgcctcgcctcctcccggaggctcctcggggccgcgctcgcccccgccagggccaactccagcctctccgcggccgtcgccgcggcgcccgcggtggagaatggcgccgccgcgtccccgaagatgccgggcttcgactacacgccgccgccctacgacggcccgcgggccgaggagatcttccggaagcgggccgagttcctcagcccgtccctcttccacttctacgaccgccccttgaacatagttgatggaaagatgcagtacctatttgatgaggatggtcgtcgttacctggatgcttttggtggcattgcaacagtttgctgtggccactgccatcctgatgtggttgaagccatagtaaaccaggcaaagaggatccaacactccacagttctgtatctcaatcatgccattgcggattttgcagagtcattggcatccaaaatgcctggggatttgaagatagttttcttcacaaattcaggcacggaggcgaatgagctcgcactgatgattgcacgtctttacactggttgcaatgacattatctcccttaggaatggataccatgggaatgctgctggaacaatgggtgctaccgctcaatccaattggaaattcaacgttgttcagaccggagtacaccatgcgcttaacccagacccctacagaggtgcttttggctctgatggggagaaatatgccagagatgttcaggaaatcattgaatttgggactacagggagagttgctggtttcatttcagaagccatacagggggttggtggaatagtggaattggcaccaggatacttgccagcggcatatgatatagtaaggaaagccggtggtctctgcattgctgacgaagttcaggcgggtgtcgcacgaactggaagccacttctggggatttgaaggccacggtgttatcccagacatagttaccatggcaaagggtatcgggaacggcataccgataggagccgttgtgacaacaccggagattgctcaggtattgacccgtagaagctacttcaacaccttcggtggtaaccccgtcagcactgcaggcggtcatgcggttctcaaagtgctggagaaggagaagctccaggagaatgcatttgttgtaggctcctatctgaaggaacaacttaacaagctgaaagagaagcatgacatcatcggtgacgttagggggaaaggcttccttcttggagttgagttggtgacagatcgtgaaaagaaaacgccagccaaagctgagatctcacatgtcatgaaccacatgaaagatatgggggtgttggttgggaagggtggtttctacgggaacgtgttcaggataacaccgccgttgtgcttcactaaagaggactctgacttcttcattgatgtgatggacatcgcgctctcgaagctgtgaggcaggctacgcgaagctgatgccatgtacatctgttgatccgtgaataataggagatttgcgaaacagcacctcgttgtttcgtaatccgtgctcgccagcttcagcttcgtccagtctgctgttcctccttatcaagtcgtttaacaactcccttgtttgagatcaataataagttcttttctatgttaaaaaaaaaaacaaaaaaaaaaaaaaaaaaaa

SEQ ID NO: 2200 - protein, 479 aa, Panicum virgatum
  misc_feature: Ceres CLONE 1777194
  misc_feature (1)..(326): Pfam Name: Aminotran_3 Pfam Description: Aminotransferase class-III
  misc_feature (1)..(479): SWISSPROT Homolog: EC 2.6.1.44 Alanine--glyoxylate aminotransferase 2 homolog 2, mitochondrial precursor
  misc_feature (1)..(479): SWISSPROT Homolog: EC 2.6.1.44 Alanine--glyoxylate aminotransferase 2 homolog 3, mitochondrial precursor
MQRLASSRRLLGAALAPARANSSLSAAVAAAPAVENGAAASPKMPGFDYTPPPYDGPRAEEIFRKRAEFLSPSLFHFYDRPLNIVDGKMQYLFDEDGRRYLDAFGGIATVCCGHCHPDVVEAIVNQAKRIQHSTVLYLNHAIADFAESLASKMPGDLKIVFFTNSGTEANELALMIARLYTGCNDIISLRNGYHGNAAGTMGATAQSNWKFNVVQTGVHHALNPDPYRGAFGSDGEKYARDVQEIIEFGTTGRVAGFISEAIQGVGGIVELAPGYLPAAYDIVRKAGGLCIADEVQAGVARTGSHFWGFEGHGVIPDIVTMAKGIGNGIPIGAVVTTPEIAQVLTRRSYFNTFGGNPVSTAGGHAVLKVLEKEKLQENAFVVGSYLKEQLNKLKEKHDIIGDVRGKGFLLGVELVTDREKKTPAKAEISHVMNHMKDMGVLVGKGGFYGNVFRITPPLCFTKEDSDFFIDVMDIALSKL

SEQ ID NO: 2201 - DNA, 1461 bp, Panicum virgatum
  misc_feature: Ceres CLONE 1777199
  misc_feature: Encodes the peptide sequence at SEQ ID NO. 2202
aaagaaaggcgaaggggaagccaaagagagattcgatgagcgatcgagccaaaccaccccggggcgacgcgacgcaagtaccagcacggcagcaccccacgggcctcgccgtcttccccctcggccctcgcgctcccatgccctagcagcaagcgagcgagcacgccagcgagcgagcgaggggcgcccgtccgagcccagcccgaggtcttctctctggtgcgcccatgatttagcaccagccatattgacctccaactctggtgacacaagctgttactagggtagcaaatcaagagctaagaatggcggattcaatggtagcgagcttctggggtcctgttacatcaacgaccgagttgtgcgaggagaactatgcacactcatcatatattgcagaattctataataccatctctaatgtcccatgcgttcttttggcgcttattggactagtgaatgctttccgccaaggttttgagaaacggttcagtgtcctgcacatatccaatatgatacttgctattgggagtatgattttccatgccaccttgcaacatgtcctacaacagagtgatgagactccgatggtgtgggagatccttctatatatgtatgtactctattcaccggactggcattacaggagcactatgcctacattccttttcctatatggtgctgccttcgcggtagttcatttctttgcccggttccaagtagtattcaagttgcattacattggcctctgcctcctctgcatccctcggatgtacaagtactacatacagacaaaagacgtagctgcgaagcggcttgcgaagctgtgggttcttacattaacccttggaactctctgctggctagttgatcgtatctgctgtaagaagctttcgcattggtatgtcaacccgcaggggcacgcatggtggcatgtactcatgggccttaactcatactatgcaaacacatttctaatgttctgtcgggctcagcaacgcgggtgggagccaaggattactcaccttcttggatttttgccatatgtcaaggtccagaaaccagaaaagagggaatgagttacattgttgaatactgatgctattcagtcagccaccagtaagctaatggcctccaatgtgcgcagacaagttgtggcatttttgtatatgggcatccaaatgattacggactataagtgttctgatgtcacactagattttggcaacttaaactgacacctgttttgtaccatatttaatcgtggaacagagattagttggagtgctggtgtcctagttttgcccatcttccctttggttctttgcagttgccttttggtgctaataggactgagtcttattatttatttgttggttgttgattggagtccagttgtattagttactactctgcatggagatagattcatccatatgataaaaaaaaaaaaaaaaaaaa

SEQ ID NO: 2202 - protein, 257 aa, Panicum virgatum
  misc_feature: Ceres CLONE 1777199
  misc_feature (1)..(250): Pfam Name: aPHC Pfam Description: Alkaline phytoceramidase (aPHC)
MADSMVASFWGPVTSTTELCEENYAHSSYIAEFYNTISNVPCVLLALIGLVNAFRQGFEKRFSVLHISNMILAIGSMIFHATLQHVLQQSDETPMVWEILLYMYVLYSPDWHYRSTMPTFLFLYGAAFAVVHFFARFQVVFKLHYIGLCLLCIPRMYKYYIQTKDVAAKRLAKLWVLTLTLGTLCWLVDRICCKKLSHWYVNPQGHAWWHVLMGLNSYYANTFLMFCRAQQRGWEPRITHLLGFLPYVKVQKPEKRE

SEQ ID NO: 2203 - DNA, 1509 bp, Panicum virgatum
  misc_feature: Ceres CLONE 1777212
  misc_feature: Encodes the peptide sequence at SEQ ID NO. 2204
gcttcgtcccaccgagccggcggtggcgcggtgctgtgacaccctccatcctccatccattccctgctcgccgtaactccatcactctttccgaccccgacacccatctcggctctcgccattgccccggcttcgaagcaaaacccgctcgtcgcggctgtctcgtcggagcactcctcctttcacccctctgtcactcttcccaaccgcacaagcaaggcggtggattaatcttgccgcgagggtgttgccgtgccccctcccgcgcctcctgcggcgttcggagtttctctctctgggttccttcagttcggagctattagtactgctttacctggatgcggctctactcatctgcactctgtttgtggcgatcaagcatgcattaccatcctaatcagttcaaaggaggcttcacacataatatggccttgtggaaatgctcgcactcaccttcaagcgtttaccatgtgaaatcttctcaaccacaaagtataaagtactttgtaagcttgatgggccaacaattccgttgtggactgtcaaccagagagggtaatctaagtataaagcttgatatgccttcacacgaaaagtcgaggattggctggaactggaaaggtatgcaccagaagcttggaggtgtagctggtggactttgctttggtttttcggttactggactagcaagcgctgaggttcctatcattagaatcaatgacaatgctgaaacttcatcgtcagctaccagttcaactcatgggaagaaagtgtacacagattattctgtcactggtattcctggagatggtaggtgtttattccgctctgtgattcatggtgcatgtattagatcagggaaacccatacctaatgaagacctgcagagaaaactagctgatgaattgagagcgatggtcgctgatgaatttgtgaagaggcgggaagagactgaatggttcgttgagggagattttgatacatatgtatcgcatattagggagccacatgtgtggggaggcgaaccagaattgttcatggcttcccatgttcttcagatgccaataactgtttacatgcgcgatgaagatgcgggtggtctgatagcaattgcggaatatggtcagcagtatggaaaagaggacccaatccaggtcttgtatcatggttttggccattatgatgctctacagattccagcaaagattggttcaaagcggaaactgtagaaattgttgagttcaaaattgtaaagaggcaaggctgcagaaggatctggtttgctggaacggcttcaccttcagggcagaggttcctcagatcgacatgctacatggtgggtgggtgcatgtgctctctatggctgtgtttagatccgctaaaatagtggtaaaaaggatcacatcagacattatagtatattgtagtatttttcgtttgtttgtggtaattgttattctactatgacctaactaggttcaaaagattcaaaaaaaaaaaaaaaaaaaa

SEQ ID NO: 2204 - protein, 296 aa, Panicum virgatum
  misc_feature: Ceres CLONE 1777212
  misc_feature (1)..(127): Pfam Name: OTU Pfam Description: OTU-like cysteine protease
MRLYSSALCLWRSSMHYHPNQFKGGFTHNMALWKCSHSPSSVYHVKSSQPQSIKYFVSLMGQQFRCGLSTREGNLSIKLDMPSHEKSRIGWNWKGMHQKLGGVAGGLCFGFSVTGLASAEVPIIRINDNAETSSSATSSTHGKKVYTDYSVTGIPGDGRCLFRSVIHGACIRSGKPIPNEDLQRKLADELRAMVADEFVKRREETEWFVEGDFDTYVSHIREPHVWGGEPELFMASHVLQMPITVYMRDEDAGGLIAIAEYGQQYGKEDPIQVLYHGFGHYDALQIPAKIGSKRKL

SEQ ID NO: 2205 - DNA, 1519 bp, Panicum virgatum
  misc_feature: Ceres CLONE 1777223
  misc_feature: Encodes the peptide sequence at SEQ ID NO. 2206
atctccccttccaacttctcacttcagttacgctcacgcccgtccgtctcttccgtcgaccgtcttccccaactcccggcggccgcgctcctccgtcctccctccacggcgcttgcgacccgtccgtcctgcgcccagcagccacactcgtggcagtagggggggcgagccggcggcgttcggggtcctctcgccggctgctggcagcccgtctagactggccgtgatgctcctggcgcgcaccctgcgctcccgcctccgcccgccgctcgcggcggcggcggcgttctcctcggcgccggcatcggcggccgcggcggaggcggagcgggcgatacgggacggtccccggaacgattggagcaggcctgagatccaggccatctacgactccccgctcctcgatctcctcttccacggggctcaggtccacagaaatgtgcacaaattcagagaagtgcagcaatgcacacttctttcaataaagactggtggatgcagtgaagattgttcttactgccctcagtcatcaagatacaacactggattgaaggcccagaaattgatgaacaaagatgctgtcctagaagcagcaaaaaaggcgaaagagtctgggagcacacgtttttgcatgggagctgcatggagagaaaccatcggaaggaaaacaaatttcaatcagattcttgaatatgtcaaggaaataaggggtatgggcatggaggtctgttgcacgctgggcatgatagagaaacaacaggctgaagaactgaaaaaggctggacttacagcttacaatcataaccttgatacatcaagagagtattatcccaatattattaccacaagatcatatgatgatagactgcagactctccagcatgttcgtgaagctggaataagcatctgttcaggtggaataattggtcttggagaagcagaggaggaccgtgtggggttgttgcatacactagccaccttgcctacacacccagaaagcgttcctattaatgcattggttgctgttaaaggcacacctcttgaggatcagaagcctgtagagatctgggaaatgatccgcatgattgccactgctcggatcgtgatgccaaaggcaatggtgaggctttcggcaggccgcgtacggttctccatgccagaacaagcgctctgcttccttgctggggccaactccatatttgccggtgagaaacttctgactaccgcgaacaatgacttcgatgcggaccaggcaatgtttaagatcctaggtcttatccccaaggccccaagctttggtgatgaagaggcggcagctcctgctgacaccgagaggcctgaacaagccgcttcaatgtaaagaaaaatgtgaaacaaattaccgatttttaatatcaccattactgcgatactagcactagtgttagctagagctagagcattgtattgtagaaaccactattttgtcgtcgcttgagacaataaaataaactaggcccaaaaaaaaaaaaaaaaaaaa

SEQ ID NO: 2206 - protein, 377 aa, Panicum virgatum
  misc_feature: Ceres CLONE 1777223
  misc_feature (1)..(376): SWISSPROT Homolog: EC 2.8.1.6 Biotin synthase
MLLARTLRSRLRPPLAAAAAFSSAPASAAAAEAERAIRDGPRNDWSRPEIQAIYDSPLLDLLFHGAQVHRNVHKFREVQQCTLLSIKTGGCSEDCSYCPQSSRYNTGLKAQKLMNKDAVLEAAKKAKESGSTRFCMGAAWRETIGRKTNFNQILEYVKEIRGMGMEVCCTLGMIEKQQAEELKKAGLTAYNHNLDTSREYYPNIITTRSYDDRLQTLQHVREAGISICSGGIIGLGEAEEDRVGLLHTLATLPTHPESVPINALVAVKGTPLEDQKPVEIWEMIRMIATARIVMPKAMVRLSAGRVRFSMPEQALCFLAGANSIFAGEKLLTTANNDFDADQAMFKILGLIPKAPSFGDEEAAAPADTERPEQAASM

SEQ ID NO: 2207 - DNA, 1560 bp, Panicum virgatum
  misc_feature: Ceres CLONE 1777237
  misc_feature: Encodes the peptide sequence at SEQ ID NO. 2208
gcgctacctgtctcgccggctcgccgcccccgtcccgcccccctccaggccggccatggcgttcaacaagatcaaggtcgccaaccccgtcgtcgaaatggacggcgatgagatgaccagagtgttctggaaatctatcaaggacaagctgatcttcccgttcttggacttggacatcaaatactttgaccttggacttccacaccgtgatgctactgatgacaaagtcacagtggaagctgcggaggccacactcaagtacaatgtggctatcaagtgtgccacgattacaccagacgaagcaagggtaaaagagtttggcttgaaggccatgtggaagagcccgaatggcacaattaggaacattctgaatggcactgtgttcagagaaccaatcatctgcaaaaacatcccaaggcttgttccagggtggacaaaacctatttgcattggaaggcatgcattcggtgatcagtaccgggcaactgatgctgttatcaagggacccggcaagcttaaattagtttttgagggaaaagaagagcaagtcgatctggaggtgttcaactttactggtgctggaggagttgcattgtccatgtacaatactgacgagtccatccatgcctttgctgaggcttccatggccactgcttatgagaagaaatggccattgtaccttagcactaagaatacaattttgaagaaatatgatggcaggttcaaggacattttccaggaggtgtatgaagctggatggaaatccaaatttgaggctgccggcatatggtatgagcaccgccttatcgatgacatggtagcatacgctcttaagagtgaaggagggtatgtctgggcttgcaagaattatgatggagatgtgcagagcgatttcttagctcaaggttttggctcattgggtttgatgacatcagttttggtgtgccctgatgaaaagacgatcgaagctgaagctgcccatggtactgttacccgccattaccgtgttcaccagaaagggggtgaaaccagtactaacagcattgcttcaatctttgcgtggacaagaggactagcacacagggcaaagctcgatgacaatgctagactgcttgacttcactcagaagcttgaggctgcctgcattggagctgttgaatctgggaagatgaccaaggaccttgcccttcttgttcatggatcttcaaatgtcacgaggagccattacctgaacaccgaagagttcatcgacgcggttgctgatgagctcagatcaaggctggcggccaactccaacttatgaaatccttgctgaagctgcaatgcttacttggacagacgattcgagtcatttttcatacattaccattttctttccttggtgccccaatcctgaaggcctgaactgaacgcgaatatccccagcagtgtgtcaaatcattaccaatgagagattgctgtggattccacgattatgcaactcatgtactgatgtacctgattgcccgttattttcaataaaagataaagaacttgtgtcaaaaaaaaaaaaaaaaaaaa

SEQ ID NO: 2208 - protein, 415 aa, Panicum virgatum
  misc_feature: Ceres CLONE 1777237
  misc_feature (1)..(374): Pfam Name: Iso_dh Pfam Description: Isocitrate/isopropylmalate dehydrogenase
  misc_feature (1)..(409): SWISSPROT Homolog: EC 1.1.1.42 Isocitrate dehydrogenase [NADP]
  misc_feature (2)..(411): SWISSPROT Homolog: EC 1.1.1.42 Isocitrate dehydrogenase [NADP]
MAFNKIKVANPVVEMDGDEMTRVFWKSIKDKLIFPFLDLDIKYFDLGLPHRDATDDKVTVEAAEATLKYNVAIKCATITPDEARVKEFGLKAMWKSPNGTIRNILNGTVFREPIICKNIPRLVPGWTKPICIGRHAFGDQYRATDAVIKGPGKLKLVFEGKEEQVDLEVFNFTGAGGVALSMYNTDESIHAFAEASMATAYEKKWPLYLSTKNTILKKYDGRFKDIFQEVYEAGWKSKFEAAGIWYEHRLIDDMVAYALKSEGGYVWACKNYDGDVQSDFLAQGFGSLGLMTSVLVCPDEKTIEAEAAHGTVTRHYRVHQKGGETSTNSIASIFAWTRGLAHRAKLDDNARLLDFTQKLEAACIGAVESGKMTKDLALLVHGSSNVTRSHYLNTEEFIDAVADELRSRLAANSNL

SEQ ID NO: 2209 - DNA, 1132 bp, Panicum virgatum
  misc_feature: Ceres CLONE 1777242
  misc_feature: Encodes the peptide sequence at SEQ ID NO. 2210
aggcagcttatagctcagacccacgacggccgcgacaggctagcccaccagcagctagctcccgcggagccgatgggtagcgccgacgtcgacgtcgggacggagctcagtctcgggctgccgggaggcggcgccgaggcggccaaggccgcgaagaggggcttcgaggacaccatcgacctcaagctgaagctgcccaccgctggcatggaggaagccgccgccggcaagccggagccggccgccgagaaggccaagaggcccgcagaggcggcggccgctgatgcagagaagccacccgcacccaaggcacaagctgtgggttggccaccagtgcgatcataccgaaggaacgtcatgaccgtccagtcagtgaagagcaagaaggaagaggaacccgagaagcagcagcccgctgccaacgccggcagtaacagctctgccttcgtgaaggtcagcatggatggcgcaccctacctacgtaaggtggacctgaagatgtacaatagctacaaggacctctcgattgctctgaagaagatgttcagcaccttcacaactaggaacaacatgaacgaggggaaattggttgatccggtgactggtgcagatgttgtcactacttacgaagacaaggatggtgactggatgcttgttggcgacgtcccgtgggagatgtttgtcgagtcatgcaagcgcctgaggatcatgaagagttctgaagccatcggtcttgcaccaagaaccaaggacaagtgcaagaacaagagctgaacaagatgcagcgtcaagatgctgcgcattatgtcataagaatggtgcccttgcagtgtgctgcggttttcctagaaatataatgtgttttaattactagtggagggagagctgtcttgttcaatttgttcatggaccagaagcaataatctatctgtgtgtagctggaatggtgttatgtgatgtcccctactgtgagtcccagaatctacttggtgattttattccagtgttgttaatcaagcttgtgtgattgttaagggcatcaatgagactattattattattatggtatcttgtaagttaacctgtttgttaatgtcaatacaatatttggcaaaaaaaaaaaaaaaaaaaa

SEQ ID NO: 2210 - protein, 233 aa, Panicum virgatum
  misc_feature: Ceres CLONE 1777242
  misc_feature (1)..(215): Pfam Name: AUX_IAA Pfam Description: AUX/IAA family
  misc_feature: The sequence is a functional homolog of  SEQ ID NO 2004 in the  10/374,780 US patent application
  misc_feature: The sequence is a functional homolog of  SEQ ID NO 660 in the  11/479,226 US patent application
  misc_feature: The sequence is a functional homolog of  SEQ ID NO 739 in the  10/374,780 US patent application
  misc_feature: Useful for making plants with modulated growth and phenotype characteristics
MGSADVDVGTELSLGLPGGGAEAAKAAKRGFEDTIDLKLKLPTAGMEEAAAGKPEPAAEKAKRPAEAAAADAEKPPAPKAQAVGWPPVRSYRRNVMTVQSVKSKKEEEPEKQQPAANAGSNSSAFVKVSMDGAPYLRKVDLKMYNSYKDLSIALKKMFSTFTTRNNMNEGKLVDPVTGADVVTTYEDKDGDWMLVGDVPWEMFVESCKRLRIMKSSEAIGLAPRTKDKCKNKS

SEQ ID NO: 2211 - DNA, 1813 bp, Panicum virgatum
  misc_feature: Ceres CLONE 1777244
  misc_feature: Encodes the peptide sequence at SEQ ID NO. 2212
acgccacagaaaaaacgcacgagtccacagcacatttgctcgggagaaatattaccagctgcgaattttttttctctctcaaagccccagagagcttccatggcttccgccaccgcctccatctcgtcgcaccccgccgccctttgcgatgtcaaagccgcgaggattggagccatgaggcagcaggtggccgtggcttcggcggcggcggcggcacggggccagtgcgctcgggcggtgcgcccgctgcgcgcggcggagcaggggaggcagccggtgtcggcctcggcggcctcggcggcgccggcggcgcccgtggccgatgaggtggcggcccccgcggcggtggactacgaggccctggcgcgcgagctggagggtgcgtcgccgctggaggtcatggaccgggcgctggccatgttcggatccgagatcgccatcgccttcagtggggcggaggacgtggcgctgatcgagtacgcgaagctgacggggcgccccttccgggtgttcagcctggacacggggcggctgaacccggagacgtaccagttcttcgacaaggtggagaagcactacggcatccgcatcgagtacatgttcccggacgccggcgaggtgcaggagctggtgcggaccaagggcctcttctccttctacgaggacggccaccaggagtgctgccgggtgcgcaaggtgcggccgctgcgcagggcgctcagggggctcagggcatggatcaccggccagaggaaggaccagtcccccggcaccagggccagcattcccgtcgttcaggtcgacccttcgtttgaaggcctggatggcggagctggtagcttgatcaagtggaaccccgtggccaatgtcgacggcaaggacatctggacattcctgaggaccatggatgtccctgtcaactccctgcatgctcaagggttcgtgtccgtcggttgcgagccgtgcaccaggccggtcctgcccgggcagcacgagcgtgaaggccggtggtggtgggaggacgccaaggccaaggagtgcggcctgcacaagggcaacatcgacaaggacggccaggcggcggcgcccaagcccgccaacggcaacggcgcggcgggtgccccggacatcttcgagagccccgccgtggtgtccctcacccgcgccgggatcgagaacctgctgcgcctggagaagcgcgcggagccctggctcgtggtgctgtacgcgccctggtgccccttctgccaggccatggaggcctcctacgtggagctggccgacaagctggccggggccggcgtgaaggtggccaagttccgcgccgacggcgagcagaagccgtttgcgcaagcggagctgcagctgcagagcttccccaccgtgctcctgttcccgacccgcaccgccaggcccatcaagtacccatccgagaagagggacgtcgactcgctcctcgccttcgtcaacagcctccggtgagagtgagagaccgcccgccagggagcgagaaccatcgttctctgtcagaattgtacttagagagggaggaggtatctgagagagggaactggggatgataggaagaaagggatggggttcagaaatacttcagatggagatcatgcatctctagctgttgtcactgcaaactgttgcaggtaaaaacccgaagcctgaggtccggtgttataaggcaaaaggtcgaggttatttgtgtgtacttatagctagtggtgagttggtgacagaggattgtaagggtaaaatcaaataagaaaatcagttttggcaaaaaaaaaaaaaaaaaaaa

SEQ ID NO: 2212 - protein, 460 aa, Panicum virgatum
  misc_feature: Ceres CLONE 1777244
  misc_feature (1)..(182): Pfam Name: PAPS_reduct Pfam Description: Phosphoadenosine phosphosulfate reductase family
  misc_feature (2)..(460): SWISSPROT Homolog: EC 1.8.4.9 5'-adenylylsulfate reductase 1, chloroplast precursor
  misc_feature (2)..(460): SWISSPROT Homolog: EC 1.8.4.9 5'-adenylylsulfate reductase 3, chloroplast precursor
MASATASISSHPAALCDVKAARIGAMRQQVAVASAAAAARGQCARAVRPLRAAEQGRQPVSASAASAAPAAPVADEVAAPAAVDYEALARELEGASPLEVMDRALAMFGSEIAIAFSGAEDVALIEYAKLTGRPFRVFSLDTGRLNPETYQFFDKVEKHYGIRIEYMFPDAGEVQELVRTKGLFSFYEDGHQECCRVRKVRPLRRALRGLRAWITGQRKDQSPGTRASIPVVQVDPSFEGLDGGAGSLIKWNPVANVDGKDIWTFLRTMDVPVNSLHAQGFVSVGCEPCTRPVLPGQHEREGRWWWEDAKAKECGLHKGNIDKDGQAAAPKPANGNGAAGAPDIFESPAVVSLTRAGIENLLRLEKRAEPWLVVLYAPWCPFCQAMEASYVELADKLAGAGVKVAKFRADGEQKPFAQAELQLQSFPTVLLFPTRTARPIKYPSEKRDVDSLLAFVNSLR

SEQ ID NO: 2213 - DNA, 2994 bp, Panicum virgatum
  misc_feature: Ceres CLONE 1777248
  misc_feature: Encodes the peptide sequence at SEQ ID NO. 2214
gagtccagtctctgctcgcccctctccgcctccgccatggccgccgcctcgctccccccgccatcgcgatggccgccgccgcctctgcgattactccctctcgtactcctcggctgcctcgccgcgtcggccccactgcgggcggcggaggcggcgggggtgctgaggcaggtggtggccggtggtggggacggcgacggcggggccttcttcgagccgttcaacgtcacctacgaccaccgcgcggtgatcctcggcgggaagcgaaggatgctcgtctccgcggggctccactacccgcgcgccacgcccgagatgtggccgagcctgattgcaaagtgcaaggagggcggcgcggatgtgattgagacatatatcttttggaatgggcatgagccggccaaaggccagtattactttgaaggaaggtttgatattgtcaagtttgcgaagctggttgctgctgaaggtctatttctttttctgcgtatcggaccatatgcttgtgctgaatggaatttcggtggtttcccagtttggctgcgtgacatccctggaatagaattccgtactgacaatgaaccctacaaggctgaaatgcagagttttgtgacaaaaatcgtaaatatcatgaaagaggagaaactttattcatggcaaggtggtcccattatactacagcagattgaaaatgaatacggtaacattcaagaccgctatggtcaagcagggaagagatacatgctatgggcagctcagatggcacttgcacttgatactggtgttccttgggtaatgtgtaggcaaacagatgctcccgaacaaattcttgatacttgcaatgccttttactgcgatggatttaaaccaaattcctacaacaagccgacaatatggactgaggattgggacggatggtatgccgactggggggaaccattgcctcataggcctgctcaagacagtgcttttgctgtagctcgattttatcaacgtggtggaagcttgcaaaattattacatgtattttggtggaacaaattttgagcgaacagctggtggtccacgtcagataacaagctatgattatgatgcaccaattgatgaatatggtatcttaaggcaacctaagtgggggcatttgaaagatctacatgcagctattaaactctgtgaaccagctcttattgctgtagatggatcacctcaatatgtaaaactggggcccatgcaagaggctcatgtatattccagtggaaaaatccacacaaatggaagcatttcagaaaatggacagatttgctcagcttttctggctaacatcgatgaacataaatatgtttcagtctggatttttggaaagtcttatagcctaccaccatggtctgtgagcatactaccagattgtgaaaatgtggcttttaatacagctagggttggtacacagacttcggtttttactgtcgaatcagggtcccccagttattcaagtagacataagcctaggactctatcccttattggtggtccatatctctcaagtacttggtggacttctaaagagcctattggcaaatggggtgaaggaagctttgctgctcaggggatattagagcacttaaatgtgaccaaagacatttctgactacctgtcatatactatgagtgtaaacatttctgacgaggatgttacatattggaattccaaaggtgttcttccatcactaactatagatcaaattcgtgatgtagcacgtgtatttgtaaatgggaagcttgcaggtagtaagattggtcattgggtctcgctgaatcaaccagttcaattggttcaaggacctaatgagttgacattgttttcagagattgttggcttgcagaactatggtgctttcttggagaaggatggagctggatttagaggtcaagtaaaactcactggcttatctaatggggatatcgacttcactaattccctttggacatatcagattggtttgaaaggtgagttttcgaggatctattctcctgagaaccaaggatatgctaagtggagtagcatgcagaatgatgacacacagacacccttcacatggttcaagacaatgtttgatgcaccagaaggtaatgacccggtggccattggtcttgggagcatgggaaagggccaggcttgggtgaatggacatctcattggacgctactggtcgatagtagcaccagagtctgggtgcccatcctcgtgcaactatgcaggaacgtacggtgatagcaagtgccgatcgaactgtgggatggctacgcaaagctggtaccacataccacgcgaatggttacaagagtcaggcaatctattggtactcttggaggaaacagggggagacccttctcagatatcgctgcaggttcattacaccaaaacaatctgctcaaaaatatccgagacttattatcctcccctttcttcctggtctcgtgcttccaacagtcgtgccaccctgaatacagtagctccagagcttcacttacagtgtgatgaggggcatgtgatctcgaagattatatttgcgagctatggaaccccttcaggtggttgccagaacttctctgtcgggaattgccatgcatcgactactctggacttggttacagaggcctgtgtcggcaataacaaatgttccatcagtgtcaccaacgatgtatttggcgatccatgccgaaaggtcgtaaaagatttggcagttgaggctgagtgctccccgcccttggctaccgaagaacctcgagatgatatgtgatcaagataccgtaatttggtcctgaaagagctgtgtggaagggagcgtttctacagccttgcaggagcatctgagctgtgtgctagtgctaggggttcctgcatcgttgtattgtatgtaaagacaatcacctactcgggggactggaaagaaagaaagggaaagaacacgttgtttccaaaaaaaaaaaaaaaaaaa

SEQ ID NO: 2214 - protein, 919 aa, Panicum virgatum
  misc_feature: Ceres CLONE 1777248
  misc_feature: Great-hit functional homolog of the protein sequence encoded by LOCUS At2g32810
  misc_feature (1)..(307): Pfam Name: Glyco_hydro_35 Pfam Description: Glycosyl hydrolases family 35
  misc_feature (63)..(477): SWISSPROT Homolog: EC 3.2.1.23 Beta-galactosidase precursor
  misc_feature (63)..(484): SWISSPROT Homolog: EC 3.2.1.23 Beta-galactosidase precursor
  misc_feature: Useful for making plants with altered cell wall content and/or composition
MAAASLPPPSRWPPPPLRLLPLVLLGCLAASAPLRAAEAAGVLRQVVAGGGDGDGGAFFEPFNVTYDHRAVILGGKRRMLVSAGLHYPRATPEMWPSLIAKCKEGGADVIETYIFWNGHEPAKGQYYFEGRFDIVKFAKLVAAEGLFLFLRIGPYACAEWNFGGFPVWLRDIPGIEFRTDNEPYKAEMQSFVTKIVNIMKEEKLYSWQGGPIILQQIENEYGNIQDRYGQAGKRYMLWAAQMALALDTGVPWVMCRQTDAPEQILDTCNAFYCDGFKPNSYNKPTIWTEDWDGWYADWGEPLPHRPAQDSAFAVARFYQRGGSLQNYYMYFGGTNFERTAGGPRQITSYDYDAPIDEYGILRQPKWGHLKDLHAAIKLCEPALIAVDGSPQYVKLGPMQEAHVYSSGKIHTNGSISENGQICSAFLANIDEHKYVSVWIFGKSYSLPPWSVSILPDCENVAFNTARVGTQTSVFTVESGSPSYSSRHKPRTLSLIGGPYLSSTWWTSKEPIGKWGEGSFAAQGILEHLNVTKDISDYLSYTMSVNISDEDVTYWNSKGVLPSLTIDQIRDVARVFVNGKLAGSKIGHWVSLNQPVQLVQGPNELTLFSEIVGLQNYGAFLEKDGAGFRGQVKLTGLSNGDIDFTNSLWTYQIGLKGEFSRIYSPENQGYAKWSSMQNDDTQTPFTWFKTMFDAPEGNDPVAIGLGSMGKGQAWVNGHLIGRYWSIVAPESGCPSSCNYAGTYGDSKCRSNCGMATQSWYHIPREWLQESGNLLVLLEETGGDPSQISLQVHYTKTICSKISETYYPPLSSWSRASNSRATLNTVAPELHLQCDEGHVISKIIFASYGTPSGGCQNFSVGNCHASTTLDLVTEACVGNNKCSISVTNDVFGDPCRKVVKDLAVEAECSPPLATEEPRDDM

SEQ ID NO: 2215 - DNA, 1978 bp, Panicum virgatum
  misc_feature: Ceres CLONE 1777264
  misc_feature: Encodes the peptide sequence at SEQ ID NO. 2216
gatcacgcgccccagcgagagagaagcatggccgacgcggcggccaacggggacgcgcgcggcggcgcggtgctgcgaccgaccaaccccatggtcacgccactgctcaccgacctctaccagttcaccatggcctacgcctactggaagaccggcaagcacctcgaccgcgcagtatttgatctttacttccgaaaaaatccatttgccggcgagttcaccatcttcggcggccttgaggagtgtataagattcattgctaacttcaagattacagaggaggaaatcaaatttctgcgaactgtcatgcctacatgcgaggatggcttctttgagtacctcagttcaattgactgctcagatgtggaggtttatgccatccctgagggttatgttgtgttccctaaagttccactgatgagaattgaaggacctgttgctgttgtccagcttcttgaaactccatttctaagtctggtcaactatgcctctctagttaccacaaatgcggcaaggcaccgacttgtagcaggaaagtcgaagaatttacttgagtttggacttcgacgggctcaagggcctgatggaggaatcagtgcatcaagatattcttatatgggaggctttgatgcaacaagcaatgttgcagcaggaagattgtttggtataccaatacgcgggactcattcacatgcatttgtgagctccttcatgggtcttcatgaaatcactgacaaagcacttgctagttctgatagttcaaacagatgtgaagatttcgtttctctggtgcagaactggctgatcaggattcaggattctagttcattgcgtggtacctttggagaaacaagtcaaagtgagttggctgcattcacgtcatatgcattggcattcccaaattccttcctggccttggttgacacatatgatgtcatgagaagtggagtgcccaacttctgtgctgttgctttagccctcaatgatatggggtataaggcggtcggaattaggttagactcaggtgatttagcatacctatctgttgagactcgcaagttcttccatgcaattgaagaagattttggggttgttggctttggaaaaatgagtattacagcaagcaatggtcttaatgaagaaactatagatgctctaaacaagcagggacacgaggtagatgcatttggtattggcacctaccttgttacatgctatgcacaagctgcacttggttgtgtattcaaattagttgagattaacaaacagcctcgcattaaactctctgaagatgtcacaaaggtatcgataccatgtaagaaaaaatgctacagattgtatggcaaagaaggatatccattggttgatataatgactggtgaagatgagccaagtccaaagattggcgaaaggctgctgtgtcgtcacccttttaatgaatcaaagagagcatatgttgttccacagcatgttgaggaattactgaagtgctactggcctggaaattcatctaattcacgggaggagcttccatccctccacgagattaggactcagtgcattcagcatttggaccgaatgaggccagaccatatgaggaggctgaacccaactccttacaaggtaagcgtgagtgctaaactgtacgacttcatccacttcttgtggctcaatgaagcgcctgttggagaactacaatgaagaaacgaggtggtgggagcgcccaaggctaacagtaataagctgttttcacgggatcattttctgcagatgtttttaccatatccatgtttcagtaaaatgcgagggtaaaaatatcataagcgaactgttatgcactgggaattaagaggataaccatactgttatgtatgactgtatatgctgctagattgctggataaaaataccttggctgagtaactgaatacgatgcgaagcaatgcctgatttgagcggaaaaaaaaaaaaaaaaaaaa

SEQ ID NO: 2216 - protein, 557 aa, Panicum virgatum
  misc_feature: Ceres CLONE 1777264
  misc_feature (1)..(268): Pfam Name: NAPRTase Pfam Description: Nicotinate phosphoribosyltransferase ( NAPRTase) family
MADAAANGDARGGAVLRPTNPMVTPLLTDLYQFTMAYAYWKTGKHLDRAVFDLYFRKNPFAGEFTIFGGLEECIRFIANFKITEEEIKFLRTVMPTCEDGFFEYLSSIDCSDVEVYAIPEGYVVFPKVPLMRIEGPVAVVQLLETPFLSLVNYASLVTTNAARHRLVAGKSKNLLEFGLRRAQGPDGGISASRYSYMGGFDATSNVAAGRLFGIPIRGTHSHAFVSSFMGLHEITDKALASSDSSNRCEDFVSLVQNWLIRIQDSSSLRGTFGETSQSELAAFTSYALAFPNSFLALVDTYDVMRSGVPNFCAVALALNDMGYKAVGIRLDSGDLAYLSVETRKFFHAIEEDFGVVGFGKMSITASNGLNEETIDALNKQGHEVDAFGIGTYLVTCYAQAALGCVFKLVEINKQPRIKLSEDVTKVSIPCKKKCYRLYGKEGYPLVDIMTGEDEPSPKIGERLLCRHPFNESKRAYVVPQHVEELLKCYWPGNSSNSREELPSLHEIRTQCIQHLDRMRPDHMRRLNPTPYKVSVSAKLYDFIHFLWLNEAPVGELQ

SEQ ID NO: 2217 - DNA, 2294 bp, Panicum virgatum
  misc_feature: Ceres CLONE 1777267
  misc_feature: Encodes the peptide sequence at SEQ ID NO. 2218
atacacaagagaacaaggatggaggattgtacagctagtcttgacggtacacgctagcaggtagcaaggctgcaagcaagagacacaattcccctgaaaccgcccaaaagcttcctgcaatcctgctgctttggcgttgaactccctccttgattaatcgcatcagctgccaaaaatttctctttattgttttttttttggttcagaaggggagcagaggcgaaataaattcctccggcgagattcgtgtggagatgagttaggtgccaggaccactcataaattctgcctgttctttcagatctgctccgtgctgtgctttgctttgcatgagtagttgttcaggcgctctagctccctcgcggcttcttccagttccaggcttggggctcttcagttcgaatctctctagcgtctagtcactcatgcgtcgtcgccggagtccaatctcgccgctgctcagagtttcttgatttggtctgctcggaatttccctttccatttcccccggagaaaatttgttcctaccaaatcaaaggtgatcctttccccctcgggatttttgtgctggtttcgccttgtgagtccatagcagcgttggaagcagacatcagctgctgcttaaaaatcctcccttttctcttggtttcttttcttagcagcgcaatcacggcctccgtccttgcttgaatcccgcgacagcctgcagcttcccatactcgtttctagtctcgatttcgtcgtgatttcaggtcggctcttactcgcctttgccgatttgtttgctcccgagagccggcctataagaatccccaccacacctttcccttcttccactccacgcgctgctgctttttcctcccaatgggcaacgcgttcgcgtgcatgccgcgcaaggagcaccggggcgcggccgcggtgtcgcgcagcaagcggatggggagcgcgcggtcggcgcgcggcgggcccaagctgacgccagcggaggaggagctcctgcaccgccaggcgctggccatggccatccaccagcacctcgactccggcggctccatgtcgcgccgcatcgacgccggggcctccctgtcgcgccgcatggcccccggctccaccagctctcgacgccgcggcgacctgccggactccgtcacgaatgccaagcccgcccaaattgttctggagaatttagaaacaaagaaaattgtccttgttcatggagaaggatttggtgcttggtgttggtacaagaccatctcacacttggaggaagctggtcttgagcctgttgccttagacctcacgggttctggcatagatcataccaatacaaacagcatagctacactaggagattactccaagccattaattgattaccttgataaacttcccgaggatgagaaggttattttggtcggccacagctgcggaggtgcatgtgtttcatatgcgttagaacactgccccaaaaagatctcgaaggcggtgtttcttactgctacgatggtgaaggatgggcagcggcccttcgatgtgttctcagaggaactccggtcagcagatgttttcttgcaagaatcacagtttttggtttatggaaatggaaaggacaagcctcctactggtctgatgtttgataaacagcagatcaaggggctctatttcaaccaaactccttccaaggatatggcgctagctgcggtgtccatgagacccatccctcttgccccaatcatggagaagctctccctcacccctgaaaagtacggcactgtgcgccgctacttcatccagacacttgacgatcacatgctctcacctgatgcccaggagaagttggttcgggagaacccgccagatgtcatcttcaagataaagggcagcgaccactgcccctttttctcgaagccgcaatccctcaacaagatcttgctggagattgcacagatccaagctccagctgcgctgctcccgggtaaagcaagttcggaggagaccgtggcagagaaatcatgactgcatgtatgtagtgtacatgaaaactgagtagcacataggttgcaaaagtgtggtgcgggggttaattgaaatcagtttgtcagataataatgtaaggaggcaaaagtgttgttttcttctgtgatcaagtatagaggatgtgagatagttttcttttaccttgtgaatcaaatatgaagtcaaaacaacatatcttaatgttttcctgagcaatgatgagtaggttgagtcctgtggaggcgtttaattccacagaaaaaaaaaaaaaaaaaaaa

SEQ ID NO: 2218 - protein, 383 aa, Panicum virgatum
  misc_feature: Ceres CLONE 1777267
  misc_feature: Great-hit functional homolog of the protein sequence given in SEQ ID NO 9684
  misc_feature (1)..(221): Pfam Name: Abhydrolase_1 Pfam Description: alpha/beta hydrolase fold
  misc_feature: Useful for making plants with modulated salt sensitivity
MGNAFACMPRKEHRGAAAVSRSKRMGSARSARGGPKLTPAEEELLHRQALAMAIHQHLDSGGSMSRRIDAGASLSRRMAPGSTSSRRRGDLPDSVTNAKPAQIVLENLETKKIVLVHGEGFGAWCWYKTISHLEEAGLEPVALDLTGSGIDHTNTNSIATLGDYSKPLIDYLDKLPEDEKVILVGHSCGGACVSYALEHCPKKISKAVFLTATMVKDGQRPFDVFSEELRSADVFLQESQFLVYGNGKDKPPTGLMFDKQQIKGLYFNQTPSKDMALAAVSMRPIPLAPIMEKLSLTPEKYGTVRRYFIQTLDDHMLSPDAQEKLVRENPPDVIFKIKGSDHCPFFSKPQSLNKILLEIAQIQAPAALLPGKASSEETVAEKS

SEQ ID NO: 2219 - DNA, 1898 bp, Panicum virgatum
  misc_feature: Ceres CLONE 1777275
  misc_feature: Encodes the peptide sequence at SEQ ID NO. 2220
atcaaatcgaaaaaatggcgctgctgagcccgcgcgtgccgcggctgccgccctccgccttcaccgccggcgggacccggtgctgcggccgcggcgcgcggtgccaggcggcggcggcgggcggcgtggcggccgcggggcagcccccgtcctcggagctggaggccatccggtggggcagcgccaagctgcagggcgcccgcgacgagatggaggacgaggtcgtgctccgcacgggctccctcctcgacggcttctccttcgccgccgtcttggacggccacgccggcttctccgctgtccagttcctcagggacgagctgtacaaggaatgcgcggccgcgctggacggcggcacggtgctcagcaccaagaatctcgaggccatcacggcctccatccagcgcgccttcgccgcagtcgacgcgaagctctccacctggcttgagcaaatggacaaggacgacgactctggcgccacggctactgccatgtttctcaggaacgatgtccttgtagtttcgcacattggggactcttgcttggtcatatcgcgcggtggaagacctgaagctttgacgagctctcatcgaccgtatgggaacaacaaaacgtcacttgaagaggtcaaacggataagggcagcaggtggatggattgttgatgggcgcatatgtggagacatttctgtatctcgtgcttttggggacataagatttaagacacgaaaggatgagatgctggtgaaaggagttaaagaaggaaggtggactgaaaagttcatctcacgaataaaatttaaagaggatatattaatctcgtcacctgatgtatctctggtagagcttggaccggatgtggaatttcttatactagcaactgacggtctttgggattacatgaaaagctctgaagctgtagcatttgtcagagatcaactacgtcagcatggtgatgtccagttggcctgtgaggcacttggtcagaaagctctggatgaacggtcacaagacaatattagcatagtcatagctgacttggggaggacaaactggaaggcgttgcccgtggaaagcccaaacttgttcttggaactaagtcaagcagttgtgactgtaggggttgtcgctgtaggaatttggttctcatcgctgcttacattacagtaggactagttctgttcagatgtgtacattacttattgaattacatgttccgctggtagctgcaaatatatgtatattcttatagggtcgattaatatagtgtaatctgttgtataatgatgaacgggtgaagtactgatgaagatcgtatagttcattgggctgaaaaaaaaaaaaacccacaaactccatggctagccgcgttcccctcctgcacgcaacctgtccccctcatccgtgcccccgtggtgtcgaatcccctgcccccttcgcggaacggtgagttgctttgtttcaatttgttcgaaaaaacccgtttgtttgctgatgcgcaggctcagctctgacccgtggatcgggcgtgcggccgggtgaatcgagctgcggtggcctcgatctggacctgcgcaccgaggctacggatccccgtccatggcgatctggaatctgcatagatcaggcgggccgcggtgtgaccggattgctacgaggtgggctggagggcgcggtggagttgccagggcatggccggccggccggcggggacttcttcctctactccaccgcgcgggatctctctgagctgataattattggatgaatttcgataattattagtagatctaagaggtgcgaaccgtgccgccttgaagaggcgaggtaaggtgaagcatgtaagagtcgtcgttgagtcggcgtgcgttgagggcacaaaaaaaaaaaaaaaaaaaa

SEQ ID NO: 2220 - protein, 384 aa, Panicum virgatum
  misc_feature: Ceres CLONE 1777275
  misc_feature (1)..(285): Pfam Name: PP2C Pfam Description: Protein phosphatase 2C
  misc_feature (13)..(382): SWISSPROT Homolog: EC 3.1.3.16 Protein phosphatase 2C PPH1
MALLSPRVPRLPPSAFTAGGTRCCGRGARCQAAAAGGVAAAGQPPSSELEAIRWGSAKLQGARDEMEDEVVLRTGSLLDGFSFAAVLDGHAGFSAVQFLRDELYKECAAALDGGTVLSTKNLEAITASIQRAFAAVDAKLSTWLEQMDKDDDSGATATAMFLRNDVLVVSHIGDSCLVISRGGRPEALTSSHRPYGNNKTSLEEVKRIRAAGGWIVDGRICGDISVSRAFGDIRFKTRKDEMLVKGVKEGRWTEKFISRIKFKEDILISSPDVSLVELGPDVEFLILATDGLWDYMKSSEAVAFVRDQLRQHGDVQLACEALGQKALDERSQDNISIVIADLGRTNWKALPVESPNLFLELSQAVVTVGVVAVGIWFSSLLTLQ

SEQ ID NO: 2221 - DNA, 1320 bp, Panicum virgatum
  misc_feature: Ceres CLONE 1777281
  misc_feature: Encodes the peptide sequence at SEQ ID NO. 2222
acatcgcagcgagggcggcggcggcggcggcggattcgcggaagagggcggaagccgccggcggagccatcgaggcctgcagggagggctcacgtcctccgttgagtccagggcctcctgcaccgccgcctcgtccggcgccaaaaccctaagcaggtttagtgccattcagagtcgaataatggcggagcacttggcttcgatctttggcactgagaaggacagggtcaactgccctttttacttcaagattggggcttgtcgtcatggggatcgctgctcccgcctgcacaacaggccaaccatatcgccgactcttgtgcttgctaacatgtatcagcgccctgatatgataacccctggggttgatgctcaaggccaacctattgatcctgagaagatgcaggagcattttgaggatttctacgaggacatctatgaggagttgggcaagtttggtgagatcgagaacctgaacgtctgcgacaaccttgctgaccacatgatagggaatgtctatgtccagttcagggaggaagaacaggcagctgcagcatataatgctcttcagggccgcttttattctggccgcccgataattgtggagtattctcctgtgactgacttccgggaagcgacctgtaggcagtttgaggagaacagctgcaaccgtggtggctactgtaatttcatgcatgtgaagcagattggcagggatctcaggaggaagctctatggccgttctgcttccaggaggtaccatgggaggagcagaagccgaagccccccacctcaaaggaggggccatcgtgaccgtgatgattaccgtggtggcggcggcggcggcggtgggcggggtagaggcagcaggcatgacaggtatgatgatggaggtggcaggcatgacaggtatgatgatggagggggcagagacggcaggcatgacaggtatgatgatggaggaagacgcaggcatggtagcccacccccaaggcgtgggaggagcccagtcagggagagcagcgaggaacgcagggccaagattgagcagtggaaccgtgaacgcgaggcaaagctgtgaggtccctgtggcaagtgcctcaagacgagcattgttggctggagttgtttcttagctcgtcagttacagctatattcgaagtggacctgtgttggttgatatcctgcttggctaagtaaccttttaagtgcaggattgctaagttcattttggttaatcagacatgtaaacttaaaatattttcagctgtattgtgtcttaaaatattttcagacatgtaaaaaaaaaaaaaaaaaaaa

SEQ ID NO: 2222 - protein, 299 aa, Panicum virgatum
  misc_feature: Ceres CLONE 1777281
  misc_feature (1)..(27): Pfam Name: zf-CCCH Pfam Description: Zinc finger C-x8-C-x5-C-x3-H type (and similar)
MAEHLASIFGTEKDRVNCPFYFKIGACRHGDRCSRLHNRPTISPTLVLANMYQRPDMITPGVDAQGQPIDPEKMQEHFEDFYEDIYEELGKFGEIENLNVCDNLADHMIGNVYVQFREEEQAAAAYNALQGRFYSGRPIIVEYSPVTDFREATCRQFEENSCNRGGYCNFMHVKQIGRDLRRKLYGRSASRRYHGRSRSRSPPPQRRGHRDRDDYRGGGGGGGGRGRGSRHDRYDDGGGRHDRYDDGGGRDGRHDRYDDGGRRRHGSPPPRRGRSPVRESSEERRAKIEQWNREREAKL

SEQ ID NO: 2223 - DNA, 1661 bp, Panicum virgatum
  misc_feature: Ceres CLONE 1777284
  misc_feature: Encodes the peptide sequence at SEQ ID NO. 2224
aattagcccccactctgctccgcggcgcctcgaatggaagcgctcgctgtaggatccgctcctccccggccgggcctcgctgccccgacccgctacccccaccgccgcgccccgagaaccctcgtcgccgcgcgccgccccctcgccgcggcccccatggaagccgccggaggcggtcgctcgagccccgccccggcccgctgcgccagcgccgagactgagtcggaggtggatgaggccgcgacgagctcgcccgccgcggaggccgaggcggcgggcgccacggagcaagggggcaacgggagccccgtggcggacgccgccgctgccggggcctccatagagggcgtcgacgggataaggatccggcggcggcccgtgacggggccggcggtgcactacgtgggcccgttccagttccgcctcgagaacgaggggaacacgccgcggaacatcctcgagaagatcgtctgggacaaggacgtcgaggtttcgcagatgaaggagaggaggcccctgtacatgctgaaggggtcgctggaggctgctcctccggcgagggacttcgttggggcgctcaaggcgtcgtatgatcggattggcttgcctgcactgattgcggaggtcaagaaggcttcaccgagccgtggtgttctcagggaggattttgatccggttcagatcgctcaggcatatgagaaaaatggagcagcatgtctaagtgttcttacagatgaaaaatattttcagggaagttttaactacttggaggctatacgcaatgctggagtccagtgccctcttctgtgcaaagagttcatagttgatgcttggcaactttactatgcacggtccatgggtgcagatgctgttcttctaattgctgctgtattacctgaccgtgatatcaagtacatgttgaaaatttgcaaaatactagggatggctgctttagttgaggttcatgatgaaagggaaatggaccgtgttttaggaatcgatggtgtacagctcattggaatcaataaccgcaatcttgagacgtttgaagttgatatttcaaacacaaaaaaacttctggaaggtgaacgaggacagctgatagctcagaaggatgtaattgttgtaggagaatctgggctgttcactcctgatcacatttcattcgttcaaaacgccggggtcaaagcagttctcgttggggagtccctcatcaagcaggaggatccagggaaagcaatcgctgggcttttcggcaaagatatttcgcacgtagttgcttcctgaagatgcagaagggccggtcgagatagttgagaaacgcaatgctggaccgcatcattttgtatagcttggggaaagatgactccttcggagggtttttggcggtcttttggtttacctgacctgatcagacgacttttccgtattccggtctttttgtgacctaacctaaccttccggacagataaatacaagattaaagtgcacaaggtatatttgaatgatctggatgtaccagagcggcttgatattgcgtagaattgatctgcattgtggctcgtcttgtttggagcatggaaatttaaacttcatgcagtatttgtagaaattttgatgaaaactggactgttttctataaatatactgtaaacattttg

SEQ ID NO: 2224 - protein, 417 aa, Panicum virgatum
  misc_feature: Ceres CLONE 1777284
  misc_feature (35)..(285): Pfam Name: IGPS Pfam Description: Indole-3-glycerol phosphate synthase
  misc_feature (108)..(413): SWISSPROT Homolog: EC 4.1.1.48 Indole-3-glycerol phosphate synthase, chloroplast precursor
  misc_feature (109)..(409): SWISSPROT Homolog: EC 4.1.1.48 Indole-3-glycerol phosphate synthase
MEALAVGSAPPRPGLAAPTRYPHRRAPRTLVAARRPLAAAPMEAAGGGRSSPAPARCASAETESEVDEAATSSPAAEAEAAGATEQGGNGSPVADAAAAGASIEGVDGIRIRRRPVTGPAVHYVGPFQFRLENEGNTPRNILEKIVWDKDVEVSQMKERRPLYMLKGSLEAAPPARDFVGALKASYDRIGLPALIAEVKKASPSRGVLREDFDPVQIAQAYEKNGAACLSVLTDEKYFQGSFNYLEAIRNAGVQCPLLCKEFIVDAWQLYYARSMGADAVLLIAAVLPDRDIKYMLKICKILGMAALVEVHDEREMDRVLGIDGVQLIGINNRNLETFEVDISNTKKLLEGERGQLIAQKDVIVVGESGLFTPDHISFVQNAGVKAVLVGESLIKQEDPGKAIAGLFGKDISHVVAS

SEQ ID NO: 2225 - DNA, 1892 bp, Panicum virgatum
  misc_feature: Ceres CLONE 1777294
  misc_feature: Encodes the peptide sequence at SEQ ID NO. 2226
actcctcacgcccccacttccgaaggttacgccgtcgccgattgacgccaccgccggaccacccatggggcccgccagtaggagccccgcgctcgtgctcctcggcctcctcctgctcgctgtctccgccgcccgcggctcgccggatggcgggagcgtcctccggctcccctcctccgcgccgcggcacctggccccgcgcttcccccgctccgcggccgtcgacctgatccgcgccctcaacctccaccccgccgacgcctccccgcgtcccgccgccgccgacggcgcccccgcccccgcggggacactcgtcgaaaggcccatccgcctcgcgtccctcgcggccgagggcacatcggtgaaggacctcggccaccacgccgggtactaccgcctccccaacacccacgacgccaggatgttctacttcttcttcgagtcgagggggcacaaggacgaccccgtggtgatctggctcacgggcgggcccgggtgcagcagcgagctcgcgctcttctacgagaatggacccttccacatagcggacaacttgtcgctcgtctggaatgactttggctgggacaaggcatccaaccttatctatgttgaccagcccactggaactggtttcagctacagctcggactcatgggacactcgccacaacgaagctgccatcagcaatgatttgtatgacttcctgcaggcctttttcgctgagcacccagagtatgctaaaaatgatttcttcataaccggggaatcatatgctggccattacattcctgcctttgcaagtcgtgtgtaccgaggaaacaataacaatgagggcattcacattaatctgaagggtttcgcgattggcaatgggctaacagatccagcaatacagtacaaggcataccctgattatgcattggatatgggattgatcacaaaatcacagtttaacaggatcaataaaatagttccaacttgtgaatttgctgtcaagctttgtggtacctctggcactgtatcttgccttgccgcttactttgtttgtaatacaatattcagtgccatcaggacaatcatagggagtaaaaattactatgacatcaggaaaccatgtgttggaagcctgtgctatgatttctcaaatttggagaaatttctgaacaaaaaaactgttagagagagccttggagttggagacatagagttcgtttcatgcagcccgagtgtctatgaggccatgttattggattggatgaggaaccttgaagttggaatccctgaactccttgagaatgacatcaaagtgttgatttatgcgggagagtatgatctcatatgcaactggctcgggaactcgagatgggtaagctctatggaatggtctggaaaggaagcttttgtctcatcgtctgataagcccttcactgtcgatggaaaagaagccggtgttctaaagagccatggtcctttgagtttcttgaaggtgcatgatgctggtcacatggtaccgatggatcaaccgaaggctgctctggagatgctgaagaggtggacttccggaaacctttcgagcccgtcttcagtctcccagaagcttgatttcgatatgtgaccaacaaattgtttctcctatgatccttcggggtttgcaacgctgccctgcactagtctccgaagactaccgtatgtaatttactgtgtacttcaggatgatattgggctctgacaagcttatcttgcgaccgtacagatgttatttgccttgtacgggcgccccgcatgctgatgagacggggtcttacaactttattagcatgtaataaaattttcagagaattgttatgtcaaggcatgcatgtttggagacttaaaaaaaaaaaaaaaaaaaa

SEQ ID NO: 2226 - protein, 516 aa, Panicum virgatum
  misc_feature: Ceres CLONE 1777294
  misc_feature (2)..(405): Pfam Name: Peptidase_S10 Pfam Description: Serine carboxypeptidase
  misc_feature (15)..(502): SWISSPROT Homolog: EC 3.4.16.5 Serine carboxypeptidase 3 precursor
  misc_feature (7)..(514): SWISSPROT Homolog: EC 3.4.16.5 Serine carboxypeptidase 3 precursor
MGPASRSPALVLLGLLLLAVSAARGSPDGGSVLRLPSSAPRHLAPRFPRSAAVDLIRALNLHPADASPRPAAADGAPAPAGTLVERPIRLASLAAEGTSVKDLGHHAGYYRLPNTHDARMFYFFFESRGHKDDPVVIWLTGGPGCSSELALFYENGPFHIADNLSLVWNDFGWDKASNLIYVDQPTGTGFSYSSDSWDTRHNEAAISNDLYDFLQAFFAEHPEYAKNDFFITGESYAGHYIPAFASRVYRGNNNNEGIHINLKGFAIGNGLTDPAIQYKAYPDYALDMGLITKSQFNRINKIVPTCEFAVKLCGTSGTVSCLAAYFVCNTIFSAIRTIIGSKNYYDIRKPCVGSLCYDFSNLEKFLNKKTVRESLGVGDIEFVSCSPSVYEAMLLDWMRNLEVGIPELLENDIKVLIYAGEYDLICNWLGNSRWVSSMEWSGKEAFVSSSDKPFTVDGKEAGVLKSHGPLSFLKVHDAGHMVPMDQPKAALEMLKRWTSGNLSSPSSVSQKLDFDM

SEQ ID NO: 2227 - DNA, 2373 bp, Panicum virgatum
  misc_feature: Ceres CLONE 1777297
  misc_feature: Encodes the peptide sequence at SEQ ID NO. 2228
atcggagactcgtcgtcagttcgaaaccaaggatcgaaagccaccccctcgaagagcggagaagcttccagaggagagggagccgcgttggtgctgcagctggtcgtggtgaggccatggatcgggttcgcggatccgcgttcctgctcgccgtcctgctcgcaggatccctgtttgcattctcagttgcaaaggaggagaccaagaagcttgggactgtgatcggtattgatctcggtaccacctactcctgtgtcggtgtctacaagaacggtcatgtcgagatcatcgccaatgaccagggtaaccgtatcacaccctcatgggttgccttcaccgatagcgagaggctcatcggtgaggctgccaagaaccaggcagctgtcaaccctgagaggaccatctttgacgtcaagcgtctcatcggaagaaagtttgaggacaaggaagtccagagggacatgaaacttgttccctacaagatcgttaacaaggatggtaagccctacattcaggtcaagataaaggatggagagaataaggtcttcagccctgaggagatcagtgccatgattcttggcaagatgaaggatactgctgaggcataccttggcaagaagatcaatgacgctgtcgtcactgttcctgcgtacttcaacgatgcacagaggcaggcaaccaaggatgctggtgtcattgccggcctcaatgttgctaggatcatcaatgagccaactgctgctgctattgcctacggtttggacaagaagggtggcgagaagaacatccttgtctttgaccttggtggtggtactttcgatgtcagcgtcttgaccattgacaacggtgtgtttgaggtgcttgccaccaacggtgacacccatcttggaggcgaggactttgaccagaggatcatggagtacttcatcaagttgatcaagaagaagtacagcaaggacatcagcaaggacaaccgtgctcttggaaagctgaggagggaagctgagcgtgccaagagagccctcagcaaccagcaccaggtccgtgttgagattgagtccctcttcgacgggaccgatttctcggagccgctgacccgtgccaggtttgaggagctcaacaatgatctgttccgcaagaccatgggccctgtcaagaaggccatggaggatgctggccttgagaagagccagatccacgagattgtccttgttggtggaagcaccaggattccaaaggtccagcagctcctgcgggactactttgatggcaaggagccaaacaagggtgtgaaccctgatgaggctgttgcctacggtgctgcggtgcagggaagcatcttgagcggcgagggtggtgatgagaccaaagatatccttctccttgatgttgctcccctgacccttggtattgagactgttggaggagtcatgaccaagttgatccccaggaacactgtcatccccaccaagaagtctcaggtgttcacgacctaccaggatcagcagacaactgtctccatccaggtctttgagggtgagcgcagcatgaccaaggactgccgccttctcggcaagttcgacctctctggcattccaccagctcccaggggcacaccccagattgaggtgaccttcgaggttgatgccaacggtatcctgaacgtgaaggccgaggacaagggcactggcaagtcagagaagatcacgatcaccaacgagaagggccgcctgagccaggaggagattgaccgcatggtccgggaggctgaggagttcgcagaggaggacaagaaggtgaaggagaagatcgacgcccggaaccagcttgagacgtacgtgtacaacatgaagaacacgatcggtgacaaggacaagctggctgacaagctggagagtgaggagaaggagaaggtggaggaagccctcaaggaggccctcgagtggctggacgacaaccagtcggccgagaaggaggactacgaggagaagctcaaggaggtggaggccgtgtgcaaccccatcatctcggccgtgtaccagaggtcaggcggcgccccaggtggtggcgctgatggtgagggtggcgtcgatgacgaccatgatgagctgtagatggttctggaaagccaaattttgtaatggtgtttaggagggggggacatatgaatgactctcggggccggcgggaaagttacggagaccaatctttcttcctctgaatgggtgcatcgctgctctgtctctagtcttctgggtgtagaactctgttttttacttccttgtgatttttcttgttgttatagcggattcgaatcagaatttatgtgaagaaaagaagatgcttcggaattaaaaaaaaaaaaaaaaaaaa

SEQ ID NO: 2228 - protein, 665 aa, Panicum virgatum
  misc_feature: Ceres CLONE 1777297
  misc_feature (1)..(608): Pfam Name: HSP70 Pfam Description: Hsp70 protein
MDRVRGSAFLLAVLLAGSLFAFSVAKEETKKLGTVIGIDLGTTYSCVGVYKNGHVEIIANDQGNRITPSWVAFTDSERLIGEAAKNQAAVNPERTIFDVKRLIGRKFEDKEVQRDMKLVPYKIVNKDGKPYIQVKIKDGENKVFSPEEISAMILGKMKDTAEAYLGKKINDAVVTVPAYFNDAQRQATKDAGVIAGLNVARIINEPTAAAIAYGLDKKGGEKNILVFDLGGGTFDVSVLTIDNGVFEVLATNGDTHLGGEDFDQRIMEYFIKLIKKKYSKDISKDNRALGKLRREAERAKRALSNQHQVRVEIESLFDGTDFSEPLTRARFEELNNDLFRKTMGPVKKAMEDAGLEKSQIHEIVLVGGSTRIPKVQQLLRDYFDGKEPNKGVNPDEAVAYGAAVQGSILSGEGGDETKDILLLDVAPLTLGIETVGGVMTKLIPRNTVIPTKKSQVFTTYQDQQTTVSIQVFEGERSMTKDCRLLGKFDLSGIPPAPRGTPQIEVTFEVDANGILNVKAEDKGTGKSEKITITNEKGRLSQEEIDRMVREAEEFAEEDKKVKEKIDARNQLETYVYNMKNTIGDKDKLADKLESEEKEKVEEALKEALEWLDDNQSAEKEDYEEKLKEVEAVCNPIISAVYQRSGGAPGGGADGEGGVDDDHDEL

SEQ ID NO: 2229 - DNA, 1522 bp, Panicum virgatum
  misc_feature: Ceres CLONE 1777313
  misc_feature: Encodes the peptide sequence at SEQ ID NO. 2230
gtgccacgctacacaatttgtgccctctctttccgcagggaacctttttgcgctctcgcgggttccaccccagcgaaaacctcgccgccgccgccgcctccactgcagcttcggggccctaaaccctaggcatggcgtcctcgatactctccgactgctcctccgcccgcctcctccctctccgccgcgcgctcctcccgcagcgggtgccccgcatccacccctgccccgctctagcttcccccaggagcctcttcgccgacgcccgaccccagctgctcccgcgcccgccccgcatggattcggtccccgccgccgccgcctcttccgccgagtcagcaactgtctcagccgatgcatctgccaaagtgattgatgggaagttagtggcgaagcaagtaagagaggaaatagctgttgaggtcagcaggatgaaggatgcgatcggcatagtgcctggcctggcagtcattcttgttgggtcgaggaaggattctcaaacttatgtgcgaaacaagaagaaagcatgcgaggaggttggtataaagtcgtatgaggtcaacttgccagaggacagctctgaggaggaggttgtcaagcacatagcgagctttaacagtgacccatctgtgcatggcatcttggttcagctgcccttacctcggcatatgaacgacgagaacattttgaatgctgtcagtattgaaaaggacgtcgatggctttcatcccctgaacattggacgacttgcaatgcaaggtcgagatccgttctttgttccttgcaccccaaaaggatgtatggagttgctgcacagatatggagttgaaataaaagggaagagagctgtcgtaatcggaagaagcaatattgttggaatgcctgctgcgctgttgttgcaaaaagcaaatgcaactgtcagcattgtgcattcacaaactaagaaccctgaggaaataacaagacaggcggacatagtcatcgcagctgtcggagttgcgaacttggtcagagggaattggataaaacctggagcagcaattattgatgttggcatcaacccaattgatgacccggagagccctcggggttataggctcgtcggagatgtctgttatgaggaggcctccaaggttgctggagctatcacaccggttcctggtggtgttgggccgatgactattgcaatgcttttgtcaaacactcttgagtctgctaaaagaatccacaaattttaaataactgcagaatccaacagaaagaagttggggatgggcacctaacatttgatgtagactacaagctaaggttttgttcaactgttttatgtgccttctgttggaccaaaaaagtgcaacaggagccctaaaaaataaattttgacacacatgagattgtatcctggcctgatacagtattgtatttgataatgtgacatggaaccatattcttgtcaccaatggaattcaggtgaatctgagatgtcagtaagctgggattagaaaaaaaaaaaaaaaaaaaa

SEQ ID NO: 2230 - protein, 368 aa, Panicum virgatum
  misc_feature: Ceres CLONE 1777313
  misc_feature (1)..(153): Pfam Name: THF_DHG_CYH_C Pfam Description: Tetrahydrofolate dehydrogenase/cyclohydrolase, NAD(P)-binding domain
  misc_feature (48)..(364): SWISSPROT Homolog: C1-THF synthase C-1-tetrahydrofolate synthase, cytoplasmic
  misc_feature (78)..(364): SWISSPROT Homolog: EC 1.5.1.5 Bifunctional protein folD [ Includes: Methylenetetrahydrofolate dehydrogenase
MASSILSDCSSARLLPLRRALLPQRVPRIHPCPALASPRSLFADARPQLLPRPPRMDSVPAAAASSAESATVSADASAKVIDGKLVAKQVREEIAVEVSRMKDAIGIVPGLAVILVGSRKDSQTYVRNKKKACEEVGIKSYEVNLPEDSSEEEVVKHIASFNSDPSVHGILVQLPLPRHMNDENILNAVSIEKDVDGFHPLNIGRLAMQGRDPFFVPCTPKGCMELLHRYGVEIKGKRAVVIGRSNIVGMPAALLLQKANATVSIVHSQTKNPEEITRQADIVIAAVGVANLVRGNWIKPGAAIIDVGINPIDDPESPRGYRLVGDVCYEEASKVAGAITPVPGGVGPMTIAMLLSNTLESAKRIHKF

SEQ ID NO: 2231 - DNA, 2595 bp, Panicum virgatum
  misc_feature: Ceres CLONE 1777324
  misc_feature: Encodes the peptide sequence at SEQ ID NO. 2232
atcgtcaccacccacctctcgccctcctcctccgccgcgacctcctcctcctcatcccccggcgctactcccccgctccacggtccaaggaaagatggcgtcccatattgttggttaccctcgcatgggccccaagagggagctcaagtttgccttggagtctttctgggatgggaagagcagcgccgaggatttggagaaagttgccactgacctcaggtctagcatctggaagcaaatgtcagaagctgggatcaagtacattcccagcaacaccttctcatactatgaccaggtccttgatacaacggccatgcttggcgctgtcccagagcgatactcttggaccggaggtgagattggcctgagcacctatttctcaatggccaggggaaatgccactgttcctgctatggagatgaccaaatggtttgacacaaactaccacttcattgtccctgaacttggcccgaggaccaagttctcatatgcttctcacaaggctatctctgagtacaaggaggcaaaggcacttgggattgatactgtcccagttcttattggaccagtctcctacttgttgctctctaagcctgccaagggtgtggagaagtcattttctcttctttcacttcttggtagcatccttcccatctacaaggaggttgtcgctgagctgaaggcagctggtgcttcatggattcaatttgatgagcctacccttgttaaggaccttgatgctcacgaattggctgcattctcttcagcatatgctgaactagagtcagcagtctctggattgaatgtgcttatcgagacatattttgctgatattcctgctgaatcctacaagaccctcacatccttgagtggtgtgactgcttatggtttcgatctcatccgtggggccaagacacttgatcttattaggagcagcttcccctctggaaaatacctttttgccggagttgtagatgggcggaacatttgggctgatgatcttgctgcctctctcagcactcttcagtctcttgaggttgttgctggcaaggacaagcttgtggtgtcaacctcctgctcgctgatgcatactgctgttgatcttgttaatgagactaagctcgatgatgagatcaaatcatggcttgcatttgctgcccagaaggtggttgaggtcaatacccttgccaaggctttggcaggtcaaaaggacgaggcttactttgcagccaatgctgctgctctggcctcaaggaagtcatcacccagggtgacaaatgaggaggttcagaaggcggcagctgctttgaagggctctgaccaccgccgtgctactaatgtttctgctagattggatgctcagcagaaaaagctcaaccttcctatccttccaacaactacaattggttcattccctcagactgtggagctcaggagggtccgccgtgagtacaaggcaaagaagatctctgaggaggaatacgtgagtgccatcaaggaagaaatcagcaaggttgtcaagatccaagaggagcttgacatcgatgttctcgtgcatggagagcctgagagaaatgacatggttgagtactttggtgagcaattgtctggttttgcattcactgccaacggatgggtgcaatcttatggatcacgttgtgtgaagccacccattatctatggtgatgtcagccgccccaaccccatgactgtcttctggtccaagacggcacagagcatgacctctcgcccaatgaagggaatgttgactggcccggtcacaatcctcaactggtcatttgtcagaaatgaccagcccaggtttgagacatgctaccaaatagctcttgcaatcaaaaaggaggttgaggatcttgaggctgctggtattcaggtgatccagatcgatgaggcggctctaagggagggcttgcccctgcgcaagtcagagcatgcattctacctagactgggctgtccactctttcagaatcaccaactgtggggtccaggacaccactcagatccacacacacatgtgctactccaacttcaacgatatcatccactccatcattgacatggatgccgatgttatcaccatcgagaactcccgttccgatgagaagctcctctccgtattccgtgagggtgtgaagtatggcgctggcatcggcccaggtgtctatgacatccactctcctaggatccccaccaccgaggagatcgctgaccgcattaacaagatgcttgctgtgcttgacactaacatcctatgggtgaaccctgactgtggtctcaagacccgcaagtacacagaggtgaagcctgccctgaccaacatggtttctgccaccaagctcatccgcacccagcttgccagcgcgaaatgagttgtttgttagctccacagtttgttgaacgcagccaacagggccaattgttttgaataattcgggtctcatccctgttccatggctaggttagtttcattggtatggtatgctgttatagttgtattctaagtttggtgtctcttcttttaggctgttttaaggcatgtgggctttgggtataaaaaaaaaaaaaaaaaaaa

SEQ ID NO: 2232 - protein, 765 aa, Panicum virgatum
  misc_feature: Ceres CLONE 1777324
  misc_feature: Great-hit functional homolog of the protein sequence encoded by LOCUS At5g17920
  misc_feature (1)..(325): Pfam Name: Meth_synt_2 Pfam Description: Cobalamin-independent synthase, Catalytic domain
  misc_feature (1)..(317): Pfam Name: Meth_synt_1 Pfam Description: Cobalamin-independent synthase, N-terminal domain
  misc_feature (1)..(765): SWISSPROT Homolog: EC 2.1.1.14 methyltetrahydropteroyltriglutamate-- homocysteine methyltransferase
  misc_feature: Useful for making plants with altered cell wall content and/or composition
MASHIVGYPRMGPKRELKFALESFWDGKSSAEDLEKVATDLRSSIWKQMSEAGIKYIPSNTFSYYDQVLDTTAMLGAVPERYSWTGGEIGLSTYFSMARGNATVPAMEMTKWFDTNYHFIVPELGPRTKFSYASHKAISEYKEAKALGIDTVPVLIGPVSYLLLSKPAKGVEKSFSLLSLLGSILPIYKEVVAELKAAGASWIQFDEPTLVKDLDAHELAAFSSAYAELESAVSGLNVLIETYFADIPAESYKTLTSLSGVTAYGFDLIRGAKTLDLIRSSFPSGKYLFAGVVDGRNIWADDLAASLSTLQSLEVVAGKDKLVVSTSCSLMHTAVDLVNETKLDDEIKSWLAFAAQKVVEVNTLAKALAGQKDEAYFAANAAALASRKSSPRVTNEEVQKAAAALKGSDHRRATNVSARLDAQQKKLNLPILPTTTIGSFPQTVELRRVRREYKAKKISEEEYVSAIKEEISKVVKIQEELDIDVLVHGEPERNDMVEYFGEQLSGFAFTANGWVQSYGSRCVKPPIIYGDVSRPNPMTVFWSKTAQSMTSRPMKGMLTGPVTILNWSFVRNDQPRFETCYQIALAIKKEVEDLEAAGIQVIQIDEAALREGLPLRKSEHAFYLDWAVHSFRITNCGVQDTTQIHTHMCYSNFNDIIHSIIDMDADVITIENSRSDEKLLSVFREGVKYGAGIGPGVYDIHSPRIPTTEEIADRINKMLAVLDTNILWVNPDCGLKTRKYTEVKPALTNMVSATKLIRTQLASAK

SEQ ID NO: 2233 - DNA, 488 bp, Panicum virgatum
  misc_feature: Ceres CLONE 1777366
  misc_feature: Encodes the peptide sequence at SEQ ID NO. 2234
atcctgccgttctgcactcattccttcctagccaggcccctgtagaataaaagcaacatgaagaagcagcggatcctcctccatgttctcttcttcatcctcatggctgcccttgctgttgatgctgatgatccacaggagctgcaggagcagcgtcgatccctgctccaggctcccccaaagatagactgcccgtcaagctgcatggtgcgctgcggcagaaactggaagaacaagatgtgcaacaagatgtgcaacgtctgctgcaaccgctgcagctgcgtgccgccgggcaccggccaggagacacgccacctctgcccctgctatgacacaatggtcaacccaaaaaccggcaagcccaagtgcccgtagcctggtgcctcaggccaatctggcaatttctgccgggcgtgttatctatgtatgctatcatcttcatgttaactataccaactgatgataaataaacaccagactttctcctc

SEQ ID NO: 2234 - protein, 105 aa, Panicum virgatum
  misc_feature: Ceres CLONE 1777366
  misc_feature (3)..(108): Pfam Name: GASA Pfam Description: Gibberellin regulated protein
MKKQRILLHVLFFILMAALAVDADDPQELQEQRRSLLQAPPKIDCPSSCMVRCGRNWKNKMCNKMCNVCCNRCSCVPPGTGQETRHLCPCYDTMVNPKTGKPKCP

SEQ ID NO: 2235 - DNA, 706 bp, Panicum virgatum
  misc_feature: Ceres CLONE 1777369
  misc_feature: Encodes the peptide sequence at SEQ ID NO. 2236
aacgcgctcccctctcgctgcggctctcatttcggctccaccgcacacgctccaccccgctcctagagaagctgatcgagaagtggtggtggacatgggccagatccagtactccgagaagtacttcgatgacacctacgagtacaggcacgtcgtcctcccgcccgaggtcgccaagcttctccccaagaaccgcctcctctccgagaacgagtggcgtgcgatcggcgttcagcagagccgcgggtgggtgcactatgcgatccaccgaccggagccgcacatcatgctgttccgccgcccgctcaactaccagcagcaggaggcggctgccgcggcggcggcgcagatgctgcccaagtgagccctccggcgagggcggcgaccacagcgggtttgctgcatttaaaacgccaatccccttttgaactcaaaaaggggcgtcgctgtgcttcgattaatctctccgcctgttggttggaatcaagtgactggtgttggaggtgtccgccttgtgttcgtggtaatgcctgtgaaggaactggctgggttaggctgtgcttatcatgagttctcttatactatgtgttatgtgactctggttgacactcttgtttctgatggttctattctggtttgtaatgctgtgatatttagtctgctatgtgatgaagagatgatgatctaaaaaaaaaaaaaaaaaaaa

SEQ ID NO: 2236 - protein, 89 aa, Panicum virgatum
  misc_feature: Ceres CLONE 1777369
  misc_feature: Great-hit functional homolog of the protein sequence given in SEQ ID NO 9228
  misc_feature: Useful for making plants with altered oil content
MGQIQYSEKYFDDTYEYRHVVLPPEVAKLLPKNRLLSENEWRAIGVQQSRGWVHYAIHRPEPHIMLFRRPLNYQQQEAAAAAAAQMLPK

SEQ ID NO: 2237 - DNA, 878 bp, Panicum virgatum
  misc_feature: Ceres CLONE 1777404
  misc_feature: Encodes the peptide sequence at SEQ ID NO. 2238
gtctcgccgccgattcgctgtgttgccttccgtccccgccgcccgttcgattcctcctgcccgcgcctcgtaggccccccgagtcagcagcctctcgccgtgtcgcggctggtttcgcgctgagttagggttagggtttgtgcggtagcggggaagaggggataggaggaggagaggagccggagatggaggaggtgacggagggagtgaacaacatggcgattacggagccgcacaagaagaaccggatccaggtctccaacaccaagaagccgctattcttctacgtcaacctcgccaagaggtacatgcagcagcacgaggaggtggagctctcggcccttggcatggccattgccacagttgtgactgttgctgaaattctaaaaaataatgggcttgctgttgcaaagaagatcatgacgtccacagttgatgtcacggatgattcaaggaatcgccctattcagaaagccaagatcgaaatagtgctgggcaagacagagaaattcgatgaattgatggcagcagctgaggaggagagggaagctcccaaggcggaggagcagagctaaacatctattttaaattttgctgttgtagtttaattagtatcatgctagaagttgcgtttgaatctcttggctaacaagagagatgtttctttgttatcaatcaagagctctgctcattgattagttggaatgataactttgttaatctcttggttgtttcgttttcaatggcaacttgtttgcttagtacattcattggtgtatgcttaatagctatggtggcgacatttgtgttcggctaactgtctcatgaatcaccacactgaaaacgatagcattagctaaaaaaaaaaaaaaaaaaaa

SEQ ID NO: 2238 - protein, 129 aa, Panicum virgatum
  misc_feature: Ceres CLONE 1777404
  misc_feature: Great-hit functional homolog of the protein sequence encoded by LOCUS At2g34160
  misc_feature: Useful for making plants with modulated nitrogen use efficiency
MEEVTEGVNNMAITEPHKKNRIQVSNTKKPLFFYVNLAKRYMQQHEEVELSALGMAIATVVTVAEILKNNGLAVAKKIMTSTVDVTDDSRNRPIQKAKIEIVLGKTEKFDELMAAAEEEREAPKAEEQS

SEQ ID NO: 2239 - DNA, 828 bp, Panicum virgatum
  misc_feature: Ceres CLONE 1777405
  misc_feature: Encodes the peptide sequence at SEQ ID NO. 2240
gacagggaggcagccaaccagttgacatgcactgcaactggaacgaatgcaagaaactgacgccaacagcccaacagccgctgccgcagctccgccacaaccaaatcaatcaacccctcactcgctcttaaaatcaatcaaccaagaatcccctcccccctctctccactaatcaaaccaaacccctccggtcccctctcctgttccccgtctcttttcttggtcgtcggcgcctcctctgctccgctcggtcgccgtggtcgaacaagcatccccatggcggaaaaaggaagccccctgcctaagtttggggagtgggatgtcaacgaccctgcttcagctgagggatttactgtaatatttaacaaagctagagatgagaagaagactggaggaaattcacagggtcaagatgagcaagtgaaaagtgaacagcaatcatctgggcaaggcttcaatgctcccaagaagaaatggctgtgctgctttcaacccagtgctgctgaatcctgaagtccacaagatagcatctggattgtggaactgagctgtgcttacctcgtcaaatttctgaagacattctgcgatatccagggagccatgttatcatgattctttttacagttatgtgatgaaagatggtctgggaaacaagtaatcttactagtctgtctctggcatgtacattatttgcaacttatatatcttggtaaacatcggttgtgtatattgatgcgtaaaatcgtgtttgatctaattgactcattgaacatttgttcagctggaagaaggggtaaaggtacagggtaaaaaaaaaaaaaaaaaaaa

SEQ ID NO: 2240 - protein, 78 aa, Panicum virgatum
  misc_feature: Ceres CLONE 1777405
  misc_feature (3)..(74): Pfam Name: NOI Pfam Description: Nitrate-induced NOI protein
MAEKGSPLPKFGEWDVNDPASAEGFTVIFNKARDEKKTGGNSQGQDEQVKSEQQSSGQGFNAPKKKWLCCFQPSAAES

SEQ ID NO: 2241 - DNA, 606 bp, Panicum virgatum
  misc_feature: Ceres CLONE 1777458
  misc_feature: Encodes the peptide sequence at SEQ ID NO. 2242
actcgaggtacaagttctcccccttcctttccacctcgattcgtctccgctctttatcccccgctgcgcccgtgcctttcctctccatctccgccgccgccgccgccgccgtcgcctcccacccgcagccgcaccactctccccggcggatcgggacgtctgctcggcgcggtccatccatggcggaggaatcaagtcgccccttgcctaagtttggtgaatgggatgtgaacgacccagcttccgctgatggattcacggtgatattcagcaaagccagagatgagaagaagggtgggaatggacaggatacagagtctccttccaaggacaccaggaccgagagggtggaatcttatgctgccaagccgaattcgaagaaatggttttgctgcgtgacagccagccccacacaatcctgaagacgatcacccgctcgtgggaatactgcccctttaatttttctatacatactatccataagactgtagaggtacccagcgctctccgggctccaggatgggtacctcgtatgtatgtgtgtgtgagggttgtcggcacacatttgcaaagtggacttctgagttctgattgtaattgtagtcc

SEQ ID NO: 2242 - protein, 80 aa, Panicum virgatum
  misc_feature: Ceres CLONE 1777458
  misc_feature (1)..(73): Pfam Name: NOI Pfam Description: Nitrate-induced NOI protein
MAEESSRPLPKFGEWDVNDPASADGFTVIFSKARDEKKGGNGQDTESPSKDTRTERVESYAAKPNSKKWFCCVTASPTQS

SEQ ID NO: 2243 - DNA, 921 bp, Panicum virgatum
  misc_feature: Ceres CLONE 1777532
  misc_feature: Encodes the peptide sequence at SEQ ID NO. 2244
atcacaaccgacctccgatccacttctgctcaccagacactgctaagctagctagctgctttacacttcactcactagtcactagcagcttgatcattcgacgatcagtgagtgttatcatatatcattagctgcaatattatatatagaattatatatatggctcgcctctccgccgttgtcgccgtcgtcctggtggctgcgctggtggcggccgagaccgcttcggctgcggtgagctgcagccaggtgacgtcggccgtggcgccgtgcctggggtacgccatgggcagctcggcgtcgccctcgtcggcgtgctgcaacggggtgaggtcgctcaacagccgggcgtcgtcgacggcggacaggcaggcggcgtgcgcctgcctcaagagcatggcggggaggctgggtggcaacatgggcaacgccgccgccagcatccccagcaagtgcggcgtcaacgtcggcgtgccaatcagcccaaacgtcgactgcgccaagtaacaaactctaatcatcactggacctggactagtacttattagcgtacttgtcgttaaccatatgcactaattacctgctcttcatatatattgtgcaggattaactgataagatgctaaggatggatgctcagctctttccttctctttgggtatgatgtcggccaacagagcagagagcagtcgtttaatttactacctcttccttttacatttgtacaacaccacgcaccacctgtgtacgtcgtcgtctatgtacaacaataatcctccctctctctgcttatgtgtttgctgggtctctgttttcatgtactactaccatgctgctgctgctactgcttgttataggcaggtcaggcagctctccgctcaatcaataaactttttttctgtaaaaaaaaaaaaaaaaaaaa

SEQ ID NO: 2244 - protein, 115 aa, Panicum virgatum
  misc_feature: Ceres CLONE 1777532
  misc_feature (1)..(86): Pfam Name: Tryp_alpha_amyl Pfam Description: Protease inhibitor/seed storage/LTP family
MARLSAVVAVVLVAALVAAETASAAVSCSQVTSAVAPCLGYAMGSSASPSSACCNGVRSLNSRASSTADRQAACACLKSMAGRLGGNMGNAAASIPSKCGVNVGVPISPNVDCAK

SEQ ID NO: 2245 - DNA, 748 bp, Panicum virgatum
  misc_feature: Ceres CLONE 1777570
  misc_feature: Encodes the peptide sequence at SEQ ID NO. 2246
aacaaccaccagtgacttcgcagcctcctcttcccccaaccaacccgaatcccagccgcagaacccccctagcagccgcgtcgatggcccccaaggcggagaagaagccggcggcgaagaagcccgcggaggaggagcccgcgacggagaaggcggagaaggccccggcggggaagaagcccaaggccgagaagcggctccccgctggcaagtccgccggcaaggagggcggcgagggcaagaaggggaagaagaaggccaagaagtcggtggagacgtacaagatctacatcttcaaggtgctgaagcaggtgcaccccgacatcggcatctcctccaaggccatgtccatcatgaactccttcatcaacgacatctttgagaagctcgccggcgaggccgccaagctcgcgcgctacaacaagaagcccaccatcacctcccgcgagatccagacctcggtgcgcctcgtcctccccggcgagctcgccaagcacgccgtctccgagggcaccaaggccgtcaccaagttcacctcgtcttagatgctaggctttcccctctgctctttgttggcgtaaggctcctggtagtgatgctagtttgctcggtttggctggcaggatggtgtagttaggtgctggtggttgctgataatgttctttctgtacgaagtgagaagtgaaatctgttaatgttatcagatgcaatgttaatggtgcttgtttaaaaaaaaaaaaaaaaaaaa

SEQ ID NO: 2246 - protein, 153 aa, Panicum virgatum
  misc_feature: Ceres CLONE 1777570
  misc_feature: Great-hit functional homolog of the protein sequence given in SEQ ID NO 9491
  misc_feature: Useful for biocontainment applications
  misc_feature: Useful for making plants with modulated flowering time
  misc_feature: No seed is being produced by the plant
  misc_feature: The plant flowers significantly late compared to wild-type.
MAPKAEKKPAAKKPAEEEPATEKAEKAPAGKKPKAEKRLPAGKSAGKEGGEGKKGKKKAKKSVETYKIYIFKVLKQVHPDIGISSKAMSIMNSFINDIFEKLAGEAAKLARYNKKPTITSREIQTSVRLVLPGELAKHAVSEGTKAVTKFTSS

SEQ ID NO: 2247 - DNA, 697 bp, Panicum virgatum
  misc_feature: Ceres CLONE 1777590
  misc_feature: Encodes the peptide sequence at SEQ ID NO. 2248
gtgctgcgccttggggagttctcatggagcagggtaagaaagcaaaggtactgtgcctgcatggcttccggacaagtgggaatttcttgaagaagcagatcagcaagtggcacccttctatattccagcagtttgacatggtattccctgatggcatcttcccagctggtggaaagtcggaaatagatggcatatttccaccaccgtactttgagtggttccagttcaataaggagttcacggaatacacaaatctagatgaatgcatttcatatctgtgtgattacatggtgaaaaatggaccttttgaaggcctacttggattctcccagtttgggcaggagggaaggtggaaacccgttgatgtcttgcagttaattttttaatttcctgctacccaaggtgcacgtctgacaggattataacttacaagcacttcgacaggagcggagccagaaatggctttcaccagtggccatgtgctggattggacgaatttgagccaaattctagtgctttgggtagaaaacctgtatatatgtacctaagatgaactaggcaagaacggtgctgctgcatgcctagcacgggcactgatccggccctgcactaggtcgcatcagttgcacagtaaagccctgagaaattgattgagttgtgacctttattttttaatcaaaaaaaaaaaaaaaaaaaa

SEQ ID NO: 2248 - protein, 120 aa, Panicum virgatum
  misc_feature: Ceres CLONE 1777590
  misc_feature (3)..(101): Pfam Name: FSH1 Pfam Description: Serine hydrolase (FSH1)
MEQGKKAKVLCLHGFRTSGNFLKKQISKWHPSIFQQFDMVFPDGIFPAGGKSEIDGIFPPPYFEWFQFNKEFTEYTNLDECISYLCDYMVKNGPFEGLLGFSQFGQEGRWKPVDVLQLIF

SEQ ID NO: 2249 - DNA, 1093 bp, Panicum virgatum
  misc_feature: Ceres CLONE 1777677
  misc_feature: Encodes the peptide sequence at SEQ ID NO. 2250
atcctttccccctaccctcagttccatcgtttggctgcattcatggtctccctgctctctcgcgcgccctacctcgcgtacctccccaagcccacctcctcctcgctgcggccgccccagcccgccatgtcgtcgtcctccgccgccgcccctgtggaggcggcggcccagccgaggaagctgccggtgctgctgttcgatgtcatggacaccctcgtcagggacccgttctaccaccacatccccgccttcttccaaatgtccatgaaggaactactagaaagcaaacatccaacggcatggtcagaattcgagaagggactgattgatgagttgcagacctgcaatgctggcgtcacgtgtcccaggagcacaggggcagctcgaaacactgcagtttttctatttgctgtaactttacagacttgcgaggctcccagctgcagaactggcatcggacgccacgcgccctgtgaagcacggagaggagtccaaacgctagtagctttcaagaaacccgataatgagctggccaaaaagttcttcaatgatggcagatcttttgatttggaaggtctcaaagagtgcatggtgagagcatatgagtacattgatggtgtcgaagatattctttgctgtttgaagaaaaataactatgagatgcatgcttttaccaattatccagtatggtaccagttaatcgaggataagttaaagctctcaaagtatttgtcctggacattttgctcttgtagaactggaaaacgcaagccttcgcctgaattttatcttcaagctatagatcatctcaatgttgatccagcaagctgcatttttattgatgacagaatggtaaacattgaagcagctcttagcgtaggaatggttgggttgcaatttaaaaatgctgaggctctgaggaaagacttgtgtgctctgggagttgaattgcctcctcttgtttgcgaaggtgatgcacaagtacaataagtctgcaccctttcttgtctccggcttaacaaaagcacaatttaaatatacatatatattaatatataatacatttgctttgtaaaaaaaaaaaaaaaaaaaa

SEQ ID NO: 2250 - protein, 315 aa, Panicum virgatum
  misc_feature: Ceres CLONE 1777677
  misc_feature (51)..(180): Pfam Name: Hydrolase Pfam Description: haloacid dehalogenase-like hydrolase
MVSLLSRAPYLAYLPKPTSSSLRPPQPAMSSSSAAAPVEAAAQPRKLPVLLFDVMDTLVRDPFYHHIPAFFQMSMKELLESKHPTAWSEFEKGLIDELQTCNAGVTCPRSTGAARNTAVFLFAVTLQTCEAPSCRTGIGRHAPCEARRGVQTLVAFKKPDNELAKKFFNDGRSFDLEGLKECMVRAYEYIDGVEDILCCLKKNNYEMHAFTNYPVWYQLIEDKLKLSKYLSWTFCSCRTGKRKPSPEFYLQAIDHLNVDPASCIFIDDRMVNIEAALSVGMVGLQFKNAEALRKDLCALGVELPPLVCEGDAQVQ

SEQ ID NO: 2251 - DNA, 870 bp, Panicum virgatum
  misc_feature: Ceres CLONE 1777716
  misc_feature: Encodes the peptide sequence at SEQ ID NO. 2252
aagcaagcaagcacatctactagcaggggcggatttacaggggggctctaaacccccctactgtccaaaacctccattgaaatcaaaggagaaatatgagagaaaaagagaaaaaaaggtgaagaaataagtggagatagagaggaggaggaaccaagcccccccccgccctaaattgaaactctgcgtccgccactgtctactagtcaaagcattttatgagaagctcgctcgatcttctagctcgcctacattttcctcctcaactctttcaacaagttcccgtagaagatcatctttctgctcgatggaccgggtgacgaagctggcttctcagcgtgaggtggtgatcttcagcatgagctcctgctgcatgtgccacacggtgacgcgcctgttccgcgagctcggggtgaacccgacggtggtggagctagacgaggacccgcgggggaaggagatggagaaggcgctggcgaggctgctgggccgcagccccgccgtgccggcggtgttcatcggtggcaggctcgtcggctccaccgacaaggtcatgtcgctccaccttggcggcaacctcgtcccgctgctgcgcaatgccggcgcgctctgggtgtagcctggcgctggctgctctgggtcacctcacacactggcgaataactgaagtgtgtgctttttatcaggagacggaggaaagtaactgagcaggccttttttctgcactgtaataatctatagaggggtgagtgttggatcagggcctttcgtgctctaacgacgcatgttttgatatgttctgcatctttttgtcgtccgtatcgaaagtttcgtcagagttagcagtttgaaaaaaaaaaaaaaaaaaaa

SEQ ID NO: 2252 - protein, 103 aa, Panicum virgatum
  misc_feature: Ceres CLONE 1777716
  misc_feature (1)..(64): Pfam Name: Glutaredoxin Pfam Description: Glutaredoxin
MDRVTKLASQREVVIFSMSSCCMCHTVTRLFRELGVNPTVVELDEDPRGKEMEKALARLLGRSPAVPAVFIGGRLVGSTDKVMSLHLGGNLVPLLRNAGALWV

SEQ ID NO: 2253 - DNA, 800 bp, Panicum virgatum
  misc_feature: Ceres CLONE 1777745
  misc_feature: Encodes the peptide sequence at SEQ ID NO. 2254
ggagatttccttcctcgtctttcctccgccgccctccgcgttcggcgcaaaccccctccgtgcccacctccgcgcgcgccggccgcccgtcccgtcgactgcctacacgcaggcagcgagctcctgcccggccgcctcccgcccacgtctgcgcgcgccgcgagctcccaagtcgaagcggggatggctctggccagattggcgtccttcatcctcctcgccgcggcggggttcgcggcggcgacgcggtcgccgtcggccttcgtgcagaacgccatctactccaaccgcatcaccatcttctcgaaaacctactgcccgtactctatccgtgctaagcgcatatttcaagatctcaagaaagatccatatattgttgaactagatctccgagaggatgggcgtgacattcaaagtgttctcctggacctagttgggcgccatactgtgccacaggtgtttgtgaatggccagcatgttggtggctcagatgatacagtaaatgctctttcaaatggacagcttgagaaactccttggtaagagtcagtcacagtgattggtctcccgacaggctcgcactgtcaagaacacgttagtgactcacatttatgtacgggaggtatatgtacttgaggggttttcttctctgtataggaccgcacagaatgttgtagctcatataatatgtcaaatgtttttttggcggtatggtagtgttgtgacaacaatctgtatgtacttgatatgtgtgatctgctcaattacatatacattgtacaaaaaaaaaaaaaaaaaaaa

SEQ ID NO: 2254 - protein, 124 aa, Panicum virgatum
  misc_feature: Ceres CLONE 1777745
  misc_feature (1)..(63): Pfam Name: Glutaredoxin Pfam Description: Glutaredoxin
MALARLASFILLAAAGFAAATRSPSAFVQNAIYSNRITIFSKTYCPYSIRAKRIFQDLKKDPYIVELDLREDGRDIQSVLLDLVGRHTVPQVFVNGQHVGGSDDTVNALSNGQLEKLLGKSQSQ

SEQ ID NO: 2255 - DNA, 885 bp, Panicum virgatum
  misc_feature: Ceres CLONE 1777794
  misc_feature: Encodes the peptide sequence at SEQ ID NO. 2256
accatcagcctccaccaccaccaccaccatggctgccctcggcatcacctccccgccggcgccgtccgccttcgcgtccgcaacatcttcccgctcccactcttcaccctccaccccccgcctccgcctccgctccctccccacccgattcgcggctgcggcgtcgttccgcgcgcggtgcgctgccgccgccgccgcagccggcagcgctgcgggctccgagggcgccgccgcagtggcggaggtggatgaggcgggcaccgaggtcgccgggggcgccgcaacctccacgcggccgccctactcgctcatctccgcggagaatgtgcagaaggcgatgcgtggcctagctattacagatgctgatcactatgggaggcttggagtcacaagactagcttctactgatgaggtaaccactgcctatgagaaaaagtgtgtagaactaaatagcaaaaaactggaagaagaggagctcaacaagaaacttgacctcctaaaggaatcatttaccatactatcaactgaggaagagcgaagattatatgattggagcatgtccagaagtgggcaacctgagcgatatgtctggccttttcaagtagatcccttggagccggcaccagatcctccccaggaacctgaagacgaggtcccgacaaagctcgttggctacttcttcctggcgtggttcatactctctgttgtgttctcggtgaccctcaacagatgagggacctctcgccccctgcaaaagatgaactgcaaccccaataccgtatatcttccctgtatgaatgctgtaaatgacaagcatactgttacatggtaaaatttaactggagcacatagctgcacattctgtaaaaaaaaaaaaaaaaaaaa

SEQ ID NO: 2256 - protein, 234 aa, Panicum virgatum
  misc_feature: Ceres CLONE 1777794
  misc_feature (1)..(62): Pfam Name: DnaJ Pfam Description: DnaJ domain
MAALGITSPPAPSAFASATSSRSHSSPSTPRLRLRSLPTRFAAAASFRARCAAAAAAAGSAAGSEGAAAVAEVDEAGTEVAGGAATSTRPPYSLISAENVQKAMRGLAITDADHYGRLGVTRLASTDEVTTAYEKKCVELNSKKLEEEELNKKLDLLKESFTILSTEEERRLYDWSMSRSGQPERYVWPFQVDPLEPAPDPPQEPEDEVPTKLVGYFFLAWFILSVVFSVTLNR

SEQ ID NO: 2257 - DNA, 647 bp, Panicum virgatum
  misc_feature: Ceres CLONE 1777805
  misc_feature: Encodes the peptide sequence at SEQ ID NO. 2258
atcccgccgccgcgcaggacgaaggagacctccgccaccatgtcgtcgatgatgtccgcgctgtccaactggctggtgaacccgcgccgcaacccgctcgcgcgcatccacatgcacgccgtttcctcgcgcctcaggaaatacgggctgaggtacgacgacctgtacgacccgtacttcgacctggacatcaaggaggcgctcgggaggctgcctagggaggtggtcgacgcccgcatccagcggctcaagcgcgccatggacctctccatgaagcaccagtacctccccgaggacctccaggctgcacaaactccattcagaggctatttgagtgacatgttggctctggtaaaaaaggagagtgctgagcgtgaagcgctgggagcccttccgctttaccagagaaccattccttaaaaagtgctgcctagaagctctctcaattttttcgcttcacggcacactgaaatgcatgaaataatatgcagtggatgaaactgtttttccttcatatcaagttccattttacttgttgacatgcttgtagttctgcttccaccctctaagtaatgggaacaaattatgtgttcaacccttattaacttctatgaaagtcttcagcagctgggtaactgttgtagcgt

SEQ ID NO: 2258 - protein, 126 aa, Panicum virgatum
  misc_feature: Ceres CLONE 1777805
  misc_feature (4)..(126): SWISSPROT Homolog: EC 1.10.2.2 Ubiquinol-cytochrome c reductase complex 14 kDa protein
MSSMMSALSNWLVNPRRNPLARIHMHAVSSRLRKYGLRYDDLYDPYFDLDIKEALGRLPREVVDARIQRLKRAMDLSMKHQYLPEDLQAAQTPFRGYLSDMLALVKKESAEREALGALPLYQRTIP

SEQ ID NO: 2259 - DNA, 775 bp, Panicum virgatum
  misc_feature: Ceres CLONE 1777819
  misc_feature: Encodes the peptide sequence at SEQ ID NO. 2260
accattacagtacgcactccggctgacgcgccccgcactctctcacaaagctcaagcctttcgctcgctcgctcgctcgcggctacatctacaatggcgcgattccagctcgcggccctggccatggccatgctcttcgccgcggcggcggcgcaggccccggccgccaccccgacgccggcgcccagggcgtcccccccgccggcgactcctccgccgaccccggcgccggtgtctccgcccgcgcaggcccccgccgttcctcccccggccccggcgcccgtgactccggcccccgcccccgaggccgccgccccggcgccggctgaggcccccacccccgaggcgagctccccgccggcgcccgcccccatgggcccctccccgtcgcccaccagcgacgtgcccccggcccccagcgccgccgccggcgtctcccccgccgccaagtgggccgccgccgccgccgtggccgccgtggccgccgccttctactgaggagtacccccgcaccgcaccgcccccgcggtgctgtaatctattgctatccgtgttgaattttttgcttttttttgctttcatattccattcggcattcgattcggtaggagagactcctggcatctgtgcgcgttgctgctactgcagtctgtgtaggatcgtggcttggacagattggttggttggctgcccccggtggtgttgtgatcccccatttgtataatcccctgttaatttatcttcacctcctcttcaaaaaaaaaaaaaaaaaaaa

SEQ ID NO: 2260 - protein, 134 aa, Panicum virgatum
  misc_feature: Ceres CLONE 1777819
  misc_feature: Great-hit functional homolog of the protein sequence encoded by LOCUS At5g10430
  misc_feature: Useful for making plants with altered cell wall content and/or composition
MARFQLAALAMAMLFAAAAAQAPAATPTPAPRASPPPATPPPTPAPVSPPAQAPAVPPPAPAPVTPAPAPEAAAPAPAEAPTPEASSPPAPAPMGPSPSPTSDVPPAPSAAAGVSPAAKWAAAAAVAAVAAAFY

SEQ ID NO: 2261 - DNA, 621 bp, Panicum virgatum
  misc_feature: Ceres CLONE 1777831
  misc_feature: Encodes the peptide sequence at SEQ ID NO. 2262
tttgagaaataaagcaaacaagaagttatccaatggcagagggaaaaggctccggcgaccttttctccagcggcaagctggtggtggatgccgcctcgtcagtgttccagcagaagagcgccgacaacgtcgacaagaagcaggtcgccggcgcggccgcggacctcctgggcgcggcgtcctcttacggcaagttcgaggacaagccagccgggcagtacatcgagaaggccgaggggtacctgaaggagtacagctcagggccggccgccggcgcagagaagcctgctggcgacgccccggcacccgcaggcgacgtcgaagcgcccaagcctgcagagccggcgcctgcgccgcctgccgcggaggaaagcaagtcggaggggttcggtctcgacgacgtcgtcaagggcgctgaccagctggtggagaagcagggcggcggcggcggggagagcaccggcggcggcgccggtgggctgtttaacatggccaaggggttcctgaagtagaccgcactgctttcagcttccgtaatttgtctgggtatctttgctgtgtttggtttgtaattaactgctaataaagccacgttgttgcctccaaaaaaaaaaaaaaaaa

SEQ ID NO: 2262 - protein, 159 aa, Panicum virgatum
  misc_feature: Ceres CLONE 1777831
  misc_feature: Great-hit functional homolog of the protein sequence given in SEQ ID NO 9349
  misc_feature: Useful for making plants with modulated cold sensitivity
MAEGKGSGDLFSSGKLVVDAASSVFQQKSADNVDKKQVAGAAADLLGAASSYGKFEDKPAGQYIEKAEGYLKEYSSGPAAGAEKPAGDAPAPAGDVEAPKPAEPAPAPPAAEESKSEGFGLDDVVKGADQLVEKQGGGGGESTGGGAGGLFNMAKGFLK

SEQ ID NO: 2263 - DNA, 838 bp, Panicum virgatum
  misc_feature: Ceres CLONE 1777870
  misc_feature: Encodes the peptide sequence at SEQ ID NO. 2264
acacaggcgcacgctgagcagtgagcttcccccataaccacatgtcaaacagagcacggcgcgcaccctccggacaccaggaatcccgggaaccggcagcggcgccggcggcgacgcctcggccgcgatgatgccacccttggcgctcgtgctcctggccctggcggccgcgctggcgccgggcgcgcgggcgcagatatcggccgcgcccctgggcgccccggtgccgtcgctggactgcgcgggcgcgctgcgggacctgacgccgtgcctgacgtacgtgaagcgccgcagcgcgctgacgcggccggacaagggctgctgcggggcgctcgcggccgtcgtgggcggcggcaacgccgcgtgcctgtgcgggttcctcgcgggtcaaggcgcgcgcggcgtccgcgtggaccccgtgcgcgcgctggcgctgcccaccatctgccgcgtcgacgcgccgccgccgaggctctgcgccgcgctcgggatgcccgtcgccgagccgccgggcggggccgccgcgccgatggagtcgtcagggtccgacgtgccgacgaccaccccggcggcgagcggcggcccggcgacgcaccgacgaccgttcctggcggctctcccgcagtgctgcctcctcgtcatcctccccaagctgctgctgctgtaataactcccctcccctgcaggtccggtcgtacgtatacaccgctcgcgtcgcggcaccgtagaaggcgtggagttgtacagcagcagtacaggtgtataaatgtacacacgcgtttggccacagccgaaggaatgaaatcaatttggcgtccaaaaaaaaaaaaaaaaaaaa

SEQ ID NO: 2264 - protein, 179 aa, Panicum virgatum
  misc_feature: Ceres CLONE 1777870
  misc_feature (1)..(80): Pfam Name: Tryp_alpha_amyl Pfam Description: Protease inhibitor/seed storage/LTP family
MMPPLALVLLALAAALAPGARAQISAAPLGAPVPSLDCAGALRDLTPCLTYVKRRSALTRPDKGCCGALAAVVGGGNAACLCGFLAGQGARGVRVDPVRALALPTICRVDAPPPRLCAALGMPVAEPPGGAAAPMESSGSDVPTTTPAASGGPATHRRPFLAALPQCCLLVILPKLLLL

SEQ ID NO: 2265 - DNA, 710 bp, Panicum virgatum
  misc_feature: Ceres CLONE 1777921
  misc_feature: Encodes the peptide sequence at SEQ ID NO. 2266
atctggctcctccactcctcgagctccaaacctcgcgtaaaccccagcccccggcgtgcagaggagagggggtcgcctccgcgggatgaagacgaggtcgcagacggcgccgaagcccctcaagacggtggcgctggcgcccaggcccggcagccccaagcggaggccgaggccgaagccgaagccgaagccggcggggaagggcgacccccgcgcgcccaagaagccccccaccgccttcttctacttcatggaggattttcgaaagacttatcagcaggaaaatccaagtgtaaagttaatgcaggaaatagggaaggcatgtggtgaaaagtggaatacgatggcgtttgaggaaaaggtgaagtattatgatatagccaccgagaaacgagcagaatttgagaaggcgatgattgaatataacaagaaaaagcaaagtggagagttgtctgaggaatccgattacgactagagctgaagattctgctattccaatttcagatggttcacctctactacttgagtcaatctattgtatattacagaactcagaattgtgatttgtaatggaatttgtagataccagtaggagtcctaagttcacgcacaattgtctcatctgtaatagactggtcgtatttaactgacacagagtcattggtgattctagtctggacgaactttcttaaaaaaaaaaaaaaaaaaaa

SEQ ID NO: 2266 - protein, 129 aa, Panicum virgatum
  misc_feature: Ceres CLONE 1777921
  misc_feature: Great-hit functional homolog of the protein sequence given in SEQ ID NO 9656
  misc_feature: The sequence is a functional homolog of  SEQ ID NO 586 in the  10/666,642 US patent application
  misc_feature: Useful for making plants with altered alkaloid content
  misc_feature: Useful for making plants with modulated growth and phenotype characteristics
MKTRSQTAPKPLKTVALAPRPGSPKRRPRPKPKPKPAGKGDPRAPKKPPTAFFYFMEDFRKTYQQENPSVKLMQEIGKACGEKWNTMAFEEKVKYYDIATEKRAEFEKAMIEYNKKKQSGELSEESDYD

SEQ ID NO: 2267 - DNA, 637 bp, Panicum virgatum
  misc_feature: Ceres CLONE 1777960
  misc_feature: Encodes the peptide sequence at SEQ ID NO. 2268
gcatcaaaaaacactccgccgccgaccaccgctgccggagattccctcgtccggcaccaagccatggacaagtataacaacaacactcagtttgcacccttgagagatgctccattttctctccgtggtgctattggtggctcgaactcaaatcttgagcaagccagaggctacacatctttgcctctagcagccctgcaaccaaatgtgtctgcacctggaagccgagccatgcacacaagccgccccatggcagctcctgttgcaaaccgcccattgtcaccccacctcccgctgaagaagccacagttcagtgctacgttctcaatctcgcaccgtattttcggtgtcgcgttgggagttgccatcatatccgtccctcttgccaccaagttcagcctgatgtttggtgtttgagagtgaactgccacatcgacgattctgatttctgcagatgtttcatcatctggtttatgcttaaactgactctgggtgctgttggaataacatcatcatcatgctcgcaaacttgggtaataagtaagaccgccaaatgatcagtgtaagaatctcattctgaatggacatgctgttatttggtctgcaaatttggccagaaaaaaaaaaaaaaaaaaaa

SEQ ID NO: 2268 - protein, 117 aa, Panicum virgatum
  misc_feature: Ceres CLONE 1777960
  misc_feature (1)..(50): Pfam Name: Sdh_cyt Pfam Description: Succinate dehydrogenase cytochrome b subunit
MDKYNNNTQFAPLRDAPFSLRGAIGGSNSNLEQARGYTSLPLAALQPNVSAPGSRAMHTSRPMAAPVANRPLSPHLPLKKPQFSATFSISHRIFGVALGVAIISVPLATKFSLMFGV

SEQ ID NO: 2269 - DNA, 632 bp, Panicum virgatum
  misc_feature: Ceres CLONE 1777966
  misc_feature: Encodes the peptide sequence at SEQ ID NO. 2270
atcaccaaaccgaaaaccacaccatggttcatcgtctccgtgccatctccctcaccggcttcaccatcctgctgtccctcgccctcctcttcacctcccagaaagctcaaggagccagcagcaacttgggccgccgcagcggcaaggagaaacgacgacaggcgtcggaggagcactacgtccccgtgcggagcgtggtgtaccggtcgcgatcggtggcgccggcggcgacggaggcggtggggtacgagccgttcgaagtgtgcgaggggtgcaggtgctgctcgacctccaacacgagcagctgcgtggacacgagctgctgctacgccatcgactgcaacctcccggggaagcccttcggcacctgcgccttcacgccccaaacctgcggctgcggcggcaccaccaactgcacccagccctcctgatccatctattaattcctgattactcatttcgtgttcttctttgactggctctcaaatctcaatttgggtctgagactgggctctggggtttcctcaaccttttgtgttctcaacttctgatagatgactgatctgaaaaacaatatagaggattaattcagggccggattctgtttgaacgaaaaaaaaaaaaaaaaaaaa

SEQ ID NO: 2270 - protein, 135 aa, Panicum virgatum
  misc_feature: Ceres CLONE 1777966
  misc_feature: Great-hit functional homolog of the protein sequence given in SEQ ID NO 9322
  misc_feature: Useful for biocontainment applications
MVHRLRAISLTGFTILLSLALLFTSQKAQGASSNLGRRSGKEKRRQASEEHYVPVRSVVYRSRSVAPAATEAVGYEPFEVCEGCRCCSTSNTSSCVDTSCCYAIDCNLPGKPFGTCAFTPQTCGCGGTTNCTQPS

SEQ ID NO: 2271 - DNA, 1073 bp, Panicum virgatum
  misc_feature: Ceres CLONE 1778082
  misc_feature: Encodes the peptide sequence at SEQ ID NO. 2272
gaccaaagagccactcgccattgaggcgatcagtgatcgagttcctcttgtgttggtgtccagagaatcgtagtgtagcgtgacagctagcgaggtttcgatatggcttccaggatggcactcctgtgccttcttggcttgctggtagcgtcacctgccattgctgactccggcatctactaccagcttgctcttatgtggcccggagcgtactgccagcagaccaacgccgggtgctgcaagccgacgaccggcgtgtcgccggcgagggacttctacgtctccggcttcaccgtctacaacgcgacgaccgacgctccggtgaccggctgcaacaacgccgctcctttcgaccctaacaagattaccggcgtccagggcctgtaccagtactggagcagcatcaagtgccccagcaacaacgacaggagcaactggaagaacgcctggaagaagtccggcgcctgctccggcctcgaggagaaggactacttcgaggccgccctctccttccgcagccggatcaacccgctggtccgcctcaaggcccagcacatcgagccggacttcgggctgtacggcgtgaagacgatcaagaatgtgttcaaggcgggcatcaacgcggcgccggtggtccagtgcagcaagggcccccttcggcaagttccagatgttccagctctacttctgggcgtcggcgagcggcaagttcatcgactgcccggcgcaggagcagtacacctgctccaaggagatcctcttccaccccttccagaaggggatggtcaagcagcagctcaatgagtccacggccgccaaccccttcgtgttcccgggtgtcgccgtggaaatgtaactgatcgatgtgcggcggcggcgctgcgctgcttaccgtttggtttgtgatgatgagtttgcgagttgcggtgacgcgcgcatggaaattaaataatgttcccctgttttgttggaggcttgctagctcctcgcggagcaatgatgtactcgtgtactaatctagcacgaataaaacagaccggctaccttcggactcaagcttacccttcctgccc

SEQ ID NO: 2272 - protein, 233 aa, Panicum virgatum
  misc_feature: Ceres CLONE 1778082
  misc_feature (1)..(159): Pfam Name: Ribonuclease_T2 Pfam Description: Ribonuclease T2 family
MASRMALLCLLGLLVASPAIADSGIYYQLALMWPGAYCQQTNAGCCKPTTGVSPARDFYVSGFTVYNATTDAPVTGCNNAAPFDPNKITGVQGLYQYWSSIKCPSNNDRSNWKNAWKKSGACSGLEEKDYFEAALSFRSRINPLVRLKAQHIEPDFGLYGVKTIKNVFKAGINAAPVVQCSKGPLRQVPDVPALLLGVGERQVHRLPGAGAVHLLQGDPLPPLPEGDGQAAAQ

SEQ ID NO: 2273 - DNA, 678 bp, Panicum virgatum
  misc_feature: Ceres CLONE 1778132
  misc_feature: Encodes the peptide sequence at SEQ ID NO. 2274
atctcaaacagatcctcagagagaagagagaagctcctcgagagagatacagagaaagagctagcgcagagttgaacggagagctgaagttcaattagtcccctgcttgcttcttccatggagagagttgcatcaagctgcttcatcggcctcctggctcaaaggagggcctactccgtggccgcggccatggcgaagggagccgggcggagggccgacgagaagaaagcggcggccaagcgcgtgatgggcaagaaggaagtgaacaccgcagctgcggagaagacggcgtgggtgccggacccggtgaccgggtactaccgcccggcgggtggcgccaaggaggtggacgcggcggagctgcgcgccaagctgctcacgcaggcggccaactgatgatgaacccaagtcactttgacttttcgaaccatgagttatcagccgaggtagcttgtcttgctttgagatcggcgctcgttgatcgccgggctccgtggcctagagctagcgtgagggtgctgtatctttgcagcatagtagtttcttcggcgactgcttcatctgatttaggttttgagacatgcaagtctgcaatcttcttgcctgctgcctcgtgaccttcttgactgctattcagtccagaaagaaagaaagaaagaacgaacgaactaagcgtgt

SEQ ID NO: 2274 - protein, 92 aa, Panicum virgatum
  misc_feature: Ceres CLONE 1778132
  misc_feature: Great-hit functional homolog of the protein sequence given in SEQ ID NO 9715
  misc_feature: Useful for making plants with modulated nitrogen use efficiency
MERVASSCFIGLLAQRRAYSVAAAMAKGAGRRADEKKAAAKRVMGKKEVNTAAAEKTAWVPDPVTGYYRPAGGAKEVDAAELRAKLLTQAAN

SEQ ID NO: 2275 - DNA, 738 bp, Panicum virgatum
  misc_feature: Ceres CLONE 1778189
  misc_feature: Encodes the peptide sequence at SEQ ID NO. 2276
atccagcacacagatcgagttgatcgataaggcggcgccatggctgcttcttccacgaccaccatgtcctttgtcttcgtcctggcgttgctgctctcgtgcggtggcgtcagcaacgcggcgcggcggatgcaggagctcccgaagcccgacgtggcgccgctgcccaagcctgaggaaccgctgccggtgcccccgcaacccctgcccaagccagagccgctgccggtgcctgagccactgccggtgccaccccagccactacccaagccagagccgatgccggtgccaccacagccaaagcccgagccgctgccggtgcccccgcagtccctgcccaagcctgagccacttcccgtgccaccacagccccttcccaagccggagccgctgccggtgccaccacagcccaagccggagccgctgccggtgccaccgcagcccctgccccaacccgggctgccggtgccgccgaagccatgatcgatgagctatggcaacatattattgacacggcgctccagtgattattttctactgtatcttgctcatccgtgcgaccatgcgtgatgctttcacagatttgtatagctagtgtgtatcatatttgcagtgtggaatggtgtgtgcattgccatgccatctcatctgatccggccatgatctgtgtattctggctgagatccatgtgtataaataaataaatggattcgtttgcaaaaaaaaaaaaaaaaaaaa

SEQ ID NO: 2276 - protein, 147 aa, Panicum virgatum
  misc_feature: Ceres CLONE 1778189
  misc_feature (92)..(204): Pfam Name: Peptidase_M10_C Pfam Description: Peptidase M10 serralysin C terminal
  misc_feature (60)..(133): Pfam Name: Trypan_PARP Pfam Description: Procyclic acidic repetitive protein (PARP)
MAASSTTTMSFVFVLALLLSCGGVSNAARRMQELPKPDVAPLPKPEEPLPVPPQPLPKPEPLPVPEPLPVPPQPLPKPEPMPVPPQPKPEPLPVPPQSLPKPEPLPVPPQPLPKPEPLPVPPQPKPEPLPVPPQPLPQPGLPVPPKP

SEQ ID NO: 2277 - DNA, 748 bp, Panicum virgatum
  misc_feature: Ceres CLONE 1778377
  misc_feature: Encodes the peptide sequence at SEQ ID NO. 2278
gactcccgcagccgccacccccataccggaccggagctaggcgacgcagcggcacctcatctccggcgaagggaaatggcgaccgttccaggggatctgatctggcagattgtaaggaagaacaactccttcctggtgaagcagttcggcaatggcaatgccaaggtgcagttcaccaaggagcccaacaacctctacaacttgcactcctacaagcactctggtctggcaaacaagaagaccgtgacaatccagccggcagctggaaaggactccgctgtggtcctctcgacgaccaagaccaagaagcagaacatgcctgcgaagatcaaccacaagtctgtcatgcgcaaggagttccgcaagatggccaaggctgtgaagaaccaggttagcgacaactactacaggcctgacctgaccaagccggccctcgcaaggctgagctcagtgtaccgcagcctccaggttgccaagtctggcgtcaagaagaagaacaggcagccgaagcactaagctttgtgttttgttgaggggcctgttggtgctcgtagtcccagcttattatctatgttccaacagttttgagacttgaagtgagacttgttagaactagagcaaccatgttaaagctgctgctgtgtcgttccataatcacaaattgcttggcacttgatgattgctactttatctgcaaacttgctgcgcacgattacccccgttttcagaaaaaaaaaaaaaaaaaaaa

SEQ ID NO: 2278 - protein, 146 aa, Panicum virgatum
  misc_feature: Ceres CLONE 1778377
  misc_feature: Great-hit functional homolog of the protein sequence given in SEQ ID NO 9265
  misc_feature: Useful for making plants with altered oil content
  misc_feature: Useful for making plants with modulated cold sensitivity
MATVPGDLIWQIVRKNNSFLVKQFGNGNAKVQFTKEPNNLYNLHSYKHSGLANKKTVTIQPAAGKDSAVVLSTTKTKKQNMPAKINHKSVMRKEFRKMAKAVKNQVSDNYYRPDLTKPALARLSSVYRSLQVAKSGVKKKNRQPKH

SEQ ID NO: 2279 - DNA, 788 bp, Panicum virgatum
  misc_feature: Ceres CLONE 1778389
  misc_feature: Encodes the peptide sequence at SEQ ID NO. 2280
agaagggaggagttctctatcctagtattttacctaccaaacctcctgctcgatctgctctccctcatccactcaattccttcgatcactcaattcgatccatggatgctcaccggcggcagagcagcagcagcaccaccaccggtggtggtactaataataataagacggctgagctcgaccctgtgctccactcgatcggcttcgagatcgaggaggtgtcgccgtcgcagctgacgggccggctccccgtcaccggcaggtgctgccagcccttcaaggtgctccacggcggcgtctccgccctcgtcgccgagggcctggccagcatgagcgcccacatggcctcgggctaccgccgcgtcgccggagtcagcctcagcatcaaccacttccgcagcgccgccgtgggggacgtcgtcctcgcccgcgccgccccagtccacgtcggacgctcaacccaggtgtgggaggtgaagctgtggaaggaggacccgtcggcgccggggaagcagggtcctcagatctcggagtcgagggtgacgctgctctgcaacctacccgtgccggagagcctcaagaacgccggcgacgcgttcaagaagtacgcagccgccagcagcagcagattgtagatgcatgcatgtatgtatgtatgatgtacatcgcattgtagtatgtactcggtcgatcgatgatgggtcgatatgacgatgatgcatccatctgcttcaataattgtagctattattgtccggccggcgatcgatccgattccagccagagcc

SEQ ID NO: 2280 - protein, 177 aa, Panicum virgatum
  misc_feature: Ceres CLONE 1778389
  misc_feature: Great-hit functional homolog of the protein sequence given in SEQ ID NO 9579
  misc_feature (1)..(75): Pfam Name: 4HBT Pfam Description: Thioesterase superfamily
  misc_feature: Useful for making plants with modulated biomass
  misc_feature: The plant is abnormally small.
  misc_feature: The rosette leaves do not appear in the normal fashion, i.e., their phyllotaxy may be abnormal or too many leaves may be emerging in comparison to the control.
MDAHRRQSSSSTTTGGGTNNNKTAELDPVLHSIGFEIEEVSPSQLTGRLPVTGRCCQPFKVLHGGVSALVAEGLASMSAHMASGYRRVAGVSLSINHFRSAAVGDVVLARAAPVHVGRSTQVWEVKLWKEDPSAPGKQGPQISESRVTLLCNLPVPESLKNAGDAFKKYAAASSSRL

SEQ ID NO: 2281 - DNA, 855 bp, Panicum virgatum
  misc_feature: Ceres CLONE 1778430
  misc_feature: Encodes the peptide sequence at SEQ ID NO. 2282
aagcatgggaagggagatcactggaagggaggaaggaatggaacacgaagaggagctgccttcatcttcttccttggactacttgacacagtgcaggatctgccatgaggaagaggacgagaggcgcgcaaccatggagtccccttgtgggtgctgtggctctctcaagtatgctcacagggaatgtgtgcagagatggtgtgatgagaaggggagcaccctctgtgagatttgccttcagaatttcaagccaggctacaccatgcctccaaagaaaactccggtggttgaaacggccgtcactatcagtgaggacatgcaatctgtggaatctcccgagagcttgattgatggtgcagattacaacagttgttcctactctgcagatcgaggtgccatgtggtgccggtcactgacgatcacgttcaccatgatgctgttggtgtggcatctagttgcagtggtgacggttgaagcggcagatcactgcgcgttcagtctcctgacaatgtacttgcttcgtgctgctggtatcttgctgccattctacgttgtcatgcggctgattcgtatggtccagagggggcagcagcaatatcgcttgcagatgctgcaggaccaaagaagaaatggatcaactatgaatcatatgcatggccaggaggaggagcagttagtaattagtattcattaagccaacgaatttaacaaatcaaatatagaaggctgcacagatgtacattatgtattgctggggaacaattttcaaacagaacatcatttgtaagcttccagtctataagttgtacagtgaaagcagcagcacttcctccccaaaaaaaaaaaaaaaaaaaa

SEQ ID NO: 2282 - protein, 229 aa, Panicum virgatum
  misc_feature: Ceres CLONE 1778430
  misc_feature (1)..(48): Pfam Name: zf-C3HC4 Pfam Description: Zinc finger, C3HC4 type (RING finger)
MGREITGREEGMEHEEELPSSSSLDYLTQCRICHEEEDERRATMESPCGCCGSLKYAHRECVQRWCDEKGSTLCEICLQNFKPGYTMPPKKTPVVETAVTISEDMQSVESPESLIDGADYNSCSYSADRGAMWCRSLTITFTMMLLVWHLVAVVTVEAADHCAFSLLTMYLLRAAGILLPFYVVMRLIRMVQRGQQQYRLQMLQDQRRNGSTMNHMHGQEEEQLVISIH

SEQ ID NO: 2283 - DNA, 779 bp, Panicum virgatum
  misc_feature: Ceres CLONE 1778457
  misc_feature: Encodes the peptide sequence at SEQ ID NO. 2284
atcacctcatctcctccccacttctctgccgttgcctccctgcagcctcctccgctcatggcgtccatggcgttctcactggtaggagccttcaagggtctctccctcgcgaccccttcctcttccatgcgcccgtccttcctccgcggtgaccgcgccgcgctctccgtcggcggcgccgcggtgggcgtgccggtgccggcgcggcggctgaccatccaaatggcgcacaagaagggagccgggagcacaaagaacgggcgcgactccaaggggcagcgtctgggagtcaagatatacggcgaccaggtcgccaagcccggcgcaatcatcatccgccagcgcggcaccagggtctatcctggaaataatgttggaatgggcaaggatcatacactcttttctttgattgatggactagtcaagttcgagaaatatggcccagacaagaaaaaggtaagtgtctacccatacgagaaacagcctgaaaacccaaacagttacagagcaagaaagagagagtacttccgcatgcagcgtgaacgcaagaaggcaagagcagagggagctgttgagcctcaattggtattagccgctgtagacgaaaactctgaggtcagcgcagactgctgataagcttcctgtctagtatttctcttgttcacaagccatgtttgatattttctccctaagactgcatgatcccttaaaggtcatattacacgatgttgtttagatgtggtctatctgctgtgctttaaaaaaaaaaaaaaaaaaaa

SEQ ID NO: 2284 - protein, 191 aa, Panicum virgatum
  misc_feature: Ceres CLONE 1778457
  misc_feature: Great-hit functional homolog of the protein sequence given in SEQ ID NO 9291
  misc_feature: Useful for making plants with modulated biomass
  misc_feature: The plant is abnormally small.
MASMAFSLVGAFKGLSLATPSSSMRPSFLRGDRAALSVGGAAVGVPVPARRLTIQMAHKKGAGSTKNGRDSKGQRLGVKIYGDQVAKPGAIIIRQRGTRVYPGNNVGMGKDHTLFSLIDGLVKFEKYGPDKKKVSVYPYEKQPENPNSYRARKREYFRMQRERKKARAEGAVEPQLVLAAVDENSEVSADC

SEQ ID NO: 2285 - DNA, 667 bp, Panicum virgatum
  misc_feature: Ceres CLONE 1778497
  misc_feature: Encodes the peptide sequence at SEQ ID NO. 2286
gtcttttcggtttccacgccgcgccgccgtctcttctggaaccctctcgtctccgcgtgcggcggcgcgcgattgcttctcccaatctcccttcggctttggaaccggatccggaccgcgaattcgagcttgcgcccgagctcgtcagctccagcgactcctattcgagatggggaacactgcatctgtgaaaactgaggcttcagcttccgtggagccacctgccacaacggctcctgcacctgaaaccaagccaaaaaagatctgctgtgcttgcccagatacgaagaagctgagagacgactgcatcgtgcagaatggcgaggatgcctgcggaaagttcatagaagcccacctgcagtgcctgagagctgaagggttcaatgtctgacacttagctctgtcatgggaactccacatctgtttctgcagtagtctgattttgatcataaggagcatgatgaataagaacttctggtagagggatagtgagaaactaagaactcactgttttgtttataggccgcaaaaaacgccactgaacatggctgtttggaagagggtatgtgtcttttttccagggcattctgcaccatgcctatcagcaattcttgatgatactctaactctatgggacattgtatacggaatttgcttgttttggtcc

SEQ ID NO: 2286 - protein, 73 aa, Panicum virgatum
  misc_feature: Ceres CLONE 1778497
  misc_feature: Great-hit functional homolog of the protein sequence given in SEQ ID NO 9650
  misc_feature (1)..(63): Pfam Name: COX17 Pfam Description: Cytochrome C oxidase copper chaperone (COX17)
  misc_feature: Useful for making plants with modulated drought sensitivity
MGNTASVKTEASASVEPPATTAPAPETKPKKICCACPDTKKLRDDCIVQNGEDACGKFIEAHLQCLRAEGFNV

SEQ ID NO: 2287 - DNA, 958 bp, Panicum virgatum
  misc_feature: Ceres CLONE 1778560
  misc_feature: Encodes the peptide sequence at SEQ ID NO. 2288
attactcttccttctccgtcacctccacacctcgtcgacacctccggtccaccaactctgccgaccatggcggctgcggcggcgcagaagctcctttcagcgagcacgaagatcatcggcgtcgggcgcaactacatcgcccacgccaaggaactcggcaacccagttcccaaggagcccgttctgttcctgaagccgacctcgtcgttcctccacgccggcgtggccaacgccgccatcgagatccccgagccgctcgagtcgctgcaccacgaggtcgagctcgccgtcgtcatctcccggcgcgggcgcgatgtccccgaggcgtcagctatggacttcgtcggaggttatgcacttgctttggacatgacagcaagggaccttcagtccgctgctaagtctgcaggtcttccatggactttggctaaaggacaggacaccttcactccaattagtgcagtagtacccaaatcggccgtcactaatcctgatgatttagagctctggctaaaggtggatgatgaactaaggcagaagggatcgacaaatgacatgatgtttaagattcctttcctaatcagttatatcagttccatcatgacgttaatggagggtgatgtgatactaacaggcactcctgagggtgtaggtcctgttagagtaggccagaagatcaaagctggtataactgatctcattgatgtggaatttgatgtccagaggcgcaatcggtcgttttctgccgatgcaattagcaatgagtaatggtagatacagagagcggtcctccgcgaggctttcctggagcaaccgcagattgttgagccttcttgtttctgtgacctgatttattgatgttgggcttgggggaaactgcttatcatttgatgtatatgtgaacttgttccctcatttaactttcctccctgtcgacgaaaaaaaaaaaaaaaaaaaa

SEQ ID NO: 2288 - protein, 233 aa, Panicum virgatum
  misc_feature: Ceres CLONE 1778560
  misc_feature (1)..(170): Pfam Name: FAA_hydrolase Pfam Description: Fumarylacetoacetate (FAA) hydrolase family
MAAAAAQKLLSASTKIIGVGRNYIAHAKELGNPVPKEPVLFLKPTSSFLHAGVANAAIEIPEPLESLHHEVELAVVISRRGRDVPEASAMDFVGGYALALDMTARDLQSAAKSAGLPWTLAKGQDTFTPISAVVPKSAVTNPDDLELWLKVDDELRQKGSTNDMMFKIPFLISYISSIMTLMEGDVILTGTPEGVGPVRVGQKIKAGITDLIDVEFDVQRRNRSFSADAISNE

SEQ ID NO: 2289 - DNA, 777 bp, Panicum virgatum
  misc_feature: Ceres CLONE 1778578
  misc_feature: Encodes the peptide sequence at SEQ ID NO. 2290
atttttatcattctcctttgctgcttgggttgagagagcgagtggaaggcatggcgatggagccggaggccggagactacggcgccttcatggagaaattcgagctgctgcctccacaatcgcagcagcagctcccgctccacgggctcaccttcgccatcaaggacatcttcgacatcggcggccgcgtcaccgggttcggcaacccggactgggcgaggacgcacgcccccgccgccgccacctcccccgtcgtcctggccacgctggccgccggcgccaccagcgtcggcaagaccgtcatggatgagatggcctacagcataaatggggagaacgcgcactacggcacgccgacgaatccgtgcgctcccgacagagtccccggaggatcctccagtggatcagctattgcagttgccgcgaaactcgtggacttcgctctgggaactgacactggcggtagtgtgagggtacctgctgcctattgtggcatatttggactcaggccttcccatggattggtttccactgaaaatgtcattccaatgtcacagatgtttgatactgttggtaggttattattcctctctttttttcttagtttattactttcagttttcatgtcctattgctgtattctcctttatgaaatttagtcacttaatggagtacctttttttttgcaaaacaagaatacagacatacagtactgttaatgttcagaattatacttgatatttgcatttattctattaaaaaaaaaaaaaaaaaaaa

SEQ ID NO: 2290 - protein, 202 aa, Panicum virgatum
  misc_feature: Ceres CLONE 1778578
  misc_feature (1)..(163): Pfam Name: Amidase Pfam Description: Amidase
MAMEPEAGDYGAFMEKFELLPPQSQQQLPLHGLTFAIKDIFDIGGRVTGFGNPDWARTHAPAAATSPVVLATLAAGATSVGKTVMDEMAYSINGENAHYGTPTNPCAPDRVPGGSSSGSAIAVAAKLVDFALGTDTGGSVRVPAAYCGIFGLRPSHGLVSTENVIPMSQMFDTVGRLLFLSFFLSLLLSVFMSYCCILLYEI

SEQ ID NO: 2291 - DNA, 855 bp, Panicum virgatum
  misc_feature: Ceres CLONE 1778587
  misc_feature: Encodes the peptide sequence at SEQ ID NO. 2292
atccaacactcactcgaacaacaagccttccagttccaggggagaagagagccagcaggaagacggctatggcggcggcgacccagtgggcgatggtggtggccgtggcggcggcggcgacgctggcgggcggcgacatgaacgcggacaagacggagtgcgcggaccagctggtggggctggcgccgtgcctgcagtacgtgcaggggcaggcgcgcgcgccgccgcccgactgctgcggcgggctccggcaggtgctcgggaagagccccaagtgcctctgcgtgctcgtcaaggacaaggacgaccccaacctgggcatcaagatcaacgccaccctcgccctcgccctcccctccgcctgcggcgccacccgcgccaacgcctcccactgcgcccagctcctgcatgttcctccgggatcgaaagacgccgccgtcttcagccccggcggcgacaaggggtccgctgctgccccagccaaggacaactcaacggccacgaccgactcgcgcgggctgcaggcgaccaatggaggcggccgcgtctcctcggtggcgaccgccggcgttgcgctcatggcgctgctcgcaggctaccttctgctcgtgccggagctgtccccttgctcattctagacctctgtcaagtgctcccccaagaaatcaccgggacgtgtcatgctgtagtagttcgtgacagataatctgtatgctcgtgttggtgttgtgctgctttactgtaatactgttgtatgctactggtgtgtaagccaagctagacgatgggtttcgctggcttgaatttattataccagtgcctctggtttctgatcaaaaaaaaaaaaaaaaaaaa

SEQ ID NO: 2292 - protein, 189 aa, Panicum virgatum
  misc_feature: Ceres CLONE 1778587
  misc_feature (1)..(78): Pfam Name: Tryp_alpha_amyl Pfam Description: Protease inhibitor/seed storage/LTP family
MAAATQWAMVVAVAAAATLAGGDMNADKTECADQLVGLAPCLQYVQGQARAPPPDCCGGLRQVLGKSPKCLCVLVKDKDDPNLGIKINATLALALPSACGATRANASHCAQLLHVPPGSKDAAVFSPGGDKGSAAAPAKDNSTATTDSRGLQATNGGGRVSSVATAGVALMALLAGYLLLVPELSPCSF

SEQ ID NO: 2293 - DNA, 910 bp, Panicum virgatum
  misc_feature: Ceres CLONE 1778601
  misc_feature: Encodes the peptide sequence at SEQ ID NO. 2294
aaaaaaccctagcagctgcccctccccactataaagctcctccgctgcgccgccgccaccctccttcccgagccagaggcgaacaaggtaagcggccgccgcaggaaccctagcgccgccgcagcagcagccatgggtatcgacctcgtcgccggcgggaggaacaagaagaccaagcgcaccgcgcccaagtcggacgatgtctacctcaagctcctcgtcaagctgtaccgtttcttggtcaggaggaccaagagcagttttaatgccgtcatcctcaagaggctcttcatgagcaagaccaaccgccctcccatctccctgcgtcgtctagccaatttcatgaaagggaaggaggagaagaacattgctgtgattgttggttcagtcacagatgacaagaggatccaagagattccagcaatgaaggttaccgcactgaggttcacagagacagcaagggctaggattatcaatgctggtggggagtgcctcacatttgaccagcttgctctccgtgctccacttggcgagaacacggtccttctgaggggtcccaagaacgcccgtgaggcagtgagacactttggcaaggctcctggtgtgccacacagccacaccaagccgtatgtgcgctccaagggaaggaagttcgagaaggctcgtggcagaaggaacagccgtgggttcaaggtctaagccgttggcctttgcctgtgcatgttgccattgtgctgcggttctgtttgagcaagcgacagtaattagtaatcactttctactgagtagtatcacaatttgttgtcctggtttgaaatttgaaacatatttgaaggattcgtggtgttatctgctggttgagcaagacacaatgttctgttgcatctcttaaaaaaaaaaaaaaaaaaaa

SEQ ID NO: 2294 - protein, 188 aa, Panicum virgatum
  misc_feature: Ceres CLONE 1778601
  misc_feature: Great-hit functional homolog of the protein sequence given in SEQ ID NO 9458
  misc_feature: Useful for making plants with modulated nitrogen use efficiency
MGIDLVAGGRNKKTKRTAPKSDDVYLKLLVKLYRFLVRRTKSSFNAVILKRLFMSKTNRPPISLRRLANFMKGKEEKNIAVIVGSVTDDKRIQEIPAMKVTALRFTETARARIINAGGECLTFDQLALRAPLGENTVLLRGPKNAREAVRHFGKAPGVPHSHTKPYVRSKGRKFEKARGRRNSRGFKV

SEQ ID NO: 2295 - DNA, 832 bp, Panicum virgatum
  misc_feature: Ceres CLONE 1778656
  misc_feature: Encodes the peptide sequence at SEQ ID NO. 2296
accacacacaaatcaaatcatttctgatcatttcatctcaaagacaagagtccatttccttgaaaggcaggtagccaccatgatcagttccaagaagctagctcaactatccaagaagtggcagggaatgggtgcaattgggagaagaagggtcacaactgtggataaggagatcaacccatcttgcagcagcatagttgcagggaagggcaactgcatagtctactcttccgatgggaagcggtttgagatcccccttgcttacctccatacgacagtctttgcagagctcctgaagctgtcgcaggaagagtttgggttcacatgtgatgggaggatcacactgccttgcgatacagcagtggagtatgtgatgtgtttgctaaggagagaagcctccgaagatgttgagaaggcgctcctcagttccatattgatgccctgccaccacccgagcaggatggtgcagccacccagtgggatgaaccagcaatttgccgtgtgcagctcctgaagatgaagacgtccagggcttcgagcctgtttcctctctttttttcaccttccatcttttttttcccagctgtaccttggagcacggtttttgtgcaacgtttttccaatggtacactgtggatgtgcagatggatgcatgtataaaaaatcacactgtgattagaaaagaaggaatcaagctcgcccttgaaacaacaaagtattgtttatttagatcgtgtaaaagatgttcaatgatgttggcaagtaaaataagagttgactgatgctgcgctctagcacatcagcgcattcataaaaaaaaaaaaaaaaaaaa

SEQ ID NO: 2296 - protein, 144 aa, Panicum virgatum
  misc_feature: Ceres CLONE 1778656
  misc_feature (1)..(105): Pfam Name: Auxin_inducible Pfam Description: Auxin responsive protein
MISSKKLAQLSKKWQGMGAIGRRRVTTVDKEINPSCSSIVAGKGNCIVYSSDGKRFEIPLAYLHTTVFAELLKLSQEEFGFTCDGRITLPCDTAVEYVMCLLRREASEDVEKALLSSILMPCHHPSRMVQPPSGMNQQFAVCSS

SEQ ID NO: 2297 - DNA, 778 bp, Panicum virgatum
  misc_feature: Ceres CLONE 1778658
  misc_feature: Encodes the peptide sequence at SEQ ID NO. 2298
atagaccaccacccccaccaccatcaccaattcaccatcatccttccccagctccgcaggctcttcacagcccgccctccgcgccggacgcgccccgatccagatccaggggcttcatggcatcgaaacgtatccttaaggaattaaaggacttgcaaaaggaccctccaacatcatgcagtgcaggtcctgctggtgaggatatgttccactggcaggcaaccatcatgggtcctcctgatagtccatacgctggaggtgttttcttagtgaacattcatttccctccggactaccccttcaagcctccaaaggtatcttttaagacgaaggtgttccatccgaatatcaatagcaatgggagcatatgtctcgacattcttaaggagcagtggagccctgctttgacaatctctaaggttttgctttctatctgctcgctgctcactgatcccaacccagatgaccctcttgtccctgagattgctcacatgtacaagacagaccggcctaagtacgaggcgacagcccgcagctggacccagaagtacgccatgggatgaaatgaagccccaaattcagcttcctgcacaagtgcagatgattgtgatgttgccccataaactgtttctggggctattatgttcttccattccttgtggtccgtgtgcattctccgatccctctaggatcgagccctagcccaacatcaacctatcattgccgacgataatgagatgacttatgcttgctgtgataaaaaaaaaaaaaaaaaaaa

SEQ ID NO: 2298 - protein, 148 aa, Panicum virgatum
  misc_feature: Ceres CLONE 1778658
  misc_feature: Great-hit functional homolog of the protein sequence given in SEQ ID NO 9309
  misc_feature (1)..(148): SWISSPROT Homolog: EC 6.3.2.19 Ubiquitin-conjugating enzyme E2-17 kDa
  misc_feature (1)..(148): SWISSPROT Homolog: EC 6.3.2.19 Ubiquitin-conjugating enzyme E2-17 kDa 11
  misc_feature: Useful for biocontainment applications
  misc_feature: The plant produces a reduced number of seeds.
MASKRILKELKDLQKDPPTSCSAGPAGEDMFHWQATIMGPPDSPYAGGVFLVNIHFPPDYPFKPPKVSFKTKVFHPNINSNGSICLDILKEQWSPALTISKVLLSICSLLTDPNPDDPLVPEIAHMYKTDRPKYEATARSWTQKYAMG

SEQ ID NO: 2299 - DNA, 1060 bp, Panicum virgatum
  misc_feature: Ceres CLONE 1778682
  misc_feature: Encodes the peptide sequence at SEQ ID NO. 2300
actccagcgcctccgcccagcgcaccaacacaacaaccgccaccgcccgcgcccgaacacttggcgcccaccactcgcccgccgcacgcttcgtcgctcgctcgctccctcctccggttccaccatggcgcccaagaacagcgctctcccacccgccagcgcggccaccgacggcatgatggagccgaggttccgcggcgtccggaagcgcccctggggccggtacgcggcggagatccgggaccccgccaggaaggcccgcgtgtggctcggcaccttcgacaccgccgaggccgcggcgcgcgcctacgacgccgccgcgctccacttccgcgggcccaaggccaagaccaacttccccgtcgcgttcgccgcgggcgcgcacccgccgccgcccaagatgctggccgtcagccccagcagcagcaccgtggagtcctcctcccgggactcgccggccgcgtccccggcggcggcccccgcgctgcccgcgccgtcgctggacctgagcctcggcatgccgcccatggtggccgcccagccgttcctgttccttgacccgaggctcgcggtgaccgtggccgtgccggcgccagtcccctgccggcccgccatcgtcgccggcaccaacaaggcgacctgccgtgaagacgagcagagcgacaccgggtcgtcgtcatccgtggtggacgcctccccggctgtcgacgtggggttcgacctcaacatgccgccgccggccgaggtggcgtaggtggaccggcgccgcgcccgatgacacgacgagtcctccccagagctcgcatagaagattagaacttgtattagtacgtaagaggttggttaatcgatcgtttaattgccgcgatggtttactacttactagctgtacataggatgttctttttgcaccggcagataggtatcacaagaaccgctgccggtgttgccaaaatacacaataccaacacaaagcgttttgtccttcgttgtaacatattaatcgctgattaatgagaaatctaccgtcttttgctcgcaaaaaaaaaaaaaaaaaaaa

SEQ ID NO: 2300 - protein, 209 aa, Panicum virgatum
  misc_feature: Ceres CLONE 1778682
  misc_feature (1)..(64): Pfam Name: AP2 Pfam Description: AP2 domain
MAPKNSALPPASAATDGMMEPRFRGVRKRPWGRYAAEIRDPARKARVWLGTFDTAEAAARAYDAAALHFRGPKAKTNFPVAFAAGAHPPPPKMLAVSPSSSTVESSSRDSPAASPAAAPALPAPSLDLSLGMPPMVAAQPFLFLDPRLAVTVAVPAPVPCRPAIVAGTNKATCREDEQSDTGSSSSVVDASPAVDVGFDLNMPPPAEVA

SEQ ID NO: 2301 - DNA, 904 bp, Panicum virgatum
  misc_feature: Ceres CLONE 1778767
  misc_feature: Encodes the peptide sequence at SEQ ID NO. 2302
aatccgcgtcggcgaccagctggccagcccaacctataaaaatcccacatcgccctccccctctctcgctcacggctcatcacgcaatcgatcgatccccaaccccttaagaaaccggaaaggattccacgccgcgggagcgcaaggcaaggcaaggcaaggccagggagcgagaggagctaggcggtgatggcgcggcggggcacggaggcgttcccggagctgggcgcgcactgcgacgaggccgactgcaaccagctcgacttcctccccttcgagtgcgacgggtgcggcgggttcttctgcgcggcgcaccggacgtaccgcggccacggctgcgccaaggccgccgaccagggccgcaccgtcgtcgtctgcccggactgcggcgacgccatcgagcgggccgcgccggggcagtccgagcgggagatcctggacgagcacgtgcggtcgcgccgctgcgacccggcgaggaagcgcaagccggtatgtcccgtgcgccgctgcaaggagccgctcaccttctccaacaccaccgactgcaaggcctgcggccggaaggtgtgcctgaggcaccgcttcccggccgaccacgcctgcgccggggcggctgcgtccaaggcggcgggcgcggccgcggccaggagggccggcggggagtgcgcccgcgacgcggggagcggcggctgggcgctgccggcggccatccgcaacttcaagatattttgactttttcagctggttgcggacttgcaaaatttaacggcaaaagctccatgggcccatggcctatcatcgtgcttgtcatggcagtgtgccgttgacccattgtaacgctgctctacagtctgcaaagtaacacgactaagaatactgattcaaaaaaaaaaaaaaaaaaaaa

SEQ ID NO: 2302 - protein, 180 aa, Panicum virgatum
  misc_feature: Ceres CLONE 1778767
  misc_feature: Great-hit functional homolog of the protein sequence given in SEQ ID NO 9210
  misc_feature (1)..(43): Pfam Name: zf-AN1 Pfam Description: AN1-like Zinc finger
  misc_feature: Useful for making plants with altered alkaloid content
  misc_feature: Useful for making plants with altered terpenoid content
MARRGTEAFPELGAHCDEADCNQLDFLPFECDGCGGFFCAAHRTYRGHGCAKAADQGRTVVVCPDCGDAIERAAPGQSEREILDEHVRSRRCDPARKRKPVCPVRRCKEPLTFSNTTDCKACGRKVCLRHRFPADHACAGAAASKAAGAAAARRAGGECARDAGSGGWALPAAIRNFKIF

SEQ ID NO: 2303 - DNA, 803 bp, Panicum virgatum
  misc_feature: Ceres CLONE 1778843
  misc_feature: Encodes the peptide sequence at SEQ ID NO. 2304
gcgaaacagcgccgccccgctcctcgtcggccacctgcggcgatgtcggcggcggtcacctcgtgcggcgccccctcgccgtcttctgcctccggcaccggcggcggggagatcacgtacgtgagctacggcggggagcagcacctgccgctggtgatgtcgctggtggacgcggagctcagcgagccctactccatcttcacctaccgctacttcgtctacctctggccgcagctcaccttcctcgcgttcgatgccaaggagggaaagtgcgtgggcacggtggtgtgcaagatgggggagcaccggggcgccttcaggggctacatcgccatgctcgtcgtcctcaagccctacagaggaaggggaatagccactgaactggttactagatctattcgggtaatgatggaatctggctgtgaggaggtgacactcgaagcagaagttacaaataagggtgccctcgctctgtatggacgcctggggttcatccgagcaaagaggctgtatagatactatctcaatggcgtggatgcttttcgcctgaaactgttgtttccacgccctgatcctggcttgcctccaatgatgattggcagcgaaagggatgaccagcagatagattccccctacttgtgacagtactcttttgagtaggtagaatgtgtcgccctttttgcatttctgtttcaaagctttcgcagctctcatgtaactgtaacaatgttgtttgtgcttacaaaccttttgaggtattctatatatttctacccctttgtcaaaaaaaaaaaaaaaaaaaa

SEQ ID NO: 2304 - protein, 199 aa, Panicum virgatum
  misc_feature: Ceres CLONE 1778843
  misc_feature (1)..(83): Pfam Name: Acetyltransf_1 Pfam Description: Acetyltransferase (GNAT) family
MSAAVTSCGAPSPSSASGTGGGEITYVSYGGEQHLPLVMSLVDAELSEPYSIFTYRYFVYLWPQLTFLAFDAKEGKCVGTVVCKMGEHRGAFRGYIAMLVVLKPYRGRGIATELVTRSIRVMMESGCEEVTLEAEVTNKGALALYGRLGFIRAKRLYRYYLNGVDAFRLKLLFPRPDPGLPPMMIGSERDDQQIDSPYL

SEQ ID NO: 2305 - DNA, 774 bp, Panicum virgatum
  misc_feature: Ceres CLONE 1778925
  misc_feature: Encodes the peptide sequence at SEQ ID NO. 2306
gatctccatcagcttcgaatccatcacaacctcagctcaccacacactgctagctagctgctttacacttcactctcactatagcagctgctagcgatcagatcagtgagtgttaattattttttttatatataatggctcgccgcctctccgtctccgtcgtcgtcctggtggctgcgctggtggctgccgagaccgcttcggcggcggtgagctgcggcgaggtgacgtcggccgtggcgccgtgcctggggtacgcgatgggcagctcggcttcgccctcggcggcgtgctgcaacggggtgaggtcgctaagcagccgggcgtcgtcgacggcggaccggcaggcggcgtgcgcctgcctcaagagcatgacggggaggctgggcggcaacatgcgcaacgccgccagcatccccagcaagtgcggcgtcaacgtcggcgtccccatcagcccaaacgtcgactgctccaagataaactgagaagaaggatgaatggctatgatgtcggccaacagagcagagagcagtcgtttaatttactacctctccattttatatttttacaccaccaccgtaccacctgtgcacgtcgtcgtcgtgtatgtaacaacaataatcctctctctgcttatgggtttgctggctctctgttttcatgtatgtactactaccatgctgctgctgctgctgctttgttataggcaggcagcactctgctcaaccaataaactttttgtataaatacatgcaaaaaaaaaaaaaaaaaaaa

SEQ ID NO: 2306 - protein, 116 aa, Panicum virgatum
  misc_feature: Ceres CLONE 1778925
  misc_feature (1)..(86): Pfam Name: Tryp_alpha_amyl Pfam Description: Protease inhibitor/seed storage/LTP family
MARRLSVSVVVLVAALVAAETASAAVSCGEVTSAVAPCLGYAMGSSASPSAACCNGVRSLSSRASSTADRQAACACLKSMTGRLGGNMRNAASIPSKCGVNVGVPISPNVDCSKIN

SEQ ID NO: 2307 - DNA, 907 bp, Panicum virgatum
  misc_feature: Ceres CLONE 1779136
  misc_feature: Encodes the peptide sequence at SEQ ID NO. 2308
atccaagtccaagaagctccactgctccactgatcccagctcgaccagagaccacgctactgccaagctgctgatcctcagcgagcctgcaatggacacgccctcgccgccgccgccgccgtccgcggagcacgaggagtacaggacggtgtggtcggcgccgcccaagaagccggcggggcggaccaagttccgggagacgcggcacccggtgttccgcggcgtgcggcgccgcggccaggcggggcggtgggtctgcgagctgcgcgtcccgggccggcgcggctccaggctctggctcggcaccttcgccacgcccgagctggcggcacgcgcgcacgacgccgccgccatcgcgctctccggccgcgccgcctgcctcaacttcgccgactccgcgtggctgctcccgccgctgatgcccgcggcgctggccagcgcgcgggaggtcagggacgcggtcgctgaggccgtcaaggcgttccggcagcggcggggctcggcatcggcgtcggcatcggcgccgtcgtcgccagcggtggaagcggccgacgaggacgaggatggcagcggctcgcctggcgcggcgccgtcgcccgacgtcttgttcgagctcgacgacgtgttcgggttgggcggcatggttgatgctggatcgtactacgcgagcttggcgcaggggctgctcctggacgcgccggccgcagctggagcgggaacgtggtgggaggacgtcgagcatggcaccgctgacattgcactgtggagctactagcgtaatgctacctccaataaaaaaagggatgaccgtcacacaaggagaattagcacacagaaagcactgtcctgcttgtctgaaacgtcaagagtagcagcttgcttctgacaaaaaaaaaaaaaaaaaaaa

SEQ ID NO: 2308 - protein, 227 aa, Panicum virgatum
  misc_feature: Ceres CLONE 1779136
  misc_feature (1)..(66): Pfam Name: AP2 Pfam Description: AP2 domain
  misc_feature: The sequence is a functional homolog of  SEQ ID NO 1227 in the  10/374,780 US patent application
  misc_feature: The sequence is a functional homolog of  SEQ ID NO 706 in the  11/435,388 US patent application
  misc_feature: The sequence is a functional homolog of  SEQ ID NO 780 in the  11/435,388 US patent application
  misc_feature: Useful for making plants with modulated growth and phenotype characteristics
MDTPSPPPPPSAEHEEYRTVWSAPPKKPAGRTKFRETRHPVFRGVRRRGQAGRWVCELRVPGRRGSRLWLGTFATPELAARAHDAAAIALSGRAACLNFADSAWLLPPLMPAALASAREVRDAVAEAVKAFRQRRGSASASASAPSSPAVEAADEDEDGSGSPGAAPSPDVLFELDDVFGLGGMVDAGSYYASLAQGLLLDAPAAAGAGTWWEDVEHGTADIALWSY

SEQ ID NO: 2309 - DNA, 844 bp, Panicum virgatum
  misc_feature: Ceres CLONE 1779146
  misc_feature: Encodes the peptide sequence at SEQ ID NO. 2310
agcttcaggtcgctggctcgctcgagctcggctcattgacagccctaccgcttaccactcagggcctcaggctcatctcctccctctgtttctcaaatctttcccttcgctcagactctccttccctggcggcgacgactgggcgagcggcggcgccatttgtcacatctttgcccagcccttcgccggcgacgagcatccaccagcttcaagcagaagacaccacttcttcaagatgccaagggccacgggcgatgcaaagcttctgatccagtccctgaacaaggcatatgctgccacaccaacaaatcttaagattatcgacctgtatgtgatttgtgcactcgctactgccatgattcaggttgcgtacatgggattggttgggtcattccccttcaactccttcctctcaggtgttctttcatgcataggaagtgcagtacttgctgtttgcctccgcattcaagtgaacaaagacaacaaggaatttaaggatctccccccagaaagggcctttgctgactttgttctgtgcaacctggtgctccacctggtgatcatgaacttccttggataagcaactgctgtacactgagtggttaagattttgtagccccagattgtggtcactgatcagcgcattttaatgtttggaactgtcataatgtcgagtatgcatatgatttctcacagattacctatgtaagcccagaattcttcgaggaactattagtggaattgacagtgttgatccagtgttgacaatgtaatactgcgagcatttgtgttcaaggaagggaaatggctatatgttacatcagaaaaaaaaaaaaaaaaaaaa

SEQ ID NO: 2310 - protein, 114 aa, Panicum virgatum
  misc_feature: Ceres CLONE 1779146
  misc_feature: Great-hit functional homolog of the protein sequence given in SEQ ID NO 9749
  misc_feature (1)..(114): SWISSPROT Homolog: EC 2.4.1.119 Dolichyl- diphosphooligosaccharide--protein glycosyltransferase subunit DAD1
  misc_feature: Useful for making plants with modulated flowering time
  misc_feature: The plant flowers significantly late compared to wild-type.
MPRATGDAKLLIQSLNKAYAATPTNLKIIDLYVICALATAMIQVAYMGLVGSFPFNSFLSGVLSCIGSAVLAVCLRIQVNKDNKEFKDLPPERAFADFVLCNLVLHLVIMNFLG

SEQ ID NO: 2311 - DNA, 790 bp, Panicum virgatum
  misc_feature: Ceres CLONE 1779151
  misc_feature: Encodes the peptide sequence at SEQ ID NO. 2312
ctgctagctcgtatcacttcgcatctcttcacatctctgatctctatcttttccaccgtataatcctctaacactaccgaccagcaatggatggggagatggactggatcgccgcgcggttcctgctgtccaccatactcggggtgcacccgctggtggtcctggatgacggcggccgcgacgacgagcacttccccgtggacgaccgcggccagcgcgcggtggtgccgacggcggtggaggcgcccgagggggtggccggcgtgtcggtgtgcgcggtgtgcacggaggaggtcgcggcgggacaggccgtggtgcggctgccgtgcgcgcactggtaccacgccggctgtatcgccccctggctgcggatcaggaacaactgcccgacgtgccgggcggagctgcctcgggagggcggggcggagaggccgcggccaccggcgcagcatgccgcgcagctggcggaggcggcgatggagatggccggcggccggctgcggcgggaggcgtcgtacacgatgctggccggcacgttaccctgctaataattaaactagctactagctggtggatcggacgtgacagcctgacaggcaacacgtacgtgacagtagcattaatgtacagcgatatttgaacttctttttagtgttttttaggcacttcttttttagtgtcaagtaataataagcaatgtacagcgataatctaatcgaagcaacaaagaccaagagtttggaggttttcactcgaaacttggttggaccaaaaaaaaaaaaaaaaaaaa

SEQ ID NO: 2312 - protein, 153 aa, Panicum virgatum
  misc_feature: Ceres CLONE 1779151
  misc_feature (1)..(41): Pfam Name: zf-C3HC4 Pfam Description: Zinc finger, C3HC4 type (RING finger)
MDGEMDWIAARFLLSTILGVHPLVVLDDGGRDDEHFPVDDRGQRAVVPTAVEAPEGVAGVSVCAVCTEEVAAGQAVVRLPCAHWYHAGCIAPWLRIRNNCPTCRAELPREGGAERPRPPAQHAAQLAEAAMEMAGGRLRREASYTMLAGTLPC

SEQ ID NO: 2313 - DNA, 878 bp, Panicum virgatum
  misc_feature: Ceres CLONE 1779174
  misc_feature: Encodes the peptide sequence at SEQ ID NO. 2314
acgcaggcacgaccgtccccccgccccgcgtccttctccctcgctctctttccccgcccaacctcccctccgaagcaagaatcaccagaggagcccggccccggaccccggaccccggaccccgaaccaagccaaccaggtgcggtgcgggcgtgagcggcggccatggcgtactacggcgaccggcgcccggagtcgtcgatcgtggaggcgttcacgctgtcgccgctgccgtacccggtgatcctgatcctgctcgtggtctcgctcctcctgggcgtctcgtggttcttcacctacgaggacttcatcgaggaggcggcggagcagttcagctgggcgctgctggccgtgcccatcgcgctcgtgctcctcatccgctggatctcctccgtcgactccttcgacggctacttcttcggcttcctccccagcgagcgccgctggaggcccggctacgggagcgcccccgccgagggcagctcgccctggggcgtcgccatgctcgtcctgctcctcatcgtgctcgcgagcttccacgagaccatccgggacatgtggcggccatgaccgaatccatccgccctcgtctgtcctgacgacctctagtgctcgatttctcatgctttttcttgcgcgcttggttgatcgctgatcctatatgtttctacgcgcgcatgcatgtttctacgcgcgcttgtacttcttgctccatcggtgctgtacatactgcataatacggattctgcaactggctagattatagactctgagggtgatactcgatcaattagctgcatgtaacactggttctgtttttttttgtgcgtgttatataatcaaggtctggtttgctttaaaaaaaaaaaaaaaaaaaa

SEQ ID NO: 2314 - protein, 134 aa, Panicum virgatum
  misc_feature: Ceres CLONE 1779174
  misc_feature: Great-hit functional homolog of the protein sequence given in SEQ ID NO 9396
  misc_feature: Useful for making plants with modulated nitrogen use efficiency
MAYYGDRRPESSIVEAFTLSPLPYPVILILLVVSLLLGVSWFFTYEDFIEEAAEQFSWALLAVPIALVLLIRWISSVDSFDGYFFGFLPSERRWRPGYGSAPAEGSSPWGVAMLVLLLIVLASFHETIRDMWRP

SEQ ID NO: 2315 - DNA, 933 bp, Panicum virgatum
  misc_feature: Ceres CLONE 1779184
  misc_feature: Encodes the peptide sequence at SEQ ID NO. 2316
ctagaaaaaggttacacgagaaaattcgaatcaggagacggggattcgagagagctccgcgcccggtagggaagggaagaggaggcgaagcggaggaggagccgaggcgggatgggggcggtcgagtccgtgccggagacctccatacacgaattcaccgtcaaggattgtaacggcaaggaagtgagcctggagacctacaaggggaaggtcctcctcgttgtcaacgtcgcctccaaatgtgggttcacggagaccaattacacgcagctgacggagctttatcagaagtacagggacaaagacttcgagatattagcattcccctgcaatcagttcttgcggcaagagccagggaccgctgagcaggcaaaagactttgcttgcaccagatttaaagcacaatacccagtttttcagaaggtgcgtgtaaatggtccagatgctgcgccggtctacaagtttctgaaagcgagcaagcctggtttgtttgggtcaagaatcaaatggaattttactaagtttcttgtcgacaaaaatgggaaggtcattgaaagatattcaacttccactgctccaatgtcaattgagaaggacatccagaaggcccttgaggaatagatctcatgccctctaattttatccatcacccactggcagaagtaggcgcttgcaaaaactattccgttgtgtagcaacatttagacgcctttgcattctgtagtacatttctgtattattaccctgatcttcaccttcatgctcatcgtgccttcgtttccttttgtgtaagtagatgttgtattgactagccatcatcttctccttcatgctcttttgcagttttttttttcatggatgcaaactatgtaacactgatcaagcattgtagttcaaggtttgtgcttatgctaaaaaaaaaaaaaaaaaaaa

SEQ ID NO: 2316 - protein, 169 aa, Panicum virgatum
  misc_feature: Ceres CLONE 1779184
  misc_feature: Great-hit functional homolog of the protein sequence given in SEQ ID NO 9255
  misc_feature (1)..(109): Pfam Name: GSHPx Pfam Description: Glutathione peroxidase
  misc_feature (5)..(167): SWISSPROT Homolog: EC 1.11.1.12 Phospholipid hydroperoxide glutathione peroxidase, chloroplast precursor
  misc_feature (9)..(167): SWISSPROT Homolog: EC 1.11.1.12 Phospholipid hydroperoxide glutathione peroxidase 1, chloroplast precursor
  misc_feature: Useful for making plants with modulated flowering time
  misc_feature: The plant flowers significantly late compared to wild-type.
MGAVESVPETSIHEFTVKDCNGKEVSLETYKGKVLLVVNVASKCGFTETNYTQLTELYQKYRDKDFEILAFPCNQFLRQEPGTAEQAKDFACTRFKAQYPVFQKVRVNGPDAAPVYKFLKASKPGLFGSRIKWNFTKFLVDKNGKVIERYSTSTAPMSIEKDIQKALEE

SEQ ID NO: 2317 - DNA, 1095 bp, Panicum virgatum
  misc_feature: Ceres CLONE 1779221
  misc_feature: Encodes the peptide sequence at SEQ ID NO. 2318
atcaaagtctccagtctccagtgcgaggaggagcccagtccagctccggcccgagcgctcgccacgccacgggcgcagagcagcacaaaccatggccgcgctgctcctcgctctcctcctcctcctcctcgccgcctcgcagccgctctccgcggccggcggcgcgcacccgggctactcgtcggccggcgagggcacctgcacggtgggcgccggcgccggcgcggcgccggggggcctgcagctgcgggagcgcggcccggggcgcgtcatcgacatcacgcacgcgtacgtgccggacctgccggcgttcgcgcagggggcggtggcggggcccgtggtgcggctcaagcactccatggcggacggctccgagtccaacctctcggagctgcggatggagtgccacacgggcacccacgtcgacgcgccggggcacatcaaccaggcccacttcgccgccggcctcgacgtcgacacgctcgacctcgacctcctcaacggacctgcattactggttgatgttccgaggaacacaaatataacagctgaagcaatggaattcctgaagatcccaaaagaagttcgccgagttctattcaggacactgaacactgacaggaagctgatgtggaagaaagaaggtgaccttaattatgttggatttacagaggatggtgcccagtggttggttgacaacactgacatcaagctagttggggttgactatctctcagttgcagcatttgatcacttgatctctgcccatgtcgtcttcttcaaaaaaccggacataatcccagtggaaggtctgaaactagacgatgtcccggtgggagtatacaatctccattgcttacctctgaggctggttggagccgagggttcgccggtcagatgcatccttatcaagtgatcgctcccgggtgttgctgaaggacaaactgtatcaaactgcttcatcctggcttggtatctcggtgcatactgagccggaaatgctgcaggccatgtagtcgtatactgaagttgtctggacatttccaaaataaataaagcaacatcaatatttcctaaaaaaaaaaaaaaaaaaaa

SEQ ID NO: 2318 - protein, 274 aa, Panicum virgatum
  misc_feature: Ceres CLONE 1779221
  misc_feature (1)..(201): Pfam Name: Cyclase Pfam Description: Putative cyclase
MAALLLALLLLLLAASQPLSAAGGAHPGYSSAGEGTCTVGAGAGAAPGGLQLRERGPGRVIDITHAYVPDLPAFAQGAVAGPVVRLKHSMADGSESNLSELRMECHTGTHVDAPGHINQAHFAAGLDVDTLDLDLLNGPALLVDVPRNTNITAEAMEFLKIPKEVRRVLFRTLNTDRKLMWKKEGDLNYVGFTEDGAQWLVDNTDIKLVGVDYLSVAAFDHLISAHVVFFKKPDIIPVEGLKLDDVPVGVYNLHCLPLRLVGAEGSPVRCILIK

SEQ ID NO: 2319 - DNA, 840 bp, Panicum virgatum
  misc_feature: Ceres CLONE 1779347
  misc_feature: Encodes the peptide sequence at SEQ ID NO. 2320
accacaccgaacgaaccaggcggcggcagagcggaagcggcggcgagcaaccagcccctctcctccgccgcctccacggatcatggccatggccgcctcctcccggctgctgtgggcgtcccgcgccgccgcctacctcaggatctccaccttccccagggccttctccactgtgctgaaggatctgaagtatgctgatactcatgaatgggtgaaggttgagggtgattcggcaactgtcgggattactgaccatgcccaggatcatttgggtgatgttgtgtatgtggagctgccagaagttggcatcagtgtatcccagggaaagaactttggcgctgttgaaagtgtgaaggcaaccagtgatatcaactcaccagtatctggagagatcgttgaagtgaatgagaaactaggcgaggaacctggattggtgaatgcaagtccatatgaaaagggatggattatcaaggttaagctcagtgattcaggtgagctcaattcactgatggatgacgagaaatactcgaaattctgtgaggaagaagacgaacattgaagaaatagaagtgtcttctgaacatcaaggacctgtgtttcaagctttatcagtgcttttggtctcagaccgtggcaaattggcaaggttcatcgtgtgcaataaattagtttaggtttgcctcatcaagggcctgggaaatccgagttgtaaatgacatgatcgagtatcttttcctctttctagttgtaacgctcgtgagttttcatttaactgtttctgtttcattccttggtatacagaattacagattgtttggtcaaaaaaaaaaaaaaaaaaaa

SEQ ID NO: 2320 - protein, 158 aa, Panicum virgatum
  misc_feature: Ceres CLONE 1779347
  misc_feature (1)..(121): Pfam Name: GCV_H Pfam Description: Glycine cleavage H-protein
MAMAASSRLLWASRAAAYLRISTFPRAFSTVLKDLKYADTHEWVKVEGDSATVGITDHAQDHLGDVVYVELPEVGISVSQGKNFGAVESVKATSDINSPVSGEIVEVNEKLGEEPGLVNASPYEKGWIIKVKLSDSGELNSLMDDEKYSKFCEEEDEH

SEQ ID NO: 2321 - DNA, 601 bp, Panicum virgatum
  misc_feature: Ceres CLONE 1779681
  misc_feature: Encodes the peptide sequence at SEQ ID NO. 2322
ataccaaccatgagcgacctcctctccaacatttccaagatgttgtgcatcaaggcaagatccgaggctacgcaggctggcgaggacgatggctatccggtggacgagtgccgcgtctgcctgtcgaggatccgcgtcggcgaggccacccggggactgccgtgccggcacgttttccaccgggactgcatcgaccgctggttggtgtcctgcaagcggacctgtccgctctgccgggtgttcgtggccgacaagaacaggcatccggtggcggccaagcacaccagccgtgaagcactcaccgacgacctggtgatttggttctccaccgtgctcgtccccggtttctgaggctaagatcgtcttcattttcgattgaagccagtattgttttcattttttttgcgagtactattcaacttatatatacctttgttagactatagaacagctttcaaaatatttctgtatgcacgcaggatatagtttctggtttcattttaattgttggaaacaacctttgtactgggtgctgcatactaaacgagaatgactgaaaataagcagtttgagtaaattaaatgacgtcaaaatttttgcc

SEQ ID NO: 2322 - protein, 113 aa, Panicum virgatum
  misc_feature: Ceres CLONE 1779681
  misc_feature (1)..(42): Pfam Name: zf-C3HC4 Pfam Description: Zinc finger, C3HC4 type (RING finger)
MSDLLSNISKMLCIKARSEATQAGEDDGYPVDECRVCLSRIRVGEATRGLPCRHVFHRDCIDRWLVSCKRTCPLCRVFVADKNRHPVAAKHTSREALTDDLVIWFSTVLVPGF

SEQ ID NO: 2323 - DNA, 893 bp, Panicum virgatum
  misc_feature: Ceres CLONE 1779814
  misc_feature: Encodes the peptide sequence at SEQ ID NO. 2324
aaacgcacctcccccccccaaaaaaatctccaaaaccaaaccaaagcctcactccaccggtctcctcccaaatccgccatgctccagctccagcaccgccgcctcgtcctcctcctcgccgtcgccgccacggccgcggcgggcggcgccgcctcggcgaagcccaccgcctaccaggccctcgcggactacgacttcccgccggggatcctccccaagggcgtggtcgcctacaccctcgacaactccacgggcgccttcacggccacgctcgacgcctccgcgtccggcgcgggcaaatccgtctgcgagttctccatccagggctcctactcgctccgctaccagaccaagataaccggcaagatcaagcccgaccacctctccaacctccagggcgtctccgtcaaggtcctcttcctctggatcaacatcgtcgaggtcacccgccgcggcgacaacctcgagttctccgtcggcatcgcctccgccgacttcgggatcgaaaacttcctcgagtgccccacctgcggctgcgggttcgactgcaacgacctcctcatgctgaaaccgggggtcgccaccgccaagctgcgcctgcgaggtgcgttttagaattccgcttctgcagagacaatgatactgctgctctaagctactactgctgctggcgatgtactccgtatgtcttagactcttattagtagatgcgttaataaagagaggaaatgtgaaaggtcccagcttttagatgtgggatggaatagcaagttcagtactcgatttcatgtttcgccaatgtttcagacagtttaggggcaactgaagaagcaatttaagacctttcaaatatttttattatgagtctacggcaaaaaaaaaaaaaaaaaaaa

SEQ ID NO: 2324 - protein, 178 aa, Panicum virgatum
  misc_feature: Ceres CLONE 1779814
  misc_feature: Great-hit functional homolog of the protein sequence given in SEQ ID NO 9431
  misc_feature: Useful for making plants with altered terpenoid content
MLQLQHRRLVLLLAVAATAAAGGAASAKPTAYQALADYDFPPGILPKGVVAYTLDNSTGAFTATLDASASGAGKSVCEFSIQGSYSLRYQTKITGKIKPDHLSNLQGVSVKVLFLWINIVEVTRRGDNLEFSVGIASADFGIENFLECPTCGCGFDCNDLLMLKPGVATAKLRLRGAF

SEQ ID NO: 2325 - DNA, 1014 bp, Panicum virgatum
  misc_feature: Ceres CLONE 1779817
  misc_feature: Encodes the peptide sequence at SEQ ID NO. 2326
ccgccttcccccactacacccccgcttcatccatctccttccttcttcctcaaagtcgtaacgtcagcagccatggtgaaggcctaccccacggtgagcgaggactacctcaaggcggtcgagaaggccaagcgcaagctccgcggcctcatcgccgagaagaactgcgccccgctcatgctccgcctcgcctggcactccgcaggcaccttcgatgtcgccaccaagaccggggggcccttcggcaccatgaagaaccccgctgagcaggcgcacggagccaacgccggtctcgacatcgccgtcaggctgctcgagcccatcaaggagcagttccccatcctatcctacgctgatttctaccagcttgcaggagtcgtggccgttgaggtcaccggcggccctgaggtcccctttcacccagggaggcaggacaagcctgagcctccaccggaaggccgccttcctgatgccacccaaggttctgaccacctcaggcaggtgttctccacgcagatgggtttgagtgaccaggacattgttgcgctttctggtggtcacaccctgggaagatgccacaaggataggtctggctttgagggagcctggacttccaaccctttgatctttgacaactcttacttcaaggagcttctgagtggtgagaaggaaggccttctgcagctgccaagtgacaaagcactcctctctgacccatccttccgcccgcttgttgagaaatatgcagcggatgaggacgccttctttgctgactatgctgaggcccacctgaagctttctgaattgggatatgctgaggcgtaaggtgcttccagaaaagggcaaaagaagggggctgggggctggttgtggttggagattgttgcctagccgatttatcgttgtgactgtttagcacctaagaccattacgaaccagaagagtgtggtggcggcttggctgtaataaacattcgtgggccatgaggcaggccaaaaaaaaaaaaaaaaaaaa

SEQ ID NO: 2326 - protein, 250 aa, Panicum virgatum
  misc_feature: Ceres CLONE 1779817
  misc_feature (1)..(209): Pfam Name: peroxidase Pfam Description: Peroxidase
  misc_feature (1)..(250): SWISSPROT Homolog: EC 1.11.1.11 L-ascorbate peroxidase 1, cytosolic
  misc_feature (3)..(249): SWISSPROT Homolog: EC 1.11.1.11 L-ascorbate peroxidase 2, cytosolic
MVKAYPTVSEDYLKAVEKAKRKLRGLIAEKNCAPLMLRLAWHSAGTFDVATKTGGPFGTMKNPAEQAHGANAGLDIAVRLLEPIKEQFPILSYADFYQLAGVVAVEVTGGPEVPFHPGRQDKPEPPPEGRLPDATQGSDHLRQVFSTQMGLSDQDIVALSGGHTLGRCHKDRSGFEGAWTSNPLIFDNSYFKELLSGEKEGLLQLPSDKALLSDPSFRPLVEKYAADEDAFFADYAEAHLKLSELGYAEA

SEQ ID NO: 2327 - DNA, 791 bp, Panicum virgatum
  misc_feature: Ceres CLONE 1779838
  misc_feature: Encodes the peptide sequence at SEQ ID NO. 2328
aaaagaactagcagctcgctccgctcgattaagccacgggtaaggatggcggcggcggcggcggcgatactcgagctggatccgtcacacgagcgcgccggccgcgttatcgacaatatcgtgcagctggagaggaggatcttcccgaagcacgagtcgctggcgcgatccatccacgacgagctcaagcgccggaactccggcctgatttacatggcatccaccgtggcgggaggcgacggcgacgaggtcgtcgggtacgccatgtacacctgcccgacctccctctgcgcctccatcaccaagctcgccgtgaaggagagttgtaggcggcagggccacggcgaggcgctgctggcggccgccgtggagcggtgccggcggaggagggtccaacgggtgtccctccacgtggatccggcgaggacggccgcggtggcactgtaccggaaggccgggttccaggtcgacgccaccgtcatgggctactacgcgacgcagagggacgcctaccggatgttcatggatctccagtgatcaggagccgagcaagacaagggcatcactcatcctcgttgtcagagatttgagttcgatcagtggctctgatgctcgttcccaatgccaataaaatgccctgatgaattctgattctgtgaactgtaaatgctttttatccatgattccctagttccaaattgcaaggtctgaaaaaacgatccgttcagttcggaggtttcacaagaaattcacaaaatcctcgcttggtttaaaaaaaaaaaaaaaaaaaa

SEQ ID NO: 2328 - protein, 163 aa, Panicum virgatum
  misc_feature: Ceres CLONE 1779838
  misc_feature (2)..(80): Pfam Name: Acetyltransf_1 Pfam Description: Acetyltransferase (GNAT) family
MAAAAAAILELDPSHERAGRVIDNIVQLERRIFPKHESLARSIHDELKRRNSGLIYMASTVAGGDGDEVVGYAMYTCPTSLCASITKLAVKESCRRQGHGEALLAAAVERCRRRRVQRVSLHVDPARTAAVALYRKAGFQVDATVMGYYATQRDAYRMFMDLQ

SEQ ID NO: 2329 - DNA, 576 bp, Panicum virgatum
  misc_feature: Ceres CLONE 1779866
  misc_feature: Encodes the peptide sequence at SEQ ID NO. 2330
atcaatccaaagaatcccccccaaacgccaccgcctcccctagggttttcgctccgcgagccggatcaggtcgagcccggggtcgggggatccgcgccatggcgtcgcgtccgtcgctgaaggcgaagcccaagggcaagggcgggaggaaggactccgccgcggccgcggccgacggggaggccaccagggcggcgaccgcggtgcggctcgtcaaggagtggaccacgtggacgatgaagacggccaaggtggcggcgcactacggcttcatcccgctcgtcatcgtcatcggcatgaactcggagcccaagccctccatctcccagctcctctcccccgtctgatcgggcctcccccggcagggccccccggatgcggtcggtctcgcctgctctcgtagtagttcatagctggttggttgttttcacatgtgctggatcgagttggtgagggttggcgagtccgtaatgcttctgggagcaggttgagcgtaataatttcttgttggcggatgtgtcttctatagaacggaccaaatccgttaagttggttatatgaatctgctatgctatt

SEQ ID NO: 2330 - protein, 82 aa, Panicum virgatum
  misc_feature: Ceres CLONE 1779866
  misc_feature: Great-hit functional homolog of the protein sequence given in SEQ ID NO 9733
  misc_feature: Useful for making plants with modulated flowering time
  misc_feature: The plant flowers significantly late compared to wild-type.
MASRPSLKAKPKGKGGRKDSAAAAADGEATRAATAVRLVKEWTTWTMKTAKVAAHYGFIPLVIVIGMNSEPKPSISQLLSPV

SEQ ID NO: 2331 - DNA, 469 bp, Panicum virgatum
  misc_feature: Ceres CLONE 1779910
  misc_feature: Encodes the peptide sequence at SEQ ID NO. 2332
accaaccattgttctccaatctctgcccgttcccccaaaaaccagcggcgccaccacaccacccatggctctggcggcggcgagatccggcctccggtcgctggcggcgcgcgccgcgccggcgaggcgccgcatgtcttcctccgtccacgacgacgcctatgagacggccaagtgggagaagatcacctacgccgggatcgtgacctgcaccctcctggcggcgtacaacctctccaagggccacccccacttcgaggagccgccggcgtacccatatctgcacatccgcaacaaggagttcccctggggacctgatggcctgtttgagaagaaggaccaccattaagcatgaatagcagcacaccgtcaggagtcatgcataattatctggttgttccagtgtttttcttttccattgaaacctatttgctgcaacatgaaataagaatgacgaaactcttgtgtg

SEQ ID NO: 2332 - protein, 94 aa, Panicum virgatum
  misc_feature: Ceres CLONE 1779910
  misc_feature (2)..(75): Pfam Name: COX6A Pfam Description: Cytochrome c oxidase subunit VIa
MALAAARSGLRSLAARAAPARRRMSSSVHDDAYETAKWEKITYAGIVTCTLLAAYNLSKGHPHFEEPPAYPYLHIRNKEFPWGPDGLFEKKDHH

SEQ ID NO: 2333 - DNA, 1035 bp, Panicum virgatum
  misc_feature: Ceres CLONE 1779913
  misc_feature: Encodes the peptide sequence at SEQ ID NO. 2334
ctccattctccagcgaccatctcctgctctccacccctctcaatggcggctgctgctacctccctcgctactaccctcgccatcgcgcgaccggcggcggcggcatccgggaagcgggccctcctcgcctccaaggcctcctcgccgctcctatccttcagcagtgcccgcctcccctcacaggccgtttccttctccgggggcctagcgccttcgccctcccacagccgcgcgcgcttcgtcacatccgccagcgccgaacccaaggaagcagatattcagtcaaaaatcacaaacaaagtgtactttgacataagcatcgggaatcctgtggggaagaatgttgggaggattgtcatcggcttgtatggagatgatgttccccaaacagcagagaacttccgtgctctttgcactggagagaaagggttcggatacaagggatccagtttccaccgtgtcatcagggatttcatgattcaggggggagattttgacaagggcaatggtactggcgggaaaagcatatatggacgaaccttcaaagatgagaacttcaaattggttcacactggacctggagcggttagtatggctaatgctggaccaaacaccaatggcagccagtttttcatctgcactgtcaagacaccttggttggacgggaggcacgtcgtgtttggccaggttctagaaggcatggatgtcgtgaagctgatcgaatcgcaggagactgacagaggtgaccgtccgaagaagaaagtagtcatcagcgattgcggggagcttccggtggtctaagttttacatgtcttaccacagacaagaagttgataccactcaccccacttgagttgacatgagaatatcatgatacttatcgtgttatctcccactagttatagagattattttgagttaaagccaaggtcacaaatctgaggcatactgttgcttttcggctaaaataaatgtgctagctttccttgccctgtctgggggaaggcttttgttcaaaaaaaaaaaaaaaaaaaa

SEQ ID NO: 2334 - protein, 252 aa, Panicum virgatum
  misc_feature: Ceres CLONE 1779913
  misc_feature (1)..(164): Pfam Name: Pro_isomerase Pfam Description: Cyclophilin type peptidyl- prolyl cis-trans isomerase/CLD
  misc_feature (28)..(251): SWISSPROT Homolog: EC 5.2.1.8 Peptidyl-prolyl cis-trans isomerase CYP20-2, chloroplast precursor
  misc_feature (33)..(251): SWISSPROT Homolog: EC 5.2.1.8 Peptidyl-prolyl cis-trans isomerase CYP20-3, chloroplast precursor
MAAAATSLATTLAIARPAAAASGKRALLASKASSPLLSFSSARLPSQAVSFSGGLAPSPSHSRARFVTSASAEPKEADIQSKITNKVYFDISIGNPVGKNVGRIVIGLYGDDVPQTAENFRALCTGEKGFGYKGSSFHRVIRDFMIQGGDFDKGNGTGGKSIYGRTFKDENFKLVHTGPGAVSMANAGPNTNGSQFFICTVKTPWLDGRHVVFGQVLEGMDVVKLIESQETDRGDRPKKKVVISDCGELPVV

SEQ ID NO: 2335 - DNA, 870 bp, Panicum virgatum
  misc_feature: Ceres CLONE 1779919
  misc_feature: Encodes the peptide sequence at SEQ ID NO. 2336
aacaacccgccgcgccgcctccccagaacccccagccatggcgtcggccgccgccgccgcccccggcgtgcgcgtggtcggcgggtgggcgagcccgttcgtgatgcgcgtgtgcgtcgcgctcaggctcaagggcgtcgcctacgagttcctgcaggaggagctgggcaagaagagcggcctgctcctcgcgtccaaccccgtgcacaagaagatgcccgtgctcctccacggcggccgccccgtctgcgagtccctcatcatcgtgcagtacgtcgacgaggccttcgccgccgccgggccgcggatcctccccaccgacccctacgaccgcgccgtccaccgcttctgggccgagtacgccgacaccaagctcccggcggcgctccggacactgaggggcatgatcgacggcgacaaggccgaggcggcggagcaggtggcctcggctctcgggcagctcgaggaggccttcgcggcgtgcagcaaggggcggcgcttcttcgccggcgacgacgtcgggttcttggacatcgtcctcgggtcgtacgtcgggtggttccgggcggcggagcagatcaccgggcagccggtcctcgacgaggccaggacgccgcggctggcggcgtgggcgccgcggttctgcgcccacgaggccgtcagggacgtgatgcccgacgccggcagcctcgtcgagttcggcgaggcgctccgcgcggggctggcggtcagtgcttcacggccgtaacggcgacgcggcgaggccttcgccgggaacgttttgctgcttttatttccagccttggttgccatgccaattgacatctccgaataaagggctatttgaatcaaaaaaaaaaaaaaaaaaaa

SEQ ID NO: 2336 - protein, 236 aa, Panicum virgatum
  misc_feature: Ceres CLONE 1779919
  misc_feature (1)..(74): Pfam Name: GST_N Pfam Description: Glutathione S-transferase, N-terminal domain
  misc_feature (1)..(102): Pfam Name: GST_C Pfam Description: Glutathione S-transferase, C-terminal domain
MASAAAAAPGVRVVGGWASPFVMRVCVALRLKGVAYEFLQEELGKKSGLLLASNPVHKKMPVLLHGGRPVCESLIIVQYVDEAFAAAGPRILPTDPYDRAVHRFWAEYADTKLPAALRTLRGMIDGDKAEAAEQVASALGQLEEAFAACSKGRRFFAGDDVGFLDIVLGSYVGWFRAAEQITGQPVLDEARTPRLAAWAPRFCAHEAVRDVMPDAGSLVEFGEALRAGLAVSASRP

SEQ ID NO: 2337 - DNA, 627 bp, Panicum virgatum
  misc_feature: Ceres CLONE 1779930
  misc_feature: Encodes the peptide sequence at SEQ ID NO. 2338
aagactagtcaaaacaagtgcgctgttcgtcatcccccgtctccgtacgctccgcatcccgacctcaccggcggcgggaacacgatggtggcgttgctgggccggcggatcggggtggcggcggtggccgccgcgttcatcgccctcgcggcgttcggatccgcctcgccctcccccaagtccttcgtgaaatccaccgtcgccgcccacgacgtcgtcatcttctccaagtcatactgcccgtattgtagaaaagcaaaggccatatttaaggagcttcagttaaagaaagagccctatgttgtggagcttgatcgtcgagaggatggttcggagatccaggatgccttatctgagatagttggccggcgtactgttcctcaagtttttgtccatggaaagcatctggggggctctgatgatactgttgaggcttacgaaagtggaaagttggccaaactcttgaatatcggagtcaaggacgatctttaagaaacatgttagcatcacaagtttatctcttgtttttgagttatgaggcgatattatgcgactctgaatttacattatacagaatatgtaactgaatattgcggcataattcataacatctgaaccctacttttg

SEQ ID NO: 2338 - protein, 135 aa, Panicum virgatum
  misc_feature: Ceres CLONE 1779930
  misc_feature (1)..(65): Pfam Name: Glutaredoxin Pfam Description: Glutaredoxin
MVALLGRRIGVAAVAAAFIALAAFGSASPSPKSFVKSTVAAHDVVIFSKSYCPYCRKAKAIFKELQLKKEPYVVELDRREDGSEIQDALSEIVGRRTVPQVFVHGKHLGGSDDTVEAYESGKLAKLLNIGVKDDL

SEQ ID NO: 2339 - DNA, 945 bp, Panicum virgatum
  misc_feature: Ceres CLONE 1779991
  misc_feature: Encodes the peptide sequence at SEQ ID NO. 2340
tctctgctctcctccactccctcctgctcctgtataaatagcattagcaaccaagcaattccatcaccccacatcgttggtagatcttgcagcgttgggtctcacagtcccagacccaattaagaagctagcagagcaactgagcaagcgatggcgccgccgaaggtgtacggatgggcgatctcgccgttcgtgtcgcgcgcgctgctggcgctcgaggaggccggcgttgactacgagctcgtccccatgagcccccaggacggcgaccaccgccgcccggagcacctcgccagaaacccttttggtcaggtgcccgttattgaggacggcgacctcacggtcttcgagtcccgggcgatcgcgaggcacgtcttccgcaagcacaagccggagttcctaggcgccggcagcctggagcggtcggcgatggtggacgtgtggctggaggtggaggcgcaccagctgcacccggcggcgaacggcgtcgtggtggagtgcttcggcgcgccgttcctcggccgcccccgcaaccaggcggccgtcgacgagaacctcgggaagctgcggaaggtgctggaggtgtacgaggcgcggctggcgcagagcaagtacctcgccggcgacttcctcagcgtcgccgacctcagccacttcaccatcatgcactacttcatggccaccgagtacgcggcggtcgtggaggcgctcccgcacgtgagggcgtggtgggaggagctcgccgcgcggccggcggcgaggaaggtggccgggttcatgccggtcggcgctgggccggccaagaaagacgagtgatcgataaagctgtagtgttgtgttgtgcttaatttcccgttgagcggttttctacttctatccttgtaataatgagctgctttcagcgttcataataaataattcacagaaaaaaaaaaaaaaaaaaaa

SEQ ID NO: 2340 - protein, 221 aa, Panicum virgatum
  misc_feature: Ceres CLONE 1779991
  misc_feature (1)..(96): Pfam Name: GST_C Pfam Description: Glutathione S-transferase, C-terminal domain
  misc_feature (4)..(76): Pfam Name: GST_N Pfam Description: Glutathione S-transferase, N-terminal domain
  misc_feature (1)..(214): SWISSPROT Homolog: EC 2.5.1.18 Glutathione S-transferase I
  misc_feature (1)..(221): SWISSPROT Homolog: EC 2.5.1.18 Glutathione S-transferase IV
MAPPKVYGWAISPFVSRALLALEEAGVDYELVPMSPQDGDHRRPEHLARNPFGQVPVIEDGDLTVFESRAIARHVFRKHKPEFLGAGSLERSAMVDVWLEVEAHQLHPAANGVVVECFGAPFLGRPRNQAAVDENLGKLRKVLEVYEARLAQSKYLAGDFLSVADLSHFTIMHYFMATEYAAVVEALPHVRAWWEELAARPAARKVAGFMPVGAGPAKKDE

SEQ ID NO: 2341 - DNA, 899 bp, Panicum virgatum
  misc_feature: Ceres CLONE 1780003
  misc_feature: Encodes the peptide sequence at SEQ ID NO. 2342
accatccagctaggtgcgccagcattctcctaagtcctctgtgcaagcgtccctctctgggtttttcacacacacagtcgccatggcatccaaggccttcctcctcgttgccctcaacctcctcctctttgcggtggccaacgcctgcggcggcggctgcccgacgccgacaccaccaacgccgacgccgccgacgccaacgccgccctcaccgtcaccatcgggcaaaggcaagtgccccaagaacgcgctcaagctcgcggtgtgcgccaacgtggccggcctcgtgaaagccaaggtggggaagccgccggccgagccgtgctgcagcctcctcggcggcctcgccgacctcgaggccgccgcctgcctctgcaccgccatcaaggccaacgtgctcggcatcaccctcgacatccctgtcaagctcagcctcattgtcaactactgtggcaagaacctccccagcggcttcatatgcgcttgatattagctacgtgattacgtgcttgcattgcctgcaacgcgcgcgcacgcatgaatacacagccagttgttcattcgtgagtgcatgctgcatgcgtccgatttgttttctccgacttttgttttgtgtgctttctttgtccgtcaggtggttctgaatgtagaaccacggacggatcaacaatgatgtgtgtgcatcgagagtgtttgattgtgtttaccttttacttcttttccattcttccctctaaacgtatgtgtatggtgatttcttctccaaggtccaagctaggaaatgcactgttttgggtttgtgtggtgtttatctcattgttgtaattgcttgtagtggattccaaggattgtatgtaccgcaagcacaagtttatttgtaaaaaaaaaaaaaaaaaaaa

SEQ ID NO: 2342 - protein, 134 aa, Panicum virgatum
  misc_feature: Ceres CLONE 1780003
  misc_feature (1)..(82): Pfam Name: Tryp_alpha_amyl Pfam Description: Protease inhibitor/seed storage/LTP family
MASKAFLLVALNLLLFAVANACGGGCPTPTPPTPTPPTPTPPSPSPSGKGKCPKNALKLAVCANVAGLVKAKVGKPPAEPCCSLLGGLADLEAAACLCTAIKANVLGITLDIPVKLSLIVNYCGKNLPSGFICA

SEQ ID NO: 2343 - DNA, 911 bp, Panicum virgatum
  misc_feature: Ceres CLONE 1780036
  misc_feature: Encodes the peptide sequence at SEQ ID NO. 2344
gtgtgtcttgtatcatccagctgagctaagctgagcagaacaagctcgctctggcgctctgctctagtattttacctaccaaacctcctcactccctccctcccttggtcactctcaattccgatccgtcgctccgcctcctgctgctgaccacccccggcccatcgaatcgcacaattccatccatggataatcaccggcggcagagcagcaccagcagcagcagcaccaccaccactaataataataagaagacggctgagctggaccctgtgctgcactcgatcgggttcgagatcgaggaggtgtcgccggcgcagctgacgggccgcctccccgtcacggccaggtgctgccagcccttcaaggtgctccacggcggcgtctccgccctcgtcgccgagggcctggccagcatgggcgcccacatggcctcgggctaccgccgcgtcgccggagtcagcctcagcatcaaccacttccgcagcgccgccgtgggggacgtcgtcctcgcccgcgccgccccgatccacgtcggccgctcaacccaggtgtggaaggtgaagctgtggaaggaggagccatcggcaccagggaacaagggtcctcagatctccgagtcgagggtgacgctgctctgcaacctacccgtgccagagagcctcaagaacgccggcgacgcgctcaagaagtacgccgcccccgccaccaccagcagattgtagataataattaattaagcttacacaccatgtttgctctgctctctatctgcctgccttccatgtccatccatcttcttcaataattgtagctagctattattgttgtccggccggcgaacgatccaattcagttacctcctcttatttcttagtataatttgttattaaaaaaaaaaaaaaaaaaaa

SEQ ID NO: 2344 - protein, 179 aa, Panicum virgatum
  misc_feature: Ceres CLONE 1780036
  misc_feature: Great-hit functional homolog of the protein sequence given in SEQ ID NO 9579
  misc_feature (1)..(75): Pfam Name: 4HBT Pfam Description: Thioesterase superfamily
  misc_feature: Useful for making plants with modulated biomass
  misc_feature: The plant is abnormally small.
  misc_feature: The rosette leaves do not appear in the normal fashion, i.e., their phyllotaxy may be abnormal or too many leaves may be emerging in comparison to the control.
MDNHRRQSSTSSSSTTTTNNNKKTAELDPVLHSIGFEIEEVSPAQLTGRLPVTARCCQPFKVLHGGVSALVAEGLASMGAHMASGYRRVAGVSLSINHFRSAAVGDVVLARAAPIHVGRSTQVWKVKLWKEEPSAPGNKGPQISESRVTLLCNLPVPESLKNAGDALKKYAAPATTSRL

SEQ ID NO: 2345 - DNA, 1109 bp, Panicum virgatum
  misc_feature: Ceres CLONE 1780099
  misc_feature: Encodes the peptide sequence at SEQ ID NO. 2346
atattcagaggcgcaacgcacacaagcaaggcggctagtggtgcaagtacagccacccagtgcgaagctcgctggtgcatgcggcaatggcggcttcgcttgggctaaaccctgaagctctcttcagctcctactcgtcgtcctactcctcgcccttcatgtccggctacgcgccgcagagcttcccggcggccaataacaccttcgtcgacgacgcggcggtcttctcctcagagctcgatgatctttgccagcttgagtactcgccggcatcgctcatcgacggcgccggagccggggctgggggcgatcgcaacgagaagtcgatgtggtgtgggggtcgagatgagaagagacctaggagcagtggaaggattgggttcaggacgagatcagaggtggagatcctggacaacggattcaaatggaggaagtacggaaagaaagctgtcaagaacagccccaatccacggaactactaccggtgctcgtcggagggctgcggcgtgaagaagcgcgtggagagggaccgcgacgacccccgctacgtcatcaccacctacgacggcgtccacaaccacgccagccccggcgccgccgccatcatccagtacggcgggggcggcttctacagcccgcagcacagcggctcgccgtcggccgcctcctactcgggctcctacctcttctgacttccgagcgggtcattcttcccagaacgtgcctcgatcagcagcgagcacgtgttgctacatcgagaccgaggaattctgagccttgacccggtggttcaccccaagtaggatgagaaacgatagcggccggctagattccgatctgcttgtggaattttacagttgtgcagtagcagtaataattaagctagaagtactttaatcacatcatcaattagttacctcttcttatgacgcatcaatcatcactaggataactgatgacagcatgcttgttacttgccctctttctttcttctgttttagtttctttttttttggcagtctgttttagtttctttatgtacacgctctttaatctatacgcggttgctaaaaggctgctgatttaattaaaaaaaaaaaaaaaaaaaa

SEQ ID NO: 2346 - protein, 201 aa, Panicum virgatum
  misc_feature: Ceres CLONE 1780099
  misc_feature: The sequence is a functional homolog of  SEQ ID NO 130 in the  10/714,887 US patent application
  misc_feature: The sequence is a functional homolog of  SEQ ID NO 130 in the  11/435,388 US patent application
  misc_feature: The sequence is a functional homolog of  SEQ ID NO 134 in the  10/714,887 US patent application
  misc_feature: The sequence is a functional homolog of  SEQ ID NO 134 in the  11/435,388 US patent application
  misc_feature: The sequence is a functional homolog of  SEQ ID NO 146 in the  10/714,887 US patent application
  misc_feature: The sequence is a functional homolog of  SEQ ID NO 146 in the  11/435,388 US patent application
  misc_feature: The sequence is a functional homolog of  SEQ ID NO 148 in the  10/714,887 US patent application
  misc_feature: The sequence is a functional homolog of  SEQ ID NO 148 in the  11/435,388 US patent application
  misc_feature: The sequence is a functional homolog of  SEQ ID NO 152 in the  10/714,887 US patent application
  misc_feature: The sequence is a functional homolog of  SEQ ID NO 152 in the  11/435,388 US patent application
  misc_feature: The sequence is a functional homolog of  SEQ ID NO 1533 in the  10/374,780 US patent application
  misc_feature: The sequence is a functional homolog of  SEQ ID NO 1535 in the  10/374,780 US patent application
  misc_feature: The sequence is a functional homolog of  SEQ ID NO 1617 in the  10/412,699 US patent application
  misc_feature: The sequence is a functional homolog of  SEQ ID NO 1619 in the  10/412,699 US patent application
  misc_feature: The sequence is a functional homolog of  SEQ ID NO 1640 in the  11/479,226 US patent application
  misc_feature: The sequence is a functional homolog of  SEQ ID NO 2 in the  10/225,066 US patent application
  misc_feature: The sequence is a functional homolog of  SEQ ID NO 202 in the  10/714,887 US patent application
  misc_feature: The sequence is a functional homolog of  SEQ ID NO 202 in the  11/435,388 US patent application
  misc_feature: The sequence is a functional homolog of  SEQ ID NO 204 in the  10/714,887 US patent application
  misc_feature: The sequence is a functional homolog of  SEQ ID NO 204 in the  11/435,388 US patent application
  misc_feature: The sequence is a functional homolog of  SEQ ID NO 206 in the  10/714,887 US patent application
  misc_feature: The sequence is a functional homolog of  SEQ ID NO 206 in the  11/435,388 US patent application
  misc_feature: The sequence is a functional homolog of  SEQ ID NO 210 in the  10/714,887 US patent application
  misc_feature: The sequence is a functional homolog of  SEQ ID NO 210 in the  11/435,388 US patent application
  misc_feature: The sequence is a functional homolog of  SEQ ID NO 254 in the  10/374,780 US patent application
  misc_feature: The sequence is a functional homolog of  SEQ ID NO 30 in the  10/714,887 US patent application
  misc_feature: The sequence is a functional homolog of  SEQ ID NO 30 in the  11/435,388 US patent application
  misc_feature: The sequence is a functional homolog of  SEQ ID NO 808 in the  10/412,699 US patent application
  misc_feature: Useful for making plants with modulated growth and phenotype characteristics
MAASLGLNPEALFSSYSSSYSSPFMSGYAPQSFPAANNTFVDDAAVFSSELDDLCQLEYSPASLIDGAGAGAGGDRNEKSMWCGGRDEKRPRSSGRIGFRTRSEVEILDNGFKWRKYGKKAVKNSPNPRNYYRCSSEGCGVKKRVERDRDDPRYVITTYDGVHNHASPGAAAIIQYGGGGFYSPQHSGSPSAASYSGSYLF

SEQ ID NO: 2347 - DNA, 844 bp, Panicum virgatum
  misc_feature: Ceres CLONE 1780164
  misc_feature: Encodes the peptide sequence at SEQ ID NO. 2348
ataaacacacagagatcaataaccaagcaatcagcagttctcaccgccaaatccaagaactcaggaggcatctgtctcctctgctctcgcgttagcgaagccaacacccagcagagaagcataatggcggcaagagcaggagcggtggcggtggcgtgcctcgtggccgccgtggcggcggcgctgctggcctcgccggcgtcggcgcagtccgggtcgtgcacgaccacgctgatcagcctgtacccgtgcctgaactacatcagcggcaacgtgtcgacgccgccgtcctcgtgctgctcgcagctcgccagcgtcgtgcagtccaagccgcagtgcctctgcgccgcgctcagcggcgactcgtcgtccctcggcgtcaccatcgacaagaagcgcgcgctcgagctccccaaggcctgcaacgtcgataccccgccggcgagcaagtgcaactctgccggcagcggcaacgcaccgggcgccgcgacaccgaccacgccgtcggccggcgagccagcgaccgcaggggccagcggcggatcgaaggcgacgccgacggcgccctacctgacatctggcgccggcgcgtcgatccggggggcggtgagcctggcgctcgcattcgcagctgtcgccgtctacgcggccttagcgaccgtgtgagcatctcggcgttcggagattcacagccgttcatgatgtgtttgtgtcattgttgtagcgtgagttggttgatcatggcattgagttttgggcatcacagctgtaatattattggttgtatctggttattaccacagtaaaaaatattgttcgtggcgaaaaaaaaaaaaaaaaaaaa

SEQ ID NO: 2348 - protein, 180 aa, Panicum virgatum
  misc_feature: Ceres CLONE 1780164
  misc_feature (1)..(80): Pfam Name: Tryp_alpha_amyl Pfam Description: Protease inhibitor/seed storage/LTP family
MAARAGAVAVACLVAAVAAALLASPASAQSGSCTTTLISLYPCLNYISGNVSTPPSSCCSQLASVVQSKPQCLCAALSGDSSSLGVTIDKKRALELPKACNVDTPPASKCNSAGSGNAPGAATPTTPSAGEPATAGASGGSKATPTAPYLTSGAGASIRGAVSLALAFAAVAVYAALATV

SEQ ID NO: 2349 - DNA, 644 bp, Panicum virgatum
  misc_feature: Ceres CLONE 1780183
  misc_feature: Encodes the peptide sequence at SEQ ID NO. 2350
acacccaagaagccgatcatctctcccctgacaagttcgcagagaaacatatctgatcttgcttcgttgacgagccatggccgaggagaagcaccaccacctgttccaccaccgcaaggaggaggagagctccggcgaggtcaactacgagaaggaggagaagcaccacaagcacctggagctcggcgccatggccgccggcgcctacactctgcacgagaagcacaaggccaagaaggaccccgagaacgagcacggccaccggatcaaggaggaggtggccgccgtcgccgccgtgggcgccgctgggttcgccttccacgagcaccacgagaagaaggacgccaagaagcacggcgacaactgaacgcgcgcgcgtgtttatttgcctgaagcatccatctatttgcttgatttttcttttctctttcaactcgtgtgcgctaggtcttgatttggactgatttatctgcacctaggatgaattcgatccggatcctcggtgttcctgaatcaagtgcaaaatcaggcctcgaataataaccgtgtggtgctgtctgcgtttgtgtaccgtgtactggatcatctttgtatttttcttaacgagacgtctcgagaataatatggatttattacatgtttct

SEQ ID NO: 2350 - protein, 96 aa, Panicum virgatum
  misc_feature: Ceres CLONE 1780183
  misc_feature (1)..(54): Pfam Name: ABA_WDS Pfam Description: ABA/WDS induced protein
MAEEKHHHLFHHRKEEESSGEVNYEKEEKHHKHLELGAMAAGAYTLHEKHKAKKDPENEHGHRIKEEVAAVAAVGAAGFAFHEHHEKKDAKKHGDN

SEQ ID NO: 2351 - DNA, 533 bp, Panicum virgatum
  misc_feature: Ceres CLONE 1780222
  misc_feature: Encodes the peptide sequence at SEQ ID NO. 2352
gcaccatccgatccgaatcctactactactacgactaccacaccagctgacttccgagaggcatcatgaagcagccggcgcatcatctgctgctcgccgccttcgcggtggtcctgctgctgtgcgcgggggtcgtcgccgacgcggcgacgtgcgacgcgacgcagctgaccccgtgcgcgggcgccatcatcgggaacgcgccgcccacctcggcgtgctgcagcaggttgaaggagcagcagccgtgcctgtgcacgtacgcgcgcgaccccaacctgcagcgctacgtcaactcgcccaacggcaagaaggccatggccgcgtgcaggctgcccgtgccgtcctgctaattggttaacttcttcgattcgcgtcggcaccgcgcgcgtgcggccggccggccgctaccttgttcccgacgtcttgatctccgttgtgttgtgctggtctccgctgcttcctgtatctgccgtgccgagctagctcctcgggctcttcgcgtgtatgaataaaggatgtaataattacgc

SEQ ID NO: 2352 - protein, 95 aa, Panicum virgatum
  misc_feature: Ceres CLONE 1780222
  misc_feature (1)..(66): Pfam Name: Tryp_alpha_amyl Pfam Description: Protease inhibitor/seed storage/LTP family
MKQPAHHLLLAAFAVVLLLCAGVVADAATCDATQLTPCAGAIIGNAPPTSACCSRLKEQQPCLCTYARDPNLQRYVNSPNGKKAMAACRLPVPSC

SEQ ID NO: 2353 - DNA, 689 bp, Panicum virgatum
  misc_feature: Ceres CLONE 1780275
  misc_feature: Encodes the peptide sequence at SEQ ID NO. 2354
ctagctaaatagcttcgagactccagtgagatggctccggttggccttctgctcgtcggtgtcgtgaccgcggtggcggggctgcttctcgaggcggcggcgccggcgagtgccgcgctgccgcgggtggagcaccggcccaaggcaggcgggacgctcgccgtcctcgccgtcggcgactggggccggcgtgggcagttcaaccagaccttggtcgcccagcagatgggagtggtggggcagaagatggacatcgacttcgtcatctccaccggcgacaacatctacgacgacggcatcgccaacaccagcgacccgctcttcaaggagtccttctccaacatctacaccgccaagagcctccagaagccttggtacctcgtccttggcaaccatgactacactggcaacccgctcgcgcagctggaccccgccattcgcaacgtggacaacaggtacaccgccattgcaaagtcgttcatcgtcaactcaggaattgcggatttcttcctcatcgacacgacgccattcatcctccattactggaacaagaccaagtttgattggagaggggttgctcctcgcgacacctacattttggacggatgaagtatatataagagaaaatctcatattccatggaataaaggttacttttgtttcgattgcaaaaaaaaaaaaaaaaaaaa

SEQ ID NO: 2354 - protein, 192 aa, Panicum virgatum
  misc_feature: Ceres CLONE 1780275
  misc_feature (1)..(149): Pfam Name: Metallophos Pfam Description: Calcineurin-like phosphoesterase
MAPVGLLLVGVVTAVAGLLLEAAAPASAALPRVEHRPKAGGTLAVLAVGDWGRRGQFNQTLVAQQMGVVGQKMDIDFVISTGDNIYDDGIANTSDPLFKESFSNIYTAKSLQKPWYLVLGNHDYTGNPLAQLDPAIRNVDNRYTAIAKSFIVNSGIADFFLIDTTPFILHYWNKTKFDWRGVAPRDTYILDG

SEQ ID NO: 2355 - DNA, 1052 bp, Panicum virgatum
  misc_feature: Ceres CLONE 1780314
  misc_feature: Encodes the peptide sequence at SEQ ID NO. 2356
aacgggctcgccgcggggccacaaaggacacgagacgagctgcacaaatcgctcgcttgctaggggcgcccaaacccgggcgctcctgcaaacctgtcgctaccgagccacatggctgcggcgggcgccgcctgcgcctcaccccacagctccctgctgctctcgcgctcccgtccccacgggctttcgccggcgagctacatgccgcggcgactcatcctcggcgtcggcacctcggccgtcgcggcgctggcggtggccacggcgccgccggcggtgctgcaggacggggcggccacgctgttcgccaccgccggcgcctacgccctcgtgcgcaccttcgacgtgctcaccgagcggcggctcgtcgagaagagtttgagcaggaaaattgtgcacgtcctatccggcgttctgttcatggcatcctggccactcttcagtaattcgacagaggcacgatatttcgctgcggttgttccgttcttgaactccttgaggcttctgatttacggactacgcctttacacagatgaggctcttgtaaaatcagtgtcacgtgaaggaaaaccagaggaattgctgagaggtcccctctattatgtcttggtgctactcttcagtgttttagtcttctggcgcgagtccccaatcggggttgtttccttgtcgatgatgagcggtggtgatggttttgctgacattgtcgggagaaggtatggctcagtgaagctgccattcaatcagaagaagagctggatcgggagcatctcgatgttcatttctggtttcctgctatcctcgataatgctgttctacttctccagccttggttacattcatgttagctgggaggaggcatttagtaagctggctcttgttgcgttggcagcaaccgtggtggagtgtattcctgcaactgatgttgttgatgacaatatatctgttcctttggcctccatgttggtagctttactcttgtttggctccaacacacaatgattaatccataataataagagtacattattcaaaaaaaaaaaaaaaaaaaa

SEQ ID NO: 2356 - protein, 296 aa, Panicum virgatum
  misc_feature: Ceres CLONE 1780314
  misc_feature (1)..(204): Pfam Name: CTP_transf_1 Pfam Description: Cytidylyltransferase family
MAAAGAACASPHSSLLLSRSRPHGLSPASYMPRRLILGVGTSAVAALAVATAPPAVLQDGAATLFATAGAYALVRTFDVLTERRLVEKSLSRKIVHVLSGVLFMASWPLFSNSTEARYFAAVVPFLNSLRLLIYGLRLYTDEALVKSVSREGKPEELLRGPLYYVLVLLFSVLVFWRESPIGVVSLSMMSGGDGFADIVGRRYGSVKLPFNQKKSWIGSISMFISGFLLSSIMLFYFSSLGYIHVSWEEAFSKLALVALAATVVECIPATDVVDDNISVPLASMLVALLLFGSNTQ

SEQ ID NO: 2357 - DNA, 521 bp, Panicum virgatum
  misc_feature: Ceres CLONE 1780322
  misc_feature: Encodes the peptide sequence at SEQ ID NO. 2358
ctcatcacaagcgaagcagagcacacaggaagcactccaccttcttcagccgcgctacctgctttccttcctgcttgctcgtgatcaccgagatcaggatgtctggttgcagcggcggcaactgcgggtgcggctccgcctgcaactgcggcggcggatgcaacggctgcaagatgttcccaccgagagcggcggctgcgactgcaacacctgcaagtgcggcaccagctgcggctgctcctgctgcagctgcaactgaggcggccatgcgccgccgccatggaagcacgaggagaaagccccccggcgtagtatataggagcagcgtctaaataagatcttgccaactgcgccatccatcatctaccgtgtcgtgtcgtgacatccatggtcgcctgccgtgtctcagctggggttgttgtctgaacgtctctggtgatcgacgacgcatgccggtcgtcgatctttagcttgtgtgtccgtcctcctcgtgcacgccacctttaatatatgtatttcag

SEQ ID NO: 2358 - protein, 77 aa, Panicum virgatum
  misc_feature: Ceres CLONE 1780322
  misc_feature (3)..(62): Pfam Name: Metallothio_2 Pfam Description: Metallothionein
MSGCSGGNCGCGSACNCGGGCNGCKMFPPRAAAATATPASAAPAAAAPAAAATEAAMRRRHGSTRRKPPGVVYRSSV

SEQ ID NO: 2359 - DNA, 1063 bp, Panicum virgatum
  misc_feature: Ceres CLONE 1780330
  misc_feature: Encodes the peptide sequence at SEQ ID NO. 2360
acacaggaaaaagcctcgccgctctcgcatcgttccagaactcagatcaggatgacgggctccatggatctcccagcgaagggcgggttcagcttcgacctgtgccgacggaacgactttctggagaagaaggggctcaaagtccccggtttcaggaagaccgggactaccatcgtcggcctcgtcttccaggatggggttgttcttggggcagacacaagggcaactgagggtcctatagttgctgacaagaattgtgagaaaatccactttatggcaccaaacatctattgctgtggagcaggaacagctgctgacacagaggctgttacagatatggtgagctcccagctacagcttcaccgatatgcaaccggtcgtgaatcaagagtcgtgactgctcttacactgctgaagtcacaccttttcaagtatcaaggtcatgtcagtgctgctcttgttcttggtggagtggattgtactggaccacatctacacactgtttatccgcatggatccacagatactcttccttttgccacgatgggttctggatcgcttgctgcaatgtcggtgtttgagtcgaagtacaaagaaggacttacaagggaggaggggatacaacttgtggccgatgccatccgtgctggtatcttcaatgacttgggtagtggcagcaatgtggatgtctgtgtgataaccaaggggaagacagaatacttgagaaactatgagttaccgaatccaagaacttatgttagctcaaagggatacagcttcaccaaggggcagactgaggtactgtccgcaaagatcataccactgaagcagaaggttgaggttgctgagggtggtgatgcaatggaggagtgatcacgcatgcgtgcattcggacggtcatattcagaatttatgtaatatttcttagtggggctgctggaacaagaaaagaatggatgtctttgttgtactttctggactgaatccagacttttgctgaaggtgtttctaatgttgaacattatttagtgattgttggctccaaaaaaaaaaaaaaaaaaaa

SEQ ID NO: 2360 - protein, 273 aa, Panicum virgatum
  misc_feature: Ceres CLONE 1780330
  misc_feature (4)..(273): SWISSPROT Homolog: EC 3.4.25.1 Proteasome subunit beta type 7-A precursor
  misc_feature (4)..(273): SWISSPROT Homolog: EC 3.4.25.1 Proteasome subunit beta type 7-B precursor
MTGSMDLPAKGGFSFDLCRRNDFLEKKGLKVPGFRKTGTTIVGLVFQDGVVLGADTRATEGPIVADKNCEKIHFMAPNIYCCGAGTAADTEAVTDMVSSQLQLHRYATGRESRVVTALTLLKSHLFKYQGHVSAALVLGGVDCTGPHLHTVYPHGSTDTLPFATMGSGSLAAMSVFESKYKEGLTREEGIQLVADAIRAGIFNDLGSGSNVDVCVITKGKTEYLRNYELPNPRTYVSSKGYSFTKGQTEVLSAKIIPLKQKVEVAEGGDAMEE

SEQ ID NO: 2361 - DNA, 560 bp, Panicum virgatum
  misc_feature: Ceres CLONE 1780336
  misc_feature: Encodes the peptide sequence at SEQ ID NO. 2362
aacaatgtccaccgccgcggacgacgacgccgactaccacagctccggcggatccgtcatgcccgacgtcctcgccaagggccgcgaggcctgctacaaggcgcgggatgccttctacgcgtgcgtggagaagcacgcggacaagaagcccgccgagatcgccaccatggggctcctctatcccgccgactgcaagaagtcccgcgccaacttcgtcagcaactgccgccccacctgggtgaagcacttcgaccggcagtactgcgccaagaagcgggtgcagaggctgctcgacggcgacgaggaccgccggggccccatctcgcttccccagccctacaccttcaagcaataggtagccctcctgggtttctgtttttggtattgagctgaattggatcagtactactttggtatccggatgcaatagtgttggttccaggcttgatatcgtttagatgtgatgcatatgtgatgtgtagcagtacattgctcccgatgctaaaggatgaacaaatttgtatgtgaatttttaaatattaagatatcccctatttcac

SEQ ID NO: 2362 - protein, 116 aa, Panicum virgatum
  misc_feature: Ceres CLONE 1780336
  misc_feature: Great-hit functional homolog of the protein sequence given in SEQ ID NO 9652
  misc_feature: Useful for making plants with modulated nitrogen use efficiency
MSTAADDDADYHSSGGSVMPDVLAKGREACYKARDAFYACVEKHADKKPAEIATMGLLYPADCKKSRANFVSNCRPTWVKHFDRQYCAKKRVQRLLDGDEDRRGPISLPQPYTFKQ

SEQ ID NO: 2363 - DNA, 513 bp, Panicum virgatum
  misc_feature: Ceres CLONE 1780355
  misc_feature: Encodes the peptide sequence at SEQ ID NO. 2364
gctgctcggtcaggtcagcctccccccatcacagcctctcgcagatccccaccctctccgccgccagccaccgcgtcgcgaccctcgaccgccaggatgacagaagcaccatttctgccgcgtgagaggctcttcaagcagcagaattacttccagaacttgacgaagcacacctacctgaaagggcgctatgatgtgatcacctccgttgccatcccccttgcacttgctgcctccagcatgttcatgattggccgtggagtttacaacatgtctcatgggattgggaaaaaggagtgaacttccgcgggttaactagtgggcatggaagtaataccatccaggctgtgaagtctttaattgcaaaataatactgtcaaagaacaatccaactacatttccgcttcattttctgtttgtatttgtggatatctactgccagctacttgaagatcagcgttatcgctgtttcagttaattgcaccattcctttcctcctctgtgtttcatttc

SEQ ID NO: 2364 - protein, 67 aa, Panicum virgatum
  misc_feature: Ceres CLONE 1780355
  misc_feature (1)..(54): Pfam Name: COX7a Pfam Description: Cytochrome c oxidase subunit VIIa
MTEAPFLPRERLFKQQNYFQNLTKHTYLKGRYDVITSVAIPLALAASSMFMIGRGVYNMSHGIGKKE

SEQ ID NO: 2365 - DNA, 1735 bp, Panicum virgatum
  misc_feature: Ceres CLONE 1780416
  misc_feature: Encodes the peptide sequence at SEQ ID NO. 2366
acacacgacacacagattacagcgctctcgctcgcacttcctccgctcgtctgacatctcctcccgtcctttcctttcgaagcctcggggatcccggcgatggccaccgccgccaccctggtgtcggtcgacgacaagctcgaccagcttcgcgccgaggtcgccaagctcgaccagatcagcgagaacgagaagtccgggttcatcagcctcgtgtcgcgctacctcagtggggaggcggagcagatcgagtggagcaagatccagaccccgaccgatgaggtggtgatgccgtacgacaccctcgcgtcgcctcccgaagatctcgaggagacgaagaagctgctggacaagctcgttgtgctcaagcttaatggagggctcgggacgaccatgggctgcactggccccaagtctgtcattgaggtccgcaacgggttcacattccttgaccttattgtgattcaaattgagtctttgaacaagaagtatggatgcagtgtccctttacttctgatgaactctttcaacactcatgatgacacacagaagattgttgagaagtatgccaactccaacattgagattcacactttcaatcagagccagtatcctcgcattgatactgaagacttctcgctacttccaatcaagaaatctgggaaggatggctggtatcctccaggccatggtgatgtgttcccctctttgaacaacagtgggaaacttgacctcttattggctcagggcaaggagtatgtctttgttgcaaactcagacaacttgggtgctatagttgacatcaaaatcctaaaccatctgatcaacaaccagaatgagtactgcatggaggttactccaaagactctggctgatgttaagggtggtaccctcatctcttacgaaggaagggttcagcttttggagattgcccaagtacctgatgagcatgtgaatgaattcaaatcaattgagaagtttaagatattcaacactaacaacttgtgggtgaacctaaaagctatcaagagacttgtagaagctgatgcacttaagatggaaattattccaaaccccaaggaagttgatggtgtgaaagttcttcaactcgaaactgcagctggcgcagctattaggttcttcgacaaagcgattggaattaatgttccccgctcaaggtttctcccagtgaaggctacatctgatttgttgcttgtgcagtctgatctttacaccttggttgatggctttgtcacccgcaacccagccagagcaaatccagctaacccttcaattgagcttggtcctgagttcaagaaggttgccaacttccttgcccggttcaagtccatccccagcattgtcgaccttgatagcttgaaggtttctggtgacgtctggtttggctctggaattacactcaagggcaaggtgaccatcaccgccaagcccggagtgaagttggagattccagatggagctgtgcttgagaacaaggacgtcaggggcccccaggatctctgagcgatgcgtaccgtcgtcaccagtttttccgaggaccttttgcaggagccgccgccctagtcaatccgctgagctttgtcttttgtaagtgtcatgtgcattaccgctgtgagggtcttgtgagcccgctacagaataattgtaatcctctttacttgtgtttttggcgcaccagggacgaatattttgctaaaaaaaaaaaaaaaaaaaa

SEQ ID NO: 2366 - protein, 474 aa, Panicum virgatum
  misc_feature: Ceres CLONE 1780416
  misc_feature (1)..(413): Pfam Name: UDPGP Pfam Description: UTP--glucose-1-phosphate uridylyltransferase
  misc_feature (11)..(474): SWISSPROT Homolog: EC 2.7.7.9 UTP--glucose-1-phosphate uridylyltransferase
  misc_feature (4)..(474): SWISSPROT Homolog: EC 2.7.7.9 UTP--glucose-1-phosphate uridylyltransferase
MATAATLVSVDDKLDQLRAEVAKLDQISENEKSGFISLVSRYLSGEAEQIEWSKIQTPTDEVVMPYDTLASPPEDLEETKKLLDKLVVLKLNGGLGTTMGCTGPKSVIEVRNGFTFLDLIVIQIESLNKKYGCSVPLLLMNSFNTHDDTQKIVEKYANSNIEIHTFNQSQYPRIDTEDFSLLPIKKSGKDGWYPPGHGDVFPSLNNSGKLDLLLAQGKEYVFVANSDNLGAIVDIKILNHLINNQNEYCMEVTPKTLADVKGGTLISYEGRVQLLEIAQVPDEHVNEFKSIEKFKIFNTNNLWVNLKAIKRLVEADALKMEIIPNPKEVDGVKVLQLETAAGAAIRFFDKAIGINVPRSRFLPVKATSDLLLVQSDLYTLVDGFVTRNPARANPANPSIELGPEFKKVANFLARFKSIPSIVDLDSLKVSGDVWFGSGITLKGKVTITAKPGVKLEIPDGAVLENKDVRGPQDL

SEQ ID NO: 2367 - DNA, 1976 bp, Panicum virgatum
  misc_feature: Ceres CLONE 1780419
  misc_feature: Encodes the peptide sequence at SEQ ID NO. 2368
agagtccacaaggagacgcatgcagcagcagctcatctagttgctagtagccgcatgtcaaatgcatgctgcctgctgttaccctacaagcaagtgtgcaaccgcagcagcatatgccaagtaggagcagcatcagcagtgtggtggtggcgataagaggtgagtggccaaagtaagctgtttgctccatggaaccttttgcccgatgctaaccgtcaccgaatgcagcagtaggcgctcacgcctctcaccaccactgactgcccggccaccacccagcgtgcgtggtctgtggtctttttttcttcccccttcctccgatcccagccttcccagtcagtcatccctccctcccagcggagctgctgctgctctgctgattgattggcctcgcctagtcgccttgcagataacagacatatggccatcatccttgtacgagcagcgtcgcccggactctccgacgcccatgtccatgggagcctcctccagtgctcctcccccctgcagctcaagaggagggtgccgccacgcagtagtggccgctggatgctctgctcgctcaggtacgcgtgccttggcctcgacccgggggagattggccggacctccgccgtgtactccagcctgaccgtcaacccggcgggagaggccgtcgtctcctccgagcagaaggtctacgacgtcgtgctcaagcaggcggcattgctcaagcgccagctgcgctcgcagacgccgcccgtcctcgacgtcaggccccagcagctggacatgccgcgcaaccgcctcaacctcaaggaggcctacgcccgctgcggcgacatctgcgaggagtatgccaagactttttacctcggaactttgttgatgacagaggagaggcgccgcgccatatgggccatctatgtgtggtgtaggaggacagatgagctcgtagatgggccaaacgccaactacattacgccaacggctttggaccggtgggagaagagactagaggatcttttcgcgggacgcccttacgatatgcttgacgccgctctttctgataccatctcaaggttccccatagacattcagcccttcagggacatgattgaagggatgcggagtgaccttagaaaggcgaggtataagaacttcgacgagctctacatgtactgctactatgttgctggaactgtgggattaatgagtgtacctgtgatgggcatcgcacctgagtctaaggcaacaactgaaagcgtgtacagtgctgccttggctctcggaattgcgaaccaactcacaaatatactccgggatgtaggagaggatgctagaagaggaaggatatatttaccacaagatgaactggcacaggcagggctctctgatgaggatatcttcaatggtgtcgtgacaaaccgatggagaaatttcatgaagcagcagagggccaggatgttttttgaggaggcagagagaggggtgactgagctctcacaggctagcagatggccagtatgggcctccctactgttgtaccggcaaatcctggatgaggttgaagcaaacgactacaacaacttcacaaagagggcttatgttggaaaagggaagaaactgctagcacttcctgttgcatatgggaagtcactactgctaccagtttcactgagaaatagccagacctagccgctgccattgaaaacaagacaaggtgatcaggataggctagatagaaaatagggcaatgtcctggtggagataaattaattattgttcaggtgtatcatatgaaatgggaatctgttgggggcagaggcacagatagatagaaaaagcactgcaaccaacctagatggatatggaacgctgccctgtatatccgatccgcttaggagcatgcgtcatacacttgagtctctgaaggaaagagcaacatgtatactgatttctttttttatatatgccaaaaaaaaaaaaaaaaaaaa

SEQ ID NO: 2368 - protein, 418 aa, Panicum virgatum
  misc_feature: Ceres CLONE 1780419
  misc_feature (1)..(275): Pfam Name: SQS_PSY Pfam Description: Squalene/phytoene synthase
  misc_feature (1)..(275): Pfam Name: SQS_PSY Pfam Description: Squalene/phytoene synthase
MAIILVRAASPGLSDAHVHGSLLQCSSPLQLKRRVPPRSSGRWMLCSLRYACLGLDPGEIGRTSAVYSSLTVNPAGEAVVSSEQKVYDVVLKQAALLKRQLRSQTPPVLDVRPQQLDMPRNRLNLKEAYARCGDICEEYAKTFYLGTLLMTEERRRAIWAIYVWCRRTDELVDGPNANYITPTALDRWEKRLEDLFAGRPYDMLDAALSDTISRFPIDIQPFRDMIEGMRSDLRKARYKNFDELYMYCYYVAGTVGLMSVPVMGIAPESKATTESVYSAALALGIANQLTNILRDVGEDARRGRIYLPQDELAQAGLSDEDIFNGVVTNRWRNFMKQQRARMFFEEAERGVTELSQASRWPVWASLLLYRQILDEVEANDYNNFTKRAYVGKGKKLLALPVAYGKSLLLPVSLRNSQT

SEQ ID NO: 2369 - DNA, 1410 bp, Panicum virgatum
  misc_feature: Ceres CLONE 1780432
  misc_feature: Encodes the peptide sequence at SEQ ID NO. 2370
acctcaccctctatccgcttctagacagttcccctgataacctcgcggcatctcccatccccgtctcgtcgtcgtcgcagcaccccatcgccatgggcaagattaagatcggaatcaacggtttcggaaggattggcaggctcgtggcccgggtcgccctccagagcccggatgtcgagctcgtcgccgtcaacgaccccttcatcaccaccgagtacatgacctacatgttcaagtacgacaccgtgcacggccactggaagcacagtgatatcagcatcaaggactccaagacccttctcttcggtgagaagccggtcactgtcttcggcatcaggaacccggaggagatcccatggggcgaggctggcgctgactatgttgtggagtccactggtgtcttcactgacaaggagaaggctgctgctcacttgaagggtggtgccaagaaggttgttatctctgctccaagcaaagatgcccctatgtttgttgttggtgtcaatgaggacaagtacacctcagatattaacattgtctccaatgctagctgcaccacaaattgccttgcccccctcgccaaggtcatcaatgacaactttggtatcattgagggtctgatgacaactgttcatgccatcactgccacccagaagactgttgacggcccttcagccaaggactggagaggtggcagggctgccagcttcaacatcattcccagcagcactggtgctgccaaggctgttggcaaggttcttcctgagttgaacggcaagctcaccggtatgtccttccgtgtccccactgtcgatgtctctgttgttgacctcaccgttagaatcgagaaggctgcttcatatgaggacattaagaaggctatcaaggctgcgtccgagggtcctctcaagggtatcatgggttacaccgaggaggatttggtttccactgacttcactggtgacagcaggtcgagcatcttcgatgccaaggctggaatcgctctgaacgagcacttcgtcaagctcgtctcctggtacgacaatgagtggggctacagcaaccgtgttgtcgacctgatccgccacatggccaagacccagtagagcgtttcggcttgatggtccccattgtctttcctagtcgtggaccggcctgctgcttgtctatgcagagaataaatgtgaatccttcggacgccaggattcatgctaagtgggacacatgagttgccttttgtttttcctatctgccaccttcctgtaacgaagttgctaatatggacctgagtttagttttttgcttgtgaagaatataaacaaggggttgtaattttgctgtgttggtcggtttgttcacttgttgaatagatgagcttttgtgtttggtgaaaaaaaaaaaaaaaaaaaa

SEQ ID NO: 2370 - protein, 337 aa, Panicum virgatum
  misc_feature: Ceres CLONE 1780432
  misc_feature (1)..(151): Pfam Name: Gp_dh_N Pfam Description: Glyceraldehyde 3-phosphate dehydrogenase, NAD binding domain
  misc_feature (1)..(158): Pfam Name: Gp_dh_C Pfam Description: Glyceraldehyde 3-phosphate dehydrogenase, C-terminal domain
  misc_feature (1)..(337): SWISSPROT Homolog: EC 1.2.1.12 Glyceraldehyde-3-phosphate dehydrogenase, cytosolic
  misc_feature (1)..(337): SWISSPROT Homolog: EC 1.2.1.12 Glyceraldehyde-3-phosphate dehydrogenase, cytosolic 1
MGKIKIGINGFGRIGRLVARVALQSPDVELVAVNDPFITTEYMTYMFKYDTVHGHWKHSDISIKDSKTLLFGEKPVTVFGIRNPEEIPWGEAGADYVVESTGVFTDKEKAAAHLKGGAKKVVISAPSKDAPMFVVGVNEDKYTSDINIVSNASCTTNCLAPLAKVINDNFGIIEGLMTTVHAITATQKTVDGPSAKDWRGGRAASFNIIPSSTGAAKAVGKVLPELNGKLTGMSFRVPTVDVSVVDLTVRIEKAASYEDIKKAIKAASEGPLKGIMGYTEEDLVSTDFTGDSRSSIFDAKAGIALNEHFVKLVSWYDNEWGYSNRVVDLIRHMAKTQ

SEQ ID NO: 2371 - DNA, 2673 bp, Panicum virgatum
  misc_feature: Ceres CLONE 1780443
  misc_feature: Encodes the peptide sequence at SEQ ID NO. 2372
cagatctttcagcttaattccctcgtgcgccacgccgctcgccattctcgcctcctttctccagtctcgaatccttctggtagtatcgggagaattagcagcagcagaacctgtgctttgggatcccatgtcgggggcaatcgcttcctcgtcttcggctttcctcctcctcgtcgcgtcctcctcgccgcggcgcaggcggagcagggtcggcgcggctctgcactcgtatggctacggcggcgcggggctgcggttgcattgggcgctgcggggcccgcctcgggatgcatccgcgccggtgcgcgccgcggcggcgccgggcgggagcgagggtgaggaggccgcggcggcaggggagagctccacgtccacgccgaagggggtcgccgtgcagggcagcaaggccaaggctgcagattctgcttcacctcccaaagctgtgacatccgcgccgaagcaacgccgcagcgctgcaaacgaaaatggggcgcttgggagcagcagtgcgagcaaatctgctgccccagtgtccgaaccacccacagccgagtcgccagctcctgtctctgagacagaaatggatgccagtgcgaaagttgcagaaccgaagccggccgcattggatgatgctaaggaaagtgttggcatcgctgaaccggtggaagctaaggctgatgcctctgcggctacggaagctgcggcgggtgctgctgatgatagtgaaggcaaggaacctggccctttggctgggccgaatgtgatgaatatcgtcgtggtggcttctgaatgtgctcctttctgcaaaacaggtggtcttggagatgttgtgggtgctttgcccaaggctttggcgaggagaggacaccgtgttatggtcgtgataccaaggtatggcgagtatgcagaagcccgggatttaggtgtacggagacgttacaaggtagctggacaggattcagaggtgacttattttcattcttatattgatggagttgattttgtatttatagaagcccctcccttccgtcaccgacacaatgatatttatggaggaaaaagaatggatgttttgaagcgcatgattttgttctgcaaggctgctgttgaggttccatggtatgctccatgcggtggtgccgtttatggtgatggcaatttagttttcattgctaatgattggcatactgcacttttgcccgtctatctgaaggcctattaccgagacaatggtttgatgcagtatgctcgatccgttcttgtgatacacaatattgctcatcagggccgtggccctgtagatgacttcttcaatttcgacctgcctgaacactacatcgatcacttcaagctgtacgatcctgttggtggcgatcacagcaacgtctttgctgccgggctgaagatggcagaccgggtggtgaccgtgagcagtgggtacctgtgggagctgaagacatcggaaggtgggtggggactccacgacatcataaaccagcacgactggaagctgcagggcatcgtgaacggcatcgacatgggcgaatggaatcccgcggtggacgtgcaccttcactctgacggctacaccaactacacattcgagacgctggacacgggcaagcggcagtgcaaggcggccctgcagcagcagctggggctgcaggcccgcgacgacgtgccgctgatcggcttcatcgggcgtctggaccaccagaagggcgtcgacatcatcgcggacgccatccactggatcgcggggcaggacgtgcagctggtgatgctgggcacggggcggcccgacctggaggacctgctgcggcggtgcgaggcggagcacaaggacaaggtgcgggcgtgggtggggttctcggtgcccatggcgcaccgcatcacggcgggcgcggacgtcctgctgatgccgtcgcggttcgagccgtgcgggctgaaccagctgtacgccatggcgtacggcacggtgcccgtggtgcacgccgtgggcgggctccgcgacacggtggcgcccttcgacccgttcgcggacgccgggctcggctggacgttcgaccgtgcggaggcgaaccggatgatcgacgcgctcgggcactgcctcaacacgtaccggaactacaaggagagctggcggggcctgcaggcgcgcggcatggcgcaggacctcagctgggatcacgccgcggagctgtatgaggacgtgctcgtcaaggccaagtaccagtggtgactggtgagcgagccggttggcgacgccgacgcgcctcccgtcgcgggaccctggacgcgcgcccgcgggcgtgcttcttccaggcggtgcgcggccggcgcatttgcgccgggagacggtggttggcgtgccgggggagcgtgggcggacgcgcgcgcgcgatgatgccaccgggcaagggggcagtagacagcgacggcgatgtaatgtaagagacctgtgctgctgccgtgctcatgcatggtctgaatcactttgatccggtacgaggtgatgtaaattatcaagttttggaggcgaagcgcgtgcgtccgttcccgccggccggtaaatggagttgtagaaactgtatgtactgatgtactcttcacatggccatttttaatgtgccgcgcagccaagcttttagctaaaaaaaaaaaaaaaaaaaa

SEQ ID NO: 2372 - protein, 704 aa, Panicum virgatum
  misc_feature: Ceres CLONE 1780443
  misc_feature (1)..(156): Pfam Name: Glycos_transf_1 Pfam Description: Glycosyl transferases group 1
  misc_feature (1)..(244): Pfam Name: Glyco_transf_5 Pfam Description: Starch synthase catalytic domain
  misc_feature (1)..(704): SWISSPROT Homolog: EC 2.4.1.21 Soluble starch synthase 2-2, chloroplast precursor
  misc_feature (51)..(704): SWISSPROT Homolog: EC 2.4.1.21 Soluble starch synthase 2-3, chloroplast precursor
MSGAIASSSSAFLLLVASSSPRRRRSRVGAALHSYGYGGAGLRLHWALRGPPRDASAPVRAAAAPGGSEGEEAAAAGESSTSTPKGVAVQGSKAKAADSASPPKAVTSAPKQRRSAANENGALGSSSASKSAAPVSEPPTAESPAPVSETEMDASAKVAEPKPAALDDAKESVGIAEPVEAKADASAATEAAAGAADDSEGKEPGPLAGPNVMNIVVVASECAPFCKTGGLGDVVGALPKALARRGHRVMVVIPRYGEYAEARDLGVRRRYKVAGQDSEVTYFHSYIDGVDFVFIEAPPFRHRHNDIYGGKRMDVLKRMILFCKAAVEVPWYAPCGGAVYGDGNLVFIANDWHTALLPVYLKAYYRDNGLMQYARSVLVIHNIAHQGRGPVDDFFNFDLPEHYIDHFKLYDPVGGDHSNVFAAGLKMADRVVTVSSGYLWELKTSEGGWGLHDIINQHDWKLQGIVNGIDMGEWNPAVDVHLHSDGYTNYTFETLDTGKRQCKAALQQQLGLQARDDVPLIGFIGRLDHQKGVDIIADAIHWIAGQDVQLVMLGTGRPDLEDLLRRCEAEHKDKVRAWVGFSVPMAHRITAGADVLLMPSRFEPCGLNQLYAMAYGTVPVVHAVGGLRDTVAPFDPFADAGLGWTFDRAEANRMIDALGHCLNTYRNYKESWRGLQARGMAQDLSWDHAAELYEDVLVKAKYQW

SEQ ID NO: 2373 - DNA, 1853 bp, Panicum virgatum
  misc_feature: Ceres CLONE 1780447
  misc_feature: Encodes the peptide sequence at SEQ ID NO. 2374
aattcaatcatcgaccaaacaaagggggaatcggaatcggtcgcctcctctcctccccccaccaccaacccttcttcctcttccggtctctctctctctctctctctactagtctctactgccgccgtcgccgccgcccgtccgcttcctctcgcagctcccctgcctcctgcaagcagctgcctttctttccgctcagctccctgctcgcgcggccggccggccggatcggcggcctagcctcggcaagtccccttgctgtgccggcggtttccgcccagatctgagcctctcgcccccccccccccccacaaaggccccgtcttccgcccaaagccgccgcctttcgcgatggcctcgtcccccacggcggcccccggggcgtcctactggtgctaccagtgcgaccgcttcgtccgtgccgcgccgcagcaggagggcggcggcggcgactccccgtccgccgccgtcgcctgcccggcctgcggcggcggcttcctcgaggagatgggcgcgcccccgccgcgggccgcctacctccgccgcccgcgcgcgcaccaccaccacgccgcggcggccgccgacctgcgcctccgccgcgcccgccgcggcgggggcggcggcgccggggccgacacccgcgcctcgcccttcaaccccgtcatcgtgctccgccgctcccctgccggaggggacgcggacgacgtcgccgccgcagccagcagcttcgagctcttctacgacgacggcgcaggctcgggcctccgcccgctccccgagagcatgtccgacttcctcataggctcggggttcgagcgcctcctcgaccagctcgcgcagatcgaggccggcggcctcgcccgcgcgcgcgacaacccgccggcctccaaggccgccgtcgagtccatgcccgtcgtcgccgtcgacgccgcgcgcgtcgccgccgactcccactgcgccgtctgcaaggagcccttcgagctcggcgccgaggcgcgcgagatgccctgcagccacatctaccacgccgactgcatcctgccctggctcgcgctccgcaactcctgcccggtctgccgccacgagatgcccaccgacgcgccgcgcgcaggggcgcgggccgccggcgagggctccgaggaggaggccaccgtcggcctcaccatctggaggctccccggcggcggcttcgcggtcgggaggttcaccggcgggaggaggcccgaggagagggagctccccgtcgtgtacacggagatggacggcggattcaacaacggcggcgcgccaaggaggatctcctgggtgtcaaggcagagcccctccacggagaggggagccatcaggcgcatcctgcgcagcgtcttcgcctgcttcgggcgcggccactcttcttcgcgggcctcgtcctcccaatcacacgcgatgccggagctcaacgatgcggcgtccgaccggagcgccagcttcagccatgggtcaaggagccggagcacgagctggcggctcgaggacggccacgccgatgccatggtgcagagatgaaaacttactgcacaaagcttgttgcttgcttgcttgcttgcttgcttgtttcattcatgtatttacttactgcttagtagtacttagaagaagaagaaacacgaaggatttgtagaacaaagcaatcggcttattggtgatgtacataggagagcagcatctcatctcatctctctagagacgatgtatgatggattgctacttgcaggtgggatggggaattatactgttcaccttaaatggtgatcctgcaatgggcattcggtgaggtgatgaaaatgttctttcaaaaaaaaaaaaaaaaaaaa

SEQ ID NO: 2374 - protein, 397 aa, Panicum virgatum
  misc_feature: Ceres CLONE 1780447
  misc_feature: Great-hit functional homolog of the protein sequence given in SEQ ID NO 9294
  misc_feature (1)..(41): Pfam Name: zf-C3HC4 Pfam Description: Zinc finger, C3HC4 type (RING finger)
  misc_feature: Useful for making plants with altered Lignin content
  misc_feature: Useful for making plants with altered alkaloid content
  misc_feature: Useful for making plants with altered lutein content
MASSPTAAPGASYWCYQCDRFVRAAPQQEGGGGDSPSAAVACPACGGGFLEEMGAPPPRAAYLRRPRAHHHHAAAAADLRLRRARRGGGGGAGADTRASPFNPVIVLRRSPAGGDADDVAAAASSFELFYDDGAGSGLRPLPESMSDFLIGSGFERLLDQLAQIEAGGLARARDNPPASKAAVESMPVVAVDAARVAADSHCAVCKEPFELGAEAREMPCSHIYHADCILPWLALRNSCPVCRHEMPTDAPRAGARAAGEGSEEEATVGLTIWRLPGGGFAVGRFTGGRRPEERELPVVYTEMDGGFNNGGAPRRISWVSRQSPSTERGAIRRILRSVFACFGRGHSSSRASSSQSHAMPELNDAASDRSASFSHGSRSRSTSWRLEDGHADAMVQR

SEQ ID NO: 2375 - DNA, 2082 bp, Panicum virgatum
  misc_feature: Ceres CLONE 1780451
  misc_feature: Encodes the peptide sequence at SEQ ID NO. 2376
agtcaaaaagctccccctcctcttcccctcacccacctctcgaactctccggccctccaaaccctagctttcccccacctcccccccatggccgacggcgatccggcgaaggcgccggcgccggacagcgagaagccttcagccccggcggcggcggtcgaggtggaggagacgcggcggccgccgccggcgcgccccgggagtccggtcgaggagaagcgccagtcccaggtggacgcgacggcggccgaggcagtgacgcgcccgccgccgaaggaccctggggcgccgcccgctgagaaccgggagaaagaggcgaaggagaggaaagaagtggagaaggggatgggggatgagacgaaggagaagcgggaggaggaggataaggggaaagaggaggcgaaggaggaggcggcggcgaaagagaaggctgaggcaaaggggaaggtgaaggtacatgcggtggtgaaggtggaggggacggagaaggaggtcaagccgacccggcggccggccggggccagcgcggagacgtccatcctcgcggtgcctgtggtggccgtaccgtgcttcatagcgccttcggggttcgcgggccaatttgcaatgacgcatcaagcagctttggcgagtgtaacagcacaggcacaaatgcacttgcaatccccaaccacatctacatgttcagaagcgccgtcaagtccgttttatataacaccaaggtctatagtgccactgcagcaatcaccatcaactgaaggaaatgtttgtagacaattagcagacaagccattttcatcggagccaaaatcaccccaccttgtaaatatggtggctgatggcttcaactggaggaaatatggccagaagcaggtgaaaagtagtgataattccaggagctactatagatgcactagctcaggttgttcggctaaaaagaaggttgagcattgccctgatggccgtgtcgtggaaatcatttatagaggggctcataatcatgaaccacctccaaaaactagatttgcaaaagaaaaggtgactcctattagtgttccctctggaggtgaaaccttgagacttgtgaatacagaaattctagaatccagtacacctacctgcaaatcggaccattgtgctgtcacagaaacctgtgagcagcagctcttttgctcgagtgattgcgaaggtgatgctggtaacaaatctgaagatgaacatcctagtgaagaacccatgccgaagcgaagggtgattgaaacgactgcacctaacttaacccctgttctcagaactgttagagagcaaaagataattgtgcaggctggaaagatgagtgatggatacagatggcgcaagtacggacagaaaattgttaagggaaatccaaaccccaggagttattatcgttgcacacatggtgggtgccctgtccgtaagcatgtggaaaaggcaccagatgatgtcaacaatattgttgtaacttatgaaggtaaacacaaccatgatgaaccatttagaagcaacagcatacctgtgtctgctatcagtccaccaacggtaaccatcgaacaacccaacacatcaaccacaacagcagatgggaaacccccaaccatcactcagaaggatgccaatggcgagtctgataaggaaactactttggaattcggaggtgagaaagcacttgaatctgcacaaacactgctcagcatcaaaactaattctgatgacatgaagaactctgtcctgaaagaaacttcttctgcagttcctgtccaaaacagctgaattctgctgagatagggtgattctattgacgtattagcctgtgatatttgttggttgtctgttattgtgttagcttgtgtatgaggtgatgtttgcgttcggcattctgtggagcactggaggaaaatttgaggaaacatttaggttctggaacccatgactggtcgtgtacctgtatagatttttaatccttagtgtgtataggtactgtatttcttacctgacgctaagcaacaaagagacccaatgagacctgatgagagttcttcagaaaaaaaaaaaaaaaaaaaa

SEQ ID NO: 2376 - protein, 567 aa, Panicum virgatum
  misc_feature: Ceres CLONE 1780451
  misc_feature: The sequence is a functional homolog of  SEQ ID NO 227 in the  11/479,226 US patent application
  misc_feature: Useful for making plants with modulated growth and phenotype characteristics
MADGDPAKAPAPDSEKPSAPAAAVEVEETRRPPPARPGSPVEEKRQSQVDATAAEAVTRPPPKDPGAPPAENREKEAKERKEVEKGMGDETKEKREEEDKGKEEAKEEAAAKEKAEAKGKVKVHAVVKVEGTEKEVKPTRRPAGASAETSILAVPVVAVPCFIAPSGFAGQFAMTHQAALASVTAQAQMHLQSPTTSTCSEAPSSPFYITPRSIVPLQQSPSTEGNVCRQLADKPFSSEPKSPHLVNMVADGFNWRKYGQKQVKSSDNSRSYYRCTSSGCSAKKKVEHCPDGRVVEIIYRGAHNHEPPPKTRFAKEKVTPISVPSGGETLRLVNTEILESSTPTCKSDHCAVTETCEQQLFCSSDCEGDAGNKSEDEHPSEEPMPKRRVIETTAPNLTPVLRTVREQKIIVQAGKMSDGYRWRKYGQKIVKGNPNPRSYYRCTHGGCPVRKHVEKAPDDVNNIVVTYEGKHNHDEPFRSNSIPVSAISPPTVTIEQPNTSTTTADGKPPTITQKDANGESDKETTLEFGGEKALESAQTLLSIKTNSDDMKNSVLKETSSAVPVQNS

SEQ ID NO: 2377 - DNA, 1341 bp, Panicum virgatum
  misc_feature: Ceres CLONE 1780471
  misc_feature: Encodes the peptide sequence at SEQ ID NO. 2378
attctctcagttgcttcgacgtatttctctctctacggctcaaggtaccggtaccggaggcggtagagagagaaacacgaaggggagaggtggagactggagagaggttaatgcaggtgtcattaatcaaatttctctgaagcaccagaaccaaaatgctgcctggtgctaagtgataccatcttgtaatgcctaagcttttacgggaagtggaggatcatccggttcatcccatgtctaagtcaaaccatggcttcttgtcaggaaatggccatgagatgaagcatttaggtcataaaatccacgacaaggactcgtcatcagagtctggtcagtctcaccaagaagcaccggcagtgagtgagagcagtctaaacgaaaacacctcaactcaatctgacaatgatgaaggtcatgggaagcataatcaggacacagagcactcagtattgtccatggggaagcaaggatctgcctttttgcccccaaaactagattacaatccatcttttgcttgtcttccttataccgctgatgcttattatggtggggtcttgccaggatatcctacacatgccattgtccatccccagcaaaatcatacaacaaatgctccggttatgttgcctgttgaacctgcagaagaagagccaatttatgttaatgcaaagcaataccatgcaatccttaggaggagacagacacgtgctaaattggaggcccagaataagctggtgaaaggccggaagccataccttcatgaatctcgacaccgtcacgccatgaagcgagctcgaggatcaggagggcggttcctcaacacaaagcagctccaggagcagagccagcagcatcaggcatcaggtggttcgagctcctcaaagttcattggcaacagcataagctcccagagtgaccccacccccacaccttcaactcctgcttcttcggacactgcaagtgcttcaagggtcaaccaggaccacaactgctttccatcagttggcttccgccctgccatgaacttcagtgcaccaggtggagacggagcaaagctggttagttgaagaaaagtgaagtggtcacagaagcatcgccaggcacactgcctgcggcaactcatccttggcttttgaaacaatgaatatgaaatggacatgtagcttaagaatctcagaataaacaaagtccttttaagcttgctgtggctaaaagaactgtggttatgagaatgtttctagactgaaatccatacatcgtgttgggttgaggtgcagacctcgaaacttgttcagcagatattgccttatgtctctgccagaaaaaaaaaaaaaaaaaaaa

SEQ ID NO: 2378 - protein, 292 aa, Panicum virgatum
  misc_feature: Ceres CLONE 1780471
  misc_feature (1)..(57): Pfam Name: CBFB_NFYA Pfam Description: CCAAT-binding transcription factor (CBF-B/ NF-YA) subunit B
MPKLLREVEDHPVHPMSKSNHGFLSGNGHEMKHLGHKIHDKDSSSESGQSHQEAPAVSESSLNENTSTQSDNDEGHGKHNQDTEHSVLSMGKQGSAFLPPKLDYNPSFACLPYTADAYYGGVLPGYPTHAIVHPQQNHTTNAPVMLPVEPAEEEPIYVNAKQYHAILRRRQTRAKLEAQNKLVKGRKPYLHESRHRHAMKRARGSGGRFLNTKQLQEQSQQHQASGGSSSSKFIGNSISSQSDPTPTPSTPASSDTASASRVNQDHNCFPSVGFRPAMNFSAPGGDGAKLVS

SEQ ID NO: 2379 - DNA, 2040 bp, Panicum virgatum
  misc_feature: Ceres CLONE 1780482
  misc_feature: Encodes the peptide sequence at SEQ ID NO. 2380
atggaacctcggcctcatgcgacgggccggggaggaagcaagcgcgcagcaaaggcgcgcagcatcgtcacaagagacaagaggcaccgggagaagaggagacgactaaggctagaagaagaggagggatagctcctataagtagccccctccccttccccccctctcttcctccctccacctccgatcccccgcctcatccgttcccctcacctctcagctctagcgcggcggagagagctagctagagagaggaccgggccgggagattgccggcggccggcggttgtctagctgtggaacaaacgactatctcttgtgcgcgcgcgcgcggatcaagcggggagttttggtgttgtgaatggtgaacggcgaggcggaggcggagtgcacgcgggcgtcgctgctggggaggtatgagatcgggcgcacccttggggagggcaacttcggcaaggtgaagtacgcgcgccacaccgccaccggcgcccacttcgccatcaagatcctcgaccgcaacaagatcctctcgctccgcatcgatgaccagataaggagggagatcgggacactgaagctgctcaagcacccgaatgtcgtccgcttgcacgaggttgctactagcaaaacgaagatttacatggtgcttgagttcgtcgacggcggcgagctctttgacaagattgctgtaaagaggaaactgtctgaacatgagggaaggaggcttttccagcagctaattgacggcgtcagctattgccatgataaaggtgtctaccacagggaccttaagccagagaatgttcttgttgatcggaagggaaacatcaagatctccgacttcggccttagtgctctacctcaacatctcgggaatgatggacttctgcacacaacatgtggcagccccaattacatcgctcctgaggttttgcaaaatagaggttacgatggctccttgtcggatatatggtcttgtggggtaatcctatatgtaatgcttgttggttaccttcccttcgatgacaggaatcttgttgttctttatcagaagattttcaagggagactgtcagatcccaaggtggctttcacctgctgcacaggaccttcttagaaagattcttgaaccaaatccgatgaaaaggatcaacatcatgggcatcaaagagcatgagtggtttcagaaggactatgttcctgttgttccatacgatgacgacgaagatttacttcctagttcagttctcccaatcaaagagcaaattgatgaatcagctcaagaaaagcctactcatatcaacgcttttcagttgatcggaatggcttcgtcccttgacctttctggtttcttcgaggaagaggatgtggctcaaagaaagattcggttcacatcaacgcattcacccaaggatttatttgacaagattgagaatgctgtgaccgagatgggattcaaagtccataggggaccaaggaagctcaaagtattgaaaaattgcaaaacttccaagaactccaggagtcccgcatcatttttggtgtgcattgaggtgtttgagctaggaccggctttgtatgtcgtagaactgaggaaatcctatggagattctatattgtatagacagctgtgtgagaggctctcagatgagttgggggtgtgcaagacagaggagattatgaggactgaatcgctgggtgactcagatatgtcgagccttgatggcgaagcactacctttgtctggtttctgatcattgcctccctgcgtggttttgggcacaggggatgagggacattctcgttcctgatgcagatctagattaggatcatgcacaaagcgtgtggcgcaaattagccaccaggttgaatattgttgtagcctgtctgttccccagattctcattctgatccataactaattatttctaaatcatgttcgcttaaacaaacactactgctaaatcatcagcaatggatgctgatgcagaaagctggctgatccagtattgttcaaagtcaaaaaaaaaaaaaaaaaaaa

SEQ ID NO: 2380 - protein, 463 aa, Panicum virgatum
  misc_feature: Ceres CLONE 1780482
  misc_feature (5)..(438): SWISSPROT Homolog: EC 2.7.11.1 CBL-interacting serine/threonine-protein kinase 1
MVNGEAEAECTRASLLGRYEIGRTLGEGNFGKVKYARHTATGAHFAIKILDRNKILSLRIDDQIRREIGTLKLLKHPNVVRLHEVATSKTKIYMVLEFVDGGELFDKIAVKRKLSEHEGRRLFQQLIDGVSYCHDKGVYHRDLKPENVLVDRKGNIKISDFGLSALPQHLGNDGLLHTTCGSPNYIAPEVLQNRGYDGSLSDIWSCGVILYVMLVGYLPFDDRNLVVLYQKIFKGDCQIPRWLSPAAQDLLRKILEPNPMKRINIMGIKEHEWFQKDYVPVVPYDDDEDLLPSSVLPIKEQIDESAQEKPTHINAFQLIGMASSLDLSGFFEEEDVAQRKIRFTSTHSPKDLFDKIENAVTEMGFKVHRGPRKLKVLKNCKTSKNSRSPASFLVCIEVFELGPALYVVELRKSYGDSILYRQLCERLSDELGVCKTEEIMRTESLGDSDMSSLDGEALPLSGF

SEQ ID NO: 2381 - DNA, 1744 bp, Panicum virgatum
  misc_feature: Ceres CLONE 1780484
  misc_feature: Encodes the peptide sequence at SEQ ID NO. 2382
gtgatgctccgacggggtaggtggcgactccgcgccgtgtataaaccgctccccgcttaccttcctccctcctccgttcctcctcaccaaccaaaccctctccaatggccgcgcccgtgtcgcacacgccggtggccgccagggcgtccacgcggctcctcccccacgggcttggcgcgctcccggaatccgcgcccgcctccctccgcttctccgtcggccgccgccgccgcgccgctcgcctagaggtaaaggcatcaggaaatgtctttgggaaccacttccaggttgcaacctatggcgagtctcatggagggggtgttggttgtgttatcagtggctgcccaccaagaattcctctcactgaggcggacatgcaagtagagctcgacagaagacgtccaggtcagagtagaataaccactccgagaaaggagactgatacatgcaaaattctatcagggacacatgaagggatgaccactggcacaccaattcatgtctttgtcccaaacacagatcaaagaggcggagattacagtgaaatggctaaggcatacagaccttcccatgcagatgcaacctatgacttcaagtatggtgttagagctgtgcagggaggtggaagatcatcagccagagaaaccattggcagggtggctgctggagctcttgcaaagaaaattctgaagctcaaatctggagtagagattttggcatttgtttccaaagtgtatcaagttgtacttccagaagatgcagttgattatgaaactgtaaccatggaacagatagagagcaacattgttagatgtcctgacccagaatatgcagagaaaatgattgctgccattgataaagtacgagttagaggggattcaattggtggggttgtcacatgcattgcaagaaatgttccacgtggtattggctctcctgtttttgacaaacttgaagctgagctggcaaaagctatgctttctcttcctgcaagcaaggggtttgagattggcagtgggtttgctggtactgaccttactggaagcgagcataatgatgagttctatatggacgaggctggaaatgtgagaacacagactaatcgctcaggcggtgtacagggagggatatcaaatggtgaaattatttacttcaaagtggcttttaagccaacagcaaccattgggaagaaacaaaatactgtgtcaagggagcatcaggatgttgaacttttggcaagggggcgccatgatccatgtgttgtccctcgagctgttcctatggtggaatccatggctgcattggtcctgatggaccagctcatggcacacattgcacagtgcgagatgtttcctctgaaccttgctctacaagaacccattggatcggccagcagtgcttctgaattggcgccaaacctatcataatgtatattgttggaacaaaacccccctgcttgggtttctgcccaccagttttctttctttgtcagccataattctgggctttgctaagcagtttgcagttttgaaccacaccctcgattattgtacccttgagatcataaagtgagtatcatgatagaaacacattaatgttttgtgttgtgtagcaggacgcgtaccccattcttttttggtgagaggatgtatgaatacagtcgtttggtcaataaagagttgtagtatcttttttcaatttggccagtgattctcttttcttgcaaaaaaaaaaaaaaaaaaaa

SEQ ID NO: 2382 - protein, 440 aa, Panicum virgatum
  misc_feature: Ceres CLONE 1780484
  misc_feature (1)..(348): Pfam Name: Chorismate_synt Pfam Description: Chorismate synthase
  misc_feature (22)..(433): SWISSPROT Homolog: EC 4.2.3.5 Chorismate synthase 2, chloroplast precursor
  misc_feature (26)..(435): SWISSPROT Homolog: EC 4.2.3.5 Chorismate synthase 1, chloroplast precursor
MAAPVSHTPVAARASTRLLPHGLGALPESAPASLRFSVGRRRRAARLEVKASGNVFGNHFQVATYGESHGGGVGCVISGCPPRIPLTEADMQVELDRRRPGQSRITTPRKETDTCKILSGTHEGMTTGTPIHVFVPNTDQRGGDYSEMAKAYRPSHADATYDFKYGVRAVQGGGRSSARETIGRVAAGALAKKILKLKSGVEILAFVSKVYQVVLPEDAVDYETVTMEQIESNIVRCPDPEYAEKMIAAIDKVRVRGDSIGGVVTCIARNVPRGIGSPVFDKLEAELAKAMLSLPASKGFEIGSGFAGTDLTGSEHNDEFYMDEAGNVRTQTNRSGGVQGGISNGEIIYFKVAFKPTATIGKKQNTVSREHQDVELLARGRHDPCVVPRAVPMVESMAALVLMDQLMAHIAQCEMFPLNLALQEPIGSASSASELAPNLS

SEQ ID NO: 2383 - DNA, 1666 bp, Panicum virgatum
  misc_feature: Ceres CLONE 1780491
  misc_feature: Encodes the peptide sequence at SEQ ID NO. 2384
cggacagagctcggcccagctcggctcgcccctccccactcccctccctgatgcgcgtgcccccatgcggcggctccgacacagttaggccccgtctggggctgcatccgcggcggcggcggcggcggcgatgaagcggccgctgcggcgctccttcgcagtgctcctcttcgtcgtgctcgtcggcgcggcctcgttctccgccgccctccgccgcgccgtggcccccgcgcccgcgcgggagccgcccctcccggcgctcgaccaggcgcgcctcaacgccacgctgctccgcctcgccgccgtcgatccctcggaggccccgctgcggcgggacgtggacgacctcctcgagggccgcctcccggtctccgcggcgcgcgaccgcgcccgcgcgtggcgccgcgaccggctcctccacccgctccacctccaccaccaccgcttcccgctgccccgccgcggccgctacccggacgaggaccacgacaccctgctccacccgctcccgcgccacgaccagcagctccacatcgaccccgccctccgccgcgcgctccgctcctggcaccgcctccgccgctacgatcccgccgtcctcggcagcctcccctccctcctctccctgcccggccgcatcccatcctgcgcggttgtcggcaacagcggcatcctcctccgggcgaaccatggcgctctcatcgactcccacgacgccgtgttccgcctcaacaacgcccgcatcgcagggtacgccgcgcacgtcggcagcaagaccaacttctccttcatcaacagcaacgtccttcacctctgcgcgcgccgacccggctgcttctgccacccctacggccatggcgtccccatcctgctctacatctgccaggccgcccatttcctcgacatcgcagcctgcaacaccacctcatcctctcgccacggctcccctatctccgtcaccgacgcccgcctcgacgtcctctgctcccgcatcgtcaagtactactccctccgccgattcgtcgcggagactggccgcgcggctgaggactgggaccgcgcacacgacgccgctatgttccactactcgtccgggatgcaggccatcatgatcgcggtgggagtttgtgacagagtcaacgtgttcggcttcgggaaatcctccgatgcaaagcaccattaccatagcaaccagaaggcggagctggatctccatgactacgaggcggagtacgccttctatcacgacctcgccgagcacccgcaggtagtccccttcctcaagtgcgatgtcccgcccgttgtcttctaccattaggccagcttcgtaaagcgcggcatgtgctcgacgttatgtagcccgggtgtttttttttcttttcgggtgttttgattagtaagtgcgatgtaaaacttgttgtgtcggtgggttgatctattttgattagatgaaataggcaaattcaggtagaaaagttttcgtgtactgttggagttggaagctgtataggggatttagggaggctactccatggtatagaaggattgcttgggttttttagcttcagcaggactgtaggcagggtctggaattgtataatcttagactgatatttcaatttattatgaaacaaaatgtatatcttaaaaaaaaaaaaaaaaaaaa

SEQ ID NO: 2384 - protein, 395 aa, Panicum virgatum
  misc_feature: Ceres CLONE 1780491
  misc_feature (1)..(280): Pfam Name: Glyco_transf_29 Pfam Description: Glycosyltransferase family 29 ( sialyltransferase)
  misc_feature (173)..(221): SWISSPROT Homolog: EC 2.4.99.4 CMP-N-acetylneuraminate-beta-galactosamide-alpha-2, 3-sialyltransfer ase
MKRPLRRSFAVLLFVVLVGAASFSAALRRAVAPAPAREPPLPALDQARLNATLLRLAAVDPSEAPLRRDVDDLLEGRLPVSAARDRARAWRRDRLLHPLHLHHHRFPLPRRGRYPDEDHDTLLHPLPRHDQQLHIDPALRRALRSWHRLRRYDPAVLGSLPSLLSLPGRIPSCAVVGNSGILLRANHGALIDSHDAVFRLNNARIAGYAAHVGSKTNFSFINSNVLHLCARRPGCFCHPYGHGVPILLYICQAAHFLDIAACNTTSSSRHGSPISVTDARLDVLCSRIVKYYSLRRFVAETGRAAEDWDRAHDAAMFHYSSGMQAIMIAVGVCDRVNVFGFGKSSDAKHHYHSNQKAELDLHDYEAEYAFYHDLAEHPQVVPFLKCDVPPVVFYH

SEQ ID NO: 2385 - DNA, 1920 bp, Panicum virgatum
  misc_feature: Ceres CLONE 1780504
  misc_feature: Encodes the peptide sequence at SEQ ID NO. 2386
actttggcacacgcacgccgacgcacatccactcggcacaggctctcaggcagttcctcctttcctcgccgccgcactttggagccccacctcggcctgcctcgatctcacgcgcgcgctcgtgcgcccatggggaggataaagagtgggcgacgcacgacggcgccgccggcgccgctgctactgctgctgctcctcgtcggcgcgtcgctaccagggcggtgcattgcgcagggcggcggagctgggctcacgcgggggagcttccccaaggggttcgtcttcggcaccgccgccgccgcctaccagtacgagggagcggtggaggtggatggcagagggccgacgatctgggacactttcgcgcacacgttcggcaagatttccgactttagcaatgccgatgttgccgtcgatcagtaccaccgttttcaggacgatgtacagctcatggcagacatgggaatggatgcttaccggttttcgattgcctggtcgaggattttgccaaatggtaccggtcaagtcaatcaggcagacatcgaccactacaacaaagtgattgatgcactagtatcaaaaggaattcagccatatgtaaccctctaccactgggacctccctcaggccctggaagacaggtacaatggatggctgaacaggcagatagttgacgattttgcggcctacgctgagacatgcttcaaggcgttcggggatcgtgtgaagcactggatcacgatcaacgagccgcacactgttgccgttcagggctgtgatgcggggcttcacgcaccaggacgctgttcagtgctgctccacctgtactgcaagtcagggaattccggcactgaaccctacatcgtcgctcacaacttcatcctagctcatgccaccgtttcagacatctacaggaggaaatacaaggcaactcagaatggccagattgggattgcatttgatgtcatctggtacgaaccgatgacaaatagcacaatcgacattgaagctaccaaaagggcacaagagtttcagctaggatggttcgcggatccgttcttcttcggagattacccggcgacgatgagaacaagggttgcagaaagactgcccaagttcacagcagatgagtctgcccttgtcaagggggctctggactttatgggcataaaccactacaccactttctacgcgaggcataacactaccaacatcattggacgattgctgaatgataccttagccgacaccggaaccgtcagccttccattcgacaagaacgggaaaccgattggagacagggccaattcgatctggctgtacatcgtgcccagcgggatgaggaagctgatgaactatgtcaaggagaggtacaatagcccacccgtttacataactgaaaacggtatggacgacggcaacagccctttcacttccatcaatgacgccctcaaggacaacaagaggatcaagtaccacaacgactacctcaccagcctcgctgcctccataaaggaggacgggtgcgacgtgcgtggctacttcgcgtggtcgctgctggacaactgggagtgggccaccgggtacacctcgagattcgggctctacttcgtggactacagggacaacctcaagagataccccaagaactcggtgcagtggttcaagtcgctgctcagctccagctgaagacggcagatatcgttggtctgtccatacttgtatatattatgttctacgcaagcacatgctcataggataaacaaaagtgcgtgcagcttcagtgtacatgatccaatcttctgtatggtttagccatcaacctatcatgtctgataccacacacacacaggatactaaaaaacaagcttaattacagaaatgaacactggatttcttcaaaaaaaaaaaaaaaaaaaa

SEQ ID NO: 2386 - protein, 519 aa, Panicum virgatum
  misc_feature: Ceres CLONE 1780504
  misc_feature: Great-hit functional homolog of the protein sequence encoded by LOCUS At1g26560
  misc_feature (2)..(460): Pfam Name: Glyco_hydro_1 Pfam Description: Glycosyl hydrolase family 1
  misc_feature: Useful for making plants with altered cell wall content and/or composition
MGRIKSGRRTTAPPAPLLLLLLLVGASLPGRCIAQGGGAGLTRGSFPKGFVFGTAAAAYQYEGAVEVDGRGPTIWDTFAHTFGKISDFSNADVAVDQYHRFQDDVQLMADMGMDAYRFSIAWSRILPNGTGQVNQADIDHYNKVIDALVSKGIQPYVTLYHWDLPQALEDRYNGWLNRQIVDDFAAYAETCFKAFGDRVKHWITINEPHTVAVQGCDAGLHAPGRCSVLLHLYCKSGNSGTEPYIVAHNFILAHATVSDIYRRKYKATQNGQIGIAFDVIWYEPMTNSTIDIEATKRAQEFQLGWFADPFFFGDYPATMRTRVAERLPKFTADESALVKGALDFMGINHYTTFYARHNTTNIIGRLLNDTLADTGTVSLPFDKNGKPIGDRANSIWLYIVPSGMRKLMNYVKERYNSPPVYITENGMDDGNSPFTSINDALKDNKRIKYHNDYLTSLAASIKEDGCDVRGYFAWSLLDNWEWATGYTSRFGLYFVDYRDNLKRYPKNSVQWFKSLLSSS

SEQ ID NO: 2387 - DNA, 1773 bp, Panicum virgatum
  misc_feature: Ceres CLONE 1780508
  misc_feature: Encodes the peptide sequence at SEQ ID NO. 2388
gagagccaaaagcccggacgcaacccccctccctcctgctcgtgctcgcctcgcttcctcccattcccccacggccccacgctgaagctcttgacgctccgttcatcgatccagcgctccaggccgccgatcgggatggcgcgctgagccccgtgcggtgcgcgcgtctcggcgggcgcgatgctggcggcgtccaccagggtctgctctaggctcgcttctccgcacgcctcctcgctcgccgccgctgctgctgcggcggcggcgctggcgagctcccccgcgctgggctccgggatgagcggcctggagaggcagcccgctcctacggtttccgggatcggcgactctacggggaggagtcgcggggccgatgacccgccaccgcggccttgctgttcgtccggcgagtcgagggaaggatatcagtggggtagagtgccgtatcaaaggcagctgatgccacatcagcgcaaagtgactgctgaatctaaccatcatgtttctggtgcaagctgttcctcactgtatcagcagagttacagatatttttcatcctcttctgatcaggagaggatacgggctggaaacaagcttatacgtgatctaccaaggtatgtaaaaattgtggaagttgggccacgagatggactgcaaaatgaaaaggacactgtaccaacacctgtaaaggttgagcttatacggagactggctgcctctggattatctgttgttgaggcaactagtttcgtatctccgaaatgggtaccacagctagctgatgcaaaggatgtcatggaagcagttcagaatattgagggtgtatgtcttcctgtattgaccccaaatattaagggatttgaggcagctattgcagcaggggcaaaagaaattgcagtatttgcatcagcttctgaaggattttcaaagtcaaacataaattgcacaatcaaagagagtcttgcccgctataatgatgttgctcttgctgccaaagagaaagaaattcctgtccgagggtacgtctcttgtgtggttggatgcccagtagatggactagtaccaccgtcaaacgtagcttatgtagccaaagagctttatgacatgggctgctatgaggtttcacttggcgataccattggagttggtaccccaggcaccgtggttccaatgcttgaggctgccatgtccgttgttcctgtggagaagcttgctgtccatttccacgacacctacgggcaatctctttcaaacattctcatctctctccagatgggggtcagcgttgtggactcctccgtggccggccttggcggctgcccatatgcgaagggcgcgtcagggaacgtcgcaaccgaggacgtagtgtacatgctcaacgggttgggtatcaggacaggcgtcgacctgggcaaggtgatggctgccggcgagttcatctgcaagcacctgggacgccagtctggttccaaggccgcaaccgcactgaacaaggttactgcaaaagcctcaaaactctgaggcttgagaaatttaccaggatcctctgttccagataatagctgtaaaacgagcacaatattgtgaaataaacaatactgctgtgtcatgaggtgtctgttcaagacaaataaatactacagcaatgcttgtcaccggaggtggcatgtgccatcttcatctggtgatataagcacaagattgcgagtcatgtaagtcgagcaaatccaacaaatgtgaccactttcgccagaaaaaaaaaaaaaaaaaaaa

SEQ ID NO: 2388 - protein, 446 aa, Panicum virgatum
  misc_feature: Ceres CLONE 1780508
  misc_feature (143)..(439): SWISSPROT Homolog: EC 4.1.3.4 Hydroxymethylglutaryl-CoA lyase, mitochondrial precursor
  misc_feature (144)..(435): SWISSPROT Homolog: EC 4.1.3.4 Hydroxymethylglutaryl-CoA lyase
MLAASTRVCSRLASPHASSLAAAAAAAAALASSPALGSGMSGLERQPAPTVSGIGDSTGRSRGADDPPPRPCCSSGESREGYQWGRVPYQRQLMPHQRKVTAESNHHVSGASCSSLYQQSYRYFSSSSDQERIRAGNKLIRDLPRYVKIVEVGPRDGLQNEKDTVPTPVKVELIRRLAASGLSVVEATSFVSPKWVPQLADAKDVMEAVQNIEGVCLPVLTPNIKGFEAAIAAGAKEIAVFASASEGFSKSNINCTIKESLARYNDVALAAKEKEIPVRGYVSCVVGCPVDGLVPPSNVAYVAKELYDMGCYEVSLGDTIGVGTPGTVVPMLEAAMSVVPVEKLAVHFHDTYGQSLSNILISLQMGVSVVDSSVAGLGGCPYAKGASGNVATEDVVYMLNGLGIRTGVDLGKVMAAGEFICKHLGRQSGSKAATALNKVTAKASKL

SEQ ID NO: 2389 - DNA, 2552 bp, Panicum virgatum
  misc_feature: Ceres CLONE 1780510
  misc_feature: Encodes the peptide sequence at SEQ ID NO. 2390
agaaccaatcgccaattggaaaacgaaaagagccgcaccaccaacccacgttccagcagcctccacttgctcccccacgcctctcgccgccgggcgggctgccgcgcgtcggctccccgtcgccctccgcccgcggccgcgggcgtgccgcgcgggccccgctcgccaggcggccatgcgcgccaatcgcgcccgcttcctccgggtaacttcgcggtcaacctccccaccccaccccatggccgccaccacgccgacgaaagtcttagcatactcctctcccgcagcagcctccccccccctctccgcctcgccctctgcctctgtttattttaaatactcctagcgttggctaccgcggcagtggcagtgggagggaggaccacgtcgggcgccggaggagcgaggagtcgaggccgcggcgagatcgctctggtggtggtcgcgcgccggcggtacgcggcggcggttctcgtccgcggagatggaaagcacgctcaaggggatacggggctgcggcgcgcccggcgtgctggacgtggacgacgcggccaccgtgggcggcggcgtcgaggacacctacggcgaggactgcgccaccgaggaccagctcgtcacgccctggaccgtctccgtcgccagtggttacaatttgatgagggacccccgctacaacaagggcctcgccttcacagagagggagcgcgagacgcactacctccgtggccttctgccaccagcaatagtatcccaagagcttcaggagagaaagatcatgaacaatatcagacaataccaggtgcctttgcagcgttacatggctatgatggacttacaggagaacaatgagaggcttttctacaagctcctcatcgacaatgtcgaggaattacttcctgtagtgtacacaccaactgttggtgaggcttgccagaagtatggttccatatttagtcgtcctcagggtctttttatcagcttgaaggagaagggaaagatccttgaggtgctcaagaactggccagagaggagcattcaagttattgtagttactgatggtgaacggattttggggcttggagatcttggatgtcagggaatggggatccctgttggcaagcttgccctttacactgccctgggaggagttcgtccatctgcttgcttacctatcacactggatgttggcacgaataataaggacctgcttaatgacgaattttacattggcctgagacaaagaagggccactggccaggagtatactgattttctgcaagaatttatgaccgctgtgaagcaaaactatggagagaaagtactcattcagtttgaggattttgccaaccataatgcctttgagctccttgcaagatatggcacaactcaccttgtattcaatgatgatatccagggaaccgcttctgtggttcttgctgggctgattgcagcgcaaaagttacttggtggaacattggcagagcatactttcctcttcctgggtgctggagaggctgggacaggtattgcagaacttatagctctcgagatatcaagacagacaaaagctcctatagaggaatgtcgcaagaaaatctggcttgttgattcaaagggcttaattgtcagttcaagaaaggagtcccttcaacacttcaagaaaccatgggctcatgagcatgaaacaattggcaacctcttagatgctgtcaatgctatcaaaccaacggtgcttattggcacatctggaaaggggcaaactttcacacaggatgttattgaagccatttcctcatttaatgagaggccaattattcttgccctgtccaacccaacatcacagtctgaatgtactgctgaacaagcttacacatggagcaagggtcgagcagtatttgcaactgggagcccttttgacccagtggagtacgatggcaagatatatgttcccggacaggcaaacaatgcctatatcttcccagggtttggccttggtgtggtgatgtctggggcaattcgtgttcacgatgacatgcttctggcagcctcggaggctcttgctcagcaggtctcagaagagaactttgaaaaggggctcatctatcctcccttctcaaacatcaggaagatctccgcgcacattgcagccaacgttgcagcaaaggcatatgaacttggtttggcaagtaggcgccctcggccgaaggacctggtgaaatatgcagaaagctgcatgtacagccccgtttaccgcaactaccgctgaattcgaatcgattttagttatgtgcaaccatcagccattgcagaatcacaaaatttcctaagaacactactcgattcagatcctccatgctgtaattaggctgtctctagcagagcagctcacgtcctgttctccccctgtgtgttctgcagtgtttttactttgcgatgtgatgtgaaatgcctccggccaggcttttgtatcctagtcattgtgctactgccgtccttccggagaagggtaaatttggaataataaagtcggatcgacagttttctccctcggc

SEQ ID NO: 2390 - protein, 593 aa, Panicum virgatum
  misc_feature: Ceres CLONE 1780510
  misc_feature (1)..(254): Pfam Name: Malic_M Pfam Description: Malic enzyme, NAD binding domain
  misc_feature (1)..(593): SWISSPROT Homolog: EC 1.1.1.40 NADP-dependent malic enzyme
MESTLKGIRGCGAPGVLDVDDAATVGGGVEDTYGEDCATEDQLVTPWTVSVASGYNLMRDPRYNKGLAFTERERETHYLRGLLPPAIVSQELQERKIMNNIRQYQVPLQRYMAMMDLQENNERLFYKLLIDNVEELLPVVYTPTVGEACQKYGSIFSRPQGLFISLKEKGKILEVLKNWPERSIQVIVVTDGERILGLGDLGCQGMGIPVGKLALYTALGGVRPSACLPITLDVGTNNKDLLNDEFYIGLRQRRATGQEYTDFLQEFMTAVKQNYGEKVLIQFEDFANHNAFELLARYGTTHLVFNDDIQGTASVVLAGLIAAQKLLGGTLAEHTFLFLGAGEAGTGIAELIALEISRQTKAPIEECRKKIWLVDSKGLIVSSRKESLQHFKKPWAHEHETIGNLLDAVNAIKPTVLIGTSGKGQTFTQDVIEAISSFNERPIILALSNPTSQSECTAEQAYTWSKGRAVFATGSPFDPVEYDGKIYVPGQANNAYIFPGFGLGVVMSGAIRVHDDMLLAASEALAQQVSEENFEKGLIYPPFSNIRKISAHIAANVAAKAYELGLASRRPRPKDLVKYAESCMYSPVYRNYR

SEQ ID NO: 2391 - DNA, 1355 bp, Panicum virgatum
  misc_feature: Ceres CLONE 1780520
  misc_feature: Encodes the peptide sequence at SEQ ID NO. 2392
atcctcacatcacccacctccgcagagcttcacgcattgcacggggagcagaggaaaccatctcccagactcccagcggcagcggcggagaaagctagcgcccaaacccaatccacctagctagctagcgagataggcatggcgcgctgggccattgcgatccacggcggcgcgggcgtggacccgaacctgccggagagctgccaggaggaggccaagcgcgtgctggcgcggtgcctgcaggccggcgtggacatgctgcgcgcgggggcctcggcgctcgacgtcgtcgaggccgtggtgcgcgagctcgagaccgaccccttcttcaactccggccgcggctccgcgctcacccgccgcggcaccgtcgagatggaggccagcatcatggacggccgcggccgccgctgcggcgccgtgtccggcgtctccaccgtcaagaaccccgtctccctggcgcgccgcgtcatggacaagtcgccgcactcgtacctcgccttcgacggcgccgaggagttcgcccgcgagcagggccttgagaccgtggacaacagctacttcatcaccgaggacaacgtcggcatgctcaagctcgccaaggaggccggcagcatcctgttcgactaccggatcccgctggccgggacggacacgtgcagcgcgctggccggggcggacaaccacaagggcatggtgatgaacggcctccccatcagcatctacgcgccggagacggtggggtgcgcggcggttgactcgagcggcttcaccgcggcggccacctccacgggcgggctcatgaacaagatgacgggccgcatcggcgactcgccgctcatcggctccggcacctacgcctgcggcgcctgcgccgtgtcgtgcacgggggagggcgaggccatcatccgctccacgctggcgcgggacgtggccgccgtcatggagtacaaggacctgccgctgcaggagaccgtcgactactgcgtcaaggagcgcctcgacgagggcttcgcgggcctcatcgccgtctccagcaccggcgaggtcgcctacgggttcaactgcaccggcatgttcaggggatgcgccaccgaggacggcttcatggaggtcggcatctgggagtgagccagcggagcggagcggagctgggcgtgcgtgcacacgtggccatcttgcgattgccacgtgggtaatcctccttctcagtcagggtcgtgggtattgtggcttgctttagtcgtagtgattggagatgggatgaataatgatgatcgtgattgtgatggtgatggttattgccctgtgaaataaaattgtgaaaagttatacaaaaaaaaaaaaaaaaaaaa

SEQ ID NO: 2392 - protein, 330 aa, Panicum virgatum
  misc_feature: Ceres CLONE 1780520
  misc_feature (1)..(332): Pfam Name: Asparaginase_2 Pfam Description: Asparaginase
  misc_feature (1)..(174): SWISSPROT Homolog: EC 3.5.1.1 L-asparaginase 1 precursor
  misc_feature (1)..(329): SWISSPROT Homolog: EC 3.5.1.1 L-asparaginase precursor
MARWAIAIHGGAGVDPNLPESCQEEAKRVLARCLQAGVDMLRAGASALDVVEAVVRELETDPFFNSGRGSALTRRGTVEMEASIMDGRGRRCGAVSGVSTVKNPVSLARRVMDKSPHSYLAFDGAEEFAREQGLETVDNSYFITEDNVGMLKLAKEAGSILFDYRIPLAGTDTCSALAGADNHKGMVMNGLPISIYAPETVGCAAVDSSGFTAAATSTGGLMNKMTGRIGDSPLIGSGTYACGACAVSCTGEGEAIIRSTLARDVAAVMEYKDLPLQETVDYCVKERLDEGFAGLIAVSSTGEVAYGFNCTGMFRGCATEDGFMEVGIWE

SEQ ID NO: 2393 - DNA, 2056 bp, Panicum virgatum
  misc_feature: Ceres CLONE 1780525
  misc_feature: Encodes the peptide sequence at SEQ ID NO. 2394
accaaccactcgtcaccccgccgcgcgccatctcccctgcggctgcgacctgcgactacgagacatggcggcgcaaacttcggcggcctccactcttgccttcgggcgccacaaaaccctagccgccgccgccgccgcggggcccaaacccctgccggccccgggctccgtctccttcccggccgcccagccggcgtgcctcctctccgcgtccgccgcccgccgccgggatgtctccgccatggtctcggcgccgccggccgtcggcaccgccatgccgtcgctcgacttcgagacctccgtcttcaggaaggagaaggtctcgctcgccggccacgaggagtatattgtcaggggcgggaggaacctgttcccgctgctcccggaggcgttcaagggggtaaagcagatcggagtgattggatggggctcgcagggtcctgcacaagctcagaacctgagagattcactggccgaagcaaagtcagacattgttgtgaagattggtctccggaaaggttccaaatcttttgaggaagcacgtgctgctggattcactgaagagagtggaactttgggtgatatttgggagactgtttcaggcagcgatcttgtgttgctgttgatatcagatgctgcacaggctgacaactatgagaagattttctctcacatgaaaccgaatagcattcttggtttatctcatggatttctgctgggacatttgcaatcgcttggacttgatttcccaaagaacatcagtgtgattgctgtatgccccaagggaatgggtccatccgtccgtaggctttatgttcaaggcaaggaagtaaatggtgctggaatcaactctagctttgccgtgcatcaggatgttgatggaagggcaactgatgttgctctagcatggtcagttgcacttggctctcccttcacatttgccaccactttagaacaggagtacaagagcgatatcttcggagagcgaggcattttgctgggtgctgttcatggtatcgtggaggccttgtttaggaggtacacagaacaaggaatggatgaagagtcagcctacaaaaacactgttgagggcatcactgggattatctcgaaaaccatctcaaagaaggggatgcttgaagtctacaactctttgagcgaggaaggcaagaaggagttcaacaaggcttacagtgcctcattttatccttgcatggatatactctacgagtgctatgaagatgtggcctctggaagtgaaatccggagtgttgtgctggctgggcggaggttttatgagaaagagggactaccagcgtttccaatgggcaacattgatcaaactcgcatgtggaaggttggtgaaaaggtgcgctcgacccgtccagagggcgatcttggcccgctgcatcccttcactgctggagtgtacattgctctgatgatggctcagattgagatcctgaggaagaaggggcactcctactcagagatcatcaacgagagcgtgatcgagtcggtggactcgttgaaccccttcatgcacgcccgtggggtggcctttatggtggacaactgctccacaacggctcgcctgggatcaaggaagtgggcgccgcgcttcgactacatcctgacgcagcaggccttcgtgacggtggacaaggacgccccgatcaaccaggaccttattagcaacttcatgtccgaccccgtccatggtgccatcgaggtctgcgccgagctgaggcccaccgtcgacatctcagtgcctgccaatgctgattttgtgcgcccggagctccggcagtctaactagatggaggtggtgagctcagagagaaagtgggagtttgcctccggggttggtgttgtatgtgttgagcttgagccactgcttgaaagtatgaacctgtgtgagctgctggacctgaggaagcttaggtatctgtttcccgaataaacccttcatcgaatagcttgggagtgtatctgtgaaacagtgaaagtgtggagtgaataagtgattgcttcgcaaaaaaaaaaaaaaaaaaaa

SEQ ID NO: 2394 - protein, 584 aa, Panicum virgatum
  misc_feature: Ceres CLONE 1780525
  misc_feature (1)..(584): SWISSPROT Homolog: EC 1.1.1.86 Ketol-acid reductoisomerase, chloroplast precursor
MAAQTSAASTLAFGRHKTLAAAAAAGPKPLPAPGSVSFPAAQPACLLSASAARRRDVSAMVSAPPAVGTAMPSLDFETSVFRKEKVSLAGHEEYIVRGGRNLFPLLPEAFKGVKQIGVIGWGSQGPAQAQNLRDSLAEAKSDIVVKIGLRKGSKSFEEARAAGFTEESGTLGDIWETVSGSDLVLLLISDAAQADNYEKIFSHMKPNSILGLSHGFLLGHLQSLGLDFPKNISVIAVCPKGMGPSVRRLYVQGKEVNGAGINSSFAVHQDVDGRATDVALAWSVALGSPFTFATTLEQEYKSDIFGERGILLGAVHGIVEALFRRYTEQGMDEESAYKNTVEGITGIISKTISKKGMLEVYNSLSEEGKKEFNKAYSASFYPCMDILYECYEDVASGSEIRSVVLAGRRFYEKEGLPAFPMGNIDQTRMWKVGEKVRSTRPEGDLGPLHPFTAGVYIALMMAQIEILRKKGHSYSEIINESVIESVDSLNPFMHARGVAFMVDNCSTTARLGSRKWAPRFDYILTQQAFVTVDKDAPINQDLISNFMSDPVHGAIEVCAELRPTVDISVPANADFVRPELRQSN

SEQ ID NO: 2395 - DNA, 1695 bp, Panicum virgatum
  misc_feature: Ceres CLONE 1780527
  misc_feature: Encodes the peptide sequence at SEQ ID NO. 2396
aaccaaccatggaagctgcagaaagcaagcaagcaagcagcagccgtcgccggaggttgcctgtcgattccatttcttctctgcaacatcaactccacgtttggctttccatcgatttgctttttctctctcgcgcgcgcgcaggggccgggcattagcagctctactctgccaatggaagacgcggagcttccgatccaacatggcggcacgctatctgctgaggaccaaaagaagccactgtccgtgacgagctgcctgctgccagcatgcagcctgagatccacagcagcggttgcccctgctgctcatgctgaaagccaagccgccggcgatctctgcatccggtcattgtccttctccaagctcttgagcttcagaatggccagggcgccgtcatcactgtccacctcggagtacattgatcaaattgatcctgaaactccaggtaacagcagcaccaccaaggaggaggaggagaagctgaagcagatatgccgctcccagtccgtgcctacgagcggcaggctgttcaaggtggcaaaagggttgaggagagtaacggactccagctccctcggccctgccccggctggagtgttccgcctcagattggtgccacttgttcctcaaacggaggcaagcgccactgctgcagccggggaggaggaagcgtcggcagaagacattgcggcggaggaagcggtgtgccgcatctgcatggtggcgctgtcggaagaggcggtgctcaagctggagtgctgctgcaagggtgaactggccctggcgcacaggggatgcgccatcaagtggttcagcatcaagggcaacggcacctgcgacgtctgcagccaggaggtgctcaacctccccgtcaccctgcgccgcctccatcaccatccatccattcaggctcagcatcaagccgatcccaccaccacggccaccagcagccgtcgctacagagtgtggcacggcacaccgatcctcgtgattatcagcatgctcgcctacttctgcttcctggaacagctgctggtcggcgaccatgggaccgcggctctggccatctctttacccttcgcctgcgccctcggcctcttctcctctctcaccacaacaaagatggtgtccaggagatatgtgtggatctactctgcagtgcagttcctcttcattgtgctcttcacccacctcttctacagatacgtgcggatgcaagctgtgatcgccatcatcctgtccaccttcgccggcttcagcatggccatctgcaccaactctgtcctcctccagattctcagatggagggccaggcatgtggcatcgccaaccacaaccacaactggagaaggaggtcatagttccagggaaccaccgtcagcagaccttgagattgctttgcctccttcgtagctcgcttcactaccatccaatcctctccagtttagttcaatccagcaccagctccccctccagctagctgtgtttgtatatagcttcatcctttgtttgctgagaccttcttgtatgcatgaaccgtcctttctggctttctatcattctatggtactaatccgtgacagtgagcatccacatccctcttttcccaaaactgaaacaaaagtaaatacatcaaaacaaacatataaaggaaaggatttgctttttattcaaaaaaaaaaaaaaaaaaaa

SEQ ID NO: 2396 - protein, 413 aa, Panicum virgatum
  misc_feature: Ceres CLONE 1780527
  misc_feature (1)..(48): Pfam Name: zf-C3HC4 Pfam Description: Zinc finger, C3HC4 type (RING finger)
MEDAELPIQHGGTLSAEDQKKPLSVTSCLLPACSLRSTAAVAPAAHAESQAAGDLCIRSLSFSKLLSFRMARAPSSLSTSEYIDQIDPETPGNSSTTKEEEEKLKQICRSQSVPTSGRLFKVAKGLRRVTDSSSLGPAPAGVFRLRLVPLVPQTEASATAAAGEEEASAEDIAAEEAVCRICMVALSEEAVLKLECCCKGELALAHRGCAIKWFSIKGNGTCDVCSQEVLNLPVTLRRLHHHPSIQAQHQADPTTTATSSRRYRVWHGTPILVIISMLAYFCFLEQLLVGDHGTAALAISLPFACALGLFSSLTTTKMVSRRYVWIYSAVQFLFIVLFTHLFYRYVRMQAVIAIILSTFAGFSMAICTNSVLLQILRWRARHVASPTTTTTGEGGHSSREPPSADLEIALPPS

SEQ ID NO: 2397 - DNA, 1677 bp, Panicum virgatum
  misc_feature: Ceres CLONE 1780542
  misc_feature: Encodes the peptide sequence at SEQ ID NO. 2398
acggccgccattgcccacaggagaaggacgaggaaaggtagtaaccaccttgttgcgttggcagttggcaccaaggccagcccaacagcaaaaggaggggagaagggatggcgtcctgcgcaaaccagctgcagctgcccaccgcttctctccacgctcttcgtcgtcaagcgggcagggtggttatcccgccgcctcgtccgcgtcgccgcccccggagtgccgccgccgccgccgccgccatggactccggcggccccagcccggtcgtgctcgggtgcggcgccatcaacgtggactacctggccacggtggcgtccttccccaaccccgacgacaagatccgcagcctcgagctcaaggtccagggcggcggcaacacgggcaacgcgctcaccgcagctgcgcgactcggcctccgccccaggatcatttccaaggtagccaacgatgctcaaggaaggaacatcctcagcgagctccaagctgatggcatcgacacatcctacattctggtcgcagaggacgggaattcacccttcacctacatcatcgttgatcaacagacgaaaactcgtacttgtatacacactcctggttctccacccttggtgccagaagagctcacgaaggcaaacttgtcttctgctttagatggagcagacatcgtctactttgatgtacgattgcatgacactgctttgcttgttgcagaaaaggcaagtcaaagaaaaatccctattttgattgatgccgaaagaaagagggagggtttggacgagcttcttaattttgcatcctatgttgtatgctctgcaaagtttcctcaggcctggacaggagcttcatcactaccggttgctttagtgtccatgctttcaagactacctaaaatcaaatttgttattgtaactctgggggagaaaggttgcttgatgcttgagagaagcatgacagatgcttctgaggcaggggaaatagatgcagaggctttactggaatcactacagaagaaagttgaccagagttctactataccgaaatgcattgcttccaagtcgaatttgagaataagcgtggatggagtaggctcgataagtggcaggttacttctaggtacagctgaagttataccacctggagagctcatagatacaactggcgcaggagatgcattcattggagcagttctgtacggtttatgcaccggcatgccaccagagaggatgctgccttttgcagcacaagtggctggttgcggttgcagaggtttgggagctcgcagcagccttcctcatcgcacggacccacacctggctggctattgatcagaattgggcagaacttccgaattaggcagattttcatcctccatgaccacctgcctcattccatcccatggctctagatatttccaaatccaatccagttcagtaataaaagtaaaactgataagaagcacctgtaactagagcgtatcatgattatcatgggggcttgtcatgttcaacgcccctgaaaacctgaggtttatttcttttgttttcgcaaggaccgatatttgtgcgaaagtgaatgtaactacattggtcgagcacgagtccaatttgtacccaatttctacttgaagaaaatacatgctcatgcagtttcagtcaaaaaaaaaaaaaaaaaaaa

SEQ ID NO: 2398 - protein, 406 aa, Panicum virgatum
  misc_feature: Ceres CLONE 1780542
  misc_feature (2)..(347): Pfam Name: PfkB Pfam Description: pfkB family carbohydrate kinase
MASCANQLQLPTASLHALRRQAGRVVIPPPRPRRRPRSAAAAAAAMDSGGPSPVVLGCGAINVDYLATVASFPNPDDKIRSLELKVQGGGNTGNALTAAARLGLRPRIISKVANDAQGRNILSELQADGIDTSYILVAEDGNSPFTYIIVDQQTKTRTCIHTPGSPPLVPEELTKANLSSALDGADIVYFDVRLHDTALLVAEKASQRKIPILIDAERKREGLDELLNFASYVVCSAKFPQAWTGASSLPVALVSMLSRLPKIKFVIVTLGEKGCLMLERSMTDASEAGEIDAEALLESLQKKVDQSSTIPKCIASKSNLRISVDGVGSISGRLLLGTAEVIPPGELIDTTGAGDAFIGAVLYGLCTGMPPERMLPFAAQVAGCGCRGLGARSSLPHRTDPHLAGY

SEQ ID NO: 2399 - DNA, 1580 bp, Panicum virgatum
  misc_feature: Ceres CLONE 1780550
  misc_feature: Encodes the peptide sequence at SEQ ID NO. 2400
aggctccaagctcccgcaacatctccacacaagcccgagccccgagagaggtagagcagagcaggggagagtagtagtcggcggcgcgcggtggacatggcgggcttcaaggtgacgcggatctcggagggcccggtgaagccggcgacggcgaccccggaggagacgctgccgctggcgtgggtggaccggtacccgacccaccggggcctggtggagtcgatgcacatcttccggtcgggcgcggacgcggcccccggcatgatccgggaggcgctgggcaaggcgctggccttcttctacccgctggcggggcgcatcgtggagggcgcggagccggggtgccccgccatccgctgcaccgccgacggcgtctacttcgcggaggccgaggcggactgcagcctcgaggacgtgcggttcctggagcgcccgctgctgctgcccaaggaggacctcgtcccctaccccggcgacgaccgctggggcgtcgagccgcacaacaccatcatgatgatgcagatcaccaagttcacctgcggcgggttcgtgatggggctccggttcaaccacgcgtcggcggacggcatgggcgccgcgcagttcatcaacgccgtcggcgacatggcgcgggggctcgcggagcccaaggtgaagcccgtctgggacagggagaagttccccaaccccaagatcaagcccggcccgctcccggagctccccgtgctggcgctggactacatcgtcctcgacttccccaccggctacatcgacggcctcaagaagcagtacaaggagcacagcggcaagttctgctcgggcttcgacgtgctcacggccaagctctggcagtgccgcacccgcgctctgaacctggagcccaacgccgaggtcaagctctgcttcttcgccagcgtccggcacctgctcaagctcgacaggggatactacggcaactccatcttcccggtgaagatgtccgcgccggctgagaaggtgctcggctcgtccatcatggaggtcgtggacatgatccggcaggccaaggacaggatggccgtggagttcttccagttcgccaaggaggagaccgaccaggacccgttccagatgaccttcaactacgagtccatctacgtgtcagactggagcaagctcgggttctcggaggtggactacggcttcgggccgccagtgttcgccggcccgctggtgaacaacgacttcatcgcctccgtcgtcatccttaaggcgccgctgccgctcgacggcacgcggatgctcgccagctgcgtcaccaaggagcattccgaagagttcgttcgtggcatgaaggcagacctgccatgaatttctttccttttatagctgaaatggcaaaactcaactgcagggagatgaatggtcacgcaaaagatgcctctgtttggttaatgctgttgttacttttggttgtatttatttatcatattgtcttggttaatactactttagacagcaaattcgatcatttgtaccatttgatatgagacaataaaaggttatactgtcaatttgatcaaaaaaaaaaaaaaaaaaaa

SEQ ID NO: 2400 - protein, 417 aa, Panicum virgatum
  misc_feature: Ceres CLONE 1780550
  misc_feature (1)..(411): Pfam Name: Transferase Pfam Description: Transferase family
MAGFKVTRISEGPVKPATATPEETLPLAWVDRYPTHRGLVESMHIFRSGADAAPGMIREALGKALAFFYPLAGRIVEGAEPGCPAIRCTADGVYFAEAEADCSLEDVRFLERPLLLPKEDLVPYPGDDRWGVEPHNTIMMMQITKFTCGGFVMGLRFNHASADGMGAAQFINAVGDMARGLAEPKVKPVWDREKFPNPKIKPGPLPELPVLALDYIVLDFPTGYIDGLKKQYKEHSGKFCSGFDVLTAKLWQCRTRALNLEPNAEVKLCFFASVRHLLKLDRGYYGNSIFPVKMSAPAEKVLGSSIMEVVDMIRQAKDRMAVEFFQFAKEETDQDPFQMTFNYESIYVSDWSKLGFSEVDYGFGPPVFAGPLVNNDFIASVVILKAPLPLDGTRMLASCVTKEHSEEFVRGMKADLP

SEQ ID NO: 2401 - DNA, 2500 bp, Panicum virgatum
  misc_feature: Ceres CLONE 1780564
  misc_feature: Encodes the peptide sequence at SEQ ID NO. 2402
gtctctggtagaacgttccagaacccctcctctcccctctcccaataaaatccccccaccccacgaccctcccccgtctcatcccacgcttcctcgcgctccccacaaaccctcctcgcctcctccctcgcgccgccgccgcctctctcctagcgttcgggaagggcctcgccatggcctcggagacggagacgttcgccttccaggcggagatcaaccagctgctctccctcatcatcaacaccttctactccaacaaggagatcttcctcagggagctcatctccaactcctccgatgccttggacaagatcaggtttgagagcttgacggacaagagcaagctggatgcccagccagagctgttcatccacattgttcctgacaaggccacaaacacactgacaatcattgacagtggtattggtatgaccaagtcagatctcgtgaacaaccttggtaccattgcacggtcaggcacaaaggagttcatggaggctttggctgctggtgctgatgtttctatgattggtcagtttggtgttggtttctactctgcataccttgttgctgagagagtagttgtgaccaccaagcacaacgatgatgagcagtacgtgtgggagtctcaggctggtggctccttcactgtcaagcgtgatacctctggggagccccttggcaggggtactaagatgaccctctacctcaaggatgatcagttggagtaccttgaggagcgtcgcctcaaggatctgatcaagaagcattctgagttcatcagctacccaatctctctctggacagagaagactactgagaaggagatttctgatgatgaggatgaggaagataagaaggatgaggagggcaaggttgaggatgttgatgaggagaaggaagagaaggagaagaaaaagaagaagatcaaggaggtttctcatgagtggcagttggtcaacaagcagaagcctatttggatgaggaagcctgaggagattaccaaggaagagtatgctgctttctacaagagcttgaccaatgactgggaggagcatcttgctgtgaagcacttctctgttgagggtcagcttgagttcaaggctgtcctctttgtacccaagagggctccgtttgacctctttgacaataggaagaagctgaacaacatcaagctctatgtccgccgtgtcttcatcatggacaactgtgaggagctgatcccagagtggctgagctttgtcaagggcattgttgactctgaggaccttcccctcaacatctcccgtgagaccctccagcagaacaagatcctcaaggtcatccgcaagaacctggtcaagaagtgcattgagctcttctttgagatcgctgagaacaaggaggattacaacaagttctatgaggccttctccaagaacctcaagcttggcatccacgaggactcccagaacaggaacaagattgctgagctcctgaggtaccactccaccaagagtggtgatgagctgactagcctcaaggactatgtgaccaggatgaaggagggccagagtgacatctactacatcactggtgagagcaagaaggctgtggagaactcccccttccttgagaagctgaagaagaagggctatgaagtcctgtacatggtggatgccattgatgaatatgccattggtcagctgaaggagttcgaaggcaagaagcttgtctctgccaccaaggagggcctgaagctcgatgagagcgaggatgagaagaagaggaaggaggagctcaaggaaaagttcgagggcctctgcaaggtgatcaaggaggtgctgggtgacaaggttgagaaggttgttgtctctgaccgtgtggtggactccccctgctgtcttgtcactggtgagtatggctggaccgccaacatggagaggatcatgaaggcccaggctctgagggactccagcatgtccggatacatgtcctccaagaagaccatggagatcaaccctgagaatgccatcatggaggagctccggaagcgtgctgaggctgacaagaatgacaagtctgtcaaggaccttgtcatgctgctgttcgagactgcgctcctcacctctggcttcagcctcgacgaccccaacaccttcggcagccgcatccaccgcatgctcaagctgggcctgagcatcgacgaggacgagactccggaggctgacacagacatgcccccgctggaggacgacgctggcgagagcaagatggaggaggtcgactaagcgctgcgcggtggttttttacgtttgaagttgagttagcttagctattcgggttgccagtctctgaacctctagttgtcggtttattttgtgtggtgttacttttggtcgcctgcaatgcatgtggctaaatgctgtggtgccgtggattatcgaactgcttatgtgaatcgtcggtggtataatagtattattatcctgctgtcttccaaaaaaaaaaaaaaaaaaaa

SEQ ID NO: 2402 - protein, 698 aa, Panicum virgatum
  misc_feature: Ceres CLONE 1780564
  misc_feature (1)..(529): Pfam Name: HSP90 Pfam Description: Hsp90 protein
MASETETFAFQAEINQLLSLIINTFYSNKEIFLRELISNSSDALDKIRFESLTDKSKLDAQPELFIHIVPDKATNTLTIIDSGIGMTKSDLVNNLGTIARSGTKEFMEALAAGADVSMIGQFGVGFYSAYLVAERVVVTTKHNDDEQYVWESQAGGSFTVKRDTSGEPLGRGTKMTLYLKDDQLEYLEERRLKDLIKKHSEFISYPISLWTEKTTEKEISDDEDEEDKKDEEGKVEDVDEEKEEKEKKKKKIKEVSHEWQLVNKQKPIWMRKPEEITKEEYAAFYKSLTNDWEEHLAVKHFSVEGQLEFKAVLFVPKRAPFDLFDNRKKLNNIKLYVRRVFIMDNCEELIPEWLSFVKGIVDSEDLPLNISRETLQQNKILKVIRKNLVKKCIELFFEIAENKEDYNKFYEAFSKNLKLGIHEDSQNRNKIAELLRYHSTKSGDELTSLKDYVTRMKEGQSDIYYITGESKKAVENSPFLEKLKKKGYEVLYMVDAIDEYAIGQLKEFEGKKLVSATKEGLKLDESEDEKKRKEELKEKFEGLCKVIKEVLGDKVEKVVVSDRVVDSPCCLVTGEYGWTANMERIMKAQALRDSSMSGYMSSKKTMEINPENAIMEELRKRAEADKNDKSVKDLVMLLFETALLTSGFSLDDPNTFGSRIHRMLKLGLSIDEDETPEADTDMPPLEDDAGESKMEEVD

SEQ ID NO: 2403 - DNA, 2434 bp, Panicum virgatum
  misc_feature: Ceres CLONE 1780571
  misc_feature: Encodes the peptide sequence at SEQ ID NO. 2404
aaccgagagcgagcgagcgaatccaaccgagcccgcccatccatttctcccttcctccccattcccctactccaatccttcctccgcacgccgagccctccccctccgcttccctaatccgcacgggcgcctcgccaccctaccccgattgctacctcctcgtggtgggcgccgctccgatccgcccgatccgcgctgctcctggggctccggcgcgcggcggcgagcggcgggggcggcgcagggatggactccgaggacgacatgcacgacgcgaacgactctgccgacgatgacttctacagcggcggggaggccgggctccccggcagcgacgacggggacgccgactacgacttcgccgaccacgactccgacgactccggggagctcctctcccaccggcagcagcaaaattacagcatactcagtgaagttgatatcaagcagcgccaagaagatgacataaatagggtttcaactgttctttcaatttctaagtcagaagcatgtgttcttcttcgcaactataactggagtgttagtaaggtgcatgacgaatggttcgccgatgaagagtgtgttcgtaagattgttggcttaccagagaagcacatggaactgccaaatgacagagaagtgacatgtggaatatgttttgaaagttgccctcgtggcatgatgagtgctgctgtatgtggtcatcctttctgcagtacatgttggagaggttacattagcactgctataaatgatggtccagggtgtttgatgttgaggtgtcctgatccatcctgtgctgctgctgttggacaagatatgataaatgcactggctgatgatgaggataaggaaaagtatgggagatatcttcgcagatcttacattgaagataacagaaagacaaaatggtgtcctgctcctggatgtgaatatgcagtggaattcgtcatgggcagtggcagctatgatgtcaattgtaattgttcatatggattttgttggaattgcactgaggaagctcatcgtccagtagactgtgcaactgtttcaaagtggatcctcaagaacagtgctgaatcagaggatatgaactggatactggctaattcaaagccttgtcctaaatgcaagcgacctattgaaaaaaatcagggatgcatgcacatcacatgcactcctccatgcaaatttgagttctgctggctgtgtcttggtccatggtcggagcatggagagagaactggtggattttatgcttgtaaccgctatgagtcagcaaggcaagaaggagcgtatgatgaatctgaaaggagaagagaaatggccaagaactcccttgagagatatacacattattatgaacgatgggcagccaatcaatcttcaaggcaaaaagcgttgggagatcttcaaagtctgcagaatgacaagcttgaaaagttgagtgacatacaaagccaacctgagtcacagctgaagttcatcatagaggcatggttacagattgtcgaatgtagaagggtattgaagtggacttatgcctatggattttacctgccagagcatgagcatgccaaaagacagttcttcgaatatctgcaaggcgaggcagaatccggtttggagcggttgcatcaatgtgcagagaaagaacttcaagtataccttgaagccgaatctccctcaaaagatttcaatgatttccgtacaaagctagctggattaactagtgtgactcgcaattattttgaaaatcttgtccgggctttggaaactggattaaatgatgtgggtccttccactagccatggcacatgcagcagaagtgcaacttccaagagtcttggtggtaaaagtaagagtggcaagaacagggcatcaagcaccagctccaaatctggtggctcaaacagaggtttggatgacagcaacatttggatatgcgatcagtgcacatttgcaaaccctaaatcagccagagcctgccaggcctgtgatcgccaacatcgatagctctagtcagtgctcatttgagttttggactattcatttgcaatccctcaggtgttactccgtgatgcgcaatatacatgaaatttaagagttaacctatatctggggctagcgaggaggtatcagtaggaggattgcggacacagttaagaaagtagattttcgtgtatcctctattgtttgtcgtctgacagcacccgtgaagcctcaagccctcaactcatcatccagatcgatttgtatatataagtataatatttgtaacaatgttttgttttgtggaagtggagggggcccaggaggtgctcgccgccaaatgagctgaattgtgtagtgctgttgtaatgtaataatgctctgaccaatttaaaagaaatttagtcttgttaagaggggacaaaaaaaaaaaaaaaaaaaa

SEQ ID NO: 2404 - protein, 589 aa, Panicum virgatum
  misc_feature: Ceres CLONE 1780571
  misc_feature: The sequence is a functional homolog of  SEQ ID NO 546 in the  11/435,388 US patent application
  misc_feature: Useful for making plants with modulated growth and phenotype characteristics
MDSEDDMHDANDSADDDFYSGGEAGLPGSDDGDADYDFADHDSDDSGELLSHRQQQNYSILSEVDIKQRQEDDINRVSTVLSISKSEACVLLRNYNWSVSKVHDEWFADEECVRKIVGLPEKHMELPNDREVTCGICFESCPRGMMSAAVCGHPFCSTCWRGYISTAINDGPGCLMLRCPDPSCAAAVGQDMINALADDEDKEKYGRYLRRSYIEDNRKTKWCPAPGCEYAVEFVMGSGSYDVNCNCSYGFCWNCTEEAHRPVDCATVSKWILKNSAESEDMNWILANSKPCPKCKRPIEKNQGCMHITCTPPCKFEFCWLCLGPWSEHGERTGGFYACNRYESARQEGAYDESERRREMAKNSLERYTHYYERWAANQSSRQKALGDLQSLQNDKLEKLSDIQSQPESQLKFIIEAWLQIVECRRVLKWTYAYGFYLPEHEHAKRQFFEYLQGEAESGLERLHQCAEKELQVYLEAESPSKDFNDFRTKLAGLTSVTRNYFENLVRALETGLNDVGPSTSHGTCSRSATSKSLGGKSKSGKNRASSTSSKSGGSNRGLDDSNIWICDQCTFANPKSARACQACDRQHR

SEQ ID NO: 2405 - DNA, 1587 bp, Panicum virgatum
  misc_feature: Ceres CLONE 1780573
  misc_feature: Encodes the peptide sequence at SEQ ID NO. 2406
aacgccgttcgacggactccgtgcaccaggcagcgaagacacctcccgatctggggccacctgcagtgacacggctcgccgtggacggagcgcttcttctgtctcccggacctcctcttctcctaatctcctctccccagcctctccctgcataaagccgagcctcccttccagcggcttcccactccaccaagagccgccagttcgacaaaccccggccccgcagcaaggatttctgcgccgaatcccttcgtgacccaatgggagaggcctcgccgtcgatcgccagggatgttaccgagttgatcgggaacacgccgctggtgtacctcaacaaggtgacagatgggtgcgtcggccgcgtcgccgccaagctcgagtccatggagccctgctccagcgtcaaggataggattggctacagcatgatcactgacgcagaggagaagggcctgatcactccaggcatgagtgtgttgattgaaccaactagcggcaacacaggaattggactggcctttatggctgctgccaagggttacaaacttatactcacgatgcctgcttccatgagcatggagaggagaatcatactgaaggcttttggtgctgaactggtccttactgaccctctcctgggaatgaaaggagctgtcaaaaaggcggaggagattcaagcaaagacacccaactcgtacatccttcaacaatttgaaaatcctgctaacccaaagattcattatgagactacagggcctgaaatctggaaagctacatcaggaaagattgatgcccttgtatctggtattgggacaggaggtaccataactggaactggtcgatacctcagagaacaaaatcctaatgtcaagctctatggtgtggagccagtagagagtgctgttttaaatggtggaaaacctgggccacacaagattcaaggaatcggagctggttttattcctggggtcttggatgttgacctcattgatgaaactctacaagtttcaaacgatgaagctattgagactgcaaaggttcttgctttgaaagaaggattgttggttggaatctcttctggtgctgctgcggctgcagccgttagacttgctaagaggcctgaaaatgctggaaagctatttgttgtcgtcttcccaagctttggtgagcgctacctgtcatcagtgcttttccagtccatcaagaaggaagcagagagcatggtggtcgagccctagagggctatagcctagagtacacaattccaacagctattttgggagggggtctccatttctacagaaataaagctttggtgccctttcgcatttgctaatcaaagcatacatctctcagtcgatgtccagttcggtcttatccgtgttcattgaagaataacatcgtttgggacttctctttacagttcgacattctctcttttctgtatatcgtatcaaccagtgtgaaataaagcgtcacagtgtgtttcatgcctggatccttattgaagatttctcttggaaatcctgcaaaaatgaactagtgtatatgacgtgccaaattgtcgaaaaaaaaaaaaaaaaaaaa

SEQ ID NO: 2406 - protein, 325 aa, Panicum virgatum
  misc_feature: Ceres CLONE 1780573
  misc_feature (1)..(324): SWISSPROT Homolog: EC 2.5.1.47 Cysteine synthase
  misc_feature (1)..(325): SWISSPROT Homolog: EC 2.5.1.47 Cysteine synthase
MGEASPSIARDVTELIGNTPLVYLNKVTDGCVGRVAAKLESMEPCSSVKDRIGYSMITDAEEKGLITPGMSVLIEPTSGNTGIGLAFMAAAKGYKLILTMPASMSMERRIILKAFGAELVLTDPLLGMKGAVKKAEEIQAKTPNSYILQQFENPANPKIHYETTGPEIWKATSGKIDALVSGIGTGGTITGTGRYLREQNPNVKLYGVEPVESAVLNGGKPGPHKIQGIGAGFIPGVLDVDLIDETLQVSNDEAIETAKVLALKEGLLVGISSGAAAAAAVRLAKRPENAGKLFVVVFPSFGERYLSSVLFQSIKKEAESMVVEP

SEQ ID NO: 2407 - DNA, 2462 bp, Panicum virgatum
  misc_feature: Ceres CLONE 1780586
  misc_feature: Encodes the peptide sequence at SEQ ID NO. 2408
gggttgattctctctctttcttcccgcagagaggatcaggaaacggcagaggagatagaggaaaagaagagaaatacgaaagagttttctctctaggattgcggttcttgcgagttagaaactctggccagtttctggtcctttcagccattactggaaagagcaaccatctgggctctgaaatactacagccacagatcaattgagatctcgctgctgtagttggaccgcaatgcaagggcagaggaattctatggagcattttactgatgtttttggattcgacattggatctagttcaggcaacccagtcatcgatcagcaggcatattggaacaatgttcttggatcggtagaatcacagaatcttcaaggctatcagatgaatcacagtgatgccaccatcccatatggaaatgaaccacagcaagatggtacatttcttggtttctgggaatcaggagaagcaagttcaagtggcagtgcactaaactatggcagctctagcaatgttaaaactgagcatcttaacataggcggtggcctgaggattggtgaaaggcgactggtagctgacaatgacctttctctggatgtggatatcaacctcaatgccaatgctaatgatctacgcggtcaaagttcaaatgttaactgtgcctctcaaggtcctgagcagtacagtggccgtgaccgtaatggtataaatgctcagccatcggacctgagattacatccatataggacattcctactaggtgcagaggaaacagactcttttactttgaaccctagtgaaaatcctttgggtgatttttcattaatgcaagaaggcattcatcaaagaccagggggttccctggacggtcgccggctagcgtgcaagagaaaaaatatcgaaggagccaatggacagagttcagcgggtgctagcacaattttttcccacaggaacgataatgccttccataacattgcttcttcaagttacaatcctgcccctatcagaaattcgtcctctccaaattgcttgctgattccaagctctatcgaggatcaactgccaggttatggaactagtgctgcactgtcatctggtagctatgatcttcatggagggatcaacaatgctgggaactcacagagaagtttccgtgcaagaaccaccacagctcaacagattgctccctgtactgtatggccctctgcaaatgctatcagactttctaattcttggaatcaccagccacctcatccacagagtacatttgatgacccccaggaggttattcctgtggtcagtagcctcaacctgcaataccaacatccaatgaatgatactggtgttccgcaagctgcaaaccgttacactggtcatggagcttcatcgtcgcgagctggcagtttggacaaccgagttattggtagtgaagaggttcttagaaggaatgtggtgcctaccagctactctgatttagttccccctactgcagtagacctgaggcgtttggtgccagaaccatctaattggagttctgatggccgaggcactgcaatatcaggaactattcctcctgtatcaagagctaataccagttcaacagttaatccgccaggaggatccactcaccaaaacctcagtagacgccatacaagaaatttgtcagaggagattggccgtctatctggagcactccgaggtcatcaacccccacgcttaaggtcagggtttctgttggagcgccagggcgatggtgtttggggtgttcctttatcgatgaggggtagggaaggaagaaggctaatggagattcggaatgcacttgaaatgattcataggggcgagaatgtaaggcttgagtctatcttctacggtggtgttgacattcatgacagacacagggacatgcgtttagacatagacaatatgtcgtatgaggagttattagcactcgaggaaagaataggaaatgttaacactggcctcagcgaggaagcagtgataaagctgctcaagcaaagaaaattttcatcatggagactgaaagcatccttggaccacgagccatgttgtatctgccaggaggagtatgttgatggagacgaccttgggagtcttgactgcgggcacgacttccatgctggctgcatcaagcaatggctggtgctgaagaacgtgtgccctatctgcaaaaacacggcattgaagacctgaaactgaaaggctcgtcagagacacccatgttccatgttcgttggatcgcaagatcatttaccgattcgtattactgtgctttttggttgggaaattttggcattcaccttcggttgggaaaggaatttttaaaaaagagagagagaaatggtccctgtagactgctgctgcagtaaataatccctggaatatgtctccctgcatttaaccaaatatttatggctggcaaaaaaaaaaaaaaaaaaaa

SEQ ID NO: 2408 - protein, 660 aa, Panicum virgatum
  misc_feature: Ceres CLONE 1780586
  misc_feature (1)..(41): Pfam Name: zf-C3HC4 Pfam Description: Zinc finger, C3HC4 type (RING finger)
MQGQRNSMEHFTDVFGFDIGSSSGNPVIDQQAYWNNVLGSVESQNLQGYQMNHSDATIPYGNEPQQDGTFLGFWESGEASSSGSALNYGSSSNVKTEHLNIGGGLRIGERRLVADNDLSLDVDINLNANANDLRGQSSNVNCASQGPEQYSGRDRNGINAQPSDLRLHPYRTFLLGAEETDSFTLNPSENPLGDFSLMQEGIHQRPGGSLDGRRLACKRKNIEGANGQSSAGASTIFSHRNDNAFHNIASSSYNPAPIRNSSSPNCLLIPSSIEDQLPGYGTSAALSSGSYDLHGGINNAGNSQRSFRARTTTAQQIAPCTVWPSANAIRLSNSWNHQPPHPQSTFDDPQEVIPVVSSLNLQYQHPMNDTGVPQAANRYTGHGASSSRAGSLDNRVIGSEEVLRRNVVPTSYSDLVPPTAVDLRRLVPEPSNWSSDGRGTAISGTIPPVSRANTSSTVNPPGGSTHQNLSRRHTRNLSEEIGRLSGALRGHQPPRLRSGFLLERQGDGVWGVPLSMRGREGRRLMEIRNALEMIHRGENVRLESIFYGGVDIHDRHRDMRLDIDNMSYEELLALEERIGNVNTGLSEEAVIKLLKQRKFSSWRLKASLDHEPCCICQEEYVDGDDLGSLDCGHDFHAGCIKQWLVLKNVCPICKNTALKT

SEQ ID NO: 2409 - DNA, 1962 bp, Panicum virgatum
  misc_feature: Ceres CLONE 1780597
  misc_feature: Encodes the peptide sequence at SEQ ID NO. 2410
gtctgcgtgcgtgtgcaggcctcactccgcgcatccccttctggccaggaggtcgcccacgcagccgctcctctctcttcccttccccgatctcccccaatccgaccagaccaacaggcaccttcgacttgagcggagcaggcgaggcggaggcggagatggcgctgcgacgggctctcctcagatcggccgagatctcccccgaccgcaaggctgcaattgagtattttcattcattatcaagggcacagcctgctcgttctctcaatggtgccggcctttgccctgctagcagatcatttagtacccaggctgctactacatcaagtacaccacagcctccaccaccacctccccctccagagaagactcacttcggtggcctcaaagatgaagaccgcatttttaccaacctctatggtctgcatgacccttttctgaaaggtgcaatgaagaggggtgactggcataggaccaaggatttggtgattaagggggcagactggatagttaatgaaatgaagaaatcaggcctccggggacgtggaggtgcaggtttcccctctggtctcaaatggtcctttatgcccaaggtttcagatggacgcccttcttatcttgttgttaatgctgatgagagtgagcctggaacttgcaaagatagagaaatcatgcgtcatgaccctcacaaacttctggaaggatgccttattgctggagttggaatgagggcatccgctgcttacatctacattagaggtgaatacgtgaacgagcgtctcaaccttgagaaagcccggcaggaagcatatgcagctggacttcttggtaaggatgcttgcggatctggttatgattttgatgtgcatattcattttggtgctggtgcatacatctgtggtgaagagactgccctacttgagagccttgaagggaagcagggcaaacctaggctgaagccgcctttcccagccaatgctgggctttatggctgccccactactgtgacaaatgttgaaactgtggctgtatccccaacaattcttaggcgtggtccagaatggtttgcaagctttgggcgcaaaaacaactctggaaccaaactcttctgtatctcagggcatgtgaacaaaccttgcaccgtggaggaggaaatgagcatacctctcaaggagttgctcgagaggcactgtggaggtgtgaggggaggatgggacaacctgcttgcagttattcctggtggttcatctgttccccttttaccaaaacacatatgtgatgatgtgttgatggactatgatgcactgaaggctgtgcagtctggattgggtactgcagcggtcatcgtgatggacaaatctacggatgttgttgatgcaattgctaggctgtcatacttctacaagcatgagagttgtgggcagtgcacgccttgccgggagggcacaccctggctttggatgatcatggagaggctcaaggttggtaacgcgaagctggaggaaatcgatatgcttcaggaagtcacaaagcaaatcgaaggacatactatctgtgcccttggggatgctgcagcatggcctgtgcaggggcttatcaggcacttcaggccggagctggaaaggaggatccgtgagcgagctgaaagggagctgctggcggcttctgcatgatacgccagctatgtcgcccctgtactagtttcctgatttctttacttaaataatgcaaactggaggagctcatttctatgtaaggaaatgcagcattcttgatttctttaaaccttcacatggatgtttatttgatgcactcaagcagctggtgaattttgatggactagataagcttttcaaagtagaaacaaacgtgatcattgtaccagctacatgatccatcataatgttattgtggatgtgtatgtctacctgtttttctctctaaaaaaaaaaaaaaaaaaaa

SEQ ID NO: 2410 - protein, 504 aa, Panicum virgatum
  misc_feature: Ceres CLONE 1780597
  misc_feature (27)..(493): SWISSPROT Homolog: EC 1.6.5.3 NADH-ubiquinone oxidoreductase 51 kDa subunit, mitochondrial precursor
  misc_feature (68)..(497): SWISSPROT Homolog: EC 1.6.5.3 NADH dehydrogenase [ubiquinone] flavoprotein 1, mitochondrial precursor
MALRRALLRSAEISPDRKAAIEYFHSLSRAQPARSLNGAGLCPASRSFSTQAATTSSTPQPPPPPPPPEKTHFGGLKDEDRIFTNLYGLHDPFLKGAMKRGDWHRTKDLVIKGADWIVNEMKKSGLRGRGGAGFPSGLKWSFMPKVSDGRPSYLVVNADESEPGTCKDREIMRHDPHKLLEGCLIAGVGMRASAAYIYIRGEYVNERLNLEKARQEAYAAGLLGKDACGSGYDFDVHIHFGAGAYICGEETALLESLEGKQGKPRLKPPFPANAGLYGCPTTVTNVETVAVSPTILRRGPEWFASFGRKNNSGTKLFCISGHVNKPCTVEEEMSIPLKELLERHCGGVRGGWDNLLAVIPGGSSVPLLPKHICDDVLMDYDALKAVQSGLGTAAVIVMDKSTDVVDAIARLSYFYKHESCGQCTPCREGTPWLWMIMERLKVGNAKLEEIDMLQEVTKQIEGHTICALGDAAAWPVQGLIRHFRPELERRIRERAERELLAASA

SEQ ID NO: 2411 - DNA, 1385 bp, Panicum virgatum
  misc_feature: Ceres CLONE 1780604
  misc_feature: Encodes the peptide sequence at SEQ ID NO. 2412
actccactccgttccacaaatcctcactcccctatccgtgatgcagtgacctgctgctccgagcctgccacatactggtagttgttggagcaagcatataacctgcacgcctctaccacctccatactcgcatcacaggccccaatcccatcccgccgccccaccgaacctgcttctttgatagccttcctttgctttcccctccgatctttgctcggtccctggctaaacatgaccgaatcctttgtgctcaacaccggcgcgaggatcccatcggttggccttggcgtatggcaaattcagcctgacgccgtcggcaacgccatctatgctgctgtcaaggctgggtatcggcacattgattgcgctgcagcatacagcaatgagaaggaggtgggcttggctttgaagaaattatttgaggatggtgtggttaagcgtgaagatatttttgtcacctctaagctgtggtccactaatcatgcacctgaagatgtaccagaggcaattggtaccacacttaaagatttgcagcttgactacttggacttgtaccttattcatggtccattccgtatcaagaagggaactacgatgagccctgaaaatcttatccctactgatatccctgctacatggggagcaatggagaagctatatgactctggcaaagctcgtgcaatcggtgtgagtaattttacgtgtaagaagctggaggatttgttcgccattgcacgtgtgcatccagcagtcaaccaggttgagtgccatccggtttggcagcaagacaagctccgtaagctttgtcagttgaagggtgttcatctttctgccttttcacccttaggttcacctggggtcaatggcccaagcgtcctcaacaaccccattgtgatctctgttgctgagaagttgcagaaaacacctgcccaggtcgctctacggtggggaattcaaatgggccagagtgtacttcccaaaagtgccaatgaagcaaggattaaggagaacatcgacatatttgattggtccattcctgaagatctgatggcgaagttctctaaaatcaaacaggttaggttgcagagagccgaatttgcagttaaccctcagagcggctataatacactggaggatttttgggatggcgagatataaagcatacagatatgtccagcatacatgagcagggcaagggaaataatcttatatgctttgcctggacagctgagaattattaccttcatttggattttggagaaagaaaatgcgaatacttgccctatgctgctcttctagacgcttcttttcattgtatccaaagatgactgtgttacatttacaaataaagtaaatggcttgttcaaaaaaaaaaaaaaaaaaaa

SEQ ID NO: 2412 - protein, 308 aa, Panicum virgatum
  misc_feature: Ceres CLONE 1780604
  misc_feature (1)..(279): Pfam Name: Aldo_ket_red Pfam Description: Aldo/keto reductase family
MTESFVLNTGARIPSVGLGVWQIQPDAVGNAIYAAVKAGYRHIDCAAAYSNEKEVGLALKKLFEDGVVKREDIFVTSKLWSTNHAPEDVPEAIGTTLKDLQLDYLDLYLIHGPFRIKKGTTMSPENLIPTDIPATWGAMEKLYDSGKARAIGVSNFTCKKLEDLFAIARVHPAVNQVECHPVWQQDKLRKLCQLKGVHLSAFSPLGSPGVNGPSVLNNPIVISVAEKLQKTPAQVALRWGIQMGQSVLPKSANEARIKENIDIFDWSIPEDLMAKFSKIKQVRLQRAEFAVNPQSGYNTLEDFWDGEI

SEQ ID NO: 2413 - DNA, 1449 bp, Panicum virgatum
  misc_feature: Ceres CLONE 1780629
  misc_feature: Encodes the peptide sequence at SEQ ID NO. 2414
aggagtgcatccccgccgcacatcaatcggtctcgcacgactctgctctcccgcagccaaaaaaaccctagactccccggccgccgcttctccttcccctccccccagctcgcgccgtcctcccaagcgccctcgcctcgcctgctcgccgccgccgccgccgtcgagcaccgatcaatcagcagccatggcgaatccagcggcgccgggaggagcgaggtcattcctgcaggccgtgtcgaaggtcaccgaggaggcgccgacgccgctccgcgtcgtccagatggaaggcctggccgtactgaagatcattaagcactgtgaggagtttgcgcctgctctggttacaggtcaacttcttggtttggatgttggcagcgtgctcgaagtgacaaactgtttccccttccctatcagagaagaggatgatgaagcagatgctgatggtgcaaattaccagcttgagatgatgagatgcttgagagaagttaatgttgacaataatactattggatggtatcaatcttgcttgcttggttcttttcaaaccgtggaactgattgaaacatttatgaactatcaggagagcatcaggagatgtgtgtgcattgtctatgacccatctaggtctagtcaaggaatgctagctctcaaagccctgaagcttacggactcatttatggatctttaccgtaacaatggtttaactggagagaagttaagagagaagaaattgtcatgggttgatatttttgaggagataccgattaaagtttccaactcagcgcttgttagtgccttcatgaaggagctagaacctgagtctcctgttactcagtgtgacttcgacagacttaaattgtctaccgctccctttatggaaaggaatttggaattcctaattggctgcatggatgatctttcatcagagcagaacaagttccaatattattaccgtaacctctcaagacagcagtcacagcagcaggcatggcttcaaaagagaaggcaagaaaacatggcaagaaaagctgctggtgaggagccattgccagaagaagatccttccaaccctattttcaagcccattcctgagccatcacgattggaaggctatcttgttaccaatcagatctccagttactgcaaccatatcaatggggttgctggtcagaatttcaacaggctatacctgatgaaggccctgcatgaggactagaagactgggatatgagtggaagctgttgttaaatttaacttgtgccactgcttaaaatcacaattttgcgatgtacctgacatgaacgtgccagtcttatatttctgcatatttccatgacgccagatggatagcttccagtgagatgcacttccgcgatgtatcagtattctgtattatttctgaaatgggcaggctcactactgttagaaaaaaaaaaaaaaaaaaaa

SEQ ID NO: 2414 - protein, 343 aa, Panicum virgatum
  misc_feature: Ceres CLONE 1780629
  misc_feature: Great-hit functional homolog of the protein sequence given in SEQ ID NO 9504
  misc_feature: Useful for making plants with altered alkaloid content
  misc_feature: Useful for making plants with modulated biomass
  misc_feature: The plant is abnormally small.
MANPAAPGGARSFLQAVSKVTEEAPTPLRVVQMEGLAVLKIIKHCEEFAPALVTGQLLGLDVGSVLEVTNCFPFPIREEDDEADADGANYQLEMMRCLREVNVDNNTIGWYQSCLLGSFQTVELIETFMNYQESIRRCVCIVYDPSRSSQGMLALKALKLTDSFMDLYRNNGLTGEKLREKKLSWVDIFEEIPIKVSNSALVSAFMKELEPESPVTQCDFDRLKLSTAPFMERNLEFLIGCMDDLSSEQNKFQYYYRNLSRQQSQQQAWLQKRRQENMARKAAGEEPLPEEDPSNPIFKPIPEPSRLEGYLVTNQISSYCNHINGVAGQNFNRLYLMKALHED

SEQ ID NO: 2415 - DNA, 610 bp, Panicum virgatum
  misc_feature: Ceres CLONE 1780630
  misc_feature: Encodes the peptide sequence at SEQ ID NO. 2416
ctcctcacccagccttgcagattgcaggatctccagcacctccacgcctcgatccagatccagcagctgaaagatggatgcgaacagacgccagagtggaattcagcagttgttggctgcagagcaagaggctcagcaaattgtaaatgcagctagggcagccaaatcggcaaggcttagacaagccaaggaggaagctgagagggaaatagctgaataccgctcccaaatggaggctgaattccagagaaaagttgcagagagtagtggtgactccggtgcaaatgttaaacgtcttgagcaagagacagcggcaaaaattgaacaactcaatcaacaggctgcaagtatctcccctgaagtcattcagatgctgctgaggcatgtgaccactgtgaagaactaaacgttgatgtgcagcaaatatgactgcaaccttgtattttctatctaattctttatatcagagaggagtaataaaggatttgtcacttataactgtaattctgtgttcttgttcacagaataagctgctgcagtttagcagcaaacctgtctattactatcaaaacttggtgatcatttggtaattatcactttctcttgtttc

SEQ ID NO: 2416 - protein, 110 aa, Panicum virgatum
  misc_feature: Ceres CLONE 1780630
  misc_feature (1)..(110): SWISSPROT Homolog: EC 3.6.3.14 Vacuolar ATP synthase subunit G 1
MDANRRQSGIQQLLAAEQEAQQIVNAARAAKSARLRQAKEEAEREIAEYRSQMEAEFQRKVAESSGDSGANVKRLEQETAAKIEQLNQQAASISPEVIQMLLRHVTTVKN

SEQ ID NO: 2417 - DNA, 2104 bp, Panicum virgatum
  misc_feature: Ceres CLONE 1780637
  misc_feature: Encodes the peptide sequence at SEQ ID NO. 2418
accgattcacttcgccactcctcagtcacacactcgccgcacgagcccatggccttggcgacgccactccgccacctcctccccgtggcggcggcgccgtccacggcccccgaccccgccgggccgtccctgaccacccgccgcgccctctcgctcccccgggtcagcctccacctccgctccagcgtcgccgcgtccacgtcccccaagcccaggtccgccgtgacggcggcggcgtccgcggcggccgggcggccgacggtgcttgtcacggagaagctgggccccgcggggctggacctgctgcgcgcgttcgcgaacgtggactgctcgtacgagctcacggcggaggagctccgcgccaaggtctcgctcgtcgacgcgctggtggtgcgcagcgggacgcgcgtcacgcgggaggtgttcgaggccgcgcgcggcaggctccgggtcgtcggccgcgccggcgtcgggatcgacaatgtcgacctccaggcggccaccgaggccggctgcctcgtcgtcaacgcgcccaccgccaacacggtcgccgccgccgagcacgccatcgcgctcctcaccgccatggcgcgcaatgtcgcgcaggccgacgcgtcgctcaaggccggcaaatggcaacggagcaaatatgttggtgttaccttggtggggaaggtactagcagttatgggctttggaaaggtaggctcggaagtagctcggcgcgcaaaaggacttgggatggatatcattgctcatgacccatatgctcctgttgatagagctcgggcaattggtgtagatcttgtatcatttgatgaggccatttctacatctgacttcatatcactgcatatgcctttaactccatccacggcaaagattttcaatgatgaaacttttgcaaaaatgaaaaagggtgttagaattattaatgttgcaaggggtggagttgttgatgaagatgcattgctgagagcacttgacaatggaacagttgcccaggctgcacttgatgtatttactgaggagccaccaccgagagacagcaagttggtgcagcatgagaatgtcactgtaacaccgcaccttggagctagcacaacagaagcgcaggaaggtgtagcccttgaaattgcagaggctgttattggtgccctgagaggaaatctggctgccacagctgtgaatgccccaatggtccctgctgaggttttatcagagctgtctccctatgttgtccttgctgagaagctgggccgacttgtcgtgcaactcgtagctggtgggagtggggttaaggtcgtaaaggttgtctactcatcagctagagaccccgatgacttggacacaagacttcttcgtgccatggtcaccaaaggcatcatcgaacctatttcgagtgcattcgtcaatattgtcaatgcagactatgttgccaggcaaagaggccttcagatcatcgaggagagaattctcctttacggttcacctgaaatccccctagactccatccaagttcacctcaccaatgtggagtccaagtttgctggtgccttgtctgatgcaggtgacatcagagttgaaggcaaggttaaggatggctccccgcatctcacgcttgtcgggtctttcagtgttgacgttagccttgaaggcaacctgatactgtgctgccaaattgatcaggcaggtatcattgggaaggtgggatcgatcttgggaaagatgaatgtgaatgtgagtttcatgagcgttggaaggactgctcctggaaagcaggcgataatggccattggggttgatgaggagcccgagaaggaagctctcaagctgatcggtgacataccgtctgtcgaggagtttgtctttcttaagctttagagaggaaataaccaagtaggtaggtaccggaggtaacatttgtgctatgttagcttgagattgatttttccaagcttctaggggctagttttggggtactgtacattggcattctttggtgtccttcaggacacgccacagataacagtatatatcaagaaatgcatgcaaaaaatgcaatttttcctcttgggcgtgctaaaaaaaaaaaaaaaaaaaa

SEQ ID NO: 2418 - protein, 611 aa, Panicum virgatum
  misc_feature: Ceres CLONE 1780637
  misc_feature (1)..(310): Pfam Name: 2-Hacid_dh Pfam Description: D-isomer specific 2-hydroxyacid dehydrogenase, catalytic domain
  misc_feature (69)..(611): SWISSPROT Homolog: EC 1.1.1.95 D-3-phosphoglycerate dehydrogenase, chloroplast precursor
MALATPLRHLLPVAAAPSTAPDPAGPSLTTRRALSLPRVSLHLRSSVAASTSPKPRSAVTAAASAAAGRPTVLVTEKLGPAGLDLLRAFANVDCSYELTAEELRAKVSLVDALVVRSGTRVTREVFEAARGRLRVVGRAGVGIDNVDLQAATEAGCLVVNAPTANTVAAAEHAIALLTAMARNVAQADASLKAGKWQRSKYVGVTLVGKVLAVMGFGKVGSEVARRAKGLGMDIIAHDPYAPVDRARAIGVDLVSFDEAISTSDFISLHMPLTPSTAKIFNDETFAKMKKGVRIINVARGGVVDEDALLRALDNGTVAQAALDVFTEEPPPRDSKLVQHENVTVTPHLGASTTEAQEGVALEIAEAVIGALRGNLAATAVNAPMVPAEVLSELSPYVVLAEKLGRLVVQLVAGGSGVKVVKVVYSSARDPDDLDTRLLRAMVTKGIIEPISSAFVNIVNADYVARQRGLQIIEERILLYGSPEIPLDSIQVHLTNVESKFAGALSDAGDIRVEGKVKDGSPHLTLVGSFSVDVSLEGNLILCCQIDQAGIIGKVGSILGKMNVNVSFMSVGRTAPGKQAIMAIGVDEEPEKEALKLIGDIPSVEEFVFLKL

SEQ ID NO: 2419 - DNA, 2116 bp, Panicum virgatum
  misc_feature: Ceres CLONE 1780647
  misc_feature: Encodes the peptide sequence at SEQ ID NO. 2420
accccaccaaccagtccagcaagccactccgactcaccaaccagccgctcgcccggcctccgacgccgccccgcgccccaatccggaagaggaggcgcggccgccggcgccgatcggaccccatgctccgcgcggcgctctcccgctcagcctccgggctccgccgctccccggcgatggccgcggccgtcccgctctccaccgccgccgccccgtggctctccaacggccccgcctcgtccccgccaagggtgcgcctcctcatcggcggcgagttcgtcgagtcgcgcgccgacgagcacgtcgacgtcaccaaccccgcgacgcaggaggtggtgtcgcggatcccgctcacgaccaccgacgagttcagggccgccgtggacgccgccaggacggccttccccgggtggcggggcacgcccgtcaccatgcgccagcgcgtcatgttcaagttccaggaactcatccgggcaaacatggacaagcttgcagagaacattacaacggagcaggggaagacgctgaaagatgcttggggcgatgtgtttcggggtctagaggtggtggagcatgcttgtggaatggggactctgcaaatgggtgaatacgtatcaaatgtttctaatgggattgataccttcagcattagggagccacttggtgtgtgtgctgggatatgcccatttaattttcctgctatgattcccctatggatgtttcccatagcagtaacatgtggcaatacttttgtcctgaagccatcagaaaaggacccaggggctgctatgatgcttgcggagctagcaatggaggctggtttacctaagggtgttttgaacattgtccatggtacccacgatgttgtcaacaatatttgtgatgatgaggatattaaggctgtatcctttgttggttccaatacagctggtatgcatatatattctagagcatctgcaacaggcaagcgtgttcagtgcaacatgggagcaaagaatcatgcaattatacttcctgatgctgacagagatgccacactgaatgcccttatagctgctgggtttggtgcggcagggcagaggtgcatggcattgagcactgctgtttttgttggaggttcagaatcatgggaggatgaacttgtgaaacttgcaagtggcctcgttgttaattcaggaatggttaatgatgcagaccttggtccagtgatcagcagacaggcaaaggaccgaatctgcaagttagtccaaaatggtgttgacagtggtgcacgtcttttgcttgacgggagggatattatggttccgcagtttgaggatggcaattttgttggtccaacccttctggctgatgttaaaagtgacatggagtgttacaaggaggaaatttttggtccagttcttctcttgatgaaggcagagagcctagatgatgccatccaaattgtaaatagaaacaagtatggcaatggggcttctatatttacaacatctggtatctcagcaaggaaatttcagacagacattgaagctggccaggtgggaatcaatgtcccaattccggtaccgctgccattcttctccttcacaggcagcaaggcttccttcgcaggagatttgaatttctacggcaaggccgacgtgcagttcttcacccagatcaagacgatcacgcagcagtggaaggagtcgccggcgcagcgcgtctccctctccatgcccacctcgcagaagtgagacggcaggaaaccctcgcccccacaccctccagcatttcacctctggacatagacccatgtgattcgagaagcgagaaggatgattggtaggcacggcagcgccccatgcatggtcgtatgatactcgtgtgctcgcctgctcaaagtccgacagaccgtgaccatgcgagcctcatttagctgtccaggtttagagattgccagattgggcgctgcccgttctgctgtgtagagaatactgaaaaatccctgcagatggggtgtcatgtgtatactctaaaaataaggagaaattccctactgtcctattaaagttacctcttcatttcttgaccttttttttttccacaagtttcttaaaaaaaaaaaaaaaaaaaa

SEQ ID NO: 2420 - protein, 537 aa, Panicum virgatum
  misc_feature: Ceres CLONE 1780647
  misc_feature (1)..(465): Pfam Name: Aldedh Pfam Description: Aldehyde dehydrogenase family
  misc_feature (32)..(537): SWISSPROT Homolog: EC 1.2.1.27 Methylmalonate-semialdehyde dehydrogenase [acylating], mitochondrial precursor
  misc_feature (4)..(534): SWISSPROT Homolog: EC 1.2.1.27 Methylmalonate-semialdehyde dehydrogenase [acylating], mitochondrial precursor
MLRAALSRSASGLRRSPAMAAAVPLSTAAAPWLSNGPASSPPRVRLLIGGEFVESRADEHVDVTNPATQEVVSRIPLTTTDEFRAAVDAARTAFPGWRGTPVTMRQRVMFKFQELIRANMDKLAENITTEQGKTLKDAWGDVFRGLEVVEHACGMGTLQMGEYVSNVSNGIDTFSIREPLGVCAGICPFNFPAMIPLWMFPIAVTCGNTFVLKPSEKDPGAAMMLAELAMEAGLPKGVLNIVHGTHDVVNNICDDEDIKAVSFVGSNTAGMHIYSRASATGKRVQCNMGAKNHAIILPDADRDATLNALIAAGFGAAGQRCMALSTAVFVGGSESWEDELVKLASGLVVNSGMVNDADLGPVISRQAKDRICKLVQNGVDSGARLLLDGRDIMVPQFEDGNFVGPTLLADVKSDMECYKEEIFGPVLLLMKAESLDDAIQIVNRNKYGNGASIFTTSGISARKFQTDIEAGQVGINVPIPVPLPFFSFTGSKASFAGDLNFYGKADVQFFTQIKTITQQWKESPAQRVSLSMPTSQK

SEQ ID NO: 2421 - DNA, 2087 bp, Panicum virgatum
  misc_feature: Ceres CLONE 1780658
  misc_feature: Encodes the peptide sequence at SEQ ID NO. 2422
gaaaatcaaagcgccgcgtcgtcgcttcccttccagccttccaggcttccacacgcatctcatcttcttccccgacctcgccgcctccgccgttgaccccggcggccgacgccggcgaggcagcacctcgccggacgcccacccctgctccttgatctgcctagtccccctccagcaattcctgtagccgcctccagccgtcctcccgcggaaccctagatctccgataccccgcgcgccctcccgccgacggccacccaatcggaatgggccgccatctccagtaaggtccagcgacccaggagtacctgcctccgccttcgcgcgtgcgcgaggcgccgccgcgatggcgatccgcatcaccgtgtcctactcgggctacgtggcgcagaacctggccgcgtccttcggcctgcgctgcaccagcgccgccgctgccggcgctggcgcggcgcccggcccggggtgccgcttcctccaggacgcgctatcccgccccttctgcctcttcgcaacctcccgccgcgccgactcccaccatgacgccgaggatcacaaccacccgaagcccaggcccagggctctgcctccggccgcctccgcgggaggcggccactcgctgttgctgccgcggtcgtcctccacgaaaccgccggtggatgacccgccaacgtcgctggccgtgggcctgctgtcggtgttcgcgtccgggatgggttcgactggtggcattgcgggggcctcctccctcgcggcgtccccgtcaatatcagccggattcaaccctgcggcgctgctcccgttcctgcaggcgaccaagtggctcccctgcagtgacatcgtcaccgctgccacggcgtcccgcggctcaagacgcccagcaggtgcctcgacggcgcctgcaccgcgagcaacaggtgcctcaatagcgcctgcaccgcctgcagctgcaccatcaccccgtcctgctccacgcagagctgtcccatcgcctggtccttcacctgtgccgtcacctgctgtggctgctccgtccaaggtgggcattcaagctttggttggaagtgccagcattgcctcaggttcaactggaattggtagtggcgcgattgcctcgggtgcagctgggatggtgaggaagagtggcgctagtcttgctgccggtgcaagggtaagcaggaaggctggttggctctcgaggtgggtgagctcatgctcggatgatgcgaagactgtctttgctgctgtgactgtgccgttgctctatagatcatccctagctgagccaaggtccatcccatccaaatcaatgtacccaacatttgatgttggtgaccgaatccttgctgagaagatttcttatattttccgggagccagaagttttggacattgttatctttcgtgcacctccagtccttcaggcattgggctacagctccaatgatgtgttcatcaagagagttgtggcgaagggtggggacatcgttgaagtacgtgatggtaacttgttggttaatggagtaatccaggatgaagaatttgtgctggagccggctgactatgaaatggatccactgactgtccctgaaggctatgtatttgtactaggggacaacagaaacaacagctttgattcacataactggggaccgcttccagtgaatagcattctagggagatctgtgcttcgatactggccaccgtcgaaaataacagatacaatatatgagcatgatatggcgcaattcacagtcgccacatcctgagatatgcattgtggctgtaccacattgaaaatgcagtcccatttttccttttctttttccggccgagctttactgacaagtgtaaagctgagccgcagtttttgcattcttatttattggatgtcgccttgccccagatgcccattggcagcttggctgacagattagtttttccctctctactgtcagatgcactttcgaaggcaacaattcctgtactatgtagcctaagaagggaaaccctgtatgtttctggaggcagatgaatgagcttcatggctggcagtaggcttagcatcaaaaaaaaaaaaaaaaaaaa

SEQ ID NO: 2422 - protein, 473 aa, Panicum virgatum
  misc_feature: Ceres CLONE 1780658
  misc_feature (1)..(78): Pfam Name: Peptidase_S24 Pfam Description: Peptidase S24-like
MAIRITVSYSGYVAQNLAASFGLRCTSAAAAGAGAAPGPGCRFLQDALSRPFCLFATSRRADSHHDAEDHNHPKPRPRALPPAASAGGGHSLLLPRSSSTKPPVDDPPTSLAVGLLSVFASGMGSTGGIAGASSLAASPSISAGFNPAALLPFLQATKWLPCSDIVTAATASRGSRRPAGASTAPAPRATGASIAPAPPAAAPSPRPAPRRAVPSPGPSPVPSPAVAAPSKVGIQALVGSASIASGSTGIGSGAIASGAAGMVRKSGASLAAGARVSRKAGWLSRWVSSCSDDAKTVFAAVTVPLLYRSSLAEPRSIPSKSMYPTFDVGDRILAEKISYIFREPEVLDIVIFRAPPVLQALGYSSNDVFIKRVVAKGGDIVEVRDGNLLVNGVIQDEEFVLEPADYEMDPLTVPEGYVFVLGDNRNNSFDSHNWGPLPVNSILGRSVLRYWPPSKITDTIYEHDMAQFTVATS

SEQ ID NO: 2423 - DNA, 1706 bp, Panicum virgatum
  misc_feature: Ceres CLONE 1780664
  misc_feature: Encodes the peptide sequence at SEQ ID NO. 2424
agacagacccgagggcctgcgttttaattatttttctccctcgccgccgttttgccgtcgcggcggcgctcgaagtgcgcggttcgtcggccgccggtcgagcatctcctcgcctttttgcagaaccgggagagaacagcggcggggaggcgggcagcgcagcgcgggggcgttgccgtcgtgggtgacatcgcgacggcgacgcggacgggcgctagtccaagcaatatccttgcagccttgctagtgatagtataaaaataagcacagggccgagacgccggggatgggcaggactcgcggggaaggagcagcaagcaagcaacaagcgagagccggtcaactcaaggggcttgtcaagagcaagaagatgggcagcgcacagcagcagctgctcctgctctgcttcttgttcttcctcctatctgcggtcgccccgcaggtagtcagagcagtgaaaccaatcccaaattccattctcggggtcgaggagggagacaattctaaaggaatcatccagaaggacatcatagagacggtcaacaagcatcccgatgctgggtggacggctgcacacaatccttactttgcaaactatactattgcacaatttaaacgtatccttggagtgaagcccacaccacagagtgtgctgactgatgttcctaccaaaacttattcaagatcactgaaacttccaaaggagttcgacgccagatctaagtggtctcattgcagcacaattgggaacatacttgatcaaggtcattgtggctcctgttgggcttttggtgctgtggagtgcctccaggatcgtttttgcattcatatgaacacgagcatttcactatcagtcaatgacctactggcatgctgcggttttatgtgcggtgatggttgtgatggaggctatcctatcatggcatggcgctactttgttcaaaatggtgttgtcacagaggagtgcgatccatatttcgatcaggttggttgcaagcatcctggatgcgaacctgcttatcctacaccagtgtgtgaaaagaaatgcaaggtgcagaaccaagtttgggaggaaaaaaagcatttcagtgtcaatgcgtacagaataagttctaatccagatgacataatgtcagaggtctacgaaaatggccccgtagaagttgctttcacagtttatgaggattttgcccactacaaatctggagtatacaagcacattaccggtggcatgatgggtggccatgcggtcaagttgattggatggggaaccagtgatgctggagaggattactggcttctcgcaaatcagtggaacagaggctggggtgatgatgggtacttcaagatcatacgaggcaaaaatgaatgtggcatcgaagaagacgttgttgctggaatgccatccacaaagaatatggtcagaaactacggtggttcctttggaacagctgtagtttgatcactgccctaggcctgaaatactatcggataggatggccatgtatttgtattgctgaatgctgatgaacttttgtaaagtagccttgatggtgtatgttttgtacaccagcacgttggcaaggctggcaggttgctgagatggcaacatctgttctgaaacatatatgacagttgtggctgttgcattctaagattcagctataccagcatctcttttggttcaaaaaaaaaaaaaaaaaaaa

SEQ ID NO: 2424 - protein, 391 aa, Panicum virgatum
  misc_feature: Ceres CLONE 1780664
  misc_feature (1)..(236): Pfam Name: Peptidase_C1 Pfam Description: Papain family cysteine protease
MGRTRGEGAASKQQARAGQLKGLVKSKKMGSAQQQLLLLCFLFFLLSAVAPQVVRAVKPIPNSILGVEEGDNSKGIIQKDIIETVNKHPDAGWTAAHNPYFANYTIAQFKRILGVKPTPQSVLTDVPTKTYSRSLKLPKEFDARSKWSHCSTIGNILDQGHCGSCWAFGAVECLQDRFCIHMNTSISLSVNDLLACCGFMCGDGCDGGYPIMAWRYFVQNGVVTEECDPYFDQVGCKHPGCEPAYPTPVCEKKCKVQNQVWEEKKHFSVNAYRISSNPDDIMSEVYENGPVEVAFTVYEDFAHYKSGVYKHITGGMMGGHAVKLIGWGTSDAGEDYWLLANQWNRGWGDDGYFKIIRGKNECGIEEDVVAGMPSTKNMVRNYGGSFGTAVV

SEQ ID NO: 2425 - DNA, 873 bp, Panicum virgatum
  misc_feature: Ceres CLONE 1780678
  misc_feature: Encodes the peptide sequence at SEQ ID NO. 2426
gacaaaaaaaatctcacgcctgctgccccccacctctgacctctcgccctctcgccgtccatggagtccgtcgcggccgccgcgatcgccaccaccacccggtccgtcccgctccccttctcctccgcgccgctccaccgccggcgccgttccgccttcctccccgtcgccgcctccaagcgtcacaacgacgacgacaaggaggccgcgaacggccccgggcgcgagcccaccgggctggcgccgtacgggctctccatctcgccgctctccaaggacgcggccatggggattgtggtcagcgccgccacggggagcggctggacgacgggatcgggcatggaggggccgccaacggcgagcagagccggtggggcggacatgccggaggtgtcgacgctcccttggtcgctcttcacaaaatcgccgcggcgccggatgcgtgtggccttcacctgcaacgtgtgtgggcagcgtaccaccagggccatcaatcctcatgcctacaccgatggaactgtgtttgttcagtgctgtggttgcaatgtattccataagttggtcgacaacctgaacctgtttcatgagatgaagtgctacgttggtccagacttccgctacgaaggagatgctccattcaactactttgacaataacgaggatggcgatactatcttcccactctaaacccttctaatttgctcgtgtagctgtatgtaataagcagatgaaccttccggaacttgtaatattatactgatgtatataattgtttgtacttaactagtagagcagacctcgctctgcagaagttatacaggtagcagataatggaatagatatggaagtttacaaaaaaaaaaaaaaaaaaaa

SEQ ID NO: 2426 - protein, 208 aa, Panicum virgatum
  misc_feature: Ceres CLONE 1780678
  misc_feature (1)..(64): Pfam Name: zf-DNL Pfam Description: DNL zinc finger
MESVAAAAIATTTRSVPLPFSSAPLHRRRRSAFLPVAASKRHNDDDKEAANGPGREPTGLAPYGLSISPLSKDAAMGIVVSAATGSGWTTGSGMEGPPTASRAGGADMPEVSTLPWSLFTKSPRRRMRVAFTCNVCGQRTTRAINPHAYTDGTVFVQCCGCNVFHKLVDNLNLFHEMKCYVGPDFRYEGDAPFNYFDNNEDGDTIFPL

SEQ ID NO: 2427 - DNA, 1661 bp, Panicum virgatum
  misc_feature: Ceres CLONE 1780688
  misc_feature: Encodes the peptide sequence at SEQ ID NO. 2428
cacgctcactccgcctcctcccccaaacctcccaaaccccaccgcctcgccggaagcccggaaccctagccccctcccccaccccagccgccgcgcccccccgatccgccgccatgagggagatcctgcacatccagggcggccagtgcggcaaccagatcggggccaagttctgggaggtgatctgcgacgagcacggcatcgaccacaccggcaagtacgcgggcgactccgacctccagctcgagcgcatcaacgtctactacaacgaggccagcggcggccggttcgtcccgcgcgccgtgctcatggacctcgagcccggcaccatggactcggtgcgctcggggccctacggccagatcttccgccccgacaacttcgtcttcggccagtccggcgccgggaacaactgggccaaggggcactacaccgagggcgcagagctcatcgactcggtgctcgacgtcgtccgcaaggaggccgagaactgcgactgcctccaagggttccagctctgccactcgctgggaggaggtactggctcaggaatgggcaccctgctcatctctaagatcagggaggagtacccggaccggatgatgctcacattctctgtcttcccatcgccgaaagtgtctgatactgtggtggagccctataacgccactctctccgtgcaccagcttgttgagaacgcggatgagtgcatggtgctcgacaacgaggctctgtatgacatctgcttccgcaccctgaagcttgcaacaccaacctttggtgatctcaaccaccttatctctgcaaccatgagtggtgtcacatgctgcctgcgcttccctggccagctgaattctgacctccggaagcttgcagtcaacctgatccccttcccacgtctccacttcttcatggtcggattcgctccactgacctcaaggggctcgcaacagtaccgtgccctcactgtgccagagctgacccagcagatgtgggactccaagaacatgatgtgtgccgctgaccctcgccacggccgctacctcactgcatccgccgtgttccgtgggaagatgagcaccaaggaagtggatgagcagatgctgaacgtgcagaacaagaactcatcctacttcgtggagtggatccccaacaatgtcaagtctagcgtgtgcgacatcccgcccaagggcctgaagatgtcatccacattcatcggcaactcgacatccatccaggagatgttccgccgcgtgagcgagcagttcactgccatgttcaggaggaaggccttcttgcactggtacactggtgagggcatggacgagatggagttcaccgaggctgagagcaacatgaatgacctggttgctgagtaccagcagtaccaggatgccacggctgaggacgaagaggagtatgaggaggaagaagaggttgctgcctaagccaccatcctgagtactttctccagatgtaacatcgcttgtatcgctgatgctttctgttagccattatgttgattgaggtgcttgtggtgatgtttggtgatagatgggtggcattgcttatgtatgcgatgttgccgtgacaaaactgcattttctttgtgttctggttgctcaagctgcactgtttgccaaaaaaaaaaaaaaaaaaaa

SEQ ID NO: 2428 - protein, 444 aa, Panicum virgatum
  misc_feature: Ceres CLONE 1780688
  misc_feature: Great-hit functional homolog of the protein sequence given in SEQ ID NO 9198
  misc_feature: Useful for making plants with modulated flowering time
  misc_feature: The plant flowers significantly late compared to wild-type.
MREILHIQGGQCGNQIGAKFWEVICDEHGIDHTGKYAGDSDLQLERINVYYNEASGGRFVPRAVLMDLEPGTMDSVRSGPYGQIFRPDNFVFGQSGAGNNWAKGHYTEGAELIDSVLDVVRKEAENCDCLQGFQLCHSLGGGTGSGMGTLLISKIREEYPDRMMLTFSVFPSPKVSDTVVEPYNATLSVHQLVENADECMVLDNEALYDICFRTLKLATPTFGDLNHLISATMSGVTCCLRFPGQLNSDLRKLAVNLIPFPRLHFFMVGFAPLTSRGSQQYRALTVPELTQQMWDSKNMMCAADPRHGRYLTASAVFRGKMSTKEVDEQMLNVQNKNSSYFVEWIPNNVKSSVCDIPPKGLKMSSTFIGNSTSIQEMFRRVSEQFTAMFRRKAFLHWYTGEGMDEMEFTEAESNMNDLVAEYQQYQDATAEDEEEYEEEEEVAA

SEQ ID NO: 2429 - DNA, 3170 bp, Panicum virgatum
  misc_feature: Ceres CLONE 1780721
  misc_feature: Encodes the peptide sequence at SEQ ID NO. 2430
gcagccgcgccgaggcgacacctcctggttcgcgtcggccgactggaagctaccgcccccgagaccgaacacgccggaccgcggggggcgccgcagaccgcgcggctttcctccagcctcgggcgacgaccctccgccagggtaggctgacgccccccgccaggctcgcccgaccgaagcaagccgccgccgcatccggactcctccaggccgtgaaagattttgacacaaaaaggacattttcagtcgaagagaagttcgtggctgaggctgaagaaaatctgcatgtgcttgacttgtaagactcgctggttttgagaggtgtctgacatagactatccaaaattcagcgccagggatcagggagtgacctaccccaaggtggggagttcattccttttccagttacaaggagggcaaactcgtattccatcatgatggaagaggacatggaaaatggaaggtcgtatcaggaaagaccaagaaccttttccacaatacgaagtaaatcatctataccactggtcttccgtttgttgatgaggataaatccccgtgccttgattattctctctcttttggtcttcagtggtgttctatatgtgggagccagtacatcaccaattgtggtctttgtattctgtatatgtactctcagtttattcttctctctttacctcacaaagtgggttcttgccaaggacgaaggacctccagaaatgtctgagatatctgatgccataagagacggtgctgaaggattttttaggacacaatatggaactatttctaaaatggcgtgtattctggcctttgtcattcttggcatttatctcttccgcactaccaccccacagcaggaggcatctggtttaggaagggcaacatctgcatatattacagttgcttcatttctccttggagctttgtgttctggaatagctggctttgttgggatgtgggtctctgtacgtgcaaatgttcgagtttcaagtgctgctcggcgctctgcgagggaagcattgcagattgctgtccgtgctggtggtttctcagccattgtggttgtttgcatggctgtatttggtgtggcaatactgtattcaacattttatgtttggcttggagtagattcacctggttcaatgaaggttaccgacttgcctcttctccttgtgggatatggatttggtgcctcctttgttgccctttttgctcagttgggtggtggaatatacaccaaagctgctgatgttggagctgatctggttggaaaagttgagcagggaataccagaagatgatcctcgcaatcctgctgtcattgctgacttggttggtgacaatgttggagactgtgctgcgcgaggtgctgatctttttgagagcatagcagcagaaattatcagtgcaatgatacttgggggaacaatggcacagcgctgcaagattgaggatccctctggatttattctgtttcctcttgttgtccattcattcgatttggtggtgtcatcagttggaattctctcaatcagagggacacgcgaccctggtcttatctcccctatcgaagatcccatgtcaattatgcaaaaaggctattctattactattatgcttgctgttcttacatttggagtgtctactcgttggctcctgtacacggaacaagcaccttcagcatggctaaactttgcgctgtgtggcttggtggggatcattacggcatatgcttttgtttggatatcgaagtattacacagattataaacacgagccagtccgccttttagctctttcaagttctacaggacatggaactaatattattgctggagtaagtttgggaatggaatcaacagcccttccagttctagtgataagtgtagccataatatcagcatattggctggggcagacctctggcttggtggacgagtctgataacccaacaggtggtctttttgggacagccgtagcaacaatggggatgcttagcacagcagggtatgttctcactatggacatgtttggtcctatagctgacaacgctggtggtattgttgagatgagccagcagcctgaaagtgtgagggaaatcacagatgttctagacgctgtgggcaacacaacgaaagctactacaaagggatttgccattgggtcggcggcactggcttccttcctcctgttcagtgcgtatatggatgaagtagcttcttttgctcaaatgccattcaaagaggttgacatagcagtccctgagatttttgttggtggtttattaggctcgatgcttatattcctgttcagtgcatgggcttgttcagcagttggcaaaactgcacaggaagttgttaatgaggtcaggagacaatttattgagaggcctggtattatggactacaaagagaagcctgattatggacgttgtgttgcaattgttgcatctgcatccttgagagaaatgataagacctggggctttagcaattatatcacccatggcagttggcgttatcttccggattctgggccactccactggccaacctcttctcggagctaaagttgtggcctcactgcttatgtttgctactgttgctggtattctcatggcactcttcctgaacactgctgggggcgcttgggataacgcgaagaagtacattgagactggtgctcttggtggcaaaggcagtgagtctcacaaggctgcggttactggcgacacggttggtaacccatttaaagacacagcggggccttcgcttcatgttcttatcaagatgcttgccacaatcacattggtcatggcgccgatatttttgtgattaaccaaccaaccactcatcaagctaaccctcagagatgtatttaccggactcatttagcatcactaagagaatcagtgcctccctcctgatatttcacggtaatattgtactggatggtgcaaacgtcggagaatgcacatacttgtgacggagattacagagttaatcgcctagtgtcttgtgtttgacgttggagaatacttatatttgtgatggagattacagaactagtcgcccgaatgccttgtgtttgtttactggaacatttttgtagcgttcattatgccaaatgcaacatccgttgcgctagctgaaaaaaaaaaaaaaaaaaaa

SEQ ID NO: 2430 - protein, 799 aa, Panicum virgatum
  misc_feature: Ceres CLONE 1780721
  misc_feature (1)..(799): SWISSPROT Homolog: EC 3.6.1.1 Pyrophosphate-energized membrane proton pump 2
MMEEDMENGRSYQERPRTFSTIRSKSSIPLVFRLLMRINPRALIILSLLVFSGVLYVGASTSPIVVFVFCICTLSLFFSLYLTKWVLAKDEGPPEMSEISDAIRDGAEGFFRTQYGTISKMACILAFVILGIYLFRTTTPQQEASGLGRATSAYITVASFLLGALCSGIAGFVGMWVSVRANVRVSSAARRSAREALQIAVRAGGFSAIVVVCMAVFGVAILYSTFYVWLGVDSPGSMKVTDLPLLLVGYGFGASFVALFAQLGGGIYTKAADVGADLVGKVEQGIPEDDPRNPAVIADLVGDNVGDCAARGADLFESIAAEIISAMILGGTMAQRCKIEDPSGFILFPLVVHSFDLVVSSVGILSIRGTRDPGLISPIEDPMSIMQKGYSITIMLAVLTFGVSTRWLLYTEQAPSAWLNFALCGLVGIITAYAFVWISKYYTDYKHEPVRLLALSSSTGHGTNIIAGVSLGMESTALPVLVISVAIISAYWLGQTSGLVDESDNPTGGLFGTAVATMGMLSTAGYVLTMDMFGPIADNAGGIVEMSQQPESVREITDVLDAVGNTTKATTKGFAIGSAALASFLLFSAYMDEVASFAQMPFKEVDIAVPEIFVGGLLGSMLIFLFSAWACSAVGKTAQEVVNEVRRQFIERPGIMDYKEKPDYGRCVAIVASASLREMIRPGALAIISPMAVGVIFRILGHSTGQPLLGAKVVASLLMFATVAGILMALFLNTAGGAWDNAKKYIETGALGGKGSESHKAAVTGDTVGNPFKDTAGPSLHVLIKMLATITLVMAPIFL

SEQ ID NO: 2431 - DNA, 2092 bp, Panicum virgatum
  misc_feature: Ceres CLONE 1780722
  misc_feature: Encodes the peptide sequence at SEQ ID NO. 2432
aaaattgcagcggcggcttatccaccttgatcgagtcgaagcctctccgacatggtgtccccgtcggacctctcgtagagccgccgaccttctccgcgcctcgcgtcggtgaggtgatccggagtaatttggattgcttgttctaggcgatctgatccagaggtggtgcggtgcgattctgttgcggaaatttttgttggggggaattttctgcgggcggcgtcggcgccggaggcgaagatgatccgtcttcagacgtacgcggcgttcagcctgctggcgaccgcgtcggcggtgtactacgccttcagcagccgggagcagttttacccggcgatggtctacctctccacctccaagatctgcttcgtgctgctcctcaacactggcctcgtcgccatgtgcgtcgcctggcagctcgtcaagcgccttttcctgggctcgctccgggaggccgaggtcgagcgcctcaacgagcagtcctggcgggaggtcgtcgagatcctcttcgcagtcaccatcttccgccaggacttctccgtctccttcctcgccatggtcgctgcgctgctcctcatcaaggcgctgcactggctggcacagaagagggtcgagtacatcgagaccacgccctccgtgcccatgctctcgcacataaggatcgtctccttcatggcgttcctgctcattgtcgactgcctcttcctgtcgaactcgctcaggtcgctcatagacaagcgggaggcgtcagttgccatcttcttctcctttgagtatatgatactggcaacatccacagtatcaacatttgtgaagtatgtattctatatcagtgacatgctaatggaaggtcaatgggagaaaaaggcagtgtacacattttacttggaactcatcagtgaccttgtgcacttatcactatacatgctcttcttcatagctatcttcctgaactacggtgtcccgctgcacttgattcgtgagctatatgagaccttccgcaacttcaaaattcgtgttgcagattatgtacgctacagaaaaatcacttccaacatgaatgaacgttttccagatgctacagcagaggagctcaatgcgagtgacgctacatgtattatttgccgtgaggagatgactacagcaaagaagctgctttgtgggcatctgttccatgtgcattgtctaaggtcatggctagagcgccagcacacttgccccacgtgcagagctccaatcatccccccagataatggacgtgctgcatcagcccgacaacatggagctcaacctggagttcagcctggagctgcaggtactggtactccagcctcagaaggagcagtgggtgacaacatgagcagacgccaagcaaagcttgaagctgcagcagcagcggcttctttatatggaagatcttttgcttatcctccagcaaacatcctaaataggtcaggtccttcacagtctacatcaagtacaccacaatttgaagcaagtagctccaatcaatcacagaaagaccaagaactgcagttccagaacaccagcgatggtttcgcacctctgccttttaatgcacatggtgccatgggttcaggaacaatcaccagggatcttgaaaattcactgcagagggcacaagaaaactttataaagagtcagatagagatgttacaaatccagttgcaaatggttcagcgtggtgctgctgtgccggccactaacaatgagaatgccgagcacacaaagaatgattgaaactgtaaatactaaataggcagagatgagaacgggataaacaaaacaaacatttggctgtacctgaggggaaattgttgcatgatgccttgccttgattttggtaggtttgttcatttacacttccctgttagtgccctcttagcaacaccagatgtttcttctttttatgtggtggttgcgcagtttggatctctgtcaagcccgtataataccattgatagaggctgtcgtgttgtaacaatggctagttgagagactaaacaaaatccatttatccaggaaaagaaatagaatggttctttttgcctaaaaaaaaaaaaaaaaaaaa

SEQ ID NO: 2432 - protein, 506 aa, Panicum virgatum
  misc_feature: Ceres CLONE 1780722
  misc_feature (1)..(38): Pfam Name: zf-C3HC4 Pfam Description: Zinc finger, C3HC4 type (RING finger)
MIRLQTYAAFSLLATASAVYYAFSSREQFYPAMVYLSTSKICFVLLLNTGLVAMCVAWQLVKRLFLGSLREAEVERLNEQSWREVVEILFAVTIFRQDFSVSFLAMVAALLLIKALHWLAQKRVEYIETTPSVPMLSHIRIVSFMAFLLIVDCLFLSNSLRSLIDKREASVAIFFSFEYMILATSTVSTFVKYVFYISDMLMEGQWEKKAVYTFYLELISDLVHLSLYMLFFIAIFLNYGVPLHLIRELYETFRNFKIRVADYVRYRKITSNMNERFPDATAEELNASDATCIICREEMTTAKKLLCGHLFHVHCLRSWLERQHTCPTCRAPIIPPDNGRAASARQHGAQPGVQPGAAGTGTPASEGAVGDNMSRRQAKLEAAAAAASLYGRSFAYPPANILNRSGPSQSTSSTPQFEASSSNQSQKDQELQFQNTSDGFAPLPFNAHGAMGSGTITRDLENSLQRAQENFIKSQIEMLQIQLQMVQRGAAVPATNNENAEHTKND

SEQ ID NO: 2433 - DNA, 1891 bp, Panicum virgatum
  misc_feature: Ceres CLONE 1780733
  misc_feature: Encodes the peptide sequence at SEQ ID NO. 2434
gagtcgagactccagagacgacgactcgtgacgcgtcgcgctcgctcgccgccgccggccgccgccggctgctgcgctgcgcggtggcgcggccatctggcagctgctgcaaaccccaattccaaatcccccgcagcgatcgaacgccacccccgaaaaatcccccaaaaaagaagggggaaattacgcagcatgaactgcttgaagaactcgcgctccgtcctctcgcggctcctccgccacaggccccacgtcgccatgccgccgccgccggcgacggcgccgcagtcgccggcatcccggtactactctttgtacgcctcccgcatcctccgcaacaagcccgccgtctccccgccgccgccgccgcagttgcctggccctaggcactactacacctcccggccgaggcaggaggtcatccacttcacccgccgccgcggcgggtcccggtggtaccacgaccagcggaagctcaccgcggcggtcttcatcaccgggggcggggcggtcgccatctacttcggccacctcgaggccgtgccctacaccaaccgctcccatttcatcatcgtctcgcccaagctcgagcgccagctcggcgagtcccagttcgccgaactcaagaagcagttcgggcccaagatcctgcccccgctccaccccgacagcatccgtgtccgcctcatcgcctcggagatcgtccgcgccgtgcaccgtggccttgccggccaccagcgatacgacgcctcgtacggagaggacgcctcgtatgggtatggcggcatctccgacgacgacaccatcaggaaccgcgacgccgacgctgctgccgcgatgcttggtgggtcccctcgcaagaacgcgacagcggctgctgcggcccagcgagacgacgaggttctggatgacaggtgggtcactgagagccggagccggggtaaggcgaagggggcgcagccgcagacgggtcaccttgacgggctcaattgggaggtgattgttgtcagagacgacatcgtcaatgcaatgtgcctgcccggtggcaagattgtagtcttcactgggttgctggacaaattcagggcagacgctgaggttgccactgtgcttgggcatgaggttggacacgctattgccaggcacgccgcagagcagatcacaaagaacatgtgggtggcaatcctgcagattattgccctgcagtttatctatatgccagacctgataaatacgatgtcaacattactccttaggctgcccttctcacggaggatggagatagaggctgatcacattggactcctgctacttggtgctgctggttatgatccacgagtagccccgtcagtctatgagaaactaggaaagataggaggagattcagcactgaacaattatctctcaactcatccttcgagtaagaagagagcagagcttctctcgcgagctaatgtcatgaacgaggcactggaattatacagggaagttagtgccggccaaggcactgaaggtttcctctagattctgggatttactcctctgcttgtttcaaatgctttacaaaaaggttggtcatcctagcacaactagtggaagatgaaagaatgtttcgtgtcccttgttaccttcagatgttgtgtggctgaatgggcctccgtctcaccccaaactggagcttagctgcttcaatcgtgatcaggaaaaaggaaaccaagttgtccatagtgtaataattgttttttttttgaaatcaacaataattgtttgttgacagcagctcctggctccaatgtcgtttggtccattcgtgctgatggctcatcatttcttttcgaaaagcatggctcaatcttgaatgattgatcttcaaaaaaaaaaaaaaaaaaaa

SEQ ID NO: 2434 - protein, 443 aa, Panicum virgatum
  misc_feature: Ceres CLONE 1780733
  misc_feature (1)..(159): Pfam Name: Peptidase_M48 Pfam Description: Peptidase family M48
MNCLKNSRSVLSRLLRHRPHVAMPPPPATAPQSPASRYYSLYASRILRNKPAVSPPPPPQLPGPRHYYTSRPRQEVIHFTRRRGGSRWYHDQRKLTAAVFITGGGAVAIYFGHLEAVPYTNRSHFIIVSPKLERQLGESQFAELKKQFGPKILPPLHPDSIRVRLIASEIVRAVHRGLAGHQRYDASYGEDASYGYGGISDDDTIRNRDADAAAAMLGGSPRKNATAAAAAQRDDEVLDDRWVTESRSRGKAKGAQPQTGHLDGLNWEVIVVRDDIVNAMCLPGGKIVVFTGLLDKFRADAEVATVLGHEVGHAIARHAAEQITKNMWVAILQIIALQFIYMPDLINTMSTLLLRLPFSRRMEIEADHIGLLLLGAAGYDPRVAPSVYEKLGKIGGDSALNNYLSTHPSSKKRAELLSRANVMNEALELYREVSAGQGTEGFL

SEQ ID NO: 2435 - DNA, 2261 bp, Panicum virgatum
  misc_feature: Ceres CLONE 1780770
  misc_feature: Encodes the peptide sequence at SEQ ID NO. 2436
atctccagcgcagcccaggcggcccgagcccaaaaataggcttccctaacggcggctgcaccagaacgcctccgtcgtttcccaatcctctgcggccaccctcaccgccgccggcagcggcgccaccctccggtgggtgtccgccaccgcgttctcgcgctcccctcctggctgtcggccccgctcctcctctatttatatccccgccctgcccacctccacgctttccttaggcaggagcgcgcagccggcccctgcccttcttcttcgccccttccccccgaataaaatttcctacccaaggaaacctacccaatccattcgtccggcggccgatccatctgtccctccagggagaggaaggaataatcagtcagtcagttattcagtcaatcggagcggaggagagccggaatccagcaggagcgcgccgcgggttgatcccttgcgtctccggccctgccgcgcgtgcgcggcgacgtctctgctgtgcctgcgcttgcgtcgcggaggacgaatctgtgcgggagtgtgtgtgtgaggaagaggaagaggaaggtggaggagggactcttggattggcatctccctcgctgggttgcgctgcgtcgcacggcaagacggcggccttgaagatgcgggtgctggaggacgacctcttcccctccacccccggcaaggtcaagatcgagagggcgggcaccatgaaccagcagctgcaccgctgcttcgcctccaccagcaccatgttcctgtgggcgctcttcctcgtcgccatgaccgcctcctacctcagcttccagtccttcgtcaacacctcctccaagtacttcgccgcctcctggggcgggctgcactgggagcggcagatccgagcgtccgccgcgccgaggaggccgccgggctcggcggacggggcggggatgtcggtgctggtgaccggcgccgccggcttcgtcggcacgcactgctcgctcgcgctccgcaaacgcggcgacggcgtcgtcggcgtcgacaacttcaacgcctactacgacccctcgcttaagaaggcccgcaaggcgctgctctcctcgcatggggtgttcgtcgtcgagggcgacatcaacgacggccgcctcctggccaagctcttcgacgtcgtgcccttcacgcacgtgctccacctcgccgcgcaggccggcgtgcgctacgccatggagaacccggcgtcctacgtgcactccaacatcgccggcctcgtcacgctcctcgaggcctgcaaggacgccgacccgcagccggccatcgtctgggcgtcctcctcctccgtctacggcctcaacgacaaggtccccttctcggagcgcgaccgcaccgatcagccggcgtcgctgtacgcggcgaccaagaaggccggcgaggagatcacgcacacgtacaaccacatctacggcctctccatcaccggcctccgcttcttcaccgtgtacgggccctggggacggccggacatggcctacttctctttcacccgcaacatcctgcaggggaagcccatcacggtgtaccgcggcaaggaccacgtcgacctggcccgtgacttcacctacatcgacgacatcgtcaagggctgcctcggctccctggacacggccggcaagagcacgggcaccggcggcaagaagcgcggcccggcgccctacaggatcttcaacctcggcaacacctcgcccgtgacggtgcccaacctggtgtccatcctggagaagcacctccgcgtgaaggcgaagaagaacgtggtcgagatgcccggcaatggcgacgtgcccttcacccacgccaacatctccctcgccagggaacagctcgggtacaagccgaccaccaacctcgacgttggcctcaagaagttcgtcaagtggtacctgtcctactacggctacagcaggggatccaagaactttcggcaatagccatggtcgtctgattctttcttctcaattcttctttttcctctttggcccggccgcggccaccactcccggatcaaacattgacattctacctggattttttggtgggaatatgttttagggcgttccttgatcagacaaaaatactggggaaaaaattcttttcttggtgaggagagggaggaaggaggaagaaagccatagagagcagcagccgttttcttttctttcttcatcttcccctttgtgtaaattggatgtgctccatgaaacttttttccctccgaaaaaaaaaaaaaaaaaaaa

SEQ ID NO: 2436 - protein, 439 aa, Panicum virgatum
  misc_feature: Ceres CLONE 1780770
  misc_feature: Great-hit functional homolog of the protein sequence encoded by LOCUS At4g30440
  misc_feature (1)..(258): Pfam Name: Epimerase Pfam Description: NAD dependent epimerase/dehydratase family
  misc_feature: Useful for making plants with altered cell wall content and/or composition
MRVLEDDLFPSTPGKVKIERAGTMNQQLHRCFASTSTMFLWALFLVAMTASYLSFQSFVNTSSKYFAASWGGLHWERQIRASAAPRRPPGSADGAGMSVLVTGAAGFVGTHCSLALRKRGDGVVGVDNFNAYYDPSLKKARKALLSSHGVFVVEGDINDGRLLAKLFDVVPFTHVLHLAAQAGVRYAMENPASYVHSNIAGLVTLLEACKDADPQPAIVWASSSSVYGLNDKVPFSERDRTDQPASLYAATKKAGEEITHTYNHIYGLSITGLRFFTVYGPWGRPDMAYFSFTRNILQGKPITVYRGKDHVDLARDFTYIDDIVKGCLGSLDTAGKSTGTGGKKRGPAPYRIFNLGNTSPVTVPNLVSILEKHLRVKAKKNVVEMPGNGDVPFTHANISLAREQLGYKPTTNLDVGLKKFVKWYLSYYGYSRGSKNFRQ

SEQ ID NO: 2437 - DNA, 2088 bp, Panicum virgatum
  misc_feature: Ceres CLONE 1780778
  misc_feature: Encodes the peptide sequence at SEQ ID NO. 2438
atccgatcgagctcggacactcgccgccgactccgccccccaatggggctcctcagctccctgccgccgcaccgccggggcggcgccctctccggcggctggcagtggtcgttcctcgatgtcgtctgggcggtcttcctcctcgcagtggtcgtcttcctcgcgctcgtcttcacgccccgccgcggggccggggacccgctctccgttgcccgctccggtggcgccgcgccggtgccgccgtgcgctgcctcggaggttgacttcctcccctgcgaggatccacgccgaagctcccgcctcagccgcgagatgaactactaccgcgagcgccactgccccgcgcgtggcgaggcgcccgcctgcctcgtcccgccgccgagcggctaccgcatccccgtgccctggcccgagagcctccacaagatctggcatgacaacatgccttacggtaagattgctgaaaggaaaggtcatcaagggtggatgaagcatgaaggttcatactttatttttcctggtggtgggactatgttccctgatggagctgaacaatacattgaaaagcttagccagtatgttccgctgaaaactggtgtcctcagaacaggtcttgatatgggatgcggggttgccagctttggagggtttttgcttaaggagaatatcatgacactttcatttgcaccaagagattctcataaatctcaaatacaatttgctttggagagaggaattccagcatttcttttgatgttgggcacgcgtcgtcttccatttccagcacagtcctttgattttgtccattgctcccggtgtttgataccctttactgcctataatggatcttatttgattgaagttgaccgtttacttagaccaggggggtatctaatcatatcgggtccccctgtgagatggaagaagcaggagaaggaatgggatgaacttcaagtaatggcaggagctttgtgctacaaattgatgactgttgatggtaatactgccatttggaagaaacctgctgaggcttcatgtcttcctaaccaaaatgaatttggccttgatctgtgtagcaccgatgatgatccagatgaagcatggtacttcaagttgaagaaatgtgttggtaaagtttctatggttgaagaaatagctattggttccattcaaaggtggccagataggctatctaaaccttctgctagggtatcacttatcaacaatggagcaaacttgtttgaaatagatagtcagaagtgggtgaggagagtatcatattataagaaatcacttggtgtcaagcttgggaccacacacatacgcaatgtcatggatatgaatgcgttccttggaggtttcgcagccgctatagtatctgatcctgtatgggtgatgaatgttgttcctgctcgcaaaccattgacacttggagttatctatgataggggccttattggggtttatcacgactggtgtgaaccattctcaacatatcctcgaacttatgatctcattcatgcggatgcaatcgactccttgataaacgatccaatttcaggcactagcagatgtgatctatttgatgtcatgctggagatggaccgcatactgcggccagaaggaactgctgttatacggggctccccagatgtgataaacaaggcagcacaggttgctcagtcagttcggtggaatgcccaggtgcatgacagtgaaccagaatcaggcagtaccgagaaaatacttgtggctacgaaaacattttggaagctaccgctaacatcacaatagtgtaactgtatgctatgcgtgtgtgaaccctttgcacttacactcagctctgttttttggggggtgggctagagggagatatgaggctaatgggattgatgaaatagtttaatcgaggtggttattcttttcttcattcttttgtttgttccatagtgaaaggttaggtgtagtgtaatactctgtggctccatcccctttcccatttgacagtaaatactgattgatgttgttatagcatattgacattttcttaagtgatttggtttattccaaaaaaaaaaaaaaaaaaaa

SEQ ID NO: 2438 - protein, 583 aa, Panicum virgatum
  misc_feature: Ceres CLONE 1780778
  misc_feature: The sequence is a functional homolog of  SEQ ID NO 354 in the  10/374,780 US patent application
  misc_feature: The sequence is a functional homolog of  SEQ ID NO 72 in the  10/225,068 US patent application
  misc_feature: The sequence is a functional homolog of  SEQ ID NO 910 in the  10/225,066 US patent application
  misc_feature: Useful for making plants with modulated growth and phenotype characteristics
MGLLSSLPPHRRGGALSGGWQWSFLDVVWAVFLLAVVVFLALVFTPRRGAGDPLSVARSGGAAPVPPCAASEVDFLPCEDPRRSSRLSREMNYYRERHCPARGEAPACLVPPPSGYRIPVPWPESLHKIWHDNMPYGKIAERKGHQGWMKHEGSYFIFPGGGTMFPDGAEQYIEKLSQYVPLKTGVLRTGLDMGCGVASFGGFLLKENIMTLSFAPRDSHKSQIQFALERGIPAFLLMLGTRRLPFPAQSFDFVHCSRCLIPFTAYNGSYLIEVDRLLRPGGYLIISGPPVRWKKQEKEWDELQVMAGALCYKLMTVDGNTAIWKKPAEASCLPNQNEFGLDLCSTDDDPDEAWYFKLKKCVGKVSMVEEIAIGSIQRWPDRLSKPSARVSLINNGANLFEIDSQKWVRRVSYYKKSLGVKLGTTHIRNVMDMNAFLGGFAAAIVSDPVWVMNVVPARKPLTLGVIYDRGLIGVYHDWCEPFSTYPRTYDLIHADAIDSLINDPISGTSRCDLFDVMLEMDRILRPEGTAVIRGSPDVINKAAQVAQSVRWNAQVHDSEPESGSTEKILVATKTFWKLPLTSQ

SEQ ID NO: 2439 - DNA, 1550 bp, Panicum virgatum
  misc_feature: Ceres CLONE 1780782
  misc_feature: Encodes the peptide sequence at SEQ ID NO. 2440
acgtggccatgctcccgttcatggccaagggccacaccatcccactcctccacctggctcgtgtgctcctcctccgcgggctcgcgtcggccgtcaccttcctcgccaccccgcgcgacgcgccctttgtccgcgccggcgcccccggggcggccgtcgtcgagctgccgttcccctcctcgacggctggcccgcagagcacggacgagctcccctccgggtccagcttcctcgacgtcgtctccgccgccgccgcgctcgagccggtgttcgcagacgcgctggcggcgctggacccgcggccggacctgctcgttcacgacgggttcctcgcgtgggccgctgacgccgccgacgacctcggcgtgccgcggctggtctcgctcggcatgggcgccttccccttatgtgttgcagccgccgtcatggcgcagaagccgcacgcgcgagtgagctcgccgttggagccgttccaggtcgacggcctgccggggctccggctcaccaaggccgacctgcacccgccgttcgacgacccggagccggcaggccctcactgggacttcgtctgcgagaccggcagtgccatgggcttgagccgaggtaccatcgtcaactccttccatgagctcgagtcattgtacatcgacaagtggaaccgcgagatgccgctcaacaagatgtggccggttggcccactctgtcttgccagtgagccggtccgaaccttggattccgatattgccgactggcttgattcaagactcgccatgaaccgaccggttctatatgtcgcattcggctcgcaagccgacctgagccgggcacagctagaggagatcgcaaccggcctggaccggtcggatctggacttcatttgggtagttcggtcgaggtggttcaatggaaaggagccgttccaaggcaggttccgtggcaggggcaaagtggtccaaggctttatcaaccagctcggcattttgggccatcaggctattaagggcttcttcagtcactgcgggtggaactcggtgatggaaagcatcagcatgggtgtgcccatcctaacctatccaattgccgcggagcagaagttgaacgcaaagttcgttgtcgacgtggttgaagtcggaatcaggatctggccatccaaaagaggggacagtggccccgcaagtgagcagcagcttgtttcaagtgatgacgtggaaacgttggcgagagagttgatcctgggagagggagggaaacgtgcggctgccaaagcgagtgagctcgctgacgcagctagagccgcagtggagacgagcgggtcgtcgttcaaaaccctagagctgatgctccatgaggtgtgtgagattggaaggcctgaggctaaatagtgatcagtggaaggctacggcctccggtgctagctaatgatgtactgtactcgtcaaattagtgaagttattactgggtcaaatgggattgttggtatcgtacgtatttgcccttttaaagctatataagaattgataatttgtgatcaaaaaaaaaaaaaaaaaaaa

SEQ ID NO: 2440 - protein, 457 aa, Panicum virgatum
  misc_feature: Ceres CLONE 1780782
  misc_feature (1)..(112): Pfam Name: UDPGT Pfam Description: UDP-glucoronosyl and UDP-glucosyl transferase
MLPFMAKGHTIPLLHLARVLLLRGLASAVTFLATPRDAPFVRAGAPGAAVVELPFPSSTAGPQSTDELPSGSSFLDVVSAAAALEPVFADALAALDPRPDLLVHDGFLAWAADAADDLGVPRLVSLGMGAFPLCVAAAVMAQKPHARVSSPLEPFQVDGLPGLRLTKADLHPPFDDPEPAGPHWDFVCETGSAMGLSRGTIVNSFHELESLYIDKWNREMPLNKMWPVGPLCLASEPVRTLDSDIADWLDSRLAMNRPVLYVAFGSQADLSRAQLEEIATGLDRSDLDFIWVVRSRWFNGKEPFQGRFRGRGKVVQGFINQLGILGHQAIKGFFSHCGWNSVMESISMGVPILTYPIAAEQKLNAKFVVDVVEVGIRIWPSKRGDSGPASEQQLVSSDDVETLARELILGEGGKRAAAKASELADAARAAVETSGSSFKTLELMLHEVCEIGRPEAK

SEQ ID NO: 2441 - DNA, 2011 bp, Panicum virgatum
  misc_feature: Ceres CLONE 1780787
  misc_feature: Encodes the peptide sequence at SEQ ID NO. 2442
ctcctccgggctccggcctcccctaatcccactccgccgccgccgccgccgccgccagcttacctcaccatggcggcgactgcccacgcctcctccatgtctttcctgctctcccacccccagccacgctccgccgccccaggcatccatctcccgctccgcccggccgcccgccgcgtccgttacgccaccgatgccgccgtccccacggcccagcccgccgccgccgccgccagcaccaagcaccggcgcgcggcggatgagaacatccgcgaggaggcggcgcggcaccccgccccgaagcagggcctctccgcgtggtacgagcccttcccgcccgcccccaacggcgaccccaacgagcgctactccctggatgagatcgtctaccgctccagctcggggggcctcctcgacgtgcgccacgacatggaggcgctggcccgcttctcgggcgcctactggcgggacctcttcgactcccgcgtcggccgcaccacctggccctacggctccggcgtctggtccaagaaggagttcgtcctccccgagatcgaccccgaccacatcgtctccctcttcgagggcaactccaacctcttctgggccgagcgccttggccgcgatcacctcggcgggatgaacgacctctgggtcaagcattgcggcatctcccacacggggtccttcaaggacctcggcatgaccgtgctcgtcagccaggtcaaccgcctccgccgcgcgccgctctcgcgccccatcgccggcgtcggctgcgcgtccacgggggacacctccgccgcgctctccgcctactgcgcggccgcggggataccagccatcgtcttcctcccggccaatcgcatctcgctggagcagctcatccagccgattgccaacggcgccactgtgctctcgctggacaccgacttcgacggctgcatgcggctcatcagggaggtgactgccgagctgcctatttaccttgccaattcgctcaattctcttcggcttgaggggcagaagacggcagctattgagatactgcagcagttcgattgggaggtgccggattgggtcattgttccaggaggcaatcttgggaacatctatgccttttacaagggattcgagatgtgccgtgttcttgggcttgttgatcgtgtgccacggcttgtctgcgcacaggctgccaatgccaacccactgtacagttattacaagtcgggttggactgagttccagccacaggtggccaagcctacatttgcatcagctatccagattggtgacccggtgtctgtcgaccgagctgtggttgcactcaaggctacaaatggcattgttgaggaggccacagaggaagagctcatgaacgcaatgtcacttgctgatcgcactggaatgtttgcctgcccgcatactggtgttgcgctcgctgccctgttcaagctcagggaccagcgtgtcatcggggcgaatgagcgtgttgtggttgtcagcacagcccatggtctgaagttctctcagtccaagatcgactaccatgatagcaagatcgaggacatggcttgcaagtatgccaacccaccggtgagcgtgaaggctgactttggtgccgtcatggatgtcctcaagaggagactcaagggtaagctctgagcctctgtttggctaactcttccaattgattgatgtgcttcaattgtgttctgctgcatctgatttgaatgcgttgggtgactatggagcgacgattcctcggtcactagtccgttaggtctttggcctctttcaggcttcaattgggattgtgggtaggctatctgtttgaggaatttagcaagacttggaggggtatctcttgtactaccatgtgttctatggataataagtgatggtgttgctgtcggatcgaataatctcactcaatcctctgtccttcctcctttgtgcatgaagttgtccaatattattttggctgttgccagaaaaaaaaaaaaaaaaaaaa

SEQ ID NO: 2442 - protein, 530 aa, Panicum virgatum
  misc_feature: Ceres CLONE 1780787
  misc_feature (50)..(526): SWISSPROT Homolog: EC 4.2.3.1 Threonine synthase, chloroplast precursor
  misc_feature (53)..(526): SWISSPROT Homolog: EC 4.2.3.1 Threonine synthase, chloroplast precursor
MAATAHASSMSFLLSHPQPRSAAPGIHLPLRPAARRVRYATDAAVPTAQPAAAAASTKHRRAADENIREEAARHPAPKQGLSAWYEPFPPAPNGDPNERYSLDEIVYRSSSGGLLDVRHDMEALARFSGAYWRDLFDSRVGRTTWPYGSGVWSKKEFVLPEIDPDHIVSLFEGNSNLFWAERLGRDHLGGMNDLWVKHCGISHTGSFKDLGMTVLVSQVNRLRRAPLSRPIAGVGCASTGDTSAALSAYCAAAGIPAIVFLPANRISLEQLIQPIANGATVLSLDTDFDGCMRLIREVTAELPIYLANSLNSLRLEGQKTAAIEILQQFDWEVPDWVIVPGGNLGNIYAFYKGFEMCRVLGLVDRVPRLVCAQAANANPLYSYYKSGWTEFQPQVAKPTFASAIQIGDPVSVDRAVVALKATNGIVEEATEEELMNAMSLADRTGMFACPHTGVALAALFKLRDQRVIGANERVVVVSTAHGLKFSQSKIDYHDSKIEDMACKYANPPVSVKADFGAVMDVLKRRLKGKL

SEQ ID NO: 2443 - DNA, 1628 bp, Panicum virgatum
  misc_feature: Ceres CLONE 1780792
  misc_feature: Encodes the peptide sequence at SEQ ID NO. 2444
ggcggcttcgggcaccgaagcagaggaggggcgtctccaattccccatggccaccaaggttcttgacaggctcacggtggcggcctcgcctccggcgcccggcggcgtgctcccgctcaccttcttcgacgtcccgtggctcttcaccggccccgtagagcgcgtcttcttctacccctacccgcacacggcggagcaattcagcgcccgcctcctgccgcccctcgtgtcctccctctccgccgcgctgcactggttctacccgctgctcggccgcgtccgcccgtgcccggacgggggcggcgggtacgagttcttctccgcgggtggggatgcgggcgaagagggcgtcgagctcaccgtcgccgagagctccgacgacttcgacgagctgtccggcggcggcccgagggacgttgcccggctgtacgcgctggtgccgcagcttccccggacggaagacgggaccttcgccctcgcggcggcgcaggtcacgctgttcgccggccgggggatcgccgtcggcgtgtccatccaccacgtggcctgtgatgattccagctacatgcacttcgtcaagacctgggccggccagtgccgggtggccgccggcgaggagtccgccgaaggcgcgctgccaccgccgccgctcctggaccgtggcgtggtcgccgaccccgagggacttgccgccaggacgctcgacgaaatgcgtaagctggcagccaacgccccgcctcctcctcctccgccgccgccgacgaagctggtcatcgcgtcgttcgcggtcagccgcgaccacatcgataagctgaagcagcgcatcgtcgccgagggcagcgggcgtgtccactgctcggcgttcacgatggcgtgcgcgttcgcgtgggcctgcctggcgcgggtggacggcggctgcgcggacgcggagcggcgcgcgcacctgctgttctcggtggaatgccggcggcgccaggcgccgccgatcccgcaggagtacctgggcaactgcctccgcccgtgcttcgtggaggtgggcctgggcgagctgctgggcggcgacggcgtggtggccggcgccgcggcgatcggcgcgtccatcagggcgctggacgacggcgtgctggctggcgccgacgggtggttccccaagatcctgtcgctggtcccggagcggccgatgtcggtgggcggctcgccgcggtacggcgtgtacgaggccgacttcgggctcggccggccgacgaaggtggagctggtgtccatcgacaagacgcccggcacggtgtcgctggcggagggccgcgacgcgcaggccgggatcgagatcggcgtggtgctgccggaggccgagatggcgcgcttcagctcctgcttctccgacggattggagcagctgtgagcaccttggcgtgcaggtggtcggtcagctgtggtgtggtttggtgctgcttgtcaagttgtttatccgcatgcaaattgcaattgcaattgcaattgttggtgacataatttggtggttaagtagtagtaatatagataatcgaagaaattgtatatttgagcaagagatgtatacatatatcttggtgtgtgagaatctttgttaaaaaaaaaaaaaaaaaaaa

SEQ ID NO: 2444 - protein, 451 aa, Panicum virgatum
  misc_feature: Ceres CLONE 1780792
  misc_feature (1)..(192): Pfam Name: Transferase Pfam Description: Transferase family
MATKVLDRLTVAASPPAPGGVLPLTFFDVPWLFTGPVERVFFYPYPHTAEQFSARLLPPLVSSLSAALHWFYPLLGRVRPCPDGGGGYEFFSAGGDAGEEGVELTVAESSDDFDELSGGGPRDVARLYALVPQLPRTEDGTFALAAAQVTLFAGRGIAVGVSIHHVACDDSSYMHFVKTWAGQCRVAAGEESAEGALPPPPLLDRGVVADPEGLAARTLDEMRKLAANAPPPPPPPPPTKLVIASFAVSRDHIDKLKQRIVAEGSGRVHCSAFTMACAFAWACLARVDGGCADAERRAHLLFSVECRRRQAPPIPQEYLGNCLRPCFVEVGLGELLGGDGVVAGAAAIGASIRALDDGVLAGADGWFPKILSLVPERPMSVGGSPRYGVYEADFGLGRPTKVELVSIDKTPGTVSLAEGRDAQAGIEIGVVLPEAEMARFSSCFSDGLEQL

SEQ ID NO: 2445 - DNA, 1630 bp, Panicum virgatum
  misc_feature: Ceres CLONE 1780805
  misc_feature: Encodes the peptide sequence at SEQ ID NO. 2446
gaaggggacgaggagcgggcggtggcggtcgtcgctgctgctgcttctggtggcagtgcggcggcggcggccatgagctggaggaggggaggcggcgccggcgcggatggcgtggccaggaggtgggtgctgctgctttgcgtcgggagcttctgcctcggcctgctcttcaccaacaggatgtggacattgcctgaagcaagtgagatagctataccaaatgaaaggaaggggaaagagtctgagcttatggctggagactgtagtatacgaaaagttcaaggaaaacgcgattacggtgacatgctacatatgtcagatactcaccatgatgcacagactttagataagaccatagcaaacttggagacagaactctctgccgcaaggactctacaagattcttttctcaatggatctccagtgtcagaagagtacaaggcttctgagtctaccggtaggcgcaagtaccttatggtgataggtatcaatactgcttttagcagccgcaagagaagggattctatccgcaacacctggatgcctcaaggagaaatgaggaaaaagctggaggaagagaaggggatcataattcgttttgttattggtcacagtgctatttctggtggaattgtcgatagagcaattgaggcagaggataagaaacatggagacttcatgaggcttgatcatgtggagggataccttgaactttcgggcaaaacaaggacatactttgcaacagctgttgctttatgggatgctaacttctatgtgaaggttgacgacgacgtgcatgttaatatagcaacacttggaaatatcttatccaaacatattttgaagcccagggtatatattggatgcatgaagtctggccctgtcctatctgacaaggatgtcagatactatgaacctgagcattggaagttcggggaagtgggtaacaaatattttcgacatgccaccggtcaactatatgccatttcaaaagatttggcaacctacatatcaataaacaagcatgttttgcacaagtacatcaacgaagatgtttctttgggatcttggttgatagggttagatgttgagcatattgatgaccgcagactatgttgcggcactccacctgattgcgaatggaaagctcaggcagggaacacctgcgcagcctcgtttgattggaagtgcagtggtatctgcaactctgtgcagaacatctggggtgttcataagaagtgttcagaaggtgaaaaggcactgttaactgcctcgttctaatcaaagcaagtaatctccgattgaattgagatctaaaggggaccatcggcaagactggaatgcgctctgttgtgtacttaggtgtacattgtgcagaaaatgtctctgattcatttgtaggcctgtaactagctagatgcagtttaggattgggcaacactgctggagcggaccgggattttactcagcgtccgctggtgccaatcgaggatttctgaggggtgtagagctgattgattcttttgtcttgctcctatttgggtggccatttttgtagacctgatagaaagaagtactaatatattgcagaacagtggttccgtgttcagaaaaaaaaaaaaaaaaaaaa

SEQ ID NO: 2446 - protein, 402 aa, Panicum virgatum
  misc_feature: Ceres CLONE 1780805
  misc_feature (1)..(199): Pfam Name: Galactosyl_T Pfam Description: Galactosyltransferase
MSWRRGGGAGADGVARRWVLLLCVGSFCLGLLFTNRMWTLPEASEIAIPNERKGKESELMAGDCSIRKVQGKRDYGDMLHMSDTHHDAQTLDKTIANLETELSAARTLQDSFLNGSPVSEEYKASESTGRRKYLMVIGINTAFSSRKRRDSIRNTWMPQGEMRKKLEEEKGIIIRFVIGHSAISGGIVDRAIEAEDKKHGDFMRLDHVEGYLELSGKTRTYFATAVALWDANFYVKVDDDVHVNIATLGNILSKHILKPRVYIGCMKSGPVLSDKDVRYYEPEHWKFGEVGNKYFRHATGQLYAISKDLATYISINKHVLHKYINEDVSLGSWLIGLDVEHIDDRRLCCGTPPDCEWKAQAGNTCAASFDWKCSGICNSVQNIWGVHKKCSEGEKALLTASF

SEQ ID NO: 2447 - DNA, 1728 bp, Panicum virgatum
  misc_feature: Ceres CLONE 1780811
  misc_feature: Encodes the peptide sequence at SEQ ID NO. 2448
agctacaagctcgctggctccgagcatagctgtcccgtccgcgtcgtctagctacccgtcgagctctccatcggggtcccggacggacgcgaggaggagtagcggaggacaatcgccgcaatgccgccgtcggggatcaccgcggtggacgcggcggccaaggggatgaagctggagcggtacgcgagcgggggcgcgctgctgctgcggcgcgccaccagcgccaagctcgtgtcggcgtcgtcgcacctgctcttccgcgccaccgtgctcgccacgctcgcgctcgtcttcctcttcacgctgcactacccgtccctcctgtcccgctccttccacctctccgccggcggcgacgccgcgcacccctcgtccgcctcgcaccggagcctgctcatgtcctcctcctcctcctcctcctcggcggcggcgtcgtacggggacgccgcgtgggagaaggagatgcggcggagcgccaggccgagccgcgacggcgggatctccgtgctggtcaccggcgccgccgggttcgtgggcacgcactgctcgctcgcgctcaaggcccgcggcgacggcgtcgtcgggctcgacaacttcaactcctactacgacccgtcgctgaagcgcgcgcggcaggcgctcctggccagccggggcgttgtggtgctcgacgccgacatcaacgacggcctgctactggagaagctcttcgacgtggccgcgttcacgcacgtgctgcacctggcggcgcaggccggcgtgcgctacgcgatggaggcgccgcagacgtacgtggcctccaacgtggccgggctcgtcagcgtgttcgaggtggcggccaagcacgccgacccgcagccggcgatcgtctgggcgtcgtcgtcgtccgtgtacgggctcaacaccgacgcgcccttctccgaggaccaccgcaccgaccgcccggcgtcgctctacgcggccaccaagaaggccggcgaggccatcgcgcacacctacaaccacatctacggcctctccatcaccggcctccgcttcttcacagtctacggcccgtggggccgccccgacatggcctacttcttcttcgcccgcagcatcgtcgccggcgagcccatcacgctcttccgcgccgccgacggctccgacgcgcgccgcgacttcacctacatcgacgacgtcgtcaagggctgcctcggcgcgctcgacaccgccggcaagagcaccggctccaaatccggcaagaagagcgggcccgcgccgctccgcgtttataacctcggcaacacctcccccgtgcccgtcacccggatggtcgccatcctcgagaagctgctcgggaagaaggccaacaagcgcatcgtcaccatgcccagcaacgacgatgtgcccttcacccacgccaatgtcagccacgccgcgcacgacttcggctaccgccccaccacctccctcgaggccggcctccggcacttcgtcgactggttcgtggagtactacaagctcgacaccaagatcgccaagagcgcccgcagcagcgccgccgccaagcccgcgaagaagaagaaggccgcggcggcgtcttcgtgatcgatcaagcacatgcacagcacacagagacagagcaccaccaccacaaccacaagtgtgtattctctagctagttcttggaggcttttgtctgtaaccatgtattgtttaagccctcgctacttccttcttcttctc

SEQ ID NO: 2448 - protein, 489 aa, Panicum virgatum
  misc_feature: Ceres CLONE 1780811
  misc_feature: Great-hit functional homolog of the protein sequence encoded by LOCUS At3g23820
  misc_feature (1)..(260): Pfam Name: Epimerase Pfam Description: NAD dependent epimerase/dehydratase family
  misc_feature: Useful for making plants with altered cell wall content and/or composition
MPPSGITAVDAAAKGMKLERYASGGALLLRRATSAKLVSASSHLLFRATVLATLALVFLFTLHYPSLLSRSFHLSAGGDAAHPSSASHRSLLMSSSSSSSSAAASYGDAAWEKEMRRSARPSRDGGISVLVTGAAGFVGTHCSLALKARGDGVVGLDNFNSYYDPSLKRARQALLASRGVVVLDADINDGLLLEKLFDVAAFTHVLHLAAQAGVRYAMEAPQTYVASNVAGLVSVFEVAAKHADPQPAIVWASSSSVYGLNTDAPFSEDHRTDRPASLYAATKKAGEAIAHTYNHIYGLSITGLRFFTVYGPWGRPDMAYFFFARSIVAGEPITLFRAADGSDARRDFTYIDDVVKGCLGALDTAGKSTGSKSGKKSGPAPLRVYNLGNTSPVPVTRMVAILEKLLGKKANKRIVTMPSNDDVPFTHANVSHAAHDFGYRPTTSLEAGLRHFVDWFVEYYKLDTKIAKSARSSAAAKPAKKKKAAAASS

SEQ ID NO: 2449 - DNA, 1907 bp, Panicum virgatum
  misc_feature: Ceres CLONE 1780836
  misc_feature: Encodes the peptide sequence at SEQ ID NO. 2450
acacagcttccaagtgatttgttttgggctagctagtcatctggcaggaaagggggagaacaaagctgctggctgctactaccaactcttttgttcatctgggctagctcatcgatccgttgatcatatagcagctctatctgtcgtgaagaagacgaagaagaagaaggagaaagttgattttggattggtaggatgattcactccatttcaagatgggtcaattttatgtgaagcggtggtcaataagcaagctataagttcagagccgagttcgttgttcaagtaatcatctgaatggcgtatccatctacctccggcatggtccaagcttcttcatccctccatggcatcataagaagggacccagaaggatatgacatgccatccgatctggatcaagccctactcctctacttcgatggccagcaacaagcagctaacaggccatcaattcaagaacaacaaccgcagactctcaacatcttcccttcccaaccaatgcacatcgagccatccccaaagggctccatgtcttcttcagcggcggcagcacaggtcgccggcccttccaagacctcgcaagcggcgccgtcgaaggccggaggcgggccgctctccgcaggcaagagctccaaggcagcgatcaagagagaaggtagcgccggcggcaagcatggcggcgccggcgcggggccttcgagctcggatcaggaggggccccggacgccggaccccaagacgctccggcggctggcgcagaacagggaggccgcgaggaagagccggctaaggaagaaggcttacattcagcagctagagtcaggcaggatcaggctggcgcatctagagcaggagatgcagatggcaagaactcatcagagtgctctatggggtacaggaaccctaagcccagacgccgcgctgttcaacctggagtacgagcggtggctgggcgaccacagcaaggtggtggcccggctgcgcgccgccgcggaggagcaccggccggacggcgagctacgggcgtacgccgacgaggcggcctcccactacggcgcgttgatggggctcaaggcccgggccgccgccgccgacccgctccacctcctctccggcctctggaagggcgccgccgagcgctgcttcctctggatcggcggcttccgcccctccgagctcatcaaggtcgcggtgcggcatgtggagccgctggcggagcagcaggcggcgggggcgcgcgacgtggagcaggcggcgcggcgcgcggaggaggcgctcgacgccgagctggaggcgctgctgcggtcgctgtccgaggccgtcgcctccgacgcgcagccgccgccgccgggggtgttcggcggccagctctacccgcacctcccgggcgccgacgcggcgggctacatggggatggggcacatgcacatggcgctcgccatggacaagctcgccaccctcggcaccttcctcagacaggcggacgagctgcggatgcaggcgctgcaggcgctccggcagatcctgacggcgaggcaggcggcgcgctgcttcgtcgccgtcgacgactacttctgccgcctccgcgcgctcagcacgctctggaccaccacccgggcggcgccgccgcagctggcgagaggccccgccgggtagggatcgagccggtcgagcgacgccatggatggcatactgctcgctagcttagctatgacgtagagattaaagacgacgttgaatctagcagcaccatgccaatgtaccaaggatcacaagcttgtgtaggatattggtggtatagaaagaacagggaaactggaattgaagaacaagatgaaaaacgtttgtgttgcgttttagttaggcaactgaaattgctaaagcaaaaaaaaaaaaaaaaaaaa

SEQ ID NO: 2450 - protein, 453 aa, Panicum virgatum
  misc_feature: Ceres CLONE 1780836
  misc_feature (1)..(45): Pfam Name: bZIP_1 Pfam Description: bZIP transcription factor
MAYPSTSGMVQASSSLHGIIRRDPEGYDMPSDLDQALLLYFDGQQQAANRPSIQEQQPQTLNIFPSQPMHIEPSPKGSMSSSAAAAQVAGPSKTSQAAPSKAGGGPLSAGKSSKAAIKREGSAGGKHGGAGAGPSSSDQEGPRTPDPKTLRRLAQNREAARKSRLRKKAYIQQLESGRIRLAHLEQEMQMARTHQSALWGTGTLSPDAALFNLEYERWLGDHSKVVARLRAAAEEHRPDGELRAYADEAASHYGALMGLKARAAAADPLHLLSGLWKGAAERCFLWIGGFRPSELIKVAVRHVEPLAEQQAAGARDVEQAARRAEEALDAELEALLRSLSEAVASDAQPPPPGVFGGQLYPHLPGADAAGYMGMGHMHMALAMDKLATLGTFLRQADELRMQALQALRQILTARQAARCFVAVDDYFCRLRALSTLWTTTRAAPPQLARGPAG

SEQ ID NO: 2451 - DNA, 1699 bp, Panicum virgatum
  misc_feature: Ceres CLONE 1780859
  misc_feature: Encodes the peptide sequence at SEQ ID NO. 2452
acggcagctctgacctctgaagccacagctctgtactttgttttcctatcttccttaccctcaggttgagcagccaccgctcccatggacaacggatccacgaagcagaccgttgttcttttccccggcggcggcgtcgggcacgtcgggcccatgacgcagctcgccaaggtcttcctcggccacggctacgacgtcaccatggtgctcatcgagccgccgatcaagtcgactgactccggcgccggcttcatcgagcgcgtcgccgcctccaacccgtccatcaccttccacgtcctgccgccgatcccgccccctgacttcgctagctcccccaagcaccctttcctcctcatgattgagttcatgcgacagtacaacgagaagctcgagagcttcctctgctccatcccgcgggcgcgcttgcactcccttgtcgtcgacatgttctgcacccacgccatcgatgtggccgcgaagctgggcgtccccgtctacacgttcttcgcgtcgggcgccggggttctcgccgtcttcacccagctgccggcgctgctcgccggcaggcgaacggggttgaaggagctcggagacacgcccctcgagttcctaggcgttccgccgatgccggcgtcccatctcgtcagggagctgctcgaggacccggaggacgagctatgccggaccatgatgaacacctggaagcgcaacacggacacccatggcgttctggtcaacacgttctgctcgttggagagccgggccctgcaggcgttcagggatcccctgtgcgtccccggccgggtgctgcctccagtctactccatcgggccgttggtcgctaagggcgggagcggggaggacgaggagggagcggagaggcccgagtgcctcgcatggcttgacgcgcagccggagcgcagcgtcgtgttcctctgctgggggagcaaaggctcgctgccggaggagcagatcaaggagatcgccgctggcctagagaggtccgggcaacgtttcctctgggtcgtgcgcacgccggccggcagctacgacaccaagaggtacctggagcaacgccccgagccagacctcgacgcgctcctgccggaggggttcttggagcggaccaagggccgcggattcgtcctcaagtcatgggcgccgcaggcggacatcctcacgcacccggccacgggcgctttcgtgacccactgcgggtggaactcgacgctggaggccattgccgcgggcgtgccgatgctgtgctggccgctgggcgcggagcagaagataaacaaggtgctcatgaccgcggacatgggcgtcggcgtggagctggaggggtacaacgcaggcctcgtcaaggccgaggagattgaggccaaggtgaagctggtgttggagtcggaggaggggagggggctcggggaacgagcggcggaacggaagaaagaagcagaggaggcgctgaaggacggcggctcgtcgcgggcggcgttcctccggttcttgtcggatgttgagaatcttagagcgtgagattgacgaaattgtaaccagccttgctgtttatgtttgttttcttgcatactagtcttgtcctccctttgtcaattctattgtactgcttctgctgtctttcctagaataaaaaggaaacgatgacgatattgactagcaaaaaaaaaaaaaaaaaaaa

SEQ ID NO: 2452 - protein, 484 aa, Panicum virgatum
  misc_feature: Ceres CLONE 1780859
  misc_feature (3)..(165): Pfam Name: UDPGT Pfam Description: UDP-glucoronosyl and UDP-glucosyl transferase
MDNGSTKQTVVLFPGGGVGHVGPMTQLAKVFLGHGYDVTMVLIEPPIKSTDSGAGFIERVAASNPSITFHVLPPIPPPDFASSPKHPFLLMIEFMRQYNEKLESFLCSIPRARLHSLVVDMFCTHAIDVAAKLGVPVYTFFASGAGVLAVFTQLPALLAGRRTGLKELGDTPLEFLGVPPMPASHLVRELLEDPEDELCRTMMNTWKRNTDTHGVLVNTFCSLESRALQAFRDPLCVPGRVLPPVYSIGPLVAKGGSGEDEEGAERPECLAWLDAQPERSVVFLCWGSKGSLPEEQIKEIAAGLERSGQRFLWVVRTPAGSYDTKRYLEQRPEPDLDALLPEGFLERTKGRGFVLKSWAPQADILTHPATGAFVTHCGWNSTLEAIAAGVPMLCWPLGAEQKINKVLMTADMGVGVELEGYNAGLVKAEEIEAKVKLVLESEEGRGLGERAAERKKEAEEALKDGGSSRAAFLRFLSDVENLRA

SEQ ID NO: 2453 - DNA, 1670 bp, Panicum virgatum
  misc_feature: Ceres CLONE 1780907
  misc_feature: Encodes the peptide sequence at SEQ ID NO. 2454
gctgtccagctttttccgattccgttcccttccgtgggcgtggcgatgagaatgagatgctgccgctactgatgctaccgcggcggcgagaggagctcatcccctcggcggcgagcagaaccaccaccggatctagaaccccccttgcctcctcgtctccctctctccacgcgtagggcttcgagagcatcgcggcggcgagtctgcgaggccggcggcgaactcgccggcggcaagcctgcgttgggtccgcgagcgcggctcgctgctgaggcgaacccgcttcggggaggcgagcgcgtcaggagatccgtgcctcccacctactgtcagacagccccctcagttcgtccaatccggcgcttaagaagattaagaagaccatggcgatgcggggcgtcgatttcaagtggtacgatgggttcttcctctccatgctcgccactagcgtaatcatcgtctccatcaattggaagaggtatcgcctctgtgcccatccgctccacatttggatagtggtggactacaccactgtcttcatcttccgtctcctcatgtttcttgataatggtcttgctgcagggatgggattagatctcggatggcaacagagatatgctcgcttttgtggacgaatagttgtcctctcagttcttgtactacttctctacccctttctttgggtttggactgtgataggaacattgtggtttagcactgcaagaggctgtttgcctgaggaaggacaaaaatggggtttcctgatatggctgctgttcagttactgtggactcgcctgcattgcttgtgttgctgttggaaagtggctaaaccgaaggcacgcacttcaacaaagggcacagcagggaattcccgtctctgaatatggggttttggttgatatgatccgtgttcctgactgggcatttgaggccgttggcctggaaatgagagtgggccaagatacagcatatcatccaggtctttacttaagtgcagctcagcgagaagcagttgaggcactgattcaagaacttccgaaattcaggctgaaagctgttccaaccgactgcagtgaatgtcccatctgccttgaagaatttcatgttggcaatgaggtgcgtgggctcccatgtgcgcacaatttccatgtggagtgcatcgaccaatggctccggctgaatgtgaagtgcccacggtgccggtgctccgtcttccccaacttggacctgagcgcactgaacaatctccggtcgaccagcgagccagatcacccatccgccagtgccagcgatgtaacaacagcaactgcagcgactagatacgtgaggtcgcagccggctgggcaaagctacttggtgcggttgcagggtctgctgctccgtccagtccggcacgagagcatggagagtgggggtgagccagttgtggccaacagcagctcggttggccctgaggatctggccagcatagttgtagacgatggccatcagctgccagatcgctgagtggtttgatggcctaaactatatttagtaggaggggaaatagaaagggaatcaaattatgcagcggttttctttttgctgtgtattttgcgagtaaataatattgttatattatcgtttgaccaattcatcgtttgcgtccaaaaaaaaaaaaaaaaaaaa

SEQ ID NO: 2454 - protein, 374 aa, Panicum virgatum
  misc_feature: Ceres CLONE 1780907
  misc_feature (1)..(41): Pfam Name: zf-C3HC4 Pfam Description: Zinc finger, C3HC4 type (RING finger)
MAMRGVDFKWYDGFFLSMLATSVIIVSINWKRYRLCAHPLHIWIVVDYTTVFIFRLLMFLDNGLAAGMGLDLGWQQRYARFCGRIVVLSVLVLLLYPFLWVWTVIGTLWFSTARGCLPEEGQKWGFLIWLLFSYCGLACIACVAVGKWLNRRHALQQRAQQGIPVSEYGVLVDMIRVPDWAFEAVGLEMRVGQDTAYHPGLYLSAAQREAVEALIQELPKFRLKAVPTDCSECPICLEEFHVGNEVRGLPCAHNFHVECIDQWLRLNVKCPRCRCSVFPNLDLSALNNLRSTSEPDHPSASASDVTTATAATRYVRSQPAGQSYLVRLQGLLLRPVRHESMESGGEPVVANSSSVGPEDLASIVVDDGHQLPDR

SEQ ID NO: 2455 - DNA, 2443 bp, Panicum virgatum
  misc_feature: Ceres CLONE 1780940
  misc_feature: Encodes the peptide sequence at SEQ ID NO. 2456
ctcttcatctcctcctccgccccatcccccgccgccgccgcatctgccaggtgcccgctcgggcactcgccgctagccccggccgcggccacccgtcgcccaacaccggcgcaggcgcgccgcccctggccgctgctacttcgggagcaggggacgcttcgacaccgagtacccgccgccgctgctccgactccaccagcatcactccgtagctcaacctcccggccccgtgcgtcgtccacagtttcaggccccagctgtactcttgacagaagcgaagatggcgcgccgagggttgatggagcaggatctgagcaagctcgacgtcaccaagctgcaccctctgtcaccagaggtgatttcgcgccaagcgacgatcaacatcggtaccattgggcatgtggcccatgggaagtctactgttgtcaaagcaatctcaggtgtacagactgttcgattcaagaatgaactggagcgcaatatcacgataaagcttggttatgctaatgcaaaaatctataaatgtgaagatgataagtgcccacgcccaatgtgctacaaggcttatggcagtggcaaagaagatagccctctctgtgatgttccagggtttgaaaattgtaggatgaagctcctgagacatgtttcatttgttgattgcccggggcatgacattctcatggctacaatgcttaatggagcagctatcatggacggagcactacttctgattgcagcaaatgagagctgtccacagccccagacatctgagcaccttgcagctgttgaaattatgcgtcttcaacatattatcattctgcaaaacaagatcgatcttatccaggaaagtgcagcaatgaaccagcatgaagcaatccagaaatttatacagggaacaatagctcaaggtgctcctgtggtgccaatatctgcgcagctgaagtacaatattgatgttatatgtgaatacattgtgaaaaagatccccatcccagagaggaatttcatctctccacccaacatgattgttattcgttcttttgatgtgaacaaacctggttcagaggttgatgaaatcaagggtggagtagcaggtggcagtatcctcaagggagtcctgagggtgaaccagaaaattgaagttcgcccaggcatcgtgatgaaggatgagcatggcaaacttaaatgcacgcccatctattcaaggattgtctccctgtatgccgagcagaatgaactccagtttgccgttcctggagggcttattggagttggaactaccatggacccgacactgactcgtgctgataggctggtcggtcaggttcttggtgaagttggatcactgcctgatgtttatatcgagttagaggtgaacttcttcctcctaaggaggctgctgggggtgaggacaagtggaacagaaagggcaagcagggtctcaaagcttgccaagggtgagatcctgatgcttaacattgggtcgatgtccaccggagcccgtgttctcgctgttaagaatgatcttgcaaagctgcagctgactgctccggtgtgcaccagcaagggtgagaagttggcccttagccggcgcatcgagaagcactggcgtctcattggttggggcacaatccaggctggcactacacttgatgtcccaccctgcccgctctgaatcgtacaccacctgtttgacgctagagtttgaaaaagagagtggacatgtggcaaggcaaagagctgttaggaactgtttttgtaaggtggaggagaaaacctgaaccaaaatgttacctgcttggggtttattcttccatctgcagttttgtattgttattatgtgatggatgagtcacatcatagtgtttacttgggcagcgtatttataagcttgaatatagaattgagcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagctygggggggggssccgggccccaatttcccctttagggggggttttttcccccccccccggggccgttttttaaaaccgggggggggggaaaaccccgggttttccccattttatccccttggaacccctcccccttttccccgggggggaaaaaagaaaaaggccccccccgttcccccttcccaaaaggtgcccccccctaagggggaagggggcccccccctgtggggggcattaaggggggggggggggggggtttcccccccggtgcccccaaacttttgcggcccccattcccccctttttttttttttttttcctttcttttctcgtaagtggccggggtttccccccaaaacttaagaaaggggggcctttttaggggtcaaatttaggagtttccgggccccgaacacaaaaaaatttggtgc

SEQ ID NO: 2456 - protein, 464 aa, Panicum virgatum
  misc_feature: Ceres CLONE 1780940
  misc_feature (4)..(81): SWISSPROT Homolog: var Histone-lysine N-methyltransferase Su
MARRGLMEQDLSKLDVTKLHPLSPEVISRQATINIGTIGHVAHGKSTVVKAISGVQTVRFKNELERNITIKLGYANAKIYKCEDDKCPRPMCYKAYGSGKEDSPLCDVPGFENCRMKLLRHVSFVDCPGHDILMATMLNGAAIMDGALLLIAANESCPQPQTSEHLAAVEIMRLQHIIILQNKIDLIQESAAMNQHEAIQKFIQGTIAQGAPVVPISAQLKYNIDVICEYIVKKIPIPERNFISPPNMIVIRSFDVNKPGSEVDEIKGGVAGGSILKGVLRVNQKIEVRPGIVMKDEHGKLKCTPIYSRIVSLYAEQNELQFAVPGGLIGVGTTMDPTLTRADRLVGQVLGEVGSLPDVYIELEVNFFLLRRLLGVRTSGTERASRVSKLAKGEILMLNIGSMSTGARVLAVKNDLAKLQLTAPVCTSKGEKLALSRRIEKHWRLIGWGTIQAGTTLDVPPCPL

SEQ ID NO: 2457 - DNA, 1140 bp, Panicum virgatum
  misc_feature: Ceres CLONE 1780948
  misc_feature: Encodes the peptide sequence at SEQ ID NO. 2458
aagaagaaaggagagcagcagagcaacaggaaggactctgtcagatcgagccttgttctccctctcatccaagaacagcatcaaacaagaaaccagagaggtagaacagagcaagatggcctgagccaggctaagccaaacgcacgcacgctcctcctagacgcacgcacgcacgtagaggacggacgcgcaggaaggacttgcactccggcgcatgggtctcctggaccagctgtgggacgacacggtggccgggccgcgcccggactccggcctcggcaagctccgcaagtacgcctccttctcgccctcctcctcctcggtgtccgcggccgcggccgcgtcgccgcccgcggagggggcggccggcgccgtgccgccacccgtgacgcgcagcatcagcatgctccgcccctcggcgctgtccgtcgtcacgtcgccgcgcagcgagtccagctctggcgccccggactcgcccttcggcgcagcgacgacgcccaagggagagggctggaagaagctgcgccggaaaggcaggatggccgccgacggcgccgacgcccccggcacgccgaggagccccaccgtctacgactgggtggtgatcagctcgctggaccggtgaacgacagccaactgaagggcgggtsggagcacaagggccatgtgcatcctctctcagaggtcctgacgatggtgtttttgtkttttgtatacgttaaaattccccccccctttttgwaaatccccgtgkgagakgctgctgtttctgtaagytttgctagtacgctcctcaycaggtcgggggggtccccgtgtamaaagctgcccaacccttgaacttgaagtgaaaacaggcaacccaagytttgatgccctgasgggcccccmcgtcagtgatccamccggggggcagtactgggggggrgtcctgtccatgtagcccagtcctggtccctatactgttgaagagagctgtaacgttgtacgagtatgagkgcccgcgcagcgtccttttgctttgtatttttggaggggtgckscckgkgtaaaagmcctawaagagwakgtactcggtaawaakggggggggtkgggggawagggaaaaawgcatatccggtggaacmcttttttttttt

SEQ ID NO: 2458 - protein, 136 aa, Panicum virgatum
  misc_feature: Ceres CLONE 1780948
  misc_feature (1)..(26): Pfam Name: Auxin_repressed Pfam Description: Dormancy/auxin associated protein
MGLLDQLWDDTVAGPRPDSGLGKLRKYASFSPSSSSVSAAAAASPPAEGAAGAVPPPVTRSISMLRPSALSVVTSPRSESSSGAPDSPFGAATTPKGEGWKKLRRKGRMAADGADAPGTPRSPTVYDWVVISSLDR

SEQ ID NO: 2459 - DNA, 1208 bp, Panicum virgatum
  misc_feature: Ceres CLONE 1780950
  misc_feature: Encodes the peptide sequence at SEQ ID NO. 2460
cagtagctcattcactacaatatatgtagatatctgagtcgatcgatctgatgctcatagattttaagccaagcaagcacaagcatggcgtcgccgaagcaccacaatagcaagcaggccactaacaagacgaagaagaaacgccccctgctgctccgccgtgcgatgctgcattcctgcctctgcttcctgctcggtctcctcaccggcctcgccccttccgactgggccgacgccgccaacgcccaggtcttccgggcagtccgcgccatcaaccacacggcagccctgctgcagctcaagacgacggcgcgctacctggaagagccgcaccacccccagctgctgctggtggtgacgacgacgacggggctgtcgccggagcgcgagcggcggtcggcggcgctgactcgcaccgcgcacgcgctgcggctggtgtccccgcccgtgctgtggctggtggtggaggccgcgcgggaggcgcctcccacggccaccctgctgcgccgcacgggggtcgtctaccgccacctcacctacaccgacaacttgacgtccgacgcctgggaggaggagcgccaccaccagcggaacgtcgcgctggggcacatcgagcagcaccgcctgcacggcgtcgtcttcttcgcgggcctcgccgacgtctacgacctccgcctcctcgagcagctccggcggatcaggacccttggtgcgtggcccgtggcgacagtgtgggagcaggagaggagggtggccatccaagggcccctctgcagtagcggtggcgctgctgcatccgcgtggttctccgcccccaccaccaccacctccggcgccggcggggatttcagcaggcccacgcccccgctcacgtcagatgactccgtccacggcttcgccttcgccagtgacctgctctgggaccctgccagatgggaccgcttcccgaccaccgagccagaccagtcgcaggattccatcaagtttgtgcaacagttggtgatggaggattacaacaaaacaaagcccatccctgagtataccaactgttcacaagtcatggtctggcgtgtcgacactacgctcctgctcttctagatcgtaatataaccaccactagctagcttcattagatgcatgcgtgtgtgtgtgtgtgtgtgtgttacagctagaagttccatctatcgtaaaaaaaaaaaaaaaaaaaa

SEQ ID NO: 2460 - protein, 337 aa, Panicum virgatum
  misc_feature: Ceres CLONE 1780950
  misc_feature (1)..(234): Pfam Name: Glyco_transf_43 Pfam Description: Glycosyltransferase family 43
MASPKHHNSKQATNKTKKKRPLLLRRAMLHSCLCFLLGLLTGLAPSDWADAANAQVFRAVRAINHTAALLQLKTTARYLEEPHHPQLLLVVTTTTGLSPERERRSAALTRTAHALRLVSPPVLWLVVEAAREAPPTATLLRRTGVVYRHLTYTDNLTSDAWEEERHHQRNVALGHIEQHRLHGVVFFAGLADVYDLRLLEQLRRIRTLGAWPVATVWEQERRVAIQGPLCSSGGAAASAWFSAPTTTTSGAGGDFSRPTPPLTSDDSVHGFAFASDLLWDPARWDRFPTTEPDQSQDSIKFVQQLVMEDYNKTKPIPEYTNCSQVMVWRVDTTLLLF

SEQ ID NO: 2461 - DNA, 1722 bp, Panicum virgatum
  misc_feature: Ceres CLONE 1780951
  misc_feature: Encodes the peptide sequence at SEQ ID NO. 2462
atcgcaacccaattgaccccagcacgaatcgaaaagccggcgggggtgccagtgcgcatcgcggcatcggcgcatcgccgctccactctccaaccacccataccgccgaatctctcctgctggtggtagtcgtggtagccctcgaagccgcgcgcgagtgatggcgtcgtggtcgtcgccctccgccgccgccgccgccgcggcctcggcctcctcgggcgcccgattcggcctcctccccggccgggcgcagcggcagcccgtcccgtccccgtcgctggcccggggagcccccaacccccggctcgtcctcagccgcgggcctggcttcctcgcgcccgccggctccgcttccccttcctcgtcctcgagatgccgcgccgtcgccgccgaggtcgagggcctcaacatcgccaacgacgtcacccagctcattgggaagacgccaatggtgtatctcaacaacatcgtcaagggcgctgtcgccagtgttgctgctaagcttgagattatggagccctgttgcagtgtcaaggacaggatagaatacagtatgataaacgatgccgaagagaagggcctgattactcctggaaagagtgtgttggtggaagcaacaagtggaaatacaggcattggtcttgcctttattgctgcttccaagggatataagttgatattgacaatgccttcatcaatgagtatggagagaagagtcctactgagagcttttggtgctgaacttgtccttactgatgctgcaaaagggatgaaaggggccttagacaaggccacggagattttaaataagacccccaattcatacatgctccagcaatttgataaccctgccaaccctaaggtacattatgagactactgggccagaaatctgggaagattcaaagggaaaggtggatatatttattggtggaatcggaacaggtggaacaatatctggtgctggccgtttcctgaaggagaaaaatcctgaaattaaggttattggtgttgagccttctgaaagtaacatactctctggtggaaaacctggtccacataagattcagggaattggggcaggatttgttccaaggaacttggatagtgatgttcttgatgaagtaattgagatatcaagtgatgaagctgttgagacagcaaaacagttggctgttcaggaagggttactggttggaatctcttctggagcggcggccgctgctgccataaaagttgccaagagaccagaaaatgctggaaagctgatagtggttatatttccaagctttggtgagaggtatctttcgtccatcctctatcagtcgataagagaagaatgcgagaacttgcagcctgagccatgagcgagcccttggtcttaacagtgtaataaatgtttctgaaataagatgcttggtcagcatttgtgcctctgagaagtgttacaccactccacttggcatcatttggcactgtcatccttttgccactaggactggaattgatgaggcatgtggagagatatccacgactctccaactgtttcctctaacaaaacagaaacacttcttacatgtctatacgattcggtctgatttggttggtaactgtagacaacatcttgtccatgaattttcaaagttaaacaaatgtcaattggctgaagcaggtttatatattataaactctctttctcttccaaaaaaaaaaaaaaaaaaaa

SEQ ID NO: 2462 - protein, 401 aa, Panicum virgatum
  misc_feature: Ceres CLONE 1780951
  misc_feature (16)..(400): SWISSPROT Homolog: EC 2.5.1.47 Cysteine synthase, chloroplast/chromoplast precursor
  misc_feature (67)..(400): SWISSPROT Homolog: EC 2.5.1.47 Cysteine synthase, chloroplast/chromoplast precursor
MASWSSPSAAAAAAASASSGARFGLLPGRAQRQPVPSPSLARGAPNPRLVLSRGPGFLAPAGSASPSSSSRCRAVAAEVEGLNIANDVTQLIGKTPMVYLNNIVKGAVASVAAKLEIMEPCCSVKDRIEYSMINDAEEKGLITPGKSVLVEATSGNTGIGLAFIAASKGYKLILTMPSSMSMERRVLLRAFGAELVLTDAAKGMKGALDKATEILNKTPNSYMLQQFDNPANPKVHYETTGPEIWEDSKGKVDIFIGGIGTGGTISGAGRFLKEKNPEIKVIGVEPSESNILSGGKPGPHKIQGIGAGFVPRNLDSDVLDEVIEISSDEAVETAKQLAVQEGLLVGISSGAAAAAAIKVAKRPENAGKLIVVIFPSFGERYLSSILYQSIREECENLQPEP

SEQ ID NO: 2463 - DNA, 2161 bp, Panicum virgatum
  misc_feature: Ceres CLONE 1780955
  misc_feature: Encodes the peptide sequence at SEQ ID NO. 2464
agcgccgagcacctggcaatggcaatggcggcttccgccccgtccgccacctcccagatgcgcccaagccgcctcctttcttactagagccaacccaccgcccgccgcgtcccccactcccacgaactcccagccctacccaccccaaccttcgttcgggcgctgaacgcatctcgtgctctgctccccggttcttgacgccgccgtttcttggggcggtggatgcgtccccgaccccaccagcgccgcgaatccaggccgtcaggatccaggtcgtgagcaatggcggcgccggtggcgccaccgctgtgcacctggctcgtcgccgcctgcctctctgcggcctgcggtgttggcgagaaggagaagcagcgaaggcaccgcggtgccggcgttggcgtcgggggtctgttcggctcgcgccaccgccccggctctcggcgccgtggtggggctcgctctggaatgtccatggctgttgccttgcatcctgaaaggggagttgtggaaactaagaaaactgatgtcaaacaaaggagagtggttgtcactggcatgggcgtagttacaccgttaggccatgaccctgatgaattctacaataaccttctacagggtgtcagtggagtaagtgagatagaggcgtttgattgctccagctatcccacgagaattgcaggagaaatcaaatcgttttcgacagatgggtgggttgcaccaaagctagctaagagaatggacaagttcatgcaatatttgataacggctgggaaaaaagcattggaaaatgctggaatcactgaagaaatcatgaatgagttggaaaagtcaaggtgtggggttctcattgggtctgctatgggtggcatgaaggtttttagtgatgcgattgaagcattaagggtttcatacaagaagatgaacccattttgtgtaccttttgcaactacaaacatgggttctgcaatacttgctatggacctgggctggatgggcccaaattattctatctctactgcttgtgctactagcaacttctgcattctgaatgctgctaatcatatcagaaaaggggaagcagatctgatgctttgtggtggttctgatgcaccgatcatccctattggattgggaggttttgtggcctgcagagctctttcacagagaaacagtgatccaacaagagcttctcggccttgggatgtggatcgtgatggatttgtaatgggagaagggtctggtgtgcttgttctggaagaacttgagcatgcaaagcaaagaggtgcagaaatatatgctgaatttctgggaggaagcttcacatgtgatgcataccacatgacagagcctcatccagaagggagaggggttattctttgtattgaaaatgcactagcagattcaggagtaacaaaggaagacatcaactatatcaatgcccatgcaacatctacacagatgggtgatttgaaggaatttgaagctctcacccgttgttttggccagaatcctcagttaagagtgaactcaacgaagtcaatgacaggccatcttcttggagctgcaggtggaatagaagctgtcgctgctatacaagctataagaacaggttgggtacatccaaatatcaatttggataatccggagaaaaatgtggatgtcagcttgctggtgggtccccagaaggagagatgcgatgtcaaggtggcactgtcgaactcatttggatttggtgggcacaactcgtcgattttgtttgcccccttcaaatgatttttgttgacgattttcttgtggttatgcatcgtcgaaaaatcgagaccttattagaccaccaggctcggcaaacatttcctgtactgcaaaattaagatgaaatccaaaagcttagtaggatatattgccacacaaccgagggaagatagcaattgggttcatttgtaatagcaaagaaaattatcctgagccagaagagcatccattcaaatgttccttgtaccctttggctcattctaatttgtttcggatgattgttgtacttgtcatataggaactttattgggggcggtatttttattgtagccgtttgcccgacagatacagtggttttgcttacaggtccagcacatgctgcctagttcaaaaaaaaaaaaaaaaaaaa

SEQ ID NO: 2464 - protein, 496 aa, Panicum virgatum
  misc_feature: Ceres CLONE 1780955
  misc_feature (1)..(246): Pfam Name: ketoacyl-synt Pfam Description: Beta-ketoacyl synthase, N-terminal domain
  misc_feature (47)..(496): SWISSPROT Homolog: EC 2.3.1.41 3-oxoacyl-[acyl-carrier-protein] synthase I, chloroplast precursor
  misc_feature (78)..(496): SWISSPROT Homolog: EC 2.3.1.41 3-oxoacyl-[acyl-carrier-protein] synthase I, chloroplast precursor
MAAPVAPPLCTWLVAACLSAACGVGEKEKQRRHRGAGVGVGGLFGSRHRPGSRRRGGARSGMSMAVALHPERGVVETKKTDVKQRRVVVTGMGVVTPLGHDPDEFYNNLLQGVSGVSEIEAFDCSSYPTRIAGEIKSFSTDGWVAPKLAKRMDKFMQYLITAGKKALENAGITEEIMNELEKSRCGVLIGSAMGGMKVFSDAIEALRVSYKKMNPFCVPFATTNMGSAILAMDLGWMGPNYSISTACATSNFCILNAANHIRKGEADLMLCGGSDAPIIPIGLGGFVACRALSQRNSDPTRASRPWDVDRDGFVMGEGSGVLVLEELEHAKQRGAEIYAEFLGGSFTCDAYHMTEPHPEGRGVILCIENALADSGVTKEDINYINAHATSTQMGDLKEFEALTRCFGQNPQLRVNSTKSMTGHLLGAAGGIEAVAAIQAIRTGWVHPNINLDNPEKNVDVSLLVGPQKERCDVKVALSNSFGFGGHNSSILFAPFK

SEQ ID NO: 2465 - DNA, 2117 bp, Panicum virgatum
  misc_feature: Ceres CLONE 1780978
  misc_feature: Encodes the peptide sequence at SEQ ID NO. 2466
gactccaaccagcagaccgatcgagctcgctcgccttttgagaagaacaaacgcgtcctctctggtcttcttcccacttcgttccacaatcaccctatccacacgtacgtacgtacgagaaggaccacccgtgtcgtgagccgccggtgcgacgacgtacgacacacccatggcgccgtccgaggactgcggctggctgctgtacctctccctggccgccaaatgcggcgacccccaccgcctgctcggcttcgccgcggtcttggccgccgccttcgtcgtcacggcgctgctgcactgggcgtcccccggcggccccgcgtggggccggtactggtggaccaggagggccggcctgggcattggtgccgccatcccggggccccgcgggctgccggtgctcggcagcatggggctcatgacgggcctggcgcaccggaagctcgcggcggcggctggcaaggcccggcgccgcctcatggccttctccctcggcgagacccgcgtcgtggtgaccgccgacccggacgtggcgcgggagctcctcgccagcgccgccttcgccgaccgccccgtgaaggagtccgcgtacgggctcctcttccaccgcgccatcggcttcgccccgcacggcgcctactggcgcgcgctccgccgcgtcgcgtccgcgcacctcttctcgccgcgccagatcgccgcctccgccgcgcagcgcgcggtgatcgcgcgccagatggtggacgccatgatgatggagcagggcgccgccgctccaggagtcgtgacggcgcggcggttcctgaagcgcgcgtcgctgcacagcgtgatgtggtcggtgttcgggcggaggtacgagctgctgcaggcggcggacggcggcgaggaggcggcggagctccagagcctggtggaccagggctacgatctcctcgggcagctcaactggtccgaccacctcccctggctcgcccgcttcgacctgcagaggacccgggccaggtgcgccgccctcgtcccccgggtcaaccgcttcgtcggccgcatcatcgacgagcaccgcgccgcccgcctccacctcggcggcgacggcgccgccgccgtcgtggacttcaccgacgtcctgctctccctgcagggcagcgacaggctctccgacgccgacatgatcgccgttctctgggagatgatctttcgaggcacggacacggtggcggttctgatggagtgggtgctggcccgactggtgctgcaccaggacgtgcagcgcagggtccacgaggagctggaccgggtggtcgggccggggcgggccgtgaccgagccggacgccgcctcgctcgcctacctccacgcggtcatcaaggaggtgctgcgcctgcacccgccgggcccgctgctctcctgggcgcgcctcgccacgtcggacgtccacgtcggcgggtacctcgtacccgcggggaccaccgccatggtgaacatgtgggccatcacccacgacccggccgtctggcccgacccggccgagttcaaacccgagaggttcgcggccggctcgccggacgacgaggcgttcccggtgatgggctcggatctcaggctggcgcctttcgggtccggccggcgggtctgccccggcaagtcgctggcgatggccaccgtcgcgttctgggtcgccaccctcctgcacgagttcgagtggctgccggcgtcgtccgacgagccgccgcgtggcgtcgacctgtccgaggtgctgaggctgtcgtgcgagatggccgccccgctggaggcgaggctggtgccacgtcgcgcggtgtgatgacgtggcgccgatccacgtggcgccgatccacgtggcagtgggagtaccttctagtagtagagtaacataattaacgcgtgcacggtgggctgtgtaaaaaaaatgtaaagtctccatgctagtgctgctagtgtgccatccatgctagtgctaacgcgccgatccacgtggcgccgatccacgtggcagtgggagtaccttctaggtttgcttatgtgtgtacctgtaaacctgctatgtacctgcatgtataatagtatctgaaagtaagttaatgtaaaaaaaaaaaaaaaaaaaa

SEQ ID NO: 2466 - protein, 548 aa, Panicum virgatum
  misc_feature: Ceres CLONE 1780978
  misc_feature: Great-hit functional homolog of the protein sequence given in SEQ ID NO 9456
  misc_feature: Useful for biocontainment applications
  misc_feature: Useful for making plants with modulated flowering time
  misc_feature: Useful for making plants with modulated nitrogen use efficiency
  misc_feature: The plant flowers significantly late compared to wild-type.
  misc_feature: The plant produces a reduced number of seeds.
MAPSEDCGWLLYLSLAAKCGDPHRLLGFAAVLAAAFVVTALLHWASPGGPAWGRYWWTRRAGLGIGAAIPGPRGLPVLGSMGLMTGLAHRKLAAAAGKARRRLMAFSLGETRVVVTADPDVARELLASAAFADRPVKESAYGLLFHRAIGFAPHGAYWRALRRVASAHLFSPRQIAASAAQRAVIARQMVDAMMMEQGAAAPGVVTARRFLKRASLHSVMWSVFGRRYELLQAADGGEEAAELQSLVDQGYDLLGQLNWSDHLPWLARFDLQRTRARCAALVPRVNRFVGRIIDEHRAARLHLGGDGAAAVVDFTDVLLSLQGSDRLSDADMIAVLWEMIFRGTDTVAVLMEWVLARLVLHQDVQRRVHEELDRVVGPGRAVTEPDAASLAYLHAVIKEVLRLHPPGPLLSWARLATSDVHVGGYLVPAGTTAMVNMWAITHDPAVWPDPAEFKPERFAAGSPDDEAFPVMGSDLRLAPFGSGRRVCPGKSLAMATVAFWVATLLHEFEWLPASSDEPPRGVDLSEVLRLSCEMAAPLEARLVPRRAV

SEQ ID NO: 2467 - DNA, 3630 bp, Panicum virgatum
  misc_feature: Ceres CLONE 1780984
  misc_feature: Encodes the peptide sequence at SEQ ID NO. 2468
atttgatttcctcccccctctctaccctcctctccctccccgccgccgccgccgcctccaccccctctgctccctccccacgcgcctccgcgcctccgatcgggtccgcggccgcgctccccttccccgctcccgccgcggggtgctgaaggctccagctccgctccgtccgtacgcctcggggtcgtctccacgcgcccagcgacagccaatatgtcacttgatgttactccagttctcttaagtgcgcaatctgctgatggtgccatcaggaagcatgctgaagaaagcctcaagcagttccaggagcaaaaccttccaggattcttgctatccctctcaagtgagttggccaatgaagagaaacctgaggagagccggaggttggctgggttgattcttaagaatgcactggatgcaaaggagcaacacaggaagaatgagcttttccagagatggctggcactggatgctggtgccaaggcgcaaattaaaggattgttgctgcaaacactcacatctcctgttgcaagtgccagatctactgcttctcaagttattgcgaaggttgctggtattgagattccgcagaagcaatggcctgagcttattgcatcattgctctcaaacatacatcaggtccagccaaatgtcaagcaggcaacgcttgagacgcttggctatttatgtgaggaagtttctccagatgctgttgaccaagaccaagtcaataaaatacttacagctgttgttcagggtatgaatgcttctgaggcaaactctgatgtgaggcttgcagctacacgggcattgtataatgcattgggctttgctcaggttaacttctcgaatgacatggagcgtgactacatcatgagagttgtttgtgaagcaacacagtctccggaggtcaagataaggcaggctgcctttgagtgtttggtggctatctcgtctacttactatgataagctggctgcctatatgcaggacatatttaatatcactgcaaaggctgtgagggaagatcaggagtcagttgcacttcaggctattgaattctggagttccatatgtgatgaggaaattgacattctggatgagtacagtagtgagttcacagctgattctgatgttccttgcttctattttatcaagcaggcccttcctgcattagtgccgatgttgttggagactcttctgaagcaggaggaagaccaagacttggatgaaggtgcttggaatctggcaatggctgggggaacttgtttgggcctggtggcaaggactgttggggatgatattgttcctctagtgatgccttttgtgcaggaaaacataacaaagtctgattggaggcaaagagaggctgcaacatatgcttttggatctatcttggaggggccatcagctgataaactggctcctcttgtaaatgttgcattgagctttatgctgtctgcgttgatgaaggacccaagtaaccatgtaaaggacacaacagcttggactcttggaagaatctttgagtttcttcatggttcagtgcttgaaactgctcctatcattacagctgagaactgtcagcagatacttactgtgctgcttcacagcatgaaggatgtccctaatgtggctgagaaggcatgtggtgccctgtatttccttgctcaaggctatgttgatgcaggatctgcatcaccattatcccctttctttcaagatattgttcagaaccttcttatggttactcacagggaggatgctggggagtccaggctgcgcacagcagcttatgagactctaaatgaagttgtcaggtgctccactgaggagacagcccctattgttatgcagttggtacctgtcatcatgatggaactccatcagactcttgaagctgaaaaactgtcaactgatgagagggagaagaggagcgaactgcagggcctcctttgtggctgcttgcaggtcattatccaaaagttgggagggatggaatcaacgaagtactctttcttgcagtatgcagatcagatgatggatctgtttttgagagtttttgcttgtaggaacgccacagttcatgaggaggctatgcttgctattggtgcattggcatatgcagctggtccaaactttgcaaagtacatgacacagttttatcagtatttggagatgggacttcaaaactttgaggagtaccaggtctgtgccattactgtgggtgttgtgggcgacttgtgcagggcacttgaagacaaaattttgcccttctgtgatggcatcatgacccagctcttgaaggacctatcaagtaaccaattgcacagatctgtaaaaccaccgatattttcgtgctttggtgatattgcactggcaattggggagaacttcgaaaagtatctgatctatgccatgcctatgctgcaaagtgctgctgatctgtcagcacataccactgcgactgatgatgaaatgcccgactacaccaaccagctaaggaatggcatcttggaagcctactctggtattcttcagggattcaagagttcacctaagacacaactactgatgccatacgccccacatattctccagttccttgatgctctgtacaatggcaaggatatggatgacactgtgatgaagactgcaattggtgtcttgggagatctggcagacacattgggcgtccatgctggccctttgatcaatcaatctgcctcgagcaaggcatttttggaggaatgcttggcgtcagacgatcctttggtgaaagaatcagctgattgggcaagtatagcaatcacccgtgcagtttcaggttgatgtcccaaggagtctcgagtctgcacttgcatccatccacatgtcatcatgtctgggtcgtcgattgcatcatgtccagacctgctctttggagaagtccaacatccttacagcagagtcggagggtcctcactaactcatgcatcagtacatgcgtcagcccatcctttccgcccccgcgggaaaagagggttcaagttggccgcctgctaactttggcaaagggcatctgccgccttcatttcttattggatgtgagatgagcttctattgttgcctgacatgctgacagtttcctcggcatggcacgcctatggtctgtggcctataattttcccctgcattcatctcatgcattgaactctggtcggatggtcacttgggagaaaaggcccagttgcttgctgctgatccagtaagcagcagtgggcaggaacacatcgtcacaggattattttgtattaatcagggcggtcaagtccattattatgtcaagacataccctccctgctggttgctagtagcttgttttttttctgattgcattcttttccctttgtccacttgcattgccttgcatttcattattgtctgttttgtaagttttttcctgggcaaaacttgtgtcctgtcacgtctggtactgcacgctgtttgtacaagtctagctcctgcgtgcatatcagtttatttccaggtgtcattggagcagcgggcatttctgcttttcagttttgtttttggtaatccatacatgctgctccattcgggtttctctaaaaaaaaaaaaaaaaaaaa

SEQ ID NO: 2468 - protein, 872 aa, Panicum virgatum
  misc_feature: Ceres CLONE 1780984
  misc_feature (1)..(81): Pfam Name: IBN_N Pfam Description: Importin-beta N-terminal domain
MSLDVTPVLLSAQSADGAIRKHAEESLKQFQEQNLPGFLLSLSSELANEEKPEESRRLAGLILKNALDAKEQHRKNELFQRWLALDAGAKAQIKGLLLQTLTSPVASARSTASQVIAKVAGIEIPQKQWPELIASLLSNIHQVQPNVKQATLETLGYLCEEVSPDAVDQDQVNKILTAVVQGMNASEANSDVRLAATRALYNALGFAQVNFSNDMERDYIMRVVCEATQSPEVKIRQAAFECLVAISSTYYDKLAAYMQDIFNITAKAVREDQESVALQAIEFWSSICDEEIDILDEYSSEFTADSDVPCFYFIKQALPALVPMLLETLLKQEEDQDLDEGAWNLAMAGGTCLGLVARTVGDDIVPLVMPFVQENITKSDWRQREAATYAFGSILEGPSADKLAPLVNVALSFMLSALMKDPSNHVKDTTAWTLGRIFEFLHGSVLETAPIITAENCQQILTVLLHSMKDVPNVAEKACGALYFLAQGYVDAGSASPLSPFFQDIVQNLLMVTHREDAGESRLRTAAYETLNEVVRCSTEETAPIVMQLVPVIMMELHQTLEAEKLSTDEREKRSELQGLLCGCLQVIIQKLGGMESTKYSFLQYADQMMDLFLRVFACRNATVHEEAMLAIGALAYAAGPNFAKYMTQFYQYLEMGLQNFEEYQVCAITVGVVGDLCRALEDKILPFCDGIMTQLLKDLSSNQLHRSVKPPIFSCFGDIALAIGENFEKYLIYAMPMLQSAADLSAHTTATDDEMPDYTNQLRNGILEAYSGILQGFKSSPKTQLLMPYAPHILQFLDALYNGKDMDDTVMKTAIGVLGDLADTLGVHAGPLINQSASSKAFLEECLASDDPLVKESADWASIAITRAVSG

SEQ ID NO: 2469 - DNA, 1713 bp, Panicum virgatum
  misc_feature: Ceres CLONE 1781022
  misc_feature: Encodes the peptide sequence at SEQ ID NO. 2470
gtcccccgtgacagcgaagcagaggctcatcaccctacccaagtacccatcctccgccgccgccatggcagcagcccccaccggcggccccgccatcaccatgtcctcctcctccttcctctctccgtcgccgttctatgtcaaggcgtcgaggaccagccaccgccgacccgccaggagaatgcctgtcaccgtccgctgcgtcagtagcccgccggccgccgatacagctcacaagactagtgtcccgcgcaatgcaaacatgaccaagctccaagcaggatatctgtttcctgagatagccaggagaagagcagctcatttgctgaagtaccctgatgctgagattataagccttgggataggtgacactaccgagcccattcctgacgtcataacaaatgccatggcagagagagcacatgccttatcaacaattgatggctacagtggttatggagctgagcaaggtgaaaagaaactaagggcagcaattgctgcaacctactatgcggaccttggtattgaagattcagacatatttgtctctgatggtgccaaatgtgacatttctcgcctccaggtcctttttggatctaatgtgacaattgcggtccaagacccatcataccctgcatatgttgattcaagtgttatcatgggccaaaccgacttatatcagcaagatgttcagaagtatgggaacattgagtacatgagatgcaatcccgaaaatggatttttccctgatctgtcaactgtcccacgaacagatataattttcttttgttcacccaacaaccctactggtgctgctgcatctcgggaccaactaacaaaactagtcaaatttgctaaggacaatgggtccatcattgtctatgattctgcttatgctatgtacatatcagatgatagtccaaagtccatctttgaaattcctggagcaaaagaggttgccattgagacagcatcattctcaaaatatgctgggttcactggtgtccgtctaggttggactgttgtccccaaggaacttcttttctcagatggacatccagttgctaaagatttcaaccgcatagtctgcacttgcttcaatggcgcatcaaacattgctcaagctggtggcttagcttgcctctctacagagggcctgaaggctatgcgtgacgtcgttggcttctacaaggagaacactgaaataattgttgacacatttacatcgcttgggttcaacgtgtatggtgccaagaacgctccttacgtgtgggtgcacttccctgatcgcaagtcgtgggatgtgttcgctgagatcctcgagaaggcaaacgttgtcactactcctggcagtggatttggaccaggcggcgaaggctttgtgagggtcagtgcattcggccacagagagaacatcattgaagccgctaggagattaaagcatatgtacaaatgagcaccgacgcaacttctgtatcgcacttgaaggactgtaccaataagatcacagctggatttggaatgccaaatcctctctttggagctaccaggagatattagaagtgatacttgataatttcgtaggctttttttttaatggtgttactccattcaaaccatttccattttgaaataatgctttgtatacctgaggcgtttaaatcaccaatggttatataaaaaaaaaaaaaacaaaaaaaaaaaaaaaaaaaa

SEQ ID NO: 2470 - protein, 463 aa, Panicum virgatum
  misc_feature: Ceres CLONE 1781022
  misc_feature: Great-hit functional homolog of the protein sequence given in SEQ ID NO 9635
  misc_feature (1)..(370): Pfam Name: Aminotran_1_2 Pfam Description: Aminotransferase class I and II
  misc_feature: Useful for making plants with modulated nitrogen use efficiency
MAAAPTGGPAITMSSSSFLSPSPFYVKASRTSHRRPARRMPVTVRCVSSPPAADTAHKTSVPRNANMTKLQAGYLFPEIARRRAAHLLKYPDAEIISLGIGDTTEPIPDVITNAMAERAHALSTIDGYSGYGAEQGEKKLRAAIAATYYADLGIEDSDIFVSDGAKCDISRLQVLFGSNVTIAVQDPSYPAYVDSSVIMGQTDLYQQDVQKYGNIEYMRCNPENGFFPDLSTVPRTDIIFFCSPNNPTGAAASRDQLTKLVKFAKDNGSIIVYDSAYAMYISDDSPKSIFEIPGAKEVAIETASFSKYAGFTGVRLGWTVVPKELLFSDGHPVAKDFNRIVCTCFNGASNIAQAGGLACLSTEGLKAMRDVVGFYKENTEIIVDTFTSLGFNVYGAKNAPYVWVHFPDRKSWDVFAEILEKANVVTTPGSGFGPGGEGFVRVSAFGHRENIIEAARRLKHMYK

SEQ ID NO: 2471 - DNA, 2249 bp, Panicum virgatum
  misc_feature: Ceres CLONE 1781026
  misc_feature: Encodes the peptide sequence at SEQ ID NO. 2472
aacaccagcctcagtcccggcctcccaatggcgtggtgagagaacacctccccctcccgtttctccggccccttgctgtcgtcgactcgtctcgtcccctccagggtccagggagggaagaagatgagctgctcctcttgctgcgccgccgccgccgttccgtctcccccggtggttctcgccaggccgcgggtgaggttcgctgcttcctgctccacaagaacagaccagaaggtgcttttcctcggttccagacagtttccaaggatcacatacaacccatcaagccgtgcgtcgtcacggttgtcgcggagagaggtaatagcttttgccgggcaacagtcttgggacatcggcagatttgtcaggactttgtacttcttcaacgggcccccaaaccctctgaagattgttgagtccatcattagcagtttcactagctctgcttctagcgaagcgccgaagaaaatggaaacatctgatgtggtgctggtcactggagccactggtggtgttgggcgccgggtggtcgacatcttgcggaagaagggcataccagttcgagtattggctagaaatgatgataaggcaaggagcatgttggggcgcgacgtagatttgatcataggagatgttacaaaggaagatacactcgatcctaagctcttcaaaggggtcaggaaagtcgtgaacgctgtatctgtcatagtaggaccaaaggaaggtgatacaccagatagacagaagtacaaacaaggcatcaagttttttgaacctgagatcaagggaccttcgcctgaaatggtagagtacatcggaatgcaaaacttgattaatgccataaagaacagtgttggactaagtgaagggaaacttctatttgggcttaaaggcaacttatctggaaagattgtgtggggagctcttgatgatgttgtaatgggtggtgttagtgaaagtacttttcaaatcctaccaacaggaagtgaaactggtgggccaactgggttgttcaaaggtactgtatctacttcaaataatggtgggtttactagtataaggacaaagaatttcactgttccagaggacctgtcagcatacgatggtattgaattacgagttaaaggtgatgggcgacggtataaactcattattcggacaagctatgaatgggatactattggctatacagaaagctttgacacaactaagggagaatggcaaagtgttaaaatacctttctcttctctgaaacctgtatttcgtgctcgtactatgactgatgctccacccttcgatgcaagcagcattacttcactgcagcttatgttcagcaagttcgaatatgatggaaaactcaacccgacatttactgaaggtccattcgagcttcctttttcaagtattaaagcatacatcaatgagccgatcactccaaggttcgttcatgtgagttctgcaggagttacaaggcctgaaagaccgggtctagatttaaacaagcaaccgcctgctgttcgcttgaacaaagagcttggctccatcttaacttataagttgaagggagaagatttaattagggaaagtggtgttccgtacactattgtgcgaccatgtgcgttaactgaggaaccagctggagccgatctcatatttgaccagggggacaatatcacagggaagatatcaaggaaagaagttgcccgcatttgtgtagcggctctggcaagcccaaacgcggtggggaaaacttttgaggtcaagagcaccgttccattcagcgaaccatatgtgattgacccttcaaactcccctcctgaaaaggactatgaagtgtattttaaagaactaaaagaaggcatcacgggtaaagaggcattagaagctacacctgctcaggtctgaagaatggttgcatgaagaatgccatctgcttttgataaaatttgacacgataactctactcaccatggtgattttaataccaaaggggagatcctttgtgaaagaagatgctttcgatatggaatgtaaaatgagcaggcagtgacaatatcttgtctttaccatgcatgtatatgaagagaaacgtgagtcgcatagaattgtaggtgacacttgcatggtaaatctaggaaatgaattactataggcagatgtatgtatctgtattttgtctcttgtagagtgctgcacgtgttttataacaaaagaacaaaacgtaaatttaaaaaaaaaaaaaaaaaaaa

SEQ ID NO: 2472 - protein, 593 aa, Panicum virgatum
  misc_feature: Ceres CLONE 1781026
  misc_feature (1)..(65): Pfam Name: Epimerase Pfam Description: NAD dependent epimerase/dehydratase family
MSCSSCCAAAAVPSPPVVLARPRVRFAASCSTRTDQKVLFLGSRQFPRITYNPSSRASSRLSRREVIAFAGQQSWDIGRFVRTLYFFNGPPNPLKIVESIISSFTSSASSEAPKKMETSDVVLVTGATGGVGRRVVDILRKKGIPVRVLARNDDKARSMLGRDVDLIIGDVTKEDTLDPKLFKGVRKVVNAVSVIVGPKEGDTPDRQKYKQGIKFFEPEIKGPSPEMVEYIGMQNLINAIKNSVGLSEGKLLFGLKGNLSGKIVWGALDDVVMGGVSESTFQILPTGSETGGPTGLFKGTVSTSNNGGFTSIRTKNFTVPEDLSAYDGIELRVKGDGRRYKLIIRTSYEWDTIGYTESFDTTKGEWQSVKIPFSSLKPVFRARTMTDAPPFDASSITSLQLMFSKFEYDGKLNPTFTEGPFELPFSSIKAYINEPITPRFVHVSSAGVTRPERPGLDLNKQPPAVRLNKELGSILTYKLKGEDLIRESGVPYTIVRPCALTEEPAGADLIFDQGDNITGKISRKEVARICVAALASPNAVGKTFEVKSTVPFSEPYVIDPSNSPPEKDYEVYFKELKEGITGKEALEATPAQV

SEQ ID NO: 2473 - DNA, 2280 bp, Panicum virgatum
  misc_feature: Ceres CLONE 1781053
  misc_feature: Encodes the peptide sequence at SEQ ID NO. 2474
aacggtcctgcgtcttggccgcgttgcagagagaacacagagggaggagggaaaaaaaaactcgtctctctctcgcgtgaggtggcgagcccgaggagcggaggccacaagtctaatccgcccgtatctaatccgctcgagcgccgcgaggaggaggacggaggaggagggagcggcggggcgggcctgattcgagctcttctcttgcgcttcgcggttagcactttgaagtgtgtgatctcggcttcttcgaatcctgaagcacggttgaatcatggctgggtcccttgctgccgctgcctgcttccctggtccaggggcttccccggcagcgtccgccaaaacatcgaagaacatggctggtgaattaccggacagtttaagtgtccatggaattgttgcaaagcctggcgccccttctgggaacatgcaagtgaaggctcaagctcaagcccttcccaaagttaacggcaccaagcataaccacaagaatgcgagtgcagacacggaggaggcgataccttacagtgctcccaagacattctacaaccaactgccggattggagcatgcttcttgcggctgtcaccaccatcttcctggcagcagagaagcagtggacactgcttgactggaagccaaagaaacctgacatgcttgttgacacgtttggctttggtaggatcatccaggatggcctggtgtttagacagaacttcatgattcggtcctacgagattggtgctgatcgtacggcttctatagagacattaatgaatcacttacaggaaaccgctcttaaccatgtgaagactgctggccttcttggagatggttttggcgccacgccagagatgagcaagcgaaacctgatctgggttgtcagcaaaattcagcttcttgttgagcaatacccctcgtggggagatatggttcaagtggacacatgggtagctgctgctggcaaaaatggcatgcgtcgagactggcatgttcatgactacaattctgggcgtacaattttgagagctacaagtgtttgggtgatgatgaataagaacactaggaggctttcgaaaatgccagatgaagttagggctgagataggccaatatttcaatggccgctctgccataacagatgagcaaagtgagaagctgtctaagccagggagcactgttgatggtgatgctgcaaagcagttcataaggaaggggctcactcctaggtggggagaccttgatgtcaaccagcatgtgaacaacgtcaagtatattgggtggattcttgagagtgccccaatttcaatcctggagaagcatgagcttgcaagcatgacgctggattacaggaaggagtgcggccgcgacagcgtgctgcagtcactcaccaccgtcgcaggtgaatgtgtggatggccacccggactccaccatccagtgcgaccacctgctccagttggagtcgggggctgatattgtgaaggcacacacggagtggcggcccaagcgagcacacggcggtgagggaaacatgggttttttcccagccgaaagcgcatgaacacccccctgaagctggaccggctgagcatgaacgtgggggctcctgtgaagcgcgaatcctaagttatggctactaacccagaacgagtgtctggtcgtgagaagtttggcatgccagggaacgccgcattacccacccaacctggggtagtacaaggacgggagtcgcaaggggactgactggaggaggatgtgaagccctgggggacaggatgttaagccagcgaaaccggaggatgacgagtcgtgttctgatgcggtgacgccgattgctgaaccaaggagcggcaggagctggttgaggccggagcaaaaaaaaaaagatgtggcgcagggggacaatggtagtggtctaggccaggttgggtgtgtagaaggcatgcattccctttgtaacagcctaatttgtacattcttaccatcttaatcccattggttgaatcgcagccgtccggcgcttccatcgatgaattcaggtccaggaccattccttgtactccttgtgcagacagacaattctgtgctactaggtctgcatccttgagtcgctgtcgtttctgcctgaagctgcttgctccgtcgagcaaatcttgctgtcatttttctttctttctttctttgtaatggaaggttgaaccgtgaagcttatacatcgccgccgtgtctggatggaacaaggcacagcgacatgtaacccaaaaaaaaaaaaaaaaaaaa

SEQ ID NO: 2474 - protein, 428 aa, Panicum virgatum
  misc_feature: Ceres CLONE 1781053
  misc_feature (1)..(270): Pfam Name: Acyl-ACP_TE Pfam Description: Acyl-ACP thioesterase
MAGSLAAAACFPGPGASPAASAKTSKNMAGELPDSLSVHGIVAKPGAPSGNMQVKAQAQALPKVNGTKHNHKNASADTEEAIPYSAPKTFYNQLPDWSMLLAAVTTIFLAAEKQWTLLDWKPKKPDMLVDTFGFGRIIQDGLVFRQNFMIRSYEIGADRTASIETLMNHLQETALNHVKTAGLLGDGFGATPEMSKRNLIWVVSKIQLLVEQYPSWGDMVQVDTWVAAAGKNGMRRDWHVHDYNSGRTILRATSVWVMMNKNTRRLSKMPDEVRAEIGQYFNGRSAITDEQSEKLSKPGSTVDGDAAKQFIRKGLTPRWGDLDVNQHVNNVKYIGWILESAPISILEKHELASMTLDYRKECGRDSVLQSLTTVAGECVDGHPDSTIQCDHLLQLESGADIVKAHTEWRPKRAHGGEGNMGFFPAESA

SEQ ID NO: 2475 - DNA, 1812 bp, Panicum virgatum
  misc_feature: Ceres CLONE 1781063
  misc_feature: Encodes the peptide sequence at SEQ ID NO. 2476
gctgatccacgacatcaacattggacagccccgcccttctccccctccggctccagcgacaggcgcaagcgcatggcccctagggttgcgccggccatgcgggtgctccccctcgcgctcgccgcggccatcttctccggggtgaccgccatcctcatctacctctccggcctctcctcatatggcagcgctcggctttcggagtcggacttggccgcgctcaccgcgctgcagggccgcttcagcaagtgcgtggatgcaaatgggctaggactgaaagcggtgagtggaaaggactactgtcgagttgtgatacaatacccaagcagcacagtttccaagtggacggatccgagtactggaaaggttgaaggtttgtcgtttgagttcaatctgtgcgaagctgtggcctcatgggagcaggtccgaaacagcacaacggtactcacaaaagagtacattgatgctttgccaaatggctgggaggagtatgcatggcgcaggatcaacaaaggaaatcttctgaataagtgccagaacagaactctgtgcatggagaagctctcgctagttctacctgagacatcaccatatgtgcctcgccaatttggaagatgtgctgttgttggaaactctggcgatcttcttaaaactaaattcggggatgaaattgattcttatgatgtcgtcttcagagaaaatggtgcacccatccagaattacactgagtatgtcggtacaaagagtacatttcgccttctgaacagaggatctgcaaaggcactggacaaagttgttgagttagatgaaacaaaaaaggaggtattgatcgttaagacgacaatacatgatatcatgaaccaaatgattcgggaagttccaataaccaatccagtatacctcatgctaggcacatcatcatcgtttggttcgtccgctaaaggaactggggttaaagctattgaatttgctctctccatctgtgacagtgttgacatgtatggcttcacagtagacccaggttacaaggaatggacaaggtacttttctgaggccagaaagggtcacacgccacttcatggtagagcatattatcaaatgatggaatgtctcggtctggtaaaaatccactcaccgatgcgaggtgatcctggcagggcagtgaaatggctgcctaccaaggatatcattgaagctgctagagttgcctctgagaaattgttgaggagacctggagctggaagcgatggccctctggagacttgcaccatgataaagaagcgtaacaaaggaaaggcaccaaacagatccggtctgcgagatgctgccatgaagcaccttgagtacatgaaaggtgccaccaggtatcccttggagcgaagtgccgagggtggctacctctgcatgattaacgatacataggaccacagtggttcaaagtccattagatgtagaagatggacaaggagactgcacaaaacataacagaagtcacgacaccattaagcagcaagatcagatgagctatttggtgtcagttgatgtggtgggacagttttgaaggaatttcagagcggataggtgtgatgcagttttggtgtatgggcagtatgagtaacgagcatggtttcaaacgtgtgtcaaacggtttcagatcatgtttttgtttgtagcggaatgaacagatcttaagagctgaatgctgagcttgtcagcactgtaactagaagaaatgcgcatgtctagaatttgtaatgcgttaatcaattttttttactggaattgaattctgctaaaaaaaaaaaaaaaaaa

SEQ ID NO: 2476 - protein, 449 aa, Panicum virgatum
  misc_feature: Ceres CLONE 1781063
  misc_feature (1)..(262): Pfam Name: Glyco_transf_29 Pfam Description: Glycosyltransferase family 29 ( sialyltransferase)
MAPRVAPAMRVLPLALAAAIFSGVTAILIYLSGLSSYGSARLSESDLAALTALQGRFSKCVDANGLGLKAVSGKDYCRVVIQYPSSTVSKWTDPSTGKVEGLSFEFNLCEAVASWEQVRNSTTVLTKEYIDALPNGWEEYAWRRINKGNLLNKCQNRTLCMEKLSLVLPETSPYVPRQFGRCAVVGNSGDLLKTKFGDEIDSYDVVFRENGAPIQNYTEYVGTKSTFRLLNRGSAKALDKVVELDETKKEVLIVKTTIHDIMNQMIREVPITNPVYLMLGTSSSFGSSAKGTGVKAIEFALSICDSVDMYGFTVDPGYKEWTRYFSEARKGHTPLHGRAYYQMMECLGLVKIHSPMRGDPGRAVKWLPTKDIIEAARVASEKLLRRPGAGSDGPLETCTMIKKRNKGKAPNRSGLRDAAMKHLEYMKGATRYPLERSAEGGYLCMINDT

SEQ ID NO: 2477 - DNA, 1761 bp, Panicum virgatum
  misc_feature: Ceres CLONE 1781072
  misc_feature: Encodes the peptide sequence at SEQ ID NO. 2478
cttcgtctcttcgctcccactcctccccccaccgttccgaagcttccacgcctcgcctcgcctctcccggttcccgcgcgctccgaggccagatccgcgccgccgctctggtcgagggcggcggaggccggcgcggggaggcgacaggcggggtagcttcgcccggggaggagagagaggcgggcgggcgggcgggctagctagctagctagctacctaggctgcggctgcgatggcggtggagaagacggcgccggccgcggccgcgggcgcggccgccgcggggaggaccgtgctggtcacgggcggggcgggctacatcggcagccacgccgtgctgcagctcctcctcgcgggcttccgcgccgtcgtcgtcgacaacctcaacaactcctccgagctcgccgtccgccgcgtcgccgcgctcgccggggaccactcccgcaacctatccttccacaaggtcgatctccgtgacaagggagctctggaaatggtttttgcttcaacaagatttgatgctgtcgtacacttcgctggactaaaagctgtgggtgaaagtgtgcagaagccattgctatattatgacaacaatgtcattgggacaataaatcttctagaagttatgtctgctcacggttgcaagaagttggtgttctcttcatcagctgcagtttatggatcacccaagaactcaccctgcacagaggagtttcctctgactccaaacaatccatacggcaaaacaaagcttgttgttgaggatatttgccgtgacatctaccgttcagatcctgaatggaagatcattttactaaggtacttcaatccagttggtgcacatcctagtggataccttggtgaagacccatgtggaattcccaacaatcttatgccctacgttcagcaagttgctgttggaaggaggccagctctgacagttttaggaaatgattatgcgacaagagatgggactgggattcgagattacatccatgtggttgaccttgctgatggacatattgctgcattgcataagctttttgagaacccgagcatagggtgtgaagcatacaaccttggaactggaagaggtacatcagtgctggagattgttaaagcattcgagaaggcttctgggaagaaaattcctctgatttttggtgcaagacgccctggtgatgcagagatattgttttcagtgactgctaaagcagaaagggagcttaactggaaagcaaaatacggcattgatgaaatgtgtcgcgaccagtggaactgggctagcaagaacccctatggttatgtatcgcctgattccaccaagcagaacggccaccaaacaaatggatctgttgattcctccaggcagaatggtcaccacacaaatcggtcagttggctcaaccaggtggaacgggcactgtgggtatgggtcagctgactcacccaagcggaacggccactatgcctatggatcatctgactccaggcagaatggcaatggccgcctgcaatgagccgagtcagtctggcctgtgagccccctgtacattcggtatgtcgcgaacccactatccgagattcatgtggatcaatgggttggcaggtcatacagtatagagtcaatggcagcagaattccagtttgttgtgggtaaacctatttcctacgttattctttccttctttcaaacgtggtgtaggaatgtggtcatagtttatcggctgattctattcgttaaaaaaaaaaaaaaaaaaaa

SEQ ID NO: 2478 - protein, 428 aa, Panicum virgatum
  misc_feature: Ceres CLONE 1781072
  misc_feature (1)..(264): Pfam Name: Epimerase Pfam Description: NAD dependent epimerase/dehydratase family
  misc_feature (16)..(358): SWISSPROT Homolog: EC 5.1.3.2 UDP-glucose 4-epimerase
  misc_feature (17)..(364): SWISSPROT Homolog: EC 5.1.3.2 UDP-glucose 4-epimerase GEPI48
MAVEKTAPAAAAGAAAAGRTVLVTGGAGYIGSHAVLQLLLAGFRAVVVDNLNNSSELAVRRVAALAGDHSRNLSFHKVDLRDKGALEMVFASTRFDAVVHFAGLKAVGESVQKPLLYYDNNVIGTINLLEVMSAHGCKKLVFSSSAAVYGSPKNSPCTEEFPLTPNNPYGKTKLVVEDICRDIYRSDPEWKIILLRYFNPVGAHPSGYLGEDPCGIPNNLMPYVQQVAVGRRPALTVLGNDYATRDGTGIRDYIHVVDLADGHIAALHKLFENPSIGCEAYNLGTGRGTSVLEIVKAFEKASGKKIPLIFGARRPGDAEILFSVTAKAERELNWKAKYGIDEMCRDQWNWASKNPYGYVSPDSTKQNGHQTNGSVDSSRQNGHHTNRSVGSTRWNGHCGYGSADSPKRNGHYAYGSSDSRQNGNGRLQ

SEQ ID NO: 2479 - DNA, 1417 bp, Panicum virgatum
  misc_feature: Ceres CLONE 1781078
  misc_feature: Encodes the peptide sequence at SEQ ID NO. 2480
aaaaataaaacccctccactactatccctctcttcctctcttctttccccttccaatggagtcgtgcagcttccgccccgccacagcgccttcccctttcccctcggcgccttcctcatcgtcttcatccccgcgcgccccgtgcccccatctccggtttcctagaccaagaaacgggagacagattcgggtgcggaggagggcgtccggatttgatgccttcccgcccctccccggcaaggtctttgttgacgaggcaattggagctgaatatggggagggctttgaaacatttcggatggatggaccaattaaggtcgatgtggattatctgaatgaaaaattgcaagaatgcttccttcaaaggataaggcatgccatgaagccagatgaggcgtttggtctaattttttcgtgggataatgttattgctgatacagactcgctaaagttggatgcttggagacagcttgctttggaggaagggaaggatatcccaagtgcagctcatgtccgaaagagtattcttcatggtgctgctgaccatgttctgagaaaggtattgtattgggcgaaagaagaatataaaatggaaaagctgaaggcgcgcctcatagagttatactacgaaaacctgttcaaactcgatacacccgtagaagggttgagagaatggttggatgccgttcagacagcagggataccttgtgctgtcgcatcgtcccttgacaggagatgcatgatcgaagctttggaccggatggcgctaagcaaatacttcaaggcaattgtgactgacgaagatgatatggagtcgatagcaaataggtttctgtcagctgctatgaagttggatcgtaaaccctcaaagtgtgtggtgtttgaggatgacccgagaggtgtcaccgctgcgcataactgtaccatgatggcagtcgcactgattggtgctcatccagcgtatgagctggtacaggccgaccttgcgatcgcaaagtacagcgagctctcggttatcaacctcagaaggctgtttgcgaacaaggggataagcttcatggacctacagaaacagataattgagaaggcacctcccaggagaaggctgacagtagacaccatcttctgattgattcttcctcgtttgtctcctgcccgtgcttgaatagccagagccagccacagtcggtttatttgtgctgttgtatataaagatagcgctgatgtaggttatctgccctgtaccccttgtcggcctgaatgtggtagttgtatcgaggtaacaagcatgaagagaactgctgcaacaatgctgacgttgttgcaagctgacactgtccaatttattcgttatccatatcttttgagagcatgaaaaatgggcgtggcgaaaggataaaaaaaaaaaaaaaaaaaa

SEQ ID NO: 2480 - protein, 357 aa, Panicum virgatum
  misc_feature: Ceres CLONE 1781078
  misc_feature (1)..(178): Pfam Name: Hydrolase Pfam Description: haloacid dehalogenase-like hydrolase
MESCSFRPATAPSPFPSAPSSSSSSPRAPCPHLRFPRPRNGRQIRVRRRASGFDAFPPLPGKVFVDEAIGAEYGEGFETFRMDGPIKVDVDYLNEKLQECFLQRIRHAMKPDEAFGLIFSWDNVIADTDSLKLDAWRQLALEEGKDIPSAAHVRKSILHGAADHVLRKVLYWAKEEYKMEKLKARLIELYYENLFKLDTPVEGLREWLDAVQTAGIPCAVASSLDRRCMIEALDRMALSKYFKAIVTDEDDMESIANRFLSAAMKLDRKPSKCVVFEDDPRGVTAAHNCTMMAVALIGAHPAYELVQADLAIAKYSELSVINLRRLFANKGISFMDLQKQIIEKAPPRRRLTVDTIF

SEQ ID NO: 2481 - DNA, 1765 bp, Panicum virgatum
  misc_feature: Ceres CLONE 1781099
  misc_feature: Encodes the peptide sequence at SEQ ID NO. 2482
gtgctactagctgacgccgggccggtgggggtgtgagcgggctgcggcgagctgccactgcggcggtcggctggcggcggccgcgcgagaggagtggagcgagatgaacgctcggtgggcggtgcttctcgcgctgctggtggcgagcgccggcgccggcggcgcgcgcgccgcggggctcggcgggctgagccgcgcgtcgttccccaaggggttcgtgttcgggacggcgacggcggcgtaccaggtcgagggcgcggcgtccaccaacggccgggggccctccatctgggacgcattcgcgcacaccccaggaaatgttgtgggaaatcaaaatggagatgtcgcggtggatcaataccatcgctacaaggaagatgttgatctcatgaaaagtttgaattttgatgcctaccgattttcaatctcatggtccaggatcttcccagatggagagggaagagtcaatccagaaggtgtagcatattacaacaatttgataaactacctgctccagaaaggcatgactccttacgtcaacatttaccactacgatcttcctcttgcactcgagaagaaatacggagggtggttaagctcaaagatggcagacctgtttacagagtatgctgacttctgttttaagacctatagcgatcgtgtaaagcactggtttacattcaatgagccaaggatagtagcagcgcttggttatgacgctgggtcaaatcctcctcaaaggtgcaccaaatgcgccaatggtgggaattcagcaaccgaaccttatattgtagcccataattttctcttggcacatgctgctgcggttgcaagataccgtacaaagtatcaggctgctcagaagggtaaggttggtatagttctggacttcaactggtatgaacctcttacaaactcacctgatgaccaagcagctgctcaaagagctagggacttccatgttggctggtttgttgatccattgataaacggacattatccacagataatgcaagatcttgtgaaagagagactgcccaggttcactcctgagcaagctaaattggtcaagggctcagcagactatatcgggatcaaccagtacacagccagctacatgaagggccagaaattgctccagcagacgcctactagctactcagatgattggcaagttcaatatgttcatgaaaggaatggcaaaccaattggaccccaggcgaattctgattggctttacatcgtcccgacgggaatgtatggatgtgtgaactacctcagggagaagtatggaaatccaacagtctacataaccgagaatggaatggatcagcctggaaacctgacccgcgaccagtacctgcgcgatgtgacaagggtgcggttctacaagagctacatcggccagctgaaaagggccattgatcagggcgctaacgtggctggctacttcgcgtggtctctccttgacaacttcgagtggcggtcaggatactcgtccaagttcggcatcgtctacgtggacttcaacacgcttgaacggcacccgaaggcttcggcctactggttcagggacatgcttaagaagaattgagatttctaaaggccaagcctgaagttaccattttgctcagctttgccttgtgtttcggatggccgccagcgtgctaggctgtcaaaatgggaataaaagaagaacagaacagccgctccaaattgtgcattccatttatgatttatggccgaaaaaaaaaaaaaaaaaaaa

SEQ ID NO: 2482 - protein, 496 aa, Panicum virgatum
  misc_feature: Ceres CLONE 1781099
  misc_feature: Great-hit functional homolog of the protein sequence encoded by LOCUS At3g18070
  misc_feature: Great-hit functional homolog of the protein sequence encoded by LOCUS At3g18080
  misc_feature (1)..(465): Pfam Name: Glyco_hydro_1 Pfam Description: Glycosyl hydrolase family 1
  misc_feature: Useful for making plants with altered cell wall content and/or composition
MNARWAVLLALLVASAGAGGARAAGLGGLSRASFPKGFVFGTATAAYQVEGAASTNGRGPSIWDAFAHTPGNVVGNQNGDVAVDQYHRYKEDVDLMKSLNFDAYRFSISWSRIFPDGEGRVNPEGVAYYNNLINYLLQKGMTPYVNIYHYDLPLALEKKYGGWLSSKMADLFTEYADFCFKTYSDRVKHWFTFNEPRIVAALGYDAGSNPPQRCTKCANGGNSATEPYIVAHNFLLAHAAAVARYRTKYQAAQKGKVGIVLDFNWYEPLTNSPDDQAAAQRARDFHVGWFVDPLINGHYPQIMQDLVKERLPRFTPEQAKLVKGSADYIGINQYTASYMKGQKLLQQTPTSYSDDWQVQYVHERNGKPIGPQANSDWLYIVPTGMYGCVNYLREKYGNPTVYITENGMDQPGNLTRDQYLRDVTRVRFYKSYIGQLKRAIDQGANVAGYFAWSLLDNFEWRSGYSSKFGIVYVDFNTLERHPKASAYWFRDMLKKN

SEQ ID NO: 2483 - DNA, 1513 bp, Panicum virgatum
  misc_feature: Ceres CLONE 1781106
  misc_feature: Encodes the peptide sequence at SEQ ID NO. 2484
gtgcgagcatggaggggcgccctgcactgctggccctcgcgccagcagcggcgacggtgctggtcatgctctcgctgagctgctcgtggtgcggcggcgtgtcggcggcgagggtggtcgcggcggcggcgggcgccggcgccgagcggcacccggtggtgctcatcccgggcgcgggcggcaaccagctggaggcgcgcctgacggacgagtacaggccgtgcagcctggcgtgccgggtgtggccgctcgtgcacggccgcggcggctggttccgcctctggttcgacccctccgtgctcctcgccccgctcaccaggtgcttcgccgagcggatgatgctccgctacgacgccggcgccgacgacttccgcaacgcgcccggcgtcgagaccagggtctccgacttcggctccacctccaccctccgctacctcgacccaaacctcaagctcctgacggggtacatgaacaccctgtcgagcacgctggagacggccggctacgaggagggccgggacctgttcggcgcgccgtacgacttccgctacggtctggccgccccggggcacccgtcggcggtgggcaccgcgtacctgcagcgcctcaggctgctggtggagtcggcgcgcgcggccaacggcgggcggcccgccgtcctggtggcgcacagtctgggaggcctgttcgcgctgcagctgctggcgcgcagcccgccggcgtggcgcgccgcgaacgtggcgcgcctcgtcacgctctcggcgccgtggggcgggtcggtacaggagatgctcaccttcgcctccggcaacacgctcggggtgccgttcgtcgacgcgtcgctcatccgcgacgagcagcggacctccgagagcaacctgtggctgctgccggcgccccgcgttttcggcaacaccacgctggtggtgtcgcaggcccacggcagcggcggcggcaaccgctcctactccgccaagaacatgacgcagttcctccgggacatcgggttcgaggagggcgtcgagccgtaccgcgcgcggatcctgccgctcgtcgaggccctgccggagcccggcgtgcccgtgacgtgcctggtgggcaccggcgtcgacacggtggagagcctcgtgtacggggacggcggcttcgacgagccgcccgaggaggtggtgtacggcgacggggacgggacggtgaacctggccagcctcgtcgccccgatcagggcgtggtccgactcgccggcgcaggtcgtcgaggtcgtggagctgcccaaggtgtcgcactccggcatcctcaatgacaagagcgcgctcgagcagatcatcaggatcatcgactccatcaacctcaacgccaccagctagctatcagacgtcttgatgagatgctttgccttttatttggtagacgaccgactctaaaaatcccactttaataccttagatttgctagttttctgttaattatttacgagatgattgagatttgtcaaaaaaaaaaaaaaaaaaaa

SEQ ID NO: 2484 - protein, 452 aa, Panicum virgatum
  misc_feature: Ceres CLONE 1781106
  misc_feature (1)..(341): Pfam Name: LACT Pfam Description: Lecithin:cholesterol acyltransferase
MEGRPALLALAPAAATVLVMLSLSCSWCGGVSAARVVAAAAGAGAERHPVVLIPGAGGNQLEARLTDEYRPCSLACRVWPLVHGRGGWFRLWFDPSVLLAPLTRCFAERMMLRYDAGADDFRNAPGVETRVSDFGSTSTLRYLDPNLKLLTGYMNTLSSTLETAGYEEGRDLFGAPYDFRYGLAAPGHPSAVGTAYLQRLRLLVESARAANGGRPAVLVAHSLGGLFALQLLARSPPAWRAANVARLVTLSAPWGGSVQEMLTFASGNTLGVPFVDASLIRDEQRTSESNLWLLPAPRVFGNTTLVVSQAHGSGGGNRSYSAKNMTQFLRDIGFEEGVEPYRARILPLVEALPEPGVPVTCLVGTGVDTVESLVYGDGGFDEPPEEVVYGDGDGTVNLASLVAPIRAWSDSPAQVVEVVELPKVSHSGILNDKSALEQIIRIIDSINLNATS

SEQ ID NO: 2485 - DNA, 1714 bp, Panicum virgatum
  misc_feature: Ceres CLONE 1781132
  misc_feature: Encodes the peptide sequence at SEQ ID NO. 2486
gaccccaatccccttccgattccccccgtcgcctgagcggctgagccagccagcctagcctgcctgccaagccaagccaagtcgtcgccagttcgccgcccaccgccgcgtctccgcctccccttccccgcatccgcgagcgcggcggagctcgaatcccggcgtcccaaatggcgaccgcgtgcccgccgctctcgctgccgtccacctcccccctccgcggcggcaggtcggcccgcgccgggcccaggcgccggcagctctccgccgtccgctgcagcgccgtcggagaggcggtagcggaggaggcctcggtcgggaccgcggaggagccgctgctggtcagcgctatcagggggaagaaggtcgagaggccgcccgtctggctcatgaggcaggccgggaggtacatgaagagctatcaattgctttgtgagcggtatccgaagttccgtgaaagatcagaaaatgtcgacttagttgttgagatctctctgcaaccatggaaggttttcaagcctgatggagtcatcttgttctcggatatccttactccacttcctgggatgaacatacctttcgacattgtgaaaggaaaaggtccagtgatttatgatcccttgagaacagcagctgctgtgaatgaagtcagagaatttgttcctgaggaatgggtcccttatgtggggcaggctctaaatttgttgcgacaagaggttaaaaatgaagctgcagttctaggttttgttggagctccctttaccttggcatcttactgtgtggaaggaggttcatcaaagaactttacaatgattaagaagctggccttctcagaaccagcgattctgcacaatttgctacaaaaattcacaacatcaatggctaactacattaaataccaagcagacaatggggcacaggctgtccaaatttttgattcatgggctactgaactcagcccagctgattttgaggagtttagcctgccttatctaaagcagatcgtggatagtgtccgggaaacacatcctgacttgcccctgatactatatgcaagcggatctgggggtttgctggagaggcttgctttgagcggtgttgatgttgtcagcttggactggacggtcgacatggctgagggaagaaaaagattgggatctaatgtagcagttcaggggaatgtggaccctggtgttctttttggatcgaaggagttcattagcaagcggatttatgacactgtgcagaaggctggtaatgtgggacatgtattgaaccttggtcatggcatcaaggttggaaccccagaggagaatgttgctcacttctttgaggttgcaaaaggaatcagatactaaaggacattgggctgttgcttttctccccatcggctgaagttgtaggatcactggctgaggatagatgcagaaagtcatgtgtagcatagagtacttcagaacaagtatttttgtgatagattctgtctatcacatttcaagctccggtttcagagtaatattgtaagcaaatttgagttcacgtgtaatgaagcgcctgcttgtttataccactatatagagtagcagtatagttctgtaacagtctaatcttatctgcatgcaagattattgattatatgttcccactatagaaatatttcagttgactttagccatcgagggtgcttggtgctgaaaaaaaaaaaaaaaaaaaa

SEQ ID NO: 2486 - protein, 395 aa, Panicum virgatum
  misc_feature: Ceres CLONE 1781132
  misc_feature (1)..(328): Pfam Name: URO-D Pfam Description: Uroporphyrinogen decarboxylase (URO-D)
  misc_feature (1)..(395): SWISSPROT Homolog: EC 4.1.1.37 Uroporphyrinogen decarboxylase, chloroplast precursor
  misc_feature (9)..(395): SWISSPROT Homolog: EC 4.1.1.37 Uroporphyrinogen decarboxylase, chloroplast precursor
MATACPPLSLPSTSPLRGGRSARAGPRRRQLSAVRCSAVGEAVAEEASVGTAEEPLLVSAIRGKKVERPPVWLMRQAGRYMKSYQLLCERYPKFRERSENVDLVVEISLQPWKVFKPDGVILFSDILTPLPGMNIPFDIVKGKGPVIYDPLRTAAAVNEVREFVPEEWVPYVGQALNLLRQEVKNEAAVLGFVGAPFTLASYCVEGGSSKNFTMIKKLAFSEPAILHNLLQKFTTSMANYIKYQADNGAQAVQIFDSWATELSPADFEEFSLPYLKQIVDSVRETHPDLPLILYASGSGGLLERLALSGVDVVSLDWTVDMAEGRKRLGSNVAVQGNVDPGVLFGSKEFISKRIYDTVQKAGNVGHVLNLGHGIKVGTPEENVAHFFEVAKGIRY

SEQ ID NO: 2487 - DNA, 2213 bp, Panicum virgatum
  misc_feature: Ceres CLONE 1781150
  misc_feature: Encodes the peptide sequence at SEQ ID NO. 2488
gacgtcacgacccgctggctccttcattcccatctccaccgtgaccgtgaggtctcccacctcctcctcctcctcgtccccccgatctcccccgcggccgccgccgcatcccgtccgaaaggagcccgaaccctagccccgcctacgcgcccattgcctccgatcgccatgtccgccgctcagcttctccgtcactcccgcaagctgcggagtttgcaaaatgctgtagattgcgagcgttctagtcttgtccggtatttctctagcagttccggttcctttatcgtcaaagaaaatggtcttggaaagcgaactggaggcaccagattatctaagcatagccagcctgcaaaagagcttgagacattctcagtgggagtaaacagaagctacacttggacaagagcttccaacagccgtatcccaagtgctgttagcagtctcaatggttcattttcatgtggacaggtggcttcagcacgaccattctcaagcagtgcagacttgccaccacatcaagaaatcgggatgccttcactttcgcccacaatgactgagggaaacattgccaagtggcttaagaaggaaggagacaaggtctcccctggtgaggttctctgtgaggtggaaactgataaagcaactgtggaaatggagtgcatggaagagggctatctcgctaagattattcatggagatggtgccaaggagataaaagttggcgagatcattgctgtaactgtggaagaagagggtgacattgagaagttcaaggattataagccatcatcttctgcggaacctgcagctcctactgaatcaaaggctcaacctgaaccttcaccaccaaaggtggacgagaaagaggctagcaagactcctgagcccaaggccccaaagattgaagaagcttctcaatctggagatcgcatatttgccagccctcttgcccggaaactggctgaagataacaatgtcccactgtcaagtgtgaaaggtactggtcctgatgggcgtattttgaaggcagacattgaagattacttggctaagggaggacataaggaggcttttgctgctccagggttaggttatgtcgacattccaaatgcacagataagaaaggttaccgcaaaccgcctgctagcatcgaaacagaccattccacattactacttgacagttgatgcacgtgttgacaaacttgtcaaattgcgaggtgaactgaatccgctgcaggatgcctctggtggaaagaaaatatctatcaatgatcttgtaatcaaggctgcagctttggctcttcgaaaggtccctcagtgtaacagctcatggatgaatgattttattcgccaataccacaatgtgaacatcaatgttgccgtacagacagagcatggattgtttgttccagtaattagggacgcagacaagaagggacttggtacaattgctgaggaggtgaagcagttggctcaaaaggcaagggataacagcttaaaaccagcagattacgagggtggcaccttcacggtatcaaacttgggaggtccctttggaattaaacaattctgtgccatcataaatcctcctcaatctgcaattttggccatcggctctgctgagaagagggtgatacccggttccgctgatggtcagtatgagtttggttcattcatgtcagctacgctgagctgtgaccacagggttattgatggtgcgattggtgcggaatttctgaaagcgttcaagggctacatcgagaacccaacctcaatgctgctgtgaagtttaggatgatgaccagcaagacaattcttgtgaagctgtggaataacccggccacccggaaagtggtgtctccattttgtataatctcgtgatggtctcaaggaggacctggaaaccaagagcacgcaaccgacacagaatgacctgattttccgtttaccctttttgacgccgccagtgttaggctggaaagtaggataaacttacaaggcctcattgagctcttttttttttcctctccttttgttgggtttggccccctgggctgttctggcatgagaatgtcgctccccggagaacacttttgagtatagcgttttgcatatttttctatgcacagggagaattggtcggaataaacgaagtgactcaataatcagggaaggaactgtttgggtcgtcaaaaaaaaaaaaaaaaaaaa

SEQ ID NO: 2488 - protein, 539 aa, Panicum virgatum
  misc_feature: Ceres CLONE 1781150
  misc_feature (1)..(234): Pfam Name: 2-oxoacid_dh Pfam Description: 2- oxoacid dehydrogenases acyltransferase (catalytic domain)
  misc_feature (3)..(539): SWISSPROT Homolog: EC 2.3.1.12 Dihydrolipoyllysine- residue acetyltransferase component 2 of pyruvate dehydrogenase complex,
  misc_feature (3)..(539): SWISSPROT Homolog: EC 2.3.1.12 Dihydrolipoyllysine- residue acetyltransferase component 3 of pyruvate dehydrogenase complex,
MSAAQLLRHSRKLRSLQNAVDCERSSLVRYFSSSSGSFIVKENGLGKRTGGTRLSKHSQPAKELETFSVGVNRSYTWTRASNSRIPSAVSSLNGSFSCGQVASARPFSSSADLPPHQEIGMPSLSPTMTEGNIAKWLKKEGDKVSPGEVLCEVETDKATVEMECMEEGYLAKIIHGDGAKEIKVGEIIAVTVEEEGDIEKFKDYKPSSSAEPAAPTESKAQPEPSPPKVDEKEASKTPEPKAPKIEEASQSGDRIFASPLARKLAEDNNVPLSSVKGTGPDGRILKADIEDYLAKGGHKEAFAAPGLGYVDIPNAQIRKVTANRLLASKQTIPHYYLTVDARVDKLVKLRGELNPLQDASGGKKISINDLVIKAAALALRKVPQCNSSWMNDFIRQYHNVNINVAVQTEHGLFVPVIRDADKKGLGTIAEEVKQLAQKARDNSLKPADYEGGTFTVSNLGGPFGIKQFCAIINPPQSAILAIGSAEKRVIPGSADGQYEFGSFMSATLSCDHRVIDGAIGAEFLKAFKGYIENPTSMLL

SEQ ID NO: 2489 - DNA, 1328 bp, Panicum virgatum
  misc_feature: Ceres CLONE 1781153
  misc_feature: Encodes the peptide sequence at SEQ ID NO. 2490
cccccctccgcctctcgctccctctcgcctctggttcggagagctctcttgaagcctcgaggcccgcctcgcctgggctctgctcctccggctccgccgccgcgctagctgttgcattgcagcccgcgagccctgagctgacagctagctcgttattcgccacacttccaagacatggacttcgaagaccgctgccacaaggtccaggagcccaagttcgactgcctgcttttcgacctcgacgacactctgtacccgttgagttctgggatcgcaggccatgtcaagaagaacattgaagactacatggttgagaagctgggtattgatgagagcaagatcgagaaccttggcaacctgctgtacaagaactacggcaccacgatggccggcctcagggcgatcggctacagcttcgattacgatgagtaccacgccttcgtccatggaaggctaccctacgacaacatcaagcccgaccctgttctcaagcacattctcaagaacctgcgcatccgcaaactcatattcaccaacggcgacaaggtccacgccgtgcgcgccctcaagaggctgggcctggaggactgcttcgaggggatcatctgcttcgagaccctgaacccgccgtgcccgccgcagggcgaccaggagcccgagatcttcgacatcgccggccacttcgcccggtccagcaccgccgacgagctccccaagacccccgtcctgtgcaagcccaacgtcgacgccatggaggaggcgctgaggatcgccaacgtcaacccacacaaggcgatcttcttcgacgacagcgtgcgcaacatcctggccgggaagcagatcggcctccacacggtgctggtgggcaagtcgcagcgtgtgaagggcgcggaccacgcgctggagagcatccacaacatcagggaggcgttgccggagctgtgggaggaggccgagaaggcggaggacgtgctctacgccgaccgcgtggccatcgagacctccgtcacggcgtaaaaaatcccccggcgcaccgtcatcagccgaagtttctcgacgtccagggccgcagcagcgatcacgcatcgcacgcccgggccaggactggggtggtctcccacggtgggaactgaattccagcgatggccgggccgggaatttccgacaacagcaggggtgcagcatgtaatggtggggaacagatgatgagctcgtgttgggctggtcctagtatatatacatatatatgtatcggccggaccttttgcttgtaaattactagtagaagaaaaaaaaaaaaaaaaaaataaaaaaaaaaaaaaaaaaaa

SEQ ID NO: 2490 - protein, 280 aa, Panicum virgatum
  misc_feature: Ceres CLONE 1781153
  misc_feature (1)..(219): Pfam Name: Hydrolase Pfam Description: haloacid dehalogenase-like hydrolase
MDFEDRCHKVQEPKFDCLLFDLDDTLYPLSSGIAGHVKKNIEDYMVEKLGIDESKIENLGNLLYKNYGTTMAGLRAIGYSFDYDEYHAFVHGRLPYDNIKPDPVLKHILKNLRIRKLIFTNGDKVHAVRALKRLGLEDCFEGIICFETLNPPCPPQGDQEPEIFDIAGHFARSSTADELPKTPVLCKPNVDAMEEALRIANVNPHKAIFFDDSVRNILAGKQIGLHTVLVGKSQRVKGADHALESIHNIREALPELWEEAEKAEDVLYADRVAIETSVTA

SEQ ID NO: 2491 - DNA, 443 bp, Panicum virgatum
  misc_feature: Ceres CLONE 1781158
  misc_feature: Encodes the peptide sequence at SEQ ID NO. 2492
cacagcgcctcacccccgtctccggtctccagtcccgcaaccgcgacgagatggccgagattgagctgaagaccgcacctgctgacttccgctttcctacaacgaaccaaaccaggcactgttttgcgcgctatattgagtaccatagatgtgtcaatgacaaaggggatgaaactgctgattatgagaaattcgccaagtactaccgctctctttgcccaggagaatgggttgagaagtggaacgagcagagggaaaacgggacctttgcagggcccctctaaatcttatttgagagtcaccgtggaccaccctacagctttcatcactccggatttgttcttatttgtgttagtctcgtgacacctaagcactcactgcaaaacagttcgtgatgctgtttatttggattgcactcataatttaaaccgttgttgctaccg

SEQ ID NO: 2492 - protein, 77 aa, Panicum virgatum
  misc_feature: Ceres CLONE 1781158
  misc_feature (1)..(72): Pfam Name: COX6B Pfam Description: Cytochrome oxidase c subunit VIb
  misc_feature (13)..(77): SWISSPROT Homolog: EC 1.9.3.1 Cytochrome c oxidase polypeptide VIb
MAEIELKTAPADFRFPTTNQTRHCFARYIEYHRCVNDKGDETADYEKFAKYYRSLCPGEWVEKWNEQRENGTFAGPL

SEQ ID NO: 2493 - DNA, 1761 bp, Panicum virgatum
  misc_feature: Ceres CLONE 1781172
  misc_feature: Encodes the peptide sequence at SEQ ID NO. 2494
aaaaatccaaaacaaaaatccaaggccgcgcggtacgcctacctccgcggctccgcctcgcccgcgccgatggcgctgcagctccagctgccgcgaccgccgccactgcgccttgccgccgttcggctcccttccccggccgccccggcccgtggcgcctccgcttccgcggccgccctccgcgcccgcactggcggcgtcgcgttctcgctccagacgaacgtgcgcctgctcaagcccaaccgccgcgtccgccgctctcgggacccctactacgacctcgacgaggatgaagacgacgaggacgaggagttcgaggaagaggacgacgacgagggctacgacagcgatgatgatatgtcagatttggaatatcctggtgtactctattcaaacagccctcatgctccaagcaagaggccagtactgcagactccattgataaaagaaaactgggaaggaggacaactggaaactcgtggtaaatatggcagtctggagaaaattaattctcttcttcctaggagtaaagtgggacgatcgtcaccagatcttatgaacatggacagtgaagtagagttgaaaaatgaaagcatttctcgaagtttgttccagaaactgcaagaagaatatgaattcgatgacaaatggttaccactggttgattacttgtgcacatttggactaaatgaatctcattttacatacatctatgagagacatatggcctgctttcaaatcagtcaggcttcagcagaagaaaggttggatttcctgctaaatgctggggttaaaagcaaggatatgaagaggatactggttaggcagccacagattctggaatacactcttagcaatctgaaatctcatgttgattttctggtgggcattggggttcccagtacacgaatagggcaagttatttcttctgctccttcgatgttctcttacagcgtggagcagtctctgaagccaacggtaaggtacctgattgaggaagtaggtattgaggagagtgatgtgggcaaagtagtgcagctaagcccacagattctggtgcagaaaattgatagtgcatggaaatctcgatccctttttctatcaaaagaattaagtgctcccaaaggtagcattgttaagatggtgacaaaacaccctcagctacttcattacagcattgaggatggaatcttgcctcgcatcaatttcctgagaagcattggtatgagaaactctgatattctcaaggtactgacaagtcttactcaggtgttatctttgtccttggagggcaatctcaagccaaagtatctttacttggttaatgaccttaagaacaatgttcaagccttaacaaaatatccaatgtacctgagcttgtctctcgatcagagaattcgtccccgacaccgttttcttgtttcattgaagaaagctccaaagggtccatttcctctgagctcctttgtgcccacagatgagcgtttttgccagaggtgggctgggactagcttggagaaacaccatacattcagacagagcttgctgcttacaggttttgctgagaagtctggaaggaaaacattagtctcaagacggtagatagctagctggtgggaaataggtttcttttgagcctatgctcttaacggtaagatgatttcttctacagcactcttcttaattctttggggtttctttggataatgttttccatagcactgattggttcgctgtttccaaaaaaaaaaaaaaaaaaaa

SEQ ID NO: 2494 - protein, 510 aa, Panicum virgatum
  misc_feature: Ceres CLONE 1781172
  misc_feature: Great-hit functional homolog of the protein sequence given in SEQ ID NO 9602
  misc_feature: Useful for making plants with altered Lignin content
  misc_feature: Useful for making plants with altered alkaloid content
  misc_feature: Useful for making plants with altered terpenoid content
MALQLQLPRPPPLRLAAVRLPSPAAPARGASASAAALRARTGGVAFSLQTNVRLLKPNRRVRRSRDPYYDLDEDEDDEDEEFEEEDDDEGYDSDDDMSDLEYPGVLYSNSPHAPSKRPVLQTPLIKENWEGGQLETRGKYGSLEKINSLLPRSKVGRSSPDLMNMDSEVELKNESISRSLFQKLQEEYEFDDKWLPLVDYLCTFGLNESHFTYIYERHMACFQISQASAEERLDFLLNAGVKSKDMKRILVRQPQILEYTLSNLKSHVDFLVGIGVPSTRIGQVISSAPSMFSYSVEQSLKPTVRYLIEEVGIEESDVGKVVQLSPQILVQKIDSAWKSRSLFLSKELSAPKGSIVKMVTKHPQLLHYSIEDGILPRINFLRSIGMRNSDILKVLTSLTQVLSLSLEGNLKPKYLYLVNDLKNNVQALTKYPMYLSLSLDQRIRPRHRFLVSLKKAPKGPFPLSSFVPTDERFCQRWAGTSLEKHHTFRQSLLLTGFAEKSGRKTLVSRR

SEQ ID NO: 2495 - DNA, 1699 bp, Panicum virgatum
  misc_feature: Ceres CLONE 1781227
  misc_feature: Encodes the peptide sequence at SEQ ID NO. 2496
aggctgcgagcggccacctgcggctccacgcccgccaccgacccccatctctcctggccaaacaaatcccgcgccgccccgccaccactcgccaccaccgcaccgcagcagcacagcacggcccccgcgccagagaaacccagagagagggatccacggcgggcccgcgcgcgcgcagcgagcgagcgagcgagcgagctgctgctccgacgatacgatgatggccctgcaggtcgccggctgcgccctgccgcccctcctcgcgcggcggcggcgccgcgcgttccgctcgccccgcgcggtggcgtcggacgccgcgccggcggcggcgagggaggaggacggcaaggtcgcgctgggcgggtccggcgtcgcggtcaccaagctcggcatcggggcctggtcctggggcgacaccacctactggaacgagttccagtgggacgataggaaactgaaggcagcaaaaggagcatttgatgcgagcatcgattgtggaataactttctttgatactgctgaagtatacggagctgggatatctggagccataaattcagaaagtttactcggaagattcattaaggaaaggcaacgaaaggaaaaagtcgaagtggccatcgcaacaaagtttgcagctcttccatggaggtttggccgtggaagtgtcatctgtgcactgaaggcctcattggatcgccttggcgtgtcttcagttgagctctaccaacttcattggccagggatatggggcaatgaaggttacctggatggccttggagatgctgttgagcaaggtcttgtgaaagctgttggagtctcaaactacagtgaaaaacgcctccgagatgcttatgcgcagcttaagaagagggggattccactggcttcaaatcaagtaaattacagcctgatatacaggaacccggaggaaaatggggtgaaggcagcttgcgatgagctcggaattattttgattgcgtattccccaatcgcccaaggtgctctgacagggaaatacactccggacaaccccccgaaagggcctcgaggacggatatatactccagagttcctgacaaagctccagccgcttatcaaccggatcaaggagattggagggaactacgggaggaccccaacccaggtggtgctcaactggctggtgtgccagggcaacgtggtgccgatcccgggggcgaagaacgcggagcaggcgcgggagttcgcgggcgcgctggggtggagcctgacgggcgacgaggtggaggagctccgatccatggcgcgccaggtcaagcccgtcatcggcttcccggtggagaagctgtgacgacccgctcgctgcctgcaggtagctagctgctgggaattttgcatcggatggatgtggtcaaccgcggaagacaaaatataattacctctcgtcccgtgacagcaaccacgaagtagtacagtacagtatagtataggtagattgacaagcatgccatgccatctcgagctgaaaccaaaatacacgcattggaagaagagcagactagtatatactactgcagtagcccgagcgttgactgttgacctgacgtctgttctggagtatgctgttgagcacctcgcgtcaccctgtttagttccaaaacattttttataataaccgtcgtatcgaatgttcggacaaaaaaaaaaaaaaaaaaaa

SEQ ID NO: 2496 - protein, 371 aa, Panicum virgatum
  misc_feature: Ceres CLONE 1781227
  misc_feature (1)..(311): Pfam Name: Aldo_ket_red Pfam Description: Aldo/keto reductase family
MMALQVAGCALPPLLARRRRRAFRSPRAVASDAAPAAAREEDGKVALGGSGVAVTKLGIGAWSWGDTTYWNEFQWDDRKLKAAKGAFDASIDCGITFFDTAEVYGAGISGAINSESLLGRFIKERQRKEKVEVAIATKFAALPWRFGRGSVICALKASLDRLGVSSVELYQLHWPGIWGNEGYLDGLGDAVEQGLVKAVGVSNYSEKRLRDAYAQLKKRGIPLASNQVNYSLIYRNPEENGVKAACDELGIILIAYSPIAQGALTGKYTPDNPPKGPRGRIYTPEFLTKLQPLINRIKEIGGNYGRTPTQVVLNWLVCQGNVVPIPGAKNAEQAREFAGALGWSLTGDEVEELRSMARQVKPVIGFPVEKL

SEQ ID NO: 2497 - DNA, 2072 bp, Panicum virgatum
  misc_feature: Ceres CLONE 1781248
  misc_feature: Encodes the peptide sequence at SEQ ID NO. 2498
ataattattcgcagcacacaaaaagagggggcgcaagcaagagaagacacgagaactagcggaagagagagaagaaaagcttagggagagagggagagacgtgtagtggtggagttggatcggcctgtgcggatcggaggaggtcatgaacagctaatgcccattcatttattatggacttgcaccagttgttaaagtacagattagctggtgctaacgtcttctacgagttccctacagaaaacaacttagcaaacattccctggccagttagtcccctgaagtccgagttcagcaactccccatacactctttcagcccagcttgagtgtgacaatttgtctgctattagcaacactccagataatcagagctccacagaaaccatttcagcacaaccaatatcaccattgaaagttgacagttcatacagacaggcaggcatccttcgagaaaacacccaagtgagacctgatccattgtacgcaacatcaaggcataatatgcaacacactttacgggaaatagagactgttctgatggctcctgatgctgatgatgcagccaatggcaccaagcatgagtttgaggaacacaaacctactcagctgatgaggcagcggtcaaggacatggagtcatgaatcaagacagccatcaccaggagttgtccgcacacaatttggatctggataccccacagcaagctatgacttccgcccagaaaagcggcaaagggagttaagggaggatccgcagagcatggtgaagcagctattaaccaagtgtgctgaagcattaagtgaggagaggatagatgagttcttcaagcttgttcagcaagctcgcggagttgtatcaattactggggagccaatacagcggttagatgcttaccttcttgagggtttggttgctagacatggaaactcgggtacgaacatatatcgtgctctgaagtgccgtgagccggagagtaatgaacttttgtcctacatgaagattttatacagtatctgtccgtacttcaagtttggctatatggctgccaatggggcaattgcagaggcattgagaaatgaggataaaatccatataattgatttccagattgctcaagggacacaatggataacactgatccaagcgctagctgcaaggcctgggggtccaccacatgtgcggatcactgggatagatgatccagtgtcagagtacgctcgtggggaaggtctggaccttgtagggaagatgttgaagagcatgtccgaagaattcaggataccattggagtttacccctctacctggtttctatgccactcaagtcacaaaagaaatgctggacatcaggccaggcgaagcacttgctgtcaacttcactctgcagctacaccacacaccagatgagagcgtggatgtcaacaacccacgggacgggctactccggatggtgaaagggttgtccccgaaggtgactacgctggtggagcaggagtcacacaccaacacaactccattcctgatgaggttcagcgagactatggactactactcggccatgttcgagtcaatcgacgtgaacctgccacgggacagcaaggagcggataaacgtggagcagcactgccttgccaaggacattgtgaacatcatcgcctgtgaggggaaggaccgggtggagcggcatgagctcctgggcaagtggaagtcgaggctgaccatggctgggttcaagccgtacccgctaagctcatacgtgaactcggtgatcaggaggctcctcgcatgctactctgacaagtacaccctggaggagaaggacagcgcgatgctgctcggctggaagaataggaaattgatatcagcttctgcgtggcactgacaataagttttcagaagaacataagtaaacaccttctcttacatataaatatatatagtgaattccctggtctgctttcccaggaaaggttctctttgttgtgtacatgtacaggatgttgcatccttagttttttccccctaaattgtaaaccaggataaacattgacaaaaaaaaaaaaaaaaaaaa

SEQ ID NO: 2498 - protein, 569 aa, Panicum virgatum
  misc_feature: Ceres CLONE 1781248
  misc_feature (1)..(304): Pfam Name: GRAS Pfam Description: GRAS family transcription factor
MDLHQLLKYRLAGANVFYEFPTENNLANIPWPVSPLKSEFSNSPYTLSAQLECDNLSAISNTPDNQSSTETISAQPISPLKVDSSYRQAGILRENTQVRPDPLYATSRHNMQHTLREIETVLMAPDADDAANGTKHEFEEHKPTQLMRQRSRTWSHESRQPSPGVVRTQFGSGYPTASYDFRPEKRQRELREDPQSMVKQLLTKCAEALSEERIDEFFKLVQQARGVVSITGEPIQRLDAYLLEGLVARHGNSGTNIYRALKCREPESNELLSYMKILYSICPYFKFGYMAANGAIAEALRNEDKIHIIDFQIAQGTQWITLIQALAARPGGPPHVRITGIDDPVSEYARGEGLDLVGKMLKSMSEEFRIPLEFTPLPGFYATQVTKEMLDIRPGEALAVNFTLQLHHTPDESVDVNNPRDGLLRMVKGLSPKVTTLVEQESHTNTTPFLMRFSETMDYYSAMFESIDVNLPRDSKERINVEQHCLAKDIVNIIACEGKDRVERHELLGKWKSRLTMAGFKPYPLSSYVNSVIRRLLACYSDKYTLEEKDSAMLLGWKNRKLISASAWH

SEQ ID NO: 2499 - DNA, 1412 bp, Panicum virgatum
  misc_feature: Ceres CLONE 1781288
  misc_feature: Encodes the peptide sequence at SEQ ID NO. 2500
attcctctgcttctaattcttcaatcggttcttcttcttatcttgttatcttcacgtacggatgccatgccctgccaatgccatgccatcatctaccggcaaccaacaaagccagcgaaacccttaattattagctcctcgttaacgacgacattgcctcctgcatctgcggcataccgtcgtcgatcgatggcggcgccggcgccgcccatcagcaagcgcctgatgcggtgccggtgctgcgaggacacgctgggcgtcccgctccgccgcgcccagcagcagcagcagcagttcccggagctggtgcggctgcgtgatgcgcctccgccgccgcggccccggcgcatcgtgctggtgcggcacggcgagagcgagggcaacgtggacgaggccgcctacacgcgcgtcccagacccgcgcatcggcctcacagccaagggccgccgcgacgccgagctctgcggccgccgcctccgggacctcttctcctccggctccgacgacgactggaaggtctacttctacgtctccccctaccgccgcacgctggagacgctgcgcggcatcgcccactccctcgagccccaccgcatcgccggcgtccgggaggagccgcgcctccgcgagcaggacttcggcaacttccaggaccgcgaccggatgcgcgtcgagaaggagacccgcctccgctacggccgcttcttctaccgcttccccaacggcgagtcggccgccgacgtctacgaccgcatcaccggattccgggagacgctgcgcgccgacatcgacatcggccgcttccagccgcccggggagcagagccccaacatgaacgtcgtgctcgtctcccacggcctcacgctccgcgtcttcctcatgcgctggtacaagtggacggtgcgccagttcgagagcctcgagaacctcgacaatggcggcgccctcgtcatgcagacggggcagggcggcaggtacagcctcctcgtccaccacaccgccgacgagctcagggccttcgggctcaccgacgagatgctcgaggaccagatgtggcagaagacggcaaagccaggggagctcaactacacattcatgaccaacggccagtcattcttcgatcgattcactactactactagtacctactaattaaccaaatactaactagtagatgtatcctgctggtccttgttcaaaaaaaaaggatatatcctggctagtagtacagtaccaacaacttagccttttttttgcttgtacgtacggaagatcatcttaattactgattaattcactgctgtatcttggccctgtttggtttgtttgggccagaaagtagcacaaacttagactaataattacgggtattaaataaagctagtttactgcaaaaaaaaaaaaaaaaaaaa

SEQ ID NO: 2500 - protein, 361 aa, Panicum virgatum
  misc_feature: Ceres CLONE 1781288
  misc_feature (1)..(177): Pfam Name: PGAM Pfam Description: Phosphoglycerate mutase family
MPCQCHAIIYRQPTKPAKPLIISSSLTTTLPPASAAYRRRSMAAPAPPISKRLMRCRCCEDTLGVPLRRAQQQQQQFPELVRLRDAPPPPRPRRIVLVRHGESEGNVDEAAYTRVPDPRIGLTAKGRRDAELCGRRLRDLFSSGSDDDWKVYFYVSPYRRTLETLRGIAHSLEPHRIAGVREEPRLREQDFGNFQDRDRMRVEKETRLRYGRFFYRFPNGESAADVYDRITGFRETLRADIDIGRFQPPGEQSPNMNVVLVSHGLTLRVFLMRWYKWTVRQFESLENLDNGGALVMQTGQGGRYSLLVHHTADELRAFGLTDEMLEDQMWQKTAKPGELNYTFMTNGQSFFDRFTTTTSTY

SEQ ID NO: 2501 - DNA, 2328 bp, Panicum virgatum
  misc_feature: Ceres CLONE 1781296
  misc_feature: Encodes the peptide sequence at SEQ ID NO. 2502
tcggcgcgacgacctcccccaccctcccctctccagctctcctccccattccccgcgcgacgaggccgctccatggcgagtcgcggccggcctcggcccggctcgctccaggtcctcgccgccgtcctcctcctggccgccgcgtccgcggccgccgccggatcccccggtcggcccgcgccggggccaccgctgttcctcccgctcacgcgctcctaccccaacgctaaccggctcgccggctcgttgcggcgcgggctaggcgaaggggcgcaccccaacgcgcgcatgcgcctccacgacgatctcctcaccaacgggtactacacgacgaggctgtatatcgggacgcccccgcaggagttcgcgctgatcgttgactccgggagcaccgtcacgtacgtgccctgcgcctcctgcgagcagtgcggcaatcaccaggatccaagatttcaacctgatctctccagtacatattcaccagtaaaatgcaatgtcgactgtacttgtgacaatgacaaaaatcagtgcacttacgagaggcagtatgctgaaatgagctccagcagtggggttcttggtgaggacattgtgtcttttggtagagagagtgaacttaagccacagcgtgctgtttttggctgtgaaaattctgaaactggagatttgttcagccagcatgctgatggtataatggggctgggtcgtggtcaacttagcataatggatcagcttgttgataagggtgttataagtgattcgttctctttgtgctatggtggaatggatgttggtggtggtgctatggtccttggtggaatgccttctccttctgacatggttttctcacgttcggaccctgtccgcagcccgtattacaacattgagttaagggaaatacatgttggtggaaaggcattgcgggtagacccaagggtctttgacagcaaacacgggactgttttggatagtggaaccacatatgcttatttgccagagcaagcttttgtgtcttttaaagatgctgtgactagcaaagtccattctctcaagaaaatccgtggccctgatccaaattacaaggatatctgctttgcaggtgctggaaggaacgtctcacaactacatgaggtatttccagctgttgacatggtatttggaaatggacagaagctctcacttacaccagaaaattatttatttcggcactccaaagttgatggggcctattgtttgggtgtattccaaaatgggaaagatccaacaacactactaggaggtatcatagttcgtaatacacttgtgacctatgaccgtcacaatgaaaagattggcttttggaaaactaactgttcggaattgtgggagaggctccatatcggcggtgcttcttcaccagcaccttcaagtgatacaggttcacaagctgatatgtcacctgctcctgcccctagtggtttaccagaatttgatgttggtctcataaccattgatatgtccattaatgttacttacccaaatctgaaacctcatctccatgagctgtccgagctgatagctaaagaattggaaattgactcccgtcaggttcgagttatgaatgttacaagccaaggaaactctactctgatcagatggggtattttcccagcaggacctgataatgctatgtctaacacaacagcaatgggtatcatctaccggttaactcagcatcatgttcaattgcctgaaaatcttggcagttatcagttgctcgagtggaatgtgcaacctttaaccagaaggtcatggtttcaagaacatgtagtctccatactgcttgggattttattagttgttctgttcactttgtcagccttcttagtagtacttgtttggagaaagaaatttagtggtcaaactgcctacagacctgttgactcagtggctcctgagcaagaactccagccgctatgatccaaagctgtttggcggagcaacatatagacaattctttggtagagataccgtcgtgtggggttacatatcacagcggcacgcatctgctgctggagtagccctctttgtatgtaacacaagctacaagcttacagaagaagcacaatatgattacatgacttctcgattcaaggtgttgttcataaactgtagtgattcagatcaagagcttcctcttgtgcttatggtagaagaaggttttgttcatgtaatgtagattaagtagggtagagaagggacaagcacacccgtggaacggaacaatgtaatatctatttgataagtgctgagggtatctggcttcttcaaaaaaaaaaaaaaaaaaaa

SEQ ID NO: 2502 - protein, 628 aa, Panicum virgatum
  misc_feature: Ceres CLONE 1781296
  misc_feature (1)..(343): Pfam Name: Asp Pfam Description: Eukaryotic aspartyl protease
MASRGRPRPGSLQVLAAVLLLAAASAAAAGSPGRPAPGPPLFLPLTRSYPNANRLAGSLRRGLGEGAHPNARMRLHDDLLTNGYYTTRLYIGTPPQEFALIVDSGSTVTYVPCASCEQCGNHQDPRFQPDLSSTYSPVKCNVDCTCDNDKNQCTYERQYAEMSSSSGVLGEDIVSFGRESELKPQRAVFGCENSETGDLFSQHADGIMGLGRGQLSIMDQLVDKGVISDSFSLCYGGMDVGGGAMVLGGMPSPSDMVFSRSDPVRSPYYNIELREIHVGGKALRVDPRVFDSKHGTVLDSGTTYAYLPEQAFVSFKDAVTSKVHSLKKIRGPDPNYKDICFAGAGRNVSQLHEVFPAVDMVFGNGQKLSLTPENYLFRHSKVDGAYCLGVFQNGKDPTTLLGGIIVRNTLVTYDRHNEKIGFWKTNCSELWERLHIGGASSPAPSSDTGSQADMSPAPAPSGLPEFDVGLITIDMSINVTYPNLKPHLHELSELIAKELEIDSRQVRVMNVTSQGNSTLIRWGIFPAGPDNAMSNTTAMGIIYRLTQHHVQLPENLGSYQLLEWNVQPLTRRSWFQEHVVSILLGILLVVLFTLSAFLVVLVWRKKFSGQTAYRPVDSVAPEQELQPL

SEQ ID NO: 2503 - DNA, 1507 bp, Panicum virgatum
  misc_feature: Ceres CLONE 1781305
  misc_feature: Encodes the peptide sequence at SEQ ID NO. 2504
agtggccggcagaaagcagcgggtttcaggcgccggggtccgggtgcgggcttgccaccggtttgctgcagtgagatcctcgtctcccggctgcaggctccagcgtactgaaacttcgtttacctgccgcccgcccctgctcttgccccgccagccaagaagcagcctccgtcgccggccgctgcctccggcggtgcgggaagttgtctctgccggtggccgtctagcttacccatggccttgtccggcgagaagcggcctccgccgccggcccctgccaccggcgggacatggaggaagcttttcctagcactgtttgtgtccttgtcggcactgttgtacatgcagattcagccgccaccgcccaagatccccggctcgccgggcggccctccggtcacggcaaccagaacgaggctcagcgacggcaggtacctggcctacctggaatccggcgtcccgaaggaggaggccaattacaagatcatctttgtccatggattcgactcctgcagatacgacgcgctcccgatttccagggagctggcacaggagctcggcatctacctgctgtccttcgaccggcccgggtacggcgagagcgacccgcacccggcccggacggagaagagcatcgcgctcgacatcgcggagctcgccgacaacctgcagctggaccccaagttctacctcgccggcttctccatgggcggcgagatcatgtggagctgcctcaagcacatcccgcacaggctctccggcgtggccatcctcggccccgtcggcaactactggtggcccgggttgccggcgaacgtgtcgcgggacgcctggttccagcagctcccgcaggaccggtgggcggtctgggtcgcccaccacctgcagtggctgacctactggtggaacacccagaagctcttcccggcctccagcgtcatcgcctacaaccccgccctcctgtccgaggcggacaagctggtcatccaaaagttcgcccacagaacctacatgccgcagatccggcagcagggggagcacgagtgcctgcaccgggacatgatggtcgggttcgggagctggagctggagcccgctgcagctggaggacccgttcgccggcggcgggcggcgggggaaggtgcacctgtggcacggcgccgaggacctgatcgtgccggtcagcctgtcgaggtacatcagcggggagctgccgtgggtcgtgtaccacgagctccccacgtcggggcacctcttcccgatcgccgacgggatggccgacgccatcgccaggtccctgctgctcggggacgacgacggcggcggtccgcagccggcctgagtcgatcgcccgggcgggtttctccatgagatccacgacctgcttaaccggcttgctcttgctatcatcccgctcacgtgcgctgaataatctctcgatgtaagaactttggtgagacactagaacaacatgtgtttttctggtctaaaaaaaaaaaaaaaaaaaa

SEQ ID NO: 2504 - protein, 368 aa, Panicum virgatum
  misc_feature: Ceres CLONE 1781305
  misc_feature (1)..(227): Pfam Name: Abhydrolase_1 Pfam Description: alpha/beta hydrolase fold
MALSGEKRPPPPAPATGGTWRKLFLALFVSLSALLYMQIQPPPPKIPGSPGGPPVTATRTRLSDGRYLAYLESGVPKEEANYKIIFVHGFDSCRYDALPISRELAQELGIYLLSFDRPGYGESDPHPARTEKSIALDIAELADNLQLDPKFYLAGFSMGGEIMWSCLKHIPHRLSGVAILGPVGNYWWPGLPANVSRDAWFQQLPQDRWAVWVAHHLQWLTYWWNTQKLFPASSVIAYNPALLSEADKLVIQKFAHRTYMPQIRQQGEHECLHRDMMVGFGSWSWSPLQLEDPFAGGGRRGKVHLWHGAEDLIVPVSLSRYISGELPWVVYHELPTSGHLFPIADGMADAIARSLLLGDDDGGGPQPA

SEQ ID NO: 2505 - DNA, 726 bp, Panicum virgatum
  misc_feature: Ceres CLONE 1781314
  misc_feature: Encodes the peptide sequence at SEQ ID NO. 2506
atcacacacaacgatctagtccgctctactgaggctcgaggcacaaagctcactagtgttaagcatcgagccatggctgccaagagcaccatggcttcccttgtcctcctcatggcgctgctgctctcgtgcagcggcatgagcggtgcggcgaggttgctagaggaggcggcgcccaaggaggagtacccgcaccccgccgtgccggagctgccaaagcccgagctgccgccgcaccccacggtgccggagctgccacctcaccccaccgtgcctgagctgccgaagcctgaggtgccggagttggcggcgccgaagcccgagctgcctccccacccggccgttccagagctgccgaagcccgaggtgccggagcaccccgccgtgccggagttgccgaagcccgagctgcctccccaccccgccattccagagctgccgaagcccgaggtgccggagcaccccgtcgtgccggagcttccgaagcctgagctgcctcctcaccccgcggtgccaaagcacgagctgccaccgaaacccgagggccactacccggtgccagagaccaaaccatgatcggactgcggcatcactgtcaccgctgcccaacaataaatacgtcctgtatttgtgaatgtcctccaaatacagcattatcttgtattattagcacacatattcgtctgttacgtttcaatgtttgtataaaaaaaaaaaaaaaaaaaa

SEQ ID NO: 2506 - protein, 167 aa, Panicum virgatum
  misc_feature: Ceres CLONE 1781314
  misc_feature (60)..(119): Pfam Name: Trypan_PARP Pfam Description: Procyclic acidic repetitive protein (PARP)
MAAKSTMASLVLLMALLLSCSGMSGAARLLEEAAPKEEYPHPAVPELPKPELPPHPTVPELPPHPTVPELPKPEVPELAAPKPELPPHPAVPELPKPEVPEHPAVPELPKPELPPHPAIPELPKPEVPEHPVVPELPKPELPPHPAVPKHELPPKPEGHYPVPETKP

SEQ ID NO: 2507 - DNA, 1932 bp, Panicum virgatum
  misc_feature: Ceres CLONE 1781414
  misc_feature: Encodes the peptide sequence at SEQ ID NO. 2508
gtggcgcgactctcacacttgagccttctctagcgccaagtagtcctagctttctgccttcctgctttctccctatctgatctgatccctctctcattacacaaactaagccagaaatacacagcacagactgaagagaaggttggaacaaacaatggaggaagcaaggatcccggggtacttcaagaacaagggcatcctcatcaccggctcaacgggcttccttggaaagatactggtggagaagatactgagggtccagccggacgtcaagaggatctacctcccggtgcgagcgccggacgcagaatcggccaagaaacgggtggagactgaggtgatcgggaaggagctgtttgggctcctgcgggagacgcacggcaaggaggggttccagtccttggtcgacgacaaggtcgtccctctcgccggcgacatcggccacgagaacttcggcgtggagggcgcccagctggcgcagatgacccgggagatcaacgtcatcgtcaacggagccgccaccaccaatttctacgagaggtacgacgtggccctggacgtgaacgtgatgggcgtgaggcacatgtgccagctggccaggcagtgccccaacctcgaggtcatcctccatgtctccactgcttatgtggttggggagaggcagggggtgatccaggagcgggcgttcaagcacggcgagacactgcgtgaggacggcgcgcagctgcggctggacgtcgacgccgagctccggctggccagggactaccagcggcagctcgccggcgacgacgcggagcagaagaacgagaggaaggccatgaaggagctcggcctcgcacgagcccgggagttcgggtggcccaacacgtacgtgttcaccaaggcgctaggggagatgacgctggcgcaggagctcgccggcagcggcgtgccggtggcgatcgtgcggcccagcatcatcaccagcatccacaaggacccgctgccggggtggatcgaggggaccaggaccatcgacgccatcatcattggctacgccaagcagaacctctcctgcttcctcgccgacctcgacctcaccatggatgtcatccccggggacatggtggtgaacgcgatgatggccgcggcggcggcgcacgcctcgccgccgccgccgccgccggcggcaggccagcagcgggtgccgccgccgccgccgacggtgtaccacgcgacgtcgtccctccggaacccggcgccgtacgcggtgctgtaccggacggggatccgctacttcagcgcgcacccgcgggggggcgccggcgggcgcgcccggccggtgcgcttcttcgccacggtggccggcttcacggcgtacatggtggtccggtaccggctgccgctggagctgctgcggctgctcaacctgctgctgtgcggcctcctcgcgcggccctgcgccgagctccgccgcaggtacgccttcgtcatgcgcctcgtcggcctctacgagcccttcgcgctcttccggggcgtcttcgacgacgccaacgtcgagaggctccggctcgccatggcgcccgccgaccgcgccgccttcggcttcgaccccaagaccctcgactgggacgactacttctacagcatccacatccccggcgtcatgaagcacgtgctcaagtgagttcttcaagccaagcgaatgaagggcaagaactggaatctcatccatcctcagccgaagaagagatgatcagtgatcgtgcatggacgatgaggagacactgatggaaatgcatccagtcagcagctagcttggacttcttctagttataatttagctggttgttattattattatttgatgatatataaaaggacaacggtgtccagtactattatattagcagtcatcctgccctcgtcgaaaaaaaaaaaaaaaaaaaa

SEQ ID NO: 2508 - protein, 504 aa, Panicum virgatum
  misc_feature: Ceres CLONE 1781414
  misc_feature (1)..(103): Pfam Name: Sterile Pfam Description: Male sterility protein
MEEARIPGYFKNKGILITGSTGFLGKILVEKILRVQPDVKRIYLPVRAPDAESAKKRVETEVIGKELFGLLRETHGKEGFQSLVDDKVVPLAGDIGHENFGVEGAQLAQMTREINVIVNGAATTNFYERYDVALDVNVMGVRHMCQLARQCPNLEVILHVSTAYVVGERQGVIQERAFKHGETLREDGAQLRLDVDAELRLARDYQRQLAGDDAEQKNERKAMKELGLARAREFGWPNTYVFTKALGEMTLAQELAGSGVPVAIVRPSIITSIHKDPLPGWIEGTRTIDAIIIGYAKQNLSCFLADLDLTMDVIPGDMVVNAMMAAAAAHASPPPPPPAAGQQRVPPPPPTVYHATSSLRNPAPYAVLYRTGIRYFSAHPRGGAGGRARPVRFFATVAGFTAYMVVRYRLPLELLRLLNLLLCGLLARPCAELRRRYAFVMRLVGLYEPFALFRGVFDDANVERLRLAMAPADRAAFGFDPKTLDWDDYFYSIHIPGVMKHVLK

SEQ ID NO: 2509 - DNA, 1868 bp, Panicum virgatum
  misc_feature: Ceres CLONE 1781435
  misc_feature: Encodes the peptide sequence at SEQ ID NO. 2510
ggacgtgtggcagcgccgcgcctctgtctcaccaccctccatccctcttcccgactcggcgactccccaaccgcagcccacaaaccgagcggagaggagccccgaaacaagcgccaacggaattgggatcgcaacacatcccaccccacaccgccactccccatctccattcccctccaccgccctcgctccgtcccgcctgcccgtccggatccgcgcggcctcggatcgatctcttctctcgtcggttaccaaaatggataaactcaatggttctgctcgtcttatgattgtttcagatcttgaccatacaatggttgatcaccatgatgaggagaacttgtccttgcttaggtttgctgccctgtgggagtccgtttactgtcaggattctctacttgtcttttcaactggacggtcgcctactctctataaggaattgaggaaagagaagcctatgctgaccccagacatcactatcatgtctgtgggcactgagataacatatggcgaggcaatggttcctgatgatggttgggaagaatatctgaataataagtgggacagaaatattgtggtacaggaaactgcgagcttttctgaactgaagcttcagccagagacagaacagcgtccacacaaggtcagctttttggttgacaagaagagtgcccaggaagtgataaaatctcttgccgagaagttggagaaacatgggttagatgcgaaaattatatacagcggtggccaggaccttgatatattgcctcaaggggctggaaagggccaggcactagcatatctgcttaagaagctaagctcatgtggaaagccaccgaacaatactcttgtttgtggtgactctggtaatgatgcagaattattcagtatccctggtgtacatggtgtcatggtcagcaatgcccaagaggaactgcttcagtggtaccaagaaaatgcaaaggataaccctaagataattcatgcaagtgagagatgtgcagctggtattatacaagccattgggcacttcaagctaggacctaatgtttctcctagagatgtggattttccatatgcgaaggatgcctcttttaaacctacagatgctgtagtgaagttctatgttctctatgagaaatggcgcaaggctgaagttccaaagtctgactcagttatacagtacttcaaaaatattactcatgcaaatggagtcatcatccatcctgctgggcttgagtgctctatccatgcatccattgatgcattgggatcatgttatggtgacaaacaagggaaaaagtaccgagcatgggtggacagactttttatcacacagactggttcagatagctggttggtgagatttgacttgtgggagtcagaaggcgatgtgcgagtgtgctctctgtcaagtcttgccttgagtctaaagactgaatcccctgagggctttgtggtaacatacatccacaagacatggctgaacggttactcttcaggggttgagcaggcatctaagctttagactgatttgctgcttctccgcccatgcaaatggaattttcttgaggatagaataatgtatctgcttatctgagaaagatcttcttttcacgtttataatgttaacttcttaaccgcactggaggatgtccagggagaggatatggtgccctacttgtttggtatgtaagataaatgctccatctcatgacttccatgagaagccgaagtgattcatctttggtatatataagcacacactaatcttgttatcactattcatgctagtgctcttgatcgctgtcacactaatcttgatgaataatgaagtgctattttagcaaaaaaaaaaaaaaaaaaaa

SEQ ID NO: 2510 - protein, 423 aa, Panicum virgatum
  misc_feature: Ceres CLONE 1781435
  misc_feature (1)..(254): Pfam Name: S6PP Pfam Description: Sucrose-6F-phosphate phosphohydrolase
  misc_feature (1)..(63): Pfam Name: Hydrolase_3 Pfam Description: haloacid dehalogenase-like hydrolase
MDKLNGSARLMIVSDLDHTMVDHHDEENLSLLRFAALWESVYCQDSLLVFSTGRSPTLYKELRKEKPMLTPDITIMSVGTEITYGEAMVPDDGWEEYLNNKWDRNIVVQETASFSELKLQPETEQRPHKVSFLVDKKSAQEVIKSLAEKLEKHGLDAKIIYSGGQDLDILPQGAGKGQALAYLLKKLSSCGKPPNNTLVCGDSGNDAELFSIPGVHGVMVSNAQEELLQWYQENAKDNPKIIHASERCAAGIIQAIGHFKLGPNVSPRDVDFPYAKDASFKPTDAVVKFYVLYEKWRKAEVPKSDSVIQYFKNITHANGVIIHPAGLECSIHASIDALGSCYGDKQGKKYRAWVDRLFITQTGSDSWLVRFDLWESEGDVRVCSLSSLALSLKTESPEGFVVTYIHKTWLNGYSSGVEQASKL

SEQ ID NO: 2511 - DNA, 2174 bp, Panicum virgatum
  misc_feature: Ceres CLONE 1781552
  misc_feature: Encodes the peptide sequence at SEQ ID NO. 2512
acacacgcgcgccgcaggtccccgaccccgcagccgcctccacgactcctcgtgctcgtgcaccactcccctcgagcgcggcgcggagcaaggggggcaccaaaatggcggcggcggagatcgggggtttcgcggcggcgagaatggcggcgccggcgctcaggccggctgcgccccccgccccggcggcggcggcggcgccaccgcagcccaggagggctgtggcggcgcggtcgctccggacggtcgccgccgagacgctgacggcggatctcgccggcgggaccaacggcgcgctgcatgctcagatgaatagcgaggctactactgaaatcacttcacaggcagttactgcgatttctaggaggaagacaaagatagtctgcactataggcccctcaaccaacactcgtgagatgatctggaagcttgcagagactggaatgaatgttgcacgccttaatatgtcccatggtgaccatcagtcacaccagacggttattgatttggtcaaggagtacaatgcacagaatactgatggaaatgttatcgccatcatgctggacaccaagggtcctgaagttagaagtggggatgttccagagccaatcatgctcaaggaaggtcaagagttcaacttcacgattaaaagaggggtgagcaccgaagacaccgtgagcgtgaattatgatgacttcataagtgatgttgaagttggcgacatactgttggtggatggaggaatgatgtcgcttgcagtgaaggctaaatcagctgatacagtcaagtgtgaagtagttgatggtggagaattgaaatcaaggcgccacctaaatgtccgtggaaagagtgccactttgccatctatcacagaaaaggattgggaagacataaaatttggcgtcgaaaacggtgttgatttctatgcagtttcctttgtgaaggatgccaaagttattcatgaattgaaggactaccttaaaggtgctaatgcggatatacatgtcattccaaaaattgaaagtgcagattcaataccaaatctgcagtccattattgctgcttcagatggggcaatggtggctcgtggagaccttggtgctgaacttccaattgaggatgttcctttgctgcaggcagagattgtccagacatgtcgaagcatggagaaaccagtcattgttgctacaaatatgttggaaagcatgatcaaccatcctactccaactagggcagaagtttctgacatagctatcgcagtccgggaaggagctgatgccatcatgttatctggcgaaactgctcatggaaagtacccactaaaggcagtcaaggtgatgcacactgtggcacttagaacagaatccagcctttataactcaactacctcccctggtcttgttgcacctgcacaggctctatacagtgaggagttttccccaagccagcttagtaaaatgtttggatctcattcaaccatgatggcgaacacccttcgtacaccgctcattgtatttacacagacaggctccatggctgtccttctgagccactatcggccctcatctacgatatttgcatttacgaatgaggaaagagtgatgcaacggctggcactctatcagggggtcatccctattcacatgcagttctctgacgatgcagaagaaactttcaccagagcaattagcagcttgctgaaagcgcaacatgtgaagaagggggactatgtcacccttgtccagagcggagtgacttccatctggagagatgaatccactcaccacatccaagtgaggaaagttcagggctgaagtgccggtcgggattgatactcggagaattttggatagcgctgcccagaagtgttatcatcttactacaagtaatttttaatgttttacgaggagactgctacgtcgagttacattttgtattcagaagtcacatgtagactctggatcttttaactctgtattcgttgattatcacatcttttttgcctttactgttcttcctttcttgtgaaccttgattttagtttcttgttcaaaaggggctaatggggtggtactggtaaatttgtaaaaccggagcctccttcactccaagaactggtcgagttaaaacttaaaagtggtgtgctgttgtcataaaaaaaaaaaaaaaaaaaa

SEQ ID NO: 2512 - protein, 569 aa, Panicum virgatum
  misc_feature: Ceres CLONE 1781552
  misc_feature (1)..(336): Pfam Name: PK Pfam Description: Pyruvate kinase, barrel domain
  misc_feature (80)..(568): SWISSPROT Homolog: EC 2.7.1.40 Pyruvate kinase isozyme G, chloroplast precursor
MAAAEIGGFAAARMAAPALRPAAPPAPAAAAAPPQPRRAVAARSLRTVAAETLTADLAGGTNGALHAQMNSEATTEITSQAVTAISRRKTKIVCTIGPSTNTREMIWKLAETGMNVARLNMSHGDHQSHQTVIDLVKEYNAQNTDGNVIAIMLDTKGPEVRSGDVPEPIMLKEGQEFNFTIKRGVSTEDTVSVNYDDFISDVEVGDILLVDGGMMSLAVKAKSADTVKCEVVDGGELKSRRHLNVRGKSATLPSITEKDWEDIKFGVENGVDFYAVSFVKDAKVIHELKDYLKGANADIHVIPKIESADSIPNLQSIIAASDGAMVARGDLGAELPIEDVPLLQAEIVQTCRSMEKPVIVATNMLESMINHPTPTRAEVSDIAIAVREGADAIMLSGETAHGKYPLKAVKVMHTVALRTESSLYNSTTSPGLVAPAQALYSEEFSPSQLSKMFGSHSTMMANTLRTPLIVFTQTGSMAVLLSHYRPSSTIFAFTNEERVMQRLALYQGVIPIHMQFSDDAEETFTRAISSLLKAQHVKKGDYVTLVQSGVTSIWRDESTHHIQVRKVQG

SEQ ID NO: 2513 - DNA, 1485 bp, Panicum virgatum
  misc_feature: Ceres CLONE 1781560
  misc_feature: Encodes the peptide sequence at SEQ ID NO. 2514
agaacacacatcgtgccctatgctatttcgccatttctgttcgtcccatcagacaaaatccccatctcccccaaccggttgtgccgtgtgcgtcactgaacaagaacacgtccggttcctgttccctagatctgcgtggaggcggcgtggagcctgaatccggcaaaagggttcgcggttggttggccggagcgcccgagcccgccgtcaaaacccaatcttagcgcccgaccggccgtgcgccgccgccgtcttcctgcggtgacaaggagcaggcaaggtcggcggagatggtgccgtgggaagggtacttgagcgacgagacgatgggcaccttcgcgcccatcgtgctctactgggtgtacgccggcggctaccagcttatcctgcaccgccggccgctcgagcggtacaggctccacacgcgggctgaggagaagaagaacctcgtcagcctccccgccgtcgtccgcggcgtgctgctgcagcagctcgtgcaggccatcgtcgcgatgatcctattcatggtcacatcagatagctcagtaactgtagttcagccacctattgtcgttcagatctttcagtttttaattgcaatgctcgtgatggattcatggcaatattttgtgcatcgctacatgcaccaaaacaaattcctttatcggcacatccactctcaacatcatcggctcattgttccttatgctattggggctctctacaaccatccattggaggggctgcttttggacaccttaggtggtgccatctccttcttggtatccggtatgacaccaagaacagctgtgttctttttctgttttgctgtcctcaagacagttgacgatcactgtggactttggttaccgcataacatcttccagaacctgtttcaaaataatactgcctatcatgatatccaccatcaactccaaggcacaaaatacaattactcccagcccttcttctcgatctgggacagaatactggggacccacatgccgtacaacttagtcagcaggaaggaaggtggatttgaagcaagaccgttgcgagactagcttgtgctcaatgcaagtgtacagatctccagtgaaagattgagatacaatggtcagcctccccttcacatgattagaagctcacaggggcccatctacttctaaaacgatgaaactgtgccggtgctgcttttggcatctctgtccaagccaagttacttgggaatggactgaagctcctacatcgcttgttctcctgcagttcatctagatgggagggtccatttcgaagtctgaatgtgtgatacggtggtttgtatgcatggtacctgttatggttctttttcttctttttgtgcagagcttccattacattgctgtgcagatagtgtatttgaaaatcacgcttctgtatgtacccaattattcgtgtaattgaattactgggcatgacggatcggaaaaaaaaaaaaaaaaaaaa

SEQ ID NO: 2514 - protein, 257 aa, Panicum virgatum
  misc_feature: Ceres CLONE 1781560
  misc_feature (1)..(204): Pfam Name: Sterol_desat Pfam Description: Sterol desaturase
MVPWEGYLSDETMGTFAPIVLYWVYAGGYQLILHRRPLERYRLHTRAEEKKNLVSLPAVVRGVLLQQLVQAIVAMILFMVTSDSSVTVVQPPIVVQIFQFLIAMLVMDSWQYFVHRYMHQNKFLYRHIHSQHHRLIVPYAIGALYNHPLEGLLLDTLGGAISFLVSGMTPRTAVFFFCFAVLKTVDDHCGLWLPHNIFQNLFQNNTAYHDIHHQLQGTKYNYSQPFFSIWDRILGTHMPYNLVSRKEGGFEARPLRD

SEQ ID NO: 2515 - DNA, 3374 bp, Panicum virgatum
  misc_feature: Ceres CLONE 1781593
  misc_feature: Encodes the peptide sequence at SEQ ID NO. 2516
agcttctccccctcgacctcgggccaaaggttctagaaccttctagacgcctcgatcgcaccacgccgcgcccctcccgatggcgcgcctccatctcctcctctcccgcgcgctcgcatcgcaccaccttctcccttgttcgaccgcttccggcctccgccccactccgcggcggcctatccctccccactccccgccgcctttttctcctccacatggtcataccctgccccccttcgcagccgctgcgtcgcggcaatacgccgcatcgagcttcaggataaggcgctcgtcggcgccgccgatgttactgaggcggaggaaggcgaggaggccgacgcggaaggcccccggcgagctcattgtgcaaattggcatcgaggaggacctccccgacgatcctgagatcttgagcattgcggaaacactccaaactgatgttgggaaggcggtgaaggtggccttcgacaaacttgaaggctctgagtacaggaccagagatacttctatcagcaacttgaacaagtacaataccatcgagctttctctgctgctttgtaatgataatttcatcaggaagctgaacaaagaatggagggatgtggatcatgctactgatgttctgtcaatgtcacagcatatcccggggctcgatattcccattctgcagttgggtgacatagtaatttctgttgaaacagcacagcggcaagcagaagaaagaggtcacacatttcttgatgagatcagaatcctcgtggtgcatggactgttgcatttattgggcttcgatcatgaactcagcgaagacgctgaagaagagatggagaaggaagaagaacatatattaaatactcttgagtggagaggaaagggattaattaagagtgcatatgacatagctagcgatatggcacatttacaaagttctgctgaggccaataacaatatagagaaagtgagcctaaaagaggaacgtcgacccaaattgatccatatgatttgtgatatagatggtacttttgtggattatgaaggacgcttgcatgaagaatccgtagaatctttgagagaggcaattgcaacaggagtaaatgttatcatggttactagaaagagccggatttccaccatcagaaccttcaagcatcttgatttccatgataaaggtgattttctatcagagacatcacctggtgtatttttgcagggttcacttgtctatggaaggcatggccaagaagtttatagagcggaattggatgtggatatctgcaaggaggtacttctgtactccttgaagcataaaattcctgttgttgcatactgtgaggaacaatgtttgaccttgtttgaacatccatttgttaacttgctgcacattgtgcatcatgagaacaaggtaaaagtgatgcattctgttgaggaactgctggaatattattcatctattcagaagttgctactctttgacagtgctgaagaggattcatctgtcctgaggcagcattgttcagaactgactgaagggaaagcacgtgttctcaaaatgcagccaaatacaattgatattgtgccactcaatgcttcgaagggtggtggtataagaattctacttgatcatcttggaataacagaagattgtgatcttgacatagttggagactatacaagatggctgagcaatatgtgattcaactgaaaacattactggaactttcttaagaaaaaacatggcgattcggagcattagatgttaaagaagcaaccgtatgcatgtcatgcaccaaagatacataattaccactttggaagtttttatattaggagggggcgctgaatggcaacctaaatatttcattcagatcctttgttgagatgcatgaaaaagagaatggaatgagccacagccatgtgagcaaagtcatattcatcagttcatgacaattttgactctccttagaattttgtagatttgtgttttctgtaccattgttaaatgttactcagttaaatgtgtaaatggctcctccacgtggtggatatttatttattatgaaaaaaaaatactggagtgtagattgatgagtaggaattcaatggaggcattgtgataaagataactgtattttctgccatcttaagtcttgttgattatgattcaccctttctcattctatccatcaaaaggtttgaccttcacatggatcaagaaacgggggataaaagaaaatatcttgatcctagaaggatatatagtttgagttttcatgtgtaaagcacaatgggaagtggagacttggcagttggcaccctagttcttatttattccaggtttttcttatttacagaccaatatgtatttgtgcatctctcttgttctggtgtgtagatggtttgctgccactatatgagtgtctgttgttgctagttcttgacattactctcgcagctgaaccatttgaggccctctttgctatcaccttgttgcatggccttggtcttgaacacatgtagcatcagatattgatgtgaatgattgggactttccttggtagtacttggacagccctttcctgtggaaattaaattacgtttattcaatttttcagaaaatgtacaaattgaagtaaactcagttgcatccttataatggattgtgtgcaaaggggatcctctctggctcaagtgatcgtggggcaaatatactcacctgactggaagctgggctagcagcgaggacaaatcatatactggaccctcgtcatccagctgcaaagtgctcgaagatgctgaggatggctcatagtcatggggatgaccagatgggcatgatgctgcatcatcagacagatttgaagctgatgagtacaaggacccgctggatgcacctgagaaggaagcagactcagagggatcaccaccttgttcattgcagctatcgtcctgacacaagaataacctatgcgatggtaaattgcaaggctctgccatttcatgtgaagctctgctcaatgtttggaacttggaaggcaaagggacgcagcatatgttgatatatagagacgtaggaagagaactgttcaaacgggtagatagataggcatctagttttatcagataggcttcatcaactcggcgccagagagaaggaagaaattgacatcagccacagttattttgggtagatcattggtagcctgatgggggagcagggggcgctagttgacgatcgtgcgccgcggcaacaaagcagcgaacgagcgccggagctagcaagcagcgcacgtgcagcgccagtggtagtactgaacgagcatttgacttactctagtgttacagtctgtcgctactaaaaaaaaaaaaaaaaaaaa

SEQ ID NO: 2516 - protein, 537 aa, Panicum virgatum
  misc_feature: Ceres CLONE 1781593
  misc_feature (1)..(211): Pfam Name: Hydrolase_3 Pfam Description: haloacid dehalogenase-like hydrolase
MARLHLLLSRALASHHLLPCSTASGLRPTPRRPIPPHSPPPFSPPHGHTLPPFAAAASRQYAASSFRIRRSSAPPMLLRRRKARRPTRKAPGELIVQIGIEEDLPDDPEILSIAETLQTDVGKAVKVAFDKLEGSEYRTRDTSISNLNKYNTIELSLLLCNDNFIRKLNKEWRDVDHATDVLSMSQHIPGLDIPILQLGDIVISVETAQRQAEERGHTFLDEIRILVVHGLLHLLGFDHELSEDAEEEMEKEEEHILNTLEWRGKGLIKSAYDIASDMAHLQSSAEANNNIEKVSLKEERRPKLIHMICDIDGTFVDYEGRLHEESVESLREAIATGVNVIMVTRKSRISTIRTFKHLDFHDKGDFLSETSPGVFLQGSLVYGRHGQEVYRAELDVDICKEVLLYSLKHKIPVVAYCEEQCLTLFEHPFVNLLHIVHHENKVKVMHSVEELLEYYSSIQKLLLFDSAEEDSSVLRQHCSELTEGKARVLKMQPNTIDIVPLNASKGGGIRILLDHLGITEDCDLDIVGDYTRWLSNM

SEQ ID NO: 2517 - DNA, 1941 bp, Panicum virgatum
  misc_feature: Ceres CLONE 1781600
  misc_feature: Encodes the peptide sequence at SEQ ID NO. 2518
gctggaacccaaccaaaacccccacctcccgactcccgagcacagctcccaatttcccactcgccgcctgccccttccctcaggggcgccatgatggccgctcgcctccgcctcgcgctgctgctctccgtcttcctgtgcgccgcgcgggcgcggcccagcctcgagccgaccatccgcctcccgtcggagcgcgcggcggcgggggaggccgagggggcggacgacgccgtcgggacccggtgggccgtgctcatcgccggctccaacggatactacaactatcgccaccaggcggacatctgccatgcctaccagatcatgaagaagggcggactcaaggatgaaaacatcatcgtcttcatgtacgacgatatcgctcacagcccggaaaatccaaggcctggtgtcatcatcaaccatccccagggtggcgatgtctatgctggggttccaaaggattacactgggagggaggtcaatgtcaacaatttcttcgctgttctgcttggcaacaaaacagctgtcagtggtgggagtggcaaggttgtggacagtggccccaatgatcatatttttgtttactacagtgaccatgggggtcccggtgtccttgggatgcctacctacccgtacctctacggtgatgacctcgtaaatgttctgaagaagaagcatgctgcggggacgtacaaaagcctggtcttttaccttgaagcatgtgaatctgggagcatatttgagggtctcctgccgaacaacatcaatgtgtacgcgaccactgcttcaaatgcagacgagagtagctggggaacttactgccctggcgataacccgagccctccgccagagtatgacacctgcttgggagacttgtatagtattgcttggatggaagacagtgatttccacaatttgcgaactgagtctctcaagcagcaatacaatttggtcaaggataggacatcggttcacaatacttacacctatggttcccatgtgatgcaatacggttcactgaacctgaatgtgcaacatttatcttcgtacattggaacaaaccctgctaacgatggcaacaagtttgttgaaggcaattccttgccatcatccacaagagctgttaatcagcgtgatgctgatcttgtttacttctggcagaagtaccggaaattggctgagggctcacctgggaaaaatgatgcccggaaggaattgcttgaagtgatggcccaccgatctcatgttgacaacagtgttgagctgattggaagccttctctttggatcagaggacggtccaagggttctgaaggctgttcgtgcagctggtgatcctttggttgatgactggagctgcctcaagtccatggttcgtgcatttgaggcgcagtgtgggtcattggctcagtatggaatgaagcacatgaggtcctttgcaaacatctgcaatgccggcatccttcctgaagcagtgtcgaaggtcgctgctcaggcttgcaccagcattccttccaacccctggagctccatccacaagggttttagtgcctaaatgatgcacaggtgaagcgaaatatttcagctgctccaccaaaccgaactccattacaatcctcaggggtgttgtgcttaaaccataggtgaagcaaaatatttcagccgctccatcataccaaactacattatagtcctcaggagcgtttagtgcttgaaccataggtgaagcagacttatgccattattctgttccaccgcatcagattaccatagtagcccgatttctggtgtacatacgtagttggaaagttatttggcaatataatttctcgttgttgtacatattcccgatagcttgttagcagatgtgtgtaatttgtacttccaattaatgaagaacacattgcaactatttttacatcaaaaaaaaaaaaaaaaaaaa

SEQ ID NO: 2518 - protein, 487 aa, Panicum virgatum
  misc_feature: Ceres CLONE 1781600
  misc_feature (3)..(425): Pfam Name: Peptidase_C13 Pfam Description: Peptidase C13 family
  misc_feature (8)..(487): SWISSPROT Homolog: EC 3.4.22.34 Legumain precursor
MMAARLRLALLLSVFLCAARARPSLEPTIRLPSERAAAGEAEGADDAVGTRWAVLIAGSNGYYNYRHQADICHAYQIMKKGGLKDENIIVFMYDDIAHSPENPRPGVIINHPQGGDVYAGVPKDYTGREVNVNNFFAVLLGNKTAVSGGSGKVVDSGPNDHIFVYYSDHGGPGVLGMPTYPYLYGDDLVNVLKKKHAAGTYKSLVFYLEACESGSIFEGLLPNNINVYATTASNADESSWGTYCPGDNPSPPPEYDTCLGDLYSIAWMEDSDFHNLRTESLKQQYNLVKDRTSVHNTYTYGSHVMQYGSLNLNVQHLSSYIGTNPANDGNKFVEGNSLPSSTRAVNQRDADLVYFWQKYRKLAEGSPGKNDARKELLEVMAHRSHVDNSVELIGSLLFGSEDGPRVLKAVRAAGDPLVDDWSCLKSMVRAFEAQCGSLAQYGMKHMRSFANICNAGILPEAVSKVAAQACTSIPSNPWSSIHKGFSA

SEQ ID NO: 2519 - DNA, 978 bp, Panicum virgatum
  misc_feature: Ceres CLONE 1781601
  misc_feature: Encodes the peptide sequence at SEQ ID NO. 2520
attcgccagccacaaccaccccctgtcccggtggcccttccgcccttgctccagcgcgtccactccccatctctctctctcgctctctgcgctcgccacgcgagccacatggctcccgctacggcaaccgccgcgttcactagcctcctccccgccggcgcctcgcggctcccctcggccgccgctgccgctggagcggcggcctccttcgtgcggctcccgcggcacccgacgggctgggctggggcctccgtcgcggcgccgaggacggcgcgcaggcgggcgcccggggtcgcctacgcgaccgccgccacggataagagcatctacgactacaccgtcaaggacattgatggaaaagatgttcctcttaaaaaattcaagaataaggtgttgctgattgttaacgttgcttctcaatgtgggttgacaacagcaaactacactgaattatctcatatctatgagaagtacaagactcaagggtttgagattcttgcatttccatgcaatcaatttggtgcacaagaacctggatcaaattctcaaataaagctgtttgcctgtacaagatttaaagctgaatttcctatttttgacaaggttgatgtcaatggacctaatacagcccccatctataaatttctgaagtccagtgctggaggatttttgggcgatctagtcaagtggaattttgagaagttcttagtggacaagaatggcaaagttgtagagagatatccacctacaacttcaccgttccagattgagaaggacatccagaaactcattgcagcataagtactcccaagtctttcagttgagtatatgtacataggccttgtcttaaagttgtttcatgtgattatatctttttagtaatgtaataattctttcttgtaaaataactcactcattatctacagtgcatatatagatgtaacattttttttcgaacaaaaaaaaaaaaaaaaaaaa

SEQ ID NO: 2520 - protein, 230 aa, Panicum virgatum
  misc_feature: Ceres CLONE 1781601
  misc_feature: Great-hit functional homolog of the protein sequence given in SEQ ID NO 9474
  misc_feature (1)..(109): Pfam Name: GSHPx Pfam Description: Glutathione peroxidase
  misc_feature (21)..(230): SWISSPROT Homolog: EC 1.11.1.12 Phospholipid hydroperoxide glutathione peroxidase 1, chloroplast precursor
  misc_feature (65)..(230): SWISSPROT Homolog: EC 1.11.1.12 Phospholipid hydroperoxide glutathione peroxidase, chloroplast precursor
  misc_feature: Useful for making plants with modulated heat sensitivity
MAPATATAAFTSLLPAGASRLPSAAAAAGAAASFVRLPRHPTGWAGASVAAPRTARRRAPGVAYATAATDKSIYDYTVKDIDGKDVPLKKFKNKVLLIVNVASQCGLTTANYTELSHIYEKYKTQGFEILAFPCNQFGAQEPGSNSQIKLFACTRFKAEFPIFDKVDVNGPNTAPIYKFLKSSAGGFLGDLVKWNFEKFLVDKNGKVVERYPPTTSPFQIEKDIQKLIAA

SEQ ID NO: 2521 - DNA, 829 bp, Panicum virgatum
  misc_feature: Ceres CLONE 1781604
  misc_feature: Encodes the peptide sequence at SEQ ID NO. 2522
accactcaagctgagctcagctgtagcctagctagctaggtagctaataaatccatcacatccccgcgccatggcgaagaaccaccaccgcattgtggcgctcctgctcgtcgcggccacgctggtcgcgcagctcatcgcgccggccgcggcctgcccgtcctgcccgacgcctaagcctccgccgccgcccccgacgcccgtgccgtcgtccgcgccgccgtccacgggcaagtgccccctgaacacgctgaagctgctggcgtgcgtggacgcgctcaacgggctggtgcacgccgtggtcggcgccaaggccagcgagaagtgctgcccgctgctgcaaggcgtggccgacctcgacgccgcgctctgcctctgcaccaccatcaaggtcaaggcgctcagcatcaacctcgtgctccccatcgccatcgaggtgctcgtcaacgagtgccacaagaacgtccccgccagcttccagtgcccgtaatcacacactcactcatcactattgcgtatgtatgtaccattaattaattatacatctgcatgcatgcatccatgcatgatgggttaaggttatgataaaccagtcatatactcatatatctatatatatcttaagcatgtacgtatagcttaatgcatgagctctctttggcttgtgatataaatggagctgtggattgtccatttgtttttgtaattgtgtatcaatattgtaacatgaaccagtgtgagagttgtgggcttggaacttgtagtgaccaaaaagatttatatgaataaagcgtgtgtgtcatacatgtaaaaaaaaaaaaaaaaaaaa

SEQ ID NO: 2522 - protein, 139 aa, Panicum virgatum
  misc_feature: Ceres CLONE 1781604
  misc_feature (1)..(83): Pfam Name: Tryp_alpha_amyl Pfam Description: Protease inhibitor/seed storage/LTP family
MAKNHHRIVALLLVAATLVAQLIAPAAACPSCPTPKPPPPPPTPVPSSAPPSTGKCPLNTLKLLACVDALNGLVHAVVGAKASEKCCPLLQGVADLDAALCLCTTIKVKALSINLVLPIAIEVLVNECHKNVPASFQCP

SEQ ID NO: 2523 - DNA, 1933 bp, Panicum virgatum
  misc_feature: Ceres CLONE 1781607
  misc_feature: Encodes the peptide sequence at SEQ ID NO. 2524
agaacaaaggccatcgctctcccatactggcctcagacagagagagacttgcctgaaacacacacaccttatagttccccgcagctgacggctgagctctgcttgagattttcagccgcagtagcgttacaggaagggatcaggcatggctgcaaggagggctgcttcctccgtcctctctcgctacctcctcgcaaggtcttctgcttcttctcccgcctgcaaatccgctctcctcggaccaggggatcttcttcgcaggttcggtactgcaccggctgccgccgccgccgccaccgaggagccaatccaacccacagtggagatcaagcacacccaactcctcatcaatggcaacttcgtcgacgcagcttctgggaggacgttcgcgacggtggacccccgcaccggcgaggtcatcgcgcgcgtcgctgagggcgacagcgaggacatcgaccgcgccgtcgccgccgcccgccgggccttcgacgagggcccgtggccgcgcatgaccgcctacgagcggtgccgggtgctgctgcggttggcggacctgatcgagcagcacgcggaggagatcgcggcgctggagacgtgggacaacgggaagacgctggcgcagtcggccggcaccgaggtgcccatgctggcgcggtgcatgcggtactacgccgggtgggcggacaagatccacggcctggtggtgccggccgacggtgcgcaccacgcgcaggtgctgcacgagcccgtcggcgtcgccgggcagatcatcccctggaacttcccgctgctcatgttcgcctggaaggtcggcccggcgctcgcctgcggcaacaccgtcgtcctcaagaccgccgagcagacgccgctctccgcgctctacgtcgccagcctcctccacgaggctgggctccccgacggtgttctgaacgtggtctccggcttcggcccgacggccggcgccgcgctgtgtagccacatgggcgtggacaagctcgcgttcaccggatcgacgggcacgggccagatcgtcctcgaactggcggcgaggagcaacctgaagccggtgaccctggagctcggcggcaagtcccccttcatcgtcatggacgacgccgacgtcgaccaggccgtcgagctcgcgcaccaagccgtcttcttcaaccagggccaatgctgctgcgccgggtcgcggacgttcgtgcacgagcgcgtgtacgacgagttcgtggagaagtccaaggcccgcgccatgaagcgcgtcgtcggcgaccccttcaggaacggcgtcgaacaggggcctcagatcgatgaggagcagttcaagaagatcctgcggtacgtccagtccggcgtcgacagcggcgccaccctcctcgccggcggcgacagggcgggcaaccggggcttctacatccagccgacggtgtttgccgatgccaaggacgacatgaagatcgctcgggaggagatattcgggccggtccagaccatcctcaagttcagcggcgtggaggaggtgatccggcgggcgaacgcgtcgcagtacgggctggcggcgggggtgttcacgaggagcctggacgcggccaacacgctgtcgcgggcgctgcgggtgggcaccgtgtgggtcaactgctacgacgtgttcgacgcgggcatcccgttcggcggctacaagatgagcggcgtcggccgggagaagggcgtctacgccctccgcaactacctccagaccaaggccgtcgtcacgcccatcaggggcgccgcctggctgtgatcccggccgccgccgccgccgcagcccgtcgacgctcgccggtggtatgatctctgatgtactagaagaacatggacggcgccggacaccagaaaatgtgtcgaataataacagccggtttagttgcaacaccaaaaaaaaaaaaaaaaaaaa

SEQ ID NO: 2524 - protein, 544 aa, Panicum virgatum
  misc_feature: Ceres CLONE 1781607
  misc_feature (1)..(461): Pfam Name: Aldedh Pfam Description: Aldehyde dehydrogenase family
  misc_feature (1)..(544): SWISSPROT Homolog: EC 1.2.1.3 Aldehyde dehydrogenase 2B4, mitochondrial precursor
  misc_feature (1)..(544): SWISSPROT Homolog: EC 1.2.1.3 Aldehyde dehydrogenase 2B7, mitochondrial precursor
MAARRAASSVLSRYLLARSSASSPACKSALLGPGDLLRRFGTAPAAAAAATEEPIQPTVEIKHTQLLINGNFVDAASGRTFATVDPRTGEVIARVAEGDSEDIDRAVAAARRAFDEGPWPRMTAYERCRVLLRLADLIEQHAEEIAALETWDNGKTLAQSAGTEVPMLARCMRYYAGWADKIHGLVVPADGAHHAQVLHEPVGVAGQIIPWNFPLLMFAWKVGPALACGNTVVLKTAEQTPLSALYVASLLHEAGLPDGVLNVVSGFGPTAGAALCSHMGVDKLAFTGSTGTGQIVLELAARSNLKPVTLELGGKSPFIVMDDADVDQAVELAHQAVFFNQGQCCCAGSRTFVHERVYDEFVEKSKARAMKRVVGDPFRNGVEQGPQIDEEQFKKILRYVQSGVDSGATLLAGGDRAGNRGFYIQPTVFADAKDDMKIAREEIFGPVQTILKFSGVEEVIRRANASQYGLAAGVFTRSLDAANTLSRALRVGTVWVNCYDVFDAGIPFGGYKMSGVGREKGVYALRNYLQTKAVVTPIRGAAWL

SEQ ID NO: 2525 - DNA, 1486 bp, Panicum virgatum
  misc_feature: Ceres CLONE 1781615
  misc_feature: Encodes the peptide sequence at SEQ ID NO. 2526
aactatatcctacgcacacagcaacatctcccagtccgcagcagaagcgagcataggcggtgcaggaaatggacagcgcgagcagcctcgtggtggacgacaccagcggcggcggcgcgtgcagggacaagctcagggcgctggccgccgcggccgccgagggggcgacgctggagcgcatgggcagcggcgccagcgcggtcgtggacgcggccgagccgggcgccgaggcggactcgggctccgcgggccacgccggcgcgggcgggaagctgccgtcgtccaggtacaagggcgtggtgccgcagcccaacgggcggtggggcgcgcagatctacgagcgccaccagcgcgtgtggctcggcaccttcgcgggggaggccgaggccgcgcgcgcctacgacgtcgccgcgcagcgcttccgcggccgcgacgccgtcaccaacttccgcccgctcgcggacgccgacccggacgccgccgccgagctccgcttcctcgcgtcgcgctccaaggccgaggtcgtcgacatgctccgcaagcacacctacttcgacgagctcgcccagaacaagcgcgccttcgccgccgcgacctcgtcgctcgccggcgcccactccccctctttcgcgcccccctctcccacgcgggcgcgggagcacctgttcgacaagacggtcactcccagcgacgtgggcaagctcaaccggctggtgatcccgaagcagcacgccgagaagcacttcccgctgcagctcccgtccgccggcggcgagagcaagggcgtgctcctcaacttcgaggacgccgcggcgggcaaggtctggcggttccgctactcgtactggaacagcagccagagctacgtgctcaccaagggctggagccgcttcgtcaaggagaagggcctccaggccggcgacgtcgtcggcttctaccgctccgcggccgccgccggcgccgacagcaagctcttcatcgcctgcaggctgcggcccagcggcgtcaccgcctcgacagcccccgtagcggagccatcgtcggcgccggtggcgaaggccgtgcggctcttcggcgtcgacctgctgacggcgccagcgccggccatggccgggtgcaagagggccagggacctggcggcgcccccgcaggcggcgttcaagaagcagctcgtggagctcgcgctagtgtagattaatgccttgctcccgggcgaccgatcactcttctctctagctagtcccttttttcttttgctcgatcgccaaaaactcaagatggtagcatcaccgagctgaattagtcccctcgcggcggcgtctcacctagttggttcgtttgttaatttccttttcatcgtcttgctcttttgctgccgatgtaaatcttctcatctgtatactactaatggagaaaaaaaacagccctagaactagaaggctagaagatgatcaactgacacaaccaaaaaaaaaaaaaaaaaaaa

SEQ ID NO: 2526 - protein, 374 aa, Panicum virgatum
  misc_feature: Ceres CLONE 1781615
  misc_feature: Great-hit functional homolog of the protein sequence given in SEQ ID NO 9247
  misc_feature: Great-hit functional homolog of the protein sequence given in SEQ ID NO 9654
  misc_feature (1)..(109): Pfam Name: B3 Pfam Description: B3 DNA binding domain
  misc_feature (1)..(63): Pfam Name: AP2 Pfam Description: AP2 domain
  misc_feature: The sequence is a functional homolog of  SEQ ID NO 1178 in the  10/374,780 US patent application
  misc_feature: The sequence is a functional homolog of  SEQ ID NO 1179 in the  10/374,780 US patent application
  misc_feature: The sequence is a functional homolog of  SEQ ID NO 1181 in the  10/374,780 US patent application
  misc_feature: The sequence is a functional homolog of  SEQ ID NO 1182 in the  10/374,780 US patent application
  misc_feature: The sequence is a functional homolog of  SEQ ID NO 1186 in the  10/374,780 US patent application
  misc_feature: The sequence is a functional homolog of  SEQ ID NO 1374 in the  10/412,699 US patent application
  misc_feature: The sequence is a functional homolog of  SEQ ID NO 18 in the  10/838,616 US patent application
  misc_feature: The sequence is a functional homolog of  SEQ ID NO 26 in the  10/838,616 US patent application
  misc_feature: The sequence is a functional homolog of  SEQ ID NO 34 in the  10/838,616 US patent application
  misc_feature: The sequence is a functional homolog of  SEQ ID NO 36 in the  10/838,616 US patent application
  misc_feature: The sequence is a functional homolog of  SEQ ID NO 38 in the  10/838,616 US patent application
  misc_feature: The sequence is a functional homolog of  SEQ ID NO 42 in the  10/838,616 US patent application
  misc_feature: The sequence is a functional homolog of  SEQ ID NO 44 in the  10/838,616 US patent application
  misc_feature: The sequence is a functional homolog of  SEQ ID NO 46 in the  10/838,616 US patent application
  misc_feature: The sequence is a functional homolog of  SEQ ID NO 48 in the  10/838,616 US patent application
  misc_feature: The sequence is a functional homolog of  SEQ ID NO 52 in the  10/838,616 US patent application
  misc_feature: The sequence is a functional homolog of  SEQ ID NO 53 in the  10/838,616 US patent application
  misc_feature: The sequence is a functional homolog of  SEQ ID NO 736 in the  11/435,388 US patent application
  misc_feature: The sequence is a functional homolog of  SEQ ID NO 738 in the  11/435,388 US patent application
  misc_feature: The sequence is a functional homolog of  SEQ ID NO 740 in the  11/435,388 US patent application
  misc_feature: The sequence is a functional homolog of  SEQ ID NO 754 in the  11/435,388 US patent application
  misc_feature: The sequence is a functional homolog of  SEQ ID NO 760 in the  11/435,388 US patent application
  misc_feature: Useful for making plants with altered Lignin content
  misc_feature: Useful for making plants with altered alkaloid content
  misc_feature: Useful for making plants with altered protein content
  misc_feature: Useful for making plants with altered terpenoid content
  misc_feature: Useful for making plants with modulated growth and phenotype characteristics
MDSASSLVVDDTSGGGACRDKLRALAAAAAEGATLERMGSGASAVVDAAEPGAEADSGSAGHAGAGGKLPSSRYKGVVPQPNGRWGAQIYERHQRVWLGTFAGEAEAARAYDVAAQRFRGRDAVTNFRPLADADPDAAAELRFLASRSKAEVVDMLRKHTYFDELAQNKRAFAAATSSLAGAHSPSFAPPSPTRAREHLFDKTVTPSDVGKLNRLVIPKQHAEKHFPLQLPSAGGESKGVLLNFEDAAAGKVWRFRYSYWNSSQSYVLTKGWSRFVKEKGLQAGDVVGFYRSAAAAGADSKLFIACRLRPSGVTASTAPVAEPSSAPVAKAVRLFGVDLLTAPAPAMAGCKRARDLAAPPQAAFKKQLVELALV

SEQ ID NO: 2527 - DNA, 1957 bp, Panicum virgatum
  misc_feature: Ceres CLONE 1781647
  misc_feature: Encodes the peptide sequence at SEQ ID NO. 2528
aaccatactcaagcagctcaaaaccgccagccagctaccaagaaatggctcttcttgcttctgccctgacgagtcacagtgcacatcgtggcctaagaagccccataggacccaatggtggcaatttgtcatggcacctgtcttcatcaaagaagagtaaaagaaggtgtgaccttagatcacgagcagaaacgatgagcagcgagcttgcacaagagcatctgatgccctgggaaatcccaaggaaggagtggttcccccacgggttcatctttggcgccgccacttcagcgtaccaaattgaaggtgcttggaatgagcatggcaaggggccaagcatatgggaccacttctgccacaatcatcctgagaggatagctgattggagcaatggggatgttgcagtgaactcctaccatctgtatgaagaggatgtcaagttgctgaaggaaatgggcatggacgcctataggttctccatctcttggtccagaatactgccaaaggggacgctggaaggtgggataaactataaaggcctgcagtactacaaaaacctgatcaacacgttgaaagagaatggcatagagccatatgtaacaattttccactgggacactcctcaagcactggaggacaagtatggcagcttcttaaatcggaggattgtaaaagattacacagactttgccaaggtgtgcttcgagcattttggcgacaaggtgaaacactggttcacgtttaatgagcctcacacattttgttcatatgcctatggaatggggcagcatgctcctgggaggtgctcaccagggcacaattgcgccatcccatgtggtgactcgctcagtgagccataccgtgttggccacaatatcctcctagctcatgctgaggtagctgatctatacaagaagtattacaagggtgaagacgggcacatagggatggcgctcgattcaatgttctatgagccgcatggaaagacattcctcgatgaacaagcccaatcaagatccgttgacttcaacctaggatggttcatggaaccagtgtttcgtggtcactaccccttctccatgagatcactattgggagatcgactaccgtactttaaagatgatgagcaagagaaattagtgggttcctacgacatgatggggctcaactactacacatccttgttctgtgaacatattgacatttctccaagattctcgccagcgctgcacaccgaagatgcctatgcgagacccaaaatgaatgatcatgaaggcaatcctttgggtcctgatactagatcacaatggattaaatcgtacccaaaaggcctaaagaaccttcttatgatcatcaaggacaaatatggaaacccacccgtctatatcactgagaatgggaccgcggattctgacaacggtaatctatccatgagagacgcattggatgatgatataaggctagattacctccagcgccatatctcagtcatcaaagagtcaatagacttgggtgcgaacgtgcgcgggcacttcacctggtctctgctggataacttcgagtgggctaacggctacaccgatcgtttcggcctcatctacgtcgaccgcgacgatagcttcaagcggcacatgaagaagtcagccaagtggtttagaaagtttaacaatgctccaaggaaggtcatcgatgacaaacatggtcatatcaccacccttccagcttttatcagcaataactgagattcgtgcagcgtggttgcgcaccccggcatgcacgaagaatgaaattggtgtgagctttgaaaccaacaagtaaaatagaagaaaataattcggtgtcctatttggtgtaaatgcgaatgaactaagtggtgtgtccacttcactatactggccgaatctgaaataatagtgcatattttactttgaaatgacaaaaaaaaaaaaaaaaaaaa

SEQ ID NO: 2528 - protein, 565 aa, Panicum virgatum
  misc_feature: Ceres CLONE 1781647
  misc_feature: Great-hit functional homolog of the protein sequence encoded by LOCUS At5g42260
  misc_feature: Great-hit functional homolog of the protein sequence encoded by LOCUS At5g44640
  misc_feature (5)..(473): Pfam Name: Glyco_hydro_1 Pfam Description: Glycosyl hydrolase family 1
  misc_feature (3)..(548): SWISSPROT Homolog: EC 3.2.1.21 Beta-glucosidase, chloroplast precursor
  misc_feature: Useful for making plants with altered cell wall content and/or composition
MALLASALTSHSAHRGLRSPIGPNGGNLSWHLSSSKKSKRRCDLRSRAETMSSELAQEHLMPWEIPRKEWFPHGFIFGAATSAYQIEGAWNEHGKGPSIWDHFCHNHPERIADWSNGDVAVNSYHLYEEDVKLLKEMGMDAYRFSISWSRILPKGTLEGGINYKGLQYYKNLINTLKENGIEPYVTIFHWDTPQALEDKYGSFLNRRIVKDYTDFAKVCFEHFGDKVKHWFTFNEPHTFCSYAYGMGQHAPGRCSPGHNCAIPCGDSLSEPYRVGHNILLAHAEVADLYKKYYKGEDGHIGMALDSMFYEPHGKTFLDEQAQSRSVDFNLGWFMEPVFRGHYPFSMRSLLGDRLPYFKDDEQEKLVGSYDMMGLNYYTSLFCEHIDISPRFSPALHTEDAYARPKMNDHEGNPLGPDTRSQWIKSYPKGLKNLLMIIKDKYGNPPVYITENGTADSDNGNLSMRDALDDDIRLDYLQRHISVIKESIDLGANVRGHFTWSLLDNFEWANGYTDRFGLIYVDRDDSFKRHMKKSAKWFRKFNNAPRKVIDDKHGHITTLPAFISNN

SEQ ID NO: 2529 - DNA, 1366 bp, Panicum virgatum
  misc_feature: Ceres CLONE 1781661
  misc_feature: Encodes the peptide sequence at SEQ ID NO. 2530
attcatattcatggacgagattggtgcggggagtcggagccgacccgtgcgccgccgctgccgccgtcatgggtttccccacccccttcctgcagctgaagccgaagctaattgcgctggagcctccggtcggaggatatccgcggtcgaggaggcacatgcggcgcctgcgctgcgccctcaactctgagaatcctcccatgactgtttccatcactggagccacaggtttcatcggacgcagattggttcagaagcttctattggatgatcacaaggttttcgtcttaacaaggtctgccaccaaggccgcatcagtttttcctgcttccacctaccctggagtcacaatagccgaacaaggagattgggaggcatgcgttagaggctcttctgctgttgtcaacttggccggcatgcccataagcacaagatggtcaccagaggttaaacaggaaattaagcggagtcgggtcaatgttacatcaaaggtggtgaaatacataaaccatgctggaaatgctgatgctcaaccctcagtgtttgtgagtgcgacagccattggctactatggtaccagcgaaatccatagctttgatgaatcaagtccatccggcaatgactacctagcagaggtgtgcagggaatgggaggccacagcacgtcaagtaaaccagcaggatgttaaacttgtgcttctccggattggggttgttcttggcaaggacggtggtgctctagcaaagatgatccctctttttatgatgtttgccggtggtcctcttggtacgggacgccaatggttttcttggattcatatagacgacctggtgaacctcatctacgaatctctaattaacccttcgtacaaaggtgtaatcaacggaacggcaccgaaccctgtgcgtttgtcggagctgtgccaacagctggggcgagtcgtcgggcggccctcgtggttgccagttccggaattcgcgcttaaagcggttcttggtgaaggggcttctgtggtgttggaaggacaaaaggttctcccggtgaaggccaaggatctgggcttctcctacagatacccctatgtggaagacgctctcaaggccattgcccaaaacataccaactcgtctgactacaagaaagtagctagggcctttgccaccacatacatgcactgagcttggctatatcctaagtgccacacatgcaacaagatccaggccttgggcggtttgcatatgttgtataatacctgaatttggtcatgggtaacatgaaacctgctatgttttttcttttataaagcaccagtggagatgtaggcacgtatttaattgtccttccatcaaaaaaaaaaaaaaaaaaaa

SEQ ID NO: 2530 - protein, 358 aa, Panicum virgatum
  misc_feature: Ceres CLONE 1781661
  misc_feature (1)..(233): Pfam Name: Epimerase Pfam Description: NAD dependent epimerase/dehydratase family
MGFPTPFLQLKPKLIALEPPVGGYPRSRRHMRRLRCALNSENPPMTVSITGATGFIGRRLVQKLLLDDHKVFVLTRSATKAASVFPASTYPGVTIAEQGDWEACVRGSSAVVNLAGMPISTRWSPEVKQEIKRSRVNVTSKVVKYINHAGNADAQPSVFVSATAIGYYGTSEIHSFDESSPSGNDYLAEVCREWEATARQVNQQDVKLVLLRIGVVLGKDGGALAKMIPLFMMFAGGPLGTGRQWFSWIHIDDLVNLIYESLINPSYKGVINGTAPNPVRLSELCQQLGRVVGRPSWLPVPEFALKAVLGEGASVVLEGQKVLPVKAKDLGFSYRYPYVEDALKAIAQNIPTRLTTRK

SEQ ID NO: 2531 - DNA, 1548 bp, Panicum virgatum
  misc_feature: Ceres CLONE 1781665
  misc_feature: Encodes the peptide sequence at SEQ ID NO. 2532
acccagctgccttgtcttgcctccatttctaattcccccctcccgaagcccaaaccctaaacctaaacctctcacccctgccgccgccaccaccgctttcgccgccgcctcgactcccctcccagccgccgacgtcccccgcctcggaatctcggatcgtagcaatgtcgtcggacgatgaggtccgggaggagaaggagctcgacctctcatccaacgacgtcgtcaccaagtataagtccgccgcagaaatcctcaacaatgctctgaagctggttgtatctgagtgcaagccgaaagccaagattgttgatctttgtgagaagggcgatgctttcattagagagcaaactgggaatgtctacaagaatgcaaagaggaagattgaaaggggcattgctttcccaacctgtgtatctgtgaacaacacagtctgccatttctcaccgcttgccactgatgaggcagttctggaagaaaatgatatggttaaaatagatatgggctgtcatattgatggttttattgctgtggtggcccatactcatgtgattacgaacgggccagtcactggaagagcagctgatgttcttgctgctgccaacaccgcagcagaagtcgcaatgaggcttgtcagacctgggaagaagaacaaggatgttactgaagcaatccagaaagtagctgctgcttatgattgcaaaattgtcgaaggtgttcttagccatcagctgaaacaatttgtcattgacggtaacaaagtcgtgctcagtgtctctaatgctgatacaaaggtggatgatgctgaatttgaagaaaatgaagtatatgcaattgacattgtcactagcactggggaaggaaagcccaagttattggatgaaaagcagaccaccatctacaaaagggctgttgacaagaattatcacttaaagatgaaagcatcaaggtttattttcagtgagatcagccagaagttcccgatcatgcctttcaccgctagggcattggaagagaagcgtgcacgcttaggcttggtggaatgcatgaaccatgagctattgcagccatacccagtacttcatgagaagccaggtgatcttgttgcgcacataaaattcactgtgctgctgatgcccaatggatcggataagattacatcacatccgctacaggagttacagcccacaaaatccattgaagacaatgctgagataaaggcatggcttgctttggggacaaagtcgaagaagaagggtggtggaaagaagaagaaaggcaagaaaggagatgcagcagagcctatggaggatgcaacaaatggtgttccaagccaagaataattctgatttttggaattgctacctctagttttgttcacgtttctttgctgcatctgatggtgttatattacattcagttgtggaaaaaattgagtactgtttcaactgtcttaagaaatgacgaatcctgctgcacattatcgcatctaatgacaaagataattctccatgtgccatgtttgtgctaaaaaaaaaaaaaaaaaaa

SEQ ID NO: 2532 - protein, 392 aa, Panicum virgatum
  misc_feature: Ceres CLONE 1781665
  misc_feature (1)..(256): Pfam Name: Peptidase_M24 Pfam Description: metallopeptidase family M24
MSSDDEVREEKELDLSSNDVVTKYKSAAEILNNALKLVVSECKPKAKIVDLCEKGDAFIREQTGNVYKNAKRKIERGIAFPTCVSVNNTVCHFSPLATDEAVLEENDMVKIDMGCHIDGFIAVVAHTHVITNGPVTGRAADVLAAANTAAEVAMRLVRPGKKNKDVTEAIQKVAAAYDCKIVEGVLSHQLKQFVIDGNKVVLSVSNADTKVDDAEFEENEVYAIDIVTSTGEGKPKLLDEKQTTIYKRAVDKNYHLKMKASRFIFSEISQKFPIMPFTARALEEKRARLGLVECMNHELLQPYPVLHEKPGDLVAHIKFTVLLMPNGSDKITSHPLQELQPTKSIEDNAEIKAWLALGTKSKKKGGGKKKKGKKGDAAEPMEDATNGVPSQE

SEQ ID NO: 2533 - DNA, 1458 bp, Panicum virgatum
  misc_feature: Ceres CLONE 1781683
  misc_feature: Encodes the peptide sequence at SEQ ID NO. 2534
aaaatcctataggtcgagggtccgaatcgcaaaagccccatctccttctcccggcggttgtgatggcggcggcgatggcgacgccggcgagcacgtccggggagtggctcaagggcgccctacaggatcttcgggagagtaaggggagcgagctggagctcgacgctgatctcatctcgggcctcgtctccttctgcgagctcgcatctccccccgacgccgccagctacctcgagaactttattggaaaagaagctgctcagcacattattcaggagtacttgcggaggaggggtcacattggttccttgaatggaactgaaagcttgcaatcatctagtcttcagccttacgttaagccatctgctgatgcggcaactacacaaacaaagaaacaaatgcgcgcacaaaaagaagcagcgtcttcttctagtcagagttccaagagtcaagcagaaactgcagaatcccaacttgcttccaagagaggttcaaaaaagaaaggggcaaaggccatttctctcgctgaagcagcaaagggttccattgtcttcaagcaggggaaaccttgttcgtgccaagcacggcagcataaccttgttagcaactgcttatcatgtggcaaaattgtgtgcgaacaagagggcgacggaccctgtagtttctgtggtgcgctggtcttgaaggaaggtagtacatatgctggtttaagtgatgttggactacctctttcagaagcagaagctgcagctgaagcatatgcaaagaggcttgttgactatgacaggaatgctgctgcaaggactaaagtttatgacgaccaaagtgactattttgaaatggaaggaaacagttggctctcttcaaaggaaaagtcagccctacagaagcagcaagaggaagctcaggaagcagctgcaaatcaaaaggggaaagtggttgttacatttgatttggtgggtcgtaaggtgattttgaacaaggatggagccactgagctggaaacggagcacccgatcatgagaccacctgatcagaaggatcagagccaccgcatacagcccaaccccacaatcagagagcaacctgtgtacgtcgaaacaggtccagtgaagccaaaaactgaccgagcaaaacagagcaagagacttgccaagaatggtctgtgcctggaggtaaccggcaggctgcagcacgatgacaaggacctgcagagcattctgagtggcaaggtgaagaaaggcgatcacttggcttacagttcctttggtcaggcacgcgaaggggatgacgtcgaatgctcccaagattttgattgacagtatgaaatcctagtgatctaaaaacagtcatgaaacagcctgtaaaatcattgagttccccatctaaccttttggacccaatttcctgcaaaatgcaaatgtgagtgtttggcaccaaaaaaaaaaaaaaaaaaaa

SEQ ID NO: 2534 - protein, 418 aa, Panicum virgatum
  misc_feature: Ceres CLONE 1781683
  misc_feature (1)..(51): Pfam Name: zf-C2HC5 Pfam Description: Putative zinc finger motif, C2HC5-type
MAAAMATPASTSGEWLKGALQDLRESKGSELELDADLISGLVSFCELASPPDAASYLENFIGKEAAQHIIQEYLRRRGHIGSLNGTESLQSSSLQPYVKPSADAATTQTKKQMRAQKEAASSSSQSSKSQAETAESQLASKRGSKKKGAKAISLAEAAKGSIVFKQGKPCSCQARQHNLVSNCLSCGKIVCEQEGDGPCSFCGALVLKEGSTYAGLSDVGLPLSEAEAAAEAYAKRLVDYDRNAAARTKVYDDQSDYFEMEGNSWLSSKEKSALQKQQEEAQEAAANQKGKVVVTFDLVGRKVILNKDGATELETEHPIMRPPDQKDQSHRIQPNPTIREQPVYVETGPVKPKTDRAKQSKRLAKNGLCLEVTGRLQHDDKDLQSILSGKVKKGDHLAYSSFGQAREGDDVECSQDFD

SEQ ID NO: 2535 - DNA, 1725 bp, Panicum virgatum
  misc_feature: Ceres CLONE 1781714
  misc_feature: Encodes the peptide sequence at SEQ ID NO. 2536
attttcttcttcccctctccttcctcgtcgtcgtcctcttcagatcaagaaaccgtgtcctagaaaccatcgagagcgcccttcccacccctcagatcgtccaaagacggcggctttcggagcttcccgtgctttttccggcacgacgggtggttcagtttccggatcgggctgctcttccttttctggttgccggcgagcaggcggcggcggccgtccttggatcgggagttgtttagcttgttaaggtgcggagatggtggccgaggcggaggtgatgcatcaggcgcccatgcccgtgctggaggtgcagtaccaccggtgcgtgaccaagggggtcgatgaggtcgtcgggatgtctgcggcggcggcggcggcggcggtggccacgccgacggaggttgaggtcgaggtcgaggtcgccgtcgaggtgcctcgcatgggactggagcagcctgatgctgcaccgagtgtatctgtggagatgctacagtttgtgcccaacatccggtctggtagctttgctgatattgggcctaggaggtacatggaagatgaacatatccggatagatgatctttctgctcatcttggctcgctgttggtctgcccgttgccgagcgccttctatggagtttttgatggacatggaggtccagatgctgcagcctacatgaaaaggcatgcaatgaggttcctgttcgaggacagtgagttcccacaagcatcacgagtcgatgagttgtaccttcagtctgtcgagaactctgttcgaagagctttcctgcaggctgatcttgctctggctgatgatttggacatcagccgctcttctggaaccacagcgctcaccgcattagtctttggaaggcaactgttggttgcgaatgctggggactgccgggcagtcctatgccggaaaggtgtagccatggagatgtcccgagatcacagggctaactatgtcgaggagtgtgaaagggttgcggcgtctggtggatacatcgaggatggctacctcaacggcgtcctgtccgtaacccgggcccttggggactgggacatgaagacccctgatgcctcagcatccccactcattgcggagccagagttccaacaggccactctcactgaggatgacgagttcctcatcatgggttgtgacgggatctgggatgtgatgacaagccagcacgcggtgagcctcgtgcggcagggcctgcggcaacacgatgaccctgcacggtgcgcaagggagcttgtcatggaggcgaagcggctagagacagccgacaatctgaccgttgttgtcgtytgcttcgtgtcggagcygggcgcgcagcagcaggagcagccggygagrctgaggggctataagagcagtgtcaacagaggcgctgtgcaacccgaggagctggctagagaccgaccaccgctagaggaagagggttagcatggaggaaggacggactggtttgggatgtgtaaatacaactcgctgacaacacatggtggacggatcatgaggcgatgggttctagtttcccatttgttgagagaaggctgccgagtaggcaggtcaggtgcagcagcagccagcagtttggtaggttatttttcactttgtttttttctatctttcgtttacccctcagtaagcaaattgctgttattgttaacactagacacctatctgttgtacatatataaatcgaagtggtcccc

SEQ ID NO: 2536 - protein, 398 aa, Panicum virgatum
  misc_feature: Ceres CLONE 1781714
  misc_feature (1)..(265): Pfam Name: PP2C Pfam Description: Protein phosphatase 2C
  misc_feature (359)..(359): Xaa is any aa, unknown, or other
  misc_feature (368)..(368): Xaa is any aa, unknown, or other
MVAEAEVMHQAPMPVLEVQYHRCVTKGVDEVVGMSAAAAAAAVATPTEVEVEVEVAVEVPRMGLEQPDAAPSVSVEMLQFVPNIRSGSFADIGPRRYMEDEHIRIDDLSAHLGSLLVCPLPSAFYGVFDGHGGPDAAAYMKRHAMRFLFEDSEFPQASRVDELYLQSVENSVRRAFLQADLALADDLDISRSSGTTALTALVFGRQLLVANAGDCRAVLCRKGVAMEMSRDHRANYVEECERVAASGGYIEDGYLNGVLSVTRALGDWDMKTPDASASPLIAEPEFQQATLTEDDEFLIMGCDGIWDVMTSQHAVSLVRQGLRQHDDPARCARELVMEAKRLETADNLTVVVVCFVSEXGAQQQEQPXRLRGYKSSVNRGAVQPEELARDRPPLEEEG

SEQ ID NO: 2537 - DNA, 1992 bp, Panicum virgatum
  misc_feature: Ceres CLONE 1781720
  misc_feature: Encodes the peptide sequence at SEQ ID NO. 2538
atggctgtagctttttggccctgacgggacctgcagcagagtggcactcgattgcagcatctctacacgtaggccttcttattctggctgctggctgcagcaactgcagcctgcagagggcaacgccaaacccacacacaccacagtactacacctccctcctctctgacgccttttttcccgatccgatccccctgctgctgcaactgcaataataatctgattgcctcctcctcctcctcctcctgctcgatcggtcgatcgatctctctcctctcttaaatataatcacacttagctcggacacagcagctagccttgagctgagaccacgcacagggggtgagagagagatagagagaggaactgcagtccagactgctgcgcaagagaacaccaagaaacagacaaggcacggtgaccatgatgctctctgatctttcgtccgaccacgaggccactggatccagctcccatggcggggacatcgccagctacgccccgagccctctcttcctcgcgccggcagcctcggccaccgcgccgccgccgcagccggaggcgcccagggcggcggggggcaagaggaagagaagccagcccggcaacccagaccccggcgcggaggtgatcgctctgtcgccgcggacgctggtggcgacgaaccggttcgtgtgcgagatctgcaacaaaggcttccagcgcgaccagaacctgcagctgcaccgccgggggcacaacctcccctggaagctccgccagcggagcctcccgtctggcgccggcagcaggcagggcgacgccgcagcgccgccgcgcaagcgcgtctacgtctgccccgagcccacctgcgtccaccacgaccctgcaagggcgctgggggatctgaccgggatcaagaagcacttctcgcggaagcacggcgagaagcggtggcggtgcgagcgctgcgggaagcgctacgccgtgcagtcggactggaaggcgcacgtcaagggctgcggcacgcgcgagtaccgctgcgactgcggcatcctcttcactaggaaggacagcctgctcacgcacaaggccttctgcgatgccctagccgaggagagcgcgcggcttcttgcggcggccgctgcaagcaacggcagcgccatcaccaccaccaacagcagcaacggtggcaacagcagcagcgacctcctcttctccagcagcatcaccacggcaacaccgctgctcctcccgttccccaacccgcctcctcctgccgcggcggcgcaaaaccctaacgccttgtacttcctgcaccaagagcaggcgcagcagcagctgctggctcccttcctgcagccgaggatggtgcagccctcgccgtacctgcttgacctccacgcggacgccgccaccatcgccaccgccggtggcggcggcatcgtcgccgccgacgcggtcaacttcggcggcctcgccccggacggctcggtggctctgcgcggcggcggccaccggcgcctcaccagggacttcctcggcgtcgatggcggcggtcaggtcgaggagctgcagctgccgctctacgcaacgacggctgctgccgccgccgtcccccgagctgccagctgcgccaccgacatcaccagcaggcagtgcctcggcgagcggctgccgccggtcaacgagacgtggagccacaacttctagaccgtacctacttcaacttcaagtagccacgcgctcgaactgcaatactccatgaagccaaactataagtgatgtagcgatcgtcgagcgtgtcaacttgtgcacgtacgcgttgctgttaattaatttcttgatctgcattatttccctgtttaattaattctcgtcgtctagggtaatatatataaggtgaattcgaccttgggaaacttttgatcagtgtaccttatcgaattatttatgctgggttttatattaattaagatttgtttctcgttacaaaaaaaaaaaaaaaaaaaa

SEQ ID NO: 2538 - protein, 422 aa, Panicum virgatum
  misc_feature: Ceres CLONE 1781720
  misc_feature (1)..(23): Pfam Name: zf-C2H2 Pfam Description: Zinc finger, C2H2 type
MMLSDLSSDHEATGSSSHGGDIASYAPSPLFLAPAASATAPPPQPEAPRAAGGKRKRSQPGNPDPGAEVIALSPRTLVATNRFVCEICNKGFQRDQNLQLHRRGHNLPWKLRQRSLPSGAGSRQGDAAAPPRKRVYVCPEPTCVHHDPARALGDLTGIKKHFSRKHGEKRWRCERCGKRYAVQSDWKAHVKGCGTREYRCDCGILFTRKDSLLTHKAFCDALAEESARLLAAAAASNGSAITTTNSSNGGNSSSDLLFSSSITTATPLLLPFPNPPPPAAAAQNPNALYFLHQEQAQQQLLAPFLQPRMVQPSPYLLDLHADAATIATAGGGGIVAADAVNFGGLAPDGSVALRGGGHRRLTRDFLGVDGGGQVEELQLPLYATTAAAAAVPRAASCATDITSRQCLGERLPPVNETWSHNF

SEQ ID NO: 2539 - DNA, 2185 bp, Panicum virgatum
  misc_feature: Ceres CLONE 1781728
  misc_feature: Encodes the peptide sequence at SEQ ID NO. 2540
acgcaaaagcaaagcaaccgcttaaattgaaagaagaaaaacagagctcaccaattcaactgagggaaagagcaatcacacctaccctaccctccgccgccgtcgccgacgaagagctagctccgtcgcgatggccgccgccgccgcccgcgcgggccgccgcggcggacccgaggcggagctcctcgtggcgctcctcctgctcgcgctggtcgtctccggccactgcctggacgcgcaccaccgcgggctgaagcgccgccgccggaagcacgagatccactccccgatcaagacggtggtggtcgtcgtgatggagaaccgcagcttcgaccacatcctcggctggctccgccgcacccgccccgacatcgacggcctcaccggccgcgagtccaaccacctcaacgcctccgacccctcctccccggagatcttcgtcaccgatgaggccggctacgtcgactccgacccgggccacggcttcgaggacatccgcgagcagatcttcgggtccgccgacacctccgccgtgccgccccccatgtcaggcttcgcccagaacgcgcgcgggatgggcctcggcatggcgcagaacgtcatgagcggattcaagcccgaggccatccccgtctacgcctccctggccgatgagttcgccgtgttcgatcggtggttcgcctccgtgcccacctccacgcagcccaaccgcctgttcgtccactcagcgacctcccacggcctcaccttcaactgccggaaggacctcatccacggcttcccgcagaagaccatctttgatagcctcgaggagaacggcttgtcctttggcatctactaccagaacatcccggccacgctcttctaccagagcctccgccggctcaagcaccttgtcaagttccaccagtacagcctcaaattcaagctgcacgccaagtggggaaagctgccgaactatgtggtgattgagcagaggtactttgattgcgagatgtttcccgcaaacgatgaccatccgtcgcatgatgtggcaaggggacagaggtttgtcaaagaggtgtatgagacactgagggccagtcctcagtggaacgagaccgccctgattatcacatatgacgagcatggtggattctatgaccatgttcctacaccagttgtcggggtgccccagcctgatggaattgttgggcctgatccctactacttcaagtttgaacggcttggggtgcgcgtgcccagcttcctcatctcgccgtggattgagaaaggaactgtgatccatgaaccaaatggtccccaagaaagctcacaatatgagcattcgtccattccagcaacagtaaagaagctatttaatttacactctaacttcctgacaaagagagatgcatgggctgggaccttcgagagctacttcaaaatccggaagacgccaagaactgactgtccagagaaactcccagaggttacaaaatcattgcgaccatttggccctaaggaagattcatctctgtcggagtttcaagtggagttgattcaacttgcgtcacagcttaatggtgatcatgtactgaacacgtacccagatattggcaggaccatgactgtcgggaaagcaaaccgctacgcagaggatgctgttgccagatttctggaagctggtaggattgctctaagagccggtgcaaatgaatctgctttggtgacaatgaggcctgctctcaccagcagggcctcaatgtcctctggtttatcatcagagctctaatagattgttcagcaatccgtgcacaaacttgggatcatcattcactcccactctacatcacatcagaactgtttcgtaatgtgctacgacctctgttggtgtagtgcatgatatcagcatcatgtaatggatagctcttagacatggttttgtaaataaacgtcgtgatattggacatctcaggcttgcccttcgtcagactgtcatggtagcactgagatggagctcgtcagctcgaaataccatcaatttatgtgatatatgtaggtcccctgctggataatatgtagcgggaatttctaaaacattctggaattgtacctattcagtctgtactgtaactgcttgttaagcagctgaactgcaatttggtgtaatgtatgatatattgaaaaaaaaaaaaaaaaaaaa

SEQ ID NO: 2540 - protein, 547 aa, Panicum virgatum
  misc_feature: Ceres CLONE 1781728
  misc_feature (1)..(358): Pfam Name: Phosphoesterase Pfam Description: Phosphoesterase family
MAAAAARAGRRGGPEAELLVALLLLALVVSGHCLDAHHRGLKRRRRKHEIHSPIKTVVVVVMENRSFDHILGWLRRTRPDIDGLTGRESNHLNASDPSSPEIFVTDEAGYVDSDPGHGFEDIREQIFGSADTSAVPPPMSGFAQNARGMGLGMAQNVMSGFKPEAIPVYASLADEFAVFDRWFASVPTSTQPNRLFVHSATSHGLTFNCRKDLIHGFPQKTIFDSLEENGLSFGIYYQNIPATLFYQSLRRLKHLVKFHQYSLKFKLHAKWGKLPNYVVIEQRYFDCEMFPANDDHPSHDVARGQRFVKEVYETLRASPQWNETALIITYDEHGGFYDHVPTPVVGVPQPDGIVGPDPYYFKFERLGVRVPSFLISPWIEKGTVIHEPNGPQESSQYEHSSIPATVKKLFNLHSNFLTKRDAWAGTFESYFKIRKTPRTDCPEKLPEVTKSLRPFGPKEDSSLSEFQVELIQLASQLNGDHVLNTYPDIGRTMTVGKANRYAEDAVARFLEAGRIALRAGANESALVTMRPALTSRASMSSGLSSEL

SEQ ID NO: 2541 - DNA, 783 bp, Panicum virgatum
  misc_feature: Ceres CLONE 1781759
  misc_feature: Encodes the peptide sequence at SEQ ID NO. 2542
attcccccatctcgtctcgtctccccggcgcacgccatcgcttgcgtgcgcgtagcatttaaccaaccgcatccctcctcactgctcctccgcgcccccatttctccccctccccctccgccggcgatcgatcgatcccgtccgctccgcctccgcctccgccgccgccgctgctcgccgtccgttcgtccgtcgatccggttcgctgctgtcccctcgcgtcaggacaggcgatggcgaggagctcgttcaagctggagcaccccctcgagaggaggcaggctgaggccaaccgcatcagggagaagtaccctgacagaatccccgtcattgttgagaaggccgagagaagcgatatccccgacattgacaagaaaaagtaccttgttcctgccgacctcacagttggacagtttgtctatgtggtacggaagcggatcaagctcagtgccgagaaagcgatcttcatcttcgtaaagaacaccctcccgccaacagccgctctgatgtctgccatctacgaggagaacaaggacgaggacgggtttctctacatgacctacagcggcgagaacaccttcgggctgttctaagcccagggcgtcgcgaatggccctctggcctcgtcgcaaatgtctcctgtaaatacatatctgaagaacctgtgtacataatccggtccgcctttgtcgccagcagctcttaagctgtgctctgctgttaaaaaagtcctttgaagcgtaaaatgctcagcacatttatgaaaaaaaaaaaaaaaaaaaa

SEQ ID NO: 2542 - protein, 119 aa, Panicum virgatum
  misc_feature: Ceres CLONE 1781759
  misc_feature: Great-hit functional homolog of the protein sequence given in SEQ ID NO 9436
  misc_feature: Useful for making plants with modulated nitrogen use efficiency
MARSSFKLEHPLERRQAEANRIREKYPDRIPVIVEKAERSDIPDIDKKKYLVPADLTVGQFVYVVRKRIKLSAEKAIFIFVKNTLPPTAALMSAIYEENKDEDGFLYMTYSGENTFGLF

SEQ ID NO: 2543 - DNA, 580 bp, Panicum virgatum
  misc_feature: Ceres CLONE 1781769
  misc_feature: Encodes the peptide sequence at SEQ ID NO. 2544
gcgaaaggactggactgccggcgaccagcgcgacgaccgacgccggaggaggagagagcaggagcaagccaaggatcccaaccgaagaagaggatggtggcgccgacggatccgatgctgtggcacaaggtggccgccgtctccggggtcgctgctcttggactcggcacctacggcgcgcacatgttccgccccaagaaccccgcgtacaaggaggtttggcacaccgcgtccctgtaccatctcgtccacaccgccgcgctgctcggggctcccatcacaaaacatcccactgttttcggagggctactcactgctggaatcgtgctattctctggaacgtgctacaccgtggcttatcttgaagacaggaagttctcttcaccggcaccactgggtggctttgcattcatcgccgcttgggccagccttctcttctgatgaaactgtgctttagccaataaaacaaaaaatcttaaagctctgtatttggtgctttattaggttatgaaaactgtacttgtacattgtacggtatgcaccctgggttaaataattcaatatgtggttttgtgttacc

SEQ ID NO: 2544 - protein, 115 aa, Panicum virgatum
  misc_feature: Ceres CLONE 1781769
  misc_feature: Great-hit functional homolog of the protein sequence given in SEQ ID NO 9497
  misc_feature: Useful for biocontainment applications
  misc_feature: Useful for making plants with modulated biomass
  misc_feature: The plant produces a reduced number of seeds.
  misc_feature: The plants are small in stature, dark green, have oval leaves, strong bolts, and are often sterile
MVAPTDPMLWHKVAAVSGVAALGLGTYGAHMFRPKNPAYKEVWHTASLYHLVHTAALLGAPITKHPTVFGGLLTAGIVLFSGTCYTVAYLEDRKFSSPAPLGGFAFIAAWASLLF

SEQ ID NO: 2545 - DNA, 1762 bp, Panicum virgatum
  misc_feature: Ceres CLONE 1781770
  misc_feature: Encodes the peptide sequence at SEQ ID NO. 2546
acgcgcccccacctcttctccctccctccccggccgattcggcgattccccattccgcgcctcccgaatccccccgtcgaatccgagctccgggaggcgcccgcggcggggatctccccaaccgcctcgcagccccgcgcgccggcgcgccgacatcaacataaacaactactaatcagtacaaaatggcaataagcttcaaatattgggacgactgcttggatccagaggatatgagattaatgtggcaagatcctgttgtaagtaaagagtggattgatgccggggaagagcagggacagaaagttcatctctcacgggaccctgatggtgaggcatatctcacacaaactgaaatgatggcagtggctgcaatcaccattaatagacatttcaaatcacaactggacccgtatatgataggcgcacttgcggaaattgcaagtggaaggaaactctttatagatacctacgatcgcaagacaaaagagaccaaggttgggataatgcaggtggcacctgaagttgctcaatggcttggaaaggaactgggttacaagagttatgacattgaagataataccaatttgctctactggcctcttgtaaatgtctactttggtgctgcttatgcaaaatggctcttctcttgtgatgataaacaaagaacggaagaatttgttgttagagcatataagggcggcaaaaagaaggcttctcacaaatcaacttctcccattttccagcgttatctttatgtgaaagagagcttgttgtctataagacaaccagaaatttgcaatgagctcacttctggcccggaaagtttatcaagcacagaaacgcagttgatatattgggattccaaggtatcagaggccgatatggatgcaatgtggaagcatcctgatgtgtataaggagtggacaaaatccggtgagcgacgtggaaatgtacgattctcccatgatgcaaagaagaggccttacctttctcgtgtggaggtgaaggctgttgctgaaataatcatatcacgccatttgggcacaagaggatcgaaaccagaagctcttgcggcacttgcagaggtctgcagtatgcgctttgttcatggagtaagtacccgaactggattgatgggaatagactacgctactgctgaatggctttccagagattgtggctacagagcgtatacagtgatctctgtggatgatctctacaatccttttgcatcaatgtactttggtgcatcttacttggcatggttgtcatgctatgaaggaagggaacaaagctatgaattcattgtccaagcttacctcgggggaccagagaatgttaaccttcaggagactggtccattatggaaccaattcttggaggcattagcactgtaccacgacccaaagaaggagaatagtagctgctgtattttgtgaggttgtctgatatgccttcatcttttgctactgaagatcccctcccaagggttcagcatcgacaagcaacgtgctttgcatgaactacatgaggtacggggcaacaggggcttgtcaatccatatatattttggccgatcgccccctgctcatggaatgcaccaacgtgactgaacccgtcgtggtccacagatccgttccatgcttctgttccatttgtttcccttcccttttaccgtcggtatatgccaaaacggttgtaatcctgttctttccaccttttggtgtgctgtaaactgcaaaaaaaaaaaaaaaaaaaa

SEQ ID NO: 2546 - protein, 418 aa, Panicum virgatum
  misc_feature: Ceres CLONE 1781770
  misc_feature (1)..(123): Pfam Name: SLT Pfam Description: Transglycosylase SLT domain
MAISFKYWDDCLDPEDMRLMWQDPVVSKEWIDAGEEQGQKVHLSRDPDGEAYLTQTEMMAVAAITINRHFKSQLDPYMIGALAEIASGRKLFIDTYDRKTKETKVGIMQVAPEVAQWLGKELGYKSYDIEDNTNLLYWPLVNVYFGAAYAKWLFSCDDKQRTEEFVVRAYKGGKKKASHKSTSPIFQRYLYVKESLLSIRQPEICNELTSGPESLSSTETQLIYWDSKVSEADMDAMWKHPDVYKEWTKSGERRGNVRFSHDAKKRPYLSRVEVKAVAEIIISRHLGTRGSKPEALAALAEVCSMRFVHGVSTRTGLMGIDYATAEWLSRDCGYRAYTVISVDDLYNPFASMYFGASYLAWLSCYEGREQSYEFIVQAYLGGPENVNLQETGPLWNQFLEALALYHDPKKENSSCCIL

SEQ ID NO: 2547 - DNA, 1606 bp, Panicum virgatum
  misc_feature: Ceres CLONE 1781794
  misc_feature: Encodes the peptide sequence at SEQ ID NO. 2548
caggaacttgtcccaccagctagcagtcagtagcggtgttcttgcagaggcggccggccggctcgacgtgcgtcgacgatggggctccgccgcgactccgccgccgcgctggtggctctggtgctcgcggtcacctgctgctccgttgcagtagtggcctacgatcccctggacccgaacggcaacatcaccatcaagtgggacgtcatctcctggacgcccgacggctacgtggcgatggtgacgatgagcaactaccagatgtaccggcacatcatggcgcccgggtggacggtggggtggtcgtgggccaagaaagaggtgatctggtccatcgtgggcgcgcaggccacggagcagggcgactgctccaagttcaaggccggcatcccgcactgctgcaagcgcacccccgccgtggtggacctcctcccgggcgtaccctacaaccagcagatcgccaactgctgcaaggccggcgtcgtcgccgcctacggccaggaccccaccgccgccgtctccgccttccaggtctccgtcggcctcgccggcaccaccaacaagaccgtcaagctccccaccaacttcaccctccagggccccggcccgggctacacctgcggccccgcccgcgtcgtcccctccaccgtctacctcacccccgaccgccgccgccgcacgcaggcgctcatgacctggaccgtcacctgcacctactcccagcagctcgcctcccggtacccctcctgctgcgtctccttctcctccttctacaacagcaccatcgtgccctgcgcccactgcgcctgcggctgcggccatggcggccacggcggcgccggctgcatcgccggcgactccaagcgcgcgctctcccccggcgtcaacacgccgcgcagggacgggcagccgctgctgcagtgcacgccgcacatgtgcccggtgcgcgtccactggcacgtcaagctcaactacaaagactactggcgcgccaagatcgccatcaccaacttcaactaccggatcaactacacgcagtggacgctggtggcgcagcaccccaacctggacaacgtcaccgaggtcttcagcttccagtacaggccgctgctgccctacggcgccatcaacgacaccggcatgttctacgggctcaaattctacaacgacctgctcatggaggccgggcctttcggcaacgtgcagtccgaggtgctcatgcgcaaggacgccagaaccttcaccttcagccagggatgggccttcccaaggaagatctacttcaacggcgacgagtgcaagatgccgccgccggactcctacccctacctgcccaacaggtccgcccgggttgcggcaccgtcggtgatcgcctcggcattcctgctggcgctgctgctcctgctggcgccgtgattgatagggagcagcagagtgtgttgttacctgtgcagcggtggtttcgtcatgtaaacataacgcggtgggatctccaattactttctagacagcctgagaacaaatgatagtaatacatagtagagcacaagcctttttctgcggtttaaaaaaaaaaaaaaaaaaaaaaaaaaaaaaaaaaaaaaaa

SEQ ID NO: 2548 - protein, 445 aa, Panicum virgatum
  misc_feature: Ceres CLONE 1781794
  misc_feature: Great-hit functional homolog of the protein sequence encoded by LOCUS At5g15630
  misc_feature (1)..(165): Pfam Name: Phytochel_synth Pfam Description: Phytochelatin synthetase-like conserved region
  misc_feature: Useful for making plants with altered cell wall content and/or composition
MGLRRDSAAALVALVLAVTCCSVAVVAYDPLDPNGNITIKWDVISWTPDGYVAMVTMSNYQMYRHIMAPGWTVGWSWAKKEVIWSIVGAQATEQGDCSKFKAGIPHCCKRTPAVVDLLPGVPYNQQIANCCKAGVVAAYGQDPTAAVSAFQVSVGLAGTTNKTVKLPTNFTLQGPGPGYTCGPARVVPSTVYLTPDRRRRTQALMTWTVTCTYSQQLASRYPSCCVSFSSFYNSTIVPCAHCACGCGHGGHGGAGCIAGDSKRALSPGVNTPRRDGQPLLQCTPHMCPVRVHWHVKLNYKDYWRAKIAITNFNYRINYTQWTLVAQHPNLDNVTEVFSFQYRPLLPYGAINDTGMFYGLKFYNDLLMEAGPFGNVQSEVLMRKDARTFTFSQGWAFPRKIYFNGDECKMPPPDSYPYLPNRSARVAAPSVIASAFLLALLLLLAP

SEQ ID NO: 2549 - DNA, 642 bp, Panicum virgatum
  misc_feature: Ceres CLONE 1781814
  misc_feature: Encodes the peptide sequence at SEQ ID NO. 2550
ctgatcatacagatagcccaagcacgaacgatcgagctcgtcccaaacaagtagagtaactcgccactgatccttgcaaaagagaagcaaccatgaagccccaggtgctgctcgtcgcggtggccgccctcgccgtcctcgcagctctgcccctcgccgaaagcaaagggcacgggatcggggagcacgcggaggccgcgacggcgagcgcgtggccgtgctgcgacacctgcggctcgtgcaccaggtccatcccgccgcagtgcctgtgcgaggacgaggcgccaggcgggtgccacccggagtgcaggaactgcgtcaagtccaccgacggcggcagcgacgtcttccgctgcgccgaccgcatcaccaacttctgcaagcgccgctgcacgccggccgcgtccgcgtgattggttggacgccggaatcctgctctgctgtcacctgaataataccatgccggcagctgccgatcgattagctccggcctgcctttggtttcagtcttccagtgttccctctgcatcctgctctggatggggagaagagatcagtggtgttgtttttttttctttctaatgtctggtctggactcatggatttcttactgtttgtcgaataaagacccgtgttccacgc

SEQ ID NO: 2550 - protein, 106 aa, Panicum virgatum
  misc_feature: Ceres CLONE 1781814
  misc_feature (1)..(27): Pfam Name: Bowman-Birk_leg Pfam Description: Bowman-Birk serine protease inhibitor family
MKPQVLLVAVAALAVLAALPLAESKGHGIGEHAEAATASAWPCCDTCGSCTRSIPPQCLCEDEAPGGCHPECRNCVKSTDGGSDVFRCADRITNFCKRRCTPAASA

SEQ ID NO: 2551 - DNA, 1670 bp, Panicum virgatum
  misc_feature: Ceres CLONE 1781836
  misc_feature: Encodes the peptide sequence at SEQ ID NO. 2552
agcagctccgaagccacagctgctgcactttcttttcctatcttccttagcctcaggttgccagccaccgctcccatggacaacggatccgcgaagcagaccgttgttctaatccccggcggcggcgtcggccacgtcgggcccatgacacagctcgccaaggtcttcctcgaccacggcttcgacgtcaccatggtgctcatcgagccgccgatcaagtcgaccgactccggcgccagcttcatcgagcgcgtcgccgcctccaacccgtccatcaccttccacgtcctgcctccgatcccaccccctgacttcgcgagctcccccaagcaccctttcctcctcatgctggatttcatgtgccagtacaacgagaagctcgagagcttcctctcctccatcccgcggccgcgcttgcactccattatcatcgacatgttctgctcccacgtcatcgacgtggccgcgaagctgggcctccccgtctacacgttcttcgcttcgggcgctggggttctcgccgtcttcacccagctgccggcgctgctcgccggcaggcgaacggggttgaaggagctcggggacacgccactcgagttccttggcgtcccgccgatgccggcgtcccatctcgtcagggagctgctcgaggacccggaggacgagctgtgccggaccatgatgaacaactggaagcgcaacacggacacccacggcgttctggtcaacacgttctgctcgttggagagccgggccctgcaggcgttcagggatcccctgtgcgtccccggcagggtgttgcctccagtctacgccatcgggccgttggtcggcaggggcaggagcgggccggacgaagaggaagcggagaggcccgagtgcctcgcatggcttgacgcgcagccggagcgcagcgtcgtgttcctctgctgggggagcaaaggctcgctgccggagaagcagatcaaggagatcgccgctggcctagagaagtccgggcaacgtttcctatgggccgtgcgcacgccggccggcagcgacgaccccaaaagatacctggagcaccgccccgagccagacctcgacgcgctcctgccgaaggagttcttggagcggaccaagggccgcggattcgtcatcaagtcatgggcaccgcaggtggacatcctcaggcaccctgccacgggcgccttcgtcacccactgcgggtggaactcgacgctggaggccattgcagcgggcgtgccgatgctgtgctggccgctgggcgcggagcagaagatgaacaaggtgctcatgaccgcggacatgggcgtcggcgtggagctggaggggtacaaggcaggcctcgtcaaggccgaggagatagaggcgaaggtgaagctggtgttggagtccgaggaggggagggagcttagggaacgtgcggcggagcggaagaaagaagcagaggaggcgctgaaggacggcggctcgtcgcgggcggcgttcctgaggttcttgtcggatgttgagaatcttagagcgtaagcttgacgaaatcgcaaccagagtcttggtgtttatgtttgttttcttcacatactactgtccacccttttgtcaatccttgtactctttctgctgcctttcttaagtaacatcttccagaaaaaaaaaaaaaaaaaaaa

SEQ ID NO: 2552 - protein, 484 aa, Panicum virgatum
  misc_feature: Ceres CLONE 1781836
  misc_feature (3)..(165): Pfam Name: UDPGT Pfam Description: UDP-glucoronosyl and UDP-glucosyl transferase
MDNGSAKQTVVLIPGGGVGHVGPMTQLAKVFLDHGFDVTMVLIEPPIKSTDSGASFIERVAASNPSITFHVLPPIPPPDFASSPKHPFLLMLDFMCQYNEKLESFLSSIPRPRLHSIIIDMFCSHVIDVAAKLGLPVYTFFASGAGVLAVFTQLPALLAGRRTGLKELGDTPLEFLGVPPMPASHLVRELLEDPEDELCRTMMNNWKRNTDTHGVLVNTFCSLESRALQAFRDPLCVPGRVLPPVYAIGPLVGRGRSGPDEEEAERPECLAWLDAQPERSVVFLCWGSKGSLPEKQIKEIAAGLEKSGQRFLWAVRTPAGSDDPKRYLEHRPEPDLDALLPKEFLERTKGRGFVIKSWAPQVDILRHPATGAFVTHCGWNSTLEAIAAGVPMLCWPLGAEQKMNKVLMTADMGVGVELEGYKAGLVKAEEIEAKVKLVLESEEGRELRERAAERKKEAEEALKDGGSSRAAFLRFLSDVENLRA

SEQ ID NO: 2553 - DNA, 1624 bp, Panicum virgatum
  misc_feature: Ceres CLONE 1781838
  misc_feature: Encodes the peptide sequence at SEQ ID NO. 2554
gaacggttctgaaagctgggctcagccggcgcgttctcgtgtcgacgccatggcacatctcacacctcttccctccaagcgtgcggcgcgtacggacttccctgccgaaacggagaaccagctctctctctctctctctctctctctctctctctctctctctctctctctcgttcctacgcgggccccactacccggcgtcagcccacactggatcaaaatcttggctcccgcggccgcgcccgcgatcccgaggagagagagagagatactcttgcagcagcggaagccgccaagcaactggccaactgggactagccctagcgcctctcgtccacacagcccaggccaggccccgccccgcccgtcgggctggtcccccgcggcccgcccacacccaccgcgtgcgccgccggaacgggtgcgtggcgtgacgcgcgctgcgcgattttataccccgccatcccctgccagtcgctcgctggctctttcctcaacctttgctttcgagctgatctttactactaccttgcctggtgtcgagaggaagagccggagtacgggagggccggtaggccggagagcttctcgaggagcgagagggcggccatgaggatccagtgcgacgcgtgcgagggcgcggctgccacggtggtgtgctgcgcggacgaggcagcgctctgcgcgcgctgcgacgtcgagatccacgccgccaacaagctcgccggcaagcaccagcgcctcccgctcggcgacggcagcgggggcgtcccgcgctgcgacgtctgccaggagaagccggccttcatcttctgcgtcgaggacagggcgctcttctgccgcgactgcgacgagcccatccacgtccccggcacgctctcggggaaccaccagcgctacctcgccaccggcatccgcgtcggcttcagctccgtctgcggcgccggcgccggcgccggcgccgacgccgacgccctcccgccgcccaagggcggcgcctccaagcccgcggctaccgccggggccgccaaggcgccggccagcaagcccgcgcagccgcaggaggtgccgtcgtcgccgttcctgccgccgtccggatgggccgtggaggacctcctgcagctcaccgactacgagtccagcgacaagaaggactcgcctctcgagttcaaggagctggagtggttcgcggacatcgacctgttccacggccacgcgccggccaaggccgcgacggccgaggtccccgagctcctcgccacgccgcagccggcgagcaacgcggggttctacaggacgagcggcgcgcgccagagcaagaagccgcgggtggagctgcccgacgacgaggacgacttcttcatcgttcccgatcttggctgagatgtcaggtcttcgcatggttcccctgtcatgtggtgtgtatgtatgcaaagtattgtgtgtacgtgtgccgtcatgagatgcaccgatcgcttacgctgggcatatgtaattataaggcagtttggggccagtactttcagcccgagaattgagatgggtttgatgtatgagatgaactcacttggtgcagatgttcttctgctcgagtacgattctatcagatcctttacggttatat

SEQ ID NO: 2554 - protein, 257 aa, Panicum virgatum
  misc_feature: Ceres CLONE 1781838
  misc_feature (3)..(48): Pfam Name: zf-B_box Pfam Description: B-box zinc finger
MRIQCDACEGAAATVVCCADEAALCARCDVEIHAANKLAGKHQRLPLGDGSGGVPRCDVCQEKPAFIFCVEDRALFCRDCDEPIHVPGTLSGNHQRYLATGIRVGFSSVCGAGAGAGADADALPPPKGGASKPAATAGAAKAPASKPAQPQEVPSSPFLPPSGWAVEDLLQLTDYESSDKKDSPLEFKELEWFADIDLFHGHAPAKAATAEVPELLATPQPASNAGFYRTSGARQSKKPRVELPDDEDDFFIVPDLG

SEQ ID NO: 2555 - DNA, 1217 bp, Panicum virgatum
  misc_feature: Ceres CLONE 1781874
  misc_feature: Encodes the peptide sequence at SEQ ID NO. 2556
tcccgcttccctctcctccgcctctctccgattgagtggctcaccttcctcttcccccaaccagattcctccagatttcggctcggttctctcgagctcgagcagatcagcctcctccgatcgaagcccctgatctcggtttacccgcccaagagctgccgctgttgttggtggaagatctttggcggaagatccgaactcttgtgttggggtttctccgggttttcctgcgctggagggaggtttcgttctcgctggccatggtttggctgggaagcagcatcttgatgcgcaatctctgagctttatgaagatcgccagccacctgcgccgctcctgcttcctccactccttctcggtcgtcttcctctactggttttatgtgatctcataacttgccctcacccggatccgccattccccgtgctctccccgtcccctcttcctcctcccttccttcttgctttcctgaagaatcgccgaataatagcactagtactagcagcagcagcggtagagaattgtttggtggtgagctaaagatcctgccttgatgtcgtcgtcgtcgctgtcaccggcggggacggggaggatgtccgggtcggacggcgactcggcggccgacacgcaccggcgcgagaagcggcggctgtcgaaccgcgagtcgacgcggcggtcgcggctgcggaagcagcagcacctggacgagctcgtgcaggaggtggcgcggctgcaggccgagaacgcgcgcgtggcggctcgcgccgccgacatcgcgtcgcagtacgcgcgcgtggagcaggagaacaccgtgctccgggcgcgcgccgccgagctcggcgaccggctgcgctcggtcaacgaggtgctccgcgtcgtcgaggagttcagcggcgtcgccatggacatccaggaggagatccccgccgacgatccgctgctccggccgtggcagctgccctaccccgccgccaccatgcccatcggcggcgcgcacatgctccagtactgatgactgatgaggatgcctctccacctgccatggaggcagctggaggttggcaagaaagaattggctgcattgaggactacataggagggctgtatctgctgctgctgtgttataatctgtattctggttcttcaataattgttgctgttgtttgtctgtgtgtaaaaaaaaaaaaaaaaaaaaaaaaaaaaaaaaaaaaaaaaaa

SEQ ID NO: 2556 - protein, 152 aa, Panicum virgatum
  misc_feature: Ceres CLONE 1781874
  misc_feature (5)..(50): Pfam Name: bZIP_2 Pfam Description: Basic region leucine zipper
  misc_feature (1)..(65): Pfam Name: bZIP_1 Pfam Description: bZIP transcription factor
MSSSSLSPAGTGRMSGSDGDSAADTHRREKRRLSNRESTRRSRLRKQQHLDELVQEVARLQAENARVAARAADIASQYARVEQENTVLRARAAELGDRLRSVNEVLRVVEEFSGVAMDIQEEIPADDPLLRPWQLPYPAATMPIGGAHMLQY

SEQ ID NO: 2557 - DNA, 948 bp, Panicum virgatum
  misc_feature: Ceres CLONE 1781884
  misc_feature: Encodes the peptide sequence at SEQ ID NO. 2558
ggcgtggcggccgcgataaaataaatcttgtgcagcgtgtggggagggcgtacggcgacgcggacgcaccgtcacagggctgcgcaatccctttctccctcttcttcttatcccaaaggcaagagccgcgtctccgagagtccagagggtgaggaggaggagagaggagggcgcgtcctgctgtggtccttgttcgttgctccacctccgctttccgtgatgtcgtcaccgagcaagcgccgcgagatggacctaatgaagctgatgatgagcgactacaaggtggagatggtgaacgacgggatgcaggaattcttcgtcgaattcaaggggccgaccgaaagtatctatcaaggtggtgtctggaaggttagggtggaattgcctgatgcgtacccttacaaatccccttccattggcttcatcaacaagatttatcacccgaatgttgatgaaatgtctggttccgtctgtttggatgtcataaaccagacatggagcccaatgtttgatctggtaaatgtttttgaagtgttccttccacagcttttactgtatccgaatccttctgatccattaaatggggaggctgctgcattgatgatgcgtgaccgccctgcgtatgaacaaaaagtgaaagaatactgtgaaaagtatgccaaatcagaggacgctggaataaccccggaagacaagtccagcgacgaggaacttagcgaggaggaagatgactccgcggacgaggctatacttggcaatcctgatccttagtctgcgttggaagctgcgctcccagctcatctatacaatgttcattgcagaaattgcaattaaacagaaactgaaaaactaaaaaaaaatctggatgtcatgtaaataagtgtcccctgtatgttatgcaatgctgttcctttcagtcggccggttcaaaaaaaaaaaaaaaaaaaa

SEQ ID NO: 2558 - protein, 183 aa, Panicum virgatum
  misc_feature: Ceres CLONE 1781884
  misc_feature (1)..(183): SWISSPROT Homolog: EC 6.3.2.19 Ubiquitin-conjugating enzyme E2-21 kDa 1
  misc_feature (1)..(183): SWISSPROT Homolog: EC 6.3.2.19 Ubiquitin-conjugating enzyme E2-23 kDa
MSSPSKRREMDLMKLMMSDYKVEMVNDGMQEFFVEFKGPTESIYQGGVWKVRVELPDAYPYKSPSIGFINKIYHPNVDEMSGSVCLDVINQTWSPMFDLVNVFEVFLPQLLLYPNPSDPLNGEAAALMMRDRPAYEQKVKEYCEKYAKSEDAGITPEDKSSDEELSEEEDDSADEAILGNPDP

SEQ ID NO: 2559 - DNA, 995 bp, Panicum virgatum
  misc_feature: Ceres CLONE 1781906
  misc_feature: Encodes the peptide sequence at SEQ ID NO. 2560
aaagcggcgaagacaagctcacgcgccgccggcgatgtatggcgcttccgaccccgccgccgcggagcgcacggcgttccggcgggcggagaagcagtacaagcgctacaagccggccaaactcaagggtaggtccaggtccaggagcaagccggccggcgttgagggaggcggcggtgacctctcggcggtggttgacttccacgcgctgcttgcggcctacggggagctgcccgccgggatctgccggagcgactgcgccgggttcgaccgccccgtgttctgcttcttggaccggccggcgcaactatgatgtatcacttccacacaagaagattccagatgccctagctagtcttgcaaaaaatatggctattccagctatgccttttggagaagaattcaaaccagaagctgctatagtgaattattatggtccaagtgatatgctcggtggccatgttgatgacatggaagcagattggacaaaacctattgtaagcataagtttgggttgcaagtgcatctttcttcttggaggaaagacaagagatgaagttccaacagcaatgttcctgcgaagtggtgatatagtattgatggctggggaagcacgagaacgcttccatggtgtaccacggatcttcacagaaagcaaccaacaagaaatctttgcactggtttcacaactatgtggtgaagatgaatgctttatcttggactatatcaagaattccaggataaatatcaacatcagacaggtttattgaagaccatattggttgcaggtttgcccatatttgtaatcaatggtgtgttttcggtggagttaggtgcatttgcagtagtccaatggttcgataagtggcatttggaatagcttaataggaattatcagaacaattagaatatatgcatcaaactatctacaattgtagcccccattggacaacattttttctataattcgccaacccgcggaagataacaaggct

SEQ ID NO: 2560 - protein, 243 aa, Panicum virgatum
  misc_feature: Ceres CLONE 1781906
  misc_feature (1)..(77): Pfam Name: 2OG-FeII_Oxy Pfam Description: 2OG-Fe(II) oxygenase superfamily
MALPTPPPRSARRSGGRRSSTSATSRPNSRVGPGPGASRPALREAAVTSRRWLTSTRCLRPTGSCPPGSAGATAPGSTAPCSASWTGRRNYDVSLPHKKIPDALASLAKNMAIPAMPFGEEFKPEAAIVNYYGPSDMLGGHVDDMEADWTKPIVSISLGCKCIFLLGGKTRDEVPTAMFLRSGDIVLMAGEARERFHGVPRIFTESNQQEIFALVSQLCGEDECFILDYIKNSRININIRQVY

SEQ ID NO: 2561 - DNA, 806 bp, Panicum virgatum
  misc_feature: Ceres CLONE 1781911
  misc_feature: Encodes the peptide sequence at SEQ ID NO. 2562
aaaaaaccctccggcccttcctccccaccgtcgtcggcgatctccacctacgtcgccgccgatggatctctccgacgtccaggccgccctctccgacaagtcctactcctctctagcccccctctgcgacgaactcctcctccaggccgcgtccaggggaaccaccaccgacgaatggccccacgccgtccacctcctcgcccatctgtacctcaacgacttgaacagcgcgaggttcttctggaagtcgctgccgcaggaggtgaaggacgcgcgtccggagctcgccgccgtctggaggatcggccagtgcctctggaatcgcgactacgctggtgtctacacggccgcacaggggtttgagtggggccctgaccttgctgacttcatcactgccttcctagaaagctacagaaagaggatattccagcttttaacttctgcgtattccacaatcagcgttgctgatgtggctcacttcatgggcatgagtgaggaggattctacaaactatgctgtgcaaaatggttggagtttggatgcagggaccaagatgcttaccgtcaagaaaccaaaggctcagaccaaccagaagcttgatgcaagcaaactgcagcgtttgacagagtgtgttttccatctggagcactgatgcacactggcaattgcaatgcatcccgggtgcttttctacaccaaaccttaaggatcatgcttattatgtgatagctagatgcctgaacgactaggttggttttggctggaaaggggagatctctcagtaccgaaaaaaaaaaaaaaaaaaaa

SEQ ID NO: 2562 - protein, 196 aa, Panicum virgatum
  misc_feature: Ceres CLONE 1781911
  misc_feature: Great-hit functional homolog of the protein sequence given in SEQ ID NO 9460
  misc_feature: Useful for making plants with modulated low light sensitivity
MDLSDVQAALSDKSYSSLAPLCDELLLQAASRGTTTDEWPHAVHLLAHLYLNDLNSARFFWKSLPQEVKDARPELAAVWRIGQCLWNRDYAGVYTAAQGFEWGPDLADFITAFLESYRKRIFQLLTSAYSTISVADVAHFMGMSEEDSTNYAVQNGWSLDAGTKMLTVKKPKAQTNQKLDASKLQRLTECVFHLEH

SEQ ID NO: 2563 - DNA, 1020 bp, Panicum virgatum
  misc_feature: Ceres CLONE 1781991
  misc_feature: Encodes the peptide sequence at SEQ ID NO. 2564
agccgcaccgcaagaagcgtcctcggggggcacgtccttgatcggtggcgcctgcctctcgccgccgctgctggtgcctctcccccaccacgccgcagatttttttttcttattttttcctcccgtcggttctcggaggtttctcgccgtctcctccccacgcggttcctgaggcatgcggagccagatcgtctgccacgggtgcaggagccttttactctacccgagaggtgctcccagcgtgtgctgcgcggtatgccacgcagtcaccaccgtgccacctccaggaatggagatggctcgacttatttgtggtggctgccaaacattattgatgtatactcgcaatgcaacaactgtaagatgctcatgttgtgacacagttaatcttgtcagaccagtgagtagcatagctcatgtgaactgtggccagtgccaaacagtgttgatgtatccatacggagcaccatctgtcaaatgtgctatctgcaactttattacaaacgttggtgggcatcaggtaccaaccgtgagacctttgccacctgcgctgcctgcatcaagtggaaattcatataacatcccgtcaacttctgcgccaacgagtcaatcacagaacataactgttgttgttgaaaatccaatgacagtagatgacaagggaaaattggtgagcaatgttgtagttggggttacaactggtgggaaaaagtaacatatcagaacccaatgtaactttgttaatgcttaatatctggagaagttgaaaataccttgtattatactgctgttcggtgattggttggtcgacaaaaggacccctgaagagcatcggggcaaagctcgcctttgcccctgcgatcatgccagaacgaatgaaaacgaagtgcgggtgtggatactcagaaactgtagcttgttacccttgattcttttgtatgtaatatgggctctgttagacttcactgtgtgatcaaactcctctcccgtgggtgcttgcaaaaaaaaaaaaaaaaaaaa

SEQ ID NO: 2564 - protein, 179 aa, Panicum virgatum
  misc_feature: Ceres CLONE 1781991
  misc_feature (1)..(25): Pfam Name: zf-LSD1 Pfam Description: LSD1 zinc finger
MRSQIVCHGCRSLLLYPRGAPSVCCAVCHAVTTVPPPGMEMARLICGGCQTLLMYTRNATTVRCSCCDTVNLVRPVSSIAHVNCGQCQTVLMYPYGAPSVKCAICNFITNVGGHQVPTVRPLPPALPASSGNSYNIPSTSAPTSQSQNITVVVENPMTVDDKGKLVSNVVVGVTTGGKK

SEQ ID NO: 2565 - DNA, 898 bp, Panicum virgatum
  misc_feature: Ceres CLONE 1782004
  misc_feature: Encodes the peptide sequence at SEQ ID NO. 2566
atcaaaaagcccacctccgtcgctactaccacccctttgctccgctccgctcctcgacgccgacgcaccaatcgaaccctcctccgcgacctcgccgcagctccggccatgtcgatcttcgagtacaacgggtccgccgtgatggcgatggtggggaagaactgcttcgcgatcgccagcgaccggcggctgggcgtgcagctgcagaccatcgccactgacttccagcgggtgttcaagatccacgacaagctatacatcggcctctcggggctcgccaccgacgcccagacgctgtaccagaggctggtgtttagacacaagctgtatcagctgcgggaggagagggacatgaagcccgagaccttcgccagcctcgtttctgcgctcctttacgagaagagatttgggccatatttctgccaaccagtcattgctggacttggagataacaatgagccgtttatttgtaccatggactgcattggggcaaaggaactagccaaggattttgttgtttctgggacagcatcagaatctttgtatggtgcttgtgaatccatgtacaagccaaacatggaacctgacgaactcttcgagactgtatcccaagctctgatgtcatcagtagatcgtgactgccttagcgggtggggaggatacgtgctgatcgtaatgccgactgaagtgagagaacatgtggtgaagggcaggatggactaaatcagcaccctagatttctttgccgctttccggtgctttgatgccggtatgttacctccggtctgacagcagtatctcggtgctgtgtttggattgtgaagtaacattgtatcatcacagttgatgttacattctctgagggaacatttgatttcaaaaaaaaaaaaaaaaaaaa

SEQ ID NO: 2566 - protein, 204 aa, Panicum virgatum
  misc_feature: Ceres CLONE 1782004
  misc_feature (1)..(204): SWISSPROT Homolog: EC 3.4.25.1 Proteasome subunit beta type 3
  misc_feature (1)..(204): SWISSPROT Homolog: EC 3.4.25.1 Proteasome subunit beta type 3-A
MSIFEYNGSAVMAMVGKNCFAIASDRRLGVQLQTIATDFQRVFKIHDKLYIGLSGLATDAQTLYQRLVFRHKLYQLREERDMKPETFASLVSALLYEKRFGPYFCQPVIAGLGDNNEPFICTMDCIGAKELAKDFVVSGTASESLYGACESMYKPNMEPDELFETVSQALMSSVDRDCLSGWGGYVLIVMPTEVREHVVKGRMD

SEQ ID NO: 2567 - DNA, 817 bp, Panicum virgatum
  misc_feature: Ceres CLONE 1782054
  misc_feature: Encodes the peptide sequence at SEQ ID NO. 2568
atgggacccaccacctgcagctccgtcccgtcatcaccagagggaggcagccgaaattaaataaacaaaatagattagactcgtcgatccatccacgccgcgggacaggtcgtttgatcgatcgatctcgcgccggatttcccgtctccacgctcgctcgtggactcgtgaggaaggacgaagggcgcggcaatggcggggagggccaacgttccgaccaacagctctgctctgatcgccatcatcgccgatgaggacacggtgactggctttttgttggctggagtcggcaatgtagatctgaggaagaaaacaaattatcttattgttgataacaaaacaacagtcaaacaaattgaagatgcatttaaggagttcaccgcaagagaggacattgcaattgttctcatcagccaatatgttgcaaacatgataaggttcttggtagatggctataacaagcctgttcctgctatactggagatcccatcaaaggatcatccatatgatccagcacacgactcagttctttctcgcgtgaagtatctattttctgctgaatcagtagcctcagatcgccgataaaaatcagatgccttcatgtatcttttgggccattttatatcgcctaccgccattgtgaaaataaagatgtatttggcatttgagattttttttatttgccacgagttgtacctgatgaatgtattcgttccatcaccgtgactgcacttcgtagcagatatcatagtgtattcttgactatgaataacatgccaatctcacattgctgattcaaaaaaaaaaaaaaaaaaaa

SEQ ID NO: 2568 - protein, 130 aa, Panicum virgatum
  misc_feature: Ceres CLONE 1782054
  misc_feature (1)..(101): Pfam Name: ATP-synt_F Pfam Description: ATP synthase (F/14-kDa) subunit
  misc_feature (14)..(125): SWISSPROT Homolog: EC 3.6.3.14 Vacuolar ATP synthase subunit F
MAGRANVPTNSSALIAIIADEDTVTGFLLAGVGNVDLRKKTNYLIVDNKTTVKQIEDAFKEFTAREDIAIVLISQYVANMIRFLVDGYNKPVPAILEIPSKDHPYDPAHDSVLSRVKYLFSAESVASDRR

SEQ ID NO: 2569 - DNA, 667 bp, Panicum virgatum
  misc_feature: Ceres CLONE 1782092
  misc_feature: Encodes the peptide sequence at SEQ ID NO. 2570
acgtaataacgtttgaagcttgagcaaagaaacaatggccacccgccaagccaccgcggccgccaccctcgcgttcctcctcgtcgccacggccaccgtctccgccgcggcggcgtcgccggcgtcgcgcaaggtgctgcattggaaggactacctggggtgcccgcgggacgccgtcaagttcggggcctgcgtcgtagcgctcggcgccgcgggcctgcaggccggcgcgcagctcgggaccaagtgctgcgacgtcgtgcaagggctcgccgccgccgaggccgccgcctgcttctgcaccaccatcaaggagaccgtgctcggcatccccacggagtggaccgtcggcgtcggggccctggccagcgcctgcaagacggagctgcccgacggcttcaagtgtgtctgacgacgatggtcacgtctcactagctagttcatgcacacacatcctctattcctcactgtgggctatggatagctcttggtgttgatgtgaaacctattggcttgctttcttgttcaaagtaacattgcattgcatcaccgtcctttattgccctatgctggttaattttgtcaaatttgtagccgtaaatttgtttgttctgcgtgacatgaagagtcgcttgctttaaaatacgaaaaaaaaaaaaaaaaaaaa

SEQ ID NO: 2570 - protein, 125 aa, Panicum virgatum
  misc_feature: Ceres CLONE 1782092
  misc_feature (1)..(82): Pfam Name: Tryp_alpha_amyl Pfam Description: Protease inhibitor/seed storage/LTP family
MATRQATAAATLAFLLVATATVSAAAASPASRKVLHWKDYLGCPRDAVKFGACVVALGAAGLQAGAQLGTKCCDVVQGLAAAEAAACFCTTIKETVLGIPTEWTVGVGALASACKTELPDGFKCV

SEQ ID NO: 2571 - DNA, 912 bp, Panicum virgatum
  misc_feature: Ceres CLONE 1782144
  misc_feature: Encodes the peptide sequence at SEQ ID NO. 2572
ttagcggaggacggcagcagcagcgggcaccgcacaccccagctaccacaaccctcagcaggcatcgcagctggtgggcacgcgacgagcgcaatggcgccggtgaaggtgttcgggccggcgaggtcgacgaacgtggcgcgggtgctggtgtgcctggaggaggtgggcgctgagtacgagatcgtcaacatcaacctcctggccaaggagcacaagggccctgagcaccttgccagaaacccgttcggccaggtcccggcgttccaggacggtgatgtgctgctcttcgagtcccgagcgatctgcaagtacgtgctccgcaagtacaagtcagcccaggccgacctcctgcgcgaaggcaacctccgggaggcggccatggtggacgtgtggacggaggtggaggcgcaccagtacaacccggcgctgtcgcccgtggtgtacgagtgcctcatcgccccggccatgcgcggcgtccccaccaaccagaaggtggtggacgagagcctggggaagcttcgcaaggtgctcgaggtgtacgaggcgcgcctggccaccagcaagtacctcgccggggacttcctcagcttcgccgacctcaaccacttcccccacaccttctacttcacggtgacgccgcacgcgccgctcttggattcgtacccgcacgtcaaggcctggtgggagaggctcatggcgaggccgtccatgaagaagctcggcgccaccatggctgcggctgccggtgccaacaagccttgatcgcacaggacctcacgcacgcttaatgctgattcaatatatgtattgctcaactcatccataatgtacatgcggcggctttgtgtgcgcttggtttgtcgttgaataaaattgtactagcttggttaaaaaaaaaaaaaaaaaaaa

SEQ ID NO: 2572 - protein, 223 aa, Panicum virgatum
  misc_feature: Ceres CLONE 1782144
  misc_feature (1)..(76): Pfam Name: GST_N Pfam Description: Glutathione S-transferase, N-terminal domain
  misc_feature (1)..(97): Pfam Name: GST_C Pfam Description: Glutathione S-transferase, C-terminal domain
  misc_feature (1)..(210): SWISSPROT Homolog: EC 2.5.1.18 Glutathione S-transferase 1
  misc_feature (1)..(218): SWISSPROT Homolog: EC 2.5.1.18 Glutathione S-transferase I
MAPVKVFGPARSTNVARVLVCLEEVGAEYEIVNINLLAKEHKGPEHLARNPFGQVPAFQDGDVLLFESRAICKYVLRKYKSAQADLLREGNLREAAMVDVWTEVEAHQYNPALSPVVYECLIAPAMRGVPTNQKVVDESLGKLRKVLEVYEARLATSKYLAGDFLSFADLNHFPHTFYFTVTPHAPLLDSYPHVKAWWERLMARPSMKKLGATMAAAAGANKP

SEQ ID NO: 2573 - DNA, 807 bp, Panicum virgatum
  misc_feature: Ceres CLONE 1782225
  misc_feature: Encodes the peptide sequence at SEQ ID NO. 2574
aagcttcttcctcccctcctcgctcctccccaagctcgtcacatctccccattctcaccgccccgctccgtgctcgccgttctcccctcgctccgttggattaggggggtcttcctctgctcgccggagctcggagctcgtcccccccatggcggatgaagaggtatctgatccaaaggcgctccttgaggaacactcaaaggctaagtgtgtgtcacagtggtacgaatatcagaaatgtgtcaagagaattgaaaatgacgagactgggcacaagcactgtactggccagtacttcgattactggaaatgtgttgacaagaatgttgctgagaaactctttgatctgctaaaatgacaaggaaaatgccctctttcaattttctactcaaaattgggaacttggaagagccgaagaaaggtagcatgcgctatcgttgtcagcactcaacgcagagagcatcatgcatcagtatgctatttcagtgtgccctgcttctggtttgctcttcctgcgagagcagcagcagccgtgcctttttatttattaattttgatagctaactttacttcgctcagatgttatcacacaccaaatttggtggaaacatggagcgttagtaactgctccctcgttcaaagtttgggttgttatgcaaaatctagatacatagtttttgttatgtagtaggcatagcattcttctcgatgtatagacaaagttatgtatttagatttgctaagatgatctacattttgaaatggagggagtagcaaatttaggattaaaaaaaaaaaaaaaaaaaa

SEQ ID NO: 2574 - protein, 69 aa, Panicum virgatum
  misc_feature: Ceres CLONE 1782225
  misc_feature (1)..(69): SWISSPROT Homolog: EC 1.10.2.2 Ubiquinol-cytochrome c reductase complex 7.8 kDa protein
MADEEVSDPKALLEEHSKAKCVSQWYEYQKCVKRIENDETGHKHCTGQYFDYWKCVDKNVAEKLFDLLK

SEQ ID NO: 2575 - DNA, 954 bp, Panicum virgatum
  misc_feature: Ceres CLONE 1782302
  misc_feature: Encodes the peptide sequence at SEQ ID NO. 2576
gacagctagcgcgatcgtcatccgcccccgcccccaggctcaactgctcgcggcgaggcaacacccgccccctcttcccctcctcctccgccgccacctcctcgctgacgcgcgcatacgtccacggcacgatcgggccgaccaatcgcgcgcggcggctctggtgggaatgggtctcctcgaccagctctgggacgagacggtggccggcccgcgcccggactccggcctcggcaggctccgcaagtacgcctccttctcccactcgtcgtcgtcgtcctcgccggcgcccgcaatgacgcgcagcttcaccatcggcggcccgccatcgctgtccgtcgaccaccagtcgccgcgcggcgagtcgccctacagctcctccgtcccgtcctccccggccagcgcgccggactccccgttcgccgcaactacgcccaaggctgatggctggagcaggcttggccggaaacccaaggcctccgacgggccggagccggccatcgggccgaggagccccaccgtgtacgactgggtggtgatcaacttggaataagcaatcgagcggaggacgtacagagagaaagctagctagcgtgtgtgtgtgtgtttgcctgcaagttcgaggctgcgtcgtgtttccgtacatgctccgtgttcttccgaaaccgtgcctgtctgggctggcacgtggagtagtagtatatctagctagggacctggtaggatgatgatgatgatgatgatcagttcgtgggggttggaagttggcggcgatccgatccagtctagttctgccttgggcaagatgcgttttgttcggttcttcgatctggggaagaactctgaaatgaggatgtcgtgtacgcccgcctgctttgtttttctaccctcccctgtaattacctagtactgtgttcaatgcaaagcatggctctgctttcttctgctcgtccg

SEQ ID NO: 2576 - protein, 127 aa, Panicum virgatum
  misc_feature: Ceres CLONE 1782302
  misc_feature (1)..(23): Pfam Name: Auxin_repressed Pfam Description: Dormancy/auxin associated protein
MGLLDQLWDETVAGPRPDSGLGRLRKYASFSHSSSSSSPAPAMTRSFTIGGPPSLSVDHQSPRGESPYSSSVPSSPASAPDSPFAATTPKADGWSRLGRKPKASDGPEPAIGPRSPTVYDWVVINLE

SEQ ID NO: 2577 - DNA, 939 bp, Panicum virgatum
  misc_feature: Ceres CLONE 1782310
  misc_feature: Encodes the peptide sequence at SEQ ID NO. 2578
aaagccaggccaggccagccagcgagagccaagccgcactgcctccccgagtcctccactgccaccgcccgctccgcgacgcgatggccgcgctccgcctcgcctccttcaccctccgcccggcctccgcggcggtatccccctcctccggcgcggcgccgcggtccgcctccttcgccagtgcggcgcggaggctcccctcgctccgcctggccccgccccgccgccgcggggacctcgccaggccccgcgccgcggccgacgccgcggcggagggctacgcgaccgcgctgtccgaggtggccgccgagaacggcaccctcgagaagaccgtgtccgacatggagaagctggagaagatcttcgccgacgaggccgtcgccgagttcttcgacaaccccaccgtgccgcgcgaggtgaaggcccagctcatcgacgagatcgccaagtcgtccgagctgcagccgcacgtcgtcaacttcctcaacgtcgtcgttgacaacttccgcgcgggcatcgtgccgcagatcgtcgccgagttcgagaacgtctacaacgcgctcagcggcactgagctcgccaccgtcacctccgtcgtgcagctcgaatcgcaggacctcgcgcagatcgcgcagcacgtccagaagatgaccggcgccaagaacgtccgcctcaagacacagctcgacccggagctcatcgccggcttcaccgtgcagtacggccgcgacggatccaacctcatcgacatgagcgtccggaagcagattgaggagatcgcctcagagttcgagttgccctccgttgccctcgaagtctgatccggctttaggcgtcaatcctcgcccttgaagcctaggtccatcctgctccccctgctcttcttctgtatcattctctagttgaatgagtgatgaatactatataactggattccgg

SEQ ID NO: 2578 - protein, 245 aa, Panicum virgatum
  misc_feature: Ceres CLONE 1782310
  misc_feature (1)..(175): Pfam Name: OSCP Pfam Description: ATP synthase delta (OSCP) subunit
  misc_feature (1)..(245): SWISSPROT Homolog: EC 3.6.3.14 ATP synthase delta chain, chloroplast precursor
MAALRLASFTLRPASAAVSPSSGAAPRSASFASAARRLPSLRLAPPRRRGDLARPRAAADAAAEGYATALSEVAAENGTLEKTVSDMEKLEKIFADEAVAEFFDNPTVPREVKAQLIDEIAKSSELQPHVVNFLNVVVDNFRAGIVPQIVAEFENVYNALSGTELATVTSVVQLESQDLAQIAQHVQKMTGAKNVRLKTQLDPELIAGFTVQYGRDGSNLIDMSVRKQIEEIASEFELPSVALEV

SEQ ID NO: 2579 - DNA, 1021 bp, Panicum virgatum
  misc_feature: Ceres CLONE 1782370
  misc_feature: Encodes the peptide sequence at SEQ ID NO. 2580
agccaaatcaatccaacccatagccaccggaagatgagcgctccagctcctcctcttcccgcaccgctctcccgcttctgctcctcggccccgcgcctcctcctctcttcttcctctcgcgcgccggccgcctctcgcccgcctcgggccgtcgtccgctccgtctccgtctccgtctccgttgaggcgccggcggccgccgcggagccggcggtcgcgggcgggccctccgcgacgccgcgccgccgcctcatcctcctccgccacggggagagcgccgccgggggccgctccaccagagatcatgacagacctctaagcaaggctgggagagctgacgcaatcagcgtttctaataaactccaacagatggggtggatacccgagcttatcctgtgcagtgatgcaatgcgcacaaaggaaactcttaagatcctgcaagaacatgttcagggattgtctcaagcagtggtacacttcatcccaagtttttactcaattgcagctatggatggccaaactgcagagcatttacaaaaggcaatctgtgaatattcgagcgacgagatcttaactgtcatgtgcatgggtcataataaaggatgggaggaagcagcctctatgttttctggcgattcagttgttcttgagacatgtaacgcggcgctgctagaagctgcagggaaatcatgggttgaggctttttctctgtctggtcttgggggatggaagcttcatggaatcgtaaagccatgaattattgtaactaaaagctagatgtaattttttgtagcttaattctcagtttgccccgtggcctgtatgtagctcttttcttccatgtccgtgaaggtattagcgtggatagatagatgatcactactgcagaaaacgtttctaggggcgggtagattggcgttttcaggggcaggcgcgccacccatccttgtctcacgcagctagaaatcaagttttccaggagcaggtaaagggcccacctttaaaaaaaaaaaaaaaaaaa

SEQ ID NO: 2580 - protein, 240 aa, Panicum virgatum
  misc_feature: Ceres CLONE 1782370
  misc_feature (1)..(123): Pfam Name: PGAM Pfam Description: Phosphoglycerate mutase family
MSAPAPPLPAPLSRFCSSAPRLLLSSSSRAPAASRPPRAVVRSVSVSVSVEAPAAAAEPAVAGGPSATPRRRLILLRHGESAAGGRSTRDHDRPLSKAGRADAISVSNKLQQMGWIPELILCSDAMRTKETLKILQEHVQGLSQAVVHFIPSFYSIAAMDGQTAEHLQKAICEYSSDEILTVMCMGHNKGWEEAASMFSGDSVVLETCNAALLEAAGKSWVEAFSLSGLGGWKLHGIVKP

SEQ ID NO: 2581 - DNA, 1087 bp, Panicum virgatum
  misc_feature: Ceres CLONE 1782386
  misc_feature: Encodes the peptide sequence at SEQ ID NO. 2582
aaaaaaaccagcagcgcctatcgttgtatccgccggccgcgcctgggagctgaaatgggctccggttcactgcctacgcggccttctccgtcggcgttgtcgccgccgtggcccatccccggccgcgcgcgccctcctcgcctctgcagcctcggcacaggcaagctcagggccttttccatcaaagcaagtcatagtggtctgagcgaagtatctgtacagagccttcctgatactgaagttaccggtgctgcttacagcttcactggagcaacgacatcacttaccaacaagattctaacctcgtccaagaagattactcttgttagacatggcttgagctcatggaatgcagaaagccgtgtccagggaagctcaaatctgtcggtgttaacagaaaccggtgccaagcaggcagagaaatgtcgtgatgctcttgcaaacatgaagtttgacgtttgcttctctagtcctatctcacgagcaaagtcaactgccgaaattatttggcaagggaaggaagaaccccttgtttttctcaattcactgaaggaggcacacctcttctttttagagggcatgaccaatgcggatgctaagaagcaatacccagagttgtacaccaaatggagggaggaccctgcaaactttcatgttaatggcatatacccgattagggagttgtggggaacagcaagacaagcctgggagcagatcttgctcactccgggtgaaaacttcttggtggttacgcacaaatctattttgcgtgcactcatctgcacagcactaggtctccctcctgagaggttccgtgccattgatgtaaacaatggtggcatgtgtgtcttcacggtcaacaaacaaggagaagctatgcttcaagccctcaatatgacagcacacatgtacagtgatcacacgtatcagtactagttagtttcccctcactctgcattgtattatatttcctaccctgtatctgtatattacacttccattagacaagtcattcttcaaatgattttggtaaacgtgaccatagtgcacataacgataggttacacaaaaaaaaaaaaaaaaaaaa

SEQ ID NO: 2582 - protein, 293 aa, Panicum virgatum
  misc_feature: Ceres CLONE 1782386
  misc_feature (1)..(155): Pfam Name: PGAM Pfam Description: Phosphoglycerate mutase family
MGSGSLPTRPSPSALSPPWPIPGRARPPRLCSLGTGKLRAFSIKASHSGLSEVSVQSLPDTEVTGAAYSFTGATTSLTNKILTSSKKITLVRHGLSSWNAESRVQGSSNLSVLTETGAKQAEKCRDALANMKFDVCFSSPISRAKSTAEIIWQGKEEPLVFLNSLKEAHLFFLEGMTNADAKKQYPELYTKWREDPANFHVNGIYPIRELWGTARQAWEQILLTPGENFLVVTHKSILRALICTALGLPPERFRAIDVNNGGMCVFTVNKQGEAMLQALNMTAHMYSDHTYQY

SEQ ID NO: 2583 - DNA, 855 bp, Panicum virgatum
  misc_feature: Ceres CLONE 1782422
  misc_feature: Encodes the peptide sequence at SEQ ID NO. 2584
ctgagagtctgccagcagcccagcacccagcctctcgcctcgcggcgtgctcgctggcggttggtggtagtagtagggttctagccatggcgtggagcgccgccgccgtctccaggtttgccgcgggctccccggccgcagcgcccgtccccgccaggctcggcgccgccgcctcctcgctctccttcgccggggcgcgcggccgccgcttcgcccccgtcgccgcgtccctctccacctccgcgaccgctttaaaggaggctgttcagacagagaaggcaccggctgcactaggcccttattcccaggccatcaaagcaaacaatcttgtgtttgtttctggagttcttggtctgaatcctgagacagagaagtttgtctctgaaagcgttgaggagcaaactgagcaggtaatgaagaacatgggtgaaatattgaaagcaagtggcgctagctatgcttcagtggtgaagacaacaatcatgttggctgatctgcaggatttcaagaaagtgaacgagatctatggcaaatacttcccagcacctgcacctgcccgctcaacctatcaagtggcagcactgccactgaacgccaggattgagatcgagtgcatcgccgctctctgagcatatcattcggccagctgtcgaaccatcaataagcattccaacccagtcgatgtagttgttctctttcctgggatgcactactcttaggaatttatggtacagatcttgaaaactggcatataataaactttggataagtggtgtggtggcttcgatcacctcgctctccgtgtgatccatgctaaattgctaatgttttttctaaaaaaaaaaaaaaaaaaaa

SEQ ID NO: 2584 - protein, 180 aa, Panicum virgatum
  misc_feature: Ceres CLONE 1782422
  misc_feature (1)..(119): Pfam Name: Ribonuc_L-PSP Pfam Description: Endoribonuclease L-PSP
MAWSAAAVSRFAAGSPAAAPVPARLGAAASSLSFAGARGRRFAPVAASLSTSATALKEAVQTEKAPAALGPYSQAIKANNLVFVSGVLGLNPETEKFVSESVEEQTEQVMKNMGEILKASGASYASVVKTTIMLADLQDFKKVNEIYGKYFPAPAPARSTYQVAALPLNARIEIECIAAL

SEQ ID NO: 2585 - DNA, 689 bp, Panicum virgatum
  misc_feature: Ceres CLONE 1782428
  misc_feature: Encodes the peptide sequence at SEQ ID NO. 2586
aaaaaaaaaaaagtctccgctcttatcccccgcggcgcccctgcctttcctcttcgtctccgccgccgccgtcgtcgcctcccacccgcgagcgcgccactttcccggcggatcgggacctctgctcggcgcggtccatccatggcggaggaatcaggtcgccccttgcctaagttcggtgaatgggacgtgaacgacccagcttccgctgatggattcacagtgatattcaacaaagccagagatgagaagaagggtggcaatggacaggagactgattctccttccaaggacaccaggaccgagagggtggaatcttacgctgccaagccgaactcgaagaaatggttttgctgtgtgacagccagccccacacaatcctgaggaagacgatctcacccgctcgcgggaatactgcccctttaatttttccatacatactatccataagacagtgtagaggtgcccagcgctctccgggctccaggatgggtacctcgtaaaactctggagtgcgtgtatgtatgtgtgtgtgagggttgtcggcacaaatttgaaaattggacttctgagttctgattgtaattgtagtcaccgtctgtcttatatttgttggtctcgctgcctgaggctgactgcctgagtgatggatggtgctcttctactgccaaaaaaaaaaaaaaaaaaaa

SEQ ID NO: 2586 - protein, 80 aa, Panicum virgatum
  misc_feature: Ceres CLONE 1782428
  misc_feature (1)..(73): Pfam Name: NOI Pfam Description: Nitrate-induced NOI protein
MAEESGRPLPKFGEWDVNDPASADGFTVIFNKARDEKKGGNGQETDSPSKDTRTERVESYAAKPNSKKWFCCVTASPTQS

SEQ ID NO: 2587 - DNA, 700 bp, Panicum virgatum
  misc_feature: Ceres CLONE 1782431
  misc_feature: Encodes the peptide sequence at SEQ ID NO. 2588
acgttggatcaaggacaccgccgcccgagagcccctccccgatccccaagaggcaagagcagcagcagcagcagcgagccatggccacctcgaccgccgccgtgctgtccccgccgtccgtggcggggctccgcctggcgccgtcgccccgggcgcgcgtgtcgttccgcgcggcgccggtgaggcggaggtccgtggcggcgcgggcggagctgagcccgtcgctggtgatcagcctcagcacgggggtgtcgctcttcctgggccgcttcgtcttcttcaacttccagcgggagaacgtggccaagcaggtgcccgagcagaacggcaagacgcacttcgaagccggcgacgagcgcgccaaggagttcgccgccctgctcaagtccaacgaccccgtcggcttcaacctcgtcgacctcctcgcctggggctcgctcggccacatcgtcgcctactacatcctcgccacctccagcaacggatacgaccccaacttcttctgagcgcggggcggtgtccctgacgggcttgctgtaatctaagactcggtcactgtgttggtgtttgctgcgttttggtgatgtatctggtgccggaaagattggttaatttggacaagtagtgcgactgcgtgtgtatattgccgcatgaatttgatcttcatctgtgtctctgtgaaaaaaaaaaaaaaaaaaaa

SEQ ID NO: 2588 - protein, 141 aa, Panicum virgatum
  misc_feature: Ceres CLONE 1782431
  misc_feature: Great-hit functional homolog of the protein sequence given in SEQ ID NO 9745
  misc_feature: Useful for biocontainment applications
  misc_feature: The plant produces a reduced number of seeds.
MATSTAAVLSPPSVAGLRLAPSPRARVSFRAAPVRRRSVAARAELSPSLVISLSTGVSLFLGRFVFFNFQRENVAKQVPEQNGKTHFEAGDERAKEFAALLKSNDPVGFNLVDLLAWGSLGHIVAYYILATSSNGYDPNFF

SEQ ID NO: 2589 - DNA, 950 bp, Panicum virgatum
  misc_feature: Ceres CLONE 1782655
  misc_feature: Encodes the peptide sequence at SEQ ID NO. 2590
atccccacctcccttatctcccgcgctctcctctttcccaccgttagcctcctccaccatggctgccctcggcatcacctccccgccggcgccgtccgccttcgcgtccgcaacatcgtcctgctcccactcttcgcactccatcccccgcccccgcccccgcccccgcctccgcctccgcctccgctccctccccacccggttcgcggctgcggcgtcgttccgcgcgcggtgcgccgccgccgcagccggcggggccgcgggctcggagggcgccgccgcggtggccgaggtggatgaggcgggaaccgacgtcgccgggggcgccgcgacctccacgcggccgccctactcgctcatctccgcggagaatgtgcagaaggcgatgcgcggcctcgctattacagatgctgatcactatgggaggcttggagtcacaagactagcttctactgatgaggtaaacgccgcctatgagaaaaggtgtgaagaactaaatagcaaaaaactggaagaggaggagctcaacaaggaacttgacctcctaaaggaatcatttaccatactatcaactgaggaagagcgaagattatacgattggagcatatccagaagtgggcaacctgagcgatatgtctggccttttcaagtagatcccttggagtcggcaccggatcctccacaggaacccgaagacgaggtcccgacaaagctcgttggctacttcttcctggcgtggttcatactctctgttgtgttctcggtgaccctcaacagatgaaggacatgacatctcgccccctgcaaaagatgaactgcaaccccaataccgtatatcttccatgtatgaatgctgtacatgacagacatactgttaatggtaatagttaactggagcacatagctgcacattctatacagatcacgctcaaaaaaaaaaaaaaaaaaaa

SEQ ID NO: 2590 - protein, 240 aa, Panicum virgatum
  misc_feature: Ceres CLONE 1782655
  misc_feature (1)..(62): Pfam Name: DnaJ Pfam Description: DnaJ domain
MAALGITSPPAPSAFASATSSCSHSSHSIPRPRPRPRLRLRLRSLPTRFAAAASFRARCAAAAAGGAAGSEGAAAVAEVDEAGTDVAGGAATSTRPPYSLISAENVQKAMRGLAITDADHYGRLGVTRLASTDEVNAAYEKRCEELNSKKLEEEELNKELDLLKESFTILSTEEERRLYDWSISRSGQPERYVWPFQVDPLESAPDPPQEPEDEVPTKLVGYFFLAWFILSVVFSVTLNR

SEQ ID NO: 2591 - DNA, 1068 bp, Panicum virgatum
  misc_feature: Ceres CLONE 1782663
  misc_feature: Encodes the peptide sequence at SEQ ID NO. 2592
gagacggcaaggcagcgagcagccgaagccgttccccgccgcgccatggaccgcgcgcagctcctcctcgtcggcctcccggccctgctcttcttctccgacctcacccacatcttcgcgccgccgcctccccacctccgccacccgcatcaccacccccctcaccaccatccgcacccgccgcaccatccccatccccacccgccgcaccaccatccgcacccgccgcaccaccatcaccaccccgaccccgccgcggcagccatacaggagccacgcgtggatggggctggattcggcgccacagttgagctgcagttctgcgcctcctgctcctacaggggaactgcaatgaccatgaagcgcatgttggaaacctcatttccgggcattcatgttatcttgcataattatcccccacccttccccaagcgtgtacttagcaaagttatcccaattgtacaagttggagcagttgcaacaataatggctggtgatcagattttccccagacttggaatggttccacctccatggtactactcactacgcgccaatagatttggaactatggcaacaatctggctatttggcaattttgctcagtcctttctacaaagctctggtgccttcgaagtttactgtaatggagagctggtgttctcaaaactgactgagcagaggttcccaagtgagttcgagctgcgtgatctcattggcagcagattgcctgagtcgccatttgggaggaatctggggaaaacgtggacatgatcccagaaactggagctcagaatgccccattttcatctgttgcaatttaggtattagtaggtggtaacgttcagatgttgatctattaaagctgcacagcttttctgtattccggatatgtggcttgtataatggatcgcctgggtacctgacgggctgacatcaccgttatgtgacatgcataaaccgctgggatattaggggacattgtgaccacggaccacctgataacttctgggccctttgtaatatgctggagtactacattggcaacaaaaaaaaaaaaaaaaaaaa

SEQ ID NO: 2592 - protein, 242 aa, Panicum virgatum
  misc_feature: Ceres CLONE 1782663
  misc_feature (35)..(72): SWISSPROT Homolog: EC 2.7.11.24 Serine/threonine kinase NLK
MDRAQLLLVGLPALLFFSDLTHIFAPPPPHLRHPHHHPPHHHPHPPHHPHPHPPHHHPHPPHHHHHPDPAAAAIQEPRVDGAGFGATVELQFCASCSYRGTAMTMKRMLETSFPGIHVILHNYPPPFPKRVLSKVIPIVQVGAVATIMAGDQIFPRLGMVPPPWYYSLRANRFGTMATIWLFGNFAQSFLQSSGAFEVYCNGELVFSKLTEQRFPSEFELRDLIGSRLPESPFGRNLGKTWT

SEQ ID NO: 2593 - DNA, 1111 bp, Panicum virgatum
  misc_feature: Ceres CLONE 1782767
  misc_feature: Encodes the peptide sequence at SEQ ID NO. 2594
agggacgtggaaaaaccaaaccaccaaccaaccagcagggcaccgagccgtcgaagcttctgggccacgccgccacaaaaggggaaggaagacaaagccctcgcccccgatgcctccgctcctcacctcacccgcctcctcccccctccgcctcgcctctcgcctcggcgccctccacggccccgggcccctcctcctccaccaccgcgccgccgcagcctcggtccacttcctcgcgccgcgcaggaagacccgcccggccccggcgatgagctggctggggaagctgggcctgagcgggctgggcggtagcccgcgcgcgtcggaggcgtcggcggcgctggcgcagggccccgacgaggaccagcccgcgcccgggaacgagttcgcgcagttcggcgccgggtgcttctggggcgtggagctcgcgttccagcgcgtcccgggggtcacgcgcacggaggtgggctacagccaggggaacctccacgagcccacctacgaggacgtctgcaccggcgccaccaaccacaacgaggtcgtccgcgtgcagtacgacaccgccgcctgcaagttcgacgacctcctcgacgtcttctgggcgcgccacgaccccacgacgcccaatcgccagggcaatgatgttggaacccagtataggtcagggatctattactacaccccggagcaggaaaaggcggtgagagaatccctggagaagcagcagaagcttctgaaccggaagatagtcacagagatccttccggccaagaggttctacagggcagaagagtatcaccagcaatacctcgagaagggaggccgtttcgggttcaggcagtctgcagctaaggggtgcaacgaccccatccgttgctacggatgagagcaaaatggtccacctcgtatctcgcggctgaataaagatgcatcagagccagattttctactactttcctatctttgttttgccacttgaacggcggtaagaattagctgtaccatggtacctgcaatgattcgtgtaaagacgaccttaccaccaggtttgggaacataatagtccatatgagtacaatttaagctgaaaccaaaaaaaaaaaaaaaaaaa

SEQ ID NO: 2594 - protein, 258 aa, Panicum virgatum
  misc_feature: Ceres CLONE 1782767
  misc_feature (1)..(154): Pfam Name: PMSR Pfam Description: Peptide methionine sulfoxide reductase
  misc_feature (6)..(258): SWISSPROT Homolog: EC 1.8.4.11 Peptide methionine sulfoxide reductase
MPPLLTSPASSPLRLASRLGALHGPGPLLLHHRAAAASVHFLAPRRKTRPAPAMSWLGKLGLSGLGGSPRASEASAALAQGPDEDQPAPGNEFAQFGAGCFWGVELAFQRVPGVTRTEVGYSQGNLHEPTYEDVCTGATNHNEVVRVQYDTAACKFDDLLDVFWARHDPTTPNRQGNDVGTQYRSGIYYYTPEQEKAVRESLEKQQKLLNRKIVTEILPAKRFYRAEEYHQQYLEKGGRFGFRQSAAKGCNDPIRCYG

SEQ ID NO: 2595 - DNA, 783 bp, Panicum virgatum
  misc_feature: Ceres CLONE 1782790
  misc_feature: Encodes the peptide sequence at SEQ ID NO. 2596
agagggcacggggttcccgaggccaagtcgttgcatcacctttccggctttcccctcctccgtccccgtcgctcgccagtcgcctcgcattccgttcgtcgggcgcgccgccaaccaagttttttaagcgagaccaactcaggaaacccagtgatctgtttggggactaatcaaactcaacaagcgagtttcatgtctgatctcgacgtccagcttccgtctgcttttgatccgtttgcggaggcaaatgctgaggactccagcgctggtgctggatcaaaggactatgtgcacgtgcgcactcagcagcgcaacggaagaaagagtctgacaactgttcagggcttgaagaaagagtacagctataacaaaatcctcaaggatctcaaaaagaagttctgctgcaatggtactgtagtccaggatccagagctaggccaggttattcaactgcaaggtgatcagcgtaaaaatgttgctactttcctagtccaggctggaatcgcaaagaaagagagcatcaagattcacggattttaggcagcagcatatgtgtggtatcatatgatacaagtattcaaggtttctttagcttggaagtcgtaatatcagtagtcgtatgaacctttgtgtcgctactggattgagaaagtctactattgaatgcaagttgtccttgcagtatggtttgtaagtgttacctgcgtaaaagtattgtgcccctcctattgaataacaatacagattgctggttgggttcttcaaaaaaaaaaaaaaaaaaaa

SEQ ID NO: 2596 - protein, 115 aa, Panicum virgatum
  misc_feature: Ceres CLONE 1782790
  misc_feature: Great-hit functional homolog of the protein sequence given in SEQ ID NO 9555
  misc_feature: Useful for making plants with modulated biomass
  misc_feature: Useful for making plants with modulated flowering time
  misc_feature: The plant flowers significantly earllier than wild-type.
  misc_feature: The plant is abnormally small.
MSDLDVQLPSAFDPFAEANAEDSSAGAGSKDYVHVRTQQRNGRKSLTTVQGLKKEYSYNKILKDLKKKFCCNGTVVQDPELGQVIQLQGDQRKNVATFLVQAGIAKKESIKIHGF

SEQ ID NO: 2597 - DNA, 789 bp, Panicum virgatum
  misc_feature: Ceres CLONE 1782795
  misc_feature: Encodes the peptide sequence at SEQ ID NO. 2598
acgggcttatgtgttcgttcactccactgagctagttaatgcgctgagggatgatgttagcaggcaggagttgcaggctggccgtgatggccctgctgctgctccctgcgctgcttggtgatgccagcagcggcagcagcggcgccgtcgagcccgagacccagctgtctgctgcggggtgccgcggtgctcgccagccgcccggcggcgttccggcggcgggcactacttggcctccgcgtgcggatgccgttgtggcaaaggagggaggctgcggcaacgacttcgcctgcttcacgacgatccaacaagctcttaaggcagcaccggatctcgtgccatgcgagaagcagcgctacgttgtcctcgtcaagtccggcgtctctgaggaaccgttcatcaaaataacaaggaaaaacgtcatgttgctcggggagggagctgacaggaccgtgataactgggagtaagagcaacggcacgcaaaccctcatggaccagacagcgaccgtcaacgttgatccatctgaggagccccagtactagtacccggagcagctatcttctgagcagtttgagcagtagtaggagcagttcaaggaagttcctgccgacgcgagggagttcacccggagctaccggagtacgaggacttctaggcgttcatctcccagtcgacgtccctatggcgccctgcttccgagagtttctcgtatatgttttacgcttccgcatactttgtatcagtcattttgtcattaatgtaataaataacattcgtattcgcttt

SEQ ID NO: 2598 - protein, 164 aa, Panicum virgatum
  misc_feature: Ceres CLONE 1782795
  misc_feature (3)..(86): Pfam Name: Pectinesterase Pfam Description: Pectinesterase
MMLAGRSCRLAVMALLLLPALLGDASSGSSGAVEPETQLSAAGCRGARQPPGGVPAAGTTWPPRADAVVAKEGGCGNDFACFTTIQQALKAAPDLVPCEKQRYVVLVKSGVSEEPFIKITRKNVMLLGEGADRTVITGSKSNGTQTLMDQTATVNVDPSEEPQY

SEQ ID NO: 2599 - DNA, 1074 bp, Panicum virgatum
  misc_feature: Ceres CLONE 1782815
  misc_feature: Encodes the peptide sequence at SEQ ID NO. 2600
acctgagagtggccaccttggacaaagacgtagaggtccaacaaaggccttcagcctagacggacgtgccaccatgacgacgctgctctcacactccccgtctgccactaccatccgtagctcagcttcagcaccgccgtcaccggctcggtcccaccgctcacgcatcctgcttccacacgcgctctccgacttggccagcgcgggcgccgacctcgcggcggccgaggcgcttattctcccgagcgggctgcggccggagttgatgccgcggcacgtcgggctgaacacagacgggaataggcggtgggcgcgcgcgcgggggctgacgcccctggacggccacgcggccatgttccgcaacctggagccgatcgtggggctctcccgcgcttggggcgtccgtgcgcttaccgcctacgtctgctccttccagaacttgcgccgtggcaaggccgaggccgaaaacttgatgtgttgttgcgagcgtttcatcggcgacaacgtctacaacttttcaaggcaggatatccggctgcaggtcatcggcgacacctcaaagatgccgggttctctgcggcgcgccgccgcggaagccgacgaggccacgaggcacaactcacagttgcacgtgatgctagcgttctgctacacggggcagtgggacatggcccaggcgtgccgagagctcgcccgggcggtgcgggcgaacgagctcagcccggacgacatcaacgagtcgcacctcgccggcaagatcgcgaccagccccgccggcgagttctccgacatcgacttggtcatcaggaccggcggcgacttgcggctgagcaacttcccgctgtggcaggtggcgtacgcggagtttttcttcaccgacaagaagtggcccgactttggggcggctgactaccttgaagccttgcgctccttccagagcagagatcggcggttcggtctctagctagctccatgatgcaaacaagagtaccatcgaaagggcatgtttaagtcgttcaaataataatcagagagtagtcgtggttatgactacaaaaaaaaaaaaaaaaaaaa

SEQ ID NO: 2600 - protein, 296 aa, Panicum virgatum
  misc_feature: Ceres CLONE 1782815
  misc_feature (3)..(226): Pfam Name: Prenyltransf Pfam Description: Putative undecaprenyl diphosphate synthase
MTTLLSHSPSATTIRSSASAPPSPARSHRSRILLPHALSDLASAGADLAAAEALILPSGLRPELMPRHVGLNTDGNRRWARARGLTPLDGHAAMFRNLEPIVGLSRAWGVRALTAYVCSFQNLRRGKAEAENLMCCCERFIGDNVYNFSRQDIRLQVIGDTSKMPGSLRRAAAEADEATRHNSQLHVMLAFCYTGQWDMAQACRELARAVRANELSPDDINESHLAGKIATSPAGEFSDIDLVIRTGGDLRLSNFPLWQVAYAEFFFTDKKWPDFGAADYLEALRSFQSRDRRFGL

SEQ ID NO: 2601 - DNA, 867 bp, Panicum virgatum
  misc_feature: Ceres CLONE 1782822
  misc_feature: Encodes the peptide sequence at SEQ ID NO. 2602
accacacaacgatcttgttcccgcttagtgtaaagaagcagctaggcaaccatcatggcttccaggagcaccgtacctgcctaccttctcctcatggcgctgctgctctcgtgcagctgcatgagcggcgcggcgaggttgctggaggaggcagcgcccaaggaggagtacccgcaccctgccgtgccggagctgccaaagcccgagctgccgccgcaccccacggtgccggagctgccgaaacccgaggtgccggcacaccccgtcgtacccgagctgcctaaacccgaggtgccggcgcaccccgccgtacctgagcttccgaagcctgagataccagctcaccctactgtccctgagctaccaaagccggaggtgcaggatcaccctgccgtgccggagctgccgaagcccgaggtgcccaagcctgaattgcctcctcaccccaccgcgccagagctgccaaagcctgaggagccgcacccagtcgcgccggagctgccaaagcctgaactcccccctcaccccgtcgtgccagagctccccaagcccgatgtgccgaagcacgagctgccaccgaagccagagggccactacccggagccggaggcaagaccatgagcgggctacggacttgcagtccccgacatttatatattctatctatatcattttacgcgtgcatatatattgtgtctatatatgcacagttatatgtgtgagtttgtgatgatgtgtacttgcattcgagcttccttgtgatgagttaggatagtgtgtttcagaagtatatatgtatgagtatgtatatctttgtttggatccatatatatgtgtgtaaatgaataaagagttctagttactatc

SEQ ID NO: 2602 - protein, 188 aa, Panicum virgatum
  misc_feature: Ceres CLONE 1782822
  misc_feature (62)..(122): Pfam Name: Trypan_PARP Pfam Description: Procyclic acidic repetitive protein (PARP)
MASRSTVPAYLLLMALLLSCSCMSGAARLLEEAAPKEEYPHPAVPELPKPELPPHPTVPELPKPEVPAHPVVPELPKPEVPAHPAVPELPKPEIPAHPTVPELPKPEVQDHPAVPELPKPEVPKPELPPHPTAPELPKPEEPHPVAPELPKPELPPHPVVPELPKPDVPKHELPPKPEGHYPEPEARP

SEQ ID NO: 2603 - DNA, 873 bp, Panicum virgatum
  misc_feature: Ceres CLONE 1782866
  misc_feature: Encodes the peptide sequence at SEQ ID NO. 2604
cggagcaacgaagtactcgagatagattcagagagtgcagggcagttgattccaggccaagaatcattccactttgcttgctgacagcctactacctagtaggatccgtggatccatggaggtggccggaggagctgtcggcgcgccgtccccgccgcggcgcgtggtggtggcggtggacgagagcgaggagagcatgcacgcgctctcctggtgcctctccaacgtcgtctccgccgccagggccgccgcggcgccgcccccggccgtggtgctcgtccacgcccgttcgccgcgccccttctactaccccgccgccgtcgacgccgccgggtacgtcctgacgcagcaggtgatggacagcatggaccagtacatggcctccgcggccgacaccgtcgtcaccaaggccaagagcatctgcaccgcgtttcccggcgtgagggtggagacgtgcgtggagaagggcgacccgcgcgacgtgatctgcggcgcggcggagaaggccggcgccgacatggtggtgatgggcagccacggctacagcttcctgcagagggcgctgcgggggagcgtcagcagccactgcgtgcagaactgcaagtgccccgtcgtcgtcgtcaagaggggcccgccggcgagcaccaggcggcgccgcggatcgatctaggcggctctagaggccgtagccgtaagcgcacacgagcacgactcgcctcgcctcggcgaaacgtgacggtgggcgcccgtgtacatacttcgcttttgttcggtgcctgtatctccctgagtataatgttttcagttcacacaaaatattgtaacgtgtcatgtaatggacgtgtgtacattctatatatatatagtcgtttc

SEQ ID NO: 2604 - protein, 184 aa, Panicum virgatum
  misc_feature: Ceres CLONE 1782866
  misc_feature (2)..(150): Pfam Name: Usp Pfam Description: Universal stress protein family
MEVAGGAVGAPSPPRRVVVAVDESEESMHALSWCLSNVVSAARAAAAPPPAVVLVHARSPRPFYYPAAVDAAGYVLTQQVMDSMDQYMASAADTVVTKAKSICTAFPGVRVETCVEKGDPRDVICGAAEKAGADMVVMGSHGYSFLQRALRGSVSSHCVQNCKCPVVVVKRGPPASTRRRRGSI

SEQ ID NO: 2605 - DNA, 1029 bp, Panicum virgatum
  misc_feature: Ceres CLONE 1782884
  misc_feature: Encodes the peptide sequence at SEQ ID NO. 2606
atccattcatctttcgctctgcctcagagtctcagacccaagacaggctagctatggcggccagcggacggagcagggaggagaggtggagcctggccggcaagacggcgctcgtcaccggaggaagcaaagggatcgggcgcgccatcgtggaggagctcgcggggttcggggtgcgcgtccacacctgcgcccgcggcgacgccgacctgcaggagtgcctgcgccgctggggcgccgacgaccgcctcgcgcgcgtcacggggaccgcctgcgacgtcgcggtgggtgccgaccgggagcggctcgtggccgcggcgcgggaggagctgggcggccggctggacatcctcgtcaacaacgccgggcagaccatgttccggcccgtcacggagaccacggcggaggactacgcgcgcatcatggccaccaacctcgagtcctgcttccacctcgcgcagctcgcgcacccgctcctcgtcgcggcggcgtcaggcggcggcgcgagcagcagcgtcgtcaacgtctcctccatcgccggtctcgtctcctacccgtcgcttgccgtgtactcggcgaccaagggcgccatgaaccagctcacccggagcctcgccgtcgagtgggccaaggacaacgtgcgcgtcaactgtgtcgcgccgggtggcgtccggaccgacatcgccggcagcagcggcatcaagctggacccggaggtggcgcggatgatgtgggagccggagatggcgcgggtccccctgcaccgcatcggcgagccggaggagatcgcgtccctggtcgctttcctctgcatgccggccgcctcctacatcaccgggcaggtcatctgcgccgacggcggccgctccattgccgcctagccagtaggcctttgctagctgctgttagctgcgtcgacggcgcttgaattggctggcatcattgaactcctcgtctcgtactttcattttctaataataaattaattattcagaaaaccgtttcgatcaaaaaaaaaaaaaaaaaaaa

SEQ ID NO: 2606 - protein, 275 aa, Panicum virgatum
  misc_feature: Ceres CLONE 1782884
  misc_feature (1)..(180): Pfam Name: adh_short Pfam Description: short chain dehydrogenase
MAASGRSREERWSLAGKTALVTGGSKGIGRAIVEELAGFGVRVHTCARGDADLQECLRRWGADDRLARVTGTACDVAVGADRERLVAAAREELGGRLDILVNNAGQTMFRPVTETTAEDYARIMATNLESCFHLAQLAHPLLVAAASGGGASSSVVNVSSIAGLVSYPSLAVYSATKGAMNQLTRSLAVEWAKDNVRVNCVAPGGVRTDIAGSSGIKLDPEVARMMWEPEMARVPLHRIGEPEEIASLVAFLCMPAASYITGQVICADGGRSIAA

SEQ ID NO: 2607 - DNA, 805 bp, Panicum virgatum
  misc_feature: Ceres CLONE 1782906
  misc_feature: Encodes the peptide sequence at SEQ ID NO. 2608
atgcacagacgacagcgagccaagtgtactactcccagtgaagccgcactagctagccacaccagcagcttgacaagctagctagctagctaggccgcagccatgtcggaggagaagcaccaccacttcttccaccaccacaagaaggacgaagaggagcagcccgccggcgggtactcggaggtggtggccgccggcgagagcgagtacgagaggtacaagaaggaagagaaggagcacaagcacaagcacaagcagcacctcggcgaggccggcgccgtcgccgccggcgccttcgcgctctacgagaagcacgaggcgaagaaggacccggagcacgcgcaccggcacaagatcacggaggagatcgccgccacggcggccgtcggcgccggcggctacgccttccacgagcaccacgagaagaagaaggaccacaaggacgccgaggaggccagcggcgagaagaagcaccaccacctcttcggctgacccgccggcgagcgagctccggcccggccgccgcgcacccgcctgcttgctccaataattgtggccatgatttcgcaataagtcccttccggacccttagcttgcttgcttgtgtgagactgagaggtggggcccgcgcgtcgaggtgtgttccggcctgtacgtgcttgatttttctttgcgtccgtaattgcgttgaataaccgggagcgatgcacgtgtggctcccagtctgtctgtctgtggttgagtgtctgtatcctgatgatcaactcgtggaagtttttacaccgaaaaaaaaaaaaaaaaaaaa

SEQ ID NO: 2608 - protein, 129 aa, Panicum virgatum
  misc_feature: Ceres CLONE 1782906
  misc_feature (1)..(54): Pfam Name: ABA_WDS Pfam Description: ABA/WDS induced protein
MSEEKHHHFFHHHKKDEEEQPAGGYSEVVAAGESEYERYKKEEKEHKHKHKQHLGEAGAVAAGAFALYEKHEAKKDPEHAHRHKITEEIAATAAVGAGGYAFHEHHEKKKDHKDAEEASGEKKHHHLFG

SEQ ID NO: 2609 - DNA, 811 bp, Panicum virgatum
  misc_feature: Ceres CLONE 1783021
  misc_feature: Encodes the peptide sequence at SEQ ID NO. 2610
gctgctcgcccccctcccctccccctccccctcgccgccgccgccgccgccccatcgcctcgctgccgcctgcggctcccgctcaagaagcttgtgaaggtttcttgaagctgagaagatggtgctgaagacggagctttgccgtttcagtggtcagaagatttatccagggaagggtatccggttcattcgtgctgactctcaggtgttccttttcgcaaactcaaaatgcaagcgctacttccacaaccgcctgaagcctgcgaagcttacctggacagcaatgtacaggaagcaacacaagaaggatatccatgctgaagcggtcaagaagaggcgccgcaccaccaagaagccatactccaggtcaattgtgggtgcttcgttggaagtgatccagaagaagagagctgagaagcctgaggtccgtgatgctgctagggaggctgccctccgtgagatcaaggagcgtatcaagaagaccaaggacgagaagaaggcgaagaaggctgaggtggcgaagtcccagaaatcgcagacgaagggcgcagtccagaagggttccaagggccccaagctgggcggcggtggcggcaagcgctgaaggggtgttgccctactactactactagtccgctcgctccgtcttgagctttacctgtcgcacaaaagcctctttttgtaaaacctcggttaaattagcaagacttgctctgtttcagcgttgttgccatgacgacgaacgaatggattcgttattatctgggaaaatggttgccgtccttatgcttaaaaaaaaaaaaaaaaaaaa

SEQ ID NO: 2610 - protein, 161 aa, Panicum virgatum
  misc_feature: Ceres CLONE 1783021
  misc_feature: Great-hit functional homolog of the protein sequence encoded by LOCUS At2g36620
  misc_feature: Useful for making plants with modulated nitrogen use efficiency
MVLKTELCRFSGQKIYPGKGIRFIRADSQVFLFANSKCKRYFHNRLKPAKLTWTAMYRKQHKKDIHAEAVKKRRRTTKKPYSRSIVGASLEVIQKKRAEKPEVRDAAREAALREIKERIKKTKDEKKAKKAEVAKSQKSQTKGAVQKGSKGPKLGGGGGKR

SEQ ID NO: 2611 - DNA, 885 bp, Panicum virgatum
  misc_feature: Ceres CLONE 1783196
  misc_feature: Encodes the peptide sequence at SEQ ID NO. 2612
acaggtcgctgctttcatttcgcaaccgaaccaagaaaaaagaaaagaagagcaagtcgtgcaagaagccgcgcgccgaggagaatgtaccgggccatcccgtacggcgccagccggccgtggccgccacggccgcgccccgcgccgatggccgccgaggcggcggccgtagtggacgccgccgtcgcagcggtggcggcggaggagaggctgcctgcgcagcagccggctgcggcgagggaggaggtgaggcgggccgtggcggagagccccgtagtggttgtggggaggcgcgggtgctgcctcagccacgtcgtgaagcggctgctgcaggggctcggggtcaacccggccgtgcacgaggtcgccggcgaggcggagcttgccgggatcgtcgacggcaacgtcgcgctcccggcggtgttcgtcgggggcaggctcctcgggggcctcgaccggctcatggccgtgcacatctccggcgagctcgtgcccatactgaaggaggccggtgcgctctggctttgaggatcggacacggacggagctccccgcggctcatggccgtgcacatcgacttcttcctgttggcgctccgatcctccaaatcttcatcttttcttcttctttttttcctcctcggattaatgaaggcgttcttaacttatcattagataggaattsgattcttttaggggaagcgtatattgccgaagtgtatttattaggaaattggagtgcttatcttaagcgatttctatttatttcccatcatgtgaatatgaagagtgctgagaatttacctgatgagcttctggtcttgtcagtgcgcacatactattcatggttcaggaacactacaggttcgccgccggttggagctgc

SEQ ID NO: 2612 - protein, 147 aa, Panicum virgatum
  misc_feature: Ceres CLONE 1783196
  misc_feature (1)..(60): Pfam Name: Glutaredoxin Pfam Description: Glutaredoxin
MYRAIPYGASRPWPPRPRPAPMAAEAAAVVDAAVAAVAAEERLPAQQPAAAREEVRRAVAESPVVVVGRRGCCLSHVVKRLLQGLGVNPAVHEVAGEAELAGIVDGNVALPAVFVGGRLLGGLDRLMAVHISGELVPILKEAGALWL

SEQ ID NO: 2613 - DNA, 799 bp, Panicum virgatum
  misc_feature: Ceres CLONE 1783223
  misc_feature: Encodes the peptide sequence at SEQ ID NO. 2614
atcagagctccgagctctccttccaaaaataaataaataaataaataaataaaatatctcctcccttccctagctgctagttcccttcccctctctctccggccgggctgggccgggcgctccagctccagctccttccagcggccggactatggctcggaggggcgtctcctacgtgtcggcagcgcagctggtgtccatgtcccgcgacccccgcgtcgccatcgtcgacgtcagggatgaggagaggagctacgacggacacatcgctgggtcccaccactacgccagcgacagcttcgccgaccggatgcctgagctcgcccaggcaaccggggccaaggaaaccctcgtcttccactgcgcgctcagcaaggtgcgaggcccatcttgtgcacagatgttccatgactatctatcagaggccaaggaagattcaggggtaaagaacatcatggtcctagaacgtggatttaatggatgggaaatttcagggaggcctgtttgccgctgcaaggacaccccatgcaagggtgtatgctcttaagtattttactcatggcagatagtattgctctgtatgttccaagaaattgaacgccaccacaagctatagattgataaaatagcagcatgtctccattgggtggatcaacaatggcttgtttcaatgaataacagttattgtcgtcttatggcatgtaccgcatgcttggaaatgttttgcttccatcaaactatgggcattcacatcctgtctattggccctacttttgtttaaaaaaaaaaaaaaaaaaaa

SEQ ID NO: 2614 - protein, 131 aa, Panicum virgatum
  misc_feature: Ceres CLONE 1783223
  misc_feature (4)..(131): SWISSPROT Homolog: EC 3.1.3.48 Dual specificity phosphatase Cdc25
MARRGVSYVSAAQLVSMSRDPRVAIVDVRDEERSYDGHIAGSHHYASDSFADRMPELAQATGAKETLVFHCALSKVRGPSCAQMFHDYLSEAKEDSGVKNIMVLERGFNGWEISGRPVCRCKDTPCKGVCS

SEQ ID NO: 2615 - DNA, 802 bp, Panicum virgatum
  misc_feature: Ceres CLONE 1783268
  misc_feature: Encodes the peptide sequence at SEQ ID NO. 2616
ggacaccattgcaggcacgcactccagctgaagcgccccgcactagctcacaaagctcaagcctttcgctcgctcccggctacatctgcaatggcgcgcttccagctcgcggccctggccctggccatgctcttcgccgcggcggcggcccaggccccggccgccaccccgacgccggcgcccagggcgtcccccccgccggcgacccctccgccgaccccggcgccggtttccccgcccgcgcaggcccccgccatccctcctccggccccggggcccgcgaccccggcccccgcccccgaggcctccgccccggcgccggctgaggcgcccacccccgcgacgagctccccgccggcgcccgcccccatggccccctccccgtcgccgaccagcaacgtgcccccgccccccagcgccgccgccggcgtctcccccgccgccaagtgggccgccgccgccgccgccgccgccgtggccgccgccttctactgaggagggaggacccccgcgcgccgcgccccgcggtgctgtaatctattgctatccgtgttgaatttttctttttctctcacaattttttccctttctttttgcttccacattccattcggcattcgattcggtaggagagagatctgtgcgcgttgctgctgctgctgctgctgcagtcagtgtaggatcgtggcttggacagattggttggttggctgcccccggtggtgttgtgatcccccatttgtataatcccctgttaatttatcttcagctgctcttcatctaaaaaaaaaaaaaaaaaaaa

SEQ ID NO: 2616 - protein, 134 aa, Panicum virgatum
  misc_feature: Ceres CLONE 1783268
  misc_feature: Great-hit functional homolog of the protein sequence encoded by LOCUS At5g10430
  misc_feature: Useful for making plants with altered cell wall content and/or composition
MARFQLAALALAMLFAAAAAQAPAATPTPAPRASPPPATPPPTPAPVSPPAQAPAIPPPAPGPATPAPAPEASAPAPAEAPTPATSSPPAPAPMAPSPSPTSNVPPPPSAAAGVSPAAKWAAAAAAAAVAAAFY

SEQ ID NO: 2617 - DNA, 845 bp, Panicum virgatum
  misc_feature: Ceres CLONE 1783313
  misc_feature: Encodes the peptide sequence at SEQ ID NO. 2618
agtgctccttagcttttttttcgtcagtgcagtgattagtgggtaggtaacctcttctgccggagagggaaggaggaaggcgaggcgaagatgctggagaagatgtgggacgacgtggtggccgggccgcacccggagacggggctcgagaagctccgcaaggccaccacctcccgcccgctcgtcatcgacaaagacgcgggcaccgccggcgggagtagcttcaagcgtgcgcagtcgatgccgacgaccccgacgacgccggggacgccgtcgtcgacgacccctcgcggcggcagcagcaacagcaacgtgtggcgcagcgtgttccacccggggagcaacctggccaccaagagcatcggcgccaacctcttcgaccgcccgcagcccaactcgcccaccgtctacgactggctgtacagcgacgagaccaggagcaaccaccgctagatcggggacggacggatgggatcggcggaggagcggtggccggtccctgtcgacccatgtttgctggtccttgtggttgtctaaaaaaaatgcgcaggcactgtactagccgcgtcgctgtccgaggctaaaggactcttaattttgccgtttgttttcttccaatgctatggagtgagtaatgcttgtactagtggtctgttgccctgactcagcttggccgctaccaagtggtgggtagcgacccgcgggccagtgactggaacccgcttggtgtgtactcctactagtctctccatctgtaaatatttgcttcagtgtaatgggacgtgtgaattgtactgcttcctccatgtttaaatgattctctcgaaaaaaaaaaaaaaaaaaaa

SEQ ID NO: 2618 - protein, 120 aa, Panicum virgatum
  misc_feature: Ceres CLONE 1783313
  misc_feature (1)..(121): Pfam Name: Auxin_repressed Pfam Description: Dormancy/auxin associated protein
MLEKMWDDVVAGPHPETGLEKLRKATTSRPLVIDKDAGTAGGSSFKRAQSMPTTPTTPGTPSSTTPRGGSSNSNVWRSVFHPGSNLATKSIGANLFDRPQPNSPTVYDWLYSDETRSNHR

SEQ ID NO: 2619 - DNA, 1059 bp, Panicum virgatum
  misc_feature: Ceres CLONE 1783324
  misc_feature: Encodes the peptide sequence at SEQ ID NO. 2620
agctcctctgctagctctctcacgcacaagcacacacgcacctgcaggctgcagcttcaggtcgatcgacgcgcgccgacctatcgtgtcagcagcgagccatcatggccttggcacgcggcggcagggggttgccatcccgggcggcggcggcggcggcggcggtgctggtggtggcggcgctggcgggcgtggcgagcggggacttcgcggcggacagggcggagtgcgcgaaccagttgatgggcctggcgacgtgcctgacgttcgtgcaggagaaggcgacggcgcgggcgccgacgcccgactgctgcgcggggctcaagcaggtggtggccgccagcaagaagtgcatgtgcgtgctggtcaaggaccgcgacgagccggcgctgggcttcaagatcaacgtcacccgcgccatggacctgccccccctctgcaactaccccgcgaccttctccgactgccccaagattctggggatgtcgccggacgcccccgaggcagagatcttcaaggagtacgcgaggaagcacgagtcccacaacggcaccgccaccaaacccgccgctgcaaccggtgccgcgggcgggaagagcgccacgagctcgtcgccggcgggcggggccggcgccgggagcaagccgggcgcggtcgtcgtctacctcgcgtcggcgctggtcgcactcgtctccgtcgtcctcgcgtgatgggcgccgggcgcgacgcattcgatcggcgttcatatatagcaggcaggggagatacactattatactgcggatgatcggagtagaaggaagcctcaagccggagagggataaagtgacgagcagcaaaagacacgcgtactcttttcttttttcttcttcttcttttttagctgggatgtgctaactgtgcaccagcgacgcagctttattctcccagctgttagctgtgctgccttccagcctgggatttaaagtggtgggcagagactgtcgagctgcatgtctgtctgaatctgatcgatttgccatactgcaagtttggtttgcaaaaaaaaaaaaaaaaaaa

SEQ ID NO: 2620 - protein, 201 aa, Panicum virgatum
  misc_feature: Ceres CLONE 1783324
  misc_feature (1)..(80): Pfam Name: Tryp_alpha_amyl Pfam Description: Protease inhibitor/seed storage/LTP family
MALARGGRGLPSRAAAAAAAVLVVAALAGVASGDFAADRAECANQLMGLATCLTFVQEKATARAPTPDCCAGLKQVVAASKKCMCVLVKDRDEPALGFKINVTRAMDLPPLCNYPATFSDCPKILGMSPDAPEAEIFKEYARKHESHNGTATKPAAATGAAGGKSATSSSPAGGAGAGSKPGAVVVYLASALVALVSVVLA

SEQ ID NO: 2621 - DNA, 701 bp, Panicum virgatum
  misc_feature: Ceres CLONE 1783343
  misc_feature: Encodes the peptide sequence at SEQ ID NO. 2622
atactccaggaagccaagcgagccaaagccaagggacatcctaccaccaggaccagcacagcacagacagcgactgcccggccgtgctgtgcagatcgaatggcggctccgagatccgcggcggcgctcgtcctcgccgcggcgctgctgctgtcgtcgccggcgggcgtcgccgtcgtccgcgggcagcagccgccgcggggcaacccgtgcccaacgaacgcgctggcggacctcaaggtgtgcgccgacgtgctcgtccttctcaagctcaagatcaacgtgccgcggacccagcagtgctgcccgctgctggggagcctcgtcaacctcgacctggccgcctgcctctgcgccgccatcaggctcaacgtccttggcatccccgtcaacctgccgctcgacgtgcccctcgtcctcaactactgcggccggaacgcctccgccgtgccgggctccaactgctcctgacttcctgagcgtgttctgtagcggatcggatggtggatggatgctccatggcttcaggttaaccgtgatgaataactgtgtgttccccactcgcgtgtgtacgtgtagcaatcttctgtgaaaggttctgtatgccactgacaagtaattcagtggctatgtgttccattggaccagctagcacaagcagaataaacagagtttactcagaaaaaaaaaaaaaaaaaaaa

SEQ ID NO: 2622 - protein, 123 aa, Panicum virgatum
  misc_feature: Ceres CLONE 1783343
  misc_feature (1)..(84): Pfam Name: Tryp_alpha_amyl Pfam Description: Protease inhibitor/seed storage/LTP family
MAAPRSAAALVLAAALLLSSPAGVAVVRGQQPPRGNPCPTNALADLKVCADVLVLLKLKINVPRTQQCCPLLGSLVNLDLAACLCAAIRLNVLGIPVNLPLDVPLVLNYCGRNASAVPGSNCS

SEQ ID NO: 2623 - DNA, 746 bp, Panicum virgatum
  misc_feature: Ceres CLONE 1783349
  misc_feature: Encodes the peptide sequence at SEQ ID NO. 2624
acttgcaccactcaagctgagctcggttcggttgtagcctgtagcttagctaggtccccgcgcgcgccatggcgaagaaccaccaccgcattgtggcgctcctgctcttcgcggccacgctgctggtcgcgcagctcgcgccggccgtggcctgcccgtcctgcccggcgcctaagccgccgccgcccccgcccccgacgcccgtgccgtgcccgccgccgccgtcgtccgcgccgccgtccacgccgaagggcaagtgccccctgaacacgctcaagctgctggcgtgcgtggacgcgctcaacgggctggtgcacgccgtggtcggcgccaaggccagcgagaagtgctgcccgctgctgcaaggcgtggccgacctcgacgccgcgctctgcctctgcaccaccatcaaggccaaggcgctcagcatcaacctcgtgctccccatcgccatcgaagtgctcgtcaacgagtgccacaagaacgtgcccgccagcttccagtgcccgtaatcaaactcaactcagcttccatgcatgctgggttaaggttatatggtatttgattgatgataaaccagtcaagcatttacatgcatatatataatttgtttttataattgtgtatcaatattgtaacatgaaccagtgtgagagttgtggccttggggcttgtagtgactaaaaagattatatatgaataaagcgtgtgtgtcatatatatacgaaaaaaaaaaaaaaaaaaaa

SEQ ID NO: 2624 - protein, 147 aa, Panicum virgatum
  misc_feature: Ceres CLONE 1783349
  misc_feature (1)..(83): Pfam Name: Tryp_alpha_amyl Pfam Description: Protease inhibitor/seed storage/LTP family
  misc_feature (419)..(459): Pfam Name: Peptidase_M10_C Pfam Description: Peptidase M10 serralysin C terminal
MAKNHHRIVALLLFAATLLVAQLAPAVACPSCPAPKPPPPPPPTPVPCPPPPSSAPPSTPKGKCPLNTLKLLACVDALNGLVHAVVGAKASEKCCPLLQGVADLDAALCLCTTIKAKALSINLVLPIAIEVLVNECHKNVPASFQCP

SEQ ID NO: 2625 - DNA, 1075 bp, Panicum virgatum
  misc_feature: Ceres CLONE 1783401
  misc_feature: Encodes the peptide sequence at SEQ ID NO. 2626
cccacccatccatctgcgcaccaggaaaggatagataggtagagaagatcgatcggctcatcggcagatgctgtccttggtgcggcggccgctctccgcggccgtgcccgccggcgacctcctcggcatccacctcttccagtgccccgacaccgtgggcatcgtcgccaagctgtccgagtgcatcgcctcccgcggcggcaacatccacagcgtcgacgtcttcgtccccgacgacaagcgcgtcttctactcccgcagtgaattcacgtacaacccaaggctctggccgcgtgacgagctgcgcaaggatttcctcaacctgtcacactgcttcagtgcggagaggtcgaccgtacgagtgcctgatcttgaccccaaatacaagatcgctgtcctcgcttcaaagcaggaccattgtttgtttgatttattgtatagatggcaagaaggcaggcttccagttgacattaattgtgtcataagcaaccatgataggccaaaagataatcatgtgcgaagatttcttgagaggcatggaatttcatatcactacttaccgaccacatctgggaacaaacgagagcaagagattctagaattgattgaaggcacagattttgttgtgctggcaagatatatgcagatactgtcagaaagctttttaaaatcatatggtaaagatattattaacattcatcatggtcttcttccctcatttaagggaggccatccttccagacaggccttcaatgctggggtaaagttgatcggtgcaactagccattttgtcactaccgaacttgatgctgggccaatcattgagcagatggttgagcgagtttctcacagagacacgctacggagttttgtagtgaagtctgagaaccttgagaagcagtgcctagcagaggctattaagtcatactgtgagctccgtgtcttaccatatgaactgaataagactgttgtattctgagctatttgttcttacagagtggtgtggtgtgtattattttttcacaaaacaagcagtaaatgattaattttcctacaaaaaaaaaaaaaaaaaaaa

SEQ ID NO: 2626 - protein, 303 aa, Panicum virgatum
  misc_feature: Ceres CLONE 1783401
  misc_feature (1)..(179): Pfam Name: Formyl_trans_N Pfam Description: Formyl transferase
MLSLVRRPLSAAVPAGDLLGIHLFQCPDTVGIVAKLSECIASRGGNIHSVDVFVPDDKRVFYSRSEFTYNPRLWPRDELRKDFLNLSHCFSAERSTVRVPDLDPKYKIAVLASKQDHCLFDLLYRWQEGRLPVDINCVISNHDRPKDNHVRRFLERHGISYHYLPTTSGNKREQEILELIEGTDFVVLARYMQILSESFLKSYGKDIINIHHGLLPSFKGGHPSRQAFNAGVKLIGATSHFVTTELDAGPIIEQMVERVSHRDTLRSFVVKSENLEKQCLAEAIKSYCELRVLPYELNKTVVF

SEQ ID NO: 2627 - DNA, 929 bp, Panicum virgatum
  misc_feature: Ceres CLONE 1783473
  misc_feature: Encodes the peptide sequence at SEQ ID NO. 2628
accggcacacttcaattccacacaaaactttgctcctcctcatcctctctgtggtcatactttctctctcttctcttcctctgccaagaacaccggccggctagcagctcgtgctcccatggagatcgacgccgagaacctcagcgccaccgagctccgcctcggcctgccgggaaccagcagcggcgacggccgccccaagaggccggcgccctccgtcggcgccaagcgcgcgctcgacgacacccggagcgaggcctcgggcaccagcccggccgccgggggcgaccacgacgccgccacgcctgccaaagcgcaagtggtggggtggccgccggtgagggcgtacaggaagaacaccttccaggcggcggcggcgaagaaggccgagcagcccggagggctgtacgtgaaggtgagcatggacggggcgccatacctcaggaaggtggacctccggatgtacaaggggtaccgggagctcagggaggcgctggacgccctcttcacccagtccttctccgcctccgccggagcgaagggcggcgacggccagcacgccctcgcctacgaggacaaggacggcgatctcatgctcgtcggagatgtgccctgggacatgttcatctcttcgtgcaagaagctcaggataatgaatggttctgaggccaggtgaccgctgatgcacaggcagaggctgcaactcatggggtgaatcgaggagcacaggtcgtgcaaaagagctgtgtggcttggagtcttggactctccagtgctgtacaaagagatggttgtttctgaaaccaaggagaaggatctacgaattgtgtatatagttgtttaggctcttagttagccgccttgttttttgagttgtgttttgtatgagcgaaggctgtaaaagaactgaaaaaaaaaaaaaaaaaaaa

SEQ ID NO: 2628 - protein, 185 aa, Panicum virgatum
  misc_feature: Ceres CLONE 1783473
  misc_feature (1)..(194): Pfam Name: AUX_IAA Pfam Description: AUX/IAA family
  misc_feature: The sequence is a functional homolog of  SEQ ID NO 648 in the  11/479,226 US patent application
  misc_feature: Useful for making plants with modulated growth and phenotype characteristics
MEIDAENLSATELRLGLPGTSSGDGRPKRPAPSVGAKRALDDTRSEASGTSPAAGGDHDAATPAKAQVVGWPPVRAYRKNTFQAAAAKKAEQPGGLYVKVSMDGAPYLRKVDLRMYKGYRELREALDALFTQSFSASAGAKGGDGQHALAYEDKDGDLMLVGDVPWDMFISSCKKLRIMNGSEAR

SEQ ID NO: 2629 - DNA, 956 bp, Panicum virgatum
  misc_feature: Ceres CLONE 1783489
  misc_feature: Encodes the peptide sequence at SEQ ID NO. 2630
accaccgaatactcccccgccgcatccgctcgctattaatcccatcgccgccccccgctcgatcccctccgccttcttcgccgccaccggagccgggcctgcctcctctctctctctctcgttcagggtccggggagaggagaagggagccgggcgccatggggttctgggaggccttcctcaactggcttcgcagcctcttcttcaagcaagagatggagctttccttgatagggctccaaaatgctgggaaaacatcacttgtgaatgtcattgctaccggtggctttagtgaggatatgattcctactgtaggattcaatatgagaaaggtaaccaaaggaaatgtcacaataaaattgtgggatcttggaggccagccaagattccggagcatgtgggagagatactgccgtgcagtttctgcaattgtgtatgttgttgacgtggcagatcgagaaaacatggccattgcaaaaggcgagctccatgacctcctgagcaaaccatctttgactgggatcccgttactagtcattggcaataaaattgacaagcctgaagctttccctaagcaaagcttcactgaagtcatgggcttaaagacaatcactgaccgagaagtggcatgcttcatgatatcatgcaagaactcgaccaacattgattccgtcattgactggctggtgaagcactcaaaaaagaagaattgatctaagtctgtaactcttgaagcgtgctccagtttctctctttttgcatgtcgcgtagcattggggctgtaaattatgcaagaggtattgatcagggatgttgtgttcataattttgttggtagactacgtttggtgtgcacgcgcgtgctctgttacaacttacagaaggctgccctctgtttcatatttgcttggtcaatttgagcagtgtggtttgtttcaaaaaaaaaaaaaaaaaaaa

SEQ ID NO: 2630 - protein, 184 aa, Panicum virgatum
  misc_feature: Ceres CLONE 1783489
  misc_feature (1)..(175): Pfam Name: Arf Pfam Description: ADP-ribosylation factor family
MGFWEAFLNWLRSLFFKQEMELSLIGLQNAGKTSLVNVIATGGFSEDMIPTVGFNMRKVTKGNVTIKLWDLGGQPRFRSMWERYCRAVSAIVYVVDVADRENMAIAKGELHDLLSKPSLTGIPLLVIGNKIDKPEAFPKQSFTEVMGLKTITDREVACFMISCKNSTNIDSVIDWLVKHSKKKN

SEQ ID NO: 2631 - DNA, 733 bp, Panicum virgatum
  misc_feature: Ceres CLONE 1783740
  misc_feature: Encodes the peptide sequence at SEQ ID NO. 2632
agcactccgttatcttcttcgcttcccttcccccctttctgctcgctctccgccctctccgccgccgccgccatggtggcgctcgcctccctctcgtctctctgcccctgcggcctggctcaccgccgcgccgcctccgcttccgcctccgtctccatctcgtgctgcgcggtcgcgaccccatcctccgggaaagggcctcaggaatctagaacaccgcggaaaaggttgagaagaaccgagggtgccactaagagcttggaagattcggtcaagcgaaaaatggagcagttctatgaaggggtggatggtccgcccctccgagtactcccgattggcggtcttggcgaaatcggcatgaattgtatgcttgtggggaactatgatagatatatcttgattgatgcaggggttatgttcccagagtacgtattccaaactgtatcttgctcctgctttcacagcagttgagattccattattttttgtctttctaatctgcgcatatgttattctgaactccacatttctttacaagaatcataaatataaattcaatatgtacccatttctcttgtaaatatcaccctaagggatagtgacttagaaaatactcctagcgttttcgttatattctgtgcttagagtcttagacccttagacttgaacatagtttctttataatagaaagtcatatgtatgagtgaaggcctaaaaaaaaaaaaaaaaaaaa

SEQ ID NO: 2632 - protein, 132 aa, Panicum virgatum
  misc_feature: Ceres CLONE 1783740
  misc_feature (1)..(25): Pfam Name: Lactamase_B Pfam Description: Metallo-beta-lactamase superfamily
MVALASLSSLCPCGLAHRRAASASASVSISCCAVATPSSGKGPQESRTPRKRLRRTEGATKSLEDSVKRKMEQFYEGVDGPPLRVLPIGGLGEIGMNCMLVGNYDRYILIDAGVMFPEYVFQTVSCSCFHSS

SEQ ID NO: 2633 - DNA, 1098 bp, Panicum virgatum
  misc_feature: Ceres CLONE 1783834
  misc_feature: Encodes the peptide sequence at SEQ ID NO. 2634
acgccctcgtaccaagactcgccgctcgccgctcgccgccagcatctcgcgtcccgacaatctgccgcagaagaatcggccccagtccccgtctcttcttctcctcctccccctccttccccattctaccagccgcggccatggccaccgacagcgccgcccccgccgggtccaagagtaagctgctcgtcttcgattccgtggaagatctcgcggtgtctctggcgaagtacaccgctgagctgtctcagaagttcgccaccgagaggggcgccttcaccgtcgtgctctccggcggatccctcatcgactcgctcagcaagctgacggagccgccgtacctggaatcggtggactggagcaagtggcacgtcttctgggtggatgagagagtcgtgcccaaggatcatgaggatagcaactacaagctcgccttcgatgggtttctctccaaggtgccgattcctcctgggcaagtttatgctataaatgatgccttgtcagctgagggagcagcggatgactacgaagcttgcttgaagcagcttgttaagaatggtgtgattgccatgtcaacagcaactgggtttcccaggtttgatctccagcttcttggaatgggacctgatggccacattgcctctctcttccctggtcaccctcttgttaatgagaaagagaggtgggtcacctacatcaaggattctccaaagccgccaccagagaggatcacatttacatttccagtaatcaactcatctgcatatatcgcgatggtggtcactggagctgggaaagctggtccagtgcagaaagcgctttcggacaagcaaacttcttccgatctgctgcctgttgagatggctgtgcttcaagatggagaattcacttggttcactgacaagccagcagtgtccctgttgcagaacaagtgaaggccaaccatggtgatcttagttcgaagccgtttatcttaaataaaagatccaagggcctgcatagtgcatagttgcattcatcctccttggatttcatgtaagggagacttgagccctttatgtagtatgttttctagagtaaaaaaaaaaaaaaaaaaaa

SEQ ID NO: 2634 - protein, 264 aa, Panicum virgatum
  misc_feature: Ceres CLONE 1783834
  misc_feature: Great-hit functional homolog of the protein sequence given in SEQ ID NO 9581
  misc_feature (1)..(237): Pfam Name: Glucosamine_iso Pfam Description: Glucosamine-6-phosphate isomerases/ 6-phosphogluconolactonase
  misc_feature: Useful for biocontainment applications
  misc_feature: Useful for making plants with modulated flowering time
  misc_feature: The plant flowers significantly late compared to wild-type.
  misc_feature: The plant produces a reduced number of seeds.
MATDSAAPAGSKSKLLVFDSVEDLAVSLAKYTAELSQKFATERGAFTVVLSGGSLIDSLSKLTEPPYLESVDWSKWHVFWVDERVVPKDHEDSNYKLAFDGFLSKVPIPPGQVYAINDALSAEGAADDYEACLKQLVKNGVIAMSTATGFPRFDLQLLGMGPDGHIASLFPGHPLVNEKERWVTYIKDSPKPPPERITFTFPVINSSAYIAMVVTGAGKAGPVQKALSDKQTSSDLLPVEMAVLQDGEFTWFTDKPAVSLLQNK

SEQ ID NO: 2635 - DNA, 594 bp, Panicum virgatum
  misc_feature: Ceres CLONE 1783890
  misc_feature: Encodes the peptide sequence at SEQ ID NO. 2636
gagccctacccgcacccgcgccgccgccgccccgcgccccgtcgccgcagacgactccgccccgtcgccgcgatgacgaagcgcaccaagaaggccggaatcgtcggcaaatatggaactaggtatggtgctagcttgcgtaagcaaatcaagaagatggaggtgtctcagcactccaagtacttctgcgagttctgtggaaagtttgctgtgaaaaggaaagcagttggaatctggggatgcaaggactgcgggaaggttaaggctggtggtgcttacaccatgaacactgctagtgcagtcaccgtcaggagcacaatccgtcgcttgagggagcagactgaagcataatcggagctcttctctgcagtagtcctgtgctttttgtaccgtctaagacatatggctgtttggcctaagaacattcatgaatattctggttatgcttaaggatatcaaaaattatggtgctaaaatttgtacttcgttgctgttgcaaagttgacctgtcttgatccattcataatgtagaatttcctcatggttcttatctccagtttgctactctttggccaaaaaaaaaaaaaaaaaaaa

SEQ ID NO: 2636 - protein, 92 aa, Panicum virgatum
  misc_feature: Ceres CLONE 1783890
  misc_feature: Great-hit functional homolog of the protein sequence given in SEQ ID NO 9687
  misc_feature: Useful for making plants with modulated cold sensitivity
MTKRTKKAGIVGKYGTRYGASLRKQIKKMEVSQHSKYFCEFCGKFAVKRKAVGIWGCKDCGKVKAGGAYTMNTASAVTVRSTIRRLREQTEA

SEQ ID NO: 2637 - DNA, 759 bp, Panicum virgatum
  misc_feature: Ceres CLONE 1783901
  misc_feature: Encodes the peptide sequence at SEQ ID NO. 2638
attcatggaaccgccgcatgctccagtcgcggcggaggccggcgccggcgccggcgccggcgacgcttacaccatccggccgctcgagctctcggacctctccaagggcttctgcgagcttctcgcacaggtctccccttctccgccgctctcagaggaagccttccgcgcgcgcttcgccgaactcgcggcgctgggcgccgaccacctggtcctcgtcgcggaggaagccgcgacgggccgcctcgccgcagcgggggcgattctggtggagcgcaagttcattcggcgctgcggcctcgtgggccacctggaggacgtggtggtggacgctgccgcgagggggcggggtctcggggagcgcctcgtgcgccgcctcgtggagcacgcgagagggagggggtgctacaaggtcatattgaactgcacggcggagctgaaggggttctacgccaagtgcggcttcgaggagaggaatgtccagatggggctctacttctgatccaggttccactttatccgatcacacaccctgtttatgttgtcttcgattgattcgtggatttatgatgtgcgatgggggaagatctgcaggttcgcctgtttcttcgaataactgtttgtagttgcctgtgtgagcttgtgatcagtgctgcttgtaatgcattacctcagcataattgtgtatttgtgtgatgtgggacacatttattcggttcaattgtaatggattgttatcaaaaaaaaaaaaaaaaaaaa

SEQ ID NO: 2638 - protein, 165 aa, Panicum virgatum
  misc_feature: Ceres CLONE 1783901
  misc_feature (1)..(82): Pfam Name: Acetyltransf_1 Pfam Description: Acetyltransferase (GNAT) family
MEPPHAPVAAEAGAGAGAGDAYTIRPLELSDLSKGFCELLAQVSPSPPLSEEAFRARFAELAALGADHLVLVAEEAATGRLAAAGAILVERKFIRRCGLVGHLEDVVVDAAARGRGLGERLVRRLVEHARGRGCYKVILNCTAELKGFYAKCGFEERNVQMGLYF

SEQ ID NO: 2639 - DNA, 1029 bp, Panicum virgatum
  misc_feature: Ceres CLONE 1783909
  misc_feature: Encodes the peptide sequence at SEQ ID NO. 2640
acccaaattcccgaaactagctagccaccgacacccagatctctctcgctcgctcgtcggggcgcgcccatggcatccgccggcgccgacgagtcggctgcggcggcgcagccccgggccgccatctcgcacgtcatcttcgacatggacggcctcctcctcgacacggagggcttctacacggaggtgcaggagaagatccttgcgaggtacggcaaggtcttcgactggtccctcaaggccaagatgatgggcaagaaggccatcgagtctgcgctcatcttcgtcgacgagttcggcctcgacggccagctcacccccgagcagttcctagaggagcgcgagagcatgctccagtcgctcttcccatcctgcactaagctgccaggggtactacgtctggtccatcatcttcatgccaatggaataccaatggctgttgcaacaggatcccataaacgtcattttgcactgaagacacagaaccaccaggagttgttctccctgatgcatcatgttgtcatgggggatgatccggaggtgaaggctggcaagccatctcctgatattttccttgctgctatgaggaggtttgagggcaatgtagaacccagtaaatacttggtttttgaagatgcaccatcaggtgtagcagcagccaaaaatgctggaatgtctgctgtgatggtcccagatccgcggcttgatgcttcatatcacaaaggagctgaccaagttctcagttcgttgttggacttcaaacccagcgaatggggcttgccgcctttcaaagagtagacaaagtccgtatgatgatttgaaaactccaaggaacgagagaatttcaaacactcagcattgataagagaaatttcatagaatgctgcacaagattcggtttgtcttaggccttagcagtaacaatttgagcattcttgttgcccctcacattctgtggcagaaaactacttcatatgacttcccttcaatgaagatcgtatgacattgcaaaaaaaaaaaaaaaaaaaa

SEQ ID NO: 2640 - protein, 242 aa, Panicum virgatum
  misc_feature: Ceres CLONE 1783909
  misc_feature (1)..(191): Pfam Name: Hydrolase Pfam Description: haloacid dehalogenase-like hydrolase
MASAGADESAAAAQPRAAISHVIFDMDGLLLDTEGFYTEVQEKILARYGKVFDWSLKAKMMGKKAIESALIFVDEFGLDGQLTPEQFLEERESMLQSLFPSCTKLPGVLRLVHHLHANGIPMAVATGSHKRHFALKTQNHQELFSLMHHVVMGDDPEVKAGKPSPDIFLAAMRRFEGNVEPSKYLVFEDAPSGVAAAKNAGMSAVMVPDPRLDASYHKGADQVLSSLLDFKPSEWGLPPFKE

SEQ ID NO: 2641 - DNA, 1019 bp, Panicum virgatum
  misc_feature: Ceres CLONE 1783953
  misc_feature: Encodes the peptide sequence at SEQ ID NO. 2642
ctcgctcctcgccgatcacagccgcgacctcctccccaatcccgatttcgcgagctcgtccccccgcttcccggcctctcccgtctccccgccccccgcccgccctccgagaggcgaagctccgggccgcgccaccgcgcaggcacacccaaggcagcaggcgcggttccttccaccaggtgcgcgggcggcggcatggcgcagcgcgacaagaaggaggagcccacggagctccgggcgccggagatcacgctctgcgccaacaactgcggcttcccggggaacccggctacgcagaacctctgccagagctgcttctcggcggccacggcgtcgatgtcgtcgccgacctcctcctcgtcctccccggctcccgcgccggccgcgacgccccagccgaggccggcgccggtggagctggcctccccggccgacgcggccgtggcggccccggctccggaggcggcgaggacgccggcgaaccggtgctcgagctgccggaagcgggtggggctcacggcgttccggtgccggtgcggcgagctgttctgcggcgcgcaccggtactcggaccggcacggctgcagctacgactacaagggcgccgccagggacgccatcgcccgggagaacccggtggtgcgcgccgccaagatcgttaggttctgatcgtcgacggagtcaaaatccctccatccagaggatacaaagcaagcaagcaaggaaaacaaagaggagacacacatccacggaaatggaaggcctttcccttggtgttactatgctgttcttcgaagcgtttgattttcaatctcctttcttttttacgattttcaaatggaagaaaaacgggaagaaaagaggtggacaaagaatagtgtaataataatgggggtgatgatgccgccgcggtggttgagggcaaaaggatgaacaaaatggattggatgtatgtacctgtcagtcgcaaagctttgtgcaaaaaatattatacatttctatctttcgtacagaaaccc

SEQ ID NO: 2642 - protein, 157 aa, Panicum virgatum
  misc_feature: Ceres CLONE 1783953
  misc_feature (1)..(41): Pfam Name: zf-AN1 Pfam Description: AN1-like Zinc finger
MAQRDKKEEPTELRAPEITLCANNCGFPGNPATQNLCQSCFSAATASMSSPTSSSSSPAPAPAATPQPRPAPVELASPADAAVAAPAPEAARTPANRCSSCRKRVGLTAFRCRCGELFCGAHRYSDRHGCSYDYKGAARDAIARENPVVRAAKIVRF

SEQ ID NO: 2643 - DNA, 794 bp, Panicum virgatum
  misc_feature: Ceres CLONE 1783956
  misc_feature: Encodes the peptide sequence at SEQ ID NO. 2644
gaaccatcccaaacacagcaagctcagagtactcaagctagctaaagcaagcagctcataccacacacttgaagctctagctagctaatagaaatggcgccatcaaagcttgccatgttcctcgccctgactgtcctcgccttcgcggcggctgtgcacggctgcacgccgtcctgtcctaccccaccagtggttcccagcccaccgccgccggttgtgccgacgccgtccggcggtgggggctcctgcccaatcaacgcactgaagctggaggtgtgcgccaatgtgttgaacctcctgaagctcaacatccctgtcacggggagcgaccagtgctgcccgctgctgcaggggctcgtcgaccttgacgccgcaatctgtctctgcactgctatcaaggccaacgtcctcggcatcaacatcaatgtgcccatcgacctgagcctcctcctcaaccactgtggcaagatctgcccttcagatttcacctgccccaattagctagcgaatgaaacattccacacgccatctgaatcttcagcatctatccactgccttgcctgcgttcttgtgcacctatgccgtcggtctatgtgttggtttgcatcagcatgcacccatatatgtgttgttctcttctgttcgggttcgagtgagggctcaggacaggtgatggcatgcaaattgttgttctcgttcattcgaacaatatgttttgttttttgtctgtaacttcatcatatacgtgaaataaaagtttatacaagttgtgtcaaagaaaaaaaaaaaaaaaa

SEQ ID NO: 2644 - protein, 135 aa, Panicum virgatum
  misc_feature: Ceres CLONE 1783956
  misc_feature (1)..(82): Pfam Name: Tryp_alpha_amyl Pfam Description: Protease inhibitor/seed storage/LTP family
MAPSKLAMFLALTVLAFAAAVHGCTPSCPTPPVVPSPPPPVVPTPSGGGGSCPINALKLEVCANVLNLLKLNIPVTGSDQCCPLLQGLVDLDAAICLCTAIKANVLGININVPIDLSLLLNHCGKICPSDFTCPN

SEQ ID NO: 2645 - DNA, 1601 bp, Panicum virgatum
  misc_feature: Ceres CLONE 1784050
  misc_feature: Encodes the peptide sequence at SEQ ID NO. 2646
ggatacatacagatacacctccatctcatcatcccctctcctcgccccagccagccagccctcctcatctccctccggtcccccctcctcccccggtcgtcgccagcctccatcccgccgcccgcgccggagatgctgggcgtcgtgcggaggcggctcggatccggatgcgtgctcgggcagctggcgcaggccctccgcccggcggccgccgcgaggagctactccgtcgccgccaaggagataactgtgcgggaagcattaaactccgcactagatgaagaaatgtccgcagatccttctgttttcttgatgggagaagaggttggggagtaccaaggtgcatacaagatatccaagggactgctcgacaagtatggccctgatagggttcttgatacaccaatcactgaggctggctttactggcattggtgttggtgctgcttaccatggtcttcgacctatagtagagttcatgacatttaacttttcaatgcaggcaattgatcatatcattaattcagctgccaagtcgaactacatgtcagctggtcagatatctgttcctattgtcttcagaggtccaaatggagctgctgctggagttggtgctcaacactcgcagtgctatgcagcttggtatgcgcatgttcctggattgaaagttctagcaccatattctgcagaagacgctcgaggtttgctgaaagcagcaatcagggatccagatcctgttgttttcctggaaaatgaacttctttatggtgaatcatttcctgtttctgatgaggtactcgattctagcttctgccttccaattggcaaggctaagatagagagacaaggaaaagatgttacaatcactgcattctccaagatggttgggtatgcccttcaggctgcagatatactagccaaggagggtatcagtgccgaggtaatcaatcttcgttcaattagaccactggatagagctgctattaatgcatctgtgaggaaaaccaacagattggtaacagtagaagaaggcttcccacaacatgggattggagctgaaatatgcatggctgttgttgaggacagctttgagtatcttgatgcgccagttgagaggattgctggagctgatgtgcccatgccttacgctgccaacctagagaggatggctgttccacaggttgaggacattgtccgagcggcaaagcgggcttgctacagagcagtaccaatggcggcaacagcctaattcacagacccaatcgcttctcgatcttccattttgttgtctgtgtgtccagaaagatgtgtcgcataatggtacgagtgcccactaccgctcccgctccaactcaactagcgtgagctgattttgtagagcaaccaagaggtgtgtccagttcagttctccgccgccacagcagccggatggctgcctgactctgcatcactttacggttctcaactcgggtttgcgagccatgcaggatttacctgtgggggattgtgtcaataacataacatgtattttaaagggagctccaagaggtcctggaatagaaattctggttgcgccttgtttaaaaaaaaaaaaaaaaaaaa

SEQ ID NO: 2646 - protein, 371 aa, Panicum virgatum
  misc_feature: Ceres CLONE 1784050
  misc_feature (1)..(179): Pfam Name: Transket_pyr Pfam Description: Transketolase, pyrimidine binding domain
  misc_feature (1)..(364): SWISSPROT Homolog: EC 1.2.4.1 Pyruvate dehydrogenase E1 component subunit beta, mitochondrial precursor
  misc_feature (14)..(371): SWISSPROT Homolog: EC 1.2.4.1 Pyruvate dehydrogenase E1 component subunit beta, mitochondrial precursor
MLGVVRRRLGSGCVLGQLAQALRPAAAARSYSVAAKEITVREALNSALDEEMSADPSVFLMGEEVGEYQGAYKISKGLLDKYGPDRVLDTPITEAGFTGIGVGAAYHGLRPIVEFMTFNFSMQAIDHIINSAAKSNYMSAGQISVPIVFRGPNGAAAGVGAQHSQCYAAWYAHVPGLKVLAPYSAEDARGLLKAAIRDPDPVVFLENELLYGESFPVSDEVLDSSFCLPIGKAKIERQGKDVTITAFSKMVGYALQAADILAKEGISAEVINLRSIRPLDRAAINASVRKTNRLVTVEEGFPQHGIGAEICMAVVEDSFEYLDAPVERIAGADVPMPYAANLERMAVPQVEDIVRAAKRACYRAVPMAATA

SEQ ID NO: 2647 - DNA, 1812 bp, Panicum virgatum
  misc_feature: Ceres CLONE 1784064
  misc_feature: Encodes the peptide sequence at SEQ ID NO. 2648
accagtgcaagcatcggtcgaccggcaatgatggctccaccagcggtctggcttcttcttcctctcggcctcttgtgcctgtgtagctccaccgccgcctctctctcgggcggcgccacggcggcggaggccgcagccgactacgtcgtcgtggccacgagctggctcaagacgaagccggtgtgccaagggctcagggtggatgcgccggcgaaccttaccgccagcagcagctgggtgccgctgagccactcctacggcccctgctcggcggcggcgggaagtttgtcgccggcgccggccgacgtgctgctgcaggaccagcaccgcgcggcctacatccagaggaagctcgccgacggcaccccccaggacgacaacggcagcgacctgccggagtcggactgcaagagcggccagtcggagcacgctcccaccgtgtcacccaacattggcgagaactcgagccccacatcagagggctcggaggcggtgaccctcatcgaaccggcggcgggcggcagcggcgcgcagcggctgccgggcgtgaagcagacgatggtgctggacaccgcgagcgacgtggcgtgggtgcagtgcgccccctgccccatgccgcagtgccaccctcagacggacaccatctacgacccctcccagtcgtcgacgtacgcgccgttcgcctgcggctcccccgtctgccggcagctcggcccgtacggcaacggctgcgccgccgggtcccggcagtgccagtaccgcgtccagtaccccgacggaaggtccaccatgggcacctacatctccgacacgctgcggctcaaccccacgtcggtgatcggcgggttccagttcgggtgcagccacgccgtgcagggccacttccccaacgacaccgccgggatcatggcgctcggccgcggcgcgcagtcgctggcgtcgcagacgaggctcacctacggcggcgtcttctcctactgcctcccgcgcacggcgagctacagcggcttcttcgtcctcggcgtgcccggggtcgccgcctcccggtacgccctcacgcccatgttcgccgtcccgcaggcgccgatgctgtacctcgtccgcctccgggccatcgtcgtcgccggccaggccctcgccgtgccgccggcggtgttcgcgcccggcgccgtcgtggactcccgcacggtgatcacgcgcctcccgccgacggcgtacggggcgctgcgcgccgccttccgggccagcatggggatgtaccgcgcggcgccgcccaagcagcagctcgacacctgctacgacttcaggggggtccgccgcgtcacgctgcccagggtcacgctggtgttcgaccacagcgccgccgtggagctcgacccgtcggggatcctctacaacgactgcctcgccttcacccccggcagcgacgaccgggcgatcggggccatcggcaacgtccagctgcagacgtacgaggtgctgtacaatgtcgccggcgccaccatgggcttccgccgtgccgcctgctagctgatgagtcgagtgcaggcaccaatcaccatggatctctgctgccagctgctaccaacaagcctcacaacaaactacctacctatatatatacctaccgtcatttttggcccctgtatggtcgcgtttgaataagccgagtttaactcgggtacatgtatttgcctggtctatcttaagcttcttatacgtgtgaaatgaagcttaattaagaactgttttctgggcaagtccaaaagggaaatacatacatattttggacaaaaaaaaaaaaaaaaaaaa

SEQ ID NO: 2648 - protein, 500 aa, Panicum virgatum
  misc_feature: Ceres CLONE 1784064
  misc_feature (11)..(334): Pfam Name: Asp Pfam Description: Eukaryotic aspartyl protease
MMAPPAVWLLLPLGLLCLCSSTAASLSGGATAAEAAADYVVVATSWLKTKPVCQGLRVDAPANLTASSSWVPLSHSYGPCSAAAGSLSPAPADVLLQDQHRAAYIQRKLADGTPQDDNGSDLPESDCKSGQSEHAPTVSPNIGENSSPTSEGSEAVTLIEPAAGGSGAQRLPGVKQTMVLDTASDVAWVQCAPCPMPQCHPQTDTIYDPSQSSTYAPFACGSPVCRQLGPYGNGCAAGSRQCQYRVQYPDGRSTMGTYISDTLRLNPTSVIGGFQFGCSHAVQGHFPNDTAGIMALGRGAQSLASQTRLTYGGVFSYCLPRTASYSGFFVLGVPGVAASRYALTPMFAVPQAPMLYLVRLRAIVVAGQALAVPPAVFAPGAVVDSRTVITRLPPTAYGALRAAFRASMGMYRAAPPKQQLDTCYDFRGVRRVTLPRVTLVFDHSAAVELDPSGILYNDCLAFTPGSDDRAIGAIGNVQLQTYEVLYNVAGATMGFRRAAC

SEQ ID NO: 2649 - DNA, 2185 bp, Panicum virgatum
  misc_feature: Ceres CLONE 1784089
  misc_feature: Encodes the peptide sequence at SEQ ID NO. 2650
cttcctcgcgttcttcccttcgctccccgtcgcgctgttcaacgttcaaacccttccaccttcgcctcctcccctggtcttgcagtcgccattgacgaccccctccacccttcccctcccttaaatctgtcctcaccccgcgacccgcgtcgccctccctcaccatccactcctcgtagctccagccttaccgcatccacagccagccgggagatctccaagaagccatcttggaatccaagaacccaagaatcggaatcagagacagctaagattcgaattcatagatacgagctttccggataaagtccaagaattcccgcggaggaagagcgcgtggaggcgtctcggggaccagaggaggagagcccggggggattagtgagggggcaagatggtgaggctgccgtacacgacggcgctgaccacgctgtttagctacgggctgctcttcgcgttcggccagctcagggatttcttccgcaagctcatcgactggttcaaggccaagaacgtcaaggggtacgcgccgatctgcctgggcctggaggatttctatgtgcgccgcctgtaccttcggatccaggattgctttggtaggccgattgcaagcgcaccagattcatggtttgatgttgttgagcgaacctcaaatgacaataacaagacactacagcgtacctcaaatacatctagatgcctcaacttgggatcctacaactaccttggatttgctgcagcagatgagtactgcacaccgcatgttattgagtctctcaagaaatactcagcaagcacctgcagtgtccgtgttgatggcggcacgaccaagcttcacaccgagctggaggagttggttgcacgtttcgttggaaagcctgctgctatcctatttggcatgggttatgttacaaactctgccatcattccttgcctaattggaaagggtgggttgataattagtgattctttgaaccataactcaattgtcaatggcgcaagaggatctggtgcaactgtcagggttttccagcataactcccctgctcatttggaagaggtactgagagagcagatagctggtggccagccacggacacacagaccatggaagaagataattgtcattgttgagggtatctatagcatggaaggagagctgtgtaagctccctgagattatagctgtttgcaagaaatacaaggcttacacatatctggatgaggctcatagcattggtgctgttgggcagtctggccggggcgtttgtgagctccttggggttgacccagctgatgtagatataatgatgggtactttcaccaagtcttttggatcatgtggtggatacattgccgcatcaaaggagataattcagcacctgaagcatagttgcccagcccatctatatgctacttccatgtcaccaccagcagtgcaacaagttatctctgctattaaagttattcttggggaggatggctccaacagaggtgcccaaaaacttgcacgcatccgtgagaatagtaatttcttcaggtcagagctcaagaagatgggtttcgaggttcttggtgacaatgactctcctgtcatgcccataatgctatacaatccggctaagattcctgcattttctagggagtgccttaggcaaaaggttgctgttgttactgtggcattccctgcgacacctcttcttcttgcaagagctcgtatctgcatttctgcttcacacactagggaggacctggtgaaagcccttgatgttatcagcagagttggtgatcttgtcggcatcaaatacttccctgcagaaccaccaaagatagctgaagctggtcatgataaactggagtagggatgaacgttgagttagcccatgaatgattgaagttgttagaattcctcggggagttatcaacaaatcattacagaaacaagcacacattgagcagtttcattgggattttgtcaatacgcaagagtccaggaacgttcgtattagctgactattgtttgttgactgtacaactatccttccaaatctgtatagctggttgaagttcagttgttctgttgttaatccattctcgatatgtaatacaattagatgcaatatgaattttctgcagaacatccctaagattttctgcagttggaccaaaaaaaaaaaaaaaaaaaa

SEQ ID NO: 2650 - protein, 488 aa, Panicum virgatum
  misc_feature: Ceres CLONE 1784089
  misc_feature (1)..(361): Pfam Name: Aminotran_1_2 Pfam Description: Aminotransferase class I and II
  misc_feature (5)..(471): SWISSPROT Homolog: EC 2.3.1.50 Serine palmitoyltransferase 2
MVRLPYTTALTTLFSYGLLFAFGQLRDFFRKLIDWFKAKNVKGYAPICLGLEDFYVRRLYLRIQDCFGRPIASAPDSWFDVVERTSNDNNKTLQRTSNTSRCLNLGSYNYLGFAAADEYCTPHVIESLKKYSASTCSVRVDGGTTKLHTELEELVARFVGKPAAILFGMGYVTNSAIIPCLIGKGGLIISDSLNHNSIVNGARGSGATVRVFQHNSPAHLEEVLREQIAGGQPRTHRPWKKIIVIVEGIYSMEGELCKLPEIIAVCKKYKAYTYLDEAHSIGAVGQSGRGVCELLGVDPADVDIMMGTFTKSFGSCGGYIAASKEIIQHLKHSCPAHLYATSMSPPAVQQVISAIKVILGEDGSNRGAQKLARIRENSNFFRSELKKMGFEVLGDNDSPVMPIMLYNPAKIPAFSRECLRQKVAVVTVAFPATPLLLARARICISASHTREDLVKALDVISRVGDLVGIKYFPAEPPKIAEAGHDKLE

SEQ ID NO: 2651 - DNA, 1505 bp, Panicum virgatum
  misc_feature: Ceres CLONE 1784102
  misc_feature: Encodes the peptide sequence at SEQ ID NO. 2652
cctgctctgctcttcggttcctccccggaccccgtgtccccgacccgaccgatccccccctcccccgagatcccccgccggatccacccgggtgccggccgcgatgagctggtggtggacgggcgcgatcggcgcggtcaagaagcgccaggacgagcaggcggcggcggcggagcccgcctaccagagcgtcgccctcgtcgtcggctccaccggcatcgtcggcacctccctcctcgacatcctcccgctcgccgacacccccggcgggccctggaaggtctacgcgctctcgcgccgcccgctcccgccctggtccccgccgccctcccccgccgtcgcgcacctccacctcgacctcgccgacgccgccgccgtcgccaccgccctcgccccgctcaccgacatcacccacgtcttctacgtcgcctggaccgcccgcgccaccgaggcccagaaccgcgaggccaacgccgccatgctccgcaacgtcctcgccgccatcgtccccaactgccccgcgctcgtccacgtctgcctccagaccggccgcaagcactacgtcgggcccttcgaggcgctcggcacggtcgacttcccggacccgcccttcaccgaggacatgcctcgcctcgcctgccccaacttctactacgacatggaggacctcctcttcgaggaggtctcgcgccgcgggggcgccgtcagctggtccgtgcaccgcccctccaccgtcttcggctactcgccccggagcgccatgaacgtcgtcggcagcctctgcgtctacgccgccatctgccggaaggagggcgccaagctgcgctggcccggctcaagggtcgcctgggacggcttcagcgacgcctccgacgccgacctcatcgccgagcacgagatctgggccgccgtcgaccccttcgccaagaacgagaccttcaactgcagcaacggggatctctacaagtggaagaacctctggcccatactggcggaccatttcggggtcgactgggctggctacgaaggggaggacagcaggttcaagctccacgaggccatggccgggaaggaggcggtctgggaggagattatcagggagaatgagcttacacctacagcgttcgacgagatcgccaatgggtggttcgttgatgctttgttcggtgtcgaattcgagcatttggacagcatgaacaagagcaaggagcatggcttcctcggcttcaggaacaccgtcaactcattcaacacatggatcgagaagctcaaggtcttcaagattgttccatgattcctccctgcaatttactaggtctcaatactgttttttctttacaccattcagcatcttattatcttgctcgtttatcaagttccaatgcgtttgtaatttagttccatttcagacactttgctatctttgccaggtttgcatgttgtatactgttgtatattagggccaaataaagatcagcacatagcaaaaaaaaaaaaaaaaaaaa

SEQ ID NO: 2652 - protein, 396 aa, Panicum virgatum
  misc_feature: Ceres CLONE 1784102
  misc_feature (1)..(252): Pfam Name: Epimerase Pfam Description: NAD dependent epimerase/dehydratase family
MSWWWTGAIGAVKKRQDEQAAAAEPAYQSVALVVGSTGIVGTSLLDILPLADTPGGPWKVYALSRRPLPPWSPPPSPAVAHLHLDLADAAAVATALAPLTDITHVFYVAWTARATEAQNREANAAMLRNVLAAIVPNCPALVHVCLQTGRKHYVGPFEALGTVDFPDPPFTEDMPRLACPNFYYDMEDLLFEEVSRRGGAVSWSVHRPSTVFGYSPRSAMNVVGSLCVYAAICRKEGAKLRWPGSRVAWDGFSDASDADLIAEHEIWAAVDPFAKNETFNCSNGDLYKWKNLWPILADHFGVDWAGYEGEDSRFKLHEAMAGKEAVWEEIIRENELTPTAFDEIANGWFVDALFGVEFEHLDSMNKSKEHGFLGFRNTVNSFNTWIEKLKVFKIVP

SEQ ID NO: 2653 - DNA, 1101 bp, Panicum virgatum
  misc_feature: Ceres CLONE 1784110
  misc_feature: Encodes the peptide sequence at SEQ ID NO. 2654
agagagcttgagccggcagtagctacctcgagttcaggcgcaaagctcgcaagcagatagataccaggcgagaagaagctagcatcggtacggtcacaaaggtagcaagcaattcatcagcccatggacaaccagccgctgccctactccaccggccagcccccggcgaccggcggggccccggtgcccggcgtgcctggcgctgccgggcccccgccggtcccgcaccaccacctgctccagcagcagcaggcccagctgcaggcgttctgggcgtaccagcggcaggaggcggagcgcgcgtcggcgtcggacttcaagaaccaccagctgccgctggcccggatcaagaagatcatgaaggccgacgaggacgtgcgcatgatctccgccgaggcgcccgtgctgttcgccaaggcctgcgagctcttcatcctcgagctcaccatccgctcctggctgcacgccgaggagaacaagcgccgcaccctgcagcgcaacgacgtcgccgccgccatcgcgcgcaccgacgtcttcgacttcctcgtggacatcgtgccgcgcgaggaggccaaggaggagccggggagcgccctggggttcgctgcggcggcaggggccggcgcggtcgggagcggcgcggcgggcggcgccccggccgccgggatgccgtactactacccgccgatggggcagccggcgccgatgatgccggcctggcacgttcccgcctgggacccggcctggcagcaaggggcggcggcggatgtcgatcagagcggcagcttcggcgaggaagggcaagggtttgcagcaggccatggcggcggtgccgctagcttccctcctgctgcacctccgagctccgagtgatctgcgcgctcctacgcgatggcttagctaaatgtgcaatgcacttgcagtgaaagtcgattgttcaatgcgtcgggcacggtgtctatagcaagcatggtaattagtcgaacaacatacagaacgaataagtgggagagctgactggagtaagttgtacatgcacgtgatgtgctgattaatcaaagattaacatgcagttttaattaaaaaaaaaaaaaaaaaaaa

SEQ ID NO: 2654 - protein, 249 aa, Panicum virgatum
  misc_feature: Ceres CLONE 1784110
  misc_feature: Great-hit functional homolog of the protein sequence given in SEQ ID NO 9370
  misc_feature (1)..(65): Pfam Name: CBFD_NFYB_HMF Pfam Description: Histone-like transcription factor (CBF/ NF-Y) and archaeal histone
  misc_feature: The sequence is a functional homolog of  SEQ ID NO 1106 in the  10/374,780 US patent application
  misc_feature: The sequence is a functional homolog of  SEQ ID NO 1107 in the  10/374,780 US patent application
  misc_feature: The sequence is a functional homolog of  SEQ ID NO 1108 in the  10/374,780 US patent application
  misc_feature: The sequence is a functional homolog of  SEQ ID NO 1109 in the  10/374,780 US patent application
  misc_feature: The sequence is a functional homolog of  SEQ ID NO 1908 in the  11/479,226 US patent application
  misc_feature: The sequence is a functional homolog of  SEQ ID NO 2126 in the  10/374,780 US patent application
  misc_feature: The sequence is a functional homolog of  SEQ ID NO 314 in the  10/374,780 US patent application
  misc_feature: The sequence is a functional homolog of  SEQ ID NO 712 in the  11/479,226 US patent application
  misc_feature: The sequence is a functional homolog of  SEQ ID NO 846 in the  10/225,066 US patent application
  misc_feature: Useful for making plants with altered Lignin content
  misc_feature: Useful for making plants with altered alkaloid content
  misc_feature: Useful for making plants with modulated growth and phenotype characteristics
MDNQPLPYSTGQPPATGGAPVPGVPGAAGPPPVPHHHLLQQQQAQLQAFWAYQRQEAERASASDFKNHQLPLARIKKIMKADEDVRMISAEAPVLFAKACELFILELTIRSWLHAEENKRRTLQRNDVAAAIARTDVFDFLVDIVPREEAKEEPGSALGFAAAAGAGAVGSGAAGGAPAAGMPYYYPPMGQPAPMMPAWHVPAWDPAWQQGAAADVDQSGSFGEEGQGFAAGHGGGAASFPPAAPPSSE

SEQ ID NO: 2655 - DNA, 1743 bp, Panicum virgatum
  misc_feature: Ceres CLONE 1784118
  misc_feature: Encodes the peptide sequence at SEQ ID NO. 2656
acaaatcacaaacccatctctcctgttttctctggcgcacacacactctctctaagctatccttctctctctagaaccatcaccaccactcttctctctctccagccgagcgcatcgtcgaccatggtcgtcgagatgaaggagaacggcgtggcggcggcggcggcgggcgcgggcgagaaggcggcgcagcagctgagcgtgaagcgcggcgagccgacgctggtgccgccggcggagccgacgccgacgggggagcagtactacctctccaacctggaccagaacatcgccgtgatcgtgcagacggtgtactgctacaagccccactccggcggcggcgatgccgacagcaaggacgtggcggcggcgctgcgggacgcgctggcgcgggtgctggtgcactaccacccgctggcggggcggctgggcatcagcccggagatgaagctgacggtggagctcaccagcgagggcgtcgtgttcgtggaggccgacgcctgctgcgacctcgccgacgtcgacgacctcaccaagcccgaccccgccgcgctcggccagctcgtctactccgtccccggcgccaagcacatcctcgagatgccccccatgaccgcgcaggtgacgaggttcaggtgcggcggcttcgcgctgggcctggccatgaaccactgcatgttcgacggcatcggcgccatggagttcgtcaactcgtgggccgagacggcgcgcggcgccgccgagctcaccgtgccgccgttcctcgaccgcgccgtgctccgggcgcgcgacccgcccgcgcccgccttcccgcaccacgagttcgccgagatccccgacgtctccgacacggcggcgctctacggctcccaggagctcctctaccgctccttctgcttcgacccggaccggctggagcgcgtccgggcgctggcgctcgccggcggcgacctgggccgctgcaccaccttcgaggcgctctcgggcctcgtgtggcgcgcgcgcaccaaggccctggggctcgcgcccgagcagcgcaccaagctgctcttcgccgtcgacgggcggcgccgcttcgtgccgccgctgccccggggatacttcgggaacggcatcgtgctgaccaacgcgatcgccaccgccggcgagcttctgtcggcgcccgtgtcgcgcgcggcggggctggtgcagggcgccgtgcggatggtcaccgacgagtacatgcggtcggcggtggactacttcgaggcgacgcgggcgcggccgtcgctggcgtccacgctgctcatcaccacgtggtccaggctcgagttccacggcgccgacttcgggtggggcgagcccgtcatgtccggccccgtcacgctgccggagaaggaggtcatcctcttcctcgcgcacggcaaggagaggaagagcatcaacgtgctgctcggcctgccggccaccgccatggacgccttccaagagctcatggacgagatatgatgatggatcttctgcggccggtgcccgcgccggctgggtgctatacatacatatatataaatgcagggtgcttttatatatgcttaagttgcacggggtttacagtacggtcgcgtgtgttaatattcactctatgctggtgtttaattgatatatatatgtgggaattcgttatcagctgtaatggtttttgttaaatgaaaaaaatagctagcagctgtcgttgctttaatttaaaaaaaaaaaaaaaaaaaa

SEQ ID NO: 2656 - protein, 454 aa, Panicum virgatum
  misc_feature: Ceres CLONE 1784118
  misc_feature (1)..(433): Pfam Name: Transferase Pfam Description: Transferase family
MVVEMKENGVAAAAAGAGEKAAQQLSVKRGEPTLVPPAEPTPTGEQYYLSNLDQNIAVIVQTVYCYKPHSGGGDADSKDVAAALRDALARVLVHYHPLAGRLGISPEMKLTVELTSEGVVFVEADACCDLADVDDLTKPDPAALGQLVYSVPGAKHILEMPPMTAQVTRFRCGGFALGLAMNHCMFDGIGAMEFVNSWAETARGAAELTVPPFLDRAVLRARDPPAPAFPHHEFAEIPDVSDTAALYGSQELLYRSFCFDPDRLERVRALALAGGDLGRCTTFEALSGLVWRARTKALGLAPEQRTKLLFAVDGRRRFVPPLPRGYFGNGIVLTNAIATAGELLSAPVSRAAGLVQGAVRMVTDEYMRSAVDYFEATRARPSLASTLLITTWSRLEFHGADFGWGEPVMSGPVTLPEKEVILFLAHGKERKSINVLLGLPATAMDAFQELMDEI

SEQ ID NO: 2657 - DNA, 1583 bp, Panicum virgatum
  misc_feature: Ceres CLONE 1784164
  misc_feature: Encodes the peptide sequence at SEQ ID NO. 2658
gagcgcagcactgcagccggcggcgagggtggaggggcgggacggggcgcgcggcggcgcgggggattggagttgggtgcgggccgcacgggcggctcgctactacggattgaaaggtacgcgccctccgcaaccaaccgtcccaaacccccaaccaaactctccctccctccgcggattgggctctgtcgcctccgcgcgcacgcgccgcccatggcctcctcgctcgtctcgcgcccgcacctccccccgcgacccgtccccgccgccaccctggcctccactttccaggcccgcgtcgcggccgggggccttggcgggctcggggtcgcggccggcgtgcggtgccaggcgcaggcggcgggggacttggacagccactacatgcggcggtgcgtcgagctggcgcgcaaggcggctggacacaccagccctaaccctatggtgggctgcgtcatcgtccgtgacggccgcgtcgtcggagagggattccaccccaaagccggccagccacacgcggaggtatttgctctaagagatgcaggtgatttttttgagaacgcaactgcttatgtgagcttggagccctgcaaccactatggaaggactcctccttgcactgaagcactcatcaatgcgaaagtgaaggaagttgtcgtggggatgactgacccaaatcctatcgtcgcatccaaagggattgaaaagctccaaggtgctgggatagatgtgagggtgggtgtcgaggaagcgttgtgccgcagactgaatgaggcttacatccatcggatgctcaccgggaaggcttttgcaactttgagagctacactctcaatgaatggaattgtcacaaaccaaattgggaagggagctgatcaatcgggtggttactactcgcaattgatgaaagaatacgatggggtcataatttcaagcgacctggccaaaatgtcaaccttgccggtgtcacatgaagctggagcaaaccaacctcagtatatcatcatagcacagggagaaagttcccgactacatatcccgtccctcagcaaagaacatgcatctaaggctatagttcttgctgatagtcctgtcaccgtggagccagcaggggtcgaagtcgcagtccttcgtcaggtagatctagactccatccttcaactccttgcacagcgagggctttgcagcgtgctggtggatttcagagaggccggggaaagcttcgcgtcgcttctgaacgacttccaggaggacaagctggtgcagaaggttgttctggagttgctgcctgtttggctggcgagcgaagggctcaacaacctggcttttggcggcagacaatcgtttccgctgaagaacgtggagtacagggatgtgaatgggtgcatgctgctggagggctatgtcgatgtctagaatcgtttctgcaggatgtctagagtgccagtgtttgcttgtccacctgtaaactgatagtcgtgtaaactttggcactgcaaccccatgagatttgttatagagctgaatccatgtcatgagatctttgtgcactactgcactcccaaaaaaaaaaaaaaaaaaaa

SEQ ID NO: 2658 - protein, 400 aa, Panicum virgatum
  misc_feature: Ceres CLONE 1784164
  misc_feature (4)..(101): Pfam Name: dCMP_cyt_deam_1 Pfam Description: Cytidine and deoxycytidylate deaminase zinc- binding region
MASSLVSRPHLPPRPVPAATLASTFQARVAAGGLGGLGVAAGVRCQAQAAGDLDSHYMRRCVELARKAAGHTSPNPMVGCVIVRDGRVVGEGFHPKAGQPHAEVFALRDAGDFFENATAYVSLEPCNHYGRTPPCTEALINAKVKEVVVGMTDPNPIVASKGIEKLQGAGIDVRVGVEEALCRRLNEAYIHRMLTGKAFATLRATLSMNGIVTNQIGKGADQSGGYYSQLMKEYDGVIISSDLAKMSTLPVSHEAGANQPQYIIIAQGESSRLHIPSLSKEHASKAIVLADSPVTVEPAGVEVAVLRQVDLDSILQLLAQRGLCSVLVDFREAGESFASLLNDFQEDKLVQKVVLELLPVWLASEGLNNLAFGGRQSFPLKNVEYRDVNGCMLLEGYVDV

SEQ ID NO: 2659 - DNA, 855 bp, Panicum virgatum
  misc_feature: Ceres CLONE 1784181
  misc_feature: Encodes the peptide sequence at SEQ ID NO. 2660
agcagctccgagcctccgagcatacacgtacacttgaagctagaggcctagagcccacagcatctgctcgagactctgccagccaagagagtcttgaggatctagctagctagctagctaggctgcgaggatgtcgctggtaaggctgttggacacgctggccccggagtcgtggaggaaccccttcagcatcttcggcacggcggtggccgccgacgcgtggctggcgagcgacacctcggcgttcgccaacacctacatcgagagccgggacacggcgggcgcgtacgtgttcagcgcggcgctgccgcccggcgtgaagaaggaagaggtgagggtggaggtggacgagggcaacgtgctggtcatcaccggggagcgcagcgtccgccgggaggagcgcagcgacaggtggcaccacatcgagcgcagctgcgccacgttcctcggcaggttccacctgcccggggacgccgccgtcgacggcgtcagggccgccatggacaccggcgtgctcacagtcaccgtgcccaaggtcggggccatcgccgccgccgccgccgccgccgccaccgccgccgccgagccgacgatggccgcggaggccggcccctgctgatytgacgcgccggcgcgcgcgctcgatcacgggcggcgcggcacggccctgctgaatgagcagtaaggtctytygtccgtwccgtytgaagsgtccccctcctttggtttggtattgcatacttttccgtgtgatggatttgcctgcacgcatgtaacaagaagaaaaaagcctgcctgcacggcttccccatgtttgttttgtgcttgataaatgaagagcaaacctaagcaggt

SEQ ID NO: 2660 - protein, 162 aa, Panicum virgatum
  misc_feature: Ceres CLONE 1784181
  misc_feature (1)..(103): Pfam Name: HSP20 Pfam Description: Hsp20/alpha crystallin family
MSLVRLLDTLAPESWRNPFSIFGTAVAADAWLASDTSAFANTYIESRDTAGAYVFSAALPPGVKKEEVRVEVDEGNVLVITGERSVRREERSDRWHHIERSCATFLGRFHLPGDAAVDGVRAAMDTGVLTVTVPKVGAIAAAAAAAATAAAEPTMAAEAGPC

SEQ ID NO: 2661 - DNA, 2704 bp, Panicum virgatum
  misc_feature: Ceres CLONE 1784188
  misc_feature: Encodes the peptide sequence at SEQ ID NO. 2662
aaaaccccaccaacacagtgacagcaagcactaacccccagccagcctcccatggctacggcgccccttgccttccgcttccccttcccttccgcgtcacgcccgcctcctcccaggaccctggccccgccggccccgcgccgcctccctccgcgcctcgccgccgcggccacgcgacggttccgtccgcccaccgcggatgacgagcccccagaggccgcggaggattcgtcccacggcctcaaccgctacgaccagcttgcgcgcagcgtcgagcgcgcccggagccggcagcccgagatcacccccgaccacccgctcttctcgtccccctcctcggccggcggcgcaggcggcgggagctacgaccccaacgacgagttcttcgacgagatcgaccgcgccattgccgagaagagggaggagttcacgcggcgtgggctcatcaagccgtcccctgcttcgccgccgtcgtcgcagacgcagcccgaggacgagggcctcgccgacgagctctcccccgaggaggtgatcgacctcgacgagattcggaagctgcagggactcagtgttgtgtccgtggcggacgaggaggacgaggaggccgaggggggcgaggacgaggatggacacgatggcttgccgctcgacgaggatgaggaaggcttcgatgtggccgaggagctcgggctcgaaggggccaggatgcggcagccggccttccgcatgacgcttgccgagctcctcgacgagagcaagctcgtcccggtggccgtgacgggagaccaggatgtcgcgcttgcgggggtgcagagcgacgccagcctcgtggccgccggtgacctctttgtgtgcgtgggagaggaggggctcgccggcctcaccgaggccgacaagcgaggggccgttgccgtcatagctgaccaggacgtcaacatcgagggcaccctggcctgccgcgcgctggtcattgtggatgacattgtgaccgcgctccgcgtgctccctgcctgcctctacaggcagccgtccgcggacatggcggtcataggtgtcactggcacggatggggtcaccaccacaactcacctgatcaaagcagtgtacgaggccatgggggtgaggactggcatggtgggcgttcttggggcctatgctttcggcagcaacaagcttgaagcacgacctgatgcatctggtgatcccattgccgtgcagaagctgatggcaacaatgttgcacaatggcgccgaggcagttgtgttggagacagccactgatgggatgcctccatctggtgtggacagtgatatagattatgatattgccgtgctgactaatgttaggcacactgatggggaggatagcatgacatatgaggagtatatgagcagcatggcttccttgttctccagaatggtggaccctgagcgccatcgtaaagtggtaaacatcgatgatccaagtgccccattcttcgctgcacatggggggcatgatgtccctgtggtgacatattcgtttgagaacaagaaggctgatgtgcacactctcaaataccagctttccctgtttgagacagaggttttggtacagacaccgcatgggatcctcgagatctcctcagggctgcttggaagggataacatctacaacatccttgcaactgtggcagttggtattgcagtggttgcaccactggaggacatagtcaggggcatagaaaaggtggatgctatcccaggccggtgtgagctaattgatgaggagcaagcgttcggggtaattgttgatcatgcgaggacaccagaagctttgtcgaggcttctggatggtgtaagggagctgggcccacgccggatcgtcactgttgttggatgttgtggtgagaaagaaagagggaagaggccggtgatgacaaagattgcagctgataaaagtgatgttgtcatgttgacatcagacaatcctgcaaatgaagatccattggatatccttgatgatatgttggcgggtgtaggctggaccatggaagaatacttgaaacatggtgctaacgattattatccaccccttcaaaatggacataggctcttcttacatgacattagaagagttgcagtgcgagctgctgttgcaatgggcgaacaaggcgacgtggtggttatcactggcaaagggaacgacacttatcagattgaaggcgataaaagtgagtttttttatgacagggaagagtgccgagaagcattacaatatgttgatcagttgcatcgagctggaattgacacctcagagttcccttggcggttaccagaaagccactgattttggtttagtcaagatagttgagtttatctactcaaggaacaaatgtcagattcccagttctactagtacgagcttttcagggataggctgtccaagcctgcaagaaattcgtcctgcgagtgctgagttttctaaccaaagtgctaacgactaacaaaaaaaattagcctatcagttattctgttgtactgccagatggtccatggaacttcccgtccagtaaattgtggttgctttgataatggattggtgaagcttcctggtgtcaaaaaaagaatgtaagggctttctggcgttacaatttcaaaaacagcatgtcccatggcagtgaatataagatcttttggaatcagaaaaaaaaaaaaaaaaaaaa

SEQ ID NO: 2662 - protein, 758 aa, Panicum virgatum
  misc_feature: Ceres CLONE 1784188
  misc_feature (1)..(211): Pfam Name: Mur_ligase_M Pfam Description: Mur ligase middle domain
MATAPLAFRFPFPSASRPPPPRTLAPPAPRRLPPRLAAAATRRFRPPTADDEPPEAAEDSSHGLNRYDQLARSVERARSRQPEITPDHPLFSSPSSAGGAGGGSYDPNDEFFDEIDRAIAEKREEFTRRGLIKPSPASPPSSQTQPEDEGLADELSPEEVIDLDEIRKLQGLSVVSVADEEDEEAEGGEDEDGHDGLPLDEDEEGFDVAEELGLEGARMRQPAFRMTLAELLDESKLVPVAVTGDQDVALAGVQSDASLVAAGDLFVCVGEEGLAGLTEADKRGAVAVIADQDVNIEGTLACRALVIVDDIVTALRVLPACLYRQPSADMAVIGVTGTDGVTTTTHLIKAVYEAMGVRTGMVGVLGAYAFGSNKLEARPDASGDPIAVQKLMATMLHNGAEAVVLETATDGMPPSGVDSDIDYDIAVLTNVRHTDGEDSMTYEEYMSSMASLFSRMVDPERHRKVVNIDDPSAPFFAAHGGHDVPVVTYSFENKKADVHTLKYQLSLFETEVLVQTPHGILEISSGLLGRDNIYNILATVAVGIAVVAPLEDIVRGIEKVDAIPGRCELIDEEQAFGVIVDHARTPEALSRLLDGVRELGPRRIVTVVGCCGEKERGKRPVMTKIAADKSDVVMLTSDNPANEDPLDILDDMLAGVGWTMEEYLKHGANDYYPPLQNGHRLFLHDIRRVAVRAAVAMGEQGDVVVITGKGNDTYQIEGDKSEFFYDREECREALQYVDQLHRAGIDTSEFPWRLPESH

SEQ ID NO: 2663 - DNA, 2444 bp, Panicum virgatum
  misc_feature: Ceres CLONE 1784206
  misc_feature: Encodes the peptide sequence at SEQ ID NO. 2664
aaaaaacacctgcttgtgcttgttgggctcccggcggcgtcttcctctttactccgtccaccttcttgctcgaccatctactccaccttcactcgtctcacctcagccactcagcgcctcctccaccgcatcagcatcagcatgcgcgcggcggcttgttgttggcgtttgtagatgggctcctcctcgctgctcctcttcccctcgtcctcctccgccgcgccaccgcccacggcttctgctgcttattcccatgccacctcctctcactccttattgccgccgctcccctcctcccaagaccatttgctcctccactaccttcacctagcagagcaccaacaagaatccgccgccgccgccgccatggtccgcaagcgcccggcgcccgacatggacctccccccgccgcgccgccacgtcacgggcgacctctccgacgtcacggccgccgccgctggtgccggcgggcagccgccgcatcagtcgcccgccagcgcgcagctgcccgcgctgcccacccagctccagctccccgcgttccagcagcagcagcagcaccacgcgcacgcggaggtggacgcgcccccggctgcggcgggcgaggtggcggcgtccaccacggcgtgggtggacggcatcatccgcgacatcatcggcagcagcggcggcgccggggtctccatcgcgcagctcatccacaacgtccgcgagatcatccacccctgcaaccccggcctggcctccctcctcgagctccgcctccgctccctcctcaacgccgaccccgccccgccgccgctcccgcatcctcctgctctcctgcacagcaccccgcccgccgccgccccagcagtgcctgctctccctccccctcatccgcttccagacaagcgccgccacgacccgcagcagcaggaggagcccaacccgtcgccgcagtcgcccaagcccccgaccgcggaggagaccgccgcggcagccgcggccgccgccgccgcggctgccgcggccgccaaggagcgcaaggaagagcagcggcggaagcagcgcgacgaggagggcctccacctgctgacgctgctgctgcagtgcgccgagtcggtgaacgccgacaacctcgacgacgcgcaccagacgctgctggagatcgccgagctcgccacgcccttcggcacctccacccagcgcgtcgccgcctacttcgccgaggccatgtccgcgcgcctcgtcagctcctgcctcggcctgtacgcgccgctgccgccggcgtcccccgcggcggcgcggctgcacgggcgcgtcgccgccgcgttccaggtgttcaacggcatcagcccgctcgtcaagttctcgcacttcacggcgaaccaggccatccaggaggcgttcgagcgggaggagcgcgtccacatcatcgacctcgacatcatgcaggggctgcagtggccgggcctcttccacatcctcgcctcccgccccggcggcccgcccagggtcaggctcaccggcctcggcgcctccatggacgcgctccaggccaccggcaagcgcctctccgacttcgccgacacgcttggcctgccattcgagttctgcgccgtcgcggagaaggccggcaatgtcgacccggacaagctgctcggcggcgtcgcgcggcgcgaggccgtcgccgtccactggctccaccactcgctctacgacgtcaccggcaacgactccaacacgctctggctcatccaaaggctggcccccaaggtggtgacaatggtggagcaggacctcagccactcgggctccttcctggcgcgcttcgtggaggccatccactactactcggcgctcttcgactcgctggacgcgagctacggcgaggacagcccggagcggcacgtcgtggagcagcagctcctgtcccgggagatccgcaacgtgctcgccgtcggcgacccggcgcgcaccggcgacgtcaagttcgggagctggcgcgagaagctcgcacagtcggggttccgctcggcctcgcttgccggcagcgcggcggcgcaggcgtcgctgctgctcggcatgttcccctccgacgggtacacgctcgtcgaggagaatggtgctctcaagctcgggtggaaggatctttgcctgctcactgcatctgcctggcgcccaattcagaccccatgccgttaaattttagagcaaatttacagagctaaagcattactattactgctagatcttacttggcgttattgcccagatcttttgcctgtttagctagctgctgctcaatttaatcagttccgagattaggaaaatgataacatttctgatcactaattgctagatctcttcacagtgatagttactgatgtaagcttagttttatggtagattttgttcagctgtcgatcggttatcttcaccaaaaaaaaaaaaaaaaaaaa

SEQ ID NO: 2664 - protein, 670 aa, Panicum virgatum
  misc_feature: Ceres CLONE 1784206
  misc_feature (2)..(298): Pfam Name: GRAS Pfam Description: GRAS family transcription factor
  misc_feature: The sequence is a functional homolog of  SEQ ID NO 1327 in the  10/374,780 US patent application
  misc_feature: The sequence is a functional homolog of  SEQ ID NO 431 in the  11/479,226 US patent application
  misc_feature: Useful for making plants with modulated growth and phenotype characteristics
MGSSSLLLFPSSSSAAPPPTASAAYSHATSSHSLLPPLPSSQDHLLLHYLHLAEHQQESAAAAAMVRKRPAPDMDLPPPRRHVTGDLSDVTAAAAGAGGQPPHQSPASAQLPALPTQLQLPAFQQQQQHHAHAEVDAPPAAAGEVAASTTAWVDGIIRDIIGSSGGAGVSIAQLIHNVREIIHPCNPGLASLLELRLRSLLNADPAPPPLPHPPALLHSTPPAAAPAVPALPPPHPLPDKRRHDPQQQEEPNPSPQSPKPPTAEETAAAAAAAAAAAAAAAKERKEEQRRKQRDEEGLHLLTLLLQCAESVNADNLDDAHQTLLEIAELATPFGTSTQRVAAYFAEAMSARLVSSCLGLYAPLPPASPAAARLHGRVAAAFQVFNGISPLVKFSHFTANQAIQEAFEREERVHIIDLDIMQGLQWPGLFHILASRPGGPPRVRLTGLGASMDALQATGKRLSDFADTLGLPFEFCAVAEKAGNVDPDKLLGGVARREAVAVHWLHHSLYDVTGNDSNTLWLIQRLAPKVVTMVEQDLSHSGSFLARFVEAIHYYSALFDSLDASYGEDSPERHVVEQQLLSREIRNVLAVGDPARTGDVKFGSWREKLAQSGFRSASLAGSAAAQASLLLGMFPSDGYTLVEENGALKLGWKDLCLLTASAWRPIQTPCR

SEQ ID NO: 2665 - DNA, 938 bp, Panicum virgatum
  misc_feature: Ceres CLONE 1784254
  misc_feature: Encodes the peptide sequence at SEQ ID NO. 2666
attttctccttattatcctataaaatataaaccctgacgctactggccatggccgccgcctcgatcctgtccgccgcctgctcctatccgcgccgccaccccgccgcgccgcacctctccccctccgcgtgcttcaagaggttcgacagggttcgccggttctcgcccgccgccatgtcgacgccgtcggggccgaaggaggcgccgggtaataaccccggtctccacaccgagatcgaccccgccaccaagggctacctcctgcagcagacgatgttacgtgtgaaggacccaaaagtgagccttgacttctactcccgtgtgatgggcatgtcgttgctgaaaagattagattttgaagagttgaagttcagcttgtattttctcggttatgaggatgtggcttcagcccctgctgatcatatccagcggactgaatggactttcaggcaaaaagctaccctcgaactcacccacaactggggcacagaaagtgaccctgaattcaaaggttaccataatgggaattcagaccctcgtggttttggtcatataggagtaaccgtggatgatgtctacaaggcatgtgagcgctttgaacgtcttggtgttgactttgtgaagaaacctgatgatgggaaaatcaaaggtattgcgttcatcaaggatcctgatggctactggattgagatttttgaccacaccattgggacggtgaccgcttcggtgtcatgaggtgttgtggttcagatattatggaggctttgtgttcaggttagaatgttataatgccagtttttatggaactatagttcattaattgtatggttaacaagattgtacaattctgggaatctcaggagcacaacagtgggctttacccttgaggaataagactattgtctccttttggcgattaaaaaaaaaaaaaaaaaaaa

SEQ ID NO: 2666 - protein, 228 aa, Panicum virgatum
  misc_feature: Ceres CLONE 1784254
  misc_feature (2)..(145): Pfam Name: Glyoxalase Pfam Description: Glyoxalase/Bleomycin resistance protein/ Dioxygenase superfamily
  misc_feature (47)..(224): SWISSPROT Homolog: EC 4.4.1.5 Lactoylglutathione lyase
MAAASILSAACSYPRRHPAAPHLSPSACFKRFDRVRRFSPAAMSTPSGPKEAPGNNPGLHTEIDPATKGYLLQQTMLRVKDPKVSLDFYSRVMGMSLLKRLDFEELKFSLYFLGYEDVASAPADHIQRTEWTFRQKATLELTHNWGTESDPEFKGYHNGNSDPRGFGHIGVTVDDVYKACERFERLGVDFVKKPDDGKIKGIAFIKDPDGYWIEIFDHTIGTVTASVS

SEQ ID NO: 2667 - DNA, 956 bp, Panicum virgatum
  misc_feature: Ceres CLONE 1784268
  misc_feature: Encodes the peptide sequence at SEQ ID NO. 2668
gcaggcctacaaaacctcccacccgcaaacgcagctcctaaaccctagctgcctgctcccactcgcgaccagagcggcggcggcgcatctcgtggttgcgagctgcgaggccaggtcggtatcaaggggcgccggcaactccgcgtctccggcagcagattcattcttcaatggcggccttcaacaagcttggcagccttctaaggcacaacgctctgacagctggtgcccccaccagctcgtctcctgcattgttcaatgctgctcggcttatgtccaccaagcttttcgttggtggtctttcctggggcactaacgaccaatccttgaaagaagcatttagcagcttcggagaggttactgaagcgcgggtgatcacagacagggatactggaaggtcaagaggctttggctttgtgaacttcagcaatagtgatgatgccaaggaggctgtgactaaaatggacggtcaggaacttgaaggacgcagtgtccgtgtgaactttgctaatgaaaggcctgctggggaccgtggtggtggtggctttggtggcggtggctttggtggaggtggcggctatgctggtggcaaccaaagctatggttctggcggtgggcagttctaagtactcgctaacaatcgagctatttgaaataatgaactttaggacctgatgtggggcacatgtgaagccctatcatgttttattattttgtgttgtgctctattgaatcgttgaactcctaggtgcaattcaggggctaccgagcttttcctatgggtagtttatgggtagttttgaagaacgcaagggccgtgtgtaccttgtctgagtgaggaacataatttgcgcacattactttagatacctttctattgcaatgtgtacagaagtatcggttgatttattgaggtgcgctgcattctggttgcttaaaaaaaaaaaaaaaaaaaa

SEQ ID NO: 2668 - protein, 151 aa, Panicum virgatum
  misc_feature: Ceres CLONE 1784268
  misc_feature: Great-hit functional homolog of the protein sequence given in SEQ ID NO 9668
  misc_feature: Useful for making plants with modulated biomass
  misc_feature: The plant is abnormally small.
MAAFNKLGSLLRHNALTAGAPTSSSPALFNAARLMSTKLFVGGLSWGTNDQSLKEAFSSFGEVTEARVITDRDTGRSRGFGFVNFSNSDDAKEAVTKMDGQELEGRSVRVNFANERPAGDRGGGGFGGGGFGGGGGYAGGNQSYGSGGGQF

SEQ ID NO: 2669 - DNA, 1486 bp, Panicum virgatum
  misc_feature: Ceres CLONE 1784288
  misc_feature: Encodes the peptide sequence at SEQ ID NO. 2670
tctctgctctcctccactcctcgcgcggccatggctgctccggcgcccacggctctctgcgcccgccacttccgcctgccgcgcgcgccctcctcctcctcctccccttccccgccccggctgccggccaccgcctccgcctgctcgtccccgcggctccggccccgccgcctcgccgtctccccgcgcgcggaggcgggcacgggggacgtggaggcgctcagggccggggtgcccgtctacaagccgcgctcctacgacgtgctcgtcaccgacgccgcgcgctccctcgcctgcgccatcgacgacggcaagacacgcctcgagatcgagttcccgcctctgccaagcagcatatcttcttacaagggctcctcagatgagttcatcgatgccaacatccagcttgctcttgttgttgcgaggaagcttaaagagctcaaggggactaggtcctgtatagtgtttcctgatcaacctgaaaagcgcagagcgtcacagatcttcagaacagctattgacacgattgagggtattactgtcagttctctggatgatgtgcccaccgaccctgtcaacagcttcttcaaatcgataagaaacaccctggattttgacttctcagatgacaatgaagatcgatggaaatctgatgaaccaccatcattatatatcttcatcaacagcagcacacgtgaccttgcttctatagagaagtatgtggagaagtttgccacatccgttccagctcttctgtttaatcttgaactagataccttgagatctgacttgggacttctgggattccctccaaaagatttgcattaccggtttctttctcagttcaccccagtattttatatcagacagcgtgactactccaagacaattgcagttgctccatacatagtgaattacagtggtgctgtattccgtcaatacccaggcccttggcaggttatgctgaagcaggctgatggttcatatgcttgcgttgcagagagtgaagctcggttcactttgggacaggccaaagaagaactgttgagagttatcggtttacaagaagaagaaggaagctcacttgaatttctcagaagaggatacaagaatgctacgtggtgggaagagaacgttgatcaggaaacatccgccgcatggcgaacttgagattctgatctgatcagcaaagggaaatggaaataccaaagtagtgttcatgaatcatgatgacagtgtggcattgcctgtgcggcaactgcgtgtacagtgcaggaatgcgaggtctcgagcatttttccctttttggtgattgtatcatggttgagtttgagttctgtaaaacctgagccactgcaaaaaaggaggggactccaaatttgtgactcgtgtgtttgggtgccatgagcccatgaatatttctaaagtagaaattctacctgcaacgagattgttgatgcaacgtcaaaaaaaaaaaaaaaaaaaa

SEQ ID NO: 2670 - protein, 379 aa, Panicum virgatum
  misc_feature: Ceres CLONE 1784288
  misc_feature: Great-hit functional homolog of the protein sequence given in SEQ ID NO 9236
  misc_feature: Useful for making plants with modulated oxidative stress sensitivity
MAAPAPTALCARHFRLPRAPSSSSSPSPPRLPATASACSSPRLRPRRLAVSPRAEAGTGDVEALRAGVPVYKPRSYDVLVTDAARSLACAIDDGKTRLEIEFPPLPSSISSYKGSSDEFIDANIQLALVVARKLKELKGTRSCIVFPDQPEKRRASQIFRTAIDTIEGITVSSLDDVPTDPVNSFFKSIRNTLDFDFSDDNEDRWKSDEPPSLYIFINSSTRDLASIEKYVEKFATSVPALLFNLELDTLRSDLGLLGFPPKDLHYRFLSQFTPVFYIRQRDYSKTIAVAPYIVNYSGAVFRQYPGPWQVMLKQADGSYACVAESEARFTLGQAKEELLRVIGLQEEEGSSLEFLRRGYKNATWWEENVDQETSAAWRT

SEQ ID NO: 2671 - DNA, 1240 bp, Panicum virgatum
  misc_feature: Ceres CLONE 1784301
  misc_feature: Encodes the peptide sequence at SEQ ID NO. 2672
actcacacaccaccagagcacagccaagagcgagacgcccaagcaaccaccgctccacagctaagctaagccaagccagccaccgcgagaacaagtcgcagcgaaaaagcctgctacgcttgccatgacttccatggagctgctccacgccgtgatcccggagaagcagcgcgaggactcgctggcgccggcgccggcgctgacgacgacgagcagcagcgccaccgccacgagcggcgacgagggctcccacgtgccgcaggggtgggccaagaggaagcgctcgcgccgccagcgctccgaggaggagaacctcgcgctctgcctcctcatgctctcccgcggcggcaaccaccgcgtccaggccccgccgccggtccccgccgcgccgccggccgccgcggagttcaagtgctccgtctgcggcaagtccttcagctcctaccaggcgctggggggccacaagaccagccaccgtgccaagctgccgacccctcctgcttccgcgggcgctccggccgcacccgtcgttgaggcccccgccccgatcaccgtcgtcgtcccgccgccgatcgaggtcgcccgcgagccggccacgtcatccaccgccgcgtcctccgacggggcggccgcctcgagcagagtccacaggtgctccatctgccacaaggagttccccaccgggcaggcgctcggcgggcacaagaggaagcactacgacggcggcgcgggcagcgccgccgccgccgcctccaccgatctcctggctgccgccgagacgtccgaggtggggagctccggcaacggcagctccgcggcccgggcgttcgacctgaacctcccggccgtgccggagttcgtgttccggtgcggcaaggccggcaagatgtgggaggaggacgaggaggtgcagagcccgctggcgttcaagaagccccgcctcctgatgaccgcgtgaggatccgatcgatccatccaaagatttttggtctagctgcagagagttgggtggggtggaacactattcgttcattcattcgtctggtgcctgtagtactattgtttgatttgttcttgttacagctcttgtacagaaatagagtgcgagtcagatacaacacctataccatacgtatacgtaggccttcttcctcttggaagaagtatacttgtatccccttagctgtcagtaagtagtacgataccgtagttcatactccaaaaaaaaaaaaaaaaaaaa

SEQ ID NO: 2672 - protein, 277 aa, Panicum virgatum
  misc_feature: Ceres CLONE 1784301
  misc_feature (1)..(23): Pfam Name: zf-C2H2 Pfam Description: Zinc finger, C2H2 type
  misc_feature: The sequence is a functional homolog of  SEQ ID NO 1092 in the  10/666,642 US patent application
  misc_feature: The sequence is a functional homolog of  SEQ ID NO 2298 in the  10/374,780 US patent application
  misc_feature: The sequence is a functional homolog of  SEQ ID NO 506 in the  10/225,066 US patent application
  misc_feature: The sequence is a functional homolog of  SEQ ID NO 907 in the  10/374,780 US patent application
  misc_feature: Useful for making plants with modulated growth and phenotype characteristics
MTSMELLHAVIPEKQREDSLAPAPALTTTSSSATATSGDEGSHVPQGWAKRKRSRRQRSEEENLALCLLMLSRGGNHRVQAPPPVPAAPPAAAEFKCSVCGKSFSSYQALGGHKTSHRAKLPTPPASAGAPAAPVVEAPAPITVVVPPPIEVAREPATSSTAASSDGAAASSRVHRCSICHKEFPTGQALGGHKRKHYDGGAGSAAAAASTDLLAAAETSEVGSSGNGSSAARAFDLNLPAVPEFVFRCGKAGKMWEEDEEVQSPLAFKKPRLLMTA

SEQ ID NO: 2673 - DNA, 1211 bp, Panicum virgatum
  misc_feature: Ceres CLONE 1784327
  misc_feature: Encodes the peptide sequence at SEQ ID NO. 2674
atctcgcccattcaacttcgctcgcaagaagctcacgaggccatcaaaagcgaggcgagggggaggagagggaggcgccgacgcggagctcctcctgctcgatccagcaccaccagccgccgcagccgactttgccgccaacaggacaggatgtttcttacgaggacggagtacgaccgcggggtgaacaccttctcgccggaggggcggctgttccaggtcgagtacgccatcgaggccatcaagttgggatctactgcgatcgggttgaggacaaaggatggtgttgtcctggctgttgagaaacgtgtcacctcgccacttctggaaccaagcagtgtggagaagatcatggaaattgatgagcacataggttgcgccatgagtggacttattgctgatgctagaacgctagtcgagcatgctcgtgttgagacccagaatcataggttctcgtatggggagccaatgactgtagaatcttctacacaagctatctgtgacttggctctgcgctttggcgaaggtgatgaggagtcaatgtcacggccatttggagtctctctcctaattgctggacatgatgagaatggacctagcttgtactacaccgacccatctgggaccttttggcaatgcaatgccaaggcaattggatcaggctctgaaggagctgatagctccttgcaggagcagtataacaaggacctgaccctccaggaggcggagaccatagccctttctattctgaagcaggttatggaagagaaggtgaccccaaacaatgttgatattgccaaggtcgcccccaagtaccacctgtacacccccgccgaggtcgaagccgtcattgcaaggctgtgaaacacttccagattcttgctattcccgtcatcaatcagtaatagacagtcattgtatgaagcgtggacatgttgattcaggcctctctgcctagtgtgttgctatggctgtcatcatacactgttttcaactcccgcaggggcagtcgctgatagtctgattcacagcccagtcggctcagctgtttgtttttaagtagcattgagaacttctctactgccagaaagatagtacacctgtttttacgaatttgtcttctgtttccttgaacaactggctgatgcttgtgacctggtgccattggatacttctttttttttttttttgaaaaaaaaaaaaaaaaaaaa

SEQ ID NO: 2674 - protein, 237 aa, Panicum virgatum
  misc_feature: Ceres CLONE 1784327
  misc_feature (1)..(237): SWISSPROT Homolog: EC 3.4.25.1 Proteasome subunit alpha type 5
MFLTRTEYDRGVNTFSPEGRLFQVEYAIEAIKLGSTAIGLRTKDGVVLAVEKRVTSPLLEPSSVEKIMEIDEHIGCAMSGLIADARTLVEHARVETQNHRFSYGEPMTVESSTQAICDLALRFGEGDEESMSRPFGVSLLIAGHDENGPSLYYTDPSGTFWQCNAKAIGSGSEGADSSLQEQYNKDLTLQEAETIALSILKQVMEEKVTPNNVDIAKVAPKYHLYTPAEVEAVIARL

SEQ ID NO: 2675 - DNA, 2034 bp, Panicum virgatum
  misc_feature: Ceres CLONE 1784441
  misc_feature: Encodes the peptide sequence at SEQ ID NO. 2676
aaagtttcctctcgtagtcatgtctgaaccacacgcacctcatccagagctggcgcacgccatgtgctcgacggtttgccgctgacacggcgcacggcgcgcgcgtccatggcgcttgctctcctcccgccctcgcccgcatcccaccgccgctcgcttcgtcccgtttcctctccgcttctcacgcgtgtcaccaccgccgccagcttcggccttgcgttttcttcccatccctcctccggctgctgctctctgcagaggactggcgccgcaggaggcgacggtgatggcgccggcgaggcctcatcggaagcgccggtggctggatggctcgacacggacctgctcaggcgggtctcaggcgcgggggatgcggaccaggcgctggacattgtcgcagactcggcgggaggttcgggcgccgctctggaagcgcccgaatgcaacgcgatcattgccgcggcacttgaccgaggcaacgtcgatctcgcgctctcggtgttcgaagccatgcgatccggcttcgcgggagtaggaggctggaggtgggcgagaccggacgatcggacatatgccttgctcgtacagcggttggcagccgccctgcgtgtttctaatgcaatcaggataatcgattatgcatcttgcgctggtgtttcttctacagaggaggttccttttgggattattgttcgctgtccaacctgcatggtagcagttgctgttgctcaaccgcaggatggaactcaggttgtttcctgttcaaagtgtcgatatcaatatgaattattttctggagacatttcaagcatcgaatctgaagaagttagcatggatatttcagctctggagaaggcattgagattcattaatataagaaaagatggtcttccagctgctgtccactctattgtgatccgagcaccttcaggaatagcgcgcactcatagatttgctacccagaatgtagaactccctgctcaagaaggagaaagagtaaccatttcgttggcagccccatccaatgtttatcgtgaaatgggtcccctcaagattgctgcacgctcacaaggatttaaaccaggcgagcctatgtgtctgactaatcacagcaatggacaagtctcaaagttgctaagagctccatcaatgaatgaaggatcatttttccttagcccatatttattggtcggtgctctttctttgcttgcctctggagatgctgcttccgcattcattgacccaagtcttcctagacttattacagcaactgcaattgcatcagctgccatcggaacaactctaaatcaagtggtcctgccagaaattcaaaagcttccacaaaaggcagtggatatagttgctgtacggcagcagcttttgtctcagtatgacattcttcagagccgtcttaaggaactgaaacagttggctcaaaaagaggtgtggatgctcacaaggatgtgtcaattggacaacaaaatactagcagtgggcgaaccatcttatcgtgctagacgaggtagagtaaagagggtacgggaaagcttggaaagcacactctctgcaaggattgagctaatggaaagttatgcaaaattgtgttcaatgattgaaattgaaattgagatggactctgatgttattgctgctgaagtggcaagcagtgcagagagaatatctgagcaaattcaacaattaatggagatcgacagccttgaagagcaatggcgtatacaagctgaagctaatgatgaagctgaaaggcttctgagttctgattcttcagaaacattgcctgctggacatatgtaatgtaattttggtaatgagcaagcattattctcctatttcctatttagatatttatatctctgcaattttaatgttctttaccaaattaaaaacaaatttctagtttaggattttgaaggaaaatactgttacagaacattaggaaaacgaaccataaaccctgcaacagaataatacagaatattgattggaaccgtgcaaaaaaaaaaaaaaaaaaaa

SEQ ID NO: 2676 - protein, 568 aa, Panicum virgatum
  misc_feature: Ceres CLONE 1784441
  misc_feature: Great-hit functional homolog of the protein sequence given in SEQ ID NO 9594
  misc_feature: Useful for making plants with altered Lignin content
MALALLPPSPASHRRSLRPVSSPLLTRVTTAASFGLAFSSHPSSGCCSLQRTGAAGGDGDGAGEASSEAPVAGWLDTDLLRRVSGAGDADQALDIVADSAGGSGAALEAPECNAIIAAALDRGNVDLALSVFEAMRSGFAGVGGWRWARPDDRTYALLVQRLAAALRVSNAIRIIDYASCAGVSSTEEVPFGIIVRCPTCMVAVAVAQPQDGTQVVSCSKCRYQYELFSGDISSIESEEVSMDISALEKALRFINIRKDGLPAAVHSIVIRAPSGIARTHRFATQNVELPAQEGERVTISLAAPSNVYREMGPLKIAARSQGFKPGEPMCLTNHSNGQVSKLLRAPSMNEGSFFLSPYLLVGALSLLASGDAASAFIDPSLPRLITATAIASAAIGTTLNQVVLPEIQKLPQKAVDIVAVRQQLLSQYDILQSRLKELKQLAQKEVWMLTRMCQLDNKILAVGEPSYRARRGRVKRVRESLESTLSARIELMESYAKLCSMIEIEIEMDSDVIAAEVASSAERISEQIQQLMEIDSLEEQWRIQAEANDEAERLLSSDSSETLPAGHM

SEQ ID NO: 2677 - DNA, 2037 bp, Panicum virgatum
  misc_feature: Ceres CLONE 1784445
  misc_feature: Encodes the peptide sequence at SEQ ID NO. 2678
atttctttccccacccaccaactcctcccgtcccctcccccgattatcttagcagcaggaggaggaagacgacgtcgaggagtaggcctttgctcgttgtggtctggcgaaaggcctttggtggagggaataatcaatcaatccatcgctgcacttggggttctccaacaaattcatcctccataccaagaagaaagcagattggattccctgagaaccaaagcaatggatgtcaacgctgcctccgtttcttcttctccatcgtcgtgcaccaccccggagacagaggacctgcaattcgacggccgccaccacgagagggcgccgctcctgctgcccaccaagatcatggacgccgccgacgagaagggcgagaggcctgacctcaccgaggatacggcccaccagattagcgttgatccctggtatcaagttgggttcgtcctcataaccggggtcaacagcgcatatgtgctaggatactctggctctattatggttcctttaggctggattgccgggacatgtggcctcctcctagctgccgccatatccatgtatgctaatgcgcttcttgcacgactccatgaagttggcggcaaacgccatatcagatacagagatcttgctgggcacatatatggaagaaaaatttatggacttacatgggctctgcaatacgttaatcttttcatgatcaacactggctttatcatcttagctgggcaagctctgaaggcaacatatgcactctttagggatgacggagctctaaagcttccttactgcattgcaatatcaggattcgtctgtgctctttttgcctttggaatcccttatttatccgccctcagggtttggttggggttctccacacttttcagcctcatctatattgtcatagcgtttgtgctgtcactgagagatggaatggccgcgcctgcaagggattatagtattcacggaccacatggaactcgaatctttacaacaataggtgctgtagcagaccttgtgtttgcttacaacaccggaatgctgccagaaattcaagcaaccataaggcctcctgtggtcaagaacatggagaaagctctgtggttccagttcaccgttggctcgttgcctctctacgctgtaacctttatgggttactgggcctatggttcctcaacatcaacttatctactgaacaacgtcaaaggaccagtttggataaaagccactgcaaatatgtcggcctttcttcagactgtcatagcgttacacatatttgcgagcccaatgtatgagtttttggacacaaagtacggaagtgggcatggtggtccttttgcattccacaacatggtgttcagagtacttgtcagaggaggctacctgacggtgaacacgctggtggcagcggtgctcccgttccttggggacttcatgagcctgacgggcgccctcagcaccttccccctgacgttcgttcttgcaaatcacatgtacctgatggtgaagggccataagttgtctgccatccagaaatcctggcactggttgaatgtaattgggttcagcggtttggctgttgcagccgcggtcgcggcagtaaggcttatcgtgcttgattctagcacctaccacttcttcgctgatctttgaggcgaatttggagcattgccttgataggtcagctgaaagatttagttttttttgtttcattttgggtgggctggggaagatatggtaatagaaacggtgaattcaatcaatccataaaatgaagaccaccgatctatgcgcatgcagagagtgcacggacaagtggagaagtgtgtgtattgctagttgacatttgcgccacctccagttgcgacactggaagcatttcagttacaactctaaaatatttggagttgcaacgtattattaaaaagcaaatatatcagttgcaactgggccagagatacacaaacatctggattattttgtccagtgatttataataaaatatatctatgatggtaacaaaaaaaaaaaaaaaaaaaa

SEQ ID NO: 2678 - protein, 474 aa, Panicum virgatum
  misc_feature: Ceres CLONE 1784445
  misc_feature: Great-hit functional homolog of the protein sequence encoded by LOCUS At2g36590
  misc_feature: Great-hit functional homolog of the protein sequence given in SEQ ID NO 9718
  misc_feature: Useful for making plants with altered carbon content
  misc_feature: Useful for making plants with altered nitrogen content
  misc_feature: Useful for making plants with modulated nitrogen use efficiency
  misc_feature: Useful for making plants with modulated oxidative stress sensitivity
MDVNAASVSSSPSSCTTPETEDLQFDGRHHERAPLLLPTKIMDAADEKGERPDLTEDTAHQISVDPWYQVGFVLITGVNSAYVLGYSGSIMVPLGWIAGTCGLLLAAAISMYANALLARLHEVGGKRHIRYRDLAGHIYGRKIYGLTWALQYVNLFMINTGFIILAGQALKATYALFRDDGALKLPYCIAISGFVCALFAFGIPYLSALRVWLGFSTLFSLIYIVIAFVLSLRDGMAAPARDYSIHGPHGTRIFTTIGAVADLVFAYNTGMLPEIQATIRPPVVKNMEKALWFQFTVGSLPLYAVTFMGYWAYGSSTSTYLLNNVKGPVWIKATANMSAFLQTVIALHIFASPMYEFLDTKYGSGHGGPFAFHNMVFRVLVRGGYLTVNTLVAAVLPFLGDFMSLTGALSTFPLTFVLANHMYLMVKGHKLSAIQKSWHWLNVIGFSGLAVAAAVAAVRLIVLDSSTYHFFADL

SEQ ID NO: 2679 - DNA, 684 bp, Panicum virgatum
  misc_feature: Ceres CLONE 1784464
  misc_feature: Encodes the peptide sequence at SEQ ID NO. 2680
aactgctcctaaagtcctaatccgaaaggccgcgtgctctgcacggggctggtggcaaggatggagacgacgatggccgtggtcgcgagggcggcggcgccgctcgccgggaccggccgcaggccctccggttcggcgcggccttcggcatccctctccttcgccgccaccgccgccgccacgaggtcccgtggccggcttgggttggggctgagcgcgcggagcgggagggcggccggggcgcgtcgcgccgtcccgcgcggcatcgtcgcatccgcggaggttgagcaaacctacattatgataaaacctgatggagttcagcgtggcttggttggggagatcatttctccctttgagaagaaaggctttttgttgaaggggttgaagctttatcagtgctccaaggacttggctcaggtttgcctctcaaaatgtactgaacatggggaagctattgtggttctagcaaagttattgtggttctagcaacaccattcttaaggaacatgtcttttttgcatctgcatctgtttctttattacttgaaatggtcaaattatcactttttattgtcaaatataccttccactgccccacatttagcttatgtacttatgatccttatgtttatcctttctgaataaaatactgctcaatttctaaaaaaaaaaaaaaaaaaaa

SEQ ID NO: 2680 - protein, 142 aa, Panicum virgatum
  misc_feature: Ceres CLONE 1784464
  misc_feature (1)..(45): Pfam Name: NDK Pfam Description: Nucleoside diphosphate kinase
  misc_feature (65)..(120): SWISSPROT Homolog: EC 2.7.4.6 Nucleoside diphosphate kinase 2, chloroplast precursor
METTMAVVARAAAPLAGTGRRPSGSARPSASLSFAATAAATRSRGRLGLGLSARSGRAAGARRAVPRGIVASAEVEQTYIMIKPDGVQRGLVGEIISPFEKKGFLLKGLKLYQCSKDLAQVCLSKCTEHGEAIVVLAKLLWF

SEQ ID NO: 2681 - DNA, 801 bp, Panicum virgatum
  misc_feature: Ceres CLONE 1784469
  misc_feature: Encodes the peptide sequence at SEQ ID NO. 2682
agtacgtccgcccccaatccacccgccgccacgcaccaaacctccgccgccgccgacctccatcctcgagcaccatgaggcctctcgacgagaaagagaccacccaagtattcgagaagctcttcaagttcacggggcccaacctgaagcacctcctggagcggcccaccgtcgagggccccgacccggagcccggccgctactgcctccgcctccaccgcaaccgcgtctactacgcctccgaggcgctcgtccgccgcgccaccgccgtcgcgcgcccgcgcctcgccgccgtgggcacgcccatcggcaagttcacccaccacggcgccttccacctcaccgtccacgcgctcgacctcctcgcggcccacgcgcgccgccgcgtctggctcaagcccgactccgagcgctccttcctcttcggcaactccgtgcccaagtcctccctcgcgcgcatcaccgagaacaccaaggcgggggacggggtggtcgtcatgtccatggccgacgtcccgctcggcttcggcatcgcggcgaggtcggcgcaggactgcaggaaggccgacactaacgccgtggtcgtgctgcatcaggcggacgccggggagtacctccgcaaggaggaggagctcatgtgaggtgtgccatggctagggggtgcctgaaaatgtcaaggcgcaaagcaaactccccccttcttttcttttggctgtttcagggtgtaagaacttgtggtatttccatttctttggaatggaaacggggctcgcctcgattcaaaaaaaaaaaaaaaaaaaa

SEQ ID NO: 2682 - protein, 188 aa, Panicum virgatum
  misc_feature: Ceres CLONE 1784469
  misc_feature: Great-hit functional homolog of the protein sequence given in SEQ ID NO 9691
  misc_feature: Useful for biocontainment applications
  misc_feature: Useful for making plants with modulated biomass
  misc_feature: The plant produces a reduced number of seeds.
  misc_feature: The plants are small.
MRPLDEKETTQVFEKLFKFTGPNLKHLLERPTVEGPDPEPGRYCLRLHRNRVYYASEALVRRATAVARPRLAAVGTPIGKFTHHGAFHLTVHALDLLAAHARRRVWLKPDSERSFLFGNSVPKSSLARITENTKAGDGVVVMSMADVPLGFGIAARSAQDCRKADTNAVVVLHQADAGEYLRKEEELM

SEQ ID NO: 2683 - DNA, 1921 bp, Panicum virgatum
  misc_feature: Ceres CLONE 1784502
  misc_feature: Encodes the peptide sequence at SEQ ID NO. 2684
atacccagccaggcagcagccgagagcaagcagagccgccagcgccagcacagcacagcaactcgcaagcacacagctagtgatcagcggcagcaatggcggtgtctgcggccagggtggccgtcgccacggccgcctccttggccgcgcactggctcatccgctccttcctccagccccactaccccgcgctgggcctgctcctgccggccgccgtcttcctcgccatcgccgtgctgggcggcggcagcgacgccggcggcagcgcgccgccgggcccggcggccgtgccggtgttcggcaactggctgcaggtggggaacgacctcaaccaccgcttcctggcgcgcctgtccgtgcggtatgggcccgtgttccgcctccgcctcggcgtgcgcaacctcgtcgtcgtttccgacccgcggctcgccgcggaggtgctccacacgcagggggtggagttcggctcccgcccccgcaacgtcgtcttcgacatcttcacggccaacggcgccgacatggtcttcaccgagtacggcgaccactggcgccgcatgcgccgcgtcatgacgctgcccttcttcacggcacgcgtcgtgcagcagtaccggggcatgtgggaggccgagatggacgccgtcgtcgccgacatctccggcgacggctcggcggcccagcgcggcggcttcgtcgtgcggcgcaggctgcagctcatgctctacaacatcatgtaccggatgatgttcgacgcgcgcttcgactccgtcgacgaccccatgttcgtcgaggccaccaggttcaactccgagcgcagccgcctcgcgcagagcttcgagtacaactacggcgacttcatccccatcctgcgccccttcctgcgaggctacctcgacaggtgccgggacctgcaggccaggaggctcgccttcttcaacaacaactacgtcgagaagaggaggaagatcatggacacgcccggggaaaaggacaagctccggtgcgccatcgaccacatcctccaggccgagaagaacggcgagatcacgccggagaacgtcatctacatcgtcgagaacatcaacgtcgccgccatcgagaccacgctctggtccatcgagtgggcgctcgccgaggtcgtcaaccacccggccgtgcagcgcaaggtccgcgacgagatcagggacgtgatcggagacgacgagcccatcaccgagtccagcatccacaagctcccctacctgcaggccgtgatcaaggaggcgctgcgcctccactcccccatcccgctcctcgtcccgcacatgaacctcgaggaggccaagctcggcgggtacaccatccccaagggctccaaggtggtggtgaacgccaggtggctcgccaacaacccggagctgtgggagaagccggaggagttccggccggagcggttcttgggcgaggagaaggccgtggacgccaccgtcggcgggaaggtggacttcaggttcctgcccttcggcgtgggccgccgcagctgccccgggatcatcctggccctgcccatcctcgcgctcatcgtcggcaagctcgtgcgcagcttcgagatggtgccgccgcccggcgtcgagaagctcgacgtcagcgagaaaggcgggcaattcagcctgcacattgccaagcactctgtcatcgccttccacccaatctctgcatgaacaagagcgctccagatcatttctgacagggaagttaccctgcacaatgattttcgtttttatttaattggtatacgagttacggtagaaatgtggaagcaagttattttacagaatttttttttgagtttttcggggatgtaatttggaaattgaaatgttactgtcatcattcatactaatttgagcatgacatgttcggagccaaaaaaaaaaaaaaaaaa

SEQ ID NO: 2684 - protein, 533 aa, Panicum virgatum
  misc_feature: Ceres CLONE 1784502
  misc_feature (33)..(532): SWISSPROT Homolog: EC 1.14.13.11 Trans-cinnamate 4-monooxygenase
MAVSAARVAVATAASLAAHWLIRSFLQPHYPALGLLLPAAVFLAIAVLGGGSDAGGSAPPGPAAVPVFGNWLQVGNDLNHRFLARLSVRYGPVFRLRLGVRNLVVVSDPRLAAEVLHTQGVEFGSRPRNVVFDIFTANGADMVFTEYGDHWRRMRRVMTLPFFTARVVQQYRGMWEAEMDAVVADISGDGSAAQRGGFVVRRRLQLMLYNIMYRMMFDARFDSVDDPMFVEATRFNSERSRLAQSFEYNYGDFIPILRPFLRGYLDRCRDLQARRLAFFNNNYVEKRRKIMDTPGEKDKLRCAIDHILQAEKNGEITPENVIYIVENINVAAIETTLWSIEWALAEVVNHPAVQRKVRDEIRDVIGDDEPITESSIHKLPYLQAVIKEALRLHSPIPLLVPHMNLEEAKLGGYTIPKGSKVVVNARWLANNPELWEKPEEFRPERFLGEEKAVDATVGGKVDFRFLPFGVGRRSCPGIILALPILALIVGKLVRSFEMVPPPGVEKLDVSEKGGQFSLHIAKHSVIAFHPISA

SEQ ID NO: 2685 - DNA, 1661 bp, Panicum virgatum
  misc_feature: Ceres CLONE 1784522
  misc_feature: Encodes the peptide sequence at SEQ ID NO. 2686
aaacgattggctcagaggtcacctcgccttcctcaccaagaactcggccaattacatggacatggactccctcgccgctcaattttacagcggcagctcgccgcagctgcccgcctctagcctcgcttgctaccctccctccctactccccttcgtagctcgtagctcctctctacaaacggccggcctagtacgaccttcttcagctagctcgggtgccatggccgctctttcgctcaggctggggttcgtggccccgccgtatcctaggaccagcagcggcaggttcgccccgtcctgccgcgccgtcgccagcggcggcggcggaggacccccgcgccccatcaccgtcgccggcgacccgcccacggtcgtgtcggcgcccggccgccgcattgtcgccattggcgacgcccacggcgatctctcccagacgcgagccgcgctggtgttggccggcgtcctcagcgcggaatcagatggccatgtgtggacaggcgggcgcacggtacttgttcaagttggggacatccttgatcgtggtgaagatgaaattgccatactctccctattgagctcactgagcgtgcaagccaaatctcaaggtggcgctgtgtttcaggttaatgggaaccatgaaaccatgaacgtggaaggtgatttccgatacgtctatcccggaggctttgatgaatgcatacgcttccttgagtacctggatgagtgtgatgagaactgggatgacgcctttctcaactgggttaacgtcactgaaaggaggaagaaagaatacagagcttcgcggcgttcttggaactttgtcaagaaccagaaagggtttgctgcaagatcatcacttttcaagcgaggtggcccgctagcttgtgaattggcacggcatcctgttgtccttaagatcaatgactggatattttgtcacggtggccttcttcctcatcatgttgaatacgggattgagcgtatgaacatagaagtgtcaacgtggatgaaaagttcaggtgaagacagcgatcatgagaccgacatccccttcatagctactagaggttatgacagtgtggtatggagcagaatgtattcgcaagactctgccgaaaggacacgccgtgctttgctgctatcttccatcattgctgaggaaacactgaaatctgtgggagcaaaggggatggtggttgggcatactcctcagatccgtggggtgaattgcaaatgcgacggcaaagtttggtgcattgatgtgggcatgtcgtatggtgttctctactcaagaccagaggtcctagaaatagtcaatgatagaccaagggttttgaagaagcggagggactcatatgacgagatggaagtgctggactatttataaaccttgagaaacatgtgataccacgctggttttggatggcatcaaacattcatgcaaagctattgcttgcgatacacagaaaagtctgggaagaaaataatcatgttgctgcaggtatataatagcaaacattctttttccggagagctactgtaccagaccatttgggtggaagtacatgaatgaaagttacagagatatatgtaaattcaactgaaggttttctcaatgtggttagtacgtttccttcagtcaaaaaaaaaaaaaaaaaaaa

SEQ ID NO: 2686 - protein, 443 aa, Panicum virgatum
  misc_feature: Ceres CLONE 1784522
  misc_feature (1)..(279): Pfam Name: Metallophos Pfam Description: Calcineurin-like phosphoesterase
MDMDSLAAQFYSGSSPQLPASSLACYPPSLLPFVARSSSLQTAGLVRPSSASSGAMAALSLRLGFVAPPYPRTSSGRFAPSCRAVASGGGGGPPRPITVAGDPPTVVSAPGRRIVAIGDAHGDLSQTRAALVLAGVLSAESDGHVWTGGRTVLVQVGDILDRGEDEIAILSLLSSLSVQAKSQGGAVFQVNGNHETMNVEGDFRYVYPGGFDECIRFLEYLDECDENWDDAFLNWVNVTERRKKEYRASRRSWNFVKNQKGFAARSSLFKRGGPLACELARHPVVLKINDWIFCHGGLLPHHVEYGIERMNIEVSTWMKSSGEDSDHETDIPFIATRGYDSVVWSRMYSQDSAERTRRALLLSSIIAEETLKSVGAKGMVVGHTPQIRGVNCKCDGKVWCIDVGMSYGVLYSRPEVLEIVNDRPRVLKKRRDSYDEMEVLDYL

SEQ ID NO: 2687 - DNA, 1733 bp, Panicum virgatum
  misc_feature: Ceres CLONE 1784532
  misc_feature: Encodes the peptide sequence at SEQ ID NO. 2688
ttccgtcgttcctctctccaacctccctcccccacatacgattcttcacgccagcagtaatcgcccgttaatccccttccaaatccgcgatattcccaagaatcttctcttccgctcctcccattgcgctccctccctcacactcggattcctgctcgctttctccgtctccgtctccctctcggccgtcctcctctcctccgcctcggattcgaccgccgcgccacccctcttatcctgctcctgccgccgcctttttcttcctgcttctcctgtccgcccgggactctctctctccgcagttcttgctctttgcgtcgcgtcgaggagagcgtgcctttcgttccggatcgcgcggcgcccccgacatgtgcgtggagggactggaggacgcagggaggctagaccaggacatcgacaagcacgccggtttcgcgatggagagagtttgtgagaacacagtgtctgttgatttcaagcagaactttgtcccgttcatccggtcaggggagtggtctgatatcggaggtcgtgattacatggaagatgcccatgtctgcatctctgacatggcaaagaattttggctataaagcagcggatgatgaagtaatttccttttatggggtctttgatggacatggtggcaaagatgcagcccattatgtccgcgataacttgccacggatcattgtagaagatgctgattttcctcttgagcttgaaaaggtggtcaagaggtcatttgtggaaactgatagtaagtttgcagagacattttctcatcacaagggcctttcttctggaactacagcacttacagcgatgatttttggaaggtctcttctggtggctaatgctggtgactgccgagcggtcctttcccggcgtggcactgccattgaaatgtccaaggaccacaggccatgctgcatcaatgaaagaaagcgtgtagagtcgcttggtggctatgtcgatgatggttatttgaacggtcagctggcagtcactagggcactgggtgactggcatctcgacggcatgaaagagatgggtgaacctggagggcccttgagcgctgagccagagctgaaaatgatcacattgacgaaggacgatgagttcttgataataggcagtgatggcatctgggacttcttctcaaaccaaaatgctgtggatttcgcacgacggaagctccaacaagaccacaatgacttgaggctgtgctgcagggagatcgtcgatgaggcaataaggcggggagccagcgacaacctaacagcagtgatggtttcgttccaccaggaggcccctccccagaccagagtgaacaggaccggcagggttgcacgtagcatatcagctgaagggcttcacaacctcagagtgctcctggaaggccagtgacggcgccattgccgccagccctgatgttgtgctacattgctgagtgttaattgtaagtagtgattttcagtatcttggtgctgttcagcaactgtctgtcgacatgccagagtgactattcttgtctgagaataaaccaatgaatctgagatctcactagctgattgtgaggcgctgtgaataataaaagttggagctaggtaaggacgagttagcagtgtgcatccagggggctttcgtggctcattatgcgatgttttcccctgaccttttgtaaataaaaccttgctgggagtatcaatgtaatcgaagtaatgttctctt

SEQ ID NO: 2688 - protein, 346 aa, Panicum virgatum
  misc_feature: Ceres CLONE 1784532
  misc_feature (1)..(260): Pfam Name: PP2C Pfam Description: Protein phosphatase 2C
MCVEGLEDAGRLDQDIDKHAGFAMERVCENTVSVDFKQNFVPFIRSGEWSDIGGRDYMEDAHVCISDMAKNFGYKAADDEVISFYGVFDGHGGKDAAHYVRDNLPRIIVEDADFPLELEKVVKRSFVETDSKFAETFSHHKGLSSGTTALTAMIFGRSLLVANAGDCRAVLSRRGTAIEMSKDHRPCCINERKRVESLGGYVDDGYLNGQLAVTRALGDWHLDGMKEMGEPGGPLSAEPELKMITLTKDDEFLIIGSDGIWDFFSNQNAVDFARRKLQQDHNDLRLCCREIVDEAIRRGASDNLTAVMVSFHQEAPPQTRVNRTGRVARSISAEGLHNLRVLLEGQ

SEQ ID NO: 2689 - DNA, 994 bp, Panicum virgatum
  misc_feature: Ceres CLONE 1784548
  misc_feature: Encodes the peptide sequence at SEQ ID NO. 2690
cccggccctgcgctgctgcactgtcacacacacactccgcacgctctcctctcccctgcggcgacccgagagaggcgggcagccatggccggcgcggcgggcgacgacgccgggatggacgccgtccagaggcggctcatgttcgaggacgagtgcattttggtggatgagcaggacaatgttgttggacatgaatcaaaatacaactgccatctgatggaaaagattgaatctgagaatctgctccatagggctttcagtgtgttccttttcaactcaaaatatgagctgctactccagcaaaggtccgcaacaaaggttacatttcctttagtttggaccaacacctgctgcagccatcctctgtaccgtgagtctgaacttatccaggagaactaccttggtgtgagaaatgcagcacagagaaagctcctggatgagctgggcatcccagctgaagatgccccagtcgaccaatttacccctgttggtcggatgctctacaaggctccatctgatggaaaatggggcgagcatgagcttgactctatcctgatcatcgtccgggacgtcaagctgcagccgaacccagatgaggtcgccgatgtgaagtatgtgaaccgcgagcagctgaaggagctgatcaagaaggcggacgctggtgaggatggcgtgaagctctccccctggttccggctgatcgtcgacaacttcctcatgcgctggtgggacaatgttgagaagggcaccctcagcgaggtcgtggacatggagaccatccacaagctgaaggagtgaggggccgctgccaagcgtggctccggtgacctcttcgcttgccgttgctctgccgcatgcttacagtgcttacctataagaggttttgcccttgtctgctattgagaaccagatgtccagatcgtttgtttaaccggtgcttatactcatccgaataaacagcaataagtttgaccaaaaaaaaaaaaaaaaaaaa

SEQ ID NO: 2690 - protein, 237 aa, Panicum virgatum
  misc_feature: Ceres CLONE 1784548
  misc_feature (7)..(235): SWISSPROT Homolog: EC 5.3.3.2 Isopentenyl-diphosphate Delta-isomerase I
  misc_feature (8)..(235): SWISSPROT Homolog: EC 5.3.3.2 Isopentenyl-diphosphate Delta-isomerase II
MAGAAGDDAGMDAVQRRLMFEDECILVDEQDNVVGHESKYNCHLMEKIESENLLHRAFSVFLFNSKYELLLQQRSATKVTFPLVWTNTCCSHPLYRESELIQENYLGVRNAAQRKLLDELGIPAEDAPVDQFTPVGRMLYKAPSDGKWGEHELDSILIIVRDVKLQPNPDEVADVKYVNREQLKELIKKADAGEDGVKLSPWFRLIVDNFLMRWWDNVEKGTLSEVVDMETIHKLKE

SEQ ID NO: 2691 - DNA, 1670 bp, Panicum virgatum
  misc_feature: Ceres CLONE 1784564
  misc_feature: Encodes the peptide sequence at SEQ ID NO. 2692
aaaaaaaattgctgccgcgcccgctgctccgctgcctgcctgccgcccgcccctgctgctgcttcgttcatctccctccccgcctcctcggcctccgccaaagccagcctcctgaatcggagaagcgagagcagggatttctgggatttcccctcccctgaatcggcccgatgggctcgctggtctcctgcatgtccgatccttgcccgtcggcgtccccgccgccgcaggcgaagcggcgctcctccacctcctcccgcggccgtggcggcggcggcggaggcggcgggagggactccgccaaggccaccatggccatcgacgaggaggcgttggccaccgccgcggcgctcgtgctggggcagcggggcgccgtgggggcgttcgagcggtccgcgtcggtgcgctgcgcggccaagcgccagggccagggcccgccgctgccccggagcagcagcacgcgcccgaggtcgctcgccgagcccgagctccagccgcagcacctgctcgccaaggatttgaatactaaggatttggaaaccaacatcattgttctcgttcatggtggtggctttggtgcttggtgttggtacaagactatatcacttcttgaagatagtgggttcaaagttaatgccattgacttaacgggttcagggattcactcttatgacacaaacaagattagcagtctttcagagtattctgaaccacttacatcttaccttaaaggcttaggtgatgctcaaaaggtgattttggttggacatgattttggtggtgcatgtatatcctatgcaatggagatgttcccgtccaaagttgccaaggccattttcctctgcgcagcaatgctgacaaatggacacagtgcccttggcatgttccaacagcagatggacacaaatggcactctccaaaaggcacaggaattcatatactccaacggcaaggaccggcctccaaccgccatcaacatcgacaaggcactgctgagagacttgttattcaaccagagcccttccaaggatgtgtcgctggcctcggtgtccatgaggcccatccccttcgcccctctgctggaaaagctcgtgctaaccgctgagaactacggctcggtgcggcggttctacgtggagaccacggaggacaacgccattcccctccctctacagcagagtatgtgtggcaccaacccgccggagaaggtgctgcgtctgaagggggcagaccacgcgcctttcttctccaaaccacaggcgctgcacaagacactggtcgagatagccaccatgcctccggtccaggcgtcgtgagatcacgttttcatagcttcaggttttgccgtcaagtgagcgtgcatggctggtgtacatcctgaggatgtaaggatgttgtcagaggtgcggcagcatagcagggcatccttcggttgtggactgacatggtgacatcttgatcttcggggcaactatcactactgaatcccgtctagaaaaagtttggaaaggtgaaatttcacgagatttctgtgatgcttcagcttatgtgaaatttcacatttcagatatagggccttgaccccttcagcatgtgtaactctacaacagccaaaaagcaaaatgatagtaaagaaacatctttttttttaaaaaaaaaaaaaaaaaaaa

SEQ ID NO: 2692 - protein, 381 aa, Panicum virgatum
  misc_feature: Ceres CLONE 1784564
  misc_feature (1)..(220): Pfam Name: Abhydrolase_1 Pfam Description: alpha/beta hydrolase fold
MGSLVSCMSDPCPSASPPPQAKRRSSTSSRGRGGGGGGGGRDSAKATMAIDEEALATAAALVLGQRGAVGAFERSASVRCAAKRQGQGPPLPRSSSTRPRSLAEPELQPQHLLAKDLNTKDLETNIIVLVHGGGFGAWCWYKTISLLEDSGFKVNAIDLTGSGIHSYDTNKISSLSEYSEPLTSYLKGLGDAQKVILVGHDFGGACISYAMEMFPSKVAKAIFLCAAMLTNGHSALGMFQQQMDTNGTLQKAQEFIYSNGKDRPPTAINIDKALLRDLLFNQSPSKDVSLASVSMRPIPFAPLLEKLVLTAENYGSVRRFYVETTEDNAIPLPLQQSMCGTNPPEKVLRLKGADHAPFFSKPQALHKTLVEIATMPPVQAS

SEQ ID NO: 2693 - DNA, 1741 bp, Panicum virgatum
  misc_feature: Ceres CLONE 1784588
  misc_feature: Encodes the peptide sequence at SEQ ID NO. 2694
acacttctctcctcctcataccactagtgcaaggtcctagatttacacttcttggtgcttgcttagcttgtttctttctagcaacgataattgctagcagctagctcagctggtagtcagtggcctggcctggtgtgatctattggccgaccggccggccgggatcaggggttaacggtgagtactactagctagctagctagctcataagcaagcaaagcaagcagcaggcaaggccggccggagatgccgacgccgtcgcacctcaagaacccgctctacttcgacttccgcgcggcgcggcgcgtgcccgagtcgcacgcctggccggggctgcacgagcaccccgtcgtggacggcggcggcgcgccggggacgccggacgccgtgccggtggtggacctgcgggagtccggcgcggcggcggcggccggcgtggcgcgcgccgccgagctgtggggcgcgttcctgctcaccgggcacggcgtccccgcggagctcctggcgcgcgtcgaggaccggatcgcgcgcatgttcgcgctgccggccgccgacaagatgcgcgccgtgcgcgggcccggcgacgcctgcggctacggctcgccgcccatctcctccttcttctccaagtgcatgtggtccgagggctacaccttctcgccggcctccctccgcgccgacctccgcaagctctggcccaaggccggcgacgactacgccagcttctgtgacgtgatggaggagttccacaaggagatgcgcgtcctggccggcaagctgctggagctcttcctcagggcgctcgggctcaccgacgaggaggtcgccgccgtcgaggaggagcggcggatcggcgagacgatgaccaccaccatgcacctcaactggtatccaaggtgcccggacccgcggcgcgcgctggggctgatcgcgcacacgaactcgggcttcttcaccttcgtgctgcagagcctcgtgccggggctgcagctgttccggcacgccccggaccggtgggtggcggtgccggccgtgccgggcgccttcgtcgtcaacgtcggcgacctcttccagatcctcaccaacggccgcttccacagcgtgtaccaccgcgccgtcgtgaaccgggacctggaccggatatcgctgggctacttcctcggcccgccgccgcacgccaaggtggcgccgctgcgggaggccgtgccgccgggccggacccccgcgtaccgcgccgtaacgtggcccgagtacatgggcgtccgcaagaaggccttcaccaccggcgcctccgcgctcaagatggtcgccgccgccgccgccgaatccgacgacgccgacgtccaccagccgctcgtcctctcgtcgtagccgatcgatcgatcgccggagccgacaacgacgacgcataccgtacccccgagcatactaatcaaacaagcggcaaccccgatgaaatggcatccattctcgctcgcgcgcatgcagctagctagcggccggccttccgcacctgctcctcctcctctgccgctggctgtagaaaaagaaaactaattaagctgagaccaagacaaagacgaaacgaacggagaggaaaaggatatgctctctagctgtttcttctagttgcaggcaggctgctcccagccgagtttgtcgttactgaagatttatgaccctgattaaaaactaatctgaattaatgcatgtggtttggcaaaaaaaaaaaaaaaaaaaa

SEQ ID NO: 2694 - protein, 374 aa, Panicum virgatum
  misc_feature: Ceres CLONE 1784588
  misc_feature (1)..(102): Pfam Name: 2OG-FeII_Oxy Pfam Description: 2OG-Fe(II) oxygenase superfamily
  misc_feature (1)..(373): SWISSPROT Homolog: EC 1.14.11.15 Gibberellin 3-beta-dioxygenase 2-3
  misc_feature (1)..(374): SWISSPROT Homolog: EC 1.14.11.15 Gibberellin 3-beta-dioxygenase 2-2
MPTPSHLKNPLYFDFRAARRVPESHAWPGLHEHPVVDGGGAPGTPDAVPVVDLRESGAAAAAGVARAAELWGAFLLTGHGVPAELLARVEDRIARMFALPAADKMRAVRGPGDACGYGSPPISSFFSKCMWSEGYTFSPASLRADLRKLWPKAGDDYASFCDVMEEFHKEMRVLAGKLLELFLRALGLTDEEVAAVEEERRIGETMTTTMHLNWYPRCPDPRRALGLIAHTNSGFFTFVLQSLVPGLQLFRHAPDRWVAVPAVPGAFVVNVGDLFQILTNGRFHSVYHRAVVNRDLDRISLGYFLGPPPHAKVAPLREAVPPGRTPAYRAVTWPEYMGVRKKAFTTGASALKMVAAAAAESDDADVHQPLVLSS

SEQ ID NO: 2695 - DNA, 1728 bp, Panicum virgatum
  misc_feature: Ceres CLONE 1784595
  misc_feature: Encodes the peptide sequence at SEQ ID NO. 2696
atagccgcaccacttctccactgcaccagtcctcttgcttcggctctcctccacccccggggggtttctctggccttcggtgcagggtactctactccactgttggactagatcacagctgcccctctgttcgccggtgcgcgtcggattggcttgtccgcggaggccagagaatcacctagaccgggatacaggaatttcagtatgcaacaaatggccatgtcagcgtttgcggtcacctcaccttcatcgcatggctatgccttatcagcccttcatgcccgtcattctcaaagactgcacatgaaacgcatttgcagccaggttcgggcactggcacaaacacaattgcagtacaagaagctgggagattcagacctccttatcagtgaggtcactcttggaacaatgacttttggagagcaaaacacagaaaaggaagctcatgatatgctctcttattctttcgatcaaggcattaatatccttgacaccgcagaaatttaccctgttccaacgaacaaggacactcaaggaagtaccgatctatatattggcaggtggatgcaatctaagccgcgagacaagataattttggcgaccaaagttgctggttattcagaaagatccacttttcttcgggacaatgcaaaagtagtgtgtgttgatgctgccaatatcaaagaaagtgttgaaaagagccttaaacgattgtctacagactacattgatttgcttcagatacactggccagatagatatgtgccactatttggtgaatatagttataatccaaccaaatggaggtcaagcgtaccttttgagggtcaattgaaggccttccaggagctaattgacgaaggaaaggttcgctatattggtgtttccaatgagacctcatatggtgtaatggagtttgtacacgctgctaagactcaaggcctcccaaagattgtgagcatccagaacagttatagtctaattgtgagatgccgctttgaagttgatcttgttgaagtttgccacccaaataactgcaatgttggactgctggcctactctccgttggctggtggtgttcttactgggaagtatcttgatgctaacactgacatttcaaagaggagtaggcttaatctcttccctggatacatggcgcgctacaatgcctctttggcaaaggaagcgacaaacgaatacgtaaagcttgccaagaagcatgggctaactccagtccagcttgcactgggctttgtgcgtgaccgtccattcactgccagttccatcattggagcaacaaccatggatcagttaaaggagaacattgatgcattcaccagtgctccacggccactaccacaagaagttctcgacggcattgaggatctgttcaagagatacaaagacccagtaatcctctaaatgtctattcaccatttggacgaaaagaaccagcagtgctgaaatcatacaaagatcagaaaatagtagcatttatgatagtaatattttattaatgcagatagaaatgtttctttgtatcttcttccatttattttatggatactaccatcaaaatgattttttttgcactctatgtagaagtagattttcatagtgagttcgaagggaatacattctcttattctatattagtaaatgtatgaggttttagattttaacaggtctccaatacacaagtttgaccaaaaaaaaaaaaaaaaaaaa

SEQ ID NO: 2696 - protein, 405 aa, Panicum virgatum
  misc_feature: Ceres CLONE 1784595
  misc_feature (89)..(385): Pfam Name: Aldo_ket_red Pfam Description: Aldo/keto reductase family
MQQMAMSAFAVTSPSSHGYALSALHARHSQRLHMKRICSQVRALAQTQLQYKKLGDSDLLISEVTLGTMTFGEQNTEKEAHDMLSYSFDQGINILDTAEIYPVPTNKDTQGSTDLYIGRWMQSKPRDKIILATKVAGYSERSTFLRDNAKVVCVDAANIKESVEKSLKRLSTDYIDLLQIHWPDRYVPLFGEYSYNPTKWRSSVPFEGQLKAFQELIDEGKVRYIGVSNETSYGVMEFVHAAKTQGLPKIVSIQNSYSLIVRCRFEVDLVEVCHPNNCNVGLLAYSPLAGGVLTGKYLDANTDISKRSRLNLFPGYMARYNASLAKEATNEYVKLAKKHGLTPVQLALGFVRDRPFTASSIIGATTMDQLKENIDAFTSAPRPLPQEVLDGIEDLFKRYKDPVIL

SEQ ID NO: 2697 - DNA, 1603 bp, Panicum virgatum
  misc_feature: Ceres CLONE 1784639
  misc_feature: Encodes the peptide sequence at SEQ ID NO. 2698
cctgcttcccactccctccacgcctccccgcctctccttttcaaccgctccccgtcatctcccccctcctcctcctgctcccccacctctgctgcaccagccatggcgtcgtcgttcgtcgcgcaccaccacggctcgctgggggtgatggaggggaggatgaccgcgctgaggagcagcctgaggccgtgcgaggccgcggaggagttggacgctgcgccggcgacgtgcggggcgacggcggaaaggggtgccggccttttcggggacgggttctccgtcgaggacctgctggacctcgaggacctctgcgaggtcgataaggactgcgccgagctggtggacgcgccgccggcgccggcgccggcggccgtggacgacgacaagctgtccagtgactcccacggatcgtcggtggtgtcgtacgagctcatgccgctcccgccgccgccagtgattgacctcccgctgccggggcatgacgcggaggagctggagtgggtgtcccgtatcatggacgactcgcaggccgagctcccgccgcagccgaagctaccggcggcgaccgtagcagcagccgcagcagcggtagcgcggcgtccgctggaacgcgcggtgccggcggcggcgggccctacacggagcccgacgatatgcgcgctgtcgacggaggcgctggtgcccgtgaaggcgcggcgcagcaagcggtcgcgcgcctccgtgtggtcgctctccggcggcgcgctgctgtcggactcgacgtcgtcgtcctccacggccaccacgtcgtcctgctcctcctccgcctcgttcgcgccgttcctcttcctgccggcggactcgccgcccgcgttctttgcggcgcgtctcctcttcgaggcgccacgcggcgcctccaagaagcccaagcacggcaagagcggcggcaagcccaagaagcgcgggcgccggccgaagcaccacccggcgccgcaccaactcgcggcggcggccgcggccccgggcgaccggcgctgcagccactgcggcgtgcagaagacgccgcagtggcgcgcgggccccgagggcgccaagacgctgtgcaacgcgtgcggggtgcggtacaagtccgggcggctcctgccggagtaccggccggcgtgcagccccacgttcgtgagcaccatccactccaactcccaccgcaaggtgctggagatgcggcgcaagaaggagggcgacctcgtgccgtgcccggcgccactcccggccgccgcgccggccgtcgcgtcgttctgagccggcgctgtacattttccctcttctccgtccccggtcgaattatcaagcctgctgtaccgtacctggattttttcgcccccttccgccttctatttcgtttcggttgtactagtagctagagctcagcgaactgtaggagctttattattaggtcgaattaggtgtagggattaagatttccatggcttattattagctaggtttgctggggtatgcatggccgcagtacttgtgccagtagttaagaactcggtgagggtctgcacgagaacaaagcttcgtgtttggcctggcctacgatgaaaaaaaaaaaaaaaaaaaa

SEQ ID NO: 2698 - protein, 391 aa, Panicum virgatum
  misc_feature: Ceres CLONE 1784639
  misc_feature (1)..(36): Pfam Name: GATA Pfam Description: GATA zinc finger
  misc_feature: The sequence is a functional homolog of  SEQ ID NO 2634 in the  10/374,780 US patent application
  misc_feature: The sequence is a functional homolog of  SEQ ID NO 318 in the  10/225,066 US patent application
  misc_feature: The sequence is a functional homolog of  SEQ ID NO 609 in the  10/374,780 US patent application
  misc_feature: The sequence is a functional homolog of  SEQ ID NO 76 in the  10/666,642 US patent application
  misc_feature: Useful for making plants with modulated growth and phenotype characteristics
MASSFVAHHHGSLGVMEGRMTALRSSLRPCEAAEELDAAPATCGATAERGAGLFGDGFSVEDLLDLEDLCEVDKDCAELVDAPPAPAPAAVDDDKLSSDSHGSSVVSYELMPLPPPPVIDLPLPGHDAEELEWVSRIMDDSQAELPPQPKLPAATVAAAAAAVARRPLERAVPAAAGPTRSPTICALSTEALVPVKARRSKRSRASVWSLSGGALLSDSTSSSSTATTSSCSSSASFAPFLFLPADSPPAFFAARLLFEAPRGASKKPKHGKSGGKPKKRGRRPKHHPAPHQLAAAAAAPGDRRCSHCGVQKTPQWRAGPEGAKTLCNACGVRYKSGRLLPEYRPACSPTFVSTIHSNSHRKVLEMRRKKEGDLVPCPAPLPAAAPAVASF

SEQ ID NO: 2699 - DNA, 808 bp, Panicum virgatum
  misc_feature: Ceres CLONE 1784712
  misc_feature: Encodes the peptide sequence at SEQ ID NO. 2700
atgcacagacgagagcgagccaagtgtactactcccagtgaagccacactagctagccacaccagcagcttgacaagctagctagctagctaggccgcagccatgtcggaggagaagcaccaccacttcttccaccaccacaagaaggatgaagaggagcagcccgccggcgggtactcggaggccgtggccgccgaggtggtggccgccggcgagagcgagtacgagaggtacaagaaggaggagaaggagcacaagcacaagcagcacctcggcgaggccggcgccatcgccgccggcgccttcgcgctctacgagaagcacgaggcgaagaaggacccggagcacgcgcaccggcacaagatcacggaggagatcgccgccacggcggccgtcggcgccggcggctacgccttccacgagcaccacgagaagaagaaggaccacaaggacgccgaggaggccagcggcgagaagaagcaccaccacctcttcggctgacccgccggcgagcgagctccggcccggccgccgcgcacccgcctgcttgctccaataattgtggccatgatttcgcaataagtcccttccggacccttagcttgtttgcttgtgtgagactgagaggtagggcccgcgcgtcgaggtgtgttccggcctgtacgtgcttgatttttctttgcgtccgtaattgcgttgaataaccgggagcgatgcacgtgtggctcccagtctgtctgtctgtggttgagtgtgtatcctgatgatcaactcgtggaagtttttacaaaaaaaaaaaaaaaaaaaa

SEQ ID NO: 2700 - protein, 132 aa, Panicum virgatum
  misc_feature: Ceres CLONE 1784712
  misc_feature (1)..(54): Pfam Name: ABA_WDS Pfam Description: ABA/WDS induced protein
MSEEKHHHFFHHHKKDEEEQPAGGYSEAVAAEVVAAGESEYERYKKEEKEHKHKQHLGEAGAIAAGAFALYEKHEAKKDPEHAHRHKITEEIAATAAVGAGGYAFHEHHEKKKDHKDAEEASGEKKHHHLFG

SEQ ID NO: 2701 - DNA, 927 bp, Panicum virgatum
  misc_feature: Ceres CLONE 1784815
  misc_feature: Encodes the peptide sequence at SEQ ID NO. 2702
gaagcgcagagaagcagctagtcagtcaatcgtgagttcgtgactgaaaatggcggaggtggaagcgacggcggggcagctgaggctgtactcgtactatcgcagctcgtgctcccaccgcgcccgcatcgccctcaatctcaaaggcgtggactacgagtacaaggcggtgaaccttctcaagggcgagcagtctgatccagaattcctgaagcttaatcctatgaagtttgtccctgcgctggttgatgacgatgcagtaattggtgactcttatgcaatagcattgtatttggaggacaagtaccccgaccctcctcttttgcctcaagaccctagaaagaaggctttgaatcaccagattgcgaacattgtaagctctggtattcaacctctccataatctctcagtgttggtgaggttcattgaacaaaaagttggtgctggagagagtgtcttgtggacccaacaacaaatcgagagaggtttcacagcaattgagaacctgatacaactaaaagactgtgctgggaagtatgcaacaggagatgaagtccaactggcagatgtattcctcgctccccagatttatgcagccattgagcacactaaaattgacatgtcgaattaccccaccctggcgaggctccacgcagagtacatggcacaccctgcattccaagcagcgctccctggtaatcaaccggacgcccctccctcgacatagaaactgcggtgttgttgcctcgtcagcctcgcatattgctcatctgaatatagatttggtcatttggagttgttacttgctcgttgatctgtaataggaataagcacataatttcccgcgcacactgcaaatacttttctggttttaaaaaactaccgaaataagagtggtttctggtcaaaaaaaaaaaaaaaaaaaaa

SEQ ID NO: 2702 - protein, 225 aa, Panicum virgatum
  misc_feature: Ceres CLONE 1784815
  misc_feature: Great-hit functional homolog of the protein sequence given in SEQ ID NO 9330
  misc_feature (1)..(72): Pfam Name: GST_N Pfam Description: Glutathione S-transferase, N-terminal domain
  misc_feature (1)..(95): Pfam Name: GST_C Pfam Description: Glutathione S-transferase, C-terminal domain
  misc_feature (1)..(225): SWISSPROT Homolog: EC 2.5.1.18 Glutathione S-transferase zeta class
  misc_feature (6)..(225): SWISSPROT Homolog: EC 2.5.1.18 Glutathione S-transferase zeta-class 1
  misc_feature: Useful for biocontainment applications
  misc_feature: The plant produces a reduced number of seeds.
MAEVEATAGQLRLYSYYRSSCSHRARIALNLKGVDYEYKAVNLLKGEQSDPEFLKLNPMKFVPALVDDDAVIGDSYAIALYLEDKYPDPPLLPQDPRKKALNHQIANIVSSGIQPLHNLSVLVRFIEQKVGAGESVLWTQQQIERGFTAIENLIQLKDCAGKYATGDEVQLADVFLAPQIYAAIEHTKIDMSNYPTLARLHAEYMAHPAFQAALPGNQPDAPPST

SEQ ID NO: 2703 - DNA, 730 bp, Panicum virgatum
  misc_feature: Ceres CLONE 1784994
  misc_feature: Encodes the peptide sequence at SEQ ID NO. 2704
acgcagagcaagcgagcgcagcagcagctgtagctagcttgtacgtgcacaaggagctcgctcggtcgcgatggcagctagagcggcgctcctcctggccgtgagcctggtcctggccgccgtggcgagcgcgaccaactgcccgccgccgccggccccgacgccgccgacgccgacgccgacgccgccgccggccccgacgccgccgacgccgacgccgacgcccagcggcggcggccaccactgccccagggacgcgctgaagctgggcgtgtgcgccaacgtgctgggcctcgtcaaggccaagatcggctcgccgccgtacctgccctgctgctcgctgctggacgggctcgtggacctggaggccgccgtctgcctctgcaccgccatcaaggccaacatcctcggcatcaaactcaacctccccatcgacctcagcctcatcctcaacaactgcggcaagagctgccccaacgacttccactgcgcatagatcgcccactgatcgaccgtcctcgctcctccatcgccggcggccgcggtcgtccatcattccattctgtcattccgtggcggctggttgatctcatcatcaactcgctgtcagttcgagcttgtttgtttttattcgtttcgttatacaaattaatgagtggttttttcacttgtacgtagccccctcccccgcaaaagtcaccacgtatgttaaaaaaaaaaaaaaaaaaaa

SEQ ID NO: 2704 - protein, 141 aa, Panicum virgatum
  misc_feature: Ceres CLONE 1784994
  misc_feature (3)..(47): Pfam Name: Cellulase Pfam Description: Cellulase (glycosyl hydrolase family 5)
  misc_feature (1)..(83): Pfam Name: Tryp_alpha_amyl Pfam Description: Protease inhibitor/seed storage/LTP family
  misc_feature (470)..(505): Pfam Name: Peptidase_M10_C Pfam Description: Peptidase M10 serralysin C terminal
  misc_feature (19)..(56): SWISSPROT Homolog: EC 3.2.1.4 Endoglucanase/exoglucanase B precursor [Includes: Endoglucanase
  misc_feature (26)..(55): SWISSPROT Homolog: EC 3.2.1.4 Endoglucanase A precursor
MAARAALLLAVSLVLAAVASATNCPPPPAPTPPTPTPTPPPAPTPPTPTPTPSGGGHHCPRDALKLGVCANVLGLVKAKIGSPPYLPCCSLLDGLVDLEAAVCLCTAIKANILGIKLNLPIDLSLILNNCGKSCPNDFHCA

SEQ ID NO: 2705 - DNA, 883 bp, Panicum virgatum
  misc_feature: Ceres CLONE 1785060
  misc_feature: Encodes the peptide sequence at SEQ ID NO. 2706
aaggaaaccacatgccccacctcgccgccactccccccacttcctccgccgccgccgcggtccgcgccgccctccccactggcgccggccgcgtagcgttcgggcactcgcggaccgttccgcggccggtggcgctgcgcctgcgcctgcgcgcgcgggccacccggcgggagggcggcggcggcgtgcgcacggaagaacaggagcaggacacggcgcagcggacgttctacgacctgctcgggatctcggcggaggggagcgccgacgaggtccggacggcctacaggcggctggcgctcaagtaccacccggacgtgtccccgccgggcgccgcggcggagaacacccgccgcttcatcgaggtgcaggaggcctacgagacgctctccgacccgagccgccgcgccagctacgaccgtgcgctcgcccgtggcgtctgccgcctcgccttctccggctcccgctcccatcgcgcctaccaccaccaggaccatgaagagaaatctggctggagaagatcttgggaagaccaggttgcggaactgaagaggaggagcatggcgaaggattcagacgagaatctatcgtggggagctcggatgcggagaagaagggccgaggcatcatcggcagaatagctgtgatagtaacccttccaacgcaacaatgatcatatctagcatgttagccaaaaccaattataattttgtgtagcgcgattcgaaggctgttgcctgcgaggttttatgttgtgcatcaaagatgagcctgctggaaaacctgcaggctgcagctgaccccttatcagaatcgcttagtactagtaatgtagtagtagctgtagcagtggcatcttccagaaaaaaaaaaaaaaaaaaaa

SEQ ID NO: 2706 - protein, 209 aa, Panicum virgatum
  misc_feature: Ceres CLONE 1785060
  misc_feature (1)..(65): Pfam Name: DnaJ Pfam Description: DnaJ domain
MPHLAATPPTSSAAAAVRAALPTGAGRVAFGHSRTVPRPVALRLRLRARATRREGGGGVRTEEQEQDTAQRTFYDLLGISAEGSADEVRTAYRRLALKYHPDVSPPGAAAENTRRFIEVQEAYETLSDPSRRASYDRALARGVCRLAFSGSRSHRAYHHQDHEEKSGWRRSWEDQVAELKRRSMAKDSDENLSWGARMRRRRAEASSAE

SEQ ID NO: 2707 - DNA, 878 bp, Panicum virgatum
  misc_feature: Ceres CLONE 1785133
  misc_feature: Encodes the peptide sequence at SEQ ID NO. 2708
ttcccttctgtttcctcctaccgcctccgccgcccccggcgttctgccgcagacccccagccggctgccgcccacctacacgcgcgcccggcggcccgtctctcgcccgccgtgcgccgccggccgcgagctccgggccggccgcctcccgcccacgtccgcgcgcgccgcaagctcccaagtcgaagtggggatggctgtgaccagattggcgttccccctcttcatcctcctcgccgcggcgggggtcgcggcggcgacgcggtcgccgtcggccttcgtgcagaacgccatctactccaaccgcatcaccatcttctcgaaaacctactgcccgtactctatccgtgctaagcgcatatttcgagatctcaaggaagatccatatgttgttgaactagatctccgagaggatgggcgtgacattcaaagtgttcttctggacctagttgggcgccatactgtgccacaggtgtttgtgaatggccagcatgttggtggctcagatgatacagtaaatgctctttcaaatggacagcttgagaaactccttggtaagagtcagtcacagtgatggatctcccggacaggctcgcactgtcaagaacacattagtgactcatatatatgtacggaaggaatatgtacgggaggggttttcttctgtgtttaagaccgcacagaatgttgtatctcatatcatatgtctaatgttttttttggggtatggtagttgtgacaaaaatctgtatgtacttatatgtgtgatctgctcaattacatatacattgtacaatcttttctagttccccttctcttgtatatgaatggaatttcgttggtttaccttcattatggaaaaaaaaaaaaaaaaaaaa

SEQ ID NO: 2708 - protein, 126 aa, Panicum virgatum
  misc_feature: Ceres CLONE 1785133
  misc_feature (1)..(63): Pfam Name: Glutaredoxin Pfam Description: Glutaredoxin
MAVTRLAFPLFILLAAAGVAAATRSPSAFVQNAIYSNRITIFSKTYCPYSIRAKRIFRDLKEDPYVVELDLREDGRDIQSVLLDLVGRHTVPQVFVNGQHVGGSDDTVNALSNGQLEKLLGKSQSQ

SEQ ID NO: 2709 - DNA, 614 bp, Panicum virgatum
  misc_feature: Ceres CLONE 1785183
  misc_feature: Encodes the peptide sequence at SEQ ID NO. 2710
tacccggacagtgctccttttttgttggtaagccggtgatcagtgggtaaccttctgccgaggctaggagtgaagaaggtagtaggaaggaatcagcagcagcgaagatgctggagaagctgtgggacgacgtggtggccgggccgcacccggagacggggctcgagaagctccgcaaggccaccacctcccgcccgctcgtcatcaacaaagatgctgacgccgccgccgccggcgggagctacaagcgtgcgcagtcgatgccgacgacgccggggacgccgtcgtcgacgacgccacgcactaacgtgtggcgcagcgtgttccacccggggagcaacccggccaccaggagcgtgggcgccaacctcttcgaccgcccgcagcccaactcccccaccgtctacgactggctctacagcgacgagaccaggagcaagcaccgctagatcggaggacggatgggatcggcggaggagcggtggccgccggtcccggtcagcccgtttagttaccaaaaattttcacccaaaattttttactttccatttgaacacatgcatgtagtattaaatatagttaaaaaaataaaattaattgcacagtttgaatgt

SEQ ID NO: 2710 - protein, 113 aa, Panicum virgatum
  misc_feature: Ceres CLONE 1785183
  misc_feature (1)..(121): Pfam Name: Auxin_repressed Pfam Description: Dormancy/auxin associated protein
MLEKLWDDVVAGPHPETGLEKLRKATTSRPLVINKDADAAAAGGSYKRAQSMPTTPGTPSSTTPRTNVWRSVFHPGSNPATRSVGANLFDRPQPNSPTVYDWLYSDETRSKHR

SEQ ID NO: 2711 - DNA, 759 bp, Panicum virgatum
  misc_feature: Ceres CLONE 1785188
  misc_feature: Encodes the peptide sequence at SEQ ID NO. 2712
agctccaaactccattattggttgatccttgagaagagaggaggaagagaggcagaagcaaaggagagacaacagttcttcagctaggcaggagggcaaggagagaggagatggcgtcgaagaggattcagaaagagctcaagggtctgcagaaggaccctcccacctcgtgcagtgcaggtcctgtgggtgaggatatgttccactggcaggcaacaataatgggtccatctgatagcccatattctggtggagttttcctagttacaatccatttccctcctgattatcctttcaaaccaccaaaggtggcgtttcgcaccaaggtgttccatccaaacattaacagcaatggaagcatctgccttgacatcctcaaggaccagtggagccccgcgctcactatatccaaggtgttgctgtccatctgctccctgctgacggatccaaaccccgacgaccctctggtccccgagatcgcgcacatgtacaagacggaccggcacaaatacgagaacaccgcgaggacctggacccagaggtacgccatgtagaggaccgggggtcaccgaagccggcgctgctccgcttgtgtattgtgtcgctggacctgggcgtgtctcctttgcgttcgatcgtgtgctgtactgctgtatgatgaatcaaattgggtttgcagtgcactgtgtggtgccgaatgttgtatcgtgtcactccgaagcagtaattctgaatgtccaaaaaaaaaaaaaaaaaaaa

SEQ ID NO: 2712 - protein, 147 aa, Panicum virgatum
  misc_feature: Ceres CLONE 1785188
  misc_feature: Great-hit functional homolog of the protein sequence given in SEQ ID NO 9309
  misc_feature (1)..(147): SWISSPROT Homolog: EC 6.3.2.19 Ubiquitin-conjugating enzyme E2-17 kDa
  misc_feature (1)..(147): SWISSPROT Homolog: EC 6.3.2.19 Ubiquitin-conjugating enzyme E2-17 kDa 10/12
  misc_feature: Useful for biocontainment applications
  misc_feature: The plant produces a reduced number of seeds.
MASKRIQKELKGLQKDPPTSCSAGPVGEDMFHWQATIMGPSDSPYSGGVFLVTIHFPPDYPFKPPKVAFRTKVFHPNINSNGSICLDILKDQWSPALTISKVLLSICSLLTDPNPDDPLVPEIAHMYKTDRHKYENTARTWTQRYAM

SEQ ID NO: 2713 - DNA, 740 bp, Panicum virgatum
  misc_feature: Ceres CLONE 1785210
  misc_feature: Encodes the peptide sequence at SEQ ID NO. 2714
gtatctcgtctgccgcccacccgaacgccgcacggacgcggcacacggcggctaatcgagcggcatgaggagctcggcggggccgcgcgcggcgggcgacgtcgacgtggagctgctcaaggcggtggcgcaggcgtggcacgcgcactcgggcaacccgcggccgtcgcgggcgtcggaggctggcggcgacgacagcgacgcgcccggcgccggcggcgcgcgcacccgcgcgggcgcgtcgcggcaccggccgtcgcggttcaagctggaggccatggccgcggcggccgccgccgcggcagctccaccccgcgaggcggcgtgggacttcgcgcggtcgctgtgggacacgtacgagctcgtcagcgtggcgcggaagctcgagtccggtctcgtcatcgccgaccacgccgccgcggcgccggccgtgccgcggggcggagacgcgcggggagcagggaagcgggccaaggagagcgggcgcagcttgaggagcctgttcctgcgctccacgtccaggaggttcggggaaccaaacagctaagaatgcacatttgaggtctgttgcatcgcagttgtcaagtttgctcaaatttcagaaatggcaagaaagaaaacagatacatcagcaccccatattcccatgtctttcaaagttttcagcatctgaacgagctcagtatgaattccagcgctgctgcactggtcgatttgggtaaaaaaaaaaaaaaaaaaaa

SEQ ID NO: 2714 - protein, 160 aa, Panicum virgatum
  misc_feature: Ceres CLONE 1785210
  misc_feature: Great-hit functional homolog of the protein sequence given in SEQ ID NO 9697
  misc_feature: Useful for making plants with modulated nitrogen use efficiency
MRSSAGPRAAGDVDVELLKAVAQAWHAHSGNPRPSRASEAGGDDSDAPGAGGARTRAGASRHRPSRFKLEAMAAAAAAAAAPPREAAWDFARSLWDTYELVSVARKLESGLVIADHAAAAPAVPRGGDARGAGKRAKESGRSLRSLFLRSTSRRFGEPNS

SEQ ID NO: 2715 - DNA, 660 bp, Panicum virgatum
  misc_feature: Ceres CLONE 1785241
  misc_feature: Encodes the peptide sequence at SEQ ID NO. 2716
agacgcgacgccgtcagcccgtcccgccgacttccgccgcggtgatcaccggaaccctagctgcggcacctctaccgccaggctctatcccatcgctgtgcgtggcctctcggacttcctcgccggattgatcgctggttgtggttgggatggcaacaccacttatagcaggacttgcagttgcagcaactgctcttgccggtagatatagcatcgaagcttggcaagcttataaggcaaggcctatagttccaaggatgcgcaaattctatgaaggtggctttcaacctacaatgaaccgaagggaagctgcattaatccttggtgtcagggaatctgccaatgcagagaaggtcaaagaggcgcacaagagggtaatggtcgccaaccatccggatgcgggtggaagtcattaccttgcttcaaagattaacgaggcgaaggatgtgttgactgggaaaaccagaggaggcgggtcagccttttgattggagaatgaacattgtgttcttccagtggaaggataattttgtacctccagacttagcattagaagatgggcacaagacttggtgttatgaaattttttggacaaataatattggatctttttgtagtaggttattaacttcttaataaaactcaaggctcagttgtgcc

SEQ ID NO: 2716 - protein, 112 aa, Panicum virgatum
  misc_feature: Ceres CLONE 1785241
  misc_feature (1)..(57): Pfam Name: DnaJ Pfam Description: DnaJ domain
MATPLIAGLAVAATALAGRYSIEAWQAYKARPIVPRMRKFYEGGFQPTMNRREAALILGVRESANAEKVKEAHKRVMVANHPDAGGSHYLASKINEAKDVLTGKTRGGGSAF

SEQ ID NO: 2717 - DNA, 958 bp, Panicum virgatum
  misc_feature: Ceres CLONE 1785265
  misc_feature: Encodes the peptide sequence at SEQ ID NO. 2718
acagcctgagccagccgcctgcccgcctcgcctccgatctgcctaccgcccgcgccacgtcgcccagcacctgcacggccgcgccgccgccctgcatcgaactcgcccccttcccccgggcggccgctgctaccgcggattcccctcgagagactgagagagagatccggcatggggctctgggactcgctgctcaactggctccgaagcttgttttttaagcaggagatggagctctccttggttgggctgcaaaatgctggaaagacatctctagtcaatgctgtcgctactggtggctacagcgaggacatgattccaacagtaggctttaatatgcggaaagttaccaagggaaatgtcacaattaaactttgggaccttggtgggcaacggagatttcggactatgtgggagcgctattgtcgaggagtttctgccattctatatgtggtggatgctgccgatcgagatagtgtcccaatagcgaaaagtgaattgcatgacctgctgacaaaacagtctttagctgggattcccttgcttgttcttggcaacaaaattgataagtctgaagctctttctaagcaggcattggttgaccaacttggattggaatcaatacaggatcgtgaagtttgttgctacatgatctcctgtaagaattctgtgaacatagacgttgtcattgactggcttatcaagcactccagaacagcaaagtagcttctgtgtgtttgtatcacttgatgcacggtgatttgagtgcctctgaatcaccacttcccgtttcctggtccagatgttaaaagcgaccaccttgtaatctatgatctctttggtgtcagacaaacagcatggtgtctagtacttgaacatctgaacctttgtactcctttgtaaatgccttaaatatttgattattctttattgtggacaaaaaaaaaaaaaaaaaaaa

SEQ ID NO: 2718 - protein, 184 aa, Panicum virgatum
  misc_feature: Ceres CLONE 1785265
  misc_feature: Great-hit functional homolog of the protein sequence given in SEQ ID NO 9273
  misc_feature (1)..(175): Pfam Name: Arf Pfam Description: ADP-ribosylation factor family
  misc_feature: Useful for making plants with altered terpenoid content
MGLWDSLLNWLRSLFFKQEMELSLVGLQNAGKTSLVNAVATGGYSEDMIPTVGFNMRKVTKGNVTIKLWDLGGQRRFRTMWERYCRGVSAILYVVDAADRDSVPIAKSELHDLLTKQSLAGIPLLVLGNKIDKSEALSKQALVDQLGLESIQDREVCCYMISCKNSVNIDVVIDWLIKHSRTAK

SEQ ID NO: 2719 - DNA, 662 bp, Panicum virgatum
  misc_feature: Ceres CLONE 1785379
  misc_feature: Encodes the peptide sequence at SEQ ID NO. 2720
aaaaccgtaagagcttctgaggagcaaaagacttcagtctagacactagacacagtaaaccttagcaccaacccaggttcagtatcttaccaaggatactccaaatatggctggatcacagagctcctctcccaattccaactcaacgtggagcctgaaagagaacaagatgtttgaagaggcactcgcctactatggtgagggcacacccaacctgtgggacaaagtgtccagcgccataggaggcatcaagtctgctgaggaggtgcgctgccactatgaagatcttgttgacgacgtcaagatgattgagtcagggcgggttacgtaccccaagtacaagacgcagggattctggacccgaggttgaagcatcagaagctcaagtgggccgaaacaaaagttccaagaatctatgattcacttaggttctagaaggaagcgaagtaatccaattctggttggagaataaaatgatgaaacattgtgtatatgtatatagtagataattagcaatgttaagtctctttgttgttgtaggatctagtttacattcataaaccccctgtatacattatccccttaaactaagttatgaagatgtaaaatcatgtatttatgttaattaaaaaagttgtgcctggtagcattctgttgcctcg

SEQ ID NO: 2720 - protein, 87 aa, Panicum virgatum
  misc_feature: Ceres CLONE 1785379
  misc_feature: Great-hit functional homolog of the protein sequence given in SEQ ID NO 9692
  misc_feature (2)..(51): Pfam Name: Myb_DNA-binding Pfam Description: Myb-like DNA-binding domain
  misc_feature: Useful for making plants with modulated nitrogen use efficiency
  misc_feature: Useful for making plants with modulated nitrogen use efficiency
MAGSQSSSPNSNSTWSLKENKMFEEALAYYGEGTPNLWDKVSSAIGGIKSAEEVRCHYEDLVDDVKMIESGRVTYPKYKTQGFWTRG

SEQ ID NO: 2721 - DNA, 942 bp, Panicum virgatum
  misc_feature: Ceres CLONE 1785507
  misc_feature: Encodes the peptide sequence at SEQ ID NO. 2722
gtgccacctccgtgtgccaagagcttcgagaagccgtcccccaaatccgcctacgcttccccctcctcctccacgaggtgaggaaaccctagcgaccgaccatggcgctgctcccgcgcacggcgcggctcgcgctcctctccaccccgcgggcgtactccgccgccgccgaggcgggcgcctcgaagacgtccccggcgccgtacgggggcgcccccccgccggcgatgtcgaagacggccgagttcgtggtctccaaggtggacagcctgatgaactgggcgcgcaagggctcgatctggcccatgaccttcgggctcgcctgctgcgccgtggagatgatgcacgccggcgcggcccgctacgacttcgaccggttcggcgtcatcttccgcccctcgccgcgccagtctgattgcatgatcgtcgccggaacactcaccaacaagatggcgccagccctccgcaaggtttatgaccaaatgcctgaacctcgatgggttatctcgatgggcagctgtgctaatggtggtggatactaccactattcctactctgttgtccgcggatgcgaccgtattgttcccgttgacatctacgtccctggatgcccaccaaccgccgaggcactactgtacggtgtcctccagctccaaaagaagatcaacaggcgcaaggatttccttcactggtggaccaagtgaagcaattgtctgttgttgttgctcccgtgctatatttcttcgcatttgacctacttgtcatctgaaataaggacagcctcggtgcttggatttgcgaatttgttgttgtacctggaaggatgcatgcccaggttgtttgataagcatggaactcatgtacttaaaatcagttcaacagtaatggacataccagctgtgaatctgtatttttgctttccaaaaaaaaaaaaaaaaaaaa

SEQ ID NO: 2722 - protein, 200 aa, Panicum virgatum
  misc_feature: Ceres CLONE 1785507
  misc_feature (1)..(108): Pfam Name: Oxidored_q6 Pfam Description: NADH ubiquinone oxidoreductase, 20 Kd subunit
  misc_feature (6)..(200): SWISSPROT Homolog: EC 1.6.5.3 NADH-ubiquinone oxidoreductase 20 kDa subunit, mitochondrial precursor
MALLPRTARLALLSTPRAYSAAAEAGASKTSPAPYGGAPPPAMSKTAEFVVSKVDSLMNWARKGSIWPMTFGLACCAVEMMHAGAARYDFDRFGVIFRPSPRQSDCMIVAGTLTNKMAPALRKVYDQMPEPRWVISMGSCANGGGYYHYSYSVVRGCDRIVPVDIYVPGCPPTAEALLYGVLQLQKKINRRKDFLHWWTK

SEQ ID NO: 2723 - DNA, 726 bp, Panicum virgatum
  misc_feature: Ceres CLONE 1785539
  misc_feature: Encodes the peptide sequence at SEQ ID NO. 2724
accaccctccacagcacacattaagcacaagcacaagcacaagctagcaagagctgcgtgtagctgcgccaaagccaccatggtgaaaatcaccgtaacaaggaaatcccagtccttcgtcgtgccggcatccgagccggcgccgccgtcggccgagacgacgacgctcgagctgtcggcgatcgaccgcgtgccgggccttcgccacacggtgcggtccctgcacgtgttccacaacaagaagcagtcctccaccaccggctgcggcgacgacgacgacgatgctgccaggccgggggaggtgatccgcgcggcgctgtcccgcgcgctggtggattaccgcccgttcgccggccgcttcgtcggctcggtcgccgccggggaggcctgcgtcgagtgcaccgacgacggcgcgtggttcgtggaggccgtcgccgactgcagcctcgaggacgtgaatggcctcgactacccgctcatggtctccgaggaagagctgctgcccgctccagaggaaggcgttgaccctacaagtattccggtcatgatgcaggtacttcgtcttccaatcttcgcatgcattccaggctagctacttgttgaccaccgttttttattttttaaaaataatctttttagtggctacatattgtaccattttcctaataagtggacaatgttttaaacactacaagaaaaaaaacagaaaaaaaaaaaaaaaaaaaa

SEQ ID NO: 2724 - protein, 170 aa, Panicum virgatum
  misc_feature: Ceres CLONE 1785539
  misc_feature (3)..(153): Pfam Name: Transferase Pfam Description: Transferase family
MVKITVTRKSQSFVVPASEPAPPSAETTTLELSAIDRVPGLRHTVRSLHVFHNKKQSSTTGCGDDDDDAARPGEVIRAALSRALVDYRPFAGRFVGSVAAGEACVECTDDGAWFVEAVADCSLEDVNGLDYPLMVSEEELLPAPEEGVDPTSIPVMMQVLRLPIFACIPG

SEQ ID NO: 2725 - DNA, 604 bp, Panicum virgatum
  misc_feature: Ceres CLONE 1785685
  misc_feature: Encodes the peptide sequence at SEQ ID NO. 2726
atcgcaaccatttcaaaacttcctttccctccaccagttacatcactagctagactagacgcacacacctccgagggagacaatcaaggaccctgctgccatggcgtccaactcgaccaagctgggctcttcgtcgtcgtccgagtggacgcggggggaggacaagatgttcgagcgcgccctggcggtgtacgacacggacaccccggaccggtggcacaacgtggcgcgctacatgggcggcaccaagtccgtcgaggaggtgcgccgccactaccagctgctcgtccgcgacgtcgcgcagatcgagtccggcagggtgccgttccactggtacgccgccgcgccgccgccgcggacactgcagcgaggttgaaggcttgaagtatatatctgagcttcaatgaagaaggggacggattgcacagtggctagctgtgctcctcgaagaaaaagatttataaattttgcatgtatatgtgcatgtgtgcgcgttgaatggaaatggcaaagctagctaggacatcgagattaatgtccggtctgctgctctttaatcttgtgtaccaagtccagcttttgatctatatggatcgaattatat

SEQ ID NO: 2726 - protein, 91 aa, Panicum virgatum
  misc_feature: Ceres CLONE 1785685
  misc_feature (1)..(50): Pfam Name: Myb_DNA-binding Pfam Description: Myb-like DNA-binding domain
MASNSTKLGSSSSSEWTRGEDKMFERALAVYDTDTPDRWHNVARYMGGTKSVEEVRRHYQLLVRDVAQIESGRVPFHWYAAAPPPRTLQRG

SEQ ID NO: 2727 - DNA, 1556 bp, Panicum virgatum
  misc_feature: Ceres CLONE 1785691
  misc_feature: Encodes the peptide sequence at SEQ ID NO. 2728
atcaccagccacagcaaatccatttccacacacaggcacaaaccttgagcctgcactctactgattagtcagtcctcttgagtcttgtcgatccatccttctagagatgctatattgcgtcgattaccaatcctcaatatatcttataataacaggagaaaacattgatggatgaactgtgagctaagagaagaattttgagcagggagatggcgctgatcatgaatgtctctgactatgaagagctcgcaaagcagaagctgtcgaagatgttttatgacttctatgcatcaggtgcagaagatcagcggacactcaaggagaatagggaggcattctccagaattttgtttcgaccaagggtactgattgatgtgtcccgtatcgacatgtccctgagcgttttaggctacaacatttccatgcccattatgttggctcccactgctttgcacaaactggcccatccagaaggagaggttgcttctgcccgagctgcagctgctacagaaactattatgactttgtcttcatggtcatcttgtagtattgaagaagttagctcgagtggaccaggactccgtttctttcaactttcagtattcaaggacaggaactttgtgcaacagcttgtcagaagggctgaaaacgctggctataaggcaattgcaatcactgttgatgccccacggcttggtcacagggaagctgatgtcaggaacagattctccttgcctgaaaatgtgggattgaagtgctttgaaggactggatctcagcaatatggacaagaatgtttctggccttgctgcatatgtcactagccagattgacagctctctatcttggaaggatatcaagtggctacagatgattacccggttgcctatcttagtgaaaggagtcataacagcagaagatgctcgaattgccattgaatgtggtgttgcgggtattatcatgtccaaccacgggggacgccagctagactatcttccttcaaccatcagctgcctcgaagaggttgtcagagaagccaaagggcgtgtccctgtgttccttgacggtggcatccgccgtggcactgacgtgttcaaggccttggcattgggagcctcaggagtatttattggaaggcccgtcctgttcgccctcgccgtggacggcgagcccggtgtgaggaaggcactgcagatgctgagggacgagctcgagattgccatggcgctgagcggctgcacgtcgctgaaggagatcactcgcggccacgtcaacactgaggatgacaggatcggtcgctctcggctgtagcctcgctcttgctgttggttttgtctctgtgttaatactgaaactcgcggggctgctgaacctgaacgccatgacataaatggattcagagattcagtagcgtcagacaccagcagttcttgtgttcctggtgacctggtagattcatgcgtacacgcgcaagcatgaaggggtgattgcattcttgttgttaactcgtgactggtgaattgcagatccgtttcccaaaaaaaaaaaaaaaaaaaa

SEQ ID NO: 2728 - protein, 366 aa, Panicum virgatum
  misc_feature: Ceres CLONE 1785691
  misc_feature (1)..(344): Pfam Name: FMN_dh Pfam Description: FMN-dependent dehydrogenase
  misc_feature (4)..(359): SWISSPROT Homolog: EC 1.1.3.15 Peroxisomal (S)-2-hydroxy-acid oxidase
  misc_feature (7)..(351): SWISSPROT Homolog: EC 1.1.3.15 Hydroxyacid oxidase 1
MALIMNVSDYEELAKQKLSKMFYDFYASGAEDQRTLKENREAFSRILFRPRVLIDVSRIDMSLSVLGYNISMPIMLAPTALHKLAHPEGEVASARAAAATETIMTLSSWSSCSIEEVSSSGPGLRFFQLSVFKDRNFVQQLVRRAENAGYKAIAITVDAPRLGHREADVRNRFSLPENVGLKCFEGLDLSNMDKNVSGLAAYVTSQIDSSLSWKDIKWLQMITRLPILVKGVITAEDARIAIECGVAGIIMSNHGGRQLDYLPSTISCLEEVVREAKGRVPVFLDGGIRRGTDVFKALALGASGVFIGRPVLFALAVDGEPGVRKALQMLRDELEIAMALSGCTSLKEITRGHVNTEDDRIGRSRL

SEQ ID NO: 2729 - DNA, 969 bp, Panicum virgatum
  misc_feature: Ceres CLONE 1785723
  misc_feature: Encodes the peptide sequence at SEQ ID NO. 2730
actctcccccgctctcttccaatccaatctctccctgcgcctccaccggtccctgcgcctccaccgactcgatcgccgccggcgagcctagggagagaggaagcacgccggcccgatcgccagccatggcccgcggagagaaccaggagtcgcagactggcaacgtccccgcggcttcggcgtcggcggcggggccgaagccggcggcggcggggcccgggaagggcgcggagggccagtcggtggtgcggcggctgcagtcggagctgatggcgctgatgatgggcggcgaccccggcgtgtcggcgttcccggagggggacaacatcttccactgggtgggcaccatcgccgggtcggcgggaaccgcctacgagggcacctcctaccgcctcgcgctcgccttcaccgccgagtacccctacaagccgcccaaggtgcggttcgacacgccgtgcttccaccccaacgtcgacgcccacggcaacatctgcctcgacatcctccaggacaagtggtcctcggcctacgacgtccgcaccatcctgctctccatccagagcctcctcggagagccgaacaacgactcgccgctcaacacgcaggcggcggcgctctgggcgaaccaggaagagttcaggaagatggtggagaagctctacaagcccgccgcgtagaggaaaggggagtaaggcgcccggcgcagatgccgccggcgcggcttcgcgagtggtggcatggagaagctccgcaagcagtgatctcgcttcgatgacaagggggttaggtgcattctttggtcgggttcggtttccagtctggtggtatagcaggggaggatgcgagtctgtaattgttttttgagttctggtcgggttcgtttcacagtagtagttgttatcgcctcttgttgtttcaatcttgattctggagcgacaaattccatctcaaaaaaaaaaaaaaaaaaaa

SEQ ID NO: 2730 - protein, 183 aa, Panicum virgatum
  misc_feature: Ceres CLONE 1785723
  misc_feature (13)..(180): SWISSPROT Homolog: EC 6.3.2.19 Ubiquitin-conjugating enzyme E2 C
MARGENQESQTGNVPAASASAAGPKPAAAGPGKGAEGQSVVRRLQSELMALMMGGDPGVSAFPEGDNIFHWVGTIAGSAGTAYEGTSYRLALAFTAEYPYKPPKVRFDTPCFHPNVDAHGNICLDILQDKWSSAYDVRTILLSIQSLLGEPNNDSPLNTQAAALWANQEEFRKMVEKLYKPAA

SEQ ID NO: 2731 - DNA, 688 bp, Panicum virgatum
  misc_feature: Ceres CLONE 1785734
  misc_feature: Encodes the peptide sequence at SEQ ID NO. 2732
ggttgaagtggaacctttcccttctctcggactgtctcctcccttctctttcttccctcgcggcggcgacgactgggcgagcggcggcgccatttgtcacgtcttcgtccagaccctttgccggcgacgagcatcctccaggcggcggccatggccaccttcgagctctaccggaggtccaccatcggcatgtgcctcaccgagacgctcgacgagatggtctccagcggcaccctcagcccggagctcgccatccaggtcctcgtccagtttgacaagtctatgacggatgctctggagaaccaagtgaagagcaaggttaacatcaagggccatctgcacacctacaggttctgcgacaatgtgtggaccttcatcttgacggatgcacagttcaagaatgaggagacaaccgagcaggtgggcaaggtgaaaattgtggcctgcgactccaaattgctgagccaaagccagtagaggccctatgctcgtggtggggtgtgtcttgtctgggcaccagagtagcagtgctctgttcagctgcttctttacctggctcctgcctgcatttgcgttgctgttagtgatatatcttgtatacaatctgctggtgttatatataccaccaaccaaccagagtatgtcatggtgtggtatgacagcaagcagatctaaacccttttattag

SEQ ID NO: 2732 - protein, 108 aa, Panicum virgatum
  misc_feature: Ceres CLONE 1785734
  misc_feature: Great-hit functional homolog of the protein sequence given in SEQ ID NO 9382
  misc_feature: Useful for making plants with altered Lignin content
  misc_feature: Useful for making plants with altered terpenoid content
MATFELYRRSTIGMCLTETLDEMVSSGTLSPELAIQVLVQFDKSMTDALENQVKSKVNIKGHLHTYRFCDNVWTFILTDAQFKNEETTEQVGKVKIVACDSKLLSQSQ

SEQ ID NO: 2733 - DNA, 923 bp, Panicum virgatum
  misc_feature: Ceres CLONE 1785819
  misc_feature: Encodes the peptide sequence at SEQ ID NO. 2734
acaaaagccagccaaacaatcattcgagtagaagtaaccaacccagccaagaggcagccacgactctacactgtgactccgtgagccttgtgctccttcctgctctgcacactccgcaccagctcagcaatcatgcctcgcccggcccccctcctcctccaccacctcctggcggccgccgcgctcctggccctggcgggcgcgtcgccggcgaacagcgaagccgcggccagcgacttcatccgcaagtcgtgccgcgacacgcagtacccgtcgctgtgcgtgcagagcctggcgtcgtacggcgagtccccgccgccgcggagcccgcgggagctggcgcgcgcggcgctgatggtgagcgcggaccgcgcgcgtgcggcgtcggcgtacgtggggcggctgtgcggcggcgcggcgaagaagggcgggcgcaagggcacggcggcgggcgccgtgcgcgactgcctggagaacctggcggacagcgtggggcacctccgcgacgcggcgcaggagatgggcggcgccgggatggggcgcgcggggtcggcggcgttcaagtggcacctgagcaacgtgcagacctggtgcagcgcggcgctcaccgacgagaacacctgcctggacgggctcgccggccgcggcgtggacgccggcacgcgcgccgccatccgcggcagggtcgtcgaggtcgcgcaggtcaccagcaacgcgctcgccctcgtcaacaaggtcgggccaccagggtactagcccgggcacctctcttcataccacctatatatgctgcgtgttgtgcgtcgcttaactagctcagttcccatgccttctccacctatatatgcttgtgtaagatatagttaagggcgataaaactttggtgaccagaaccacttatacaaaaaaaaaaaaaaaaaaaa

SEQ ID NO: 2734 - protein, 207 aa, Panicum virgatum
  misc_feature: Ceres CLONE 1785819
  misc_feature (2)..(166): Pfam Name: PMEI Pfam Description: Plant invertase/pectin methylesterase inhibitor
MPRPAPLLLHHLLAAAALLALAGASPANSEAAASDFIRKSCRDTQYPSLCVQSLASYGESPPPRSPRELARAALMVSADRARAASAYVGRLCGGAAKKGGRKGTAAGAVRDCLENLADSVGHLRDAAQEMGGAGMGRAGSAAFKWHLSNVQTWCSAALTDENTCLDGLAGRGVDAGTRAAIRGRVVEVAQVTSNALALVNKVGPPGY

SEQ ID NO: 2735 - DNA, 754 bp, Panicum virgatum
  misc_feature: Ceres CLONE 1785924
  misc_feature: Encodes the peptide sequence at SEQ ID NO. 2736
ataaaccctcgcgtcgaataaaaaaaagtcccctccacgggccgccgcgccgagcgagcagcgagccgccaccgccgcacgacgggatggcgtcgacgccggagccggaggacgggagggagctctacgcgctgctccacctctcgccggacgcctccgacgaggaaatccgcagggcgtaccgccagttcgcgcaaatctaccaccccgacaagtaccaggacccccagatgaaggaagtagcaactgaaaatttccaacgaatacgcgatgcatatgagatactatctgatgagaacaaaagacagatttatgacatctatggtatggaaggtttaaattctggcctggaacttggtcccaaactaactaaaccagaggaaattagagaacagttggaacgactgcggcggcgcaaggaggaagaaaaatttctcgttcatgctcgacccaatggctcaatcattgctaatttctcggtgccacaatatttagacggtgatggcatcatgaaagggtacatatttattctattttagtatatatgcctgtaatcttttgtccagtcacattgttcggaagctgctaagaattatgataataatgtgcaactgttctcttgtttaattcatagttgcattatggtaaaattgcttagtaatttattacttgtaaacctcaaatgttaatgtaattttgatgatgtaatcaatacgtgctattttgcatccttcaaaaaaaaaaaaaaaaaaaa

SEQ ID NO: 2736 - protein, 150 aa, Panicum virgatum
  misc_feature: Ceres CLONE 1785924
  misc_feature (1)..(66): Pfam Name: DnaJ Pfam Description: DnaJ domain
MASTPEPEDGRELYALLHLSPDASDEEIRRAYRQFAQIYHPDKYQDPQMKEVATENFQRIRDAYEILSDENKRQIYDIYGMEGLNSGLELGPKLTKPEEIREQLERLRRRKEEEKFLVHARPNGSIIANFSVPQYLDGDGIMKGYIFILF

SEQ ID NO: 2737 - DNA, 914 bp, Panicum virgatum
  misc_feature: Ceres CLONE 1785938
  misc_feature: Encodes the peptide sequence at SEQ ID NO. 2738
gttttccaatcgcgtcgcccctccttccccccgcgatcgacgcctccgcccgatccgctcgtcgcaaccgccggaggagaaggcgcgaagcgggaggaaggcccggccggacggcggttcgacccgcggggctcgattcgacatgaatcccgagtatgactacctcttcaagcttctgcttattggtgattctggtgttggcaagtcatgccttctcctgagatttgcggatgactcgtacctggacagttatatcagtacaattggagtcgactttaaaattcgtacagttgagcaagatgggaagaccatcaagcttcaaatttgggatactgctgggcaagaacgtttcaggacaattaccagcagctactaccgaggagcccatggcattatcattgtatatgatgtcacagaccaagaaagcttcaacaatgttaagcaatggctgaatgaaattgatcgttatgcaagcgacaatgtaaacaagctccttgttgggaacaagtgtgacttgacggcaaacaaagttgtgtcatatgaagcaggcaaggctcttgctgatgagatgggcatcccgttcatggagaccagtgccaagagtgctactaatgtggagcaggctttcatggctatggctgcatccattaagaccaggatggctagccaacctgctgcagctaatgccaggccgccaaccgtgcagattcgtggccagccggttaaccagaagacgtcctgctgctcttcctagattattcatttctttcagttcatgtaaactttgatgcactgttcctactgtttgcttgtgatgcgtttgtattattccctgttaattgcctaaatagcatttttcatataattcaactgatcaattatcttgactgagcaaaaaaaaaaaaaaaaaaaaa

SEQ ID NO: 2738 - protein, 203 aa, Panicum virgatum
  misc_feature: Ceres CLONE 1785938
  misc_feature: Great-hit functional homolog of the protein sequence given in SEQ ID NO 9286
  misc_feature: Useful for making plants with altered Lignin content
MNPEYDYLFKLLLIGDSGVGKSCLLLRFADDSYLDSYISTIGVDFKIRTVEQDGKTIKLQIWDTAGQERFRTITSSYYRGAHGIIIVYDVTDQESFNNVKQWLNEIDRYASDNVNKLLVGNKCDLTANKVVSYEAGKALADEMGIPFMETSAKSATNVEQAFMAMAASIKTRMASQPAAANARPPTVQIRGQPVNQKTSCCSS

SEQ ID NO: 2739 - DNA, 928 bp, Panicum virgatum
  misc_feature: Ceres CLONE 1785950
  misc_feature: Encodes the peptide sequence at SEQ ID NO. 2740
gcatccagcacacagatcgagttgatcgataaggcggcgccatggctgcttcttccacgaccaccatgtcctttgtcttcgtcctggcgttgctgctctcgtgcggtggcgtcagcaacgcggcgcggcggatgcaggagctcccgaagcccgacgtggcgccgctgcccaagcctgaggaaccgctgccggtgccctcgcaacccctgcccaagccagagccgctgcctgtgcctgagccactgccggtgccaccccagccactacccaagccagagccgatgccggtgccaccacagccaaagcccgagccgctgccggtgcccccgcagtccctgcccaagcctgagccacttcccgtgccaccaccgccccttcccaagccggagccgctgccggtgccaccgcagccccttcccaagccggagccgctgccggtgccaccgcagccccttcccaagccggagccgctgccggtgccaccacagcccaagccggagccgctgccagtgccaccacagcccctgccaaagcctgagcccctgcccgtgccaccacagccgaagcctgagccgctgccggtgccaccgcagcccctgccccaacccgggctgccggtgccaccgcagcccctgccccaacccgggctgccggtgccgccgaagccatgatcgatgagctatggcaacatattattgacacggcgctccagtgattattttctactgtatcttgctcatccgtgtgaccatgcgtgatgctttcacagatttgtatagctagtgtgtatcatatttgcagtgtggaatggtgtgtgcattgccatgccatctcatctgatcaggccatgatctgtgtattctggctgagatccatgtgtataaataaataaatggattcgtttgtataaaaaaaaaaaaaaaaaaaa

SEQ ID NO: 2740 - protein, 209 aa, Panicum virgatum
  misc_feature: Ceres CLONE 1785950
  misc_feature (60)..(133): Pfam Name: Trypan_PARP Pfam Description: Procyclic acidic repetitive protein (PARP)
  misc_feature (92)..(266): Pfam Name: Peptidase_M10_C Pfam Description: Peptidase M10 serralysin C terminal
MAASSTTTMSFVFVLALLLSCGGVSNAARRMQELPKPDVAPLPKPEEPLPVPSQPLPKPEPLPVPEPLPVPPQPLPKPEPMPVPPQPKPEPLPVPPQSLPKPEPLPVPPPPLPKPEPLPVPPQPLPKPEPLPVPPQPLPKPEPLPVPPQPKPEPLPVPPQPLPKPEPLPVPPQPKPEPLPVPPQPLPQPGLPVPPQPLPQPGLPVPPKP

SEQ ID NO: 2741 - DNA, 769 bp, Panicum virgatum
  misc_feature: Ceres CLONE 1785960
  misc_feature: Encodes the peptide sequence at SEQ ID NO. 2742
gtgagcttagcggaggagaagaaagccatccattccatcctcccgagcaaggcaaaaagataaggaacacgggacgcaccaacccccggcgattgccgaaggccggaacgaaaccaaccccctcgtcgtcctagaagctcccgcgtcccctccccctagcctccgctctccaatggcgccctccctcctcgccgccgccgccgcgcccttcctcgtcgccggcagcaattgcagccgccggacgctgagcgccgcccccacccgccgggccgggctgcgcgttgccgcgctcaagtacgaccctgccaaggtggcgccgcagtccgaccgggtgctcgtccgtctccagcagatccctgagaaatctgctggtggtgtattgctacctaagtctgctgttaagtttgagaggtatctgatgggtgagattctatcggtcggttctgatgttagtgaagttgaggctggaaagaaggttctattttcagatatcaatgcttatgaggtggacctaggtaccgatgagaagcactgtttctgccgggaatcggatctgttagctgttgttgaatgaattttaccctaaaatttcagacttgggcgacagtgtaccaagcctccaagtgaacgggcttgacttttgtcccaactttgttgtatgccatttgaatgttcatgaattccacaaactgatgagaccagtgaattttgaccgccataagcagtaatgaaattacgcttctttccttaaaaaaaaaaaaaaaaaaaa

SEQ ID NO: 2742 - protein, 133 aa, Panicum virgatum
  misc_feature: Ceres CLONE 1785960
  misc_feature (1)..(87): Pfam Name: Cpn10 Pfam Description: Chaperonin 10 Kd subunit
MAPSLLAAAAAPFLVAGSNCSRRTLSAAPTRRAGLRVAALKYDPAKVAPQSDRVLVRLQQIPEKSAGGVLLPKSAVKFERYLMGEILSVGSDVSEVEAGKKVLFSDINAYEVDLGTDEKHCFCRESDLLAVVE

SEQ ID NO: 2743 - DNA, 837 bp, Panicum virgatum
  misc_feature: Ceres CLONE 1786056
  misc_feature: Encodes the peptide sequence at SEQ ID NO. 2744
atcctcacgctgccactaagctctccaagcccctcaccagcctctgctccccatctctctgctctgctctgggccattcactccgcggctcccctagctccgcgtccgcccaaccaccgcgaccgccagcgcctcctccagatcggcgggcgggcaccggccggcgatgacatccgccgtcgccaccaccgtagggtgcggggggctccccttccgcccgtcctcgacggcgcccacaggacgaccccgcggcagatgggtcgtccgagctcaagccgcaggagcggacgcctccgacgacaagtcggtggagatcatgcgcaagttctccgagcagtacgcccgccgctccaacacctacttctgcgcggacaaaaccgtcactgccgttgtcatcaagggacttgctgatcacaaggatacactcggagctcctctatgcccttgtaggcattatgatgacaaagctgccgaggtagcacaaggattttggaattgcccatgcgttcccatgcgtgagaggaaggaatgccactgtatgctttttcttactcccgacaatgattttgctggaaaggaccaggctatctccttggaggagatcaaagaggcgacagcaaagttctaaccccgtgtatttttcgccaaatgtttacttgacagctagttttcttttatatgtacatgtacttatgtagaagcatctataagatatgccaccagagaaaatttttcataagatgtgcagtaaacagcacttccgagggctgtcgacgtgtcgatcctatgtggccataagagctctttgttgttgtataaaaaaaaaaaaaaaaaaaa

SEQ ID NO: 2744 - protein, 153 aa, Panicum virgatum
  misc_feature: Ceres CLONE 1786056
  misc_feature: Great-hit functional homolog of the protein sequence given in SEQ ID NO 9660
  misc_feature (1)..(105): Pfam Name: FeThRed_B Pfam Description: Ferredoxin thioredoxin reductase catalytic beta chain
  misc_feature: Useful for making plants with high aluminum sensitivity
  misc_feature: Useful for making plants with modulated high pH sensitivity
  misc_feature: Useful for making plants with modulated low iron sensitivity
  misc_feature: Useful for making plants with modulated phosphate use efficiency
MTSAVATTVGCGGLPFRPSSTAPTGRPRGRWVVRAQAAGADASDDKSVEIMRKFSEQYARRSNTYFCADKTVTAVVIKGLADHKDTLGAPLCPCRHYDDKAAEVAQGFWNCPCVPMRERKECHCMLFLTPDNDFAGKDQAISLEEIKEATAKF

SEQ ID NO: 2745 - DNA, 915 bp, Panicum virgatum
  misc_feature: Ceres CLONE 1786088
  misc_feature: Encodes the peptide sequence at SEQ ID NO. 2746
aaactcaaagccgtggcaatctccgcgccgcaaaccctagccgccgccatggccttcctcgctcccgccgccgccgcctcgtccctccgcgcccccacctacgtagccgcctcctccgggcgccgctcggtgctccccgcggccgccaaagcgacggccagctccgggtccgggtccgccacctctccgcaccccatcctctcctccctccgcatggccgcctccgctgccgtcctcctcgccgccacctccccggccctcgcgtgcaccccctccgcgcctccgcctccgcccattccccaaacggccgcggccgagcccgaagacgcccccgtccaggacgcctccctcccgttcgagaagctcatcgtcgagaccgccgcgctcgcgcgcgccggcgacgcggaggctgcgcgcgcccgcctgtccgccgccggcggaggcgagggctgcgcgcgcctcctcgcggcgcaggctctgttcgtggacggcaaggtggacgaggcgatcgcggcgctcgaggagctcgcgcgggaggaccccgccgactaccgccccctcttctgccagagcgtgctgtaccgcgccctggggagggaggcggaggccgagtccgcgctccagcgctgccgcgaggccggctgcgactgcgccgcgctagtcgtgggtccagcaacggtggtcttgccggccggtgcggaggccgttgacgccgaggaggtagagccggagccggcgaaggtttgaccgcgtgacttgacttggagtgtgcatgctccggcgatacggaatagagggaattttaaaacgtcattgctgatgtttaggatctgagtaaagatgcccgtttacgtttacatggctgctaataaattgaaccgctcatgataccttgaaaaaaaaaaaaaaaaaaaa

SEQ ID NO: 2746 - protein, 232 aa, Panicum virgatum
  misc_feature: Ceres CLONE 1786088
  misc_feature: Great-hit functional homolog of the protein sequence given in SEQ ID NO 9266
  misc_feature: Great-hit functional homolog of the protein sequence given in SEQ ID NO 9625
  misc_feature: Useful for making plants with altered Lignin content
  misc_feature: Useful for making plants with altered terpenoid content
  misc_feature: Useful for making plants with modulated nitrogen use efficiency
MAFLAPAAAASSLRAPTYVAASSGRRSVLPAAAKATASSGSGSATSPHPILSSLRMAASAAVLLAATSPALACTPSAPPPPPIPQTAAAEPEDAPVQDASLPFEKLIVETAALARAGDAEAARARLSAAGGGEGCARLLAAQALFVDGKVDEAIAALEELAREDPADYRPLFCQSVLYRALGREAEAESALQRCREAGCDCAALVVGPATVVLPAGAEAVDAEEVEPEPAKV

SEQ ID NO: 2747 - DNA, 856 bp, Panicum virgatum
  misc_feature: Ceres CLONE 1786113
  misc_feature: Encodes the peptide sequence at SEQ ID NO. 2748
attccgttctgcccaaacctttctctggcaggcagcaggcactatataatcctccccttaccttctgcttcaatcctgagcttttatttcaccctcggccgaggacaggtactcaagaaagcgacgacgaagccttgttactctgttcatagccacgacgtacagttggtgaggcacatcacaaacaccatgggcatcctggaccacttctccgatctatgcagcatcacggagacgaaggcggccctcaagctccggaagaagcgccctctgcagacggtaaacatcaaggtgaagatggactgcgaggggtgcgagcggcgggtgaagagcgccgtgaagtcgatgcggggcgtgaccagcgtggtggtgaacccgaagcagggcaggtgcacggtgacggggtacgtggagccggccaaggtgctggagcgggtgaagagcacgggcaaggcggcggagatgtggccctacgtgccctacacgatgaccacctacccctacgtcggcggcgcctacgacaagaaggccccggcgggcttcgtccgcagcgcgccgcaggccatggccgaccccagcgcgcccgaggtcaggtacatgaacatgttcagcgacgagaacgtcaacgcctgcaccgtcatgtgatgataccgggcgtgagccgctggcgctcgtatgcatgctggcaagttcagaggaagcgcaaaaaaaaaacatgcttgtctttaatgagtttgtatgcgtttggtgcatttatgtcgatacatgtgtttatttggttccaaagaagaaaagccactagaaagaatagctaattttgggctaaaaaaaaaaacaaaaaaaaaaaaaaaaaaaa

SEQ ID NO: 2748 - protein, 151 aa, Panicum virgatum
  misc_feature: Ceres CLONE 1786113
  misc_feature: Great-hit functional homolog of the protein sequence given in SEQ ID NO 9550
  misc_feature: Useful for biocontainment applications
  misc_feature: The plant produces a reduced number of seeds.
MGILDHFSDLCSITETKAALKLRKKRPLQTVNIKVKMDCEGCERRVKSAVKSMRGVTSVVVNPKQGRCTVTGYVEPAKVLERVKSTGKAAEMWPYVPYTMTTYPYVGGAYDKKAPAGFVRSAPQAMADPSAPEVRYMNMFSDENVNACTVM

SEQ ID NO: 2749 - DNA, 635 bp, Panicum virgatum
  misc_feature: Ceres CLONE 1786115
  misc_feature: Encodes the peptide sequence at SEQ ID NO. 2750
accaccggtcggtcgccagccgagttccaagtccgagtgctcagctcaggcctcaggcctcaggctcagctcgctctccgtccgtgtcctagctcgctgatcatcgatcaatccagagacctgccgggcaatggcgatcaagaagggcggcgcggcggcgtcggggctgaagcagatcctgcggcggtgctcgagccttggtcgccggcagcagcagcagcacagcgagtacgaggaggagtacaacgacgaggaggaggaggcgtccgggctgccgtcggacgtgccgcggggccacttcgcggtgtacgtgggcgagcggcggcggcggttcgtggtgcccatcgcgctgctggaccggcccgagttccggaccctgctgcggcgcgccgaggaggagttcgggttcgccggcgccggggccggcggcatcctcgtgctcccctgcgaggaggtcgccttccgctccctcacctccgccctcgcctgcgccggcgcccggtgagcgcgcgcgccggcgcacgtcgctccctccggctgtgctccgatatggctattcgttcgattcttgatttggccggcccggctagctatacctcgccggcgaagttaagtaaaaaaaaaaaaaaaaaaaa

SEQ ID NO: 2750 - protein, 124 aa, Panicum virgatum
  misc_feature: Ceres CLONE 1786115
  misc_feature (1)..(113): Pfam Name: Auxin_inducible Pfam Description: Auxin responsive protein
MAIKKGGAAASGLKQILRRCSSLGRRQQQQHSEYEEEYNDEEEEASGLPSDVPRGHFAVYVGERRRRFVVPIALLDRPEFRTLLRRAEEEFGFAGAGAGGILVLPCEEVAFRSLTSALACAGAR

SEQ ID NO: 2751 - DNA, 1188 bp, Panicum virgatum
  misc_feature: Ceres CLONE 1786144
  misc_feature: Encodes the peptide sequence at SEQ ID NO. 2752
catctcactccatgtcagccgctgctgctgccgctgctgagcatcctcctcctcaagcaatccccttccttcccagtcccaggaccacaccatgcatccatccatggaattcctctcaaatacagcagcagctccggccgacggcacgccatggaacccctcctccccgagaatatataaacacgagaggaggggtcactgtccgtgtacgctcgcggcgaaagcgagcaccttggtcgccgtaacgtacgtctccggcgatcaccggagggcgggcgtcggccggccatggaccgtcggcggggcgccgcgcgggagtacgaggacttcgaccctgtcgtggagtggaagctgcccggcgaggaccaggacgtggtggagatctcgctgccggggttccgcaaggaccaggtgagggtgcaggtggacaaccacggcgtgctccgcgccaccggggagcgcccggcgaggggtggccggtgggcgcggttcaagaaggacctccgcctccccgacaactgcgacgccaacggcgtccgcgccaggttcgagggcgagaagctcatcatcacgctccccatcgtcgccgcggccggagcggtggcgtccccgacgccgtctcctccggagactgagacgtcgccgttgccacttgggacggcagctgctggtccggggcaaatggaacctgccttgcaggagagaaaaatcgctgtgtcacccccttctccggcacccctgccttggctgcctatccgtcacgaagaggaagcgtggaagaagcaactgcaagatgctacttctccggcagccctgcctcctcgtctaccggaggagaagaacaagagcaagaaacagaaggggacgggtggtccgtcggggaagagccaagcgcaggcggtgggagatgctccggtgccgccgccggagcctacaaggcagctgctggtgaacgctgttgcggcggcggtcgtgctcgtggggatcatctggtgggcgtggcgcaacgcaacctcagcagctgagcggccgatagagagctgcccatttgaaatggaccgaaacttttagaagtgctgcttgtaattatgtgttgtctctgaacttgcaattgcacaagtcagtgtatctaccaaacagattatcagtgtataaacatgtagctcacaaaaaaaaaaaaaaaaaaaa

SEQ ID NO: 2752 - protein, 260 aa, Panicum virgatum
  misc_feature: Ceres CLONE 1786144
  misc_feature (1)..(86): Pfam Name: HSP20 Pfam Description: Hsp20/alpha crystallin family
MDRRRGAAREYEDFDPVVEWKLPGEDQDVVEISLPGFRKDQVRVQVDNHGVLRATGERPARGGRWARFKKDLRLPDNCDANGVRARFEGEKLIITLPIVAAAGAVASPTPSPPETETSPLPLGTAAAGPGQMEPALQERKIAVSPPSPAPLPWLPIRHEEEAWKKQLQDATSPAALPPRLPEEKNKSKKQKGTGGPSGKSQAQAVGDAPVPPPEPTRQLLVNAVAAAVVLVGIIWWAWRNATSAAERPIESCPFEMDRNF

SEQ ID NO: 2753 - DNA, 1723 bp, Panicum virgatum
  misc_feature: Ceres CLONE 1786215
  misc_feature: Encodes the peptide sequence at SEQ ID NO. 2754
acgcgtgagtcactcatcctcttcgtctctctcctatccgtcaaccactcgatgcagcggccggcggtagtaggagcggccggcaagcgggagggcggtgcggcggccggcaggaggccggtgcagcggccgacagcgggagggctgtgcagcggccggcgcgagggcggtgcggcggccggcaggaggccggtgcagcggccgacagcgggagggctgtgcagcggccggcgcgagggctgggcggcagtcggtgaggtcggcaccaagcgggtggccgaggaagatggtgcagccaacatgtctgactcgtcaaggaccgtccctccggagctgctcccgtcggaggacctgcatccgctgccaatgccggtgatcaacctcggccacctcagccaggattccgcaacccgataccgtgtggttgatgatattgccaaagcatgccgtgatctagggtacttccaggttataaaccatgggatcagtcaatctgtcatggattgtgctcttgaagcagcttcagatttcttcaaactaccgagtgagacaaaggaaaagtttgcatcggaggaccttagacgacctgttagatatgatacaagctcaaaagatagcattagcatgcccagggcattcctaaagcattatgcccatccactcaacgaatggattcaatattggccacagcaaccaccaatctacaggaaatacatgggaaagtatgcttctgaagtaaggatggtggctttgcaactggtggaagcaatagtagaaggcctaggattgggcaaggaatacctgaatgagaaatttcatgaaggctcccaagtattgtcagtgaactgctacgctaaagcatcacaaagtgccacgactatagggctggctccacattctgatcatggatttcttaccatcttgctcacaagttgtgggggccttgaagttgttgaccccagcagcaacatctggaaaagggttcagcaacttccacacactttgcatgttcacattggtgaccacatggaagttctgagcaatggcagaatgaaaacagttgtgcatcgtgcccttctgaatcctgaagaagcaaggatttctatagctagcattcatggttttgcactgcatgagaaggtcacctgtgccaaggagctagtggatgaagaaaatcccccaaagtacaaagagagcagcttcagcgacttcctgaaccatctcacagctaatatggacaacaagcacaggaactttctcgaaagccttcgaatgtaaggattgcagagcataattagggtataatcttcactacaagtcttcattgagtggctagaggcaaccatataagttcactaatgtgatatgtaattcatttttctggtaaaatttgacgtcatccaatcgtgcagggttactggtgctatggtatttgagaaggcatatcgagttatggttcatcttcacatgttgaaatctaaagtgtctgtgtaatcttcaaataaagccatatctgtggctgccggtgtccatttccagttttacatgaagcattcaaaactcgcatgtgtaatcatctttggccatcatccacaaacttgaactcagaaaccatcttcgggaacttggagtgcatgtgaatatggcatagatgactcaatcaatgtaaaaaatatctttatatgtatgcatgacaattacttaaaaaaaaaaaaaaaaaaaa

SEQ ID NO: 2754 - protein, 408 aa, Panicum virgatum
  misc_feature: Ceres CLONE 1786215
  misc_feature (1)..(101): Pfam Name: 2OG-FeII_Oxy Pfam Description: 2OG-Fe(II) oxygenase superfamily
MQRPAVVGAAGKREGGAAAGRRPVQRPTAGGLCSGRREGGAAAGRRPVQRPTAGGLCSGRREGWAAVGEVGTKRVAEEDGAANMSDSSRTVPPELLPSEDLHPLPMPVINLGHLSQDSATRYRVVDDIAKACRDLGYFQVINHGISQSVMDCALEAASDFFKLPSETKEKFASEDLRRPVRYDTSSKDSISMPRAFLKHYAHPLNEWIQYWPQQPPIYRKYMGKYASEVRMVALQLVEAIVEGLGLGKEYLNEKFHEGSQVLSVNCYAKASQSATTIGLAPHSDHGFLTILLTSCGGLEVVDPSSNIWKRVQQLPHTLHVHIGDHMEVLSNGRMKTVVHRALLNPEEARISIASIHGFALHEKVTCAKELVDEENPPKYKESSFSDFLNHLTANMDNKHRNFLESLRM

SEQ ID NO: 2755 - DNA, 1300 bp, Panicum virgatum
  misc_feature: Ceres CLONE 1786231
  misc_feature: Encodes the peptide sequence at SEQ ID NO. 2756
gcacaccgaatcccaaccaccgggcgcggcgccgaacgcccggccgggcatatacatcgccctcctgccccggctcccctcgcctcccagctcagcgcagctcgcgacaagcaggtgatcacctgagcggagcagggtgaggccgcccaagcagagccgcggggacatgctgcgggggcagcaggggcgtcgagaagaagcctaggtagggggccatgtgggcgccgtcgcgggggtcgtcgtcggggagcgggcggcggacctggcgccggcgcatcgcggactacctcgccgacgaccagaccgacgcgtccgacaatgagtcgttcatcacggcgcacagcgacgagttcggcgcgtccacgtccgccgcgggaggcgcggagggaatgctgccggcgttcctcgcggaccagagcgacctcgtggaggtcatgctggagctggacgaggagtccatggtggtgcgcagcgtcacgcccaccgccgcggcgctctacgggcccacgtcgctggccggcggcagtggcggcgcgcacacgccggacgcggggcggagcctgagccgctgctcgtcgacgtcgtcgcggatacggaggaagttcgcgtggctgcgctcgccgtcgccgtcgccgtcgcagcggcacccgccggcgccggccgccaccgccgcggcgtccgatcagcaggcggtgcgggaggcggcgctggcggcgcgcgagcggcggcgcgcccaggcgcggctgaaccggtcgcggtccggggcccggcgcgcgctcaagggcctccggttcatcagccgcaccacggggtcctccgccgccgccggcgacctctggcgccgcgtcgaggagcgcttcaacgcgctcgcgcgcgacggcctcctcgcccgagacgacttcggcgactgcatcgggatggtggactccaaggacttcgcggtgggcatcttcgacgcgctggcgcggcggcggcggcagaacctggagcggatcagcaaggacgagctctacgacttctggctccaaatctccgaccagagcttcgacgcgcgcctccaaatcttcttcgacatggtggacaccaacgtggacggcaggatcacgagggaggaagtgcaagaggtaatcgagttgagctgacttgattaatcagccgacagagtttcgttagcagtagtagttgaaagtaacatgccagtatcactggcactgctgtaactatcaccttgggagagtttacgcatggaatttcaccgtgccggtaattaaatttgatccaaaaaaaaaaaaaaaaaaaa

SEQ ID NO: 2756 - protein, 308 aa, Panicum virgatum
  misc_feature: Ceres CLONE 1786231
  misc_feature (1)..(103): Pfam Name: NADPH_Ox Pfam Description: Respiratory burst NADPH oxidase
MWAPSRGSSSGSGRRTWRRRIADYLADDQTDASDNESFITAHSDEFGASTSAAGGAEGMLPAFLADQSDLVEVMLELDEESMVVRSVTPTAAALYGPTSLAGGSGGAHTPDAGRSLSRCSSTSSRIRRKFAWLRSPSPSPSQRHPPAPAATAAASDQQAVREAALAARERRRAQARLNRSRSGARRALKGLRFISRTTGSSAAAGDLWRRVEERFNALARDGLLARDDFGDCIGMVDSKDFAVGIFDALARRRRQNLERISKDELYDFWLQISDQSFDARLQIFFDMVDTNVDGRITREEVQEVIELS

SEQ ID NO: 2757 - DNA, 1598 bp, Panicum virgatum
  misc_feature: Ceres CLONE 1786233
  misc_feature: Encodes the peptide sequence at SEQ ID NO. 2758
agcaagccagcaaagcatagggggagcagctctccctcccacccgctcttcccttttgactcctcccacctgcaaaaccgcgggccgcatcccgcccgcgccgcccaccggcggcagccagccaccgcccccggcgtctacaaaaacaagcataccaccgctcgccggacccaatcaaccccaatcaatggcgtcgtccctcctctccaccccgtcccgaaccctagcgcccgccccggcccccgcggggctccgccggagggcgccggcccaggtgcacctcccgcgcgagtgccccgccccccgccggagccgcgcgctccgcgtgcgcgcgtcggtggcgatcgagaaggagacgcccgagagcgagccgcccccgacgttcctgcgcgaggacggccgcggcgcggggtccgggtccgtgcgggagcggttcgaggccatgatccggagggtgcagggggaggtctgcgccgcgctggaggaggccgacggcagcggcgcgcggttcgtcgaggacgtgtggtcgcgtcccggcggcgggggcggcatcagccgggtgctcgaggacggccgcatcttcgagaaggccggggtcaatgtgtccgtcgtgtacggggtcatgccgccggatgcgtaccgcgcggccaagggggaggccgggaagaatggcgccgcggaggcgcagaaggctggccccgtgcccttcttcgccgcggggattagctcggtgctccatcccaagaatccatttgctcctacattgcattttaactaccgttactttgagacagatgcaccaaaagacgctcctggtgcaccaagacaatggtggtttgggggtggtactgacttgactccttcatacattattgaagaggacgtgaagcatttccattctgttcaaaaacaagcatgcgataaatttgatccaagttttcacccaagattcaaaaagtggtgtgatgattatttctatattaagcaccgtaatgagagacgcgggcttggtggaatattttttgatgatcttaatgattatgatcaagaaatgcttctcaactttgccacagaatgtgcggactctgtacttcctgcatacgtaccaatcatagagcggcgtaaggacactccattcaccgaggagcacaaggcatggcagcaactgcggagaggtcgttatgtggagttcaaccttgtttatgatcgtggtacaacattcggcctaaagactggaggaaggattgagagcatactcgtgtctcttccacttacagcacgatggcagtatgatcataaaccagaagaagggactgaagaatggaaactcctggacgcgtgcataaacccaaaggattggatctgattagccgaagtttgtttgttcttcagatcttttttgttagtgttaccctccttgtaactttgttagcttgagagttccggtcatacgtgtagtttcatcacgtcttctttatctgtagaatcgtgaataataaatagtatgatgtaagagcatctccaagagtttggcattttctactaagatttgccaactccctaaaatatatgtcaagcaaaaaaaaaaaaaaaaaaaa

SEQ ID NO: 2758 - protein, 392 aa, Panicum virgatum
  misc_feature: Ceres CLONE 1786233
  misc_feature (1)..(311): Pfam Name: Coprogen_oxidas Pfam Description: Coproporphyrinogen III oxidase
  misc_feature (1)..(392): SWISSPROT Homolog: EC 1.3.3.3 Coproporphyrinogen III oxidase, chloroplast precursor
  misc_feature (3)..(392): SWISSPROT Homolog: EC 1.3.3.3 Coproporphyrinogen III oxidase, chloroplast precursor
MASSLLSTPSRTLAPAPAPAGLRRRAPAQVHLPRECPAPRRSRALRVRASVAIEKETPESEPPPTFLREDGRGAGSGSVRERFEAMIRRVQGEVCAALEEADGSGARFVEDVWSRPGGGGGISRVLEDGRIFEKAGVNVSVVYGVMPPDAYRAAKGEAGKNGAAEAQKAGPVPFFAAGISSVLHPKNPFAPTLHFNYRYFETDAPKDAPGAPRQWWFGGGTDLTPSYIIEEDVKHFHSVQKQACDKFDPSFHPRFKKWCDDYFYIKHRNERRGLGGIFFDDLNDYDQEMLLNFATECADSVLPAYVPIIERRKDTPFTEEHKAWQQLRRGRYVEFNLVYDRGTTFGLKTGGRIESILVSLPLTARWQYDHKPEEGTEEWKLLDACINPKDWI

SEQ ID NO: 2759 - DNA, 1717 bp, Panicum virgatum
  misc_feature: Ceres CLONE 1786277
  misc_feature: Encodes the peptide sequence at SEQ ID NO. 2760
attgccacagcaaaaactttccggctccgccgtgttagctagatagcaatggctgttgcctcttcgactccagagacccatgctgcgctcccccacatcgccatgttccccttcctggccaagggccacacgatcccgatgatccacctcgcgcactacctccaccgccacggcctcgccgccgtcaccttcttcaccacgcccggcaacgccgctgccttcgtccgggagggtctgtccggcgcggacgccgccgtcgtcgagctcaccttcccggccgacgtcccgggcatcccgccgggcgtcgagagcgccgaggggctcacgtcgctggcctccttcgccgtcttcgccgacgccacgtcgctgctccggccacagctcgaggcctcgctcgctgacatgcagccgccgcccagcctcctcgtcaccgacccgttcctgtactggacgaaggcgtccgcggagaggctcggcgtcccgaaggtgtccttcttcggcatctcggcgttcgcgcaggtcatgcgggaggtgcgcgtgcgccacgacccgtgcgcgacgctgaaccacgacgacgtcgtcgacgcggacggcaacccggccaccttcaccgtgccggagttcccgcacataaagctcaccttcgaagacttcatggcgcccttcggcgacccggcctccatagcgcccatgcgggagctcgacggtaagctggggaaggccatagaggagagccaagggctgatcatcaacaccttccatggcctcgaatctccctacgttgacttctggaaccagcatgtgggcccaagggcctggcccgtcgggcccctctgcctggcccaaccagcatcggcaccgtccgaggcccgggtccggccctcttggatggagtggcttgacaacaaggcggccgatggcagggcggtgctgtatgttgctctcgggacgctggcggcgatcccggagccacagttgaaggctgtcgcggatgggcttgagcgggctgaggtggacttcatatgggctgttaggcccatgaacattgaccttggtgtgggtttcgaggagcgcacaaagggcagaggcttggtggtgagggagtgggtggaccagctggagatcttgaagcatcaaagtgtgcgagggttcttgagccattgcgggtggaactcggtactcgagagtgtcgcagccggtgtgccgctagcggtttggcctatgcatgccgatcaacctttcaatgcaaagttcgtagttgatgagttgaagatcgcggtgagagttcagacaagtgacagaactatcaggggtttagtcacaagtgaggaggtttcgaaggtggtgagggtgctcatgctaggtgaggaaggggtggaggcagcgaagaacgtggcggagctgtcggcctgcgctaaggaagccatggaagagggaggaccatcatggaaagcactgaaagatatgatcagtgagttgtgcgtgaagaaggtgaatgggaacttagaggagagccaggacgagaaggtagtagatgcttagcgtgcggtttgaagtactttttgttgcttgcaatcatcatctttagaaataattaggtggtgtgtgcaacatgcatgcttctgaactagctgtgagctctgaagaaaacaacttcagcatgtgaattttattttgttgtttttaaaaaaaaaaataaaaaaaaaaaaaaaaaaaa

SEQ ID NO: 2760 - protein, 497 aa, Panicum virgatum
  misc_feature: Ceres CLONE 1786277
  misc_feature (2)..(120): Pfam Name: UDPGT Pfam Description: UDP-glucoronosyl and UDP-glucosyl transferase
MAVASSTPETHAALPHIAMFPFLAKGHTIPMIHLAHYLHRHGLAAVTFFTTPGNAAAFVREGLSGADAAVVELTFPADVPGIPPGVESAEGLTSLASFAVFADATSLLRPQLEASLADMQPPPSLLVTDPFLYWTKASAERLGVPKVSFFGISAFAQVMREVRVRHDPCATLNHDDVVDADGNPATFTVPEFPHIKLTFEDFMAPFGDPASIAPMRELDGKLGKAIEESQGLIINTFHGLESPYVDFWNQHVGPRAWPVGPLCLAQPASAPSEARVRPSWMEWLDNKAADGRAVLYVALGTLAAIPEPQLKAVADGLERAEVDFIWAVRPMNIDLGVGFEERTKGRGLVVREWVDQLEILKHQSVRGFLSHCGWNSVLESVAAGVPLAVWPMHADQPFNAKFVVDELKIAVRVQTSDRTIRGLVTSEEVSKVVRVLMLGEEGVEAAKNVAELSACAKEAMEEGGPSWKALKDMISELCVKKVNGNLEESQDEKVVDA

SEQ ID NO: 2761 - DNA, 1731 bp, Panicum virgatum
  misc_feature: Ceres CLONE 1786281
  misc_feature: Encodes the peptide sequence at SEQ ID NO. 2762
aaaaaaaagatctttgttcacatcgaagtctccgcctcctcactcccctgccccccaatcccaccccgttcccacctcccatggcggccccggcgccggcgccggcggccacacacctccagcccccgctcctcctgcttccatgcccgccgcggccccaccctcctctccggctccgcttcctcctgccgtccccgccgcccctccgcctgcgccgccgcttcccgctcctcgcggccgctgctgtctccgccggcggcgggggcggggaggaagccgccaggaaggccgaaaaggcccggcaactacagaagcgggtccttgtgggagttgccatcggggtgggcgcaggcggcatcgtggtcgccggcggctgggtcttcgccgccgcggtgtcagctgccgtccttgccggctcccgcgagtacttcgagctcgtccgcagcacttccggtggaggcgggaccccgccgccgcgctatgtgtcccgcgtgtgctccgccatctgcgctctcatgcctatcctgacgctgtactatggacgcatggatgttaccgtgacgttttctgcattcgttattgcaatatcgttgctattacaaagaggaaatcctcgttttgctcagctaactagttcagtttttggattattttactgtggctatcttccttctttctgggttaagcttcgctcgggactagctgcccctgccttgaatacgagaatagcatacaattggccaattcttctcggtggaccagctcactggacggttggacttgtagcaaccttgatggctattagtagcatcattgctgcagacacatcagcttttctttgtggaagggcatttggccgtacgcctttgactaacataagccctaagaagaccttggagggtgctttagctggtctcgctggctgtgtactgaccactgtgctgctgtcaactgtcttacgctggccaagatctctgttgagtgctacagcttatggaatcctgatctttctgggttcattatttggggatcttgttgaatctctgattaagcgtgatgctggtgtgaaggactctggatcgctcattcctggtcatggtggaatacttgaccgagttgacagctatgttttcacaggggcactttgttactcttttgtcagagtagctctacccttgtatggggtctgattacagcagcttcccgttcattgtcaacatgtctttcttctacatctacccttgtatgggatctgattacagcagctggccgttcgttgtcaacatgtttttcttctaccatatcactccatcagcaatgtggttgcgaagtgtcgcctagatgccccagatcattcttcatcactgtacaatgcagtactgcccaagcgaattaagtatcaagtgtcttgactgttaaatgattcaaccagagaaggcttcaactcagacagtttcttacattgggtttgtgctgttcttcccagctgtaatctgtttgttgcgaacttttcagtttggttgtacatagtttgtttttatagagtaaagggaaaaggctaatttttcgtcagagaaaagtgtataatttttcatctcaaaagttgttaaagtgtattaaggtgggttttgtcaatggctcttaaggaccgaagtaccaaaccatatcagtcgatttctgttgttttcatggttatctgctacgttatccgaaaaaaaaaaaaaaaaaaaa

SEQ ID NO: 2762 - protein, 369 aa, Panicum virgatum
  misc_feature: Ceres CLONE 1786281
  misc_feature (1)..(271): Pfam Name: CTP_transf_1 Pfam Description: Cytidylyltransferase family
MAAPAPAPAATHLQPPLLLLPCPPRPHPPLRLRFLLPSPPPLRLRRRFPLLAAAAVSAGGGGGEEAARKAEKARQLQKRVLVGVAIGVGAGGIVVAGGWVFAAAVSAAVLAGSREYFELVRSTSGGGGTPPPRYVSRVCSAICALMPILTLYYGRMDVTVTFSAFVIAISLLLQRGNPRFAQLTSSVFGLFYCGYLPSFWVKLRSGLAAPALNTRIAYNWPILLGGPAHWTVGLVATLMAISSIIAADTSAFLCGRAFGRTPLTNISPKKTLEGALAGLAGCVLTTVLLSTVLRWPRSLLSATAYGILIFLGSLFGDLVESLIKRDAGVKDSGSLIPGHGGILDRVDSYVFTGALCYSFVRVALPLYGV

SEQ ID NO: 2763 - DNA, 2554 bp, Panicum virgatum
  misc_feature: Ceres CLONE 1786284
  misc_feature: Encodes the peptide sequence at SEQ ID NO. 2764
ctctctctatccccagccgccttgcctccattgccccccattgccttctcccccctcacctcctaaaacctcccctgcccctagcgccgcgcgctcgcgccgacacagccgtgcctgtgcgcgcgcgcggacgtgggtgctgacgggaactgtcgcgcgggacaggggattgaggagggggaaggcggcggcggcgggcggcggcgtgggatttgtccggtccgagattcccgggcgaggcgagatgaagtacgtcctggtcaccggcggggtggttagcgggctcggcaagggcgtaacggccagcagcatcggcgtagtcctcaaggcgtgcggcctccgcattacgtccatcaagatcgatccttaccttaacaccgatgctgggactatgtccccatttgaacatggcgaagtgttcgtgttggatgatggtggtgaggttgacttggatcttgggaattacgagagatttctggacattaagctgactcgggacaacaatataaccactggaaagatctatcaatctgtaattgacaaggagaggaagggggaatacttgggaaagactgtccaggttgtgccacacatcacaaatgccatacaagaatggattgagcgtgttgccatgataccagtggatggcaaggagggaccagctgatgtctgcgtgatagaactggggggcactataggggatatcgaatctatgccatttatcgaagctttgggtcagttctcctatcgtgttggtcctgggaacatctgtttggtgcatgttagtcttgttccagttcttaatgtcgttggtgaacagaaaacaaagccgactcagcatagtgtacgtggcttaaggggactcgggctcaccccaaatattttagcttgccgcagtacaaaggaattggaggataatgtgaaggagaaactctcccagttctgccatgtgccagcagcaaatattgtcacattgtatgatgtttccaatatctggtgcattcctttgttgctacgggaccaaaaggcacatgaggctattcttaaagttctgaacctggacagggtggaaagcattgctcgggagccaaagttagatgagtgggttgcaagagctacgatatttgatgcccttcaagacactgtgaggattgctatggtggggaagtacactggcttatcagattcatacctctccgtgttgaaagccctcttgcatgcatctgttgattgccgtaggaagcttgttgttgattgggttgcttcaacggatcttgaggactccacggccattgaggcacctgatgcatataaagcagcatgggacttattgaagggggcagatggaattttagtaccaggcggctttggtgacagaggtgttcaagggaaaattttggctgctaagtatgcccgtgagaagaatgtcccatatcttggtatttgtcttggaatgcagattgctgtggtggagtttgctcgtcatgtcatgaatctcactgatgcaaatagcactgaattcgatcccgataccaagaccccgtgtgtaatttttatgcctgagggttccaaaacacatatgggtgcgacgatgcgcctaggatcaaggagaacatttttcaaggttgccgattgcaagtctgctaaattgtatgggaatgtcacgtatgttgatgagaggcatcggcacagatatgaggtgaaccctgacatggttccagagttcgaaaatgctggccttcaatttgttggcaaagatgatactggaaggaggatggagattattgaaatacccaatcaccgatattttgttggtgcacaattccatccggagttcaagtcaaggccttcaaagccatctcccctatttgtgggactagttgcggccgcatctgggcagttggatagggtcctgcaagactgctgcaacggtcatgtggtcccagctaaacacattctaagcaatggctcttacccttctatagtacaccaaaatgggcatcctaagaagctcgccaatggtctttcaaatggaacatactatgccaatggcaatggtgtgcatgcttagagcatcagtggagggccccaaggatttgcaactatttgcttcaattttgcatttctcgttgcatcagttttggcatggctgacttaactatatcatggtcgctcgagaaagaaaaagttctttactcgatgcagactgtctgcaggggatagtgctcgttcggtggtttttagtgaaggaaccgagctggatctctttgaaggcgtgagatagtggtatccgtgttcatctctaccctcttctgtcagcaaatataacagatttgggtcagaagagtttttatgctgtatatctgaaagaaaggctgaatgttttggttgcttaatagattttcgatgagttctaaagtggacactgggaatgcactgtagtgggtgagagaatttcgatcttaggcactctgtatttggatattggacagttttttgtgctcttgcgcaaataagttaatgctctgcatgacaaaaaaaaaaaaaaaaaaaa

SEQ ID NO: 2764 - protein, 608 aa, Panicum virgatum
  misc_feature: Ceres CLONE 1786284
  misc_feature (1)..(283): Pfam Name: CTP_synth_N Pfam Description: CTP synthase N-terminus
  misc_feature (1)..(238): Pfam Name: GATase Pfam Description: Glutamine amidotransferase class-I
  misc_feature (1)..(561): SWISSPROT Homolog: EC 6.3.4.2 CTP synthase 1
  misc_feature (1)..(561): SWISSPROT Homolog: EC 6.3.4.2 CTP synthase 2
MKYVLVTGGVVSGLGKGVTASSIGVVLKACGLRITSIKIDPYLNTDAGTMSPFEHGEVFVLDDGGEVDLDLGNYERFLDIKLTRDNNITTGKIYQSVIDKERKGEYLGKTVQVVPHITNAIQEWIERVAMIPVDGKEGPADVCVIELGGTIGDIESMPFIEALGQFSYRVGPGNICLVHVSLVPVLNVVGEQKTKPTQHSVRGLRGLGLTPNILACRSTKELEDNVKEKLSQFCHVPAANIVTLYDVSNIWCIPLLLRDQKAHEAILKVLNLDRVESIAREPKLDEWVARATIFDALQDTVRIAMVGKYTGLSDSYLSVLKALLHASVDCRRKLVVDWVASTDLEDSTAIEAPDAYKAAWDLLKGADGILVPGGFGDRGVQGKILAAKYAREKNVPYLGICLGMQIAVVEFARHVMNLTDANSTEFDPDTKTPCVIFMPEGSKTHMGATMRLGSRRTFFKVADCKSAKLYGNVTYVDERHRHRYEVNPDMVPEFENAGLQFVGKDDTGRRMEIIEIPNHRYFVGAQFHPEFKSRPSKPSPLFVGLVAAASGQLDRVLQDCCNGHVVPAKHILSNGSYPSIVHQNGHPKKLANGLSNGTYYANGNGVHA

SEQ ID NO: 2765 - DNA, 2252 bp, Panicum virgatum
  misc_feature: Ceres CLONE 1786299
  misc_feature: Encodes the peptide sequence at SEQ ID NO. 2766
attcgcagccatggtgtgcctcatccctgactcctgaggccattggtgagaaagagtcgcctcgggaggacgcacctggacacgcctctgagagctccgacctccgacctccgacctccgagtccgagtccgagagatccccagctcaactctgacccgccatatcggacgaatccgttccaaccccctcaatccccccatttccaagaaggctcccctcttcgatctccctactaaagccccccgccatgtcctcctcctgcgtctcccaccaccaccaggccgtccgcccccgccacggcggccgcctcccgcgcccagcggccgcgtcctcgttcgcgccgccggcgctgcccctccgccgccgggcgacgcgcgccgccgcgacgagcgccgaggctgccccgggcgtcgctccggcggaggaggcggggcggctgcggggggcggcggtgctggccgagatggcggaggaggccgccgtctggtgcgccgtgcacgggctcgtcgtcggggaccgcgccgacccgagatcaggaactgtacctggtgtcggcctggttcatgccccattctcgctgcttccagcgcgtttcccggcatccttttggaagcaagcgtgcgagctggctcctatcttcaatgagctcgtcgatcgtgtgagcttggatggagaattcttgcaagctgcattgtctagaacgaagcaggtagatgaattcaccgctaggctgctaggaattcatgagaagatgatggcaataaataagaaagaggatatccgcttaggattgcaccgatctgactatatgctggattctgaaaccaattcactgcttcaaatagagctcaacactatttcatcatcctttcctggccttggttcccttgtcagtgaacttcacaggaccttactaaatcactatggaaaagttttaggcctagattataaaaggataccacggaattgggccgctactcaatttgctgaagcattgggcaaagcatgggctgagtataacaatgatagtgctgttgttttgatggttgttcaacctgaagaaagaaatatgtatgaccaatactggcttgtcaatcatttgaaggaatcatatggtgtgacgactataaggaaaacattggctcaagttgaagctgaagggcaggtgcttacggatggaacacttgcgatagatggtcgtaccgttgctgttgtatatttcagagctgggtatgcaccaactgattacccttcagaagcggagtggagagcgagacttttgatggaacagtcatctgctataaagtgtccttcaatatcataccatttagtaggaatgaaaaagatccagcaggaattagcaaaacctaatgtccttgaaaggttccttgacaacaaggacattgccaaactacgtaaaagtttcgcaggattgtggagcttggataatgaagagattgtgaaatcagcaatagagaaacctgacctttttgtcttgaagcctcagcgagaaggcggagggaacaacatatatggtcatgatttgcgagacatgctgatcaagctccaaaaggaacaaggggagtcacttgcagcatacatactgatgcagaggatttttccgaaagcttctcttactcccctagttaggggcggtgattgcttcgaggaccttacaatctctgagctagggatatatggagcctacctgcggaacaaagataaggtgatcttaaataatcagagcggttacttaatgcgcaccaaagtttcttcatcaaatgaaggtggtgttgctgcaggatatgctgttttagacagtattctcctcactgatgagtgagacaggaaaggctgagttacaagtgacaactgacctgaaccagtgacagtacccacagtcaaaagatcgcagtgtcattgggcacaaattgatcttggctgcaattggagaaaaactgtgaatatagcgtacataataccagacagcagatgctacaccttggatggagaagatggtattggtatttgcttgaagaaaccctagacgagaaaacggaacgggatcatgaagaagcttatgttgtcatagtttcatgaatttgtatagcaccatatagagccgcatccgagcctgatgtttcatttgagtggttccattctgtattttggcgacctttattcctgaccatgaggataattgtattgagtaagaattgaataaagctttttttaagagaaaaaaaaaaaa

SEQ ID NO: 2766 - protein, 531 aa, Panicum virgatum
  misc_feature: Ceres CLONE 1786299
  misc_feature (10)..(470): Pfam Name: GSH_synth_ATP Pfam Description: Eukaryotic glutathione synthase, ATP binding domain
  misc_feature (22)..(528): SWISSPROT Homolog: EC 6.3.2.3 Glutathione synthetase, chloroplast precursor
  misc_feature (72)..(528): SWISSPROT Homolog: EC 6.3.2.3 Glutathione synthetase, chloroplast precursor
MSSSCVSHHHQAVRPRHGGRLPRPAAASSFAPPALPLRRRATRAAATSAEAAPGVAPAEEAGRLRGAAVLAEMAEEAAVWCAVHGLVVGDRADPRSGTVPGVGLVHAPFSLLPARFPASFWKQACELAPIFNELVDRVSLDGEFLQAALSRTKQVDEFTARLLGIHEKMMAINKKEDIRLGLHRSDYMLDSETNSLLQIELNTISSSFPGLGSLVSELHRTLLNHYGKVLGLDYKRIPRNWAATQFAEALGKAWAEYNNDSAVVLMVVQPEERNMYDQYWLVNHLKESYGVTTIRKTLAQVEAEGQVLTDGTLAIDGRTVAVVYFRAGYAPTDYPSEAEWRARLLMEQSSAIKCPSISYHLVGMKKIQQELAKPNVLERFLDNKDIAKLRKSFAGLWSLDNEEIVKSAIEKPDLFVLKPQREGGGNNIYGHDLRDMLIKLQKEQGESLAAYILMQRIFPKASLTPLVRGGDCFEDLTISELGIYGAYLRNKDKVILNNQSGYLMRTKVSSSNEGGVAAGYAVLDSILLTDE

(The sequence listing continues in the following parts.)

What is claimed is:

1. An isolated nucleic acid molecule comprising:
(a) a nucleotide sequence encoding an amino acid sequence that is at least 85% identical to SEQ ID NO:2126;
(b) a nucleotide sequence that is SEQ ID NO:2125; or
(c) a nucleotide sequence encoding SEQ ID NO:2126, wherein a plant transformed with said nucleic acid molecule exhibits altered cell wall content or cell wall composition as compared to a control plant.

2. A vector, comprising:
(a) a first nucleic acid molecule having a plant regulatory region; and
(b) a second nucleic acid molecule having the nucleotide sequence of claim 1, wherein said first and second nucleic acid molecules are operably linked.

3. A method of modulating plant growth, development or phenotype characteristics, said method comprising introducing into a plant cell the nucleic acid molecule according to claim 1 and overexpressing said encoded polypeptide, wherein a plant produced from said plant cell has altered cell wall content or cell wall composition as compared to a control plant that does not comprise said nucleic acid molecule.

4. The method of claim 3, wherein said isolated nucleic acid is operably linked to a regulatory region.

5. The method of claim 4, wherein said regulatory region is a promoter selected from the group consisting of YP0092, PT0676, PT0708, PT0613, PT0678, PT0688, PT0837, the napin promoter, the Arcelin-5 promoter, the phaseolin gene promoter, the soybean trypsin inhibitor promoter, the ACP promoter, the stearoyl-ACP desaturase gene, the soybean α' subunit of β-conglycinin promoter, the oleosin promoter, the 15 kD zein promoter, the 16 kD zein promoter, the 19 kD zein promoter, the 22 kD zein promoter, the 27 kD zein promoter, the Osgt-1 promoter, the beta-amylase gene promoter, the barley hordein gene promoter, p326, YP0144, YP0190, p13879, YP0050, p32449, 21876, YP0158, YP0214, YP0380, PT0848, and PT0633, the cauliflower mosaic virus (CaMV) 35S promoter, the mannopine synthase (MAS) promoter, the 1' or 2' promoters derived from T-DNA of *Agrobacterium tumefaciens,* the figwort mosaic virus 34S promoter, actin promoters such as the rice actin promoter, ubiquitin promoters such as the maize ubiquitin-1 promoter, ribulose-1,5-bisphosphate carboxylase (RbcS) promoters such as the RbcS promoter from eastern larch (*Larix laricina*), the pine cab6 promoter, the Cab-1 gene promoter from wheat, the CAB-1 promoter from spinach, the cab1R promoter from rice, the pyruvate orthophosphate dikinase (PPDK) promoter from corn, the tobacco Lhcb1*2 promoter, the *Arabidopsis thaliana* SUC2 sucrose-H+ symporter promoter, and thylakoid membrane protein promoters from spinach (psaD, psaF, psaE, PC, FNR, atpC, atpD, cab, rbcS, PT0535, PT0668, PT0886, PR0924, and PT0585.

6. A plant cell comprising the nucleic acid molecule according to claim 1 which overexpresses said encoded polypeptide, wherein a plant produced from said plant cell has altered cell wall content or cell wall composition as compared to a control plant that does not comprise said nucleic acid molecule.

7. A plant cell which comprises a first nucleic acid molecule, wherein said first nucleic acid molecule is the nucleic acid molecule according to claim 1 operably linked to a second nucleic acid molecule that is heterologous with respect to said first nucleic acid molecule.

8. A transgenic plant comprising the plant cell of claim 6.

9. Progeny of the plant of claim 8, wherein said progeny comprises said nucleic acid molecule and has altered cell wall content or cell wall composition as compared to a control plant that does not comprise said nucleic acid molecule.

10. Seed from the transgenic plant according to claim 8, wherein said seed comprises said nucleic acid molecule.

11. Vegetative tissue from the transgenic plant according to claim 8.

12. A food product comprising vegetative tissue from the transgenic plant according to claim 8.

13. A feed product comprising vegetative tissue from the transgenic plant according to claim 8.

14. A method for modulating cell wall content or cell wall composition in a plant, comprising:
 (a) transforming a plant with the nucleic acid molecule according to claim 1; and
 (b) expressing said nucleic acid molecule in said transformed plant to overexpress the encoded polypeptide, whereby said transformed plant has altered cell wall content or cell wall composition as compared to a plant that has not been transformed with said nucleic acid molecule.

15. A transgenic plant having modified growth, development or phenotype characteristics as compared to a wild-type plant of the same species, wherein the transgenic plant comprises the plant cell of claim 7, wherein said plant exhibits altered cell wall content or cell wall composition as compared to a wild-type plant of the same species.

16. A method for producing a transgenic plant having altered cell wall growth or cell wall composition, the method steps comprising: (a) inserting the nucleic acid molecule according to claim 1 into an expression vector; (b) introducing the vector into a plant or a cell of a plant to overexpress the encoded polypeptide of the nucleic acid molecule; and (c) selecting a transgenic plant for altered cell wall growth or cell wall composition as compared to a wild-type plant of the same species.

17. The isolated nucleic acid molecule of claim 1 that is SEQ ID NO:2125.

18. The isolated nucleic acid molecule of claim 1 encoding SEQ ID NO:2126.

* * * * *